United States Patent 7,468,248 (METHODS AND SYSTEMS FOR INFERRING BOVINE TRAITS) - sequence listing, part 21

SEQ ID NO: 60661 - DNA, 2619 bp, Bovine  19866880628084
ccccgtctcagcctggagtggccagtgaggactgagtcccgcctccagctcccctcgcctccaacccgcctgtgagccccaggttcgatgctcaggtgctcccggggctgccgccaagtgggctgggcagttagggtccggctgggttgcctggtgttctggcccggcttcttgccctcagcggagaaaccagaggctgaggcgatgctggaaacctgctccattcattttaggctaccgagggaccccaactggcttccctcagatgcagatttcaaacctctgcttcagaacctgaccccttagttttacttcgattttttttttcctcctcagtctctcttaggagtatttagataaacaaaaactgattaaaagtacttgaaagtggaaggaagtttagaaggagtttggcacaagcaaggccgttgctgctggatgttgttatattttagtggagtatcagcggtggggtgtcaacagatggagggtagagaaatatatagagccttttaaacagctttctttttctcgctgaaatggcctaattgactcaaggaaatggcaacccactccagtattcttgcctggagaatcccatggatggaggagtctggtgggctacagtccacgggctctcaaagagtcggacacgactgagcgacttaactttcactaactttcaagatggactgtatgtcagctgaccagcattgaggttaggcattgacagagcaacagcgaactgtttgaatagctacagtttttgcaactgcttgtctgttcatgcttatctccaaatgtgtgaagttaatcttaccaagtacagaggcagttgacatttccaaatgttcatgatctcttgtgaaagctaggaatcttttcgagaacacagatcgcattattgaccaggggatttttgcagaaattaacacctgtggtcagcagtttgttacataagtgagtattaatatgtctctggtcaataaacgttctggtaacaaaagatgtattaagatacctggtcagtaaattgatgtcttagtctgggagtaagttagtatcagggtgacaggcataattataaatcttcctcactgctcagcttcgcaggttttgaagtgggcttagtatttatgatttcccttgtttcatgatttgatttatggcatttttcaagcactggcctcagagtaccttaacagctactaggtagttaatcttcctcagagtaccttttggatagagaacatcatgactgttgaaactgatagttgagaaggtggtgtgtttttcctgtgatcctactatgagccatacactgctgaataggaaattagcggttgttattgttcagtcggtcagtcatgtccgactctgggacccagtggactgcagcaccccaggcctccctgtccttcactctcccgtggagtttgcccaaattcatgtccattcatgccatccaaccatctcgtcttctgtcgtccccttctcctcctgccctcactttcccagcatcagggtcttttccaataagtcgactctacatcaggtggccaaagtattggagcttcagcttcagcatcagtccttccaatgaatattcagggttgatttcttttaggatggactagtttgatctccttgcagtccaaggaactctcaagagtcttctccagcaccacaatcaatggtagaattcttcagtcttatttgttttctttcgtcatttgagctatccttccttgttaatcaaaaaacattaaaaaagtaaaacagcaagcaaaatctgttactggttactatgctctgttagccattatgttgccaaagtatattcaaatttgatataaggtgactctggggaaggtaagacatgcttacttgtggcacatggttgataagtattgatttctaggatccaaactgcagcccagggagaggcctaggccggaggctactccttagctgtcttgccttgtttccgaaataaatttatcagaagcataaaaatggatggaatggccattcctcagaagtccatgtcttatatgctcctttaacaaacattttgagcaactcttatggattggtttctggagatgtgacaactcttgctgggttctggggacttgacattggacaagtcttggtcccagtgtttgcagagcttatagtgttatttaggcaccattttttttcctggactggtcttttggcaagtctaggcaggaaaattttccttgctctaaagtttttctttgtaaggctccccactgaaagggaagtgatttcctttagataagtcgtgtgccctttggtaaatgagagttctgatcctaagtgtcctgaggatgaatgtttgcctaaccctgccccaaggcgtgctttttaagggaaaaatccctgctctttcctaccacctgcatatttcccacctctgtgactggtagatgatggtgtttgcgtgttacacttgctttcctctctctctcatttatttatttattctgcaagtatctgttgactacgtgcataagccacatactgtttgtgtacaaaggataaagtggtacacaggatgaagcagaccggcatccaataagtgtgttacca

SEQ ID NO: 60662 - DNA, 1591 bp, Bovine  19866880654694
ccctcttgatggagatacactttaggacagtctagctgtggaaatcccatggacggaggagcctggtgggctgcagtccatggggtcgctagagtcggacacgactgagcgacttcactttcacttctcactttcacgcattggagaaggaaatggcaacccactccagtgttcttgcctgcagaatcccagggatgggggagcctggtgggctgccatctatggggtcgcacagagctggacacgactgaagcgacttagcagcagcagcagcagctgtcagcagtagaactctttaacagttatgatattcctgaaactgtgatcccagtgaatagagaatatcctcagggtatgaagctgctctcaccttgcaggtgatgtcagcttcccagcaaacctcagaagtgcatttttgtctttctgaagaatgttgtttgttgttcagtccccgttcatgtcctactctttgtgaccccatggtccgcagcatgccaggcttccctgtggttcactgtctcccagagtttgctcagactcatgtccattgagtcggtgacactatctaaccatttcatcctctgccaccctcttctcctgccttcaatctttcccatcctcagggtcttttccagtgagtcgtctctttgcatcaggtggccaaactgttggagctagcttatctcaaagcagtactttgtgcactcctcgtgagggcttggagtgctatctgctgttaaagtggaaacgcaagcggtttcctcagctatagtcacagcggagccggagaccagcctgatattgacaaacagttttaaaccccgtgacaattcagacctcattcctggttaggaaaagactccacactgacttgtaaaacatttaaaacccatgttcccaaatgatgcagtaagcctatttgttttttaagggctccaggtggacactgcaagcaacgaccatgagtgggaaaattgtaagtctggggcacggagatatggacaactccgggttactattcctttgccttctttctgcttccctctcataacatttcaagccctcaagtgatcctctatgcgaacttatcagtgagatatcccccctcttttttagggaatcattgaaatccagccggatcagatgcaggtaggagaaaatatttcagttgctttccgagctcagagccaccactgagacagtaacagcccctctccgcttcacctgcagacggtgaacgccatcctgatcgtcatcatggtccccatcgtggatgccgtggtatatcctctgatcgcaaagtgtggtttaaatttcacgtaggtgaccctcggcttagggtcagggttggggctgtgttccctcgcctcccagagccctggtggtagcaatgtctggctcttctcccacgatcccatgtgtctgagggagttttccaagaaatatttttgaatcagatgtctatgtgctgacgtttctgaaaatttgcccttaaaataatagtgctattaatggccatctgcagaagcatctaattaagactccctggtgagcgcagaggatagaaatttcaactatgatccagaggagt

SEQ ID NO: 60663 - DNA, 1252 bp, Bovine  19866880656134
gagtctgtggctcccttcttgccaggggtggattttagttcggtttacagctggtggcccaatggcagagggtggaatgctgcaccatacttgagcaggagcgaggcagaagacctccattgacttcatgggtgcagatgcttgggaaagggcctcagggaggagggtcaagggagtagtgaaaacttctgtttttcctaagtggttttaaacccagcataatggaaaggggcagtttattgaaatgacacactcctcgcccgagtacagaaagtctgtctgtctggaccctgtcctcaggaatggacacttttgtctggcagtggtcagtgatctctgttgatttctgttatcagtagggtgacatatcaccccagaactttgtgcctgaaacaaatagtgatttagtgtttctcccgattcctcaggttgacctggggcttttcctcagggctcgctcactgcctgtggtcggcgggagagctgctggcctggcccggatggggcagcgaggacactgggcgtcctttcctgggatccagttaaatatttaggccaaggcagcagcagttaagtgcagatgcatggcactgtgtttgttggacacggccttctcagaaacaagctagggtgtatgtctttttctctgttaaatgatgttgctggttaacctatgtttcactatatacctacctaagaaagttgggggcggggcgtgtagggagaaaagtagaatttttgcttagacatgagtgatttattaatgaatccatatatcatgttcagataagtggtttgatacttgtttatacaaaagctggagccttcctcactttctgtaatagagctgggtcactgttcctgtttgcacatttgctgtgtttgatagtgtaacttgcacacgcaggtgagattgagaaatgtttgtgtcctgagtgtgaagacccatgattaccaccagcctgatccttaagtgaggaaaacgaatctgaccttgaaagaccgtggtctagcggttgtcagtacccctgtgagttactgaagtttcctttttccttctctcctgcagaacctaaaagcagatccagaagagctttttaccaaactggagaaaatcgggaagggctccttcggcgaggtgttcaaaggcattgacaatcggactcagaaagtagtcgccataaaaatcattgacctggaggaggcagaagatgagatcgaggacattcagcaggaaatcacagtgctgagt

SEQ ID NO: 60664 - DNA, 763 bp, Bovine  19866880705896
tgagttcagcaatgaattgtgctctcacatgtattcaggacccccaaaggacatttgcatacccctccaaatatagaacccttgtgcttgacttcccctcagccagctcacagtctcagcagagctcagtggaaaacaagaattcaacaatcagtcccttcgcttctccttctgagttgaaaagataaacaccccccaaatgccactttataaagaacagctagacaagtagcacattagcaatttaaatttacagattaaagaaaaggactcacacggtgaactttaaaagagaaatatgagtagcttggataagtaacagaaggcttaacaaatttctatacgtgttaaagcaggtgaagacacaaaagaggaagacagataattaacatcagcatacaggaagcatgtctagtcacggtcggatgacacgacagcaagaaaatatatctccctagggcttttctcaagccctaggaaaagatctagctatactgaggaatggtgtacatgaagttttattctgggggtgtggggctcagagggcaggctctcgcaacagcatgactctaagtcagtctggggttgcatcctgcctgtgtgtcctaaggatgccgtgactcaaactgcagaaatgcatcattccctcacagttttggaggctagaagtccagcgtccaggtgtcagcaggggctggtttcttctggagcgtctctgcttgtctggtggctgggcccgtgttctccctgtgtccacacctgg

SEQ ID NO: 60665 - DNA, 1665 bp, Bovine  19866880706508
gcagaccgcgaggcttctgtgcccgtgcccagggccgtaacaggagaatttcagtgcaccaaggagcgggccaggggcttcccggggggttgaaagatgaacaggggcttgggggtgagcatgttccaggccctggatgagaaaggggccagccagggagctggagaaggtccagacagtagggttgagaatgtggaggcatcattgcatattcagggggatcacctggactccagactgagaaaggatccggaaagtcgaggcctgagctcggaagaccgtggggaaaccatgtcaagtctaggccagagaggatggagtcctgggtcaaggagaggttagaaagaaaaggagactgcgttaacagtacttggtgacagtacttagtactggctgtggtgcaggatggggggacaggtcacagtttagttgagtaactaggtcaaggcattgctaatatagacccccaaaagacagattcccccatgccatggttaatatgtacatgttttaataataaatgcagagggtcatccacttttgaatactgagcccatataaatccaagccaaaaccaaagaagtaaataataaggtctccatgtctattagagaaggtgatccgtaattatccaagtgacatgggctcatatgcttctcattcctctacacttgcctcgtcaccattttgctatacaaacaaaagacgcaaggagagcagagtcaccttctggaataattcttggaagtgggagggaaatactcagacactgtttcccacactggggcgacccctgctcgcaggcttcccattgccccatcccccatgcacaccgtgaccaaagtcagaggccgagccaggggcatcacgtgaaggtgaattgattagctcacatttgtgtgtccctcagattgttatttcagtcagccagctgatagcagatgttgttggcatcgggggaaccaggttccagcagtccttgtctatcatcaacaactgcgccaacagtgacaggctcatcaaggtaggtggcccggtgccgatttactttttaccccccgagacccggccttatcatctgggaaacacacgcagacagacaaatcacagctgaaagcctgtcttccctccacccttgttccagcacaccaccttctcctcggacgtgaaggacttgaccaaaaggatccgcacagtcctgatggccacggcgcagatgaaggagcacgaggctgaccctgagatgctggtggacctccagtacagcctggccaagtcctacgccagcacccccgagctccggaagacgtggctggacagcatggctcggatccacgtgaagaacggggacctgtcggaggtagccccacgcgcctgtctgtccaggctttttgagaaaacgagttatgccccactctctgaaagaagctgattatgagagaaacttcccagtaattccaagaagccagctaaaagcatgtgatacttcagtgttgggctcagagctccttcatagtcatttagcagttttccagtttggaatatcgtaaggggctttctctgtcccaggagcgttgtttgtgagctcttagaagacacctgtgctcacacatgtgcccgttagtgcagatgcgttcggcttctgcatcagaagtcctctcctga

SEQ ID NO: 60666 - DNA, 1051 bp, Bovine  19866880793344
tgtctttgctgctttgtaaaatttgacattgtttcacaaaacacagtaatcatttcttacctttccgtgtgagatattctgccaccagggctgtgacatggacatagcacattgctgcctatagtaaaagacacatgcttcagaatcacctgttacaatgcacaaagctcaccatcagaaacctaatgactgtgtgtacttatgttagatctcagggcatcagctagtgttcctaatggctgacatcttacctatagaaaaaagtgggacaattcatataaattgaaattatgaaactatgaattcagatgaatggcaacaagcttggtaaggcccatttctatctagaattatttaacttttattaaagataaaagatttttaaaaagcattttatcttactatatctaagattttggcattatttctcttaaagggaaaagacgatcccttgaagaaaaggcatgtgcgttcctatattcagagagaactgctcaaacttcaggggctaatatatttttctgtcaacctgaaaaacaatgaagttatacattttttccaaaaatagaattctaaatgaaagtaatgtaatgtccaatggataacattataaacacctttaaaatgtaagaaaaaacaaaaataaattcttttaaccgaattgccatggtttataaaacatcaaacatagctgttagaaatgaacctactgtaaggttctaatgcctaagccctggttctcatcagaatggtagaaaaattactgctactaacaagtgcataattcatttttattatggctaatggatattttagattaaacttctgatcaaacagaatggactctgaataatcaaaaagtaagaattgctacatacacttttcagatataggatacaatttcactaattcaagcaattagcatgtttaaaagtaaaagcatatttctttgggttgttctcctgatcatacctaaatgccacgggcgtgaaccctgagcagagtttttgtgggaacatgaagagaacccgccttacagcccatcattgtc

SEQ ID NO: 60667 - DNA, 1458 bp, Bovine  19866880793701
tgacccctatagaatatagcccaccagggtcctctgtcaatgggatttcccaggcaagaatactggagttgccatttccttctccaggggatcttcccaacctagggatcaattccgcatctcctgcattggcaggctggttctttaccactgagccgccagggaagcctgtgtaagatattagagacacagtaattccaaatgcaacataaaccatacctgttggtttttctcataaatacctgaaatgactctcagctgcacaattaaaagtattcttgttaccaatcatagtttatttaacaaggtaacagaaggaaccacacagcctttctctgccagaattttctgtttcttcccttgggtgtctattttaaaggtctgcctttctcatttttttcttgctttgaatctggtctgtaattataagctgcccgaaatcctttattgaagttggaggagcataaataataaatgccctaaaagtcaatggagaacattatctagcaaaatgtgttccccggttttcaaatgaatccctgaagccatgctgaaatctgtaaagtaccctagagcatgtagccctgagacagggaagaagccataggcaccacgtcattcctcaggggtttcttaggaggctgtgcagagtatccgtaacttatgactataaccatttttttcctgcagaccctctttgaatacaaattcgaatttctccgtgtggtgtgcaatcatgaacattatattcctttgaatttaccaatgccatttggaaaaggcaggattcaaagatatcaaggtaatctatctttaaatatattaatcctagtcttttcaaaaagagagccattcattttaaataagagaattagttcacgcatgacattaagaatatctgacatttttcattggtgaattcattttttttctcgtttccattttttttttttaaattgataaaatgcttcataggaacttaacttttttttttagcaaacttaccagactattgatcatgccagtgtgactcttttttcattgaacaattccattgcttaaacaatagaaatcctttttatttactgtagtttatttttatttgtttcacttttccttttttcttatgaattagcttttctttcaccaactgtggagtcaaatgacactcctgtaggtaggtgtgggggtgtgacgctgctttcttgcatcttcctcctttaaaagaaaaagaatgcaagtgattgctgaaacgcttatgtgtgctatgcgtttagacatttcccatatacttggatcaattttaaaattcacgataagccagtgaatttgttctcactgtagctaacacatccgtaacatccccgggaggcgtcttgttttttgctcctgggatcactaggtcctctaggaggtttctttaagaagtaaagcaaacaaacaaaaaacgctgcttca

SEQ ID NO: 60668 - DNA, 799 bp, Bovine  19866880805737
tcgtctcttctttgatagcagcgttctcttgtccaacagtttgagccctagtgatggtctggattgttttgttttgtccaggtcgagcctttctttgtcactctgtccctgtttgacgtaaaatgcaaccggaagatttctgctgacttccacgtggacttgaaccacttctcagtgcggcagatgctggccaccacgtccccgtctctgaggaacggcgaccggcagagcttgcctgcccctctgggcatcctccacgaggcctccatgcagtacccgaagcaggtgggggactggcccagtggtcacgccactaaggcctaccttgtacaagctgtgtaaatacataaatgaagcgtaaaatgcgcagtttgagtaaatgagactcttaattagattgattgcgtatatcacgaggctgtcaaagcaagctgaaagagaaatggcttttgacttctcatttctttttttctaaacttgctgctagttgcctcccccgccaaagagcctttttgatcgaacgatgaactgtttgttgttgagttaaccagtttggcattgggtgcttctgagtagttctgctgtttgctgattgagaatctttaatgtttgtgagatttgtttaatgtgactgtaaattctgcttgctaaagaagatggtttgttccctaggggatattttcagtcacatgtcctcatcctgatatattccttgtggctagaattgaaaaagtacttcaggggagcatcacccatggtgctgagccatacatgaagagttccgactcctccaaggtat

SEQ ID NO: 60669 - DNA, 775 bp, Bovine  19866880826017
aatactagagtggacagccttctccaggggatcttcccgacccagggattgaccccccctctcccacactgaaggcagattctttaccatctgagccaccaaggtcctttagatcttcagtctaacgctctcccaactaagctattttggatacccagtacattaattaaaactgtagcaacagctaccacaatttcccacattaatcacgtttgtcaaagggagaggagggaaaaaagacccagcaactctgatacctattttcaaaatatcacattagatttttaaggaaaagcttaagactataaatttaattctttaaattcaatttaatcaaatttaatgtacttgcattaaattgttttcaaagatattctttctataagctacttgatccaaaatgtcacctggttttatttaagatcaacagtaagaactttctgagaatagcagggacctctgtaactcggataccaggaccaaggaataaaaaaagcagggtcccaggtttcagtaactgctagaggaatctgcttcctgccatggcctggagtcaggatcggttactgtaactaggaaacctcaagccgttacctggtcccctgagatagacagtgcctgtgccctgggcccatcagataacgagaactcagggttatcaccaagggaagcaaagctcccagtgcccacctgtgcccctcacctccctactcccaagaaaatatcagatggttctgagaataagggtcattctgcactaaaaaacacacaacag

SEQ ID NO: 60670 - DNA, 1154 bp, Bovine  19866880857000
tattgcttgctggcccagtgtacacatctctagcccaaatgtatcgaggggaagatgagaggctgagggtctgggctcttctgaggtgcttggagtttcacactcgtgtggacagggactgagaaataccagaagtgacccaggcttttgcacaggcttgagtcggcggagtgtgcctggctgtcattcagaagctgcagtgattcagtgcaagtgggaatgcggtctgattcgtgtggttcgtgttcctgctgtccgctcctctttgggctgcaaggtttctcgggaggcatatgccctacaggtggttttgccatcctcaaagcgagcagctgagttcagggcacgctcactggctggggctgtgctgagcccaggccctggaggaagtcctcagcccgatcacaaggaaagaggccgacctgggaaaccactgtctgtaactcgggaaggctggtgactaagagaacttgccctttcagcatccacgaaaaagctgtctcctggctcctttcttccagatgaacccaaatgaacatttatcttcttgtttttgggggatggagccaaacaaagttaacgaggtgatacacagaacacgtttttctcttttggcagcattagtgatgatggttgaatgacctctgtgaaattctctgtaacatttctgtgtgaatgcattttcttgggggaaagggtgtctgctttcactggacggttagctccagagtgttaaggactccagtggatactaggtacctgcccacactgtgaatgggaccccgcccgctgatgctgaatgacagtctttgaatcaatcttaaaggagaaaactttgaaataggactccgtctgtatgtgttagacttggttgctggacgttgtgaggcagaagcctgtcctctggggtggagtcacgtggaatgccgagaccctgatctcacgttttcctcttcggtggttgatgcatttccagagacccaccgctaaggagttactgaagcacaagttcataatccgcaacgcaaagaaaacatcctacttgaccgagctcatcgacaggtacaagaggtgggaaggccgagcagagccacgaagactccagctcggaagactccgacacgtgagtccgctcggcctgagtccctcggggt

SEQ ID NO: 60671 - DNA, 1399 bp, Bovine  19866880922110
gaagggggagccgtacctgtcaggatggtgcgccgtttgcactgctcctctacgcccccttgccgcttcccgctctgggtgaagggcatctcaaacatgaagcggcgaatgttgtgggatctttcgaactccgttttcctttcttgcagttctttctcatcaaagaacgggatcacgtgagtcacctggatgtaggcatacttggaatccagatccttggggttgaccttaaaatgaataaagggaatggaatacagcttctggtgtgtgaaggactcctccaatgcacgctgaagcggtgttttcccactttgtatgagtaaaagttttggagactcagaacgtttgaaaaaaacagtacaacaaatgccacatactcaccacttagaacaattgctaatactttgctatttgtttatatatgtctccttacacacacgtacaggtagatttttttttagctgaaacatttcaaagtaagtggttcacatcatgacacttgagccagcatctcctaaacatgaggacagtctcctccataaccacaatacatcatcattttgttaatgttacaaaattaacactaatctcctaatagtacccagtataccaagtttagatgaaaaattctcaaatgtcccagaatggtatttttggctatttgtgtttgaaccagaatctaatcaaacattgcattttacatttagtcatgggtccttagtcttgtttaatccagactattcttcttcatgacattgacttttaaagacatcgtgctagttttcatgtggaatgactccctatctggattcctctgattctttcctaagctgtatttttacatatttggcttagagagaaaaatgtttattttagtaatagtgtttaaagccaagccctcaagtcataattaacctgtagatagattagacataaacacatggatatgaattaatttaatacaagtaagagatgaatgcatgagcatcctgagagaagttgttaggtcaaagacacagactgatccagacagaggttttggcttcagagaaaaaggcaagttggacttgagtgatttggtctagaaaggaagtaggtcttaataaggttgtgttgaggtttctggctaaaaatggacccacaatgcatgtttctcctcttcctttgtacagctctgtcacaaaggataggattaactgacaaggacaaaagagagggcggaagaacagcagtgggtgagtttaatgaatatctggaaggcaggtgcatgggggttaaagttctaatccacattcccatggaaggggcaacaaggaggaagccagagcaccccgcagaagcctgctgtgatggactggacatctgtgttcccccaaaattctcatgtagaaatcttaac

SEQ ID NO: 60672 - DNA, 1100 bp, Bovine  19866880938191
cgccaatgaagacactggtaattcatgcaacaggaacagaaatggctcgaggcgcggttttgacttgctttagacaacagtctttaaaccatgcagcctcacgccttggcatattccattccttccgcttggactccccaccacaacctcctggtcctttccctggcagaatcctccctcctcctcctcctcctctaaggctcaagtctgtgcctgacccttgaggcctcaaccctgaatgcccgtcagtgtaggggagatgtgcccaatattggaaaagttagttgcagtttttctttgcagccatcgtggtaaacactataataaatgagcgcagaaggacaaaccaggacatgctggagtgtttgttgccctgaagtgttacactgtcagctggaccctctgccagaaagctctctccttcacccgggatttttctgtggcctctttgcttgctctgctctttccagctaacagggaggggagaaaaatctctgccttaggggcaaaattccaggcactcttaccccctcgctgctgcccctttatgccaacaagtaattctgactccaccaccgagctctgaagggggcactgacattttcaagatggtttgcgggaaactaaagcaaaaatcaatacataaaataaatcacgcagtttttattatcactcagaaatagcggtgtcttccctagaaggaaggtttctaacatggttcagctaccagaggctattaccctggagaattaagcttcaagatgtaaggggaaatgacccttgtctgctgtgactgctgcaatttttgtgtctgtttccctcctcagctgctttggcagagatcacggaaatggtggcccagcttcacggtacgatgatcaagatggagaatttccagaagctgcatgaactcaagaaagatttgattggcattgacaatcttgtgatcccaggaagggtaagttctctctgtatgctctggaggtggagccagaaagacttgtgtgtgctaagtcactttaggcatgtccaactctttgcaaccccatggactacagcccaccaggctcctctgtccctggggttctccaggccagaat

SEQ ID NO: 60673 - DNA, 1709 bp, Bovine  19866880968810
gcccaggagtgagcatggaatatttgatggtggaacagcctgggcagtgtttaagcagaactgtcattagctatggatagcaggccacgtgaccacacccaccaggccaactaaaacagaatctctggtgggacaaagggaatggcatttgttaaagattcccaggcacttctaaggcatagccagcaggattgggaatcacctgtccaaaggcctgaaataaaatgtgaattgtcaagaatgtagccagatttccccacccactgatttaatctgtggcttctgcccatcctaactctgactcgaaaattccaaaggatatgattaatgataacaataaaaaccataattagcattttaagtgcttactctctgccaggcacttgagatacattatcttgcttaaccttcccaccaaccagcaagttctgtttttattcccactttacaagtgagtaaaccaaggctctgaaaacatagggagctcgcctgaggtctcatagctgacgaagggtattgctgggacttgaactcaggtcctcctttctgcctccaaagctgtggttcttcccattacacgatttccttacacaaatgatgtcagcgtaggacatcctactgtaatgccgacagcccatctgtaaggagctcacgtgtgtcccacctccctgtacctgtcagtaatctacttcctgcatcctctggggaaacggaagacacggtggagcgttcgcacacctggagagagccacacctgcctaccttcatgagagtctccgttccgcttttcctgcatcacagcttcaaagttgagctggagaatcttgttcagaattgtgatccactcttccatttccacttcactgtctgctgccaacaggtaactacttttgtcctgcatcttgagctcaaaagcaaaacgcctgactttgttgttctgaaagggggaaggaggcaaagaaacatattttagaagaattgggtcatccttgaaaattcttctctttatcgtctgctggtgagtactatctcaccggcatttcagatcgagtcatttaaaaaagcaagccccttccccttcagccctcatcactctccaccttccctgatttatcttcttcgtggctttattttcccatttgacacattacagattttacatatttatcttatttgctgcctggcccatccagtggaatgggagctcctcagggcagaatttctgttcttccctccttcatccctgtttctagaacactgtctggcaggtaataggccctttaaaaatatctgaatgaatgaaagttcactgaaaatttttcaatttctctagctcctattttttttttaatgaagtaatatgtggtatcacatttttaaagcaaaccattatcagtggacttccctggtggctcagatggtaaagaatctgcctgcaatgcaggagacccaggttcgatcctgggtcaggaagaccccctggagaagggaaaggcaacccaccccagtattcttgcctggagaatcctatggacagaggagcctggcgggctgcagtctgtggggttgcaaagagttggacacgattaagcgacaaacactactaaacactactattatctaccagtaggtctgactcccttacctggaactttctcaccacttatgagtctcagaaggtatttaggcaccaggtctcccttcccccg

SEQ ID NO: 60674 - DNA, 1472 bp, Bovine  19866880990414
tgcctgtctccggcgagctctcttctctgtctcctcctttagatttgacttgggttccactttgattcttcttcgggaggaaagataggttgatgtcctgtgggtgaaggtggtttccaagaggcttctttgtatatacaacaactacatattgttcaaaattgtctcacctcgctgcactgttgccatatgtaaacctggaaggcacactggaattgccttttataggattgaaaacgatgccctttgcagaattaaaacttgttcacattatgtgtttgtgaaaattaggatggtaacgtgggggtgtggtttaaggaacctagctgctgaacttaaatgtgtcctcaccccttttaggaagtttgccttgaattgaacaaagtaagaaatagcctgtgcttagaaaccagttgctagaaaagtttctattcttaacattagctaaactcagagcagtctggataaattcaagtgcctcggtagactttgtaagggcagaatgtgaaaaatggttttgttgttagcatcaatgagtaggttgtgcttctctctcggaatttcttcagtacaataaaggcacataacttttaaagcaaactgcagaaagccatcaacatgcacatgggaggggacaattaagcctttcaaatgatctgttaaagggattgttatactcatatgtagcaattttacatagtgattttttttttaaacatcaaggttcatttgctgttataaagtattgggttagttaacttatttttcagttaatgtttttaagaatctaaacctaaacttctctgtaatggatttgacttgaattaaatcgcctttgatctgtgagacagccatatattgtactgccttcaaaattatgttgctaatcaggaactgagagagtaaagggtaaggggctttctggatgtaggttttcatctgagagatttaggcccccctaaccccaacattgtttaaagatgtttttcgttatcttggattcctttctgctagcacaatagttcatttatccattgagaagcatgagctgcttacatgcggtaatagattaaaccggttaaagctctcagctgatgtcgcttgtgatttcttggaggaagttgtgtggtttgggttcccttgtgaatattcttaaaaatcttttgtcagtgattctccagatgtgtagaaatatttgtccagaagattaaatacactgtagaaagatgctctgtgattttttttttttgaatcaccctagtgacttttaaaaaatttgtttctctttcttgtgctcaaaaaaaaaagaaattcagccactcacgtcccagttatttgtctaggtcgaaactcaccccaggcagttccagggggagtttgttctccgctgtaatggataaggctgggccggctgcagctgcacctggtaggggtgctcgtgggggacccagaagctcctgggagcgtgggga

SEQ ID NO: 60675 - DNA, 2089 bp, Bovine  19866881054250
agggtgggatttttgaaagaataatattgaaacaggtatattatcatatgagagacagatcaccagtccaggtcgatgcatgagacaggttgctcagggctgatgccctgggatgaccctgagggatgggatggggagggaggtgagagggagttcatgattgggaacacatgtacaccattgctgattcatgtcaatgtatggcaaaaaccactacaatattataaagtaattagcctcaattaaaataaattaattaatttcaaacaaagatacaagtaggtgctcctgaaattctaatgtgttatcctacaaaaggtgaaagtgaaacttattcagccatgtctgactctttgtgaccccatggattatacagtccatgaaatactccaggccagaatactggactgtgcagccattctcttttgcaggggatcatcccaacccagggatcaaacccaggtcttctgcactgcaggcagattctttacagtctgagccaccagagaagcccagatacttcttatacttgacctcaagtcttcacagcagctcagttttagggtcactgtttcagggatgaaaaggaccaggcttggtttacctgcaaatccatacacaggagtgtgtgctaagtcacttcagtcgtgtccaattctttgtgaccccgtggaccataacctgccaggctcctctctccatgtgattctccagacaagactactggagtgtgttgccatgcctttctccagggtatcttcccaacccagggatcgaacccacgtcttttaagtctcctgctttggcaggcaggttttttaccattagtgccacctggaaagcacacctaagaaacagtgcctgaccaaggcctgggcgtttttgccctcaccagactgcctggtgggtgacgcatggcttcacagagtgcctgagagcctgcggtgggtgagaaaacccagccgtcactgatagggtatctgtttcatagacctcacttcagtacttttccagcccgttcattagccgatacctgtaacgactcttctctgctggaactgaggtgtcacaaaccttacctctgtatcagttgctgggcacaataaaaataagtcaataaatgaagcccggtcaatactgagatactgtggtcctttaaaccatatcaccgtttgctgtcaacttttaaaattagtccctcccttagtaataaaagcataaatttattgataagcttatttgtcctacaggagacttctgtgctctcctagaaggtttctggcaagcttgtttaaattataagttgtcctagtacctggaaaatgtaacctttgaggctggcagttatatgaaacctgttagcgatgtctggcatgtctcactgaccaggctcttctcctgtattttaagaaccagctcctggctgaccatggacataatcccctcatgaagaaagtttttgacgtctacctgtgttttcttcaaaaacatcagtctgaaacggctttaaaacacgtcttcaccgccttaaggtcactgatctataaggtacgtggtctcatcaggggaggtcgtcctcgattgtcacctgttctcctctgtccccccggggctgaagggggcgctaactaacctctctgggcccatttgcttcctcgtgtccatctagttcccctcgacgttctacgaggggagagcggacatgtgtgcggccctgtgctacgagaccctcaagtgctgcaactccaagctgagctccatcaggaccgaggcctcccagctgctgtacttcctgatgcggaacaacttcgactacagcggcaagaagtcctttgtccggacccacctgcaggtgcgtgcgctttagctttcaggacacgtgtgccctgtgggattctgcttccgcaggaaggccgtgcatgtcgacgtttaccaagttacctcagtgtgagttctgaacggtctggcagcaagacagaaagctcaaatgtcacatttactggtttggttaatttcctcctccacgttgtacgatttgggcccaggatgtgtctctgttggtaaattgacatttaagtattgagtcagt

SEQ ID NO: 60676 - DNA, 1987 bp, Bovine  19866881121889
ttcgggcagtctgttgctgtgttttgcagtttgtgatttttcattgtgaactcattttccgtgggttttgtttgctgctggagccccctcgtgccctagctcatgaaagcatttctgcaggaggactttgtgcttccttttgctggatccccaggggtttttgttgtcttggaatagcttttatgttattttcttacgttggagttcccaagccatttaagcagggtaaatctagaccacaaattcaggtatgatattggcctttcattgtgattagttgttgggattgtttattgttttttttcccaaggcctttcgtgtaagctaaatgtcataaccgctttctcagactgaatggaatatttttagtcttctctgtaaaaagtacaggtcttttagcatctgtgctcagtcccaggtcttcttgcctgagcagcttggggccatgtcgtctgtcttaggcctgaaaattcagccccaacaccaggggcgtgtgtctagtacctaccttggggatcactggagcagcacatgccgttatttctgtttttattcagatatttgggattattatacggaaagttttaagcacataaaaaagtgtagaaagcactataaggaactcagtttcaacatcacccagctccagcaatggtcaactcatggtcatcttattttatctgtatcttcactcacacttatgtgattccagtggacctctctttggtgtgttaatccaggagcagaaatatgtgtgtgtgtgtgtgtgtgtgtgtgtgttcttctgtgtgctctattgtatgccattggtctctttatatgtccgtgtgccccatactctaatatctttaagttattttgctttttagtggaacaagcaactttttgttcagctattgcaaaattaccctaactacacatgtacttttattcttccatataaattttagagtaagttaatcagttatcttaaattcagctggaatttgatacagtattgcttttatagtttgatttgggagagaactgatacctttatccagttttccaatccaagagcataaaggatctctccatttatttgtaacatccgtgttgtttaattgatttaaaaatttttctcttctagatcttttgtagtcctaggtttttgtttttgttatggtgaatgatgttgtgtttatgtattatgtttcccaaatgtagctattttattgctggagtagagaactgtcagtgatttttataagttgatcttggatttggcaactatattgaactctcttatttattgattgtttatttttctaggtggcatggtaagtatatgttttactttttaaggaaccgccaaactgttttgttaagtatctgtaacattttgtgctctgattagcaatgtatgaaaattctagttaatacccatcctggggtcatttagtgtattaatttttaaagcaagtttttagtcattccagtggatgaaatctgttacaattactgtcattttagtttgcatttccctgtgttgaatattttttcatgtgcttgtgtattattaatccatcttctttcaaatcttgcccccttcctttttaaattgggttgttttcttattactgagttatgagaggcctttgggtttcagatgcaggttctttatcagatgtgtattttgcaatattttctcccagtcttgcttgttttttcattttctgaatagtgaactttgaggagcatagttataaattttgatgatatctagactgtcagtttttttttaaacaactcatatttattgtatcctttctaagaaatctttctctcatccatgagtatagaagatgtttttcttccttttgtagaaattttatagtttaaagttttcccatttaggaaatctcttttagtttatcaattgcctagaatttttttttttaatcataaaatagactgaattttgtcatagtttttttctatctattga

SEQ ID NO: 60677 - DNA, 1414 bp, Bovine  19866881125517
ctgttaaagatgtgcccagcactgaagtttttctttaagttttaccatagaagttatttttaaaatgtaaatccccttcattgtctaggtgactagagtgccctaaatagagcctattctgtgatttgaataaaacttcagctaccccgtttatcatctctctttttccatccctcctctgactttttctccaagtggaaatttttttttttatttttttggaccttgaaagccttgtggttatagcagagatgaaaattttgtggggaaagatctgcaaaataaatttcttagaatgaactgggatagatggctcagctctcaggcccagacctcgcctcacagaatgaatgagccaaagttattgactcaccaaagatttccctgaagtgcgctgtgaatttaataaagctggatagctctaactggccatcattgaagaagtcatcttaccattcccttctgaattctcaatgccaggaatacttttgggaattcatgtgttggagacagtcctatgctttggagagataactctgttgaggatagagtgccttcaggagaaattcagctttttttttttttaaaataagctacaggtgtacaatatagtaattcacagtttttaaaatttaaatgaataactgcatttgtagttattataaaatatttgctgtattccccttgtaaaatatatccttgtaacgtattttacaggtaatagtttgtacctcggttccttccccttatattgtcccttccccgttccctctcctcaactggtaaccactagcatattctctgtctctgtgagtcttctgcttttttgtgacactctctagttcgttgcatattttagatgccacatacaagtgataccatgcagtgtctgtctctctctgtctggcttgtttcactaagcgtaacgccctccgagttcatccaggtcgctgcagatggcgtcgcttcctcctcctttcggccgagcagtgttccattgtgcgtgggtgctgtgtcttctttgtccattcttctgctgctggacacttgggtcgtgtccatatctcggttgttgtaaataatgctgcaggaacgttggggtgcttgtatcttcaaatagtgtttttgtgtttggatatatacacaggagtgagattttgagctgcagtttttttgaagtataattgcaatagctttaaaatggcagacaaatattatgtttatattttcctttccttactcatattgagacaatatttctatactgacacaatgacagtacaatttttaaaatgttcagctgctaaaatccaagatacatgtacttgaagtgctacggaatctgaattttgtctctcctcacatgtgagaacagctttccaatagctgtaactccgtatttgaagcacatgaa

SEQ ID NO: 60678 - DNA, 796 bp, Bovine  19866881148611
tgaggcggcaaagacagcagcaggtaaacgataacaatccaatcgaaagttgagaggtactcaggggcctgtgtaaacgtctcctctgagatcgtacatgtggttgggaccgtgtgtcattcctctgccttgcatcatggatatcttgacatgtttccaaggtctctgatcgcgactattcttagtgttttctttggaaggtaaaaaaaacaaagtaacttgccactgaaagactggtcaaactggacactctcgctccacttccaatagataagcatgatttcttagagaaacaccaacctagttaacaagacggaatatttatctgtttttatcatcttgtaaaagccacagtgtcttcctgttaaaatgcttattattgtgtgctctggagtaaagagcagatatcagacttcttgattttccttagttgaaatggagagactatgaaggtaatagaagttcaaggaaacaaccaatgagccggtcagataagtgctgggttttctcagccttgtcattaatcgtcaggaaatatcgagcacttgcccacaaaaacggctccgtccaaacaacatgattccacactggtgtccccagggttcctctcagtcaagctgagcctgcttgggcgcttctgtgatccagcacactgggcttgtcatttcccgtctccatcccctttaccctctggggtatgagaagagagttctgttctctctcacatcacctgcccgcattgcgtgtgagaagtcgatcttcattgcatgtggtctggaaagtgatgtcaggtgtg

SEQ ID NO: 60679 - DNA, 816 bp, Bovine  19866881159055
aattccatatcttgaggagattctccttcccacacttactgaggatgtgccctcagcattttttttttaatgcctttggaacatggtgcatgaaaatttctaaaaccaattcatcgcctggataaaaactactgtaagattacattcattttaaaaggcatgcattcttaggctcagagttcttttttccacctactcagtgtattgctttttgctgtctgtaccaaaggggagagagttgaactaaagttctccgaaaagttatgcaccgggccaggatattaaatacagacaaacacagacaacaggaacatggttctaactaagcctgttgattttgatttattgcatttccacctgtttgcctttagattaggactcttgttctggaattgagcctaaactctgagaattcagggtctaattttactttccccagagtctctttctcctgagctccatgttctacattaaatatgaagtccagttatattaggaggctgatagttataatttggtcacagcgcatgtctcttttctgagtacagaaaaagactcattgctttttcatagcgttttgacctgcttctcgtggcagtcacacagttcctgtcctggggccgtgctgccggtggcccgtggtttacatgttcccgccttcacttgttttcggattctgctgacccttctttccttgatgtacttaacacactgaatcggttttagggatggtggataagcctgtgggtggggatggactaacttggaggtgtctcaatccacggcagctaattggcaggctgaaacccagaaggg

SEQ ID NO: 60680 - DNA, 1667 bp, Bovine  19866881227703
agcactcgttattttttttttaaacctcttctggcaatattcaacgttttcattgtgtcttaacagaggtgtgtggtggacactcttcggctggagttaaatgtttttcttccttacagaagtagtattaaaaataaacggcctggagaaaacacgtgttttggaatgcacatagcactgaagtcgaggctggagggtaaacccttggcctctaggctaagctggaaaatcttgaaaatatttttttttcctgtggcacattcagattgaaaacaagaactatttttgtgactagtttttgatgacctgaggaaactgaccgttgtaatttttgtaccagtgaaccaggaaagccagtgcttttgtactcatttacttgcatttaagaaataggaaagctgaagaaactacgggagcttaaaactagtcaagcagtttagaaccaaaggcctgtattaataaacacagctatgctaaacgtttaaaggagtacagtatactgttatgtacatagagtttgttaatacagtcttggcattgtgtacatacacatatgacatttctacgtttttaatacatcagcttctgcataaagttcaattgtgacagatttgtgctgttcttagtatatgcaacgcacttaactctgctgttttattcttgtatataaaagcagtgcagtatggaggtgtatacagtctttgctatgttaggtttataaaccattttaaaaatttcatccttttgccaaagtggtggagtgtgtcattgataaatcataaatcctgtggtgaatagtggtgtaatgtaaagccttcaccatgttctattttcttttcagacattaattgagtaattttatatttgggaaaaataaaggtttttaattttatttaactagaatctctgccctgctgtagttaaacattctgtaccacatctgtattaaaaacaacattgctgattttcctgtagcgagtattgggtatttattgtcggacagccttaagagagggcaggatattgaaatatttgggggtgaaataacgtggtatatgaaatttgcttaaaaatacttgaaggggaaaaaagagggtggggatttgaaaccagcttgacaaatgttggttggtagttgtagaagctgaggttgggcgcctggggaccgttgcaccatgcctctgcctttgtcgaagtttccacagtatagatttcaagaggcggactggggggctggatctcccagaggacttggatcagcgctctgtcaccctgcagtctggctctgaattctactggttgttcccaaggatacgtagacacgttaatccctctgtctgttccccttccactccttcatcacctccctggttgactcctctgggacaggtggtcgtttatcccagcagggtatcctggccaggtgagctcaccttcttgggcccctacagcatcaccaaccctggacctgagtcaagtgatggctcagaccacaggtgctggtcttgcctgtgacacgcccagggccctagccatgatccactcagccccagagagttccagcaacagaaggaaaaggagtctttccacaagaaataaaatagccgcttttcctacttggggggttttggaagctgtcttttttcataactggggaggaaagaaaa

SEQ ID NO: 60681 - DNA, 882 bp, Bovine  19866881228350
tttaatggtgaaagacattttactgcaacggagaattccttaaagcacgctgacaaaccttcttcttccaaaggatcgggtgaataaagagttccaggaatagtactggtatttcttttatgtgagttgtttctgagctactgacagattgagtgatagagaagggggttagacaatgacgcttgttgttaggcttgttgttagctgttccccaagcccctgtggttagacagtagcagcagtgcagcatgctacactatccttcagagagcaacattttggaaggatgttggggcattcagaccattgtagggtgcacctgagacccccaagtgatgcggcgggtctacacatgagagtgtggcacctacctgctcgtgcatgatttcagaaagctcttttgtcatttccctgtagttggccttcatttcttcctgatactctatctgatcctctttgatgagcctttcgttcaccactaaggcttgaccgcaagcttccacaaattgcctgaaacggtgcgggagagggaaatcaaggcatgaacagaacaaagggtgagcccaattggcaggatctctttcctgaacgagcacagaaacgatcgctacttcaagagaaagacatttccagtgtgcgttacctgaaaacttctttaagcaacttcactttattgtcagggtatctttttgtgtttgtgtcatctaagaaagctcgggcgtatgctagtggacccggcgttgacctggataaagaacaaaaatttaaaattaggttatgaagaaaatgcccatcatcgttagtttcagctggcatttgctaaaaatgctgcttggagtgagttagttatgaccgctgccctccatgaacttaggaccccca

SEQ ID NO: 60682 - DNA, 1618 bp, Bovine  19866881316545
ctatggaacactgaagtctggaatggtcacaggtaatcaatccaaacttcgcaggtccatctgcagcggtatggaaattgaccatttcagatgctagttcagagagagaggctctgatgctcagctctcctctgcaaaggggtcatagtttgattggctggggatgggaaggtggacacatgacattgcctccaccttcggcacgacagcgtgcaggtctgtccctccctatatgtgtgcatcagatgaaacggcctggccagcactgggagtggaaaatgaagactgaggctcatcacactctatgaccccaagtgctggtttgtggcagactttcaaggacactgaaagcactgtctagctcttctgtgaaccatggcccaggtgctcctatgagacaggtgtgcgcctgcttacagcaactgaagacaagactcaccagtgaggaaaaaggtcaaggtcaggattataaacattggagtattttgacaatcttcagcctaaaaacagaaaaactctaaggggatttgaccatgattctggaaaccaccaatggtacagaaatggtgaatatgaacttgttccctaaatccagagcacaggggctggagactggggcatgcaactttacagatgcaggacaagcactaaaacagctgatgcaaccatatacaactcatcacttaagatatgaggcaaagtgactgcaggcttcaaaagctgaagagaagttcctagaccaaggtgtgatttagctagtggttaccatggggaaagggaattgggaggggcaatatagagccaggggaagaagaggcaagaactattaggtgtaaaataagctgcaaggatatatggtacaacaaggggaatatggccaatgttttataataattacagatggaatataacctttaaaattatgaatcacaattacaacctgtaatgtatataatattgtaaagcaactctactttaatttttaagacctacaaaaatttaaaacgtgtggtttcagggaagggcggcatgatttagggaaagggtggtatcttgggtgacacggaagcagaagtcacgggggaggggagcccctctaaaagtgaccagtgtcggactcccccgagtggtgagcaggtgttcagaatccctttttatagtaaatcatgttatggttaagcattctctttttggatgcctgtgtttcttttcaagctggaatgctttaaaataaactacctctaaaaaccctccgaatgctgttttgagatcaggatataattaacttacagaaaaggttgtgcatggcagcacttgagtggcctgtgtaaagccctaaaggataaactaaatgtttatctgtggagctagagaattgggctataggctgggaatggcaggacactggtgaggggctgactctgactttggcaggattcttggttctgcaaggctgtgtgatcctgggcaaggatctagatcttcatgggtctagacctccaccatccaccttcgtgaaataagggggcagctgcacaagaaggtggctttttggtctctattgacccccaaattctgtggtttaatttggcatcttgagaaaagaacgcacacaatc

SEQ ID NO: 60683 - DNA, 1470 bp, Bovine  19866881332438
ctctgtcctgaattaaactaccgccccccgcccctgactctgccttttttttgaagcttctttgattctttgttgtttaattttaaaaactaatatatgcttgtaacaaacaaataagcagatcctattgaaacacttaacattaaaaagccttccttccaccttctttttaatcccactccccagaacatcacttgctatatatacagttttctatatgttcaattgtttttggaaacttccatgttaataacaatcatcaaatcatattccttgaagttttttttccccccatcaaatttaagagcttccagtttacaacaaaggtgagaattttcacaaatattcacttgttcaaacttgtgagagatacttgtggagaaaatgatgattctttagttctttcctgaaaaattaggaatgccacagaaatgaaattgagcattagtgggatgttccactgataaatggtttcaaatcatgccccaaaatacagtgcccttgaaaacttcattacaagaataggttacccaactaaaggatgaataaatggaaacctcagaatgaagtctttcctctgtgattttgacaacagttttgttaacatgaggagttaaattagatgattataaattagactccatgttgacatatttttcctgcactgtgctctgaggaagctaaagggtatctcaagtttctttgagcgtgaagtattggtatctgttcttcttagtatcagttagagtaacaaagttatttctagttttgcagcctagaatgaaaagttttagttgaaaactggagatccagttgcttcagaaacataccaaccccagaaataagatacacttataatttcatttttttatctcaccaacagagaacctggatgtttaagcagttgtagaaacagatgattaaaactttgagaaaaactccttttttcctttcgcctgtaacaacttttctggggataccagacataaatattctaggaacagcaaagaactcattgacattttgctagccaagattgatgaagagtgttaagttctgtttaggggaagctttttcaaagattaaggagcttgaatttcagctttgatccccatcacagtaattgcaatgggccacgtggaagtttagatgctgccgttttctttctaggtgtcctcctgtatcctagtctgggaaggccatgtgctttcttgctaaattgtctcaatgcttttatgactatgtagttggttgatccagtgacatgtcttagtgatatcatgggatttcttctgtctctccctgcatttttaggcagaatgagggcagaattattattgtattatcagaggcagaggaaataaattagacaggggcaagtattttacttcatgtgaaatcaaggtagcaagctggttaggaaatgggtcaactagtgagcaaaacgcatagtggggttgagttgtaatc

SEQ ID NO: 60684 - DNA, 811 bp, Bovine  19866881343837
aatgagatgagggacgtccaagccctttgtaagtagtggggcctggtttcctttttaggtcagtggtttgtagatctttatcaggctcatgtaagccaaagaggaaaagaaacagaggaaaaataaatatcaggatgttgtttaaaggaaaatgaattaaccacatttttttgatacaatgctgagaacactctaggattctcctgtaactaaacatttccaaaagtgaacatttctagagcttccaattattaataattttcccattttccctttaaatttttttgttgaagagatctgacactgacaatacaccttgaaatgtcaattgaatgagcctcagagagtcacgctttaccctgactgctcatacagcttctagaagacaataatttcagatctgtatggcacagaaatctcataacaacctgctcttttttttttttttttccattgtggcataatattcataacataaaatttacatctcaaccatttttaagagtacaattcagtagcattaagaacattctccatcttgcacagggctcttttcatcttgtggaatcgaaacactgtacccattaaacaattatctccctttatctcctggcaaccaccatttcactttctgtcttgataaattgactactccaggtatctcgtataagtggaatcatacaatatctgttcctttttgactcatttcaattagcataacgcctcaaagttcatccatgttgtagcatgtgtcggaatttccttcctttttaaaggggaataatattccattgggcatatgcatgcaatt

SEQ ID NO: 60685 - DNA, 1361 bp, Bovine  19866881385094
aactcaagacaagtggctcaattgagtgaactccaggtccaagtagcagtcctggctcccctgtttaccagctgtgtgacttaaggcaagttttagcccttctgtgcttccatttccttacctgcagaatgggtttagtaagtgtacacacttcacagggctaccgagggattaatgagatgatccgtgtaaagttcacagaattgtggctggcacatagcaagtgcacaacgcatgcttgttgctgttactccccgtccagagtgggaaaagagtcataatggaatggaaacattattagtacccccttttccccacccaccaaaaaaaggccaacagggagataaggccctgaaggaagccttctgaaaataatcaaaagttgactgtgactatactgtccgccagcctgtgctctgcagttgccgacagtgaccttgtgttatgacccatgcaggctatggccactcggacgctgacgttctccaccagtcgttacttgaagccaatattgctactgaggtgtgcctgacggcgctggacaccctctctctcttcacactggcgtttaaggtttgtattgaacagctgttcatggtcagagcctttctgaaactcattttttgcttatttagctgaatcagcaagaacttcttaatgttgcagttttactgcagcaactgcttttgcccctgtaaggaagccattaatccttaaattcctttagcaaaagcattccacagttaatgaccccaattccctgaaatatagtacagcttaactctaagctgagcgccgaagaattgatgctaatagaactgtggtgttggagaagactcttgagagtcccttggactgcaaggagatccaaccagtccattctaaaggagatcagtcctgggcgttctttggaaggaatgatgctaaagctgaaattccagtactttggccacctcatgcgaagagttgactcattagaagagactctgatgctgggagggattgggggcaggaggagaaggggacaacagagaatgagatggctggatggcatcaccgactcgatagacatgagtttgagtgaactctgggagttggtgatggacagggaggcctggcgtgttgtgattcatggggtcgcaaagagtcggacacgactgagcgactgaactgaactgaaccggtcagagtgtgctgcctgcttgcaactggtggacacaggctttggcgaggttaacccttggccagatgaaagcatttaccaggaacgtggctttgctctgccctcaaggatgataaatacaggagcctaatcaggcatttctgccttcactgtctttaaacatatccaaatgtggtag

SEQ ID NO: 60686 - DNA, 1707 bp, Bovine  19866881589878
ggattgagagttggagaggctcccaaggatggagaccggggaccaggtatcactgatgggtgggagaggaaggtgtggacacggaaggtgggaagggtgggtgtcatgtgacaggaagagggagcccagggtgtcttcagggaacccatcaaaacacgtgaaccatctgactcagctggtgggtcttccaggacagaacactagctccccaaaactgtaatcaacgttgtcacatgactgacatgcagcaactgattccttgaagcaccccaacttagtttaaatataaactaatacacaactacaattgagaggtgttcaaggctaaatagaacatgtgtactattcagaacagtaaaggccactgtgttcactgaatattgtatgtaaatgatgaacttgttgacatttatctaatgtcatctcttgctttcctacatagtccaatttgatggtggctagagctaaccttccatctttaaacctctatatcatttggctcacattatttgaaaaaacccttaaagaaagaaatgtagctgaaaggatgaaattaaggaaataaatgaatggctgcccctctttggacatccccctcattcaggtacacaggaatagaagagaaagcagaggtgttaagtgttatccaaaatacatcttcaaataactagatttaaggaaaataaaataggtccttagaagaaaagttggagagccacagatctgaatgaccgggggcagtttaatttacataccttaacatatgacctcaagtggccctccaatccttcctcatggcactgggcaaccacatgaataatgaccctacacaccacaggaatgaataaagcaatgaatagtaatgtggaaatggaaacatttcattattatcacagtagcagtacaacaatgatgatgctactggcaccacaggaaacgaggaaatgaggcattggatggggtccccacatatggaatcaaaacaagtttcttaaatatcatgttcaacatgtactggcaccccagatacatatggctgtgctccagatgtggacagactgagagggaagaaggaccacctttccacctcgctcaccgtgtcacgttgaccgcaacctcctcctgggttgctcgggtgaggacgcggaagagctggtttaggatggtgggcaagaaggcgatcatcacgtgaccctccatcgcgtgcaggctctacgggcgtgggatggcaaggttcatgttatcattttaaaagtaaactgaccccaagaaatctccactcagcttcaaacacagatggaagaaacccattgaaacaaagggagacagtggcaacctactggacagagatgtctatgtccgaagcctcagaacctgtgactatgttatatggcaaaggggaattagggctgctagtcagattagctggccttgagatgggagactctgctagattatccaggagggcccaaagcaatcacgagggtccttagaagtcaaagagggagcaggagagtggaggggaagaatgctccgagatgcaacattgctggctttgagatgtgggaaggggccacaagccaaggaatgaaggatcctttaggagctggaaaaggccgggaagtagatcaactcccagagcttacagaaaggaactcagccctgttaataacgtacctgggtgggcccagtgagactcatgtcaga

SEQ ID NO: 60687 - DNA, 1084 bp, Bovine  19866881684100
cagagagctgctcctgaggagcatgtggaccaccacgccctgggcacacttcacagcaagcgtcagaggaggggttgaagacgggtgtgaaagaagttctcagcactcctcatgcgcttcttattaggaaaatatggtaaaagtggggctagcagcaggtcttgattcccagttattcctctctctaagcctcagtttcactctccacaaaataagtgtaatcaacttcaaggtcctaaaataggggctcaagattcatttcgggtctatttttaaatttttagtttaggcatttctttgaactcacagcattgatcaactaacttttttacaatgtccaaaagcaatattagcaaaaaaaaacaaacaaacctgtaactcttaagccattaattttggtgattagcttacaaacagatatggagatagaaacaaatgatttaaaaattttgaagccttagatacaattcattaaatgcaaaatgccatccgccacacctgcaaaaggaatataaaggaagtgatggccactgagctcagaaccttagagtctgaaatatgctccagagacaaaatgatcaggaagtctttactgcaaaccatctatgcattgactctgtactgcagaccatctatgcactgactccgtattgcagactacgtatgcattgactccatattgcagaccatctatatactctgctgaagacaggcatcacaactatcttataaaacaaaagtaattatttctactttctaaatgatgttaccaattatatatagttttgctttaataattaaaaaaaaaaaagtcagtgatagaaaattcaactaaaacataaatgaaaaggtctctcagcttaagaatacaaatgaaactcccacttgggaatcccacacaagaagttacttcactgtcattgataatgcactctggtatggctccctttacgtgctgaataaacattctttgatataatttggtttacatagcggcagctttcagctgaggctgggtcacaagctgagagcaccatgggggtcaatttagctgttgatgcaaaattaattttcaacggacatt

SEQ ID NO: 60688 - DNA, 954 bp, Bovine  19866881720462
agatgagaaatgaccaaagcaggaatgactgctaagggctccatataattggagggcaaacagggatgcagatacattaaaagaaaaaaaaaatcaactagccaaaatagactcaaagcatgctaatgttgccactaatatccaagagatatattcttcaccagaaaaaccacttaatggggaagaagggacaatgttagatgtaaaaataacctcagagtgtatactctaccttacacacgtcgacagctctgctctgagatagataaaaagcaggctcagcttcttaaagttcctcccagccctcccaaggcctagagtactttaaaaagagggtatgtctgataaatagtgtttgaaacaattaccaagtaaaacttaagcagtaagaaaatgtggctttgccccagagccagagaataataaaatacacgaaggtatcagtgataaaatggggtattcattcataacagccaatatctctatgctagatgttaccctaagagcatatttaaatttggtacaagcttaggaggcaagtcttattttatccttgtttaagggaaaacaatgaggcatgagggacatgtttggagcaaacactttgctccaaagtttgctccaaactcacaacactaaatagaagtctggcttctagccgaggttgtctggtttcagtaccgacactctttaattattagaccagaaaaaataaaataggtaaagaatataaacaggcaagtcagacagcaaaaaaaccaaatggcaaataaacatgaaaatatgaaaaatatcactactaagcagcagaatagaaattaaagcagagaaacaccattttttattcctctggatgcagagaaacaggaatatggagttgttacaacctttgggggaagtaacctggtaatatttaaagcgctaaaaacatgataaactgtgacccagaaatcc

SEQ ID NO: 60689 - DNA, 1093 bp, Bovine  19866881952059
acgccctcccgtcctctccctcagagcctcgctgaactcagtcctttcgatcgcatgtgctgctctgggcttggccgcttgacatccacgcaaactgaagttccagatccacaggcaattggaagtcaggtaatgttctcagcaccaagaaaacaagactcctctggaatccagcagaatgggagagcgtcggcccacgaatgagctcgacattggccaagtgtgcacaaagcctcgaaaaccaggggatgagctgaacaaaaaggctttctgattctattgctctcccctctgacatgatggcttcccgtgaactttctagtcatttcttgcctttgtgtgtctggtgattaaatgttaacacaagctgaaacgctgaacgccactgcttgaaatagcaaactgaggaaacggcagctcttggagcactctattttaagacatgagaaatgcgtcgctctgcttataaagaatttaggacttccttgatttatctgtgagctacaaaacctcctccatcggctgagatgaaaaggcttcatggaactgagtccatttttcaaaatggtgcacttctccacgttgccccacaggacccagcactgctgctggggtggagggcggggagggggtgcttgcaataagaaggaacggggcttccaaaggcagatgttaatcctgcagccctgagcctttctgcaccaccgtcttgcacacaactctcactccatactcccaccgggaacttcttggaagctgtcagatttgaaggaacaatcctcaccttcctataattagggtgagcgcaggacatgagcaagctgtccccctcccccagtgcaagggctgttagcagatggatatgtgttcgttttctccatgcgttttcatgcagcctgttcacgtgcatggtgccaggtctttgggatcctgagatgaaaaggacacagcctaccccaccgcccgagaaagctcacgagccagtgggcaggtggacgtgtgaacgaggcagaacacggtgaccgacagcagtgggcaacccaggagtggcgcttgacccactagagtgaaactgactctcctcccctcccca

SEQ ID NO: 60690 - DNA, 1299 bp, Bovine  19866880519044
atttttcttgttaagttactgaattgaataaaaatatgtaataccccttttaccataaaataaaccaatggcaatttaatagttctcctaagccctgtaccatcatttcggaaatatatatatatatatatctttctttcagatgaaaattgaattcccaagggcatagttttcagaaaatataacttggtgatgtttttagtcatgtagtttgaaatgaaattaaaaacaggaggtggctttcttgaaacatgtgagactgaaggccaaggtatgactgactatgtaggattcttttttctagttgccaaaaaaagcttttctgagctgaacaagacaggtataaaattaaagtaattgcacacttcagattttactagcaacatgaaatcttgtgggcaatttgctgctttacagacatcgtggcctgccggcacggggtggggtgcatcacatgtgagtgcatttattgttcccagcgactctgaatgatcctgcggagtcgctcttacagcagtgcgtgccggcggcatgccagcttgtgttccagagcctgcctctttagatctgaaagttattccgtttccttttttttgttttgtttgttcctaattcattggccatgtgtgtaattataggttggagggatgattacacaaacgaattacaatcaaacttggcttgtgagcatacagagctttggttgttaatcacaattatttaagcaggagctccctctccctgagatgcagatgccacattactctcgttgacacttccgcaagtcagactctgctgatgtctcatgaagaccatgtccgtgtcccgttcagcaggtcacctttatataacattggatgttgcttcttggctttgagattgctaagactggaatcagtacacagacctggtatcagaagtagatgtctcctcaaaatggtcttagaaaatcaaattgtaccacacctagtgggaaatatattgaattagtgtatttccacgttattgctctaaatggaaataatggatttttaaaataaagtttttgatttgaggctttttaatgtagacagaagacaacaggattaaaagattcccagtctctcaaatgtcacattaccataaattaatacatacagaattatcatacagccaaaagcactttgcagagcacaccacacttgaaagatacagtatagactatgtatcctcacgatgactttgagcaaatctcctgaccaagtgagcatcagttctgaatctataaaatgagagtactaacctttctcaaggaatttt

SEQ ID NO: 60691 - DNA, 1606 bp, Bovine  19866880537940
aagctttctctttttttggaaatagatttagcttctaaaatctgacctcccatcttttggaaacagccccatgctccaatatagaacatttcctaagtgtatgaagatcatcgtaggctgataatgtgtcgtcatttagaaattctgacagtgatacataaccgtgaagctgctggctaagagtttagtgtgaaataaatatagcatgtagatacttgcactagatactggaaacgattgaaggcaaaaggagaagggagcttccccagtggcttagcggtaaagaatcctcctgccaatgcaggagacgcaggttcgatccctggtcggggaagatcccacatgccttggaataactaagtctgtgcgccatagctattgagcctgcgctctagagtctgggagccccaagtactgagcccaagtgccagaactccagaactcatgaagtctgtgccacctagagcctgccctccgccataagagaagccacgcgatgagaagcctgcacacctcggcgagagagcagcccctgttctctgcagctggagaatggtcagtgcagccacaaaggcccggcacagccaaaatagataacaaataaataaaattattaaaaaataaaagagggggatggtaaaagatgagatgtttaaatagcatcaccgagccaacggacatgaatctgagcaaactgccacggatagtggcggacagaggagcctggcgtcctgccatccgtgggatccagagagtcagacatgacttaggactgatcgacagcaatttacaccagaaagaacagggcggtgtataaaattttcactgttttggataatttgcttttgtaaaaagtcatgaacgttaaaaagaatgtcagaacttaaaatgacctgatgctcacttggacttacttctccagagtatttttttaatggaatttttgtattctcttagaagatcaattgcacttatatacatttgcaggaacaatgtgacaaatgatgaaaacaaaataaggtcattttatttcattcaggacaagagtgattcatgcaaaatagtattaaaaatgactatttaaattgcacattgcctgtacttttcagaattaaagtgatatatgatgtagagatgatggatgagggagcagtggaaagcatattaatatacaaagtagcttacatgttctaaaaggatatttaagattttttacactacctcatttaatactgaaaataaagctgtgagacagttattattaattttttagatgagaaaatggaggcagagacagttttctccaaacagctaatgagtatcagagttggactcatatcaaggctatttgacttggaagactgagctcctagccaccatgaggaatttgtaaaagataggaaaattggctatattgcttaatcagattcctaacacattatttagagtggtaagttttgtaacattgggctcagttttggacttctcccagactcttgcagtgactccttgtaggcagaatatttattcatcctgctgatgaaactcattttgggactaataagatgaatggacgtgaaatgtgttacttctaagaagcaacttc

SEQ ID NO: 60692 - DNA, 782 bp, Bovine  19866881491039
tcttaaatttttaaaataacatttcactactatttaaatagtgatatatttaccgtggttattttattaactcctgtgggaggaagcagcttattttgctatacagtttgtttatgtgcaaaatataaacaaaatatcatctagaaatttaatgccaccatactaaatcttttcttctagccaagattgcatacataaaatatttcagctacatgaggttttaattttctctatttataaccagtacatttatgacatttttaatggtcaatgatacatgttaataagggataactgcaagcttagttgtttaaatatttattaaatgtgttatccagccctatgatagaaatttatttttgcatgtaaaaaagtagcttaagtgtatatatttttgctgcaatattcccaaactgaaaatcatattttttgtaatgacatctaaaaattaaatgtttggaaataattttatgttattaatgcatttgtgtgacagaatgattttttttataattatgcaaaaagttctctttcagacttgttattgctaattaactcatgtgccagatattttaaattattcaacaaacactacttgagccaatattaagtgaaagacattgtgatattcactggagatagaaaaataaacagtactctttttcagctagtgaagtaacatccagagcttgctctttagacagcataagtcaatgcccataaaataatgtaacatgtgggacatgagatgtcagggaggacacatcgctctggagggaagt

SEQ ID NO: 60693 - DNA, 1424 bp, Bovine  19866881602735
tatatgtttatatatatgtgtgtgtattgttagtgaattgtgagatacatacatctcacatcttctttatctgttcttcagtcaattgacagttattttatttaaattttatttacctatttcactacctttcaaccacctaagcagttgtgtttttttaagcaccgatcacagacggtggagacctgttgtgtcttatgcttttacagtttaatttagggaactctcaggcaaggtagagtcaatcaagaaaaaaatcatggtgcttccttaccttctcagcgaggagatctaactttggatacttaattgaagggtcattaaactcactggcatttcttgagcaaaaaccctgttctcttgtttgagagtttatagacaagctgatttgtaaattattttctatagccaatataatctgaagcagtataaatttaacatcatatatggaacactaactataaagctgaaatatgcttttttaaatgcaattttccaactattacaagtggttgcttttcagtgatgttcagagctgcagtgtttattttgcaacctttttctggccttttacttcatgccatctggtaaactttactgataatcaaggctgaataacttataacatctataatcagtatgtaatcaaatctgacgaaaaaagcatttacacatgcttatttcattcatgtatatataggtatatatagtttctctaagtaactatttttaagtgctgctatttaatgccttttcctgtagtgctagaactagaaaagttctttttgttattgatgtcctgatatgagtggaaatattcgaaattaatgtggtgttaatgatggcaattaaaatcctggtcttcatgcttttcttggtttgcccttatcttcaatccagtactgatttggggattaattcaggtatttgtaggaaaactgccttctgaggagtcacttctaaaatacttggcatccaaaatattactaaatgaaaattaattgcttttcataaaaaagaacattttacaacactttgtaatcatattaaaataatgactggcctcactaatgaaaattaaatgtgatgctgggggttctgacagtgtggcctgggagctcggtttgcatgtaaaattgagatttctatcctcgctgagcagattttttttctcaaaataattagttctgtcaaataattaatgttgttgacaggactaagttgagaattttcaaccttcctcacatatattataattatttggaatgacaagatgatattaaacaataatcttcaattctggctgtcaaacttgatcaggtcatttattttagtactgaagttcatttaataaccttgaatgtaacatataagtcatcatctatagtgccattacatgtggaatattcattgtagtcatcaaa

SEQ ID NO: 60694 - DNA, 811 bp, Bovine  19866882076628
tcccagatttagtgcttttagttccgttattgcctccatgtccataacttgattcaccagtaaactggagttttccaaacgttatctgtctcattagttattatatatatgcgtgcatgctcagtctgtccaactctttgtgacccgccaggctcctctgtccttggaattttccaggcaagaatactggaatggttgccatgccctgttccaggggatcgtcccgacccagggatgaaacccgcattctcttgtgtctcttgcagtggcaagtggattctttaccattatgctacacgggaagacatgtttataattcacattatcattttctaaagcactagtaatcaaaatattttgtgaagtatgaggtggttggattttttcagatttgggaatatatttagttatgctaaatgaaacagtgatttttcttatgacaaggatgttaagtagcttttctaaatctaatttgaattaaaaatgttcttgaaatttaggttaaataatagatttaatcacagtagactaatttccagttactttgtatttgtgcccccccaaaaaagataaatgcacacaaagtaaatctacatgcatgagatacgcatactatttgtgacttttaaatagtttagttgaggtagaatacaagtaaaaatttaccttgttgaaatatcacttttagattgaatcctttcaacctaagtcaatctgctctttaaactttcatgatatctgatattttgtttttttctgaaggtaacaaaggaaatatgtcttcatatccaaaatctgtcacaaggcaaag

SEQ ID NO: 60695 - DNA, 1965 bp, Bovine  19866880353039
cccctgccgccccgcccctttcctaaagaacctccagtagaaggaaactttgcaaccttttagatgcaacacatacattgagaaggaagacttgattttcactgatttaagtcataatttaaaacagcaaataaagtgcttcagggtaaaatgttatataaaagaaaggtgatgagctattggttgcagtttcacaagatagcttatatatgcttgctttatttctttgacttttactttttggatggtgtgccgtatgaatatagttctgttgtaaaaatctagtataccacagacagaaagctttcctggtggctctgatggtaaagaatctgcctacaaggtggggagacccaggttcctgggtcgggaagatcgcctggagaaggaaatggagaacaacccactccagtattcttgcctgcagaatcccgtggacagaggactctggcgggctacaatccatgggatcacaaagagtcggacatgactcagtgattaacaggagcacagacggaaagtaaaaggtgtggaagttcccctccctgctccatgtccctctttgagtctgaaataccttctttcggagaaggcaatggcaccccactccagtactcttgcctggaaaatcccatggacagaggagcctggtaggctgcagtccatggggtcgctaagagtcagacacaactgagcgacttcactttcacttttcattttcatgcattggaggaggaaatggcaacccactccagtgttcttgcctggagaatcccagggatgggggagcctggtgggctgccgtctctggggtcgaacagagtcggacacgactgaagtgacttagcagcagcataccttctttatagtttgatacagcatattctcccaggcttttccctctcatttctattcatacactcacacaaatacagcttttttgacataaatggattcacaagaacatatggttcaacaacttgattctcaaggggtgatttactccactcttttttcagtcttaattttatacccatatcagaactgattttgttattttatagctagtagaagctgtaattgggtgaagtcattagggagcagcaagtcttactcaatagccatataacagaataattttgtcttgtggtatcaagaacaacagtcataatgaaaacactgcccttaagtgttaatgtacttaagagaaataattgacttgttcattctgaatattttctctagaaacacatacatttaacaaattaagcacacccatattttattgactgtcttaattataatcttgaattaaataaagcccatttaaaactcactgagaggacaattgtaaatactggattttgtgtccaagtcaatcaattgctcttatttgttcatagactaggaaaaaaaatgagaagttttcctgcattttcagctcccaaataattcttccatttaaagtgaactggactggagtcacctttaaggttgctggctaccaaacattcaagaccttaacccaaaggaagataatttttttcctttagtcctgctggagcagctattgctgtaaaaagattatcatttcaaagtgttgggttacttctcaagttcactagtatgaactttctttaaaacctcgggagcaaaaacagatttggatggttcacctttagacctgatttttaaagtagttgctattttggagggatggtggttggattcacatatcacagccaacccttcttaaacatcagggtttgacctgctgccacccatccagagagctctgttgtgttagagcctccttacggtcctttcctgaaaagactttgatctgttccttcaagaaatacctgagtgccttctacaagcactcattgttctgttatctcagatgccaagaactaaaagctaacatcataatgaccattttaagtagtcacctggtatgcattt

SEQ ID NO: 60696 - DNA, 1856 bp, Bovine  19866880355316
tcgctcagtcatgtctgactcttagcaacccccatggactgcagcctaccaggctcctctgtccatgggattttccaggcaagagtactggagtagggtgccattgccttctccatggtcaccttagcccctaagaaaataacacactttataagatttaatggccacacctggaccttgtcgtcattcaaaattctttcacctttttgattgtccattctgatatttccctctgtgaccacaattgcgtctctttactccttacaagttccctcatatgtgttgaacctactcttcatcctcattgttatcccctgatcttgaaaattcctttttctccaagccattttcagttcatgagctcttatcctggtggtcagcatgtcagcagtgagtttgttaacatcctaaggaccctctgcctcatttctttgccagtcctcatattgtggttgagtaacccacatcaaccatagtctctaagtctaagctttatcatcttgcaaaatcttaaatcctgcgcacctcattttcttaccatttaggttgtctttactgcatctcagtgaaccttgtaataattttgtgatggtttgccattatattccttctaattcgtattctaagccttgtccacaatctccaggatctaatcccttttctactacttcactgtgacactggagactagcctaaggctcctcgagctttttttgccttaaaaccttgctgtatttttacccatccttttctcctaaattctgaaaaaaaataaggaccctgtctttggctcttttctcttctgtatgtatgcagtgtgtctttctgtgactcccgggtcacttgtggctttgaataccatctgtgtgctgaagactcttcagtgattgtctctggttggaccttccccctgagcttcagacatatgtacccactgcctactccactgcacccctactcatgtccaataagcatctcgagcttaaaagggctggaaaagagctctagtcttgcctgatatgaattccttcctgccagttactttcccatctcagtaaatggcttcaccatgaacccatatgctccagccagagcctgtaccacccctattcctgtcttcctcattctccacattcaaaatagcagtgcatcttttcactttatttataaaacatgttttggatctgactcctcctgagagtcaccactactacaagctgaggcccagcgtccctcatcttttgcttgatttaccgtaacttctcccattccggtgtccttacatccaaattagcccactgttgtccatctttcacagagcagccagggtggactttctgtgataaagtaagcttcatcatcccctagtttatgtgcttcccatttcaaccagagtccaaggcctctgcccccttgttcattataatccaaccacactggtctttttttccatcccttgaataccccaggcttgctccggtcttagtgtttttatatttgctggtctctctgcctggagcaatcttaccctggagttctgcccctgcctcctccttattcaggtctgaaatcattggtgacctcagaggagactttcctgaccacactggctaaaagcagcccttcaccatccccatccccagtcaccagctcatcagcctattttatcttgatagcatttatcagccctcccggcttgtttccccacatgctccttaactggagctcaagcttcttgtgagcagggacccttggctgaatgtccgccatgccgagaaggtgcttagaggaccaactggctgactttccaggataaactgcccacttgtgcccttcattgccgcttgcctactttg

SEQ ID NO: 60697 - DNA, 721 bp, Bovine  19866880480957
cacctgggagcgagccgagctcccacgtttggggcgggtgccgagggtggaaccgggagtggctgccccacctcggagccccttccagatttgcccccgcggagggtggggctacccgcggcgccggggtttggtgggaggcggagggaattccctggagtgaagcgtttggtaaaagtattgcaggaacaatcgggcttcccatgattgctctactctgggcggggaaactgaggcggaggcgaaggtagcgacttagccaaggtcagaccgcaaaggtggaccgtcctgatcccggatcgggacccaagtgtcgctcagtccctcttggttgtgctgcagccgtgcttgcctcgaataaatctctgttgtgtttgttttagaaatctgctggcattgtgggactgcttcagggctgccggacgaacgccaagttgcttcgtgtgtttcgggcaggtctagggcaggtggcagccccgccatggatggggacggactttttgatgaagaaacccaaagcaggcgatgtcagccagggcgatttggccgtcaaaggttttgacaaaacctgccgtgttccctttcgtggaatccgaatgagggagattacagacaccttcaccgggaagccaaggacatttctgtataatcagtggatgaaaggattttctcagactctctttttccttttccttgaggattaatccacagcagtctacaa

SEQ ID NO: 60698 - DNA, 2138 bp, Bovine  19866880491753
aaccctgtattttcggtggacttccctggtggtccgttaagactctgtacttctaatgcagggggcatgggttcaatccctggtcaggaaactaagatcccccttgcagtgtaacccttccccccacaaaaaagccatgtgttcctttctgttttcatgccttctgtcctttctttttttaagatttaaatttttatgtatttattcttggctatgctgggtcttgattgttgtccatagactatctctagctgcagtgagcaggagctgctctctaaataaggtgtgtgggcttctcatttcattccagagcactggctctaggcgcatgggcttcagtagctgtagcacatgggcttaattgccccgtggcatgtggaatcttcctggatgggattgaacctgtgtcccctgcattggcaggtggattcttaacctctgggcaatcaggaaagccccagcttttttgtttccacttgtgcccaagagccttcctctttagttccatccacaaagtcccctagcaagggtcatataccctctatcacctctaccctcttccactgcctgtttccctggaattcccaagttttgcctagtccagacctcatggcccttgggactcaatgaaggacagcatctccaataaggctttggctgaagctgacagtgtttaggagcccacatatgtgttttaagttcacagcacaaataaccaaacatggatgttagcaaacttccttcataatcacttgtgatttctacaccacttctgtgaccccctgtcctctttccctacttttcttcacttataattttctatttttggacaaggggaatggggagcagcagaaagggaagaaaagaacttgaaaaagagagaatgaaccaaaaaagaaacacagggaagcaggaggaatgaaggaagaaacagaagggaaagaaaagagagaaagaaagggagagagacaaagaaagaaagagagagagagacaaagaaaaaaaggaaaaaagaaagaaagacacccttaaattaagtaaccacacatgtgtctgaggcatatatctgcagtatctctacttaaacagcagggacctcatggcagatattacacatttaattgactaaagaaaccaatcatagaacaaagcccctttctttgtgagatgtcatatgataacccaaacacagtagttgctgtttttctccagacactatcaaccacagccgtctgtcttggtcctagactgtttaaaaaaaatttttttttcttttaatgtgtacatgtgtgtatcagtcacaagaccaaagtagtctccgttgcaacaatggccgccctgtggaattcagctgggctctcccagcccacagcccactcctggctgccagatgtcagccagccccagaggttctctttcatcctcacccaccgcagagccattttggtctgtgctgtggtgggggctgacaaccctttgcaagctccaccccagatctgagggaggcctaatcttgcctgaggcccgctgtggggaggggggagggtaaagagcaaagcctcctgggaacggagatggggtgggttagatttgttctcaaagttcagccactgctgcttattaaaaggcttattttcaacctaggaatccagtccttaccatgaaggaaaaccaggacagatcttgttgacagctttaaaagaagcaccgtgagctgcggacgtggaagggagcacacatgtgtcctcctcctgtgggtcttcccaggcggtcctgggtcctagtctccaggcaagaggcagttggacggctccagaccccaccacgtccaccgcctccttcatccctttctctctggatgctttcttgttctcctcttcctccttttccttctcttcttccgtctttttcccttgcacactgcagatttagaatagccatgggactccagcaaggcagtcggaagactcaccccacagagatgctgcccagagggccccagaactgccagccccacttctgatctgtaagaaaatgcaagaaaaaatttcctcgtctgcaaaatggagataatagcatccggttcatgtgaggagctcttgtcgtgcttcgttcacagggtcagcacagagagttca

SEQ ID NO: 60699 - DNA, 1872 bp, Bovine  19866880525848
tgataatggtgatggatatatttttaaaagaggcctcatctattagagatatatatttaatgatttttgaatgaagcgacataaaatctgaggttgtttaaaaaataatcagcaaatgggatttctctggtggtccagtggctaagactctgtgttcccaatgcagggagccggggcaggatcagttcttggtccgggtattagatcccacatgcagcaacttagagtttgcatgccacaattaaagatccctcatgctacaatgaagactgaagatcccaagtgctgcaactgagactgggcacagccaaataaataaatattctaaataagaaaaatctagcagagagtaagataataaagttcagttggccttacgttgataaatggtaaagttaggtaatgggtacatggaagtttattacaaatatattcattattttcaaacactgtagtgtatattttaaaatgtcatcataaaaagtttagtgaaataacatacatgttaccagttgatatgttgtctggatattaataataaccaaattcatgtcatattttgtagttcacaatgtactttttatgcataacaacataatcctaacctcaaccctaggaaataggttttattatcctcttttcacaggaaacagtttcagagtcattaagtcagtggctcaaaggctttgagctagtaggaagcagaaatgtgatttagatcaaagttcttgatttctgaatctcatgttctatctggggaggtagaggaaatgctgaatcttcctggttaagtcatttaacttctctgtcttagaagaacagaagcaacactactcaacctgcctttttttcagttgttgggaaattcaagtctgaaaatttccaggaaggagctttgttaattgtcaggtgccttataaatttattttatttatttatttctaaatagttatttattcatttgactgtattgagccttaattgtggcatgcaagctctctagttgtgggctcagttgccttgcagcatgggggatcttagtttctgaacagtgatcaaacctgagtccctttcactgcaaggcaaattcttaaccactggaccaccagggaagtcccaagggctttaaaattttagattgtcatacatctatgttttctagcagtgtgtgtgttttgtatgttagtatctcagttgtgtccgacctctttgcgaccccatggaccgaccaggctcctctgtccatgaacttctccaggaaagaatactggagtgggttgccgttctcttctccagggtatcttcccaacccagggatcaaacctgagtctcctgcattgcaggcatattctttaccatctgagccaccagataaaccctctcaagcagagccctctatacaaatgcaagaaagtggagagctctgggggctggtctcaggcaaggcaaatcttccttttggcatgcctgtcttccttttctgtagacctccttgcattccaaactccatcccttacatcactattaacagacagtggttaagatgcttttccttgtggtgcatttgaatacttgccagtgtcctgatgtgtcgttttgtagcttgtgggaacagaggctctacaacagctgtttataactgaaagttttatggcttgattttaggctagtaaaatgagtatgaaactgcgtagcattttctggtgttgtccagaattctctattagattatttgcactaagtcatccagacccatgaattttcatcaagcaacactggaaaacaaatgagacacttttgattctcaacaaatgagacacttttgattctctggggcgggggggagggtagaaagaagaactacagcgaaaa

SEQ ID NO: 60700 - DNA, 1410 bp, Bovine  19866880539769
ttgtgtccgactctttacaacactgtggagcgtagcctgccaggctcttctgtccatgggattgtccaggcaagaatactggagtgggttgacgtgtccttctccaggggatcttcccaacccagggatcaaacccgagtctcttatgtctcctgcattaggcaggcgggttctttaccactaacgtcacctgaggtgtgttatccatacatggaacttcttctgcctgtgccactgatcccagggttttggcttggtcatccgtagacgacatggcctttgacgtgtcctggtttgccgtgcactcttttggcctggacaaggctcccgtcctcctgtcgtcactggatcggaaggggattgtgaacacggcccagagggactggaagagcagcctcagcctggagcgcatgagcatgctggaattcttgctacaagtgcatggctccgaggaccaggactttggcaactactactgctccgtgactccgtgggtgaagtcacccacaggttcctggcagaaggaggcagagatccagtccaagcccatctttataactgtgaagatggatggtaagaatgacacacaaataaccttctcagtgtttggggaatggcttctccgcgtgctttgccaccgctgatgggatccaggttctcacccttgaggaatgtgcctgctttctctctagcctggctcaggcgtgtacccagaaagagcacactcagcccttgctgttttcccagcttaggtaccgggtgtgctggaggcaccactgggaaatgattttttaaacttactggacagattttcaatgcattctgtaaattctagacatagtcgctttgttgtatgctagggttggcacggattctgccaggcaggggcagagaacaacattgagagagtgggtcaaggtctcttggaggggccgtgagtgagttcctgccccttttacccttctactggtcctgtgctgtgctagtcgctcagtcgtgtctgactctttgagaacccatgtactgcagcacaccaggcttctctgtccttgggctttttcaggcaagaatactggagtggggtgccatttcctcctctgggggatcttcctgacccagggatcgaacccccagtctccttgtctcctgcattgcaagtggattctttacccactgagccatctgggaaagccccttactggtcctacctttggtgaaagggggctcctcccattcactcgcacagggagggttcttcacagaaccctgagatgggagggggagctccccatcttgttggctcacactgaagaccagtcagcctaactaagtggtcagggggccccctccccacccttctgctctctagcctcctggagtgggggacacattttcctggttaacggaaaa

SEQ ID NO: 60701 - DNA, 1469 bp, Bovine  19866880546048
ctcatgaatcgtcttggaaaaaagtcggagaagacctatgagaatgggtcatggtcaagccagagaaattcctctgacttaagctttctgcccaggctgatgtttcttgcatccacagtataatcatgagagctaatatttgctgagtgctcactctgggccaggaatttttctaagcactctacatacactaactcgcagcaacttgtaatagcctatgtaacagacaccatttttatctctatttgacaggtgagataagaatatgctcaaggtcacgtttcgacaaagtggcaaaatcggatctcaacccagacaggtagaagccagagtccaggaacttccctggtggtccagtggctaagactccatgctcccaacgcaggggacctgggttcaatcctggtcagggaactaagaccccttatgcctcaactaagacctggtgcagccaaataaattcattaaataaacaaaaagaaataaaagaagaagaaaccagagcccacactccagcctgtcacactggggtctggacagtcactgaatgacactaatccctagtcttcatcagatcgtcttccttttttttcaaagtacttagaaattttttggacaccaatatcattatatagataacatcgttaaaagcatgtttaaatgagaaaaaaaatcaccacacccatgcaaacaattttatgcatgcatgtttcttctgttcatgcactcatgtatttcattcagtgaacatatagttctgtattctggatttaagtgttaacattataaagatattttcataggtcattttctcacttattttaattgctgtatagcattccctcaagttgctgcaccgtaattgacttagccagttccttgttttgggtatttagattgtttccagcttgtccccatttcaaaagaaagaaacaaagcaaaaaagacgatctttgcttccatttttgtccttttcttggatactccaactattcagtgaagagctgcttaatctgtgcatttggagccattttgatagcctttgaccaaccatcaaggttgactcaaaggttagaagtgtgtgagctggaaggatttcatgagatgttgttctttactaaaggacctggaaggaatcaaagagcaaacggaattacactcaaactgttggtgccaatgtgctagaaaccgagcagagagagcagccaatttgcagaagtcacatttttaactcagtaacagatggcccactggtcagagcttaaaaggccagggctccttaagccagcaggatgcaggtgaatgactcaaatgctccccacaagcaaaggaactgccaccagccacttaccacaggccgcagtgacgtgtgtgtatgcaagagacatgaattatttctcctcccccaatctctgcgatttcatttttcctagcctcaaagactttcaaaactctgaatcaccatgggc

SEQ ID NO: 60702 - DNA, 4515 bp, Bovine  19866880581919
agtagaagagatttctcaatacatataaccaattgcactcagcatataattcctacatatcaaaaagaaaaagataacccaatagaaaaatagatgaaagacaaaatacacatttttactgataaagaaaatggagaaagatgctaatatcttctctaggcaaacagatctacaaatgaatgagttttattcatttaggccttgtgattactatttagtggcagcacgcatattggaggagagtcacagagagaaaagacagctggaactataagaactaaagttatcaattgacagctttggccacagtctaagttaaaataaatgtgttggcctgagtcaggcacttcaagggaaatgaagcaagtgacttgcttcagagaggacagctgctggtctaagtcactcaacgtcttaatctggcatccgtaatagaagctcctgagacgtggcctgcacagaagagaggactgttcctgcaactgagaccagttgactgcctttggaaactcaccatccgtgccacagtggcgtctgtttcccatgtggaacagcagttatgaccagtaagtattctgtttaagaaccctgtgttaaagacttgatattcttcaacacttcagcggaagccccactgcaaaggaatcatctactcaggtcaactgttgatagaatggctcagccaaggcacttagctgtgatcccagaatgatatcttcagcactgtctggtgaagagaacagtctgagagacattccatttattttctcagctacctggtgatgaagatgttatttcctccacatcctatatgagggaactgaggtctggggagttaaatgactaaagggcagagaacacagtcaataagtagaagaaccagggctctcctctgaggttttctgggttcagaccctgtattcttgccattctacacattaagtgattagggacttactgatgagcagcggatggattgtggtaatgcaggaaatcacatacctgaaataccaaaaccgatgataaatacaattgctccagccagaataatgatgatgctaataatgctatggagagagaaagaaacaggaaattacttctttattccacttaacatgctgctttgcaacctaggctcatacctgccctttgtaggaggtattatataaagactctcaactttttcttcaaaatatgtcctttcctagaagtaggtgccttagaaagggatctcaacaattccatcctcggccccctgggtgctgggatagattaaaggagtggctcttttgtctgattgtgtgcatcatcttattttcctatttccagatcagtgaagatcagacacaaagactgctggggaaaacccaatggcatttctgtaatgccaggtggcacttgagggagactagttcaatccttagcccaccctgagcattactgcatccctcttattacatcattaatctatctctttgtctccttccatagactttaaactccactaaggacagcggtcatatctttgctttgtacccactagtccacttcactctgtagatcctcactgagagtttgttttattaaaacagtaagaagtttattacagagagcttaggaaacacagataaacaaaaataagacaataaagtcacctgaaactccaccatccagacataacaactggtaacttcttgaaatgtatcttgccagttttcaatgagcagattaataaatgatgtttaggaaataaacaaataaggaaatactgcttatatttactgagtgctagaattatgtcacagatatgttgttttaggcaccatttatggactatgtcatttatccatgtgataaccttatgaggtaaacaaacgtatctccattttacagatgaagacatgacatagggatagtaagcttcttccctaaattcacgtggttggtaagtggcagagctgggattagactgtgtctccagaatctgtacttgactacttcctacactgcctgccagggatgggggttcaagatggggtgtgtccctcctctctgcccagaggaacccattaggggataccggcttgagctgctgagagtgactcagacagaacagaaggtgcaggtcagagctggcctggtggcaaagcagtccctgggaagctttcccagtgctgcctgctctggtgcataagtcatcaggcaggtgtcctccgccacagtctcattgctgccaactcacacattccctgcacccacaccgatgttatgcaattggcaggacaaaagagaggtacagggaggcaaagaatgatgctatagagagaagggaagcacagggcatttttcttgctgccccgaataggctcattgaacccagctcccctcagctcagggatgggcccaccagagagaaacgttagactcacgaggaacaatttgagtaaacagttcccctagaggttaagccctcatgaggtatagccatagggacaacaattgaataagcaaaatcatcactaggactgataaggtatctgcagttgattccaagaagagaccacatttgacaactgccccctttctttacacacctaggtgtggcctcaaatattattggtccaagtgtgtgagaacagcttaacaaactcatagcaagaggtactgtctggctttctgactactgagctggacagagcagacttgcatttgtgacccaggaatcacttaccttgggtgaattactttgtctctctgagactcagtttctttatctttaaaatgggagtatgagtaattcctgctccatctgttataaaaatattgtaagttgaagtatgcccctccctactcatattttgaagtcctaacccccaggacctcagaatgtgactttatttggcaatagtcattgcagatgtgattagttaagatgaaatcatactggagtagtgctgtgcttagtcgctaagtcatgtccaaccctttgcaaccccatggactgtagtctgccaggctcctctgtccatggcgattctccaggcaagaatgctgaagtggattgccatgcccttcttcaggggatcttctcaacccagggatcgaagccaggtctgccgcattgcaggcagattctttactgtctgagccaccagggaagcccacagtggagtggggtgggccctattccgtatgactggtgtaatcccttctccagcgatcttcctgacccaggaattgaactggggtctcctgcattgcaggcggattctttaccagctgagctaccagggaagcccctggagtagggtgggccctaattcaacatgactggtatccttatataaaggggatatttggacacagacactcacagggaaaacagcatgtgaagatgaaagcagagatctggaagccaaggaacaccaaagattgccaactaataccagaagctgggggtgaagcctgaacagattcttctcatggtcctcgggaggaaccaccccaaaccgctagtctccaaaacagtgagacaatattttttttttctgttgttacccagtttgtggtattttattatagcagacctagctttgatcttgttttaagatcaaatgggcagtgattgttgcatattccatacagggctcttcatgtttcttttttactgtaaaaaaaatttatctgtggctatttgctgcatacttattattaaaagctatgacttaaatctagagaataacccaacttgtaataacaaaaatatcgtaagtattttggtatatcaaaaagagcatgtagtagggtaggcttcgtgctaagcattcagtgtacattttctcatttgtttgaatgatcaagtcctggtctccttaatttctctcatattcctccatttctgtccccactgctcctggtcaccaccatgtctcagcggcatcattgcaacactctcctgacagccctgcttctagactaaaccttactaacccatgcttcaccctggccagaatcagtggtgacttcagaattttttattatgtatttatttatgtatttatttctggctgcacggggtcttcacggctgcacacagactttttctagttgcggcaaggtgggggctactctctagttgcagcacacaggtttctcattgcggtgccatggcttctcctgttgcagagcatgagctctaggcacgcaggcttagtagctgtggtgctcaggcttagctgctccacagcacgttggatcttagttctcagacaagggacagaagctgcattggcaggtggattcttaaccactggaccaccagggaagtcccagaatttctatatgagtgtggcttaggggggatgacctagtcgaaatggggctgagggtgatactgaggcagtataatgctgtaatcacggcacggcttctgggtccagcctgaacaggttcacatcccagcaccactaggtactaactgcggacctgtttccattccttcttgtaagaccgagt

SEQ ID NO: 60703 - DNA, 1205 bp, Bovine  19866880601082
atatacatgtatccattttcccccaagctcccctaaaaggctattttctatgtcatgggattgtctgaagattacatgagctaaggaatatgaaagtgtcctggcaaatgtaaaatgatacacgaatcatgaatattgttttatcatgcactttttgaattctacagatttacctattaaacaataattatttatacataaagtgccccaatatgatacaatcgtggtcctagaactccaaagacttcataattaaaatttgtttcactttaaagaaacctttgtattagcaaaaatatttttatcaaattaaaaatctttgtctgaatccctaattttttatcagtttgttttttttaaacttcaagtttataccatttatgtgttgttaaatcaatcagtcaaaatatggctgttttgatgactttaaatctgaagttacaaataacagttgaatctcatgttagtcaattgatctctgtttttttgttttgaagatataatattgagaaatcctaattacccagaatagaaatcaaaaaacttatttttttaaaaaaatcttgctttaaatctaacaatgctccttacataattgttctagaagtttgaaaaaggaatagtcttgtgattgtttcgaagttcagtcattaacaatatttaataagggttgtcattctttaactggttattattattctatgtggagagcaggaataaatggacccctcagataatatgtctccactatttggaagaaaatacattttaattgtatggtaacttttgataccaggatattttaatctatgaccttttacaaagtttcatataaaacttagtttttgcctttggtaaaggtgcatttcacttcaaaacagtgaatctgacatttttcatattgattccacactttcagtttcatctgacactctctgtagttgtaagcccagaaacattgttcctgtacacagccacaatgattttactgaatttactaaaagttagtaagagatacaggcttgtacagctacgttacattacagagatatttaaagagtgggatctctttatcagtctcccccagagggatttcttgtctcatttgaattatttataccaacatcttgtcttgaacttcactatgaaaaatgaaaacttggtactcacagtccgcaacattacaaacaatgctgaaaaaccca

SEQ ID NO: 60704 - DNA, 1552 bp, Bovine  19866880624238
aaacatggaaggctctctattgaactaatacctcatcccttaatttttcctttggtgaattttcttcttaagatatcccaacatgagagggtagcctgagaaagtgaatataggtagagttaaaaggatattaaatttgacatcagaaggttgagttcaagttccagctccattggttactacctgtgtgacccagcctccctgaaccttatcaggaaaagaagaatattaatttctgacatatctactttatagggcatatgatagtcaagagctaatataagtcaattttttaattgcattcttctgggttccaggtttcctgagtggtccctcagaagctatggctttaatagggggatggggcagttggaagggaggaattatcctcagggagagagctctagtgtctcacggtctggctgcaccagagcagctccacttttatctgctttatattatgagatgctacaggagattttgtttgatactatatatctgctgctaaaaacatccttgaaactcactcatacctatgatacatgacaggtcacacataaacatgaactattatcactagagagtaaattcactgccctggataaatgttggatgataaagaacatgtatctgaaattagcttttcggattatctgtgctttgcaattctggtatcctctcttgaacttcattatcagataattaagaattcactgtgtgtgaatttttattacaataattataacttggctcctactactaccctgaattacatctcctataagacccctgacttacttatcttgattacatctgtggacttctgagcagccaggcaaggactgcaaccatcttctatgttcctagtttaatcacaatcctccatcctgcagcccaggaattgttggggagaggcactgtgtcagcctttctcagctgcagatactgctcaggagagaaaacttccccccacagctcagagctcctgtaggagaactcaatttccccccaagatctggcacatcattgcacaccattagacaaggctctatcacaaagaagggtatcaggatgagaagcagagcttaggttttctgcaggcagatcattaatgacttccctctggtgtgtcttaatagaattcccaggagctcaggatctgaatggtgtgtagtgctgatctgccaaagaaagggaaatgggttaacaaaggaaaattttcagagctgctctggttttcaaaagagtggtataaatcctgattgcgtatagtgaccctggaagccagaggtagttaattattattcatggataagaatattgttacccacaagtcccctccttttcagcaataacatccaagaaatgccagtcagaaataaagggaacatttaatttaagaaagctcttaaattcttaattatcttagcctctgaagactgcaggcctttcaatcaacacctctctaggcggtagtttttgtagtcaactttttccaaaatctgcttccgccttctcggggatgtgtcacatagcatcttgtctctctcca

SEQ ID NO: 60705 - DNA, 987 bp, Bovine  19866880637584
gtactttcctgtaaacactagctatcatagtttccttggaatcacagctcccatctcctcaaggagtctgctgcactctgcctcagaagtcccccttcctgtgcagtaaaccggaaatgctatcattagacagcaagctgggacatacacggggctcacctgggttttgtcccatctctcagagatctcaagtccttcattgccgtttgtccagtgttttgaaaactactgattcatacatagtttatctgcttgtttcaaggggaagggtaaataggacccttgttatctcaccttggaggaagcagaagtcctactcttccattttcaaatactttgttaaatgatttgctgaacaccatgcaattatgctcacagaatcccttacgctctgttattaacccaatttaaaaagatcattagagtttatccagcaagaacttgttgttaggaacactttctggctcttcatgatcactgatttttctctaaagacttcataccatgaccttctagaattttgtgaaaatggacattaagttcatctatcttcatttttctcaatccaacttttcccttctttaaaattatgtatctattctgttgtgcttctctccatcattcccgaaagaacattaatactgactacaaaatcatatttgtagtagtaccttggtgtgtaatttctttggataattgcaatcatttaaaataacaagttacctttctccctttggggctctctctgtcatatctgttttcctttcattacattccagggcaagccataggaaatgcagttaaaagtacagatgctttggcattttttttttttttttaagttcccttggtagcgtgccattgattctctaatttttcattggggtaaaaacacataacataaaatttaccatcttaaccatttttaagttcagtaatattatgtatattcacattattgtaaacagagctccaaaactttttcat

SEQ ID NO: 60706 - DNA, 1308 bp, Bovine  19866880725270
tggacagagggggctgtgcatttttcttatactcttcttaaggctaaggtggcaagataaggtgcttggtggagagccaaattctcaattccagggccatttcagcactcgcacataaagcaaatacgaaagaagtggaaaggggcagagaagcagaaaaccaaaaccaaaatgcatttgggcttgataggaagtcacggactgcaggtttagattttaaatgtagcctaaaccccctggaaaatagggggtggggagggtagtaaaagccacacattagccttcagcactggtctgtgttgtccctcggccggggtagagggtcgcctttagcagctctctcagcacatcttcctctgactcggaagacgtacggatctcacccgagacaaagaactctgaacgccttcacccctttctcactgcaacccctcaaaacaaaaggtagaaacacacacaagtcagagatctataagccagtaggagaaaaaaattagaggttaaccattaaaaagccgccgtcaggaaaacacacactcgattgttccatcagaaagtgccgtgggaagaagagccgtgtgctggtaaacatgtctgcgctcaggacttgacatgcagaaaagagagagcgccgagtcccacctgagattagagaggactggtttttagtgtaacacacttcgcgttaaaagattgctgtcctcatctcgcccaaaccgctcctcgaccgtccctcggtctcggcctttctggcaccaattagtccatctccatggacatgagccggcggcgctctcgccgggtctcctggacttccttcttacagcaccagtgggagctgcagtacccgatgaggcaggacaggagcccgatgacagtggacaggccgatgccaatcagcagcgggtacttgaaggcgttcagcactgggagggagagatcagagggatagaaatcatgatgcaagttgcagggtgtaggggggtgttgcggggatggggacagctcagggaagaccatcgcctcccctctccactgccccgggtctcccccaggagtctgacctcacaggtcttgcacctagcacagggcttgaaacaagagcagctcagccataggtgtccaaaaatgagcaaatatatccccacccaattccatagcaggcagggtggtggtgggggggaacccagaaaaaaaaaaagatttccttcaatatctttgaatgtcaacttgctttttagggttttggcaggagattgatttttaaaagtcagtataagggcaccacacattcagcagcagatgcat

SEQ ID NO: 60707 - DNA, 2640 bp, Bovine  19866880748226
tctcaaggtgcccagatacctggaaccctggagagtaccaaactctaccatgtttttttcctatacatacatatgtacaatacagtttaatttataaattaggcacagtatgagattgacaataactaataataaaatagaataattataataatttactgcaataaacattatgtagatgtggtctctctcttccttaaaagatcttactgtacaaacgtaaagacttttccatcttaactaagcacttaattgcactacgcgccataacctgtgcagtctgaagctcaacagtaaaactagcacaaatttacttcctcacaatttcatgattagaatatttattcttagcctgagatcttaatttcagcatatggtccttattaagcgaagaactttcatcttttcacttaaagaaagcacttcacagtttctctttggtaaatccaaattgctggcatcactaatcttgtgttgtgggcctattattaagtaaaataaggactacctgaacacaagcactgcgctatctccacagttgatctgatgcccagacagatggctaactaacaagtaggatacactggacaaagagatggttcataccctaggctggaaaaggcacaaaattttaatttattaattatttccgaaaatttccatttaatattttcagactgagattgaccataagtaaatgaaatagaaagaaaacaaaagcttagataagcagggactactgtactcaggttttagaaagtaactaaatagttagatcctatttttaaaataaaaacagtaaaaaagcagccttaccaaatatattagtggagtgtcctttccttgcaataggtctgagttcattatgcccccatccatatatcctgtaattatcccaggcatgtttcatcatctgagaaaagaaaaattataacccatcaatttacatttttcacagactgttatccttacatttcatgcaatttaaagattctattactatatccttacacattctcctgtacctcctacattagtatattattctgttaacatcggtgtcaatgtgaaaacatatataatcatgtttaacttaagtctacacaacagaacaaaaaaataggtgtaataaagaagctctttttattggggagcaaagtgtctatttggcattctttccttttaggaactgccaatcctttcagatggagaaggcaatggcaccccactccagtactcttgcctggaaaatcccatggacagaggagcctggtgggctgcagtccatggggtcgctaggagtcggacacaactgagtgacttccctttcactttttgctttcgtgcactggagaaggaaatggcaacccactccagtgttcttgcctggagaatcccagggacgggggagcctggtgggctgccgtctacagggtcgcacagagtcggacacgactgaagtgacttagcatagcatagcataatcctttcagaaacagctccccttccctcactgtaaccatgacagagctgtcaaaaatgggctctgattccacaatcaatgaacacagcctggctagagtatccctaatctttagaccaaagatcagcaaactgttcctataaagtattttagaccttgacatctatacggtatatatgctaaccactaaactcagctactgcagcaagaagcagccctggacaatatgtaaacaaatgagcatgactgggctccaattaaactgtgtttttaaaaaccaggaagcaggcagagtttggccagcaggttgcagcctgccaatcaattcctgacctacactaagtgactgggtacatgtgatccagtaaaggcaatcaagtcctttcacacatattgttacagataccatgagacaaaggacactcttgttttgcaatctcaagacctatgcaatatataatcctggagctgaggggggctaactctcccaacatggagaaatgaagtaacaaaagaaaatagagatatacatatctgttgacaataacatctacagggttggactgagccaaatttgaagccctggtttagagcgctaggctaataaatatttttatatcaattagtttgaactgggtttctttcaacccagtgagtactaacctatacaacagcagagtatttaattaaatatcagtttaattatgtaatagtagcttatggtgtatcaaacataatattcattaaaacatttctcaactttttttgcagcctactcagacatttgaaaactaggcaaaaatattacaaggaaattaaaaatcaatatatcttaaaaacaaagatgcaaaattccttaacaaaaattaacaatacataaaaaggatactacacaatgaccatgtacaatttaagtcaggaatataagtgaatttaacattcaaaaacccatcaacatatttcaccatgttaacaaataaaagggaaaaaaacatacaatcatctttttagatgtagacaaagcatctgtaaaattcaacaccctgtcatgcttaaaaaaaaaaaaaaaaaactctcagaaaactataattacaggcaacatcctcaacttactaaagggcatcttcaaaaaaaaccctacagcagccatcatacgt

SEQ ID NO: 60708 - DNA, 1765 bp, Bovine  19866880848750
gtgtactttggaaggaatgatgctaaagctgaaactccaatactttggccacctcatgtgaagagttgactcattggaaaaggctctgatgctgggagggattgggggcaggaggaaaaggggaagacagaggatgagatggctggatggcatcactgacttgatggatgtgagtctgagtgaattccgggagttggtgatggacagggaggcctggcatgctgcaattcatggggtggcaaagagttggacacgactgagtgactcaactgaactgatgcagtgcttgggggataaaagaggtaaaaaatgggccctgccatccaggaagttggaatctagtttgctaaagaactgtagataagaaatggtagccatggaaggcagcctgtgttgggtatccattttatgactcaggcaggaccactgcaggcagggggcagccagaggtcattcagaaaaggttggtttatgtagtttatgttaggtctttggagatctggaatgattcaaatagggaagagagaagaaaggacgttccctagggagaaatgaaatgtacaaagatactgaagcaggaatatacaggttgcattcagggaacaattaaagggcagcttacctggaatggtgatttcaaactacctctccaggtggttaactatagcatcagtagggcttgaagtacaagaattttttcaccattatagttgtagaagtcatgggttatcccctaggctccaaaatttactgtatcagttagctattgctgcataacaaatagcaagctttggtggcatacaataatagtacagatttttgttcacaagcctatggatcagctgatgagagctggatgatctaggatggccttagcttggacccctctcacagtcgttgaataggctagcctgggcacgttttcacagtaatgtcaggggtccaaaaggactaggagaaacacatgagtactttggaaagcttctgcttgcatcatgactgctaacatcctcagatcaaagcaagtcacacggccaagtccaaaagcaagagatgggttaatagactccatctcttgagtgaaggaaacagcaaagtggcaaagcaaaagaagtggaagggaactggggccacctatgcaatcaatctgctacatgcactgaagagagaattatgttagaaataagcactgaccacagagacaatcattgccaataatgtagaggaccctgtattcctgaaatacacacaaccaagtagtgaagtgaaagtcggtcagtcgtgtctgattctttgaaatcccatggacgaattctccaggctagaatactgaagtgggtagcctttcccttccccaggggatcttcccaacccagggattgaacccaggtcttccgcattgcaggcagattctttaccagctgagccacaaaggaagcccaagaatactggagtgggtggcctttcccttctccagtggatcttccctacccaggaatcgaaccggggtctcccgcattgcagacagattctttaccaactgagctatgagggaagcccaactaagtaatgctatagcaatttttcactcctggctgttgccaattttttttttctttccatgttagcgggtctggtttctgccagaatttaacattgacagggtgatgctgcctcttttctggaaggaaaaaagaagctttatgttattaaggggaaaagaaaaaatgagaagaaagaaaaaatagaaccagcgagagagaca

SEQ ID NO: 60709 - DNA, 2275 bp, Bovine  19866880855794
gaaatggcatccgctccgtattcttgcctgggaaatcccatgcacagaggagcctggcgggctatagtccatggggttgcaaagagtcagagacgacttagagactgagcacacatacacgtaccaatgatgataatggcagctctttgacagtcaactcattcagctgcctctaaagtacctgcccagttcaggatgataaaatcagcattggcagaaaccaaggcccagttcctgctgtttcttctgacatgtgcgtgcagcctgttcatctaattagctcttcccagttaactaagcctcaaagtgggtattagaacatggcactgtacacagttcaggattagtgccttagctgttatcatcactcttgtcttctgggatggagccggccttgagaagcattaatcattgggtgtgtaatgatgtgcagtttggtgctagtggaagccaggccatggagccagagcctctcctatgattctgctcccctacaccatgcaagaccttagtctttgaatttaacctcctttgagctttggttttagctttgtttttgtttaggaaatgtacgtaaataagtagtacctattacataaggatattctgaagattaaacgagattgcaaggaaagtacatggcgtggtccctggctcacaggaggccctgcacacattccagttcttagtattcttgtaccttccgcacagaactgtgagagtaaaaggaggaggtaacccatggaaacccccagttcagggtcctgcatgcagtaggcacaaaatacctgcttttacacacttgccaataatcctgaatattttcattgtcttgaaagtagtaacaaaggagtttaataatccataatcaaaaaataaagtctttcttgatggtgatagggtttgcactatgggaggcgaaagcttcgggaggtgatgtgtaagtgagcaggttgacctgagagacaggttaggggggatctttgtttctggaaggttagtgatgtcgtgccttacgctggcctcagtactctgtgaaagggttgactatgtgggtgggctgtttgttttaagcttttggaacagaagtttacacagtagtagaacaaaccaccagcttcaacaattaccaatattttgagatcttacttcatctctcttccctcccctggatacacacacacacacatacacacacaccctgttcctctctctctttctttttttcccctgccgccctcttttttttccttctgaaagaatttaaaacacatcccagacatcatgtcattttgccattaaatactttagtatgcatctttcactgataagcattttttaaacataaccaccattacgttcttagatgatttcttgatgagatcaagcagaatatagcagtaatcagtagtggaatgcttatgctgaaaatgagcatttttatgcaaagtattaaatttagtccaattcagcaagtgtgttaatgtcttttatgtacaaggcactgtatgcacagtgcacacagatgaatcaagtcgggggtcccagacccagtgaagggccctaatgaaggtccgtgaggcagacagacatgtaactgaaattcaaggcaatgttcaaggaaagtccttagagagcagggagcctggcaggtggtagggtctctctgaacgtttgctgaataagaagtagagatgggatgggctggtgagttcaaaggaagccttcctgttcagtaggagaggctgtttctgtctgttcagagtgaggtctgtgtaccttggaccatgaggaacaggcccaatctctgccaacagtttttaaaaattgtgaaacagcaataaaggaggatttccacacatgcaccaaaacaaaaaggaaataagaacccatgcacacccctaccagtcggatgcagtgacgtcctatcttctccagcagtgtaagtctgaaagacgatctccaaggctgggggatagttcagatgacctttgagcatcctctaaaccaggggtccccaacttccaggcctcagaccggtatcctgttagatcaccagtggcattgggttagaaataaagtgcataataagtgtaatgtacttgagtcattccaaaaccacctccccccctttcacagtccatggaagcattgtcttccccgaaatcagtccctggtgccaaaaaagattaggggccactgctttaaaccaccgtaacttacgcccttgtaagttcacaaaaatcccacgtgtctgttgttttttaattaggtt

SEQ ID NO: 60710 - DNA, 1182 bp, Bovine  19866880856938
ggtcgcaaagagttggacatgatcgagcaactgaacaacaataaattgtggagaagtgactagacaaaggaaaaggggtgtttgggcttctaggaagctatgggaaggtgactaggaaaagtatggtagtaaaggttattgagtcaggcttgttatgcagacagtcagtgctgtctccagcaataagagtcatctctggcaattaaaatttttctcctctttctggtgctggagagagagaaatctttataaatgtaaatttgttacccttccaaggggaaatttatgccctgttttcaggcagaaatgggagggcagagtttctcctgtatatgctatttcttaattgccttcagctcaaaataacctgtaagccaaagtggtatgtttgggggtggcttattatgatcctcttcatcagctaaggaagttctgatttccaacagagcagtgctggaaaatatgaagcagaaataaaaaaattaaacataaaaactcacactctttaatgtctctctaaaactatagaaaagtcaactttatttacgaatccacctcctactcccacactgctttatatccccattgccactgctctagtttaagctctcagttctctgctggactatttcaatagcctactaacttatttctcttttccattattttctttctttacaccagcctataaaacctcgttagattacttttccataaatataactgtcagtgtgtctgtcactctccctctcagaagcctagaaggagccatttatggcttctcattccctactgggataaagtctaaacttatttttattttccatgctcttttcaatctgagttccaaaatatccttgccactcgagtatcccgtattcccttacctgaatatactgctccatttagactattaatattttattaaaaggcccttaaccattgcatgctcctgacatgtgtcatgcttgtcacttgaaatatacaacctcgtaatgtatttctccacactcttaagtagcatctctccctgccccctagcactgaccccctgccctatctatactgccaattgtttacattacccctttagctcttgctgctgctaagttgcttcagtcatgcccaactctgtgcaaccccatggactgcagccaaccaggcttctctgtccatgggatt

SEQ ID NO: 60711 - DNA, 1584 bp, Bovine  19866880948092
tggttgggaggattaaatagcttgtcccatgtgacaccaccgggctagaccagctgaggctcagaccagccttgcttcctgaacagctgttctggacaggagcccagatcaaggagccagggcttcactcacagacccaccacttggcttcagccttgctcaacaactcagactaacacggcttttatgggcagagggtggttgttgtacatcctgtaatgactataaatccctctataattcaggctgtcgtcattcagcttagcaataatgcccttgtattccaagtccttctaaaatgccaggtaccttgctaggacattgcagatctcatctcatggtggtgatggtttagtctttcagtagtgtctgactcttgcgatcccatggaccgtagccccccagcctcctctgtccatgggattttccagacaagaatattggagtgagttgccatttccttctccaaatattatctcatataatcttccaaacaacatggagtgtagggactatgatcacttccacttacagattaggaaacggagcctcagacacactaagtagcctccccatggtcatttgaaatgagcgagtacgctcctaaccatcagctgcagcgcctctgatgagatggagtccgcctacgggcccagtgctggccgccttagcttacagcatgaagccaatcttccctgagggccccctggaaaaggtacggggatccttcggtctccgtcagagccaggtgggccgcttcttccacatcgtggtcctggcgtgttgcttggcctggatgagtctagctggagtgctggcttcccaccgggatctgcacctaacagatctcagaagcctgaccagcctccagcctcgggggctctgaggggtgttccgagtagccctgaggttcctgcttgatcagattgtggctgatgggagctgtgctgtccagggtgcaatccctgaagagctccggaatgaagagaggactagagactgcaggaagcttcccaggcatgtagaagacactctattgaaaagagcagtgataccgtgtgtgccattgcctctgggcattccaggcccagtacgcttcagaccaaatactgggaagtgggccctgtttgtggaggacagagggaagcagttcacacctggctccagcagagttggtgcatttcatttgacctctttcatgaaatgtttctaagaaatgcaaaatgagacattctgagagttgggtatttttccatttggcaaagatctatgatttatatggcccctgtgacacctcgctcactctagtcttttccttcttcctccacccacactccctgtcagcccagctcaggatgagggcttagattggctgttcacgcttagctcacaaggccttgcccccttggtgcaaggggaaaccatgggagactaccagagagaggagaatccctgcattcacccagagcttgcatcataagctcctaggccagcaaaggttcttaaaaagtaagaggagggaggcagagtcctgccttgtcctctccaggagccaggagatgccagaagggacctcaatcgaca

SEQ ID NO: 60712 - DNA, 2310 bp, Bovine  19866880952849
tttcccataaaaggcactgtggaatttctccactccgggtgtgcacgccccacacctcccatcctccagcaagggtgctctccaagcagaccacgatcgcctccccagcccgtgagccacaaccaaagtgagttgcagtctgtgacttctaacgcagccaggctgcctgatgtctgcagtctctggcccccttccccgatcaccgcttctccaggaagggaataaaagtgtgcacacgaggactgggtgatatagcacagattccctctcagagcacgtgcccatgtcagatgtcaagcagtcactgtggccgtgtcttgtacaagcagcttcctgcttgagacactcttggtttcttatgtgcctggtggacacttgcccactgtattgggagtagcagtgaaataaaagccttgacttgaccccaggtgtcatctagtgctgaatgggaaagaggctatttggtgcggtatgacagcgcgaccaaatgtggccatcccaattcaaccagttccccttcatcccccaccagaacaactgacatccactccccaggctccaggtgcaaagctggacccacggcctactggtagatttgtataaggaattgaaatctctatgcacagacttcaataagaagcaccagaaaacataacctcatttgcagttttacttccttggttcttcagacaggttcatggtgaagcatccttgaaaagaggggggatccataaagacgggaggttccacgagtctgtcaggcaacatgcaaaaggagcaggctgagacacaactcggtcgaagcaaaccccaggtcttaaatgaccatgattaaaaggtcaggccccaccctcagctggcagtcatgctagttgtactttgagggaagtgggggagaaagaaaaagaaaaaaacagtttacagttaaggttctaaagcgatagatggtgagaaggcacctggctgcaatgttggcaccgtgctgtttgcggtcccgcccgcccgcccgcccgccttctcccagcctcttagacttgttaaaccctgtcaagctctggcaggaagctctgaggtctaaaccgcaaagtctctgtacattcaggacttcctgtgagagctcacagagggttgagctgctcttttctctgaaccagggcttctattgttttaacacccagagttaattattaagaataatgatgaatgaaagcccatcgcctcctgaaattctaacatggagtctagtcaagtgacagtcatcatgagatccactaggaagagaaaggaagagaaagagaaaggcccccctttctccttcctcgttgcaatcctgtgccattccatcagccatcctgccagaataactcctaacccattcccttcctgaagccctccccggcctttccagccctgcgctctgccttttttccaccatcttgtggcatacatatggtacagtgcctgtaactattcaatccctacatcacttactcattcaacaaacatttattgaacttgtactaccttccaggctctgtgctaagtgctagaaacacagaggtgcacacatctttgctttcaaggtgctcaggttgggggagggatggactaattacaggataaatgtaaccgtgtgattaagtctaggttaggggccaatacaggagcccagatgaaggacttagaatctggattggttggcaggactgggtaacccagaaggcttcccggaggaggtggcctttgaattgagttgtaatagtgttcttgcctggagaatcccagggacaggggagcctggtgggctgccgtctatggggtcgcacagagtcggacacgactgaagtgacttagcagcagcagcagcagatgagtcgaaagaactgctgaagcagaggtgtagaattagccctgtagagggagcagcagggggcaaagcccacgctgactgtctgttgaggtaaatgttattcctttatcaactactgtgtttcatcagtttgaagacactattgattttaactggcgccattatttacacaccatttgaaagaaaaagtactctcaattgcactttaacaaatgctaagatacaatcaatttatagtttcaaccctattcctgaggtgttaaaatgtgaaaaaaaaaatgtgtttagaattaatgaaatgcatagttaaaaagcctcctgaggactttggccatttctcagcattgcccctaccactttactgaaaatttcactggccagttgattcagtgggtgagtacagtcttgatgaaagaaaaagaaacaaacatccgtggcat

SEQ ID NO: 60713 - DNA, 2130 bp, Bovine  19866880998044
ttgaccctcttgtaagagtgttctcagcagagacaacaaacaggcagtgtttccccagtccactgcttagacagctgctactgagggggtggggcgcgccccagccctgctggccagcctccttcccttaccctactgctgggtgcgctatccctgttctacacttgcaagggagattccgcaatcccaggctgcagctgtcagaagcctgaaggtatgagggtccgcttcgcttggcatatctctttcctaagtctactccaaatgatacgattttgttcttagccttgaataacaacaataagttgcaccctaaagaccatctttataaaaatgagtaaactttagagaccagttggcagacatggtaaccagagactctgctctgtattctggggtatacgtactgtaactagaggattcaggatgacatgcaatcaaattccacggcatcccactacagaaggaagatactgatgatatgcaagttcagcaaaggctttccctgacacttaccaaggggctttacagtgatcgacaacttctgagtccagctctggtttctggcctggctcccggtcctgtcagacactctgcactcgtacatgccactgtctgtgagggtggtggaggcaatctcaagttggaaggtggcccagtccattttctccagtcttgcatttctgaggttatcgagttccgcataggaagcacccagcttcacggtgccatcctgctccatgccagccacaaacaccggctgtgtctggttttgtgggacatgccaccaggccacagtcaggagattctcagctccatctgccttgcagagaagggttaatgcctctccttcccacactgcttgctgccggttcttggtagacacgaccacatttcttgctgtggattacaggttttagaagaaaaagatattttgagtaaatgaaaagttttctaaaaaacagtgaactctcattaattaagacttgactactttgtgacaaatccaatcaaattgttcactcttgcaccatcccccagaataaaagatttaatcaacacttaaatagtagaaatggcagaaagaacaccagaagaactaatttacatgtaaacaatttacagtttgccctaagttttagtgatttgttccttaggcacatctagttgggaaaacacatggtattattttgttaaattaattagagttggtgtatgagactgaaagtaatgaagctgtgtttatttcaatgtttagttttctagaattcagactttcacagttcaaaatgaccttcctctccttacttatctttccctaattagtatgtatctgaacagtgaagaagtactgttaattatatttctgttcaaaatactgccattaaaaagcaattacttgaagagggcgtggagaaaagagaatcctcttacactggtggtaggaatataaattgatacagaccctatggagaacagtatggaggttccttaaaaactgaaaatagaactactgtatgactcagaaatcccactcctgggcacataccagagaaaaccataattacaaaagatacatgcaccccaatgctcattgcagcaccatttacaacaggcaagacatggaagccacctaaatgtccattaacagagaaaagggtgaagcacatgtggcacatatatacaacgtaatatcactcagccataaaaaggaatgaaattgtgccacttgccgagacttggatggacctagagctgtcatacagaatgaagaaagtcagaagttgaaaaacaaatactgtgtattaatgcgtatatgtggagtctagaaaaatagtacagatgaatctatttgcaaagcagaaacaaacacacatatgtagagaacaagcatatggacaccaagaggggaaacaaggggtgggatgaattgggagactgggattgacatatatactctgctatgtataaaacagataactaacaaggacctctgttggggcacagagaactctactcaatgctccgtggtgacaaaaggggatatgtgtatatgtatagctggttagcttttctgattattagcttttctgctaatatgctaatatgtatatatatggatatggatag

SEQ ID NO: 60714 - DNA, 781 bp, Bovine  19866881007134
atttttgccagctgaaaatacagatgttaacaccaaaaaccagtccttccctttcaattaattgtagtttcaagccatttcactttcagctttttcttcactatccatccactttacaacaatttctctgattgctatatactccacggtaccaagagatgccatttttccctctgtactttcaatatatccagtatgttgtggtatgcatcgtagaagagatcaggaaattttattgacagcagtaatttcataatttatgaatgtttgtgtgtttgtcccagatattcaagattaaagcagtccagttggctgagaaactccttcctgcctttaacacacctacgggaattccttgggcaatggtgaatctgaaaaggtaaattctatttttatatggttattcttgttctgaatatattagattaactgattttttgagccttcaccatactttttaagacttaaaactgtttttctctgcatgtatacagaagcatatttctttaaagcattgcctgatttttaaaatacattctttgctttgaaacagtaaaactatatttcatttctactgcttgtttctataagtctagatttctctcccacacctttattgttaacagtatagttgtttctttaagattgcttatttatgtctacttagtgctggaatggattcaaagtgctttccctctcttccttttttgtacactacttgttttttttctaagtcagaatagaacacaacataccttaaaatcagggcttcctgttgctg

SEQ ID NO: 60715 - DNA, 1540 bp, Bovine  19866881083871
cacagagatctttccttttacatggagactctggaattgtggcattaaatgataagaaaggataagggctgacagcatatcccacaaacaaacaaaatgcctccttcaagatagttgtaccatactgaaacctgaacagcctccagaggatagctattttcaagacaacaaatatatagctttaggttacacaaatacatatgatcatacatacatgacttttttttgctttaaaaatgaattatgtattcaaaacagataaaagatgaatatcaaagattatagggttttacacaaattaaaattgagatcaaggggtaacaattatgatccatgggccaaatctagtcctccatgttccagaaaataaagttttactggaaaacagccaccgacacccctttctttacatgttttctatacttgctttgatggctcaacagcagaactgagtatagagacagagactatatggttcacaacgcctgaaatattcaccatctggctctctggaggaaagcatgctgatccacagatcacagacaacatgacctgaatgagctgaaggaacagaaaatcatcttcatcaatgttctggaaccaagtacattaaaatatctccagatcatatttggttactcaaatattctgcttaaaatctgtgcagccaaaagtagttaacaacagtgttcattaattaacagagacaatactaaaaatctttctgtgtatcattgtatttatgtatatatctatataaacagtgcattaagatatgagctagccaatccgagtgtaaggaaacctaaagaaaaataagaactcaaaataccattactaggaactgttattaggaacttagaaatatttcagtatattcttcttttatatttaacagcatgagaccattactaggaaccacagcagagtgtaaacaatttacaactaactgcaaattttacccatttaattatgtgacaaaattttttgaatataaaataaccagcatttctataaaacattaacttttaattatgtaattaaagtgataatagcaaaataagaatgtttttatttctaaagtagatattttaatcaaagttgcatcagaaatcaagtatttcttttgacatttttcaagagactttagttattaactacaattatagctgttagtagtatatagtaacacattgtttaaaatatattataaaccatttcttctttaatttaaaggaaatataaaattaaggactttgtaacatgaatcatactgaaaaaacacttaaaatggtatgaacaactcttatacagaaaatgccactggaatcacaaagtgttctaacacttgaaagtgccgagcacagtgcttggcacacattaggtatgctgtgcttgttcactcactcactcactcactcactcattcataaggaatccacgcctaaggagaaactccaagggcaagcacaacaaattttaccaacaaatttgaagttctgacaaagactttggcaatggagaatgggagaggagatgt

SEQ ID NO: 60716 - DNA, 2916 bp, Bovine  19866881100492
agataatatacaactgctttatttcccaagaattaaaacgtgtgtttgtaccactctggattttattccacaggtcagagaaccagtctgcttaaggattaataccatctaaaactaaagagcccttaggatgctgaaacatttaggtgattgagccgagattttcttttccttgcagatgttttggtattgcctatacactgtttttaacagctttactgaagaatagacaccatagaattcacctatttaaagtgtatagttccccgagtcttaggaaatgtatacagttgtgcagccattaccacaaccaagttttagaacaattccatcatatacgttatgtctgaccacctccatggacaaataatttattggctcattaacctgtggatttaaaccactgagctttaggacctagcctacgcattcatttttgaatacatcaagttttgaagcaaaacaaactcaaagtctcaactttactcaaaataaggctccataaagcacattgtgtccaaagggctctccaacagtctataggctaattaaggatataaacaatatacacacactaatgtatatattttgaaaagtgtatattgtataatcctctatgtgtgttagtcagtgtggactgtgaccaaatttatgggagaaataatcccccattctgtgatttggctgtgcaccctttcatggggtttgacctgagacactagcttgaatacttgacagaggaagagttccctccttaatgggacatttaagaggccctgattttgtcttgtttcaaaaaggcatttttaaagaaataattaaattatcatgccccttgtcctgtaaatccaatattcatgttatacttctcctaatatagcatttattaaacatatgaatagaaatctctcaatgcaagaattacaatctgggtataatgaaactgtctctatttgcttttttactcctttcctatttctacatttatctataggtgtttcagaagggataattatgtataaacttactctactttgattccagacacatctttaatcctaagagtttactgggatctccagtcatcatgccattcaaatgctattacactgttatgtaagtgttcagtatgtgctagaccagtctcctccaaatactgatcaagttctttgtggttagaacagccgtcttaaactttatatgtgaataaatagattgtatatttcctaagcacctagtccacattgagtatacaaaaggctatttattaagaaattgtttaattcttaataaacaagaagaattgtttgttctcaggtttgtctcccgtcctctggctccctacgacatttacattcaccatttagctcagatttcctagaaccttgcagattttcctgtcctactgtctctgtaaatacagttacacacgccacaccatatgtctgtacatatggtcctcaatagttgtaagattaagccgtctctcttgccatgtctgattcctattcctccctttttgttgactaagagatctgattacgatttcaaatcgtcccctttcttttaattacatcctctatttttaatattacaaacgcataccaatagaaaaagtctgacaatacaaaatgtacagtataaaactccctttcaccaaaggcgatccattcctcctgttgtttccactttgacatttctaactcaggtctcctacattgggtgcctagagaacatacaggacacacaggaggcagttttctgaacaatgtcggccaactgccaactcactaattctctgacctggggggactcactcaaacttttgaatctcggggtccttaaaatgctgcgcatcccaccaggttgtcaagacagacgtgtatggataaggactatgttgtgggttctagagaggtctttagatccgctctaccacagactttgtcagttcaccgcttagctataaaggacgccccaacggccatcactcgcaccccgcttcgcctccacatgcaaatccagtgcctcttcctgaggcggcggcttctctgggactcccctccctagtgatcgagcgcggaggcggagcgcccaccagcgctaggacccggctggcatcccgaagaccgcgaagctctaggcgctctcggcctcggggagaagagtcttctttgtagagctcctctctgcagtctgtaatgcctgcttcctctagggatgcctctaggtcttaaatgcgtgcaaggtagagtcgaccagttccttcctcgcaaagcttccctcctccggaaagccccgccaacctccaaaactcactctagcttcagccacgccccaccggccaaagaccaggtttcccccgccccatttttgatttcggcgcgccgcgaatctcagggcggccgtgtttggttggaggtgagcacatttcccgtctgattggctgatagtagttagggtgggtgtggctaaagccgcggcggtgaattatgggggattaagagtggaggaggtgggtgacgattggttcctgaatgaggagggcggagaaaaaggcggaagcaggcgttgggagaggcggtggcttcggagaagacaaaagctggagcgagatggaagtagttaggtgtccggagcatggtaggaggtcagggtccaagggtccaaggggtctgccagcctatcgtggtgtaatcgttgtcgaccttctctccttagggactttatgtctcctgaagaccggcgtccgagaaggcccgaataaagggaagagcttctacgtgtgccgggcggacacatgcagctttgtgcgggccaccgagtaggtctccgagctaggcacaattccctgggtcttcgcgtggccactcaggaggagtcgccggccccccgctgcccaaaaggactaggaga

SEQ ID NO: 60717 - DNA, 1475 bp, Bovine  19866881125688
ttgggagaattgcagtaaaacatgtataatatcatttaagaaacaaatcgccagtccaggttcaatgcaggatacagaacgcttgggggctggtgcactgggatgacccagagggatggtatggggagggaggtgggaagggggcttcaggatggggaacacgtggacacccatggtggatgcatgttgatgtatggtaaaaccaatacaatgttgtaaagtaaaaaaaagagtaattggtttcaagtgacctttcaaagctgttatcaaataattataaaagggtttcttgaattaaaaacaagttcatctttcattttaatggattttcacaagcttgattatttgtgttttatactttatcaggttgttcttccgatgtgttaaaagtaaagctgaggggaagcagtggtgtggaaatatcccatggcaggtaggaattattcacctgttttcagatctgactgtgtaaagatgtttaacctgtgggatcaccttaaaagaccctaaagtccattgtaaactgattggtcttcatcgtactttctctgaaagacagttctcttctttcagcaaggtagaccctgttgggactcttaattcaaaggactatggatcttttttttttttacttttaattttatattggaatatgactagttaacaaacaatgttgtggtagttgtaggtgaacagcgaagggactcagtcatacataaacatctgtccattctatagttaataatagtagtgttaatcacacagttgtgtccgattcttctcgaccccatgtactatatagcctgctaggctcctctgtccatggaattttccatgcaagaatattggagtgggtatccattcccttctccaggggatcttccccacccagggattgaacccaggtctcctgcattgcaggcagattctttaccatctgaaccaccagggaagcccattctatagttagcattctcctatttagggaaaaaatttaaatttagttgactaacatcaggattttttttttaatatttatttatttggctattcttatcttagttgtagcatataggatctttagttatgacatgtgggatctattcactgaccagagattgaacccagaccccctgcattgggagcatgaaggcttagccaccagaccaccagggaagtcccaacatgtttttatagactgatatctagttgatgtttgtataaactgggtgtaattcataagcttctggaatgtaagaactaggagagaccctgcagatgtctactacatgaggaactagactgagggaggtcttgagacttgtagagggatagcttggacataaggccctagatttgcactgtgaaaccatcctaaagccaaaatcagagctgtttaggtttggggaaaagttcatcttgagagagtcgttttcagaaaaatacacattgggctattgctattattaaaagtt

SEQ ID NO: 60718 - DNA, 1096 bp, Bovine  19866881158042
tgctgctgaagcatcttctggaaatgtttctcctccggggtgagaataaggaggaacgggaaatacaggtatgattaggaaaaggactagtaatcaaccttgtgttgacttttgtctcactctgcttgtgcacccggctgatgaaatgctaatgtgggctttgtgggcaatcgggggacggttataaatagagctggcttaagaataaaataaaatggctttgccgcacacccaacattgtctggggaaaggtggtgtctagttatgaacattctatatttttccacctgacactcctccttcctgttttcctttcaggatttcagacaaaagatagagggagactctttcagtccatgtaaaactggccatgtagtccttccaccagttacaactgtacaaaacatgagcctcagtacaggtctgaacactggggtttacaaaacttggatttatataaaatagagtatagtaatgaaggccatggatgatggagtctaatttcccagggatgagcccttggatgagatccttgatagtgagcctttgtttccctatctatgaaacacagaaattattacctccctcagagggctgctgtgggcattaaatgaggtcatacactcagtatcaattatcattggtacatgattaacaaaggttttaggaggcaggtacagaatacagaactctggcaatggcaaggccagagcaaatgccaaggagtatcagattacagaatcatttaactactacatttgaaagggactttggggattgtgccaaccctcatttagtgccagaagctcttcccttccctcttctctccttaagtggttgctcaaccccaggtgcacacccacacacagttgacgcggggctgcaggctcaggccagcgcgacaattctgtcggaaagtttctctctatggcgaatctaaacctaacctctagcactttcacctaccggctttgttgcttcccgggtgatggagaacaggcccatacagcctacttcgttttggaatgatcatcactacagttagtcctctctactaactattcttcaaaaggcttctcttctaatcacaccacca

SEQ ID NO: 60719 - DNA, 1103 bp, Bovine  19866881186806
atttctaaaaagcagcaaactgcatctccaccttcagcactgaggaggacgcctacagtaaaagagaagggacagaggaaagaactgtttccacaggagaagcagcacgaatgcccacgaccccaggaaggggacctttccatctctgatgcttgaaaagactcctgttatctgcggttctgaccctacttccccagcagggtccacgcctcacctccacactggggtttgcacccgggatctgttcgtcttgtttcgctgtgggaatctccttggccaggaggctgtaggtggtgatcacgatgtcatacgtggacaggctgcagatataacacaaagcaaaagataaaccatccagcatgactctgacaaaataagacagagttgatttccttcacaaaaatccctccagcagaactcattaatttgtgtcaattcacacacacacactcacacacactctgaagaggtaaattttacactcttgacttccttatcacttaccactggtcatttttagagactactcactgtaactagaacagcccccctcttcccagccaagtcacaaaggatcatctctggctggggtcaaattaagcttgatgaaatctgacaagaacagaaagttgggcaggattggaatttaatatttagttaatttgacacagatgattctaaagtcccaaggaagtaagaaaactctgaagtcatgttcatcttatatcaatggtgctttctccccattgttctgtaatggattcgtgaaaacccattcatctagctttgatatttgggcacaaaaatacatgctgtacactttcagctcacctcgcctatactctttacatgtaaagattcttaatgaaaagcacaaatctttctccaaggaaccttaatattgtggacctgagagaacttcagtaaatactttcaataaagacgacatgcgaatttggacaggcagtgatgcctacttgttgcctgagcatcatataaaggtatatgattgagaatgattcctatcagtcagctagtgcactcaggacaccaaacccagtacaatcaaaatgcaaatcatataagatggaactgacttctaa

SEQ ID NO: 60720 - DNA, 937 bp, Bovine  19866881248445
gggaagctcttacactgtctccaaagtcctactacttttaagacccagcttctattctacttccttcatggagactaacctagtttcccctaactgatattatcactatttttttttttttttttttttaccttctatatctctttcaaggcacttacattctgctttctagaatagtaatttctgtatttaattatccctttcccctaatacagacacatatagatttgttatgagtaatttatggtaagggagttttattcgtctgtgtctaatactgtgcctggtacattgttctcattttatctctattgcattgagttgaattgatatcctcaatacagccatgctgaattctgtatctattttgctgatatactgggtattggaattcttccagttgcaaaacacagatgaaccaagacaaaagggcagcatcaataaggaaaatagataataatacctcacatattaaggcatcaggaggtagggaggcgcccaggttgaattcagtggctcagtgatgtctggaaagccctcccctcgtccatgtgggctgcccttaggcctggcctcagtgtggctgctgcagtcccaggttctacacacagataaccctgggaagccaagaagagaaatcattcttcctatgattctctctctctttttaaatgttttatcttgtactggagtatagccaactaacaatgtggtgatattttcaggtgaacagcaaagggactcagtcatacatatacatgtatctattctcccctaaacttccctctcatccaagctgccatgtaacattaaacagagttccatgtgctatacaagtaggtccttgttgattctccattttattttttttttaaactttttattttgtactggggtatagctcattgaaaatagctatacccaagaacaaaataaa

SEQ ID NO: 60721 - DNA, 1195 bp, Bovine  19866881249953
cagtttttagcaatgatgaataaagctagaaatatacttgtgtacatctttttagtgcatgtaggcattcatttctcttgggtaaatgcaaggaatggaattactaggtcatagggtcattgtatgtttacttttattagaaactacaaaaattattttacaaaatagttgtgcagacttatactctcctcagcaatgtattgaattccaattcctccaaattcttacatgagcatttccttttttttcaattttatttttttaaccacactgtgtggcacgtgggatcctagttccccgaccagggatagaacctgtaccccctgcactggaagcatggagtcttaagcactgggccagcagggaagcccctgtcttacgagcatctgatattgtcagtcttttcaattttagccatcttgatgtaatgaatttgagttttcatttgagggttatttataacttatgaacttattaataattccttatccaatgtgatcctccatcttagtaagtggtttaatgtgataaatatgcttctagtcaaaacatctctatctggcagtcagagctgcagaatgaggtgcagaaggagacttggattcaaacatgacatggtaggaactccaaatttctaatgtaaaatcaagtatcgaaagataaatagaaaaccagttaagataatgaacaatgtaactctatcttgtccctacacttatcagtaggaaattggttaacaaatatttactaaacgcttcccaggtggctcagtggtaagaaaaaaaaatctgcctgccaatgttggagccatgggttcaatccctgggtcaggaagatcccctggaggaggaagtggcaacccactccagtattcttgcctagagaaatcccatggacagaggagcttgctgggctaaagtccatgaagttgcaaagagctggacaagactgagtgactaagcacacatactagctacctctgtgagcttgatcgaatacttgaaactttctgataattttgttaagtgttcaaaatcttcacaaaaattggtattatcttcattatataacttgggaaagcagagatagtttgctgaggatggctaccttgctttatcatggtacaaccacagccctcaccccaaaccctctccatcacccaagctgctgctttttttaaagtttatttattttt

SEQ ID NO: 60722 - DNA, 2872 bp, Bovine  19866881250728
tggcccttggtctgggacttcccgcctccgaactgggagggaataaatttccgttgcttaagcccccagtttatggtgtttgttacggcagccagagcagactgatacaaattcccaggctaattatttgctatctgccatagcatttgttttccaaatgtgccatttgcactcaaatctacatgtaaattgaattagctaattaatacaggtataaaatacctcaggataggagtccctggtgacttcattttccattaattcctgtatatttatatgtcttcccttggaactcctggattaaactatattggcttctcatttaactgtaaagcactcagacagttctatctaaatgttctcctgtccctgttaccttgatatcctgaccatttcctgaaactttacacctatctatccctaaattagcctcttggactgtgggcccaaaaaaatgaccccattttgtagcaaagcccatgctttcatttcatttccataccctgcctttctgctgttatgttaaaaaattaggacttaaatgtaagtaactggtttcctttacaggagcaaaaaggattaaaatggccaatttctcgatgatgataaggatgatatctaacatttacaaatattcatttaatccttatgacaaatgctatgacataagggacagtctctccatgtttatggatgagggaagtgagggaaagagattaaccaccaaaaattacacatccagtgagtgatgtcatcaggatttgaatttaggcatctaaatccagatctcacattcctgactattaagttaccagaagaattcatggggcatgccatctaaaaagacccaaaaatcaaagtggaagaccctaagaaggagtagttagcagcctggattttgtctcagtacagtttacttctcaggaggatttatatgttgactatttcttttgtatagaagggttactaaatatgacctcgccatttagccttctgttgccaggtgggaagtctcctggtttacttcatttgaatgattcatgcttcataccatactgaataccttccatcaatcaagaaaaaggtttaacaaactcacagacgtagagaacacacttgagggtgttaaggggaggtcgagtagaagagggatggattgggagtttgggattagcagatgcaaactagtatatagagaatgaataaacacaaggtcctgctgtatagcacaagagactatgttcactatcctgtgataaaccataatggaaaagaaaatgaaaaagaatatatatatatgtttaacagaatcattttcctgtatagcagaaattaatacaacattgtaaatcaactataattcaatataaattttaaaataaaaataaaatttaaacaaattcacttgtttcaagtgaagagtttagacgtgtgtgttaggcgctgacattagacggagccaggaaccctcattcagtatggatgctaaaggccagcccacaggcacttcagactcttgtaacactgctcaatttttttcttccatggtgatgctttttacacaagcatcctcatttgccaattttaaggctaaaagatatttggcccacacgtgggaaaaaaagggcaccctaacacttggatccttttattgggctgattctatcttggatatggagaacagaagaatcttcaaataatttcctgctgctagcagtgtggtacaaatagctgttgttggacagaccattaaacaatacaaagattcccttaagacagtcttaagaactcatagcatctgcctttagtcatgggagactataacaaaacatgctctcgtgtgtctatttgaacagcatcatcaggcaatgcagagtagccatttaatcaacttgcactgagctgaatggagatctgtgggaaccagggcaaagagggcaatgggatcccctggtcctccagtccaaattcatctcccctttgtagagctaactggcctcagagagcaagcggcaaagaagcacatggcattgttttctgtcccagccatcctctcactaccttgtaaatatagatcttcactggtgatcagactgtggaatctccacagctagaggaggcatgctgtgacagagcattgtttttggaggccaagctcgtgctctgccccttaacgcctggtgaccttaggcataatgtttaactgctttttcctggtttgtggtttaatttccatttctttgcaggttatcataaagatctagtcatcatcactcatgaacccctttcttctttcctctttgaagaaatggatgatgtcagttatttctgcatgtctagctccaatggcaccccactccagtactcttgcctggaaaatcccatggatggaggagcctggtgggctgcagtccatggggttattaagagtcggacacaactgagcgacttcactttcacttttcactttcatgcactggagaaggaaatggcaacccactccagtcttcttgcctggagaatcccagggatgggggagcctggtgggctgccatctatggggtcgcacagagccggacacgactgaaacgacttagcagcagcagctcctagtgtatgtcttggcttatgttagacatcaaaaagtgcttgtaaaatgtgtgtctcatttctctcatatgttaaaatacctctctatatgttggtcatctagttgattcttaaatgctttttaaagagaaagatgtttttttaaaaaactcaggtttaggttatttacatataagctatctattaagttatgtattagtattattagtattaagttcagttatttacatacaataaagactcaatcttaagaggactcatt

SEQ ID NO: 60723 - DNA, 1712 bp, Bovine  19866881328195
taaaaactgcaatttggcacggagcagaaataaaaccccaaactcgggattcacatattctcgcataccctgtcaagctggaataaagattaaagatttaagttggacagctaccagtcaggacttatttcctccccaatgggctgtatagattggcactcaaggaatattttttataattatcagtgataatctgataacagaataacagaccagtttgtcgtttttaatttctatgcctccccttaccatcatcactgcttagacattttgtgttagtctttaaaatgtaaatttacctacagctcttcattctgcctattctaatgcctgtcaagcagagatgaaaggaaactgtacccaggcaagtctgagatctccgtctcaatcgtaaaatcttctgtggaaccttgcactacttgagcaaggcagatctgagctcttgatatggttagaaaatgtgacctactttaaaacccagcagtgtgtgtgtgatgaaatgaaagtgaattgttttgctgaaatctgacactaaaaatagggcaccggatccttcccctgctggaaaaaaaaaaaaaggcatttaaatgagtgtgtgtctgtatgtctgggaatatgtctccatggcaaccattgtcccacctcccctatcaacagcattacccctctctacagaaagaggtcatatgaatgcctttcccagcacccctcccaatcccttactccatgaaatctaattaaagagtgaaatgaattttagtgatggtcctagaggctggggagaagtccaagattgggggtggtaagggaggataactgaaggggagacacacggagacctgcccttccgcactggagcagcagctcgcaactccgttctcatttttaaaaagagccacagctcccacgctgaggagctgtaagggggtgataaacctgccatgcaacgatgttattactttaatggatacaggactggtggagcactttatttccaccagggctttttactgttgtctcttcttcccttttcacaacatccagttttcctcaaacacaccccctcccctttagtaaggaaacttgtccccatttccaatcccactctggtgaagaggaaagaaagcattacttgaatcgtaggtctgtctctagaacaagatatgtaagacagtcacactagtgaacagcccctgccctcccccaacctcaaatactcttctttcgtgaagattagaagccagaaaagaatcggggtaggggatggagaggtaaggattgaggaagatactctggcgagattgaagctgatgtgtgcaaatgagcttgaggttttgttttttttttcctagcctctgctggggacctcccttgttccttttcagcagctgcctctcgtccttcctcctctcctcacccttcgtgtccagtcagcagcagcctcagtcactcgcctcccacactgaccatcctgcccttggtctgtctgggcatctgttcctcattcctgcatccagatgttttctccaggttggatgtcagtcccctgtcatgctgcatggggtctcagctggagcagaactgtcctcccgtgaggatacgggcaggtctgggcttgtcctgctgggaagagcgaggtggctggcaagaaaacaggtggggcctcctgggaataagggcagagtcagccacacacagtctggggctcatca

SEQ ID NO: 60724 - DNA, 1018 bp, Bovine  19866881343274
acaactgaacagcaggaatggatggtgggtgcttttttaaaatcttgagtggatggattactggacagctgtgcatatggggctttcacaattatagggataagattgaggctgagagctgctttatcataatgctccatggagcaggtgggtctggaaagctgtttgagccaagagcaggaaaaagcacttcaggtgagaaaatgaccagcgcagcatctcagatatggggagtaaatcagcatgtgcgggtggtgtgctgtttggggattagctgacttaaggtggaaaaggaaaacagacctcagggtttgtggaaattaaactctggggccaggaggttggtggaggggaagaacgggagcagagtcaccctgaaaggtgtcagcagcatttttggtgcccacagagcagctaagaacccacatacatgaggctggcaaggtccactggggcccacaggaagctactctgctaaattaaggtgataagtcaggccataatcttatttttggttgtttcttaggaggaaaatggctcacaaaacaattgccgatgttccccttaggtagtgtatcagagcatttcttcaaaggactatcgcctgataagagacacagataagtttcagaggaaggatgggaagttttagatggttttctctgggaccaaagctaatgcaatcatgtggtctattcatcagagtcccactttaataacagtttatcccacaaactagttctttctgaacatcaatatgagtcccagaaagcttagtgttgaacctggcttctaagtacctggggatggtgcttctgttgctgcgtctgtggagtgtcccagaggcacgaggtggtatgcactgcccaactgcaccttcaggatccacagacctaatgggaattaccccacagcactgtggtcctaagaaaatggcacaggtaagacaagctctgtgttctctctggtgtgttcactgacagtgtgttaagtctcggaacaaagaagtacaaaatca

SEQ ID NO: 60725 - DNA, 1388 bp, Bovine  19866881392376
tactgttaaaaaatgaatacttaagtactgttaagaaataaaaaaaataaaaaaatagaaacgagtttggcagtcctttctagagcaagaaatgatcccaggaacatttagaaaaactggactgcttttactgtgtttccatttcctctaaagaaaggccttctaggtgtgaaggttgcattcatattttatattaagattagattatttcctttgtcttttaggatcctaattctaaagaacattctggagccagtaagtctcagcttgcctctgagtcatcgcattatccttccagccaccagagaaacccgttcaaggtacttgataagaatcaagaaccatccgtctggaaacagttcatcaaaggtgaagatgaggaaaagacagctgataagaagcaaagagaaaagggagatccactcctggatcaaaagaaggaacagaagccagaatctaagtgttggatggagaaggagctctcatctggcctgggagtaaagaaaaaacaatctgcagttcaagacaagcagcaaagggagaagacagagtttcagtgtgaagcaaaggagatagaggggatgcacaaaagaaaccttttagagatgaaatccaaacaggtccgtggaaatgtgctcagagaaccatctgcatttcaggtgaagtcagatagtgagagtcattctgtccagaaagaatcagaacctccgacagaagaggaaactaagcctttgcctccaattgttcacagtcaacactcaataagccagcccctgaaagaggagcacctcaacaaggagcaccctaagagctgggaggctagagaaacaaagacagggaatgacccaagcacacagaccctccaaaagagtctgctccagggccattttcaggctcagtcggagacccgggacatgcctgctccaaaggaaccagctgctcagcctgcaccactggccacggggcatcccgcaggagaggggcgagacgctggcacaagcagtggtgacagtgaggacgatgacgttgtttttgtttcgtctaagccaaggagccccttactctttgacttgcctccagacacacaggagaagaagaaccttgaactccctggtcagagtgtgcaaagaaaagtgtcttcagccccgggtgtttccaagaagggagagccttcagacccagcagcccaacgtgtgttcctcacaacacaactgcaacaaaggaaggtaactactacctgtgtgtgtctataaggtcggagcatcgcttctgtgggcaggtagggtccgccacgggcaagtgagatgtatcagtgtaaggaaggtctcacaggtggatgtttagtttctgccttttgctgtgcttatatgttcaggattgtaaatcag

SEQ ID NO: 60726 - DNA, 800 bp, Bovine  19866881524513
ttttacatacattccccctctcttcctaaggatgtccttcgaggcaaatattgtttaccatatgaaaactgagactccaaatatttgggacttattcaatgtcatgcagccagaaagttgcagagtcaggcttcgaacaaggtgcctctggctctagatcccatgttctttccatcatcccagcactcttcctgcagaagcacactctacacaatcgtatttcgacccagtaacccacatgtgaaagagacacagctccatgagcagaagcaagaagcaattggtagaaggtgtgctctggatggggcagtgatgaggtgggtggttgacggagacagaaggaagaaaagagaatgtaggtgacctggaaatacctctctctcttatactgggtttattttaagactagtcagggttgccatcgcctaacaatttccttataaatcaccctcgcagctaaatattatcctaaaaatttaccggcccacaaatttttgttaaccagtctgctacaaatattatacagatggcagactaaataaaacccatcagtagttacgactagcctccctgaaatggtaagtggccttgggcttacagggactcagctttgagaagacagccttaaataatgaacaggaagatgaaacagacactctgtctccagacaccgcgtggccctgcaagttagcatcccagatgctgccgatactcttggtttgcaaactctctttttcatgaaacaaggggtagggcagacacccatcatcgtaataaaataatggcaccagctaatttcc

SEQ ID NO: 60727 - DNA, 2139 bp, Bovine  19866881753071
tcaagcacacaatcaagttttaacgcaaccacaaggagttgtgggggcccaaagaacctgagctctgtgtcacacaattccagggggcaccattcagtcagctcctctgtcaagcagctgatgttagctatctcatagtatttcttttttttttttctcatagtatttctttgttcctttagcacaaaggtaaaatctctaaccctgggttcctaggtgcctctctcatcttagtctacagccttctctctcgggccctaaccttgggggctgactttcttctggttaataccttacttttgtttataggtagcaaaactctttcagggtttttgttttgttttgttgatggctgtgctgggtcttggttgccaggacgcaccttctgtattgcagtgagtgggggccgccctccagttggggggcgcgagtttctccttgtggtggtttccttgttgtgcagcttcagtagtcgcagctcgtgggctctaggaagcaggcttagtcattgtggtgcgcagggtcagtggggtcagttgccctgcagcatgcggaatgatcccagaccagggatcgaacccacgtctcctgcactggcaggcagattcttaaccactggaccaccagggaagtccttcaagtactttatatcacacgaaactcaatattcttggaaagggatcaggcaattattagagtcctgttttacaaaagaggaaagtgaggatcagagagatcaccaaatgccaatggtcacgtgagtaggaaaaagcagaggtcctgactcctgctttattgtttcttccatcagaacaagagagcgtaggaaataaatagactaaccctaatagttgctatagatggctctctggtcctattctgggtactctgggaaggctcacctgtgctcatcaataagtccttccaagtcccacgtgacatcctccatgctcctcctctccttctctggtctccacgggtcctctgatgttctgctgctggtacctgtggtgaagagcactgagctcactactcctcagtgccagagccgcattctggatcaggagaggaagcaggagaagtcggggaatattccgaaggtccctagggcaaatggagctgccactagaaaatgggaggtgctgagacaagtttgtgggtctgactcattaggatgcttctttttccagtaatcctttcttccatggcctttcttggcccttcatgcaaatagtctcctggaagcctgtccctttaatcttccagatatgcccagatgactagatttcagtcagagctggattaataagatccagccaagcaactgcccagggtaacagaacactgctgttataaattggaacgattgccacttaatttagatttcccctgaagtcatgtgactattggtctgtctccacaaaacacacagcacccttgagtagtaaatttaaaaacagtctgtcaaaacagataaacagcaaagtactactgtgtagcacagggaactttactcagtatcctatgataaaccataatggaaaataatataaaaaggaatatacataaataaatatatatataattggatcacttagtgtatatcagaaactaacacaacactgttaatcaactatacttaaattaaaaaaaaaaaaaaaaacaagacaaaaaactcactctgccaaattgacctacctctgtggattgtacacagaagtgccacatacacttgcctgatgcagccatatctgaagttagcagtcacgattacatgaataccaaacctgaacaggggcaaatagtgctacttactaagatcaagtcagctaattgtttttatttaaattgcaaaccctttcatactcccatgatgaagttgtcatgtttagaaaattataaaagaaaatggaagtgagaataagaacatcagaaaagtggaaaatattttaccaggtttttttggtacaaagactctgttttggccagtaggtataaattaacaataggatccattttctgtacgcaatttttattaacagaagaatcagtttatccatggaataccagaataagtgttgaacaaatatttcaaaactaacaagttgaagggacatcaactcattaatctggccgggt

SEQ ID NO: 60728 - DNA, 1226 bp, Bovine  19866881766600
tactgaagagtaagtaccgaatcctctaggataagcaaacatgagttcagaaccagatggtgatggcgtgtttgtgcccgtgcccctgtgcatctgcagtgcacacaggctgctgctccacacagggacagaggacccagctgcaacagtggtcagtggaggccctgagagcagacggccagatcctttgactacctaaccaactgagaaatgtacttgtgtacatgcagtttacatgtggtgtcatctctatgtaatatacaggacctttaaagtacttatacagttattacattttaaaagcagagatagaaataagaaaaactctctagaatatggaaatttctggaatttcagaaacatggaaaactgtctactatggtggctgaagtctgaatttgttacagatcttccttcagaaaataatattttaattatttgggtctaccctgtagttatgttctcaacattaacaaaaacaatcattaggtttaaactaacatttttagactttgagctgccaccataaaactgtttctaatcacaggccaagctaatcttatatttaaaggaaaaaaatgatcacttctagttagcatattcagtgtcagaaatgatactataggaaagtaacagttttccaaaaaattaaatatgaccaaaggcatcctttcatggctgaaaaacttccactccccactgctttccacccacacgtgacttaggaagcagcaggcaagcaagacacttgggaataccatttttggaaagccaagtcaaagccgtggtttcgtccttttctttgcttttcttttgggtcagaatgagtgcaatcattgtcagggtttttcctaaccccatatcatccgctggaaaatgaaaacaaaaataagagaggtaattactttgggcaaggaatcagttcaacttcaagagatgcggtccggggtagacaccagcctggtccccctgctgtcagcaccactccagtcgctgtgctttgcctcctctaaggaagtctttgtcttgttaaaatgaacactaaccgttgccattttttttgcgatctaggtcacagacatttattatgacctctgtaaaatttaaaacttattatttagatcttatttgagtccctgtgttttattgtcacttatccagtacattcattggtatctctctcagtttgatgatgttgcctgtgtgtatgctagtctctcagtcgt

SEQ ID NO: 60729 - DNA, 1029 bp, Bovine  19866881782830
ttcctgctgttagttgtaactggttagtttccctttggactccacttcctaatccctatgtcattttcagtgtcagaaacatgatagtgttagccattcagttgtgtccagttctttgcaaccccgtgcccaccaggctcttctgtccatggaattgcccaggcaagaatactagaatgggttgccatttccttctccaggggatcttcccaacccagggattgaacccaggtctcctgcattgcaggcagattctttatcatatgagccaccagggaagaccagaaacatagtaaagagtcccgaaatgctgctgaagtgtgaaaaaaataaggccataagaaaaagcaggagtgttgtatattaacagttgggcacaacatattcattcacatctgtgttcacttgaccaatgtgaccaagcacctgtcatgtgccaggctctgggctgggcactatggtcttcagctggaacttcctgcatggatttcccaatcaaagatgatggactataatgccttctaataaataaaacatttgggtgtgccagccttgagaaaatggaaagatgaaaagctgtgccaaaagtggttaggttttgcctttttttaactcctcaccacagcataagccaagtagcagcatgcaggacagacattaaatcagctaacattctgttctgaggacatcctagagggacaatgcatttataaagcactatcctctgctttgcctccaggatagctcatgacagcaagccacttcaaacacagtggagaattcactcccagagggtccttgctgcaactgtgtccgactctgtacaactctatggactgcagcccaccaggctcctttgtccatgggattctccaggcaacaatactggagtgggttgccatgccctgctctagggaatcttccagactcagggatcgaacatgcatctcttatgtctcctgcattggcaggcaggttctttaccacaagcaccacctgggaagcttgatgagggtccttgatgagcct

SEQ ID NO: 60730 - DNA, 1082 bp, Bovine  19866881847076
cccctcctctttctcccggggaatggggcagtgtcgggtgccaaaactgtgccaagtatgtattaataaactctgaaccatattggcagctttgtggttttctgcagccttttgcagcctggaaaacgttttcctattagaagcccctgctgttttatctattacacgtgaaaccgaataagtctccacacatccactgggagttggggagtagcatcagagtgtgcagccaggggaaaggaattaaaaagggagctaatgtcatccgtggggaatcgcgggtggggggtgggggtggggggatttgggggaccggtttcccaaggagaagggtctgcggcaggatttttcgccatgtgttgcggccactcaagcaggagcacgcgcctgctgtccgcgcgccccccaacatataaaaggcagctgcacggaatgttacacatgggctgacttacagggagaaaaatttttatctcacaaggcagatttgatttcccgagaccatatgcttgcttgtctttttccccgaagagcccacgatctcatgcgggaaaaattcagttttattggctcttggagaagagggaattggaaatgttagctaaatagagaccgcatggaccagaatctctgagcactcccccggggctgtggaggagtgtcaggctatgaaactgcagatccgaggacagaaatgcaaaaccgagaagagctgtggctgggagcaaggcagtgtgggctctggtccctgctctgttgctcacgacctccgaaccacgctctgcctgtgatgtggggggtggacgcgattcgccccgtttgtgttgcaaaaccgacgtataagtgttgcacaaggggcaccatatgcgacactgacttgggacttaacaggggtagttgcaggccagatattgttattattaatatttgaagacaacttacactctgaccaaagctaaggtatttgtccagtttttaagcaactattacttgaacactgtattaggactctctgtctacaagtggcatcaagtcaaatgaaaatgccttattcataatagggaaggattacttcattcatt

SEQ ID NO: 60731 - DNA, 1225 bp, Bovine  19866881933983
ttgccttgattcatggacctgacattccggttcctatgcaatattgctctttacagcatcggaccttgcttctatcaccagtcacctccacagctgggtattgtgtttgctttggctccaacccttcattctttctggagttatttatccactgatctccagtagcatattgggcacctaataggtactaaataagaacttactgaacacaagaaattgattaagtaataagtgaaattttaaaaaactcaatgagtaaaataagtgaataggtggaattaaaacaggtgtctctgactcaaaagctgcactaataaaggaattctgaatcattactagaatgtttgatttcttttataaacataaaaggaacaagaaaaataattatataataaacctgatgtgtaaattttgaatttataatagacaaggtaatattattacttatttcagttcacacagagtatacacagaactgtgataaattatatcatgtaagatttcatagtcttcaaaggatactttaatattctactttatttgagcttaatggcaacccatggggtgaaatagagaaggtatttttcaggtgaggaaaccaaggatcaaagaagaactaaggacacacccagagttgtatagagccagggagagaacagaagccaagaattctgagttcaggttcagaattcctccctctctacgggtgacctctgatggcaggcttcagtcatttgactgatggtgaaaatgtactatgagttttatttcctgtctgatagacttcctaaatccctttctgacaacaggtagtagggtcccaggcctctcaagacccaaagcaaggaacccccttcagagtcaagattccattcccttaaccttcctagcaaacaattggccctaagattgattcagaggcctcactgtctcaaattttagagtcacctttctgaagactgtagccagagagggtttaggcagggcaaggacaaagcaagatgggaagagaggtagtgtgaaggggtatagatggaggcagacagacctagggtcaaattctagctctgcctactcacttttccatacagatgtccagttattccagcatcatcccttgaaaacaattctctttcctcattgggctgttatagtgcctttgttgaaaatcattgactgtataaaggtcttattctgggcactcgttggttccacctccagcaca

SEQ ID NO: 60732 - DNA, 1333 bp, Bovine  19866881934278
ctctaatgcctttttaacttttaactttctatgattcaaataaggagacttaatttgtttccttctttctagattctccttttcaattccaaactagtttctcatcttacctctttaaaaacttgaataacatttctccaattcagaaaccagcatgattccaattctgctttcctcatgtatgggggtggcaggggtcccaagtaagacctaaacacattctccaggaagataacaacaggtgggcctgtctgtgcccatctgggctgcctggagaacaaatgacaatccctggcaacggtgcctggtgcagcaatccctaactggcatgattgaaaaagcaaaactgggacagattatgatactttctcctagcaacacatgatcatttgcttcatatctaggaaggatgctgctatgctcctggtgttgacactatgagcggtgagtccaagactacgtgttaagcatgtatctaacataattagaaaatttctttgccttttcctttaggagtaatggttctccttctttgccaatgctgagatatccttggacgtgaacaagtatgtctgaaatacagtattttgaagagataaaactcttcgttgagtaaagtagctcttagccatgagaaaaagccctactcccagtttccatggaaacagacattaggttaacaataaagtgaacaaactatttcaaatagtcatttgaatcctgccttgctcaggaatacagggccatcaactcagcctataccattttgatctgtatctatatacacatatgcacagaggcagctccacaatacgaaaggaacacactcattatgaggtcaggttttactgcccctctggtctccctgcgatgcagggacaactcaagaaaaatccataactgttaccagtgcatgtccagaagaaaaagatggtttcctccagtcaggtttagaccgacaacctccagccaagagagaaattagcataaccttcaaaaggaagcacaccattcactttacacagattcggtctcataaagcatctctcctcctgttacaggttcaataccaagaccaacacaaataagcaacatgttcttatcaaatttccttctgcagttataaaggcactgtttcaaaactttgagatgctattttccctgcctcacctttgagaagattttcatttaaccttgttttggtgagtcaatctcaagacattaattgcgtgcccgccaaatatatgaatactaccatttagaggactgcagctggtcagttcaatacactttccatcaaccagatactgtctaatccaccagtcccccccca

SEQ ID NO: 60733 - DNA, 1096 bp, Bovine  19866882029823
ctcagtctaaggtggatggcagtgttgcaggaaagaaccaattctgactccttgttggatctgtttctttgactttaacctttgcttttcattccttttcttattataatcatacataatgccttgcctcagcgaaccctgtccttccggctgactgttaactaaaagtgcttttgttcagctcacagggagataatctagccctgcccacctgtgaatggctgcaagaaagaagaggtgaacacatcccctccctgaggctggccattccaggagatatttgcaacataatagcctttttgctttacttcctcaactcttccccagcatacagaccccaacaagatggctattttgagacattagtctgccatcatctcagtcagcctgctttccaaataaagttgtattccttgccttagtatctcatctctgattttattggcctgtggtagcagaccaagcttggactcagtaacagcagggatgctacaaaagacttttgttccagggaagtgttttagggttcattacatgaccatgtcctgccctcaagcaattctcatttagtggttcagggaaggagggccttgcagactgaaatcacctttatcagtaattatgacctacagctagaattgagaacccatggaattggttaatgagatgggagtcattaatctctctggttaaaagaaaaaggtgaagaatgcttgacatcagtaatggtgaggataatgataatagtaataaaattagttgaatgaatgaatgcttcagtgaaatcttgggacttaaatgctcccagactatttggttatttcattagaaataaacatagttccctacctttgctgtgccagagtcttgccaagaaacccatctcatttttggagagtaacaacttgggacttctgtgtctcttacccataattgacttgcagctctatgccctttggtccatcttccctccaggttttatttagattgctctctggtgttcttttttctatatttgtgcagtactcagtttgattgcttggggttaatggtttctccccagctctgcatttatctctatgaggaatttccactt

SEQ ID NO: 60734 - DNA, 964 bp, Bovine  19866880484182
ccgtactttagatacattacctatactgtgaaatgccacaaaagagaacacaggggctcatagcaacagaggcagaataaatgcctcagtgagattccaagagcattagtcatttgacagcttgtgcttgctcacgacaaagcaagggcaagctcaatacctcctgatacactgaaggacaggagcagacaaaaggctgataccagggcctgatatttaagaacaaatgacaactcttaaaatgtgctgtagctctgaaatgctcaagaaaatatgaaagtaattttccaagcctatttcttgatgtttcttttttaaaagaaacatgatctctggagcttttgattaaagaatggtggaatcattctttttaattcactctgatttcacctccaaagggacacccaacttccctttatccctggttgactcacatcaagccagaagaaggcaaaaaaaagtcaagtgaatttgaagagctcttttcaaaattgacatatacttcggtactcaactatactgtaaaaaaaaaaaagcaaaaacggaaagcgatggtccttatcagccatgggataagtcagaagaatttttagaaaaaaaaattaagtttgaatagtgtaacatggaacatacaccactcttcctgtcatatggaataactcttaagtcaagcatcagatatgcatacttcaaagacccctccccttgtgtatctgcatttgctcatgtctctagggtgtggtggctcagagtgtaaagaatctgcctgcaatgtgggagacctgagttcgatccctgggtctggaagatcccctgaagaaggaatgacaacccactccagtactcttgcctggagaattccatggacggaggagcctgatgggctgtatagtgcatggcgtcgcaaagagtcgcacacaactgagtaactcacacacacacacacacacacacacacactagg

SEQ ID NO: 60735 - DNA, 1827 bp, Bovine  19866880546640
ttttctaactcagaaagaggattgccagggatcaaggctgcacatttggtaaatattagacttcagaaactcaatgttgaattggggctccttgatcactgttgagctgatggatgacagtcgaagaacaaaggtgttgcccatgtggatttcaaatgatgattgagtagaagaccctgtttcaaattgatgcataacttctaataacactggttggctttttaggagttaagcagcatcagatctaggatttctcaaatgtatcagaattctccagcaaagctcatcttttcattttctcttccatgcaaaagaaactttctagtagtcagaactcttgcctggaaaatcccatgaacggaggagcctggtgggctgcagtccatggggtcgatgggagtcggacacgactgagggacttcacttttgcttttcactttcatacattggagaaggaaatggcaacccactccagtgttcttgcctggagaatcccagggacgggggagcctggtgggctgccgtctacggggtcacacagagttggacacgactgaagcgacttagcagcagcagcagcagcagtagtcagaaattgattgcagttcactctggcaggcacccacgtgcttcttaatcatcaaaagagaatgaattgttagaaacacaagtggccatggatttgagagatttcattagtattttttactgcaacatgattcctttaattgtctgacatgacaaagacatgttcttccatctttccagcatagagtccacggtatgttatgttcctttggcacaaaagcaaataattgagtgcagtatccactacttctgaaatatatctctgacttttttcctctgtagtgcttaaggttgatacagcttttatttttacagagtgcaaatttgagttgttcccaggttgagaaatattttccatgaaggactatggaaagtaaaataaaaatgatgttgacttaggtattttggtacttacacatgaaagaaagcttttaggagattatttcttaaaaaaaaaaaaaaaaaacagctttccaggatttcttagtaatcataatctagcctaaaattttcgagaaattttcaggaaaaaaaaaaatgcctccagctttttggactgaaagccaagttgagtgttgtttggaacatcagtcttgaaggagctttgccactaggattgctgtaaatgaggtgatgcttgccaggctgctcaagtaacacctcagctaaacaagtgtccctgtgtctttccaacatttttatgagaaaacaacccatttatttctttggttggaaaaaaaaaaggtcttactgccaatccactcaataaagaaagctttggaggaaaattcctggtaagtaagaagccaatttctttcttccctttcttcctgagttccctgcaatttggtctctaccaccaccatccctggtggctcagtgggtaaagaactgcctgcgatgctgcagacatgggtttgacctctgggtcaggtagattccctggaggaggaaatgacaacccactccagtattcttgcctggagaatccttggacacaggagtctggcgggctatagttcaaggagtcatgatcagacacaacagtgtgacttgcacacgcacacacacacgacatactcacatttacttttcatctcattgcctgtctccatccaatcacgtagttctatcaaggcagagatctttgttttgttcactactctatcctagaccaaggacagtgcctgatgcagagtagttgctgaataaatatttattaacagttaaacagcataa

SEQ ID NO: 60736 - DNA, 754 bp, Bovine  19866880604623
attttcagcttctatttattatgtggcaaaaccaagatgtctatttatgatgtagaatattaagctcatagaagataactgacttggtgagtgtatggttaagaatctgtctccaaaattttaaccttttctattgcattaatttcctattctaacaaataataatgcatattctatgctttggcattttttgacaatttaaatatgtttccatcgtatgactcaaccttttgtaggaacattttacagaattatttttaaataactgtacaggaagtaaatattcctaggcttcaggctgcagtcagtaagaacagtggttggttcagattgactttcagagaattaaaattatacaccatgaaactccacagttagctctgcaattaaaaacgcacttcttcactcaggaaatgattatttcatttcaaaaggaaaagaagaagcagcagctaactaaatcccaaaggatctagcaaaactctcactgattccagtgttacaaatctatctcaaaattttatatgattacctcttctacttcaaaaaaaaaaaaaaaaaaagaaagcacaaattaaaggaaacttactgtaagaaaaatagtggcgatgggacaccaaggtcttaataatgaacttagtagctttaaaaatgctcacattgagacaataaaaaataggaaaacaagacagctattttcgaagagaataaattatcgatttaaaaatccgcatgcaacagcatggggttgtat

SEQ ID NO: 60737 - DNA, 2135 bp, Bovine  19866880672020
atcagttaatagctctattttgtacattatctcttcatactttgtcttcgcaaaagatcttatggctaaatcttccgttagccaatttggtttcagctgcttttctttgacagtctctaaggtgatatttattaatattaagacctattctttttccaatttcaggctcctcagcagatcactctacttttagggattaatggtccgtatcattccacctttttcatcagtttagattcatcttagtatttttagctgcttggcctttgctgctaaactacagggtgcattagagcatgaccttggatatggggctgttttcagaaacaaaactcaggattcatccgtggcttgtaagaggaaccccagggactgtgaagtggagaaataagtaaattaacaaagagtgatgaagaaataccctaaaactccaaatcttcttattgatgcttatgtgccctgcagtccctgtcgggcctgctacatagaagatatattaaaaatagttttaagtatgtacaaacactgctacatttaaaatggagaaaaacaaggacctgctggagagcacaggggactctgctcagtgctatgtggcagcctgggtgggagtggggtttgggggagaaaggatacatgtgtacgtgtggctgagtcccttcgctgtccacctgaaactatcacagcattgttcgtgaattggctatatcctaacacaaagtaaaaaaaaaaaaaaaatcccctggacagaggagcctggtaggctacagtccatggggtcacaaagagtcggacacgattgaacgacttcactttcactttctttcaacacaaagtaaaaaaaaaaagcatgtacaagaaaagacggggaaaatgtcaaagtgccgacggcacagccatacccccagcctgtcgtcatgtttctctgaccccgttcactcgacagcactgcttgagcatctgctgtgtgtctggcgtgagtcactgagaatatagccagtgagcaaggtagggtggcgtctttccttcccctggtttacacctcacctcgctactcaaaaccgtaccatgcgggcagcaaataaagacgatgcttttacaacaaaggaagaaatctgggattttttcctaaagtagaattattcggtgtttgataaaatgctaaaggaaatcaaccctgaatattcattggaaggactgatgctgaagctgaggctccagtactctgccacctgatgcaaagagccgactcattggaaaagaccctgatgctgggaaagattgagggcaggaagagaaggggacagaggatgagatggctggatggcatcaccaactcaatggacatgagtttgaggcaactctgggagatagtgcaggacagggaagcctggcgtgctgcagtccgtggggtcacagagagtctgacttgacttggcaactgaacaatagcgacacaaatactcagtgtacacttcagcgaccagaccacggtttctcttttcaggtaaggaacaggagcccctttgctggcgtaagatgcacgcgagcactcctgaacacagagctggcactgactgcaggaaggaatcttcgagggtgtcattatcagggaagaccccctaggactgccctcggggccatgaatgactgaagaagaccggcttccttctcgggccgttgtcagtatcagctgggtggtgaccttgtgtgctgggcagctccgtgctgtcctacaagtttataaccttggcagcaggatgttacatccttaggactcagcatatggacacgttcactcacaaagtactgattttctccctttttttccactgtcatggatatcggcaccaaaaagcattttgggaatgaaataattgattcaaaaccattgtcaatacagtttcaaaaagacacaaaattcaaactagtccattgaaatgggtattgaaatgtgcatgaataaaagatttcataggaaatgtggttggaattattggctagaatcaggcttggggttttctgtaatttaaaattatttacgctgcttagtaatcatcgatggaacctttgctatttgccgatgtcgcctcacaccctggggacccagagatgggtggaggcatggccgctgc

SEQ ID NO: 60738 - DNA, 719 bp, Bovine  19866880695014
cttgacgtgtgttacttaggggtactatgtcttactgactgcactacatcagcagttaactgagaatgcaaactctgacacattgaggcagacacttggcaccacggctttctccccatgattcatttttaaagccaacaaacatgaaagtcaaacgatgggtgggagaggcaagagaaattttgcaaaatttatggtacaatccgaatctgccagagatgtaagagaggagtgatcagtaataaagatcatataggaccataatcacttgtgttactacaacacaggaagatgtaacttgtgaccccttgctcccatcatcttaagattaatatgtacattcctttaaggtcatgggaggtgcttatacaatatgtctagtatgtcacaagttttacaaataatatgtatcgattattctgttacactgatatttttcttggttattgaataaatatgggttgaactctataatgacacaggagaggtgggttcgatccccgagtcaggaagatcccttggagaagggcatggcaacccattgcagtactcttgtctagagaatttcagggacagaggagcctggagggctacagtccatggggtctcaaagagttggacacgactgaagcgatttaacatgcacacaggcatgaactctataatgggtccagctttgtgctgggcacttctggaccacattttctatacttcataca

SEQ ID NO: 60739 - DNA, 1039 bp, Bovine  19866880721460
agactgggcgctgggctgcgggagggggagggggaaatggacgctaaacttagagtgagaaacgtgaccttccgtagatgaaaactgacccagtgtgagctggctggtggaccgtgcccctctgccccacggcctttgtctctccctgggtgtttgaaaggtgtgttcaagttgtgtttatgagacaggaaatacatgttttagcaggaaataaatctgtccctgcatgcacagatggctgcgtatttcattatgttgggagccaacagtgcccctttcacctgcgtttctacttctgattctatcacatcaacacaacctcccagaccaaggtctcatagctggttttctggacgactccaggtcacgtttacagagcaaaatttcctgagtgattatcggcgggtaagttcctcgctcagatgcacggttaacaacttctctcgtttcaagggcgagagtcacagtggttgacaagccgagaggaggtttggggccaagacattttcagttcattttagaaatacgagtctgaggagaggccgagcagctttaagctcctcagacacgttgttgtgggtgtcttcatctctgcgtcatcgagtcactcaaacaagcagcaagtcagactgccataaaaaaagaatgaaataatgccatctgcagcaacgtggatgggcctagtgacgctcacgttaagtgaaggaagtcggatcgagaaagaagtacgatatcatttacatgtggaatccaaaatgcgacacaaatgagcctatctatgaaacagactcacagccatagacaacagtctggtggttgccaagggggcggggatgtgaggaagggaaaggctgagagactgggataagcagatgcaaactattgtatgcaggatggataagcaacaggtcctcctaccgtatcatgcagggaactataccatacttgctatcttgtaagaaaccataatggaaaagaatatgtgtgtgtgtgtgtgtaactgaatcactttgctgtacagcagaaactaataagactt

SEQ ID NO: 60740 - DNA, 1202 bp, Bovine  19866880749950
aaggagtgcttcacactgtggctatgtagtcacaactctgaaacagagagttcctccccatagacgcatctgtctgacagctctgaccgagttaccttgataaagtctccataaagcgggcatctttctctgagacttctgaaaccttccacactagagaaaagaacccccgaattccaaattatcccttgcacatagatgcctccatgggattgtagctgtggttgtggaaccagcttcccctgtcagcctcctcctgcccgaggttctctaattgataacgagctccttgggggagcgggatttcagagtgtaagttaataatcgttttccaaggatggcacctgactcttaataacttatcaactaccttgtgtgtgatctttaggaataaacttgtcctgtaaaaggcaaatttacaaaaagaaaaaaaaacgttttgagtctgatggtaaatgacacacatttatgatttgcacataagtaaacataaaaaacatttatgatgttttgagtctgacgataattgacacacatacttatgatttgcacataagcaaatcaacaattgtggtgaccctacttaaaaaaaaatatgtgtgtgtgtgtgtgtgtgtgtgtgtggctgagtccctttgctgtccacctgaaactgtcacagctatgaaagtgaaaatgaaagtctctcagccatgtccgactctttgtgacctcatggactatacagtccatgggattctccaggccagaatactggagtgggttccctttcccttctccaggggatcctcccaacccagggatggaacccaggtctcccacattgcaggcagatactttaccaactgagccacaagggaagtcctcacagctacacttcaatataaaagttgaaataaacaataccaaagtataaaaaataaaaataaaaaacaccatctatgttgtctaagacaacttgttgagtttaaaagtatttcagactaacagctgagtgtatgtagggcaggtgtttcttaaatccgaactcatagatgctgactttgccaagagaagcttaggaaagtatgctgtgttttagtcagtacgtcatgcctgactctgtgaccccatggactgtagtcggccagcctcctgtgtccctgggatttcccaggcaagaatactgcagcggggtgccatttccttctccaggggatctt

SEQ ID NO: 60741 - DNA, 2274 bp, Bovine  19866880749951
cagccatgtccgactctttgtgacctcatggactatacagtccatgggattctccaggccagaatactggagtgggttccctttcccttctccaggggatcctcccaacccagggatggaacccaggtctcccacattgcaggcagatattttaccaactgagccacaagggaagtcctcacagctacacttcaatataaaagttgaaataaacaataccaaagtataaaaaataaaaataaaaaacaccatctatgttgtctaagacaacttgttgagtttaaaagtatttcagactaacagctgagtgtatgtagggcaggtgtttcttaaatccgaactcatagatgctgactttgccaagagaagcttaggaaagtatgctgtgttttagtcagtacgtcatgcctgactctgtgaccccatggactgtagccggccagcctcctgtgtccctgggatttcccaggcaagaatactgcagcggggtgccatttccttctccaggggatcttcctgacccagggatggaacctgcgtctcctgcattggcaggcaagttccttaccattgagccaccagagaagcccaagaaagtgtttagtgaaactcaaaatagttacaaaaactctgacttatctttaaaaaaaaaaaaaagcgttttaggtttcctggttcgtcctaaatgattctcagtgtttgttgttgctcagtccctaagtcatatctgactctgcaaccccgtggactgcaggacgccaggcttctctgtccctcaccatctcctggagtttgctcaaattctcgtccaccgagtcggccatgccatcccgccatctcatcctctgtcgccctcttctccttctgctttcaatatttctcagcacctgggtctttcccaaggagtcagctctttgcatcaagcggccaaagtaccggagcttcagcttcagcctcagtccttccaatgaatattcagggtggatttcattgttttttataacctgtatttagggaggtggataaggcactggtaataaagcttttttttaaataaataattcagtagccagagagtgtaaagacacccttgaactgctgctgagggttttgttttctgattatgaagggctggaaggcctgatgccccaggctgagtgacttcaccaggtttgtcctgtggttccccattgtcgcccttgaaaagaacattcccacagagcgggctctaaagacaataaacatcgtatgtaaaaagaaatgacataatagtcggagctgataagggagcttttcccaggggctgcgtgggaccgagcccaggaggccgtctgtgcgctgggtgcctggaaggaagtgtccccagggtggtggtcggggccaaggcaggctctgcacaaaggacccagaagtgggcagggccctccccgcctctgtgaaaatcaatccaaggaagtctgaggccgtggagcagtttcctgtcctctgtgtgggaaattcaaccgagtgcaagcggccacaacaatgggacaatatattatcataaacaggaaaaatagcatcagccacggaaatcaatggctggagttcatgaggcattcagaagattgacaagtgaataaattaaaacccaaaggttaggacattgaaagagaagttaattttatgtctgccctggagctccccttttcagactcaaattaagactgtgtagaataaaatgaacatgaagtctttcgatacacagaaaaggcttccttcagacctacatggtcagaaaaccagagaagcttttatgaacgtccccctgcatggatagccgttgtccacgaggcgttaacaacctcctcgacagcgtgaccaaagacttatttaatcgagtttcttgctttaaataaacctgctctcagcaaccaactgttcgtccaggaagtgatgggaccccctccccaataccctgaagaagtttattcaaccagaacggaatggagctgtgagagacacagtgctatttaatttaaagaacccaggaaaaagccacacgagagacctccaaacccccaaataattataaacaacagaacacagctaactctaaaacaggcttcagttccataaacaatgatcaatcctttgccatgccacagtgactttcttttttaaagatgtttttaaaagtatgtttggctttcttttaataataaaatgactttaattagaattcaccactgaaccttggttttgcaagaaagtgtttgacacaccaaattcttt

SEQ ID NO: 60742 - DNA, 1106 bp, Bovine  19866880789425
tttctgtacagcagaaactaacacaacattttaaatcaactatacttgtgtttcctataccttttcttttctagtcatttcttagcacttcagttcttttgtattttacaaacacagggtttttcagtgagttggaaattttaaaatctggcttctcaccacaggtagtttgagaaaaaaaatgatacagagcacatagaaaaaggggaaattaaattctttcattatcttaataccagattggtttatttaagaccatttccagaaaacagactgcaatatttggaaaaatatcaaagagatttagagttatgaatatggttcacatattcacataagtaataagaccaatcagtgaattataaatcaatggtcgtaaaaatgatctctttaactatctttctcctttgtgatataatctttctaattcttcgtggtcattttaaagtgacttctcctccagaacacttagagcaagcgtatttattttagtgtcaatgatcatgctaataatgcctttccaaatctccttctgaagagattattaagctatggagcaattctggtcctgacattgtttacttctaaggtcagtgcagaatcagttgctaggtgctatccatgatcaaaagccttaagtccacacagactgtctcttcacgtccccttatctgcgtccccctcactccgttgcagggcacagttagaagaggctgacaaaggacttggagcgatccctcacacttatttctctaggtttggccctgatgagtatcttcttttatctatcaaaggggacttttcatcaaaatccacatcctgtacacatcctttacaataatacacagtggatggttttccacatgctaaaaacaatgaaaagaactatgaaggagaaaaaaaataaagaactccagaggtcaatagcctgatgggtagaagttcatctcatcttacactctgccctttaacatcctcagggaatgacaaggggacgaactaacagttagtgacttaatatgatggggcttccctgctggctcagacggcagagagtctgcctgcagttcaggagccctgggtgggatccctgggtcaggaagatc

SEQ ID NO: 60743 - DNA, 723 bp, Bovine  19866880800994
atattgttttatataaaatgccctgagttcgactgatcaacttcagttgccgaagtatcaaagtagacgtgtttataaaccaattttaatggaaacactatgatttgggaaagtggaaaagtatacctaggcacctagatgtctatttttcccttcattagttaatttattttgtatttaacaatgttaatttatatttcaaaatagaacaacaagggaaaaaaacattttgtactgcagaaagccatagttttaaaatgtaaaaatctcttgaaaatcctcctgtaacctatttcatattttttgtaagagagcattttatgacaagaacatggatgtggaagggttttaggtatttttgttgaatggctgagctaacgagtgaaaggcattccaggcactctgcacattggtttattgacgtgtacagtggcacagagtttggggagtggtttgacaacatcttaaagtggttagagagtggttagcaaacatcttaaaattattcatcacttttgactcagaaaccccatttctagatatttatgctaaggaaataattacagacatatgcaacaattaagaggaagaatgcttggctgagtgaggtttttttaaataacattaaaaaatgtaaagaatgttaaggtcccaaaataatgctctggccaaataagaatggtccatcatataatgaaatgcatgcaatagttatactttata

SEQ ID NO: 60744 - DNA, 696 bp, Bovine  19866880921357
catttgttgaggacctatgtgagcttccctggtggctcagatggtaaagaatccgcctgcaatgcaggagacctggcttcaatccctgagtcgagaagatcctctggagaaggaaatggcaacccactccaagtattcctgcctggaaaatcctgatggacagatgaagttggctggctacagtcgatgagtttgcaaaaaactggagaaccaactgagggaccaacattttccctttactatgggctagtccctgggaccaggctctttcacatcatttcactcacctggtcctcaatgcaagcacatgatagggagattaaattttcatttcgtggaagaagacagtgaagctgaaatgaactgacttgttcagattcaaacccagaatcacctggttcccagagcctgacctctctccctcaatcacacaacctgtaattctagaatccatggcagaatgttaaaatgggaaggtcatcaagtacaaagctactgggtgtccagggaaatcagaaggttcagaggggaaaatccctgtggacaggatgaaatagatctctttccttgcacctttgaacagacgggagttccggctctgtcattaacctcctgtgagcctccatggagtcctgctctatgttccttttactcatttgtaaacaagattcattcttacccccaactgcttcacgg

SEQ ID NO: 60745 - DNA, 2271 bp, Bovine  19866880990153
aatgaaatgacacctaattttaaaaagtgaaagtctctcagtggtgtctaattcttttcgaggagaaggcgatggcatcccactccagtactcttgcctaaaaaatcccatggacagaggagcctggtgcactgcagtccgctaagagttggacacgactgagtgagttcactttcacttttcactttcatgcattggagaaggaaatggcaacccactccagtgttcttgcctggagaatcccagagaatcccaccagaaaccctggtgggctgccgtctatggggtcacacagagtcggacactactgaagcgacttagcagcagcagccatggagtacacagtccatggaattctccaggccagaatactggagtgggtagccactgttcccttctccaggggatcttccctatccagggatcgaaccaaggtctcccgcattgcagacaaattctttactagctgagccaccctaattaaaaagccctaattaaaaataaccactgaaatatcaacttctccatagaactttactactaacctcaccatctctggtcagttcagtaaatatgcaggaaatctatgtaacatccctccctccatccatctatccatccttcctttcatccatctacctacagggtgagcatatatgtgcagataaatagcacccacaggtacaatatccatctccagctctattttgaaatcccacatcttatattgaaccacctgtcttctgtctcgttgaccatcctctccatcagaccatgggttctttggtgggggaacctgttctttctttagtatttcagaaatggttgtattagttttatttttggctgtcctaggtctttgttgctgtggggtcttctctaggagcggtgcatgggcttctctcgtgtggggtgaggggtctaggacacacaggcttcagtagctgcgactcccaggctctcaagcacaggttcaatggttgtggtgcacaggcctcagttgttccacggcacgtggactccttctggaccagggatcgaacctgtgcctcctgcattgcaggtggattctttaccactgaacccctagagaagcccacctattcttttttcttttcttttttttacaaaattttactacttcacaagttttcaagtcaaactcctcttttactgtaaaatgcaaagtcccccttctccctttctcacaacaggaggggtctgcttaggcccttcaagaaaatagatggaagctctgacgctccacggggttcctggttcatggtttgggaaccgctgctctactgtgtgctgggaatgtgaaagtctctgccctcagactggggtccacgcgggaaccgttggcatccttctgcttgatgtgacgttaggaaagccttccctttaatcggatgaaaacctctcattccataatcagaggaaaaacaaaacaaaacaccctcagcttgcactcacgctctgtggtaggtgtctgctctgccctttgggtcagatggagttgtggtgggtggggatgaccccatcctgaacgagatagtgaactcccctggagaggggagaagcgggctgagaagggagcttggcggtgccagaggtggggttctccaagttcacggttttgaccagggtgtggtctgctccccccgccccgaatgctttgtaactgtttttggctaatggacatgaaagtttgcataaaataggcttatttaatgaagactgcccttgatctttttccaggcccacgatggaaattttcaataagaaaaagtctgcttaataaatgcatttggtaaacattaaattgacttcacccctagtattttttttttttacttttatgtagctttccacaataagttccatctgggaaaagccacattttccggggggtgggagtgaatttcttttcttttattccccggggtagtctgtgaaatcccgtctctctggttcctttgaccttccatgagatgatggggtgatgagggtgctcgtgatgaatcagtagcagtttctgcacgaatattcaatttttaataccgacagttgatttcttgaccagagtgtgcccactggaaagggcaggacctgcagtggattaatgacctaaaatcagtgttcagttttcctctctctctctttcttttttatgttaggttatctcttgaagaaacttagtgtgttagttgctcagtcgtgtccctctttttacgaccccaaggacaatggcccaccaggctcctctgt

SEQ ID NO: 60746 - DNA, 2984 bp, Bovine  19866881038590
cgctgtaggaaaacccaaaccactggtcctcacagtaggctgtcggtcttcctgcttcgataaatgagcgaaaaagagagcaagcccctgtctgctggggggtaaggtcggggtgggaggaatgtttctatccaggggggctgcatgcccggcctcaggacactgaacgacaggggaggaggaggaacctggcagcttgtggtctggatgggggctggcttgttgattagagacctgatacccgtggctgatacgtgcattttagggttggaacaaatcagcaggaatatgcctgacgggatgagaccccgtacgtcgcatagtaatctacgatgcacggaggttagcacttggtaagcacttggtaatgaggccagcacttggtaagatgccatgaaaggtaaaaatcacatcccgtcctcaaggaatttccatcaaaaccagaaggacaaggataatcctaataataccaacaaccctgccaagcatccccgggttgacttcagtctcaaagaagtgtttcctagtctcctgtcctccaatctgacccccaccccaactccacacgccatccacctgcgctgcctccttcctccagggccaacctccccctctctgatccattgcagcccccgagaataaaagcaggtgcccaagatgcttccttcgaagtgaaaagcctttcttcagtcctcccctcccctcctctgccctcctcttctctcctttccaaaagaacactcagcttctgcttgcctcagcctctcactttgtctgcagcctgaagcaaggggtcttctgcccgccaccaacccactacacctgcttttgcaaagcagaggtttccagttgtcacctgagtgggccctttagagtctgcacccagcatggtacttagtacatttgacgtctgatccccttactttagactcatcagctctagcctcaaggtgaaaatcgctacctcactgtgtcacttggcttccaattttgaaatcataatccatccttcaggcttccaccagatgaccttcccacacctcagtcgaaccacggagcacttccagggttaccatcagaagataatgtcaagggctgcgggtgcccatccattcaacagccaggtgcccagtgctggactataccaggcatgggcagtgtgggataacagcccagtccctgcccccatggagcttgcagtccagaggggaaggtagtcaaggagcaaggagaaggaccaagtgtacgcgctgtgatgagggttaccagggaaacgagggctctcacagaaactccaagggtgagaaggtgacgttcaagcgagaactaagatctgggtgatgactcagggaacccagcattcaggatcagtgaagtccctccttcgggagggtgcttggcccgtccaaggaagggcaaggttgaaattgctggacaagaagaggaaagaaggcaagcaagaatgactgaagtaggcaggggcagatcacgcctggtctcggaggccagatcaggaatttagactttattgcaagtgcatctcaaggagatggtgagggacagggaacctggcgtgctgccgtccatgaagtcacaaagagttggacatgacaacacgtgcaaaggtaagcataataagcaggggagacacaaaagctaattttgttttcaacagccttctgcttgcatagtgacacatggaatgtggaacagagcagaaactagctaaaaattaccatcattttccaggcaaatgacaacagcctgaactacagcaatgtccatgaaaatggaaggaaagacacacattcagaggcttggtgaacaagaggaagggagaggaagggatgaaagaggaggccagcgtctctcactggatcaagccggtgggtgggaatgccatcagtgagacgggaaagatggagaggaagagactggggtgggggtgggggcgcagattaagaattcagccttggctatgttaatctggagatgtggagtcagagatgttttgtggataattagaaatatgagtcagaggagagatctgactggatatgtaagtcatctacacaggaatcgtatttatagccatgaggacggatggaatcatccagcaagagggtggcaagtgagaagaatgtgcagaacaaagaaaccccaaacattcaaagtgcaggagaggaaaggacacccaaaaaagatggaggaggaggtgccaatgagaggaggaaacgggagggtggtgtgagaggagccagaggaagagactgtttcaagaaagaggaatcatcctacacgccggtgagaccagggtggggaattaatcacttgagatgggaagagaggtgttgagcaaaagacatctggaaatgtacagctaaatgagaaagcctatgaatagatgatttgggaaggtaaacccacaactagtcagttacatatgaaatatacagacccttgcaaagaatgagacatccagattaaagaaaagcattttttaaggtggatctaaagacactgaacacaatgattgatgtaaaaaagcagactgaattgaaagtattaaagataaggctgtttcagactttgttaagcatttaaggatagcagctcctacaacagcaggggctgctggctcagatggaatctgcccgcaatgcaagagaccctggttccatccctggctccagtattcttgcctggagaattccatggacagaggagcctggcgggctgcagtccacggggtcccaaagagttgaacacgaccaagcatctaacacgcacacatatatatacacgcaatgagcaaaaggatgaactagaaagatacatgcccagattcataagtgctgtcatttctggagagatgcaggtgatgggactaaaaatgggatttaaaaaaaatcacaacagggattccaaacttacctgtaatgtcatgtttttatttaaaaaaattatattaacaacagcaacaa

SEQ ID NO: 60747 - DNA, 1044 bp, Bovine  19866881337799
ccctcctggcgattctggttcctcgataaagtttgagaacctctgggtgagaatatactgtaaacatatgattaaacacacatgacaatttcccaattttgaggtcaaatgaatagctcgcacacacttggttctcgggcttttggcttcctttaaaggcatcacttgggagcctcagtaccacacctcagaccaacttacatcaggagtgctgggagaagaaccatgcatcaatctttaaaaaaaaaaaataaatatatatatatatatacctacccagaagtttcattagaatagaacaactctgatgattcaaagttttttttaaaaaattatgatacaaataggggcttcccaggtgactcagtggtaaagaatccacctgccaatgcaggagacccgggttcgatccctgggtcgggaagcttccctggagaaaggaaatggcaacccactccagtattcttgcctggagaatcccatggacagaggagcctggcgggctgcagtccatggggtcgcagagagtcagacacgactgagcgcacatgcacacatgatagaaatatgctggtttgccctctgttccttgccccaaacacgtaaaacccaaacatccccttaaagatggttcctgttttattctgaaaattataaggcaaagaaatgacagtaaaacttgtgtaaagacattgtacatgtacagggactacacgatatacttgcgagcatgtttacaaatgtagagcttcaagcttgcatttttgaaatttgttttaaaccatctagtcgtgaggccactgaagcgtatttttgccatgacggaatgtatttctacacaaacacacatttttgtcaatagaatataagacttttatcttttcaaagaggtcaagtgttaagtcagaaacatctttcaaaggaaatgtgataaaagtaatgtcaaattcaagcaagtgatctattccagaacaaagtatcccgttttctctcttcaaaggtttctaacaagtaggtattaaacttcatcttaagtttaacaca

SEQ ID NO: 60748 - DNA, 1537 bp, Bovine  19866881371541
tgtgacctgttcagagtctcctagaccttgctagaaaacagtcaccatgataaggcttttgagaagctgtgctgctctctgcattagggttatgcattattaaaaggcatctcattacaatggaaattatgaccttgtcaccaatgctataaatgtcaagaaataccactttcaaagaatatattgtcttgattataaaaagaaacctctttgcttaaaaaaaaaaaaacttactgttttcattgaaatctttttataaaaaagagttgtaacgaatcatggccatttcctaatcatggctagctccttataacatacatacacacacacacacacacacaaaatacaagacaacattgagaagtctgaattttcctctgtaaataatgggcgatttgccaatctaagtactattaaagactatatcatctaaaaaaatagtactcttcaagaaagaagtactctccaaaccttaacatttacacaatttttgttgtatgtggagaaggaaatggcaacccactccagtgttcttgcctggagagtcccagggacgggggagcctggtgggctgccctctacggggtcgcacagagtcggacacaactgaagagacttagcagcagcagcagtatcattattatttcatttttttcttaattactattagtttcttaattgctattacactactatttcttagttttttagaacagatcactttttaagaacctaaatgtctactttggcctcagagacaatattggtacaattgataacattgattcaataccgccaaaataatatcagtggggacttccttggtggtccagtggctaagactcctcgcgccacacgcaggggtcccaggtttgatccctggtcagggaactagatcctgacatgccatacctaagagttcctacgccacaactaaagatcccacatgctgtaatgaagatcaaagaccctgcgtgccgccactaagacccagggcggcccaataaagaaatactgcttttaaaaaagagggctagaggtgccagttgaaaacacaaatgtgccccacttccaccggatcaagatctctcggggtagaggaggaggagtcacttggatagtttttttttttaagaggtcccgggcaattcagtaattatctctgcttgagagagtgggtctccaaagctacggagacacgccacacccctcgtttggcggctggagggccggtagctccaggccggcacggtgggactggagctgcccacacagcagtgagcatccatttagcttcaggaggtcttgctttcctattagcgactcagcatcccgctgccactcttagtggtggaaaagaggggatcagcaggcatgagaagtgtttcggatcctttagttggagggcagttgttgcaaactgtttgatttattatttttttttttaattggaggaaaactgccttacaatgtcatgttggtttctgctatacaactcgaatcagcctgaagtaactcagaaagagaaaaacaaata

SEQ ID NO: 60749 - DNA, 918 bp, Bovine  19866881442874
tcttggctggagatgctgtttgaaaagttaggttgccttgtatcagatccttttctggaatctgttcttcaagttaacctaaaggagactcttccaaacagtgcagggggatgaaaagcccagtgacggtaatccgtcctctcctgtgtccttgaggtgatggtgactcacgagaaggtgtgttcctgcaggtcatcctcggtgaggcagtgatgctgccaccccagtggctgggggcctctctccgcatcccacatgatgctacacacagattcttgtccgttgcgttccatgcaggctgcagtgtttcccacattcagcaatcacacgcagccaaacctcgtccccacggtgcagagccaaggggcccggaggaaaggaaccatcacaggctatcttccatcgtccgacaaaacgaatggtgacttcctctttgaatgtgacacgcgtgctcctggaaagaacatgcgtggtgtcatcttgtcttttcctgaccacagtatggaggaatccaagtcttacgtgtgtcactgatgacagtgagatttctgcaagataattaaaggagttggtggttaccttttcttctctccactgcaaggagagaagttaaaaggcagagccctggtctcgacaggagaagccctgcgtctgctcggctaaaaaccttctgctgcaagaaactctggaggtcagtctggcaagcatcccagacactcagacttcattttttttcctgctgtttttgagctcagcgctaactactgttagcagacagagagctctctgcaattctttcctcagaactagctacaagaaaactaccaattatagccaagaaacagtctttcaaatacacatacacattgtaatgtgggcggaaaccaatggaaacgtttgattgccctttaaggccag

SEQ ID NO: 60750 - DNA, 746 bp, Bovine  19866881446785
cgctacataaggtatctgcattctgtagatatgaaaacagacaagaggtggtcccacgacttcactcacagacgagcaaggcaaaaaccgaaacctcctggcttctgatctcatgtctttccctcgaatcaagctaaggaatgaaactttctgttgacaagaaaaattcagtcctggtcccagaacaaatgttaacattagaaccaagttgtaaattagccgcatggtcagggctggttacacagcagtctctgttttacggccaggtcacgtgacacgctgactagtctgcctttcccatgatgatcctccgtaacgatgaaccagaaaagggattttgttcaagtataatccatctgacaagtgcaaataaatttattcaattgcctatattctaaaactcccccagcaataccaccatcacataaataaaagaagccaagttggaaacaaacctgtaagttcaggaacgctcaatgcttcagaaaatggtgattttaatatctgaccaaattctgagagtgagtgggagtaggggacacatacacacacaaaagaccatctgttacttatttaagcccttcttagacaagaatatattacttttcagggggaaaatattgttctttccagaggaataggaatgtgatataaacaatgagatgagataaagctgtttatatcaaaggatgaatcagattataacactgaaaaatagtacacatttcctgttattgctgctataa

SEQ ID NO: 60751 - DNA, 1040 bp, Bovine  19866881772087
cttttaaaagcaggctataaaatgcccatgtatctttatgaaccctcctttctaactagatagagatactcttctgataatttttgattcgataaaatctagtttttctctgagtcaaggggggaaaaaactctgggcactaaaagcttagatataacaatgttactttttctctgtaaatgattaaatgcaatttcatccatttagttcagtcatactatgattgtggtggcattagatgatgctggttgagagatgcaaagaaaaattaagtagaatgaggttagcaatttatttttaccttctcccagttaaaaattcccaatacattcaaatcaacaataattgcaaaactgtctcctgaagtagaagtagattttactcccaagtcttagcacttgttgtatttcaaagtcagccactaagccttttaaagcttgttggtgactagctgttgcagcagaaatcagaatattaatcttgaggctttatttcagagttcgtggccaataatgaggtgtcatcaggtcagaagactttcagctgtgccatttctcaaggttggggacggagggagggcaggggacacctctagaattaggaccacatgccctacattccttgataagaaggtcctgaggaacacagacattagttttcactgtgagattaaatataacataagttgaaattactcttgagttattttataactgaacttgctgtgaagtttaccgtctgaagtttccattggtactcacatcttaaaacagggttttcccagacagcttacatcattcctaactcaaggcaaaaatcctttcgtggtggaacatataactgtattctttttttttttttttttgaccgagctgcatggtttgtgggatcttagttccctgaccagggattgaacttcggggtctcatcaagggagaatgtcaagtcctaaccactggactgccagggaattccctcttaactgtattttaaagtttagccccattttatttttttaagtttttgctggagtacagttg

SEQ ID NO: 60752 - DNA, 2075 bp, Bovine  19866880633856
ggttcccctgtctggagggggtcttatccttctgttgctgttttcataggcactaaacatagagttcagagtccattggaaaggtggccgagcatgatcagcataaacaggcctaagaaggagtccaggccctatgaattcctccttcaacttcacaggatagcacttcatcttcttaaatgccttaaattccttcttaaaagcctaaagagctttaaaggactctcattctttcataatcaaaaagcttaaaacttatactctaaaattatttctgcaaaatatgtcaaaagcacatttgtcaaatatatcccattgtagagtcaagcattttggaatgcaagaaggtaaccctaatttgaaaagggggcagggcttactgacatgacacagaatgtcacagagtacagtatatttttaataaagttttttagcatctagaatatgctctcacttattggtaggattaaaaatatagctttacacaaggggaaaaaaagcttaagtgctatttagggaaactatatggtgtgctgtgcatttatacagaatcagtacaatttttctttcatgcctgtgacattggtcattaatctttgcaagcagccaagcggaaatctgaggtgtcatccacgcatagcgttatattcatagactactagcagcacattttaaagttcagtttactgaatcattgagcaacttactttctctcaaagaagttcactttgatccatacctgtcaaactggcaatgatcagagatctctactgaattacttttagcagcagaatcatttttcaaagcaagaaagcatacaaatgcattttgaaaaacccttaaaaggcattaaatttgcacagaaatggcatcttaagtgtaataagagttttagcaaatcaagatccaacttctttttgaggatcaatgggtgcgtgaaagttgctcagtcatgtccatctctttgtgaccccatggactgtagcccagcaggctcctccctccctggaattctccaggcaagcacactggagtgggtagccatgcctccttcaggggaatcttctcaacctagggatcaaacccgggtctcctgcattcaagcagattctttaccatctgagccacaatgcaatttcttaatttaggaatctagctggcactgctcagtaacatccagaaaggtctcaaagaattacatcaatttcatgatagttgaatacagccaaacacatcccaaagtgattgcagaagagttgtcttagacacacatggtttatatatgtcttaattattatttttaaaaaatgaaagatattcagaagacctaggtgtaaatctggtctcatcttttgctagctgtgtgatcttggactcagaatatacctctcataatcatctagaaaataatatagcttgctccaccaaacataagaaatgccaataaagttaaaatgaaattacatatatgaacatgaaattccagtcttaaatgcttgttcaagagaagacttgattatcaccctgctacatttttgcctcttcaagtgtcactttccatagtatttcaaggtaaaatggtctgttccacaatcattcctaaactagtttacatacctacttctgattcctaagtatgactctctgtcttgggctccactgcatgtattatggtctcatcctaggatccttctataaggtgatgctcctgccaaagtggacccagaggaaggggttgcacttctctgcttccctgtccttagttttacaaataactaatgcaaggtgtttgcatcagcagattaagaaatattaggcatcttggaggagaaagtacaacatactgtggcagagggaatgagtgagttttaaaccgattcagtgtaccttggctcttgcaagtttatcatagcaacacccattaagaattttccttcaggctagacatctgctggatcattgaaaaagcaagagagttccagaaaaaactctatttctgctttattgactatgccaaagcctttgactatgtggaccacaacaaactctggaaaattctgaaagagatgggaata

SEQ ID NO: 60753 - DNA, 1796 bp, Bovine  19866881144666
tttgaaaaattagttttctagatatattctatgacttgggaaaactgaaaaatcctgactgtcatgtcaggatacatgtcatgtcaaccgaccatgaaagaaggtcaggaaaatactcctcttgcaattacattctcagtattaagatgacctcactgcctctagaatggagctgtgaacttggccttgactgtatagtgccactctcattacgactagtcagtggccagtctctctcaatctctgcccataacagatatgaattgagggttcataggctacattaactctattccaaggaaaacaagttaacctttgtggtcagaggtggccttgctcagttagcagagggtattttcatcagtaatgaagataaaatgtcaagatatcaatagtttttgtaactattatggatgggtaactctctcttattagacgtggctggaaatgatttgtcttccataatagagaaggattacagcatgccagtaaatgatgctgttgggaattacttaaaatagttattccccttggaagttcaatgcctgaggctagataaaaatatgttatctacccatattttaactctattttaaaagtaacccttgtaaatctaggatgttcttatacttcatcattgagataaagtcttatgtttcaatggtaaacctaatgaaatgaaataagagtttagatctttggggtatatgttaatgttaataagcaagagcaaagcagtatttatttgtgcatccgtatatgctcctgtgcgtgagagaatattcaaatatttcactataacaggcctttagaaattagtgagataaagatatttatgaataaaaacaagctatttccttttttccttactttgttttccttgctaagctgtcttcacttttaatgataagtaccaaaagcctgatccctggtagaagtttcctttatgggtttcttttcttatgactaaggaaaatacatttctcataactaagagcacttcttgtggagaagatgcttgagagtcccttggactgcaaggagatcaaaccaattaatcctaaaggaaattaacccagaatattcattggaaggaatgatgctgaagctgaagctccattactttggccacccgatatgaaaagctgactcattggaaaagaccctcattctgggaaagattgaggacaaaaggtgaagaagtggcagagaatgaggtgattaaatgctcagactcagaggtgtctgactctttgcaatccatggactgtagcccgcgaggctcctctctccatgggattttccaggcaagaatactggagtgggtcatcactaactcaatggatgtgaatttgaacaaaatcagggagataatagaggagagaggagtctgctagagtccatgaggctgcaaagagtcggacatgacttagtgactgaacaacaagtaatagtaacaaagtgtctctttgtcactattcaataatttactgagaaaatgctagatatgaacaaaaggtaagtttctgataatctatattcagttatttatgagtagcaaaaaattcaagctaaaataagagaactcatttatttttttcaaacatccaaattcaattacctataaagtatccttttagaatatggaaaatatgattcttggtcatatataaatagtttacaatgaaatgtcctggagatatcagcaccaagcataggatttgatctggtcaataagtaattttaatgtcgtgacacatctggtcaaaatagttccttcttcaaaaggaaagcaa

SEQ ID NO: 60754 - DNA, 1181 bp, Bovine  19866881609990
tgtttgcgtttgccagaattagaagaaaagtagacaagaagaaaatttttcttttcttacccctgctgaaaagagtgcgtgcattttcaagttttgctgtgatggataattcagtgtgccatgaagtcaaggaaacaacaaagagcaataaaaagcagtggcaaggaaaaatacccagcccaggtttctgccttagaaagaatgacaaaaataatagaagcaaaggttgcatttgtcactttcctaacatacagcacccatttcctgaggggtgtatttttgcacacattaaggacaactctgtgttaaacctagttgtatggaagtgttgactaagattgcttgagcatcatacctcctcataaaacaagaggctgtcccgagagctccagacatctaaataaggctgcagagaagatattatatcaagcaggagacaaatttggtttagtttgctctgatggagggtttctcaggagtatgctaataaggaaatttttatcagaaagcattcattctcataaaagctattgtcaggacagctgttaacagcattagcaacaccaataaaattaagatgctctcctccttaggtttaagagctgaaaaatctgcctacctgagctggactcataagtatggaccaaaaaactgcagtaagctactcttgtgcaataagcaaaaatgataccacacaaatcattttcagaggctttgctgctaagtacctattacagctagacatagggcattaaggagcaatagaccatgttgctctggcccatttatgctgtacacacggtgtattcattgttggtatagtagtaacccaccagcatgcatcaagctagaactaccacataaaggcatggactgttagaagtggttatggaacatgaatggaggtgcgggcacacgggagttgtaagagccataaatgcaggcttgagaccagaaatcaaagtgaaacagagtgttctccccatccttccctcctttattcctgagaatcattaaagcacttaagtagtacagaaaaccagctcacaggagagactatcacaggagaattccccaaaacagagccgcttccctaactcacaaggaacagcgctgtctgatctgggaagaagagtccaggagggtcagagaaaccagcagcaatgcaatcaatcctttca

SEQ ID NO: 60755 - DNA, 841 bp, Bovine  19866880548171
ctgtgggtggtctcaacttgacccagagctgtaaataacatttatttgtgggtgattcttggatttatagccctgagctcagaccagttctctgaactccagactcttgtattccgctgcctgctccacatttccacgtaactgtttcacaagcatctcaaatttactatgtcccagaatgaactcttcattccacctcttcagtctatggtgctcccgtcttacccatctcaataaatcacaccttcacccaccagttactccatccagaaacctaaatgacatacttatctcttctttgcactcaacctcggagttggtttatcagaccttcctgtctaaacatctccaaaacctatcttgagccagtccacttagctctactgtttctcctctcaccatggtccagctctgggagtggtcccaagcttccgcttgcagaaggcagctctaacctgtgcttacatagcatccaggaaaagtgtgacatctgcataaaaccctcagtggtccctgttgcacagctcacacggacctacgtggtctggctttggcctttcttccagccctccttctaatgtctggtccctgcccttgttcctcacacaacctgtggctgctcccctccttactgctccattggtttcatgatggatactcagtctctggttactgaccctgacacaaagatcgtgagaacaaatgtttgccttgattgctaaatgtctattgctgtgtgccagatcctggaggaactaagatgaatcagagaaagtccctgccagacaggagctctcagtgtggtgaggacacgcccatgtacacagagaatatttaccat

SEQ ID NO: 60756 - DNA, 1460 bp, Bovine  19866880719351
aaaaaaaaagaaaactctaagcagagggtgacatcggtgtggggaaggtctaaatctttctccttactaactttcaagctagagaattaatgggctgttgagcagtcactttaaaagaattaaaattagacctagagaagaaagaaggagtctttgctgatactgacagtcacctacatcaccagtcgctgggatttaacactaatacacattggtcgctaacaggggtggttagacctctgctgacctctcacagagttcttgagtttctacactgtgaaaatctacttgcatgctcttttgtttccagattcccaccctggaatatttaggataaacacccaggaatataccatttctcctggtatgttggtactttcctctttttatcttaaccatgaaagtttgttaaatgaaagcaagctaaacatttataaaccttggagaaaaatagtgccttgaaatacatggagtaataatcttttaagactatttagtgttttctgtacataactgtacataccttcgcaacatttttttgaccttgaaatgaataagtttcaattcctttgccttcatggaaagaagtagaagttttcagaaagaaacaatttctaagagggataccagcagtcagagaacgagctagatactgaaattgagtttcaaaccctctggtgacgatgctatttccaatataggaaagcagaagacatttaagagtgtttggtatgaaaagtaggcacacagaaaattaaaatttcttggaggaaaaaagttacaaaaattgactagatttgcagcatgcagcttgacaattatgtgcataccaaaagctcctgacctgaggtttatagtatttttcatctaaatggaatttccctcacttcactgtaaaaccagatttgaacttcctagatgcatatttttaatgttttcgaaaacaccggggtcggtgcaaactgatagctttgtgctgctggtccgggacacagctgaataaccaaggtactacttcttcctgctcgttaacccctctctggggtctgggtgggggtgcctcggagaagggggcatgagagaccagcagcctgagggtttgacccaacaccctgccccctccagggcctctggacccccacctcccgcagcataataccttcatttattaaatatgcgcctggaaagtttccccacgagctacattcactcctgtccatgttttatagtggtgggtgtagggatgcagaggaattcgccagagacccacctgaatgaggactttaaaaaacatccccagacttccatctgatttttaaacgtagattttgggaatgagggtgaagcattaggaaatcaacaggattaaccaaattcactgctctcttattccttgtttttattgcacttaagggtgttttgtctcattaagaaccggctagccacctaccccaacagtc

SEQ ID NO: 60757 - DNA, 2287 bp, Bovine  19866880769517
atattgagggtctatatgtcttagcaatagtgatttgtattgttattattatgacacagggcgattagcaaagattaaccacaggcctacttgttgcagtataagtcgtaagtggaatcagagttatcaacataaacacacggtttttaatacattatgttagtattcatgtatatatatttgttataacacatatgcacttgtatacacagtgcttatgtcaatcatatctcaataaaactggaagaaaaaataaaacctatgattgtgggaaacaaacaaagttaatgacttgcaaaaaaaattgaaatcaatccaaatgtttcgtttttttttaatatacaagcctgaggtctttctctgtatcttctttcctcaacttctttatgggaaagttgaccacaggtagctcttttttatattaagtgtcatgaatacttgccctggtcatactatattggacttggggctgagccatgagagatcaaggtgaacttatataagacagtcactttggaggctagctttctatgatgtggtttgactccagatggtccagtatgcatgctccatattaaattatgtaaaaactgatcccaaacagattgcttctctgaagaactgtaagacagggtagcagggaacaatggatttctgcagcaagagggagaaaatggcccagttgtgagaggtggaggtcttttgagttggtcttagatattgaagatgagccgctattccaacttttcttgaagcctggtccccagaatctatgaacaactacaaaggcagttttattgattcctccaatcttagcttttatcacttaagtaaaacagctgtggatcttctttgccaacgaaaaatgcttagtataaataaaggattatatatagacttacaaatatatttaatgaatatgagcataaaagtaagtataaaacttgataatttttcagaaacttcatatgcacagaaggggatcagaaagggcatacatcaaagtgttaacaacatttgcatctctgagaatattgacctttacctttatcttctcccttttgcttgtctttactttctgatttttcaacaaatgaaataagttgctcttattaaagggaagatagtttttccccccttcatttaaaaaacaataagttctgtctagctcagggacaagatgtcatagattcacttttccctgctcctcccctgtagctataactaaatgtcctggaactaattcatcagacaattctaaaacaacttcgagaggtgggataaaaaggcacactgcctggagacctcaagccgtgtggaacatcagagtgtatctctcctggtgtctttccatgacccataaagactgggcagcaaagaggcctgcaacctggaatcacccccaggcatagacaaacagaagagcctgctctctctggccaaagaaccataagaggagcagtccagcagagatctactgggggagatttgcctcaacctatgcccaagacaatggcagtctacatgagctgtagcagcattcatagctcagtgcttccagaaccaaccatccacttaacttgggcagctcgacaggaattgggtaagagggaagcagagccagaaggatgaagtcaaccagaataacatgcacaggctccaaaaactaaattttcactgaaactacagctcacaaaaataggccaggacctaaatctaaatagggtaactgcttctttgaaactgaaataagatcaaatgtttccaaacataatattcaagaagcccaggacataagcatcactgatatgaagaagcatgaaaaatacaacctgagtgggaaagaaagaaagtgaagtcgctcattcgtgtccaactctttgcgacctcatagactgtagcctaacaggctcctcagtccatgggattttccaggcaagaatactggagtgggttgccatttccttctccaggagatcttcccaacccagggattgaacccgggtctcccgcattgtaggcaccagggaagtaaaaggcagtcgacggacacaatatggagatgaatagggtgatgggattacctgacagggatttcaaagcagcctttgtaaaaatgactctacagaaaactacaaattttcttgaaacttttgaaaaatagaaaagcttagcagagaaatgtgttttaaaagaaccaaatggaaattatagaactgagcaatacaaaagttgaaacaaaaaattcaccaggtggactcaacggtaagtggagataacaggatag

SEQ ID NO: 60758 - DNA, 1863 bp, Bovine  19866880921107
tgggagagggaggacagactgtaggtcctgaccaatattccctcctctcaaatatcagtattaaaaaaaaaattctgccataacatggatgatgaattcatgtgagatttattctgaaaggtgaatggatttgagagctaccatcttctgatggattttttttttcttttaaatgtatttattagctaaaaacttttttatctgcgctgagtctttgttgctgtgtgcgggctctctctagttgtggggcacaggcttctcactgtgttggcttctcgtgttgtggggcatgggctctaggcactcagggcttcagcagttgcaatgcgcgggctcagtagctgtgacacacaggcctagttgccctgcgggatgtcggatcctcctggaccacagattgaacctgtgtcatcgcattgcaaggtaaattcttaaccactggaccaccagggaagccctgacagattcttaatacattagaaaaaagattttaatacgggtctgttaagagatgatttttgttctataaaacaagttttaaagtgatacttgaactctttcattcaaaaattggattcaatgtctctggcaccctacactgggccttggatagttcactgggttaaaatcgagatcatttactggctttactttgaattttttgctttaatattaaatatttttcatctcttggaagctccacatctgttgtggataggtaggtaggtgtttatcttttgttgtttctgggtggtaccttctgccgcctttgcacgctgtgactttttttttctgggctccaaaatcactgcaggtggtgattgcagccatgaaatgaaaagacacttgctccttggaaggaaagttatgaccaacctagacagcatattaaaaagcagagacattactttgccaacaaaggtccgtctagtcaaggctatgatttttccagtggtcatgtatggatgtgagagttggactataaagaaggctgaacacagaagaattgatgcttttgaactgtggtgttggagaagactcttgcgagtcccttggactgcaaggagatccaaccagtccatcctaaaggagatcagtcctgagtgttcattggaaggactgacgttgaagctgaagctccaatactttggccacctgatgcgaagagctgactcatttgaaaagaccctcgtgctgggaaagattgagggcaggaggagaaggggacaacagaggatgagatggttggatggcattacagactcaatggacatgggtttgggtggactctgggagttggtgatggatagggaggcctggcgtgctgcggttcatggggtcgcaaagagtcagacacaactgagtgactgaactgaactgaactgaactgagcagttaaaataagatgtcagtgttagaatcagacattaaccccgtgacctgcctgttatatactgatcataactttgttttgcttgaatttctgaggtgagtcaaagcagatatatgtacagtctggagatggctgtgtataaactgaaacatttttgctcacaattgctgataatacattccttcagatgaaagcctcaaagaaaactagacactgatattaatggaggggatttctgaaaagcttaaggggaattattaaacttttgtactacttccatctacctcttattctgtaacctgttgcgggaggggtccttcccagcttaagtgcatgatggtgtcatttgctgtgaagaggcaccagtggatgaaaaatgaccgtgctttgtgtttgttaacactgaaatattctaaaataagcacttgcttcattagcccattagatattatgtcggcatcaggaagtag

SEQ ID NO: 60759 - DNA, 1399 bp, Bovine  19866880998498
aatttcagagacgtattagcaaagaaactttcagaaatcgccaagcctcttgaaacctcagtttcctcatccgtgcaatggactgatgaggaagcagctgagccagagggttgtttagagaactgagaaaacaacttgcagtaactgcacctcctaagtccttagaaaatgttcatttctcctcacccaccccttctcctatctctgacaaatgctctttttcttatttatattaaaaaaaatttttttgaagtatagttgattaacaatgttgcacctgaattaatttcaggtgtgcaacaaagttattctgtcatacatatgacatacatatcacttttcagattctttccccatttaggttattacacaatattgattatagtcccctgtgctatggagtaggtccttgatggttatccatctatgtatagtagtgtctgtatgttcatctcaagacaaatggtctcttaattattgtctgtgcttacctggagctggttctcacttccacaatctgggggatcaactctgtaatatcaaacatctgaccaagaagtgaaaatttcatcaatcatagctccagctctcagagttgaattgtgcctaaactatctgattcttattaacacatgctcatgtgcagaaaaattttatttctctcttgatttgggtgtatctacctcacacaggttttaataggttgatatattcatttgttcagattctatgcctgaagcaatgtaccagagattccccaaagtagatactttggggtaagttaagaaaattatcacagtgaggtccctgtgggaccctggatatacatgaccagaagagttaatgatgcaggaaatggaggattctacagcctcatagggactcaagcagctgtgactaatacactcctatatagtggacaccaaacaaatactattattaggaaatcttcagtttactagaatatttaggaatggaattttctgattaatttcatctctgtttaactgcgagtcaactagaaaaaaatcttaacttttgtttgacctttcttgttaaaagtcttcctaaaatgtaagcagaaatcatttctagacagtgttacaggctgtctatcctgagaatacatttttctcagaggagaaaggcagcacagtgcagttgccagacctagaagctacatcgtgtgcctttagctacatcactttgtctcgctgatctttgtttccactaagatatattcaattgtctaaaatgtgatagtcaggcagaagaattcaacaaaaatagagccaaacacatgaatgtctttgatagctgtggctctagaggtaaaggacccacctgccaatgcaggagacataagggacatgggttagatccctgggtgggggaagat

SEQ ID NO: 60760 - DNA, 1048 bp, Bovine  19866881058219
tgttggaatttgtagcggtttgtttttagacatgtgaagactgaaagatcttgcgttacaaacctaatggaacaaaaattgtttaagcagtgaaaaccaagcgaaatgcatgaagctccttatcctgggtctctccctctcggaactgctctgggtctgatgagaacagtggagaaacaccacacttcaagcagtttatctcttttcaagtgttagatgttcaggtggaaacatgttttactaaatgtagtggatgtgatttttttaaaaaattatttatttttaattgaaggatccttgctttgataccacagattttaactcactgttgccttggtgaactgggtatttctcacctggacttaaggcttaaactgtgaactcccagcagggaggatctaggattagtcacctatgtagatttccaaaatccaaggggagaaggagatgaaggaaagatcaaggcttcttgtcaacaggtgcctgagtttagattgttcagtaaataaacattgtctttctgtttgtttctttaccccaaactattgtttctaccggcagcctaaaggaaaacgaattacttatgaagggtttgaggtgtggccagcttgtaaagttagcgcagcctccaagctcactgaaggaaacagactcaccaagaagtacgtcctcactgcgcatgaatccaagagttgtattttcatcttattattttaaaatattcaaagtttcgtcaaacatggtttctctcaggagttaagaacaagcccctgagagctgtggtcgtcacaaagttcaaggatccggaatgtgcgggcagacacaccatttcatctttaatggttcgtctcagccccactggggcaagttcagcaactgcttttttcttctcttggaaatgagcctctgaccagaggctgtaatgaaagcagtgtatagtttgctgagtctttcattcaagagcacaccaaaagttataaataaatcccctgcccccctcgaacatttagcattttgatttgaaaatgctttcacttcaaaactcaag

SEQ ID NO: 60761 - DNA, 928 bp, Bovine  19866881508108
cttttctctaacagtaatggagacagggcaagtggctggaagcaaaggagagactcccagaatgtgagaaaggagaaaaagctcttatgtgggtaccgacagggagaagtaagcctgggtttctcatgatgcttaccaaatggaccagaattatttaacaagagtgacttctgcagctggccacatgctgggttttgttgggcttttaaggcaataagcaccaatatttatgctatacttaacaatttacaaagtgttttcagagatattatgtcatcttccaggcaaggaaaattgctcagaaagagatcaggctttctcaagatcccaaggggaaggaaccaatcccaccaagggactggaacctaaactcacaaccaggatcttctaggttcaatcctgtggccttcatcaatacaccgctgtgcctgcccccaaggaacagataacaccactggggagacatcagcaactcaaccaacgagggagacatttccaggaaaaacatctccaaatatataatgaaagccgatcagaaaagaggaatttctgctactcttaaatgacaggtgtgtgtcagacaacgaaagcaggccctgcctatgataggactcgcccgaggagtaggtaccttaacacatctgttcacctgaattctgtgaggtcagtgggtggttttacaacaagagagaccacgaaaaaaggaaatcaggaatctggattctaatccagtgtcatcaccagctgcttgtctacaccgcaggcaagcctcttaaccttcccgggcctcagtttctttgtctgtaaaatgaaagggttgggcaagatgatctccagggcctcttccaggcctataattctatgtcatttactagagcgctcatggcaaacacactaccccgggtttatagtaactgtaattaccagg

SEQ ID NO: 60762 - DNA, 1066 bp, Bovine  19866881751911
ggtcaggtgataatacttgggggatgaatgattgtgacctcatggaaagagaagggagcctccctcccgctgattggagagatgatggctgtggcttagtcatcgcctagacaggcatggttggggctgtcactcagttatctccttctggttttcaaattatgagtagagatttatggaaaatctctgtgatttctccctctccctgggagaggatccggtccacagcccttcctccgcggcacccctgcctgtttaatcgtcttagcagtcagaacggattactgcagaatatgtctcttgaagcggtctttcttcgtaaaagaaaatgttatacagtttcagtgcattttggttttctctgtgttgtgtaaattaactttgatttctgactttttttttcccggacatttttgtagatggaggactgggatgatttggaatacaaaccacagaagtacttcactgttgagtcctcagctggaggtagctatcctgagcgctggccacagggaacctcccccagtttctagctggattccaatggttcctccctgatgccggggttggatgactttcctgccactcagccaaagatatggcctgtccttttcatcatctgttgctcttaatttttctaactgacatctgtgcccatggaatggataatgagagatgtctatacatccatgtgtttatcaaagatcatccttcacccaccttgggaccttgtttaaattgtccatgtctcattcaagttaagcttctcagagacagaatgtgcagtgtctttgtcaagttttaccaacagaccaacgagggaaagccaatccatgactctctctgtaaagatagcttgctgttgtgctatgctcagtcctgtccgactctttgcaaccccaatggactgtagcttgccaggctcccctgcccatgcacttgtccaggcaagaatactggagtgggttgctatttctttctccaggggatcttcccacagcagggactgaacccacatctcttacatctcctgcctaggcaggtgggctcttcaccactagtgcca

SEQ ID NO: 60763 - DNA, 1756 bp, Bovine  19866880518462
tcccccctccccactgcccactcctactcacatcagttgggaatcttgctggtgatggacgcagtgggtcagcccctggagaggccaggcttaaagaggcttatggcaatacagtcacacatccatatctaggactcaagactgttttgaaaacttctcaacctgtcagtgagaaagatgtgcaggattttcaattatccatgaagttggacggtgtctgctggggaaatgctgaattaaccagaataactataatattttatatggttaataatcacttacatttgtctaacatgttacacttttcaaagtgctaatgtatacctgatctcattggacttttgaaagagttttaaagtatgcttcatattatatatataaatatggacagctctttccctaccacctaaggggtttcccaggtggtgctagtggtaaagaatctgcccgcaatgcaggagacgctggtgatgtgggctcaatcctgtgttgggaagatcctctggaggagggcatggaaacccactccagtattcttgcagggagaattccagggacaggggagcctggtgggctatagtccatagggttgcaaaaagtcagacacacctgagcacgcacacactcccaaccacctaacaaaggcaataaaacttccacagacactgaatatcaatatctcaggagcactaaaccccaaatgttccactttcttttacttgcctcatgaacctgttttatttattttttaaagtttgttttttaacatggaccattttaaaagactttattgaatttgttacaacattgtgcttgttttatgattttgttttttgtcatgaggaatgtgggatcttagttccctgaccagggattgaacctgcaccccctgcattggaaggcaaaatcttaaccactggaccattggggcagtcccatgatcctgttttataacacgcattttgtgttcctaattctttttctgatgttttcagatttctgttaccctagagtgtccttattcttgacattggatctttgatatcccacattaacccactttgtttttgctgtttgagtttaaaaaaacaatttattgaggtgaaatttacatacaataatctgtacacatttaaaagcattaatttactaaattttgacatatgtataaacccataaaaccatcaccacaaccaaagtagtgaacatatccatttatttcaagcattggcctttatttttccaatcaaaggaagcttaactaagatgccattttattgacattttctggttcttgaatgtgtttagggagcgctctcattccagttctgtactcatggggctgtcagttcaagcgggacctcagccttaataaatgatatttatacatattctgtgtctcattacctctagtttcgatttcagcaaattcggtccatctaatgtggtagttgaaagaggacatttcagagctggaagatctgagtccatgtctcttccttgcttctttctagatgcctgaccttggacaataatgactatcacgccacacaccttactggatcacacgagaacctcctcacgcaacaggatgtgaaaatggaagcttctcttcagtccacgatacatgtcatattccaacaccaaatcatcacacggacagtttacaaagaaaatgtccctcccctgattcacgatctcttgaacttctcaccagctttaagataataaaaagaatcaagaagggagaggaccg

SEQ ID NO: 60764 - DNA, 1351 bp, Bovine  19866880893710
attgaacttgtgccccgccctgccatggaagtgcagagtcctaactactggcccacccaggaaattcctgactaatttcttcttgtgaggacttggactgagcatgtgggaatacaaagaaacataaactgtggccttgacctcaagaggctcagaatctagtcaggatactcaaaacttaaaaatctggcaagatagtcaaaagttgaaacatgcttgggcagagaagatggtaatctattaaataattaaatggatgttggagaagcatagtttaggtattttgaaaaggaatattatttttgtgataatcaagaaagactttatggaagaagtggaattaggtagcgattcaggagaggtgaactctgaagagttttaaaggagcaggtaggcagcgtgttggtgagaaacaccccacgtgaaggaagaagagaagcccgcagtcttgggagtaggggtggcaggactgtgaggtgagtagacaagtctgattaaagtgagggataaatctgtggctgtgagcaaaagcacagcctggtcacatggaaaaggtgaaggcattgagactccactgtgaggtcctcctactgtggggaggttggtttcttgtgttaggattcaggcagaatggagataaagccccagctccaccacatatgaacagtattttacttagtgatttaacttttttgaacctcagtttgccttcttgccaatggagattatctccaccacacagagctgtcagggctgcataaataacatttcaccgtcacatgggctgtcatccctcccagtaagtgggtggcgcagggaggccaaaataagtgcttgtgaggaggaaaatgacatcattaacgggatggacatggtgtttgggaaatgccagttttgtggtggtgtccagggtgaactgaagaagaggggcatgcgtgtattggaggtgagaggaagcaggaaaccaatcttatcaggctatacacaaagagacagggtcctaactagccatcctggctatggccaagccagtagaaatgatgaagcgactgtcagaagggaggaatgaagggatttgatgaaaatagggccaaaggtaaaaagtgaaatccagaataaaaattgatttaaggatgaagacagaagtatcaaactagtagcagaaagtattgttttaaaaccttccaatggatgtttatttttggtttgttttgctttgtccagtgcctgctctttcctttgagttagctgctttcttctctctctaaacacatctttatctggaaaatcggagccctttattgtcttggcacaatggttggtctggagatcaggccagccagagtccttc

SEQ ID NO: 60765 - DNA, 1463 bp, Bovine  19866881733687
cggggagagtgactccatggcaaccttgctgagtcaaccttagcggggtcttccagcacgtgatctggttcttatttcagtccccttacttagaggctgggagtccgtaatttataacaagaactctaactcgtgggtgtgcgcccttgaggaaacatcactgtgtttctcctcccagtgggttggtttccagaagaacttgtgtccacgttgtgtctctgattcactagttataattatacctaacagcttataacacaaacctgattgtgatgaaccaaacagaaattttgtttttctcatgtgaaaagaagtctggagaaaggcagtctagaactgatgcagaatatacataacgctgtcagagactgtctttctcatgcttcctgctttattgtctgtagtgtgtggcttttggcctcaggagagcaagatgactccatcactgaaagaaatcacatttcattccaggcaggaagaaaggaggacaaagaatagtaaaaagggaaagactttatttatttttttaaaatgaggaaacacattttctgagaagctctattctgtaggcttctgcttacatcttattggccggatctgggtcatatggccggggtttcccaggtggtactagtggtaaagaagccatctgccaattcaggagatggggttcgattcctgggttgggaagatcccctggaggagggtgtggcaacccactccaatatgcttgcctggagaagcccacaaacagaggagcctggcgggctacggtccatagggttgcaaagtgttggacacaactgagcgactgagcacagcagtacaggtcacgtggctacttccttatcagtgaggggatctgaaagagataagctggcacatttactgaataaatcaatgttctcttagttaaagaagaagcaaggctggatactgggtgggtagccaacagtgtctgtcatgggaacccatctcttcaggtcaggtgtggtctgggggaaggggaagagtacctgaaccacagaaagttccctttgtccatactcccacaaggcgctcaatctccactggtaaacagcttgcaaaactcccacattccctagatggctggcacatgtttgcttacggccattttggagggtccctgccttcctctcaggagagtcattccgttctaccttctgtctcactccctccctctctgctttccttccttatttcattccacccttcctttgtcccatttcttccttcctttcctctcaccctccctcccttccttcttgaaatgcttcctgagtccctgatctgtatcagacgatgtcctgggcacttagagacacaggcctatgttgcccccttcctctgttgagcaagatgccaagtgagactcctgggtgccacacaaaaatcatggctcttcactgagcgtcgcctgctaggaactatccaggcagggg

SEQ ID NO: 60766 - DNA, 1299 bp, Bovine  19866880481852
actgtttctggatgctatgggcaactcctttttcttataattctttggaggagggaaaagcccccatttctgataactcagtaactggcagtgagtagaaatcttttaaagtcataattggtaatgaattagtttcataaaactttccctttgaagaaataaaaatccagtttctacaaaatgttgtatctgtgtatacagagagtacctcactagatagaagtgagggggtgtttttcttatttttaaatttctgccactcctcttgttcttccctttctcagtttcttctttgacttgagacaggcacccagagggaacttggggccagctaaaagcattgcagcactctggtctgattgccccaagggtggcgaggcacccagcaggtaccctccagcatttccaaagtgcctccatccccattcctttggaccctgacacacgtgtcatttgcacatcttattctggtctccactgacctcctgattttttattcttgtctttctgcctcctttggtttctctctggctatttggtcttttagagatattgaaagtcaattaggattttccaagtctacactgtgaatgaaagaattaccgggtattgagtatgaccttgaagtctctgtgttttctcattccctccgcaaatatctgttgaactgcttttacattccagatctgagcccttacttgggggcacctgacaatctgataggtcagcctgtgctctgtggtcagtggctattgcttttaactaagaaaatgggcttttacttgtttcttgttgaatctggaacaatctgaaaatgtgggcttaattccagaaaaccagtgttttatttcagtagcatttcaaagtttaattatgtggccatgttttgcctgcatgtttgtctacttgagatggtagctggaagatagaaataaagtttgttaccctgaattcttaatttaaaagtttgatgtgaaattaatgtaattgtcatttttctccattcttaacattttgtgtaaccgttgtaccaaaaaaatgaatgattcatgtgagtgtccatttgaagcagtcaatgtaacagaaaaggtactaagttaatgcttttcatgcagtttaagcaagacactatatctgaggcttctccatctataagatgggggttttgttagttgcctgtctattgtagttagtgcaagattcaaatttgactgccagggaagtctcatgtatttcttattatatcacaggatcacacattataatttttaaaagaccaaaatactaccaaagtagtgt

SEQ ID NO: 60767 - DNA, 744 bp, Bovine  19866880683692
tgactctttatcttcccccaaacccgcatgacttacacacgatggatgctcaaagatatttgttgaatggatttgtaattgattggatggatttcattaatttcattaatttaatccactaattcattaatggattttaattcatttgtaccagggacatggagaaaaagtcactggtgccagcctcaaataaaaagtactagaaaaaggaaattttattgatattactgaaattaggaagtttcccatgcagggaaattttagaaggaaataagtaggaagtaagcactcctgtttctcaacacttcaaacagctgttaaaatcacaatactgctgcaggttctgaaacaacattcttacttaaactacatactggacagatgagctattttacttagtgtctgcagagaatttaggaagtttaaggaataaaaactacagctgctgccatccatacctatttccaggtggggcgcacagttccaaatagtacttgattttgggctctgtcccactggtccgcatggtggccacgcctccattagcaaagctaaaggtgatcatttggctgcttttactagtcgggagaatctaggaattaattttcatgttataaatttattagtaagtagcaacgtaagttgttttttacctaactaatatttttcctcaaataagcaagaaagtaaatgcaaaaaaaagaacacatttgaggaagttagaaaatgtactcggtataaatg

SEQ ID NO: 60768 - DNA, 2348 bp, Bovine  19866880704577
aggcaagaatactggagtgggttgccatgcccttctccaggggctcttcctgaccaagtacctagagtacttctatttggttcctcttgtaaatgcatgatgaaaaccactatatgtccaggtgccaggctcctaagaggctcaaacatttggactgctgtcacagaaccgtgcaatttacctacgcaaaagtaaagccacctgaagactttcatctagtcaacagtgcaaagggaaagactggactcattcttttctctggtttcttttttcaaaatggcgatctggggctagctggtgcaatggtaagcctccagcaaccattgctgcacaaagaatataagacctagaagaaagctgtgagatcctctgtggggtccacacctctcattctggaagccagaggccagaaagattaggacaactgccacaggccactgtggccgatacaggacccgagtcctcagcatccacgacagcacggccgaggcctagttcaaccttgggtagcatcaatggtggagagaactctagcagcctgggatgcaacctactctgtggtcctgggcccataactcaacatctctaggtccaagtctccttaaccatataaaggggaaagttataactagtggtaactcatatactattactaaaacttaagctgtcaaaactcagataaaggttagataatacctaatagagagaccatagtagaaaagctgctttgctccatttactcgcagagataaataatgcatgtgcaacttggtttactgaattgctgacgcagccagaagataaaatttaccacccttattctaaccacctggttattcacgcccagactgccaagacttcaggagcactagaactaggttagactcaggaaacttcccatcttgcccacagatattaacacacattttaaaataaatagttttgtgttacttgaatactaacaatcattgaagaagaatctattgattctaagctctaaaatggaagtcaagctacctccagttttttcttttgaaatgttccaatgaaggaccagttttttctttttaaatgttccaatccttacagactgatactttgataaaatacagtgaattagcaatgggaaaaaaataagactgacaaaatatacaagaccacttttttccactaggatcactgtcaaatcatgggggaagtttctagatgccgagtctcaagttctgcacttaccttggataagcaactgtccagaccagcacccagtcagcagatcacatggaaaacacaggctccccacactccacagcctttcagcagaacacacaactgcagtggctcctcacaacagccactgtcgtcacccacatctcacacatgtgtaaagtgaggctcagagaggttaagccatttgcctaagatcactctgcaaagtaactggtagaagcgcaatcccaacccaagtctccctgcctgaagtctgggctggacactgtgacctgcggagagcacccagacagaaggtacacaactcgttgtcagtttactatttaactctgtatcatcacatcactatacagcttgtaggcaactgtgcccttaggtgtacctttttcttcttcctgtttccttaattaatttaagagaaatcgtaaagtagagaaatggtaatttaagagaaattgtgatgaagacatctggaaatagatcaggtaaagatatgataaataggagagagatggccactgaaattgaacctaaaaaattttttttattccatacttctccccagtcatcaatgaggggtgaggccaactggactgattcccagttaggcttaccttggccaacagccgagtgcattttttccatgtcaaacttaatttttgatcttcctggagtgctaagtatcttttcccacactgtagtcacttctttaagacagggagtgatttcttcataatcaagctttaggcgcttgttcagcaaatcattctcagaggctagaacagacaatttaagagcacgttagtgagttatagctacatgtctcctgtctcacagcaagggctgcctgcttatcaccaccactgagatgcctgcagccagcttaacaggtccaaggtgaagaccggtccgcttctgccccccaccccagctttcttatcaaggaaaaagctatatacccaggaggcatccttgattcctcttattccttcatccccgatggattttgttggttctactgctaaaatatactatacttatccaatcctatccatctccatagctaccctattaactataaacatgtcaaaggcaagaactgtgtgttagaattcctagtg

SEQ ID NO: 60769 - DNA, 2418 bp, Bovine  19866880807732
ataatatataaaatctaccagggaattcaacagttttgcaattaaatttcaagtctttcaaaatcatcttgtctatttaacaagtcgctgtaattgtttaataattacttgaataaaagaccctgctgctgctgctgctgctaagtcgcttcagtcgtgtccgactctgtgtgaccccatagacggcagcccaccaggctcccctgtccctggaattctccaggcaagaacactggagtgggttgccattgccttctccagaccctagagaaataaaataccctagagaaacatatatgggagtaagtgcaaataaaattaatgagtgaaaaaagtgacccaggctgatgggtggaatagtggtaaaatctacaggcgctccttcaagtaaaggatgagctgaggcaggcccaggaggcttttcgtatgtgttgagaagtttggatggttagtgtagttagcttggtatgtggggagggacagtgggcagtaaggataagttcaggtaaaagtaatttagctgaaatttagcattcatacctttcaacccagctaaaagtaatggagtgtccagtctgtagcggtttacagcctcatttctctaaatgtggtccttggaaagcagcatcatctgggagtctgttattgaagcagagtctcaggccccacctcaaatctactgaatcagaattttcattttaatgatatttccaagtgattcataggcatattaaagtccaatttaggcaataaagatattttgatatatcctttaataagaatttggaggtaagcagtttcagggtggttggatctaccactctggatcatcaataacataggcttctattttatttatttttgtttataattttatttatttatttattttttaaatatatgtatttatttttggattcaacgggtcttagttgtagcatggcattggggctctagttgcagctcataggctcagatgccttgaagcatgtgggatcttagttccctgaccagggattgaacctgcatccccggcactgaagggcagattctcaaccactggaccaccagggaagtcccaacacaggcttttatctcaggatttggaggtaagcaattccagagtcactggatctatatcatcaataacgtaagctttcatctcattacattttgccagagttagcatgtcgatttttttagccttattctcagtgacctcatggttccaagatggctgctgtagctctttgcacaagtgagttccaaacaggaaggatgggacatacttgtagtatctcattggccagaacagggttacatgttgacttgtaaaattgtaatcatttgggaagaggaatggtataaatatggttgatttataccatttgttcatttagttaaaaaaaaaaaaaagtggattgcctgctatgtgtcaacccatagcatatcccttggggctaagcctgagatcaagagtctctgttcattaattgcacaaaattagggttctgctagtaaagaggggtggaggaaaccattattagacaggaatcattgcctactgctggtaggataggccagatttagaagagtgttggaagccatgccaagactggacttgatccacagtggtcactggagaatcaagggggggttgatgttttgagaagcaaatctagtctgtggtgcaggtactgaggccagtaaggagatttattatgcagttgttcaagtgagaggtgatgacagctgacctaggacagtgacaggctgtggaatggaaagaagggatacatttggaaggccactccaagacagaagccattacttagtgatgctgtatgcgggcggtaaaaaagggaagggctcagaggtgagtcactgagacttcggcgggataaataagttgtctaacgggagttgccattataaaaaaactatgtattacatacatgtgatcacaagttacaaagctctgtaacttagattttccactttatggatcgcaaactgatttttgtgttagtacatagagaactcattcatccctctttaactatttttgtatttatttgaaaaatactgtaaagcccaaggaatttaagaatcatttgtaacctgataaatttaagaaattataaaaagtaaaaaagaaattgccctctccatcttgctgctggaaatgtgcaccctcccccaattttctccttaaggtaattcagaatacccagaggttccaatgcacatacacacttctctcctttctctttttcagaatgataaattcgtattagtctgcagcgtgtaatttccactgtcactcttttccacaaaaatccttgccctttatttgtcgtgtgtggccagaattcgaagaatccccagtgttaacacaggaggattctgcctcaaagt

SEQ ID NO: 60770 - DNA, 845 bp, Bovine  19866880833661
tgaaaagtggctctagctagagaaaaatgtttctggctcacttctagcccctgaccacattttgaccatgggatgactttagcattcacttggcaagggcacttccatttggctccctatgaagtcaccgaaattctagttatttctggagtgtgtgattgcctggtttatttgtgagaactatccatcagggctgagctattttgtttctggaaccgcttgtgtgatcacagttatgaaatgtttattttcttagatcggcttaagctgataaggcatttttgagccattaagaatcttgtaagtcaagattgtttagataggagatgatttttctgatgggggtaaatcagatgaatcacggtctctcccttgattgggctattatgttaaaggggtgtgactgtcacatgctcctttgagaaatggtgttgcctccttaggaagatcggctgccagcccactctttctcctctggctcacaccccagctgcaacccaaggatctagagagatgaggccaccctggagaggtaaagggtcaactgtgaatgtcagatagggccacagggtctactggcaaccacactgggtgcaagaagcccagagaaaatattccaaattaatgagcactgcagaagctcatggacttaaaggctcggcacaaatctatctcaagacaggccttgtactcacaaatcttgctttcctgtggcaaacagagaaggaaataaatatgccttctgctgtcgagagcactgagtaacaaggacagagaagcagaatacagggggaggaggtatagggaggagggggcagggggtacctgtcaggcagggcagctct

SEQ ID NO: 60771 - DNA, 1247 bp, Bovine  19866881194914
acaggaagaaacatatggaagaacatatataccaatctgggagttctttaacaaatgtctcaaaagtttcacacctttctggaactttcagtatcttcttatggttctcttttatttcacaaagcactccaattgaaactttttttgttaaattttattttgtgcgaagatgtttctgagaattatacagcatccttacagatcattaaaagcggttcatttacaaaactggagttggagtgggcctgcctttgagagctcccaaacggagagatggtggtttgcgtgtcctaggctggcagttcaccatgctgtgtgactaagaggagagttgttgagtgtgcacactcagcgcttgcttttcttctagatgcactgtctcctctcctgcccatcattcctgtcaaatgactaatcttcagggtgctttggaatgtttaggttggtttaaaaaaacaaaaaacaaaaaaagaaatgttgattgtcttaatgcacatatatgctcagcagcatttctcagatgtacttttcctgagcttattaaatagactagattgcttctagcaaatgtctttgcaaaagcctcaggagtcataacttgacggcttttgtttccatagggtaataaagccagaggcctccaggaacactcagccagtttggatctggacagctccgtgtctagcatgttcagtaacaccagcaaagtaagcacgtttcttcttatatgacaccctgaagaaaccaacaaatgggtcttgctcgtctcctctacacagggcctatcagaaggaaccagagaagcctcacagctgccatcatgaaacttttggtgcttccagacttcatgatgcaggtggaaggctggtcgtgcagatctactctgacacacaagttgtgcttagtgaagcagaaggctctgccatagcaaagagctaaacgcacaatttcaggccactgagatctagttaatcacaaggcaatcagtggatttctttctttagtagattttccaatgaaatctgaatgaaatacattaaaaataatttaaattgggaaaacctcaaacatgagcttatgaattttgagaagtatgcagcttaaattcttgtgtcctttagctgactctgtgattatcattaagcatcacgatttttgtaaataagcctcacccttccatgtctgccaccaagcacagctttgtgatgataagcaagccaaccgttcttttggtaacaaacctgtgt

SEQ ID NO: 60772 - DNA, 796 bp, Bovine  19866881297364
actttctttttaaaaacttacagctaatgtgttttgtttttacagggcgaacctttccaacacatccgtactactctgctcagctaggagcagggcagctgtcactttacaacatcctgaaggcctactcgcttctagaccaagaagtgggctattgccaaggtctcagctttgtagcaggcatcctgctgcttcatatgggtgaagaagaggcgtttaacatgctcaagtttctgatgtttgacatgggactgcggaaacaatatcggccggacatgattattttacaggtagaaagccttccttctgcctgtgataaagttgaatgctaaaataaacatgtttatgatccctttccaagtgtatctaaggaaatttcccaccatcagttaacattgtagcatgtgtcactgctgagaacttactctgtgctagccttacaccaggtggttcataggcatttatttatctcctccaccctcaggaaggcagtgttgatcccagcttataacaggaaagctaaggctcagaaaagttacatagtaaataatctgagcaggtcacacagtagcaggtggcagagctgggatgtaaacccaggcctgtctgactccagggcccttgctgctgctgctgctaagtcgcttcagtcgtgtccgactctgtgcgaccccatagacggcagcccacgaggctccccggtccctgggattctccagggcccttacttttaccttttctctttgaatccaccttcaggtagtctgagtcccacctcccagtgtatttgctattt

SEQ ID NO: 60773 - DNA, 1357 bp, Bovine  19866880108891
tgtatggatgtgagagttggactgtgaagaaagctgagtgccgaagaattgatgcttttgaactgtggtgttggagaaggctcttgagagtcccttggactgcaaggagatccaaccagtccattctaagggagatcagtcctgggtgttcattagaaggactgatgctgaagctgaaactccagtactttggccacctcatgcgaagagttgactcattggaaaagactctgatgttgggagggattgggggcaggaggagaaggggacaagagaggatgagatggctggatggcatcaccgactcgatggacttgagtttgagtgaattccaggagttggtgatggacagggaggcctggcgtgctgggattcatggggtcgcaaagagtcggacacaactgagcgactgaactgaactgaactccttcctgctgggaccctcttataaactaacacctacctcatgcgaaggagatgaagggaccccagttcccaagcaggcatgcaacccaaggccccagctcctgctgggtatgtattccagttggagaaggggatagaaaaaatgaaaaggagtgatgggtgtcagacagtggaagcattaggaataaatggaaatagagtgatgagacagaagtccaggaggcccctggtatctgtgggcctcgcactagtgcaaaggaaggtcctcgtccacgccccctctctcccaccctatctctgctccaaatcctgaggggcctcacgtgcgtgtgtatggacccatcaaagctctgtccctgccctccagcacccacgccatacacaccacagggccacccttgggctgcccctcaggactgcgggtgcccacacaaggagcagagctagccctcggaggacagacccagggaagcgggctcagaatgttcggacggggaatccagagttcccagaaccttgggtgttgtccagatgggcaaggtgtgttctccaagtaggcataccacctcagccagggactgcttaccccagaagtcaggcccaagtggggccgtctgaactgggtttgagggctgctcttctagaaagcacggagccagaggtgctgatttggttgaggggatgagagaggaggggacctttgagctgagacctggttaagaagcaggcctccctgacagctctggaaaaagacaccgggtccagagagcagctcacccagcccccaggcccgctgcccctgcctccaggcccaccgtgggcttgggaaggggccccgagaggcacctggaagcaatcttccccagcctgctccctgaaagtgaaagccactcgctttgatagtctccaaattgcctttctctcccccttc

SEQ ID NO: 60774 - DNA, 1256 bp, Bovine  19866880399785
gtgggtatatacttaatgattgggcaaacttgggttcaaacccccaaccctttctctcaattgttctgtgatgtcaggaaagttacctaacctctccgagcctcctcatttgtgaaaccacaggacgaattcttagctctcagggttttgattagacagactgagaaaaggcagtggaggggcgtggcccctggtgctccccaaaggacagcaattaacaacactaatggggcagctgtccaggccctgcccccacagcagatccatggggctggggcatcactcccatgccagttttgcaggacctctctcccaaccccccccccccagagccttccagggaagcctggtttccatagaaacagatggactgcagagcagtccccttcctgaagactgtgcccccacaagggctggcttaggaacctaaccggcaggggagggggcccaaaacacccaccagctgccaagcctctggtgattcagtggggagtcactgctgctgagtatcagagccaagagctgcttcctttgcaaacatgaccctctgcaagagggccagtgcacctgtaaggagaaacgccccccgatcatccatgccaggaaaggaggcagtgaacaagtacttccagaccaggaactccgcactcacccccagagcccaatgagaacggttgtattacagataaggaaactaaggcccaagtgacttatgcacatgtgtatctcgggctaagtgacaaagccgaaattccaaccaagttaatggtgcctaatggatattcagagaggagctcatatgtgtgtgtgtgtgtgtgtgtgtgtgcgtccacatgcccatgtgtgggctgggggtgtggtgtgctgaacatgacatccaacaagaaccgagctctaagctttcttccccatcacatctccccttgaaagtccctggcgggttgccagcacgtgaaccccgccctggggtccagcctcccttggatgaaggccctgtgactcttgcaggacccggggagggctgcagggagacccattgttctgttatcacgttggtacagaatagctggaaatggggactggaacatgcagtggaggagtgggggaagtgagagccggagtctcccggctctgcgaagagggaagcggggcagggagagccccagcaagggcaccttgggggctaagatccagagccagcatcatccttcttgcagtccttccctagggcagcccatcagccccttgggcaagag

SEQ ID NO: 60775 - DNA, 1279 bp, Bovine  19866880457578
ttgggggccctttctgtggattgaaactcataaatttaatttgctgagttgcaggaaggcgaagagttgtgtcccacctcctcccacttggcaccaccctggaaggtctggaagggagagaaaactcttgggacggctcccaagtgggttttaggcttcctgtgtcagactcagtgaaggactatagggaggaacaacagaatttggaagcaagggaaatggccagaggtggctgcagctgatgccatgggaaagacagctaagccctaaaatagcagaactcagggactggggagccctttatactccaggagctaagaatacggagaggaccctccccaccatactccaccgaggacctcactgacagtggaacttgtgagaaggggaatctttctaacaaagaagaaagacatggtgtcagatctgacggtttctctttatagacagacccattacaaccaagaagctatagataggcaaagtatgcagagaactaagggccagatttaagaaagaaacattttgagatctaagggattggttcttataggtttaatattgctatagttatgagtcagccctgctggacacacacaactgtacagcaggattgggggcaatgtgtggcccagaccctaggccaaggcatcacttccctaggagatgcctcaaggagcacctttggactccattgtccaccaccactcttgagtctagaatgatatggaagaaccttcaggtacgcagcatttggagacaggatgggtttgcactctatgtggttgccagtgagttggacatattatctggagaaaggaacataaagatctgtcctgtgaggactgctcattcatggcatttataaacaagcccactgaatgtatggggcagaggtggtagaaaaagcttccaacacttcatcattctttagttctcctgattttttccttatccaaatgctatggtctgaattgtgcaccacccccaataaattcatatgttgaagccctaacccccagtttggctgtattaaaagatagggcttttaaaaaggtaattaaggctaaatgaaatcagaaagtggctccctaatttcacatgactgatgtttccgtaagatgaagaagagctctctacacacagagaaaaggccacatagggcacactggaagacggccacctacgagccaaggagagaggtctcctcgatcttggacttccagactccagaacactgagaaagcaaatttagttgttttagactcagtctgggatt

SEQ ID NO: 60776 - DNA, 937 bp, Bovine  19866880461147
gatgtgtcatattctcaggggcagccaagggtaaagggtaagctggccgggggcagggtgggactcgggagggtgacgtcaccttccctcttagtaatgctttggcagagcccgaagctcccaccttgggagggagagggggaggaggggcagccctggagcctgtggcaaggaggctgccaagtcggagatcaggaatgggcaccctgccaggagcagccgggaccaggcctcctgggcagggggtctccgggaaaagagacgcatccccagagtcctgggaggggactctggaaagagtatgcacatcagagggagtgtggagcattggtctgtctgtctggcattgctggcagccagacgtccgctgatcaatgctctactatctgacggcctgagcattcatcctccgcagtgtgggatggcctgacttacgtgcctggcccttggagacggcggaaaggatgggctgaacctccatccacttctatgaagcctggggctagtctctcacaggggccacgtgtcaccctctctgagcacccagggtcaggttgaaggaagggaggaaattaacacccaagggtggccaggtgccagagctgaatctgacaaggacctgcccacgacggcttgcattctgggaggggagggcaattcatatgcatgaagacagaccccagccggagctttggacaagcccactggtggagtggagtggagagcctctttactcttgtcttctcatgtctctttacgagccatttgtgggagatagtttaccccccgtttctggatgaaaactcgggcagttccacttgttttctgtcttctgcgaggggacaaaaattcttaggtcactttaagtggcaaacatgaagtcaagctaataactcaaagcgtctggtccgcggtaagcgtcacacctttgaacttg

SEQ ID NO: 60777 - DNA, 3515 bp, Bovine  19866880562616
cataatgctattaacctactgggcacttgatggctgtatgacctggggccagtcacttcacctctctgtggctccgtctcttcactgcacaattggggtactaagaatatctgtctcacaaggctgacatgaagcttacatccgctctataaaacacttcgatggagcctggtatagaagcatgatataaatagatgctgcttttttttttttctcttttaaaccttttttatggtgataaccacccactccagtatccttgcctggagaattcccatggacagaggagcctggcaggctacagtccatagagtcgcagagagtcagacacgactgaatgactaagcatagcacgcacagtacatggtgataacatttaagatttactcttttaagaacttccaagtatacaatagagtgtggttacctatagtcaccacgttgctcattacatctgttgagttcaataatctaataggaagtttgtatcctttaaccaacacctcctcattttcctgaaccaccaccaccaatctgatctctagttccaggagttcagctacactagattccccatatcagtgagctcacacagtatttgtctttctgacttatttctcttagcataatgccttcaaggttcatccatgttgtttcaatgttgagatttccttctttttggtggctgaatatagatctctattattattgtgtctacttaggttttcacagagtctagacgcgcagcaaggatatcggattctcccatcccctgtgtttaatgctaacggcaccaacagtagtgtccacaaacatctcttaccacatgccgggcactgctcttaatgctttacacacattcgcccagtggatctcatagcagccctctgaggttgctgcttgttatggactgaactgtgttctcacacattcatatgttgcagtcttaattcccccagtgtgactctgtttagagatatagcccttagggaggtgatttaggttaaatgaggtcataagggtggggccctcatccaacagaattagtgtctctctaagaagaggaagagaccccagagactcctctctctcctttctgggcacacacagagcaaaggccacgtgagggcacagtgagaaagtggccgtctataagccaggaggagaggcctcagcataaactgaacttcctgccaccttgatcttggacttgaccgtctggaactgtgagaaaacaaatgtcttctgtttaagcccccagactgttctatcctgttatggcagctctagctaactaatatactgtaatgttattcttaatctcatttgatgcatggacagtgaggcttggtgaacttaaggggcttgccccaaggtcatacctggtgagtggcaaagctgggctgtgaaccaggcattggctaccaagtccacactctccctgaacctgcctccaagttcaagggcaggggactgggcatcccagaagtaggtggccaggcccgagcagcatggacagtctatatcaaggagcatgggtggaggaacagggcacatttcggccaagactttcaggctgtttccaagacctgcctgctatgcccagcatctgaaggccggtggtagggagagggcctgaccgcatcctatgtgactacaagccggctgtggctaccgggagtcaccttcagcctggcctagagccagagcagttctacagtggaaaaggttcccaggtcgggtggtaagctccctgtccccaaaggtattcaagcactgctgttcgacctctacttactggtgatgtttggggaagaacgaacagcaagaagatattttcataccgtatgaacagcaagagtagatattttcaatagttctctccagcctcaagcagctgtgaaatattagaaggggcagcagttagaggagtccctggaaaaaacacttcctgaccagctttgcctgttaattcttgctcattttccaagtcccaactcagatatcacctcctccaagaagtcttccttaactctccctccaacctcctcatgtccaggttggtggcatgggagggtcctaccggggcttcatgggtggtgctagtggtaaagaacctgcctccctatgcagatgaaagagacttggcttcgagaaaacttcctccgaggagggcatggcaacccactccagtattcttgcctgaggactctcatggacaaaatagcctggcaggctacagtccatggggttgccaagaatcagacacaagtgaagcgacttagcacgcccacacgcatgagtctaactggcaaaactagaaatgacatgtgacaattgtagggagacacagttcatcttgatacagtaatatgaatcttccatctctacggagtcagagaggcctagggtttaaatcctggtgtccgccacttcctgcttttgggggaatgcctcaatccctctgaactacaatttcctcagctgtaaaatgatttcatctcagaggatgaaaccaaagatgaaagatatcaataatatctggcaatacaatatggggtatgggccactggcactcggcctgtgatcaggatatgcacatttccttccgtctctgggaaggcataaggtggcggaggtagtaagctgtctgacactgggcgtattcaagcagatgtcagagtttgagtgttaggatcggggtcagagttcttcttctttgcactgaaataaagattgtactcagcagtgtccttatgagttcttacaactctctaaaagcacacgtatgactcggccttggccggctacgcaaagagtggacatgctttccacccacctccaccaggctatgaaaagcaggagtccactcacaatgcatgattccatttacaaaaaatgtccagaaaaggcaaaatttacagagacagagggtagattggttgttgcctgaggcagggggcgggaacggggactgagagaaaataggaagcaggtttcttttggagggtgatggaagtagtctaaaattggattgtggtgatggttatacagcttcatgaatttactacaaatcagtgaatcatacccttaaagtgagagagttttatggtgcataaattgtgcctctataaagccgttaaaaacaaagccaaaacagtcaccaataaaacaggattccagaggaaccagtgctatggtggaggggtgatgtccacgccccacaggaagcatggtgggagcaggttgaggtcagaggtcagaggcctgaggtcacctcctgtctcctcgacctggggcttcacctgggtacttccttgttatctttcgttgggtaagatgcttgggtaagatgcgaggaaatggaacaggcccactggccaacctcattaaaagcctgcagagaacctcaggcgatgtgaggagggtgggggttctgcagaagggtgaggaatcccgagtcctgtaggagactggcctcccagaaggcttcagaggccagtgctgtgtggcag

SEQ ID NO: 60778 - DNA, 2840 bp, Bovine  19866880571363
gattgtagcaagggccctctggggaccgaccgcccaaagtccctgggccacgcctctgaaggatgaccagggcagaaggatggggatcctgctttgttgccccagaaatttcctcaacctcgggccaggggtttcatctctgcaggcctcagtttcctcttctataaagcaggagtgcctatctcccaggtgattgagaaatagtgtgtgtaaaatgctctctgaagtcaaaataaattaagatgttagtctcaggaggctgccttgaatgatgggaagggtatgtgtgctgctaagtctcttcagcagtgtccgactctttgcaaccccatggactgcagcccgccaggctcctctgtccatgggattctccaggcaagaacgctggagtgggtagccatttccttctccaggggatcttcccaacccagggatcaaacctacatctcttaaatttcttacatcagcaggtggcttctttaccagtagccccaggtgggcagagcagggggcttaaaatcaggagttcctagttctggccctgctgtgtgactttggaccagaccctgcccctctctgggcctccacatgcccctggtgtgaaaagagagaattggagtcactaaggcttccttctctgaagatcctccgaaggcagagcagagggctcgtggcaggaacacagagtgcccagagctggttaagctcccagatcagagactgtgctctccaagatgctgcagccactctgcttcctcagcattcaagagtcagtgagtgcaggccggggaaggctgtcactcaggatctgctacatccaccacaggctctgcctccaggagcctaattagatgttaccccccatcagctgtgtccatgtccccatgtctgtgccattcaccaagtacgccaggatttggggccaattgcttatgagaccgtctgtctagagatgaagcacagcaagcaccaccagtgagcaaataagttcctcccccctcggcttggaacctgatgacaagcatcattgttattccagcaagtctcagccccaagtccttacgtttgtttttttcttttttggccaggcgactcagcaaatgggctctcgttccctaaccagggatcgaacctgtggcccgaagggattggactgccagggaaatactgccttcctttttttttcccctaagcctgagtcccatgtcctgaagaaggaacacaggggtcctagagtcaggcagacttgagtcagttctggctctaagggttttcaagccccctggggccttagtttcctcttctgtaaaagggaacaatggcaattcatctaatttgcagatctctttggaggatcaagtaaggtcactcattataggtgaatgcccaggacgcaataccctgcagaggctcaaaaatgttggtccctgccaacaaaaacgtgtgtgctccccacacacagggcccccaggcttccaggctgccctgtcacagccctgtcacccctaaggcagtcagccagtgctagtttcccttcctgcccggcatgctcgtggtccctgtggctgttaacagttctgagtaccaggttattcattctcagtagactcgagtccttgcaggagggaagctgctggcctctgtgtcttggacccagcccagtgctggcataaacacacaggaaggaaggaacgtctaaaatgcttttaccgacactatctctttgaatccacgcactgagcctgggagttaggtgtgagaatgcccgtctcagaggtgaagccatccatggaggctcaggtgatgaggaggctggtccaggcctcccagcttgctggaggcaagggcactggttgagacccaggtgaggctggtcccctgggactcccagaggctccacccggcaccacaggccctcacctggcaggagtgaatacaagacgtttcttggctcccaccagcccaaagcagacctacctttgcttcctccgatgcgggttttgccctgtctgtccacgtgctttcttttccctctctccagaaagcacgcccggggggctagaggcggtgaaaataaaaggagtgatttatgaactgagctgttcttcttcatcaaagaaccgctcctgggcctgctccgtgcagatggaactgagtggccgtctcggggcagtgggagcgggaagatgaataaagctgtctggcccaggccggcgcctgcagaggagaacacagcagtgctgcatgacctcgccccgcgtctgcccctctctgggcctcggggctcccatctgtcacaggatggcagcacggggtcatcccccagaggcctgcagctggcacgggggaggatgctagccggtccctgggatgcgctcgcctggttgcctgactctgggctgacggcactgggctagaaactttggagacagaggcatcgcactccttctttctggcaagccaagtccatggaccttatcggaagctctggtttggagtctagcagacttaggcttgactcatagccaagtcttactaaacatgtgattaaaattccaggccagttaattatatcctctgagcctcagtttcctcatctgtaaaatgggttaacaatgatacccacctcctatatgaagattgaataaaagaatgtgggagaaatgcttagcagagtctgatacatggtaaatgctcaatactaccagttattatgaggttcagttaccacaaaattgaagcaacaaagttgactttggggccactaagaggaaagatatatatatatatatatccctcctgaccaagccagatgtccatggtctgccccacacctacct

SEQ ID NO: 60779 - DNA, 1404 bp, Bovine  19866880620731
cgtgcaaagtcagcctaaggaagattagtgcctcttaggtctttcctgggcgagctagcagccctttgcatgtagatttttagattctcagggatacactggcacttttcacagtcccctatggacacgtttttatttttaagcttctggctctgagtgggactgggagaggggaaaaaaggaagacaggaagggaaccacagctgataaacactacgtgccaggctcagcgctagctttcattataaacctctttacctgattcttataagaattcagttggttctttaaaaaaaaaaaaatcgcttatttggcttcaccgggtcttggcacgcggctctttgatcttcgctgtggcgtgtgagatcgttagttgcagcgtgcgagccgctagttgtggcctgttggatctggttccctgacccggccccctgccctggaagccaggagtcctcgccactgaccaccaggcaagtccccagttggttctttgttagctcatgtactttacagattaagcaaacaaacaaacaaacaaggatccagaaaggtgaagaaatgtgctctggggcccagcgctgcttaagtggtgacctcctgctctgtctccagggcccatgcctctctaccagtgtttctcaatcgtgagatgatttgaggtaaatagacgaccattcaacaacttgcatgtttgtgtgtatgtctagtttgtacacccaatccatgattttgtgcttaggacaaggcatatatcagtatttaacttttaaaagttagtctaaatacaattattaagtaggatgtgagtcacgtggtgtgttgtcggggcaaaagttgagaatgatggaaattggcatgataccacatcccgcctgtaagccctcctctctgacactgggagctgggctgggcaggacaggaagggctggttgtcggtatagtgctgtctggtagaatcttcagtgataagaggagcaagctgctatctgcaccgtccaacacaacagccatcagccacactgagcacttgaaatgtggcaagatggaaaaattgaatttttaattgtattcaatttgactgaatataatttgaatttagggcttcccggtagctcagctggtaaagaatccacctgcaatgccggagaccccggtttgattccttggtcagggagatcgctggagaagggataggctacccgctccagtattcttgggtttccctggtggctcagctggtaaagtttaaacagccttatgcaattagttgctaccgtaccagccagttcagccatagaccaacctcatcacaactgttccaaaagtcatccattgagtggagagtgtggctctcacggcccttacccaggaggccgcagacccagcttctactgagcccctgga

SEQ ID NO: 60780 - DNA, 1363 bp, Bovine  19866880675528
ccctgacttgctcctgaaccagcataactaatcttgaaggctccttgtgagcgcacctccctctgccgtatgacagcccccgctttttagtctcagcatattcctaaaagccccctgcgaggtaccattgcccacctgtgtcagatggcgagactgaggtccagagagggtaagtaacatttcttaggccacacagcaagtttacaaaggaaaagacaaatcgtggaaagcttttttcttagtagatataaaagccaatagagctattttccttctcaaggctccaaattggacaatttaattctggcggtgatggctacagaggggaagaatcctgtaagccctgcaactgggtggtttttttttttaatttccccgcccgtgacttatttttgttgggaagtgagaacctcagcttttctgccgaacccagccctgcctcgtgtaaacattcataagctgtgaaaagaattcattgatgaatttatacagcactcccttatccccgggagaatgaaacccagccactgacacgagggtggtagggcaaggctgttgcacaccgaatacccacatgtctctctcctctcatccctgttctcatcgctctctggatgcccaggcgctctgcacaacctcatctgcagaaaggcaaaggcggccggacgcctgggttcttccttcctcttgctctcttctctgcttggagcagaggggagggaattcgtgtagaaatcaactctgacacatgacttcctcaatcctggctggcttctccagtacaggagaaataaagccagtgatgaggtgccaccagctcttgtcgaacacctccctttggaggaaacccctcctccaaactgcacgggccactgtggccgccactggccacacatggctattaaatttaaatcaataaaacgtaaatagaattaaagggcccgggagcgaagttctgctttgccaggtccagtcaatgacccgatgcatacagagtggagcagagccggggaacctctggacaaagggagcactattaatggtataaaccaccttgccaaagccacaaatattttgtggaaaaatactcacagagggctacactgtgtgccaaaacgcaaaagaggcatttgagaggaaaagctggcttcacggagtggtggggggtgggagacacacaccaccaggaggaatttttttttttttttttggtcagaagaaaaaaaaaatcacctatctttcttcctttttaaaaactgcaggagtgggactgggagactctgtaaggctccccctgagagtagagctctactagcatttgctggatgaatgtatcaatcaagagaaaatattaaagtaacgg

SEQ ID NO: 60781 - DNA, 1320 bp, Bovine  19866880701034
ctccactgcatctgaaaggaccatcttttgccccaaaccatccagctcttcccctgcttacagaccctgtctgtgagccggcagttctgcatcattttgcatcattcctctggtcttcccaccacacggagatttcaagcacttcccagtctttgaagtccatgatgccagatgatttctcctgcaacagatctgtttccaagactggtctgtgcccaagaccaatggaatgatgtctgttgaaccctgctaggcaccttcaggtccttgggaggtgggaaacggtatcttcgtctaaccatgaggaagctagggctcagagaggttaaggcacttgaccaaggtctcacagcgaacgcatggcacagccctttctctggactaagctgcttgtctccagagataagtgaggcatggagaggcggactgtggagaggaagtcatgaacaagaaggctttctaggagcggatttgagagtggggagcccgccccgactgagagctcctgtgcggacaaccaggatggcttcggtctgtgttttcccagcataggcgtcagagcacgttcacgaacttggggagcatcttggggctggagtcagggggacctggggctcagccctggctctgctatgaacctactgtgtgaccttcggcggattgttggccccctctggggctcagcgtggaatcagagggttggactgaacgacctcagtgcccagtggctctaacacttaaggagactatgaacgtggcagatagactctacaggacatggttcctcgcagcccaaagtagagtgttggtcagagatgggctctgcaggatgcgtgatgcaccctaggtcagagttaaggagggaagttcaaagcagaggaaaacacagagggagtctctgcccagctcacttggcacctctgccccagggcctccagcagagagctggtgtgtgtatgtggggtgtctaaccaccatgtctccccgtgtcttccccatggtcctgcctggccccggggagcagctgggcggggcctgcttgctgggcatcggcatctgggtcattggtggaccccaccggcttccgggagatcgtggccgccaaccccctgctcatcacgggcgcctacatcctcctggccatggggggtctgctttttctgctcggcttcctgggctgctgcggggccgtccgggagaacaagtgtctgctgctgtttgtgagtatcccatcccccaccccatgcatgggtgccctggggagggggggtggatagagccctgcacccacactaggggggactcacactggggtctgag

SEQ ID NO: 60782 - DNA, 1265 bp, Bovine  19866880742817
tcaccaactcccggagtttactcaaactcgtgtccattgagtcagtgatgccacccaaccatctcatcctctgtcttccccttctcctcctgccttcaatctttcccagcatcagggtcttttccaatgagtcaattcttcgcatgaggtggccaaagtattggagtttcaggttttcagcatcagtccttccaatgaatattcaggactgatttcctttaggatggactggttggatctccttgcagtccaagggactctcaagagtcttctccaacaccacagttcaaaagcatcattcttctgtgttcagctttctttatagtccaactctcacatccatacatgaccactggaaaaaacatagccttgaccagacggacctttcacactccaaatgtctgctctggaccaggctttgtctcagatactggggcctttaagctgagctgaccaatcacatcctgatcctctgttggctcttagacaagtgggcaagaaggatccccctgggagccccgagaccctgcctgtcccccaggagtccctctctccccagcacctcacccacgatgtgagagggttaaaaagcacagggcagtgcaggcccacgcctgggtcgaccagccaggccaccactgggggcttgccgtcttccttttcctcctcctcctcgctccttttttttgttcaagaaacatatgtcactcgccataactcatgtgcttattataatcatgaccagatgcttaatggcatgtaataaaaccaccactaacctggccctgctcacaaatctctcccccttacccccaccctgcggccagcccgcctgcccctcagctactcttgacagtttctcatggcaagactgacttgaggaaaagggacaaaagggaaagtgaactctgtcattcacttctggctcattcattctttcatcatccgtctctcatccattcacttttttattaactgtgcactacacaccagacactgaagatgcaatggtaaatgaggacaggctgacctctgtcctcctcagtcctctgggaggaaagatcgatgtcttgtaaacaggtaattaaacccttaattaattgcagttaattacaggggagattacctaataggagagtctatccagactggatagtcaccttcaagagcagaaccgtgtctatccgatgcatccacatacattgggtccctaaaaagtccttttttggatatttgtccaggaagtgaatgaataaaggagtgag

SEQ ID NO: 60783 - DNA, 1176 bp, Bovine  19866880822073
acagtccctgttgaagctgggctgcaacccagatgtagaatgttggtttcacggctcctcgaactacgccaggtgctgcctagcatcccaccattttcgctttgtcttctcctctcagcctctgagcttccttggacctgagcctgtcagcgaggggaccacacggcacctggcttgcctcccttttgcctgagtgatgcctgcatgcggcgtaggggtgggggcctctcacagttgggtgatcccaacaagctcctccacccagaggcaaacagcacgctccctcccgagacagcagtcttcctgtgctgaaagcaggctggtgaagctgccggctcctcctctgagcatccttcatcccatggaaggctcctccaactccccagggaccaggacttgtcaccggagatggagccaagctgcacccaagcctcacacccaccaagcgcacggccccacttacattcactcggtagtaaatattagagacacccggtcttcttagggcaactgcaatgattctagtcatctggcctgatttagggagggccacaaccccttcccattagaggaatgactacaggtatttggagttcaagttatggagggaaagcaacggagaagtagagggctcatgacaaagagtcccggctggcttgagaagatcctgagaggaaatgaatcaagggaagatccgggctggggcctgagaagaggaggaggcgggaggcagagagatctgcattctttcctccccataaaaaatcatcccagctgtgcctaggagccctaaaggaagatgtgggcaggatggggcagggcttagatggagacaggcgcaggctcaggcaaatccacagctccagtggatgtaaggatcaaaagtccagggttctgaaatcaaatcccgtttgggatttcacggccaccagctagctctgtggctggaccagtcccctctcactctggcttaggttctgtgtaccaggcttccctctgtctctccgtcttgagtctcatttctctgctctgtctgcgctctctcccctctctgaatgtatgagagcacgcgcgtactcacacacacagacactgtgaccccttcctgcaggggtggaaggctgcctgctgttggtggctagatctctttcctcttaaagcccacctccctggggg

SEQ ID NO: 60784 - DNA, 2611 bp, Bovine  19866880872285
tctagaaactgtggagctcggtgtggccttcagcctgtcagccccagatggtcttgcttcccacaaaaatcactgccctaggcctgtatcctcagctataactgaggggttggggctaagccattgcatttcaggatttttgagccagggatgactttaccagtgaagttggcctgaggacagttgaactaatgggccacacctgtgctaccacctcctgcaaatgttttctcctgggcctcaggccaccaccctcatccaggtttcacctgactttgcttcatggccctcctaggtctcctttgccatttttctttatcctaaataattcctattctgcagtgtggttcctctaagcttctcaaagcagcccagctgatcttccaaaaactgtatatccaatcatgaacctcacgtgctactatggtctgaatcatggttttccaaattcatatatgaagccttaacctccaaggtgatgctttttggagatagagcatttaggaggtttagatgaagtcatgggggtggggccctcttactgggattagtgcccttgtaggaagaaacaacagagagtttcccttccctctctctgtctctgtctctctctgtgtgtgtcatagaagcacacagagagaaggtggccatctgcaaaccaggaagagagccttcaccagaaattaaaaatgtcggcacctgatcttggacttcccagcctctagaatagttaaaaaaaaaaaaaaaagtctattgtttaagccactcagtctatggtatttccttataatagcccaagctaagacatggactgaaaaatcctccatggcaatggcctaaccccctagacttccactccccattctccccctcacactcttggcttcagctctgctggatatgtatacactccactcaaacactccagtaccacatcccaggtgaaaggtgcttctaaaagtgatcagacagctgtcccctggactcatccttgtggagccctctcccctttagagtggactggacccaaggacgccattgtaatcacttctgactagcaaagtaatgggacttcccagatggtgcagtgataaagaatctgcctgccaatgcaagagatgcaatttcgatccctgggttgggaagataccctgaagtagggaatggcaacctgctccagtattcttgccttgaaaactcagtggacaaaggagtctgatgggctacagtacatgaggttgcaaagagttggacacaactgagtgactgagcacacacgtagcaaggggactggctgtcactggggctgggtcatgaaagactgcggcttctgtcctgctctctcatctgctcgctctgataaagccaccttccatgttgtgaactctctgtggagaagcctatgtggcagggaaccaattaggctgaccgcttgggaggaatggaggccctcatgtcaacaaccaaggaggaactaaatttagcagtacttccattggttgagcttggaagcagatccactcccagtcaagccttaagataactatagtcccagctgagactttgactaaacctgtaagagacctggagcccgaagacccagccaaaccatgtccagattctgacccacaggctctgtgagataataaatgttttaagccactaacttagggagttatttgttatgcagcaatagctaactaatacaccaggctttacacatactctcctctctgtccaggacacaccattgaccctccagacagatgcttcctcaacaggatagcttaggctcctctggtcatcagagatcacttgaacctcacttcttcagtcccctaggcagtagtacctggtttttttcccctaaatgctcaccctacttgactgtattgtggtgctggagaagactcttgagagtcccttgaagggcaaggagatcaaaccagtcaatcctaaaggaaatcaactctgactattcattggaaggactgatgctgaagctgaagctccaaaactttggccacagattcaaagagccaactcattggaaacaaccctgatgctgggaaaggttgcaaccaaaaagagaagggggcagaagaggatgagatggttagatagcatcacagactcaaaggacatcaactggagcaggctctgggagagagtggaggacagagaagcctggcatgctgcagtccatggggtctcaaagagtcagacacaacttagtgactgaacaacacggaaaactaagaaaatgaacacaagaaggaatttaatacttttcaaatcattgtagaaaaaatgcaaaattatgcaagaaagagaacaatgctattatttcgtgtctttccatgaacaatatttacatagtcatgatgatgaagagctggataatgaattttactaaaaattgggataaattattcaggggggatggagggaaaggacaaccccttgtgtgcataaaaccattatgagtgtgtaaaagttaaaccctcagtaaaaagatcataattctgaataaattacaaaaaccaaggacttctaatacaaagatattatttagaaatacagaggtaaatataggtagcagccaaaagaa

SEQ ID NO: 60785 - DNA, 1118 bp, Bovine  19866881030007
ttccctggatgaatatatagagacctttaaagttaactgattctatttaaaatgtaactgttagatactagaggctcagctctggaattctccaactagccaagctccctcatcagcaatcaaattcgagccccggcggcgcccgtctttcccttctcccttcgttcttcaacccagatgaacattaagctaccacgaccattatctaactggcgtttcctgtctcaacctgtcacctctaattcatcctgtgatctcactgcctggaccagatacctctttgcaaacctacaacacctctttactgccttcgacttttcagctgacctcttagcctgtccatcacctggccctacgtgggtgaaccaacccagcttccgacgtcaacccaaacgcaagctccgtccccaccacgtcaatcgacgttggagtcccccatgcgcccacactcacccagcgtgttctaacttaggtgctttccctcttggtgcttctacagcaggaaaacccactcgggatggtttcgtgtcctcaagaaaaaaaaaaagtggggccttccacactattttgctatcttctcctgattctttacttgccatcaccttgtggagttgtggacaaaataacacagataaattctcataatttattagcgcccaagctgtttacccagaggctgccacctatggtatgcagaggagcagaggaagggatcagcactttgtgcacaaaacagtacatggctgctcatagtcaattctcagccccacgtgaacgactgactttataaccagtgttattggccaggagtgtttcacatctctcaggtgaaaaatgttcaacacttaagtgctactaataatttttatggttggaaatgaggatcaaagtacgaaaggaaaaataaattcccgggttcatacagccagccaagtctgcatggctcattttctgccacatgttttaaacggcctctctgaaaggcgggggaggggaggaggaacaagttgcattttatttctcagctctttaggtttgaaataaaagcagacggacgtggcggggggtggggggaatcaaacattcgagtaacactatacactgctactgttccccca

SEQ ID NO: 60786 - DNA, 848 bp, Bovine  19866881055495
taatcctgcccatgtttcaaaagatgctttgtctcattatcgtagttggggatgattaaaatcaacatagatatttttaatgataccttttatttatataacactgcacatttttatagcattcaccactttcttccattattgggtttaaacttaggaggaagaaatgtagccatcgtagggcaggaaatgccagaaaccagatttgccttttcctcatgactctgcctctcatcaactgtgagactctgaacaagccacggagtttcctggagcctccgttttccaactgagaaaatggaggaatgtattcagttgtctgggcttcccagatggctcagtggtaaagagtctgcctgtaatgaagaagactcaggttcagttcctgggtcatgaagatcccctggagaaggaaatggcaacccactccagtattcttgcctggggaaatcccatggacagagaagcctggcgggctacagtccatgggatcacgtagagttagacatgacttcgcgacagaacaagaataacttagctgtctagcacggcgggtgggttgttagttaaccttcactgattggtggcaaattcattgagcaattcctacatcccaggctcagctccgagtgctggggacaggacagggggtgtgacagaagacttctcagcagctgctgtcccagatacagacagtgggcaaagaacattataaagtgcctcatttcattgagagaaatatgcaaagtgatggcacactgtccccagagagctctggcaaagggttcaacaggtctgatgggggcactaatgcctgaacacagcctcatcatctgaaggcttgttgg

SEQ ID NO: 60787 - DNA, 1008 bp, Bovine  19866881059106
tacctataacttaaataatactgtatagcaattacacttgcacttaaataaaataatctgcttactacattttcagcaatttttcaacatgtgctaaaaaccagtcattttcaaaaatgaaattatataaactatatagaaattatgtaagtcaatcatagtaaaaacaaaagtaaaaaaataagtaaaaatcatagtaaatcaaatcatagtaaaaaaaaaaaaagggaaaaggtactcagacaatactgcttatggtcgacattattgcacttcgctcccatctgtgctccgggggttcttcccgtccaggtgtccgcttggggggccaccacgtggtggtgccgtgccccgctcttcccagctctgcgtgcagtgatagcacagcacgaccctgaatcagccacagtgggggtatgcacactatgggggactccgcaaaagccacagataggacctctcctgccccagggccagtcattaaacactgaccacacgtcgctgagtgtctccccctgagagcagggacccagccagcaggaggggctgaggcgggaaagagccagaagaggagaagcagcagaatcagagtcaggaagtaactcaccccagatggcagagaacgtggtccccaaggcagaggtgggtctcctgactccaagactggggcaactgaggcaagcagccggctctctggggggagcattccagggaatcccagagaagacagccccttggagctggggatgccgctcagaggtgcagtgggacttacccgtctggacagcaggtcaaagcagagtttgttctcactggtgcccaagttaatgatgccctggaggtgagaggtacagagccacgtaagcacagcagagggtgccagcagaaggctccaggagcacacgaggcagcgaagtggagctctgcaatctcgaccttcccactaccccacctggtctttgctcaagcgctgccctccacagggttccctgatcgcatctccccatt

SEQ ID NO: 60788 - DNA, 1054 bp, Bovine  19866881062928
ctggatatgtctgatgcatcatcaaagcctgatggagctagaaaccactcctgctgctgctaagtcgcttcagtcgtgttcgactctgtgcgaccccacagacggcagcccaccaggctcccctgcccctgggattctccaggcaagagtactggagtggggtgccattgccttctccgaaaccactcctgaggaaatcctaattcggaacacttcctagttcctagacaaccacatagcatataagacattgcactgggctgttacgtttccattctgtctcagcactgtcccactgagatggtgcagccatagtactaaagggaacgtctatctgttattaatggatattcatcttatatccaaggtacaaccagcaaacgggagatactttgcgaaggtggtggtggtggggggaaatccttgcatcttctgtgccttggagaagaggcagttgacgaaatcttcattgggtcaagttgtcagtacatcaaaccaaactgctgacaagaacaaggctgtatggagagaaattactgggactatacccagaaaacaagaacagagattgggcacagggtaggcagaagggaggagatgaaggtaaagcccctcaggatctactaggtagactattggaaatcctataggacctgctgccaccaatatacaattttcgttaattatctcaattgtggctgttatccccttaatgagaaacacagctttacttctaagcaggcagtgaggctggcagaaagctgaaacctgaaaatcagcagatacagggctgcatacagcccttactattgaaatgaagccacatccacaacacagggggaggactccaaatagcttcagacagcagccagccacacagggccctcaccaggcaccgggtggacgctctccggactagtcaagaggccccaatcccaagtgctcatttcaataacattagaaaataaacacggggcttatttatagcacaggaaaggcactggggcaaaagagccactcatctggtattctaccctgacggggccggatagga

SEQ ID NO: 60789 - DNA, 1393 bp, Bovine  19866881192703
gaagcggagccccagcacaaagaaaagaaaggccccccaggtttccctcaccctccatggtccccccgcagttgctcatcaccttccaggcgtctgcccagcaatactcactgaggagggcaccgccatagaggcggatgggggtcttactggtcacctgcgctccgtcgaagaccgcatcgtagagctggtcaggaaaggcaagggcctgtggacagtgggcgggaggcttggggtgactccctgtggaaccttccccttggtcatctccttcctttccccagcagcagtccagggccaggaccctgactgcccccaccccgtccatggcaacagagatctcaggttccaaggacaaacagtcaggactgtggaccaggggaccttggatgccccagggcagggcacagggggtatgagcatccgcacaggtcagagaggcggccagagagcctggacagcagaggcgtcagtatgatggtccgatggccctgtgggcaacggcagcaaggggtcccagggcagcagagggcgccgggtcccagggctggggcagggactcaccatgatggcaatgccggagaagagcacagcagagacaaactgccagactctggggagacgcagagaggaaggtcagaggcagaccgctcactgccactctcaggccccaccccggaccctcccttctccaggcaagatggagggatagctggtctggaggagggaaccaaggacaagactacacagggcccctccccacagccttgccccccgccaacactcacaagtcaatgctcacctgagccccaaaggctctcgaacagcaaacttgatctcattgcctaagacctggctgatctgtggacagagaggggtcagaaggcagcgctgtctgcccagctcactccctacctcccagagcctgccagatgcccagggacccacctgggtgcctctgcttagccagagtgacctaggctgggagggtcacactgaggccacactctgcctcctcttgataccagggcccagaggaagctgaaaatatggggcctgagaatgtgagttcaggcatctgccagttgtggacttgaagcctggctctaccatttattggtgtggtcctgggcaaatctttaatctctctgagcctcagttttcccatccataaaatgggttaataactgaacctacatctcccagggctaacaggaagattaaaaaatgcttatagagcagctggtgccataacaagcaaataatcagcactcaactaattctaaccatccgttttcattattgctgctattcctctgacatatccattacagttccagaaaatatgagctgaatctaggggccccctgcagctatacgggtctcagctact

SEQ ID NO: 60790 - DNA, 1005 bp, Bovine  19866881236685
ctaaagcacgtgttttaaatcgcttttccggagcaggtaagggacatttgctgagtcattacactctcttgcccagtctttgtgatcgtctatctgctttcatgggatgtctgactgggatcttgaacgtggtctggaatggcggaaagaggtttcctttgtgtggaaccagctcacctaacaggcctccaacccacagccttggcctcatgaacaccatgttgtaatcaactgagctaatcggccacaggcgtcatcataatagctgcagacaaatgaatcagtgtcaaacatttcctcagatgtataatgctgcggctgtgttctctctactctggggtttgtatttcagcagattaatataatactgttatggagccacaacacaggctgtgggtcctaacttctatctggcctgcagactggggtagaccccaccaaagtgcacagccaggtttctctgcttggcactaagcacctgcctgttcaagccacatcacaaccaccatcatcaattcgtctcaatgggatgaaagaggtttctggagggctacgagcacaagcaactgcactcagcaccagcaacaggcaaggtagaggagaaggggcagggtggggggcatccattcagttggcacctctgctggatagaagctgaatcccatctcccccccacccacatgtatttgagtcaactctctaatctggggctttctggtagctcagttggtaaagaatccaactgcaatgcaggagaccccggttcaattcctgggttgggaagacctcctggggaagggacaggctacccactctggtattcctgggcttccctggtggcttggatggtaaagaatcagcctgcaattcaggagacctgggtttgatccttgggttgggaagatcccctggagaagggaaaggctacccactccagcattcttgcctggagaatccccatggagagaggaggctggcaggctacagtccatggggtcgcaagag

SEQ ID NO: 60791 - DNA, 781 bp, Bovine  19866881241231
ctttaactagacggacttttgtagcaaagtgatgtctttgctttttaataagctgtttgctgccgctgctgctgctgctgctaagtcgcttcagtcgtgtccgactctgtgcgaccccatggactgcagcctaccaggtctctccgtccatgggattctccaggcaagaacactggagtgggttgccatttccttctccaatgcatgaaagtgaaaagttaaagtgaagtcgctcagtcgtgtccgacccttcgagaccccatggactgcagcctaccaggctcctccgtccatggaatttgccaggcaagagtaccggagtgggttgccattgtcttctccaataagctgtttagccatagcttttccttcaaggagcaagtgccttttaatttttttgcgtttgatggatactagcaaattactcttcaggaatgttgcaccttcaatactgattatactcagactgttacatttctgtcagttctacatttttacaagtgaaccgttgttcagtttgcagtttctttcgtcgtggaggaggctgccggtcctctgaatttccctgggagcctgagccgcacccacctgcctgggagaagccctgagtggtgccctaactcctcccgtccagcaggaggcgcggccccggacgctcccgcatgcgcggtgcgctgggtgtcagaccgccgagcccagtggcctgcccggggctccccccgctcgttcccgcactcccggcccagcggtggcggcctggagctccgcgccatcccacccg

SEQ ID NO: 60792 - DNA, 1200 bp, Bovine  19866881384466
gaatgatgctacagctgaaactccagactttggccacctcatgcgaagagttgactcattggaaaagactctgatgctgggagggattgggggcaggaagagaaggggacgacagaggaggagatggctggatggcatcaccgactcaatggacatgagtttgagtgaactcggggggctggtgatggaccagggaggcctgacgtgctgtgattcatggagtcacaaagagtcggacacaactgagcgactgaaccgaactgaactgacacttgctcccccactgcctgagtcctgtcctctcctatctccccaacaactatttacgcaggggtccaaattaggccagatgcgggaggaaggagtcctcaagggcaggacctctatgccacctaggatgaaggctccccacgcccacacctcccatccctttgatgcctggagggacaggaagcagggtggcaagatggtgcctctggtctagtccacaccccacacccctggtttggtggtgaggtggccccatgcctgaccaggaagatgactccttggccacagactggcctcgctgcatcctctgctccctacctctcctcctgaggtccctgggggtggggggaattggtggcctcctaggaaagaacccacttcatctgtactacagataccacccccgaccctgagaccacgagaggccttgtctttgcaccttaacacacctcgtctttgctcctctgtctgccctgcccccagcctccattggtttgactcctcagtgccttcctcctcatattcaaaagctcgaaaccatgaccgaaagtttggggacactgggtttgtcctgacacatctgggagcacatgttcaggcttggatccgtctgtctggatgttttccgtttgttggctggttttgcctgcaagaggtgtgaacctctgattggctttgaggttctggaaatcaggaaggtttgtgttcatttcaaagttcagaaaaatcactgtggttttgggtcacggttgggtttgcctgcttgatggcagcggtggtctggggggtatctgagctaggtctctgtggggtccccatggggtctgagtgtgagacgctcagggggtggccctctgggtggggctgatcctggactcagtgatggggtgagtggccaagggcggaggcaggggtagggcgctgtgctcg

SEQ ID NO: 60793 - DNA, 1162 bp, Bovine  19866881407972
cttctgcgtttgtttctcgggattactgcttcctcccacaagaatgggagcttcacaagaacaggagcccttctctctgtctaccccacatttcccaagattaaacagaacccacatgcactatgggcttaatacatacttgttgacggattaacaaaagaaactagagtaagtgcctcattttaccaagactactgagaccaaaaaagggaaactaacttgcccaaggtcaccgctcaggtcaaggccaggccgggggtccaggcgtcccaacactgagggcacggtgtgcccgtcacacgtctcagcagggacaggcagaccctcggtgggcaccaccatcccctctctgtctcaggagtgggcatctccacgtgtgtgaccttccgccagcctggccaggctagcctggctcctgcacccccagactgggctcccgaaaggcctgttgtccctctcacttccccagagcagcatcaccccgaggggcctctgtgggaagagggtggggtggggaaggggaagaagcctgctggggatgggccttgggccacatctggaattaagagccgaaaacccagctcagcgctgataatgctttattgacaggagatgaaagtcgggcgggctgtccatctctgtgctccggctcgcgctgctttacgaggtgtgatgctctctgggaacttcgggggccctccccacccccttttcctgctcccagcccacattagagccttcacaggcaggagcccctggcttgcactccccacccttggccagggggtggaggtgggggatcggtcccaccttggaaaagactgaagaggcccatgaaagtgagggtttgttcctgccctgccccatgggacctgtctgcccccagcagcctcagctgtgatgaaccttcctttgcccatcatgtaacacatcacaggtcctgggaattaggacagggacatatgggggggggggcggtgcgcattttctgccaatcacacgagctaagaaagagaccctcctcggggtgtgtgtgtgtgtgcatgcgtgcatgcataggttgggtgggtgtgcagagaactgaacgttctagcaggaatccactcatagtgtgaggtggggcaatcagacaggtatatgctttacaggcgtaaattcaagt

SEQ ID NO: 60794 - DNA, 1467 bp, Bovine  19866881757043
gtgagctaggacagagtccctcttcccccagcgcgcccgggcccttcagactctcccactgcctgcccttggcctcagctccagtcctgccttctcttggccacctctcggctgtttgcagaacctcgagtcacactgctctgtccagtgaagagctgttgagtgttgagccacgtgtttgtccgtgtgtctccctaatgtctagctcggtgcctggcatacatagaatccccccaaatggttgttgaattaattgaattaaagttagacaggactcttgagtgttcccctcgttgggaggtttcaaacaggtggcccccatggaggattcagcctgcatcttttaaaattctatgtgactggctttgagcgtttttaaaaaggggaggttccatggaagaatgaaccccactttctcttcaataagcagaagggttccaccgcctccttcctgggacctagctctgacaaaaagcccgttggttagagctgaagggtggccccttcttagaaacagagcaaatgttctccttttcccctgaagcttcttcccctgtcacttcacccttttacacaaaatctgtcctggactcctgtaagcactgacattttcggcctctgatttgtttaaaaccttattttgcagctggacatagatgcacggctagggggttgtccagaatttcatttagcgacgaagtttgggccaaggctgggaccgaggtccctgggtcttgcctgcactcttctgcctgcctcaggctccccatatgtccttcccccacactggaaccagcccgcacgcaccctacacgtgcttggaatctccgctttggatttgccttaagctccttttgctacaaggttgggatgttttagagcttcctaagtgtacatcagctcctcccattaccacccccaacgagctcctcggtgccccccgagcgcagcgtccagagctacatccatcacggacactgggctgtcagcgtggccacgtgcccctctcaaaggcccgaatccagaatgaatttatcccagggggaaccttgttatgcttttatgtcttcaattcattagattctctgtcagcagcataaatcagggccggaccctcttctcacacactcgggaatggggaagacacgcagagaagagagaaaatgcgcagggggcttgggtgtgctggacagtggcttccccacccccgtatttattcctttgtttttttttttttagccaaaaagggatcttagagagatcaccgggggcaccaggcagagggagaggctagatgggggagactgaggctaaaagtgttgcttcccccataattttatcagattgcccctaattccaccccagttccatagtcgaaagctctctccttttagtccaccatggcatgcctaggggagttatctttacaaaaaaccaaccaaatcacgttaaattcctcaacacctc

SEQ ID NO: 60795 - DNA, 735 bp, Bovine  19866881824487
ccactgccctcctccgacctcagcttttcagtttcccggcttgatggatatagaggttgttaggcttggcccctggcctcagcctgaaggaagctgttacatcgtacatttcagatagatttaactcagccttctgttttaactgatttcagtttttaaatttgaattgatctcagggaactcccctatggccaccccagcttcgggttgctacttccacagttcttaataggcaggatgggattggctgagcgtttcagggcggtctgtcgggatgggggccatcgagaagcagaagcaggagtgcccttccttccagctgaattcagggaccgtggggagtgaggctctggggacccgctgttcaccaggcaggttgaggacttctggagggagctcaagatttgtacagagataacctgatggttgattttgtgaatctgtggttgtgtttgacagtgatccccaggatggacttggggtcatcgtcggacaacctgaacatttcgtagtacctttgccaagttggagaattctcctagctcacatggctcctggcatccaacttggagaaaactgttaatcaatacatgtttttaaaaaaatccttaacacaaggagttctttttctccttcaagttggactaaagctcagaactgtaaagttatcaggtcagttggctcagctgtttgtttttcataaattggcaatgtttttgagaaatctatttttca

SEQ ID NO: 60796 - DNA, 687 bp, Bovine  19866881840829
caggacgttcttagaacaactgtggagtctccagaatggatcaagatccattgttccccagccagtcggtgggctccaccccgcattgtccacggcccctcccagctcctgcgaggctcctcgaaggagccgatgaacctctcgatcagagctttggctggcagccctgtgtgctggtggcttttattgtgagtgcccaaggatctcggggtttccttgtccccgggctgcacaccccgctggggaaaggcctgtttatggtaaatgatgcctgtttgctttgattcctagctcaggccccagggccacgattgagtccccgtaaattaaaagctgcttatattggaggggggtgggggaggagggcggtggattaagcaatactgtgaagccctgggaaccatggggacttcagagagagcagccagttgggcctcccagaggcagccagggggcgtatccttgtcccacgtaggcgggaccctctgggtggtgccgctggactcaggaactagggtgacactgtgtcttctctagacctacaaactgtttagaaagaaaaaacacaaacttccgtcacggcgggcttctcctctttcctgcttcttatatttgcctaagatgttcggacgcctgggaggtgctgtcccatgatctacactgcaaactgagggctggtcccaatat

SEQ ID NO: 60797 - DNA, 2052 bp, Bovine  19866880845919
ttgcagtttggtagataatgcctctctggggccgcaattgcccccttctggctctggctgccctcgcatgtctgggccaggatagcgctgctcagtcctttgttctgcaagtgggcctgatggtgtcttaggttagcactttttgtgaagtagctatcccacagtctggtttgctagcccaagttagttccctcagattgcccttggggcattcaggccaggtccttactctaagcaatgtagtccgtgtctccctgaccaaccccagcttgctagtggtggatgcagacgtctgcactgcttctcctctgggggagttactgttgggcacataatctgtgggttttaattatttacttatttttcctcccggttatgttgccctctatggttccaaggctcgccacagactcagcagtgagagtgtttcctggtgtttggaaacttctctcttttttaagactcccttccctcgacggagctccatccctacctcttttgtctctctttttatcttttatattttttcctacctcctttcgaagacaatgggctgtttttctgggtgcctgatgtcctctgctggcattcagaagttgttttgtgaaatttactcagtgttcaaatgttcttttgatgaatttgtgggggagaaagtggtctccctgtcctattcctctgccatcttaggactgcccccttagaggcatttctgacaacgtaatttcatacagtggtggttttaggattctgagttttatgaggcagatttgccctaaattgtagtaattccatctcctccttcctcatacccatccaacagtgtcagcttctcagtaattatcttccattgccttatgtggcatcccttctttcctgttctgtttttctgtttctaactgtgatatggaaagccatataactcaattaaaatgctgagcctatggtagctgatttggcatctttgtcccctggtttggctttctttggggtttgctcatagatgagtagggtctagataagagttgaagagttactctaccttgtaaccatgttctttagcaaactgcagaatcagtgaccgtcgttctctggtagtgttggtggcatcaaaaacctagaggcacatgatgagattggtttgctttaaatctagttctgatagaatgcctactctttgaccatccctatgctaagcaaatgatttcaaggaggagataaaacttgaccagggttttgaaggattttaaacgacttatatcaatttctcaagcactcgttgaggccttgctgtctgcccagaaatgtagccgactctgtaggcataaaaaggccagaggaaaattgtggaattctattagtctcattttacaggtaaaatagctgagacttagaagaagggtttcttttacccaaggccactgagacttactgacgaagcagaattgaaactgattttctcaactcctaggtgaagcttcttccctccctatcactttggagttctttgaagcccttttagaatttccaaatcctatatcagaggtttatgagattaaattggctaggtgtttaggtaaatctctagaactaaaaaatgtttgtattgcagtcaaattctagtgtagtcctgttgaattattgggggtagagtggtagactctattggttaggagtatagattctggagctatacaacctgtattccagttctggcttaccctttgggaaaatatttaactatttggtctttctgcactacatttttctggggtataaaatggagtataataaaaaatacttatcttgtgggggagggtggaattacattaatacatgcaaagtgcttagaataatgtatagaacataataaacactcaatatatattagctcttctccatcccaacagaaacccaagagaaaatgcaaattttcttactgcaacacgaccttcctcatggctgagatagctatgaacatctttcagggctgctagggcacactgcctgaaaaagatgaagaaagaaacagagacatctactgtatcaaag

SEQ ID NO: 60798 - DNA, 989 bp, Bovine  19866881757324
tgccagttcagttgttagtcagcagtatgaccttgggcaactcccttccttctttcctggggccttactttttcatctattaaatggggcaatcaatatagtggaatagataacaataacaataataaaactttccactaaaaaatccctagaaaagctggataaaataaatgtttgcattgctgatctttcaagaaaacaaaacattatgaatatagggttcccaaatgaagcaaaacttggggaaaagagtgataaatggatagagaagccataattcccatggggacatttgccaatcacagtattcaagagccttgagcttttaaaacataatagaaatatgagatgaaaccttaggtgtatatagggtagggatttatctgggaccttcaaaggactacatcctcaataaaattataaactaaaaaatatatccacaggcaaagggaaacaataagaaaatatgtctgcctcacttttggtagaaaaaattaggaaaagcctccactaagaatgtataaccccaaacatattgttagatagatttgtggttcagaattatattacccatgtgtttcagaaaatgctaagctgagagtttaataaaaagtgatttcaagtcatttgcttccaggagtgtctggaaaaagcaaatgtaaattctctctagattctctcaactgaggctgcatggattttccacagataaatttttgtcaaactgaggctcatataacatacacagaacataagctataataagtaaaaataagcagaaacaacaagaactctaacaacttaagataaaggatccacaatataaaataaatattctcgagatttttaggagaagtaaaagattgactcaaaaatgcaaggaagaaataagatgctattgaatataagatccagatttgaaaaagaattaagtagaatttttataaatgaagaatatattcattaaaatggaaatctcaatgggtaga

SEQ ID NO: 60799 - DNA, 2324 bp, Bovine  19866880457320
taagcattcggtttgtcattctttattttcttattggaacacacttaaggaatgacttctccaccatagtgattcagggcataaccttccccagctggttgtttgagactctgctttatttgctctctcactggactacctttctcattagtgaagacatttggaaatacacccactcagtcctaatttgagtgaattagattttcatcagcatcagtgtgcacatgactgtgattaacaaggaaaatgaacacataccatttaaaatttattaaagtttgggagaaaaattccgtttgatcacaagtaaaattctctgcatgtttagtcacttagtggaaaacatttacatttggggagaagtacttacttgctaatatgtcagcagagcacaaatgaaactgttcataacctcctgctgccatcattatgaaatgtagtcaacgttaattgaaatatctgactgcttattgtcacaacctgtgagccaggcgtgacactcctttgtatgttttattatttgttttctcctgtatgaccattggaacatcaggttttcattaattgcttgttttgttttgataactttgacagtaagtggttcctctaaaatgtgcttaagagacacccataaaggagttgatgtcccaatctctgtgccgagtgaacacaaggaaatcagttgtttgcaataaaggttcaaaagtagacaacctcaattccatcttcaaaggattgacgttgtaaggttatgtgcatgctcagtcactcagtcatgtccagctctttgcaaccacatggactgtagcctaccaggctcctctattcatggggttctccatgcaagaaaactggagtgggtttccatttcctactccaggggatcttcccgacccagggatcgaacctgcgtcccctgcatcttctatattggcaggcagactctttagaactgagccatctgggaagccccctactttgacaatatgtgtcttaagagcagggatagttccagatgcatgtttacatctccctctcattagaattgggtttcacttgtggctcagctggtaaagaatctgcctgcaatgtgagagacttgggttcgattcctgggtcgggaagatctcctggagaagggaacagctacccacttcagtattctggcctggagaattccatggtctgtatagtccatgagttcacaaagagtcggacacgactgagtgactttcacttcattcattagaatcacaccgccacttactgcctgtcatccccagtaaacaccaattatgatgggatttggttttaagatatttgcagtttgatggccaaaggaaataactgttatagtgtatccattgtgatcaatccctatgcatgcctggcatatcagattataaaaggaattcacttggtgtggacgagtgcttggttaaattcaaccaagcccagagagatataataagggaaaagaaatgctggggaaatcatttgcaaggaaagactgcactcttctccacctatgaggactaaagaatacaatggagggagaccctcgtgcatagttgaagaatggaagaggttgaagcagaagcaggcacaatcgtgttcagaactgtatatctctgccccttctttgctacactcgcccgaggaaggcacagtccaccaggcatggagaagcatcaggtagttctttggattttctcttacattttagcttggatcacaatactgatagcttgtcctgaagaggctttgttgttgttcagtcgctaagtcatgtccgagtctttgcaacaccatggattgcggcatgccaggcttccctgcccttcaccatctcccagggtttgctcaaactcatgtccattgagtcagtgatgccatccaaccatctcatcctctgtctctcccttctctttttgcctccaatctttcccagcatcaggatcttttccaatgagtcagctcttcacatcaggtgaccaaagtattggagcttcagcttcagcatcagcatcagtccttccaatgaatgttcttgccttgagaaccccatgaacagtatgaagaggctttggtgcttttaaagaaaacaaccctatagtatcttccctgttctctgcagccaggagtgcatttcatctcaagggcttttccctccaacgcttcaccttgactcatggtatcccctagggatgaagagctctccttgactccgcggagtcccgtgaacgggcactcagaactcacttgccagcatcacgggagggaaaattttccttagagtcatttgagaagagaatgcctcttac

SEQ ID NO: 60800 - DNA, 1084 bp, Bovine  19866880482716
ttaaaggtgatagcctgcaggagcttattctgtgcccctgtaacattttggggaaaaaaatcacccaggatgtccaatatgcatttcttaaagatttagtatacgtgagtcactttgcaaagctatttcagtatggaaagaaacagatcattccattggctttctctcttatatcctctgcgcgcaacctaaaaccccatgggcatgacttaaggcaatggcaattactccgcattccttgcttaggataatccttccttaatgtgtttaactatctattgagcacccatgacagtgccaccatttatcttaaaacttggaaatcaacacatatcagtcttggaaggtaaaactgatttttaaagatgaaccaaaaattcaaatattcatataaaatattcttaagtgttggcgcaaaaatactgagcaatacaaatcagcaaaacaacaggttaattaggtttcatgcttgatcactgcgacagtttagttctttattttcattttttgacaatttagttcttgatatccaacctctcatctattctcatttttaatctctttcaatgtttcctgtaaaattcatgtcttttttcctttcttttttggaaaaaaaaaaaaagaagtctctgaagtacaagagattcagaaataaaggaagtcagggaagagaactgcatgcccctagggaatttatttcctgtccttgggtcatcccattttattttcttctagttctgaaaacaccatgctgaccggatttttgattaaaagtggatttgggctgagcagaaagttagagaactatatatcaactgaccaaaatccttttcagaaatgaaactaaagaaattacactttccttttacctacaattctcagaaaagcgaaagtatttcctcagtatttagcaattccccaatctcttaactccaagaaatctatcaaaggctcttttataattatgtaattgagtaattattatatgccaggcattaggctaaagtgaataacagcatgaaaaaagaactattatccatcctatttttcagtttcgaaatcaggaactcaaatatttacaata

SEQ ID NO: 60801 - DNA, 1907 bp, Bovine  19866880565506
ccataccccagggcaaggagacagtgaagaaagagggtgaccattctagactggtaggtggctgtataagcctgatatgcataggcaccaatactatggcacagatttttgagataagaaaaagtactgtgatttcggctggcaatgagacaggtggccaggctcaaatctgtcaaacttctataaatcagaggaggacagctgggtatgctgaagccctgtcagggcaggatttgactgctggagggctctggaacttggcaatttatgggaaggtgtggggaaagggcttcagcagaacagatttctgggtaatagattcgtccttttctaaagggtccgggacattcaggttccgggtcatactcggggttttttggtgccgtgggaggggagagttttggttctggaaagttttgaggtaaaaattttctcctctgcgaatgtctactgtgtgagttgcagtttcattctgttacagcttaaaaacagttcagtatctggttagaaccaggatagagccagagtgaggttggctctatgttggcggcaggtttaataagcaaggaaacgggagtaatgcttacttgggctctcgctagaggaagaaatcaccctctacacccatctgccagaatcttatacagaggcttcaatagagttcagtctccttagcttcaaaatggtctcaacatcaccctttctctctcgagacttctcctggaaccagcttctccggtgggaatgatggcagaacacaccattctaaggacaagcgagagggtgctgctgctgctgctgttgctaagtcgcttcagtcgtgtctgactccgtgcgaccccatagacggcagtccaccaggctccgccgtccctaggattctccaggcaagaacactggagtgggtgaaagtaaagtcactcagttgtgtccgactcttcgcgacgccatggactgcagcctaccaggctcctccgcccatgggattttccaggcaagagtactggagtgggttgccattgctttctccgggagagggtgaggagcctccagttgcctggattcagcttgagggtcaactagtgagcacagcctctggatgcttcctctaacaggtgtgtcttataatcataagacaagaaagttgtcttataatcatatgtcttataatcataaaacaagaaagttcaccgaggctgaggacaagtaggtagttttgaagagtgcaggcctagagttcaaaagaagatacttgtgagttttagaaacaagttgaatgtatctgaactgcagcactgaaatctgaagttacagaaaaagaatggtgaacttgaatggtgaacaagtgagtaactctgttgcatgaaacacagctgtggggtaaggaaataatcatagttactactggggttacagtctcagtccagttcttatgattaccatggcacatgtatcagcttaagtgcttgtaaataagtcaaattatttaaagtataataatttgcagtaaaggacttcagtttggttttttccaaattcatcatgaaaagtcgctgatcacacattttcagcaatatgcggacttttagattatataaaattaattttcatgaactacatttaatcttctggagataaactgaaaagatgactgtttcatttggcaggactggttgatcattcatctctcctcgacatttggaaaaagaaaagaaagaagacaagactcctaaagatactgtgtagaaacgatttccttgtctcaagatggtcagtagacccaggtgtatttaactatggctgatgacccaattaagccagttaaactacccttatcgttcttgtttcattaagaatttttctccatttacctctattcatttgcttatttgcaccttttgaaacta

SEQ ID NO: 60802 - DNA, 1836 bp, Bovine  19866880682779
tatgaatgacacagcctcatgggtgcaggttagtcaagaaaaagagaactccagtcagtgaagctcccctcaaaggcctcagattatattaatgagatcaccaaaggaatatatatttattttatactaaaacaaaatactctagtatgtacgcttcattttttcatgatcccctctttacatgctatgctatgctatgctaagtcacttcagtcatgtccgactctgtgtgaccccatagacggcagccaccaggctcccccgtccctgggattctccaggcaagaacactggagtgggtcgccatttccttctccaatgcatgaaagtgaaaagtgaaagcgaagtcgctcagtcgtgtccgactcttagcgaccccatggactgcagcctaccagactccgtccatcggattttccaggcaagagtactggagtgggataccattgccttctccacctctttacaggactttttcaattaatccaccacccattgtttctacttactttagtaaggtcctcttttattttgctaatttaaccacatttcacttcctcctgttactctacttcccccaaggcaaacccctctgaatagtatttattaagaaagctctctatagcatgactaaaaaatgctggcaactataaagatagcaagtctttgcattgtaactgtgagtagtgataaggaatcctaacaacctgcatacattaagatttcattctggcttcaatttacttctaaccctgttatcatctcatgacattttgcactactaggggaagaggttggctaaagttgttggtacagatgtaatttatggcaatttaaactgagtcaagaagttaataactttgaaataatgcatgcacctcacactgagtttaatcagggcttattaaagatgagttacatgtgccttttcgcccttcatgtatcctcatgtagaaacaagtttacctataattaagcaaaagccctcacaatgctcttaatattttctaaattgtgagctttctgtaaaaatgacttgtcagaacataaatggttaaaatgaagattcccgcagctcaccttcatcactcctcaggtacattatcagctaaaagcacatttttctccactctgaaagtacagaaaatgacactgttgtgaagcctccaggactcctcactaaacatgaatattcagtaccaagaacagaagcttcagcacatcaaattaaatgtaaccttaagaagagcttatcatttttgagttatttgcatcttttccccctagacttcccttcccaactgtggaggatgactgggcatttctacccagtcagcgtgaacttcaaatgaattcttttgctggggctacagagtgggcactctggctggtcacctataacaaccatgcaaccgccagtgagtcagtattctgtggataaggttatcactgacaagccttgagatactattcaagttctgtgagagtaagtatgtgttaggaattctcaattaggattgtttggttacaagtatcagaaaccccattaaagatgatttaagcagcagcaggcaccccactccagtattctcgtctggagaattccatggacagagaagcctggtgggctacaggccatggggttacaaagaatcagacatgactaagcaaccaatgctttcacttttctcagggatatactacacttaacctggaagttacaggggagcaaactggcctcaggcatagatggttgaggggttcaaacaatgaggtcgtatctctttctccttatgaatctctgctctcccagaaaaccctcactgtataagggca

SEQ ID NO: 60803 - DNA, 1116 bp, Bovine  19866880692450
tttaaagtggtatcatctgcatatctgaggttgttgatatttctcctggaaattgatttcagcttgtgattcatctagctcagcattttgcacgatgtactctgcatataatttaaataagcagagtgacaataaataaccttgacatattcctttcctgattttgaactcgcctgttgctccatgtctggttctaactgttactacttgttttgcatacaagtttctcaggaggcaggtaaggtggtctggtattcccatctctttaagaatagtacacagtttgttgtcaaaggctttagcatagtcaatgaagccaaagtagatgtttttcacattagtgctaaataaacttaactcagtcaccttatttatctagggcttcatcactaccatattaaatgcagatcaagagatcaggccctgttttgataaacaaacaaaaaaacattaaactgggcaatctatattgcaattattgctgcttctgtaagtgcattcactgattcactgtaataatgaattcaatgacaagttggttgattttcaaaagtttctgatgcatatctatattcatgagcaaaaattagaagagtctgctacttatattcctaaaagctatcattaccgtcattatttcctcactaagtcatgtctaatcctttgcgaacccatggactatagcctgccaggctcctctgtccatcagatttcccaggcaagaatattgcagttggtcgccattttcttcctccaaaaaactatcatagccaacagcatttctaaatcctgatcatcaaactatttgactctgcttgtatagaaagagaagtaggctttggcctgagttacccagataagtgattaattctggtaagaccaatttgaatctaatatattttcccatagtgtacacattactttttatggtttattcctagatagcttctggtaggctatcctcaggtgttggatttaatgacaagtaaggaagaaaagtgaaaatcggtcaatcatcaaccatggtttttagtgtatagtttctagaccagtaatatgagtactacctgagaacttgatagaaatgctattctcaggcttgcctcagatacacta

SEQ ID NO: 60804 - DNA, 1415 bp, Bovine  19866880781995
cttttgttgacaagtactaatttgggtttgtgtaagatgacccattcaaagcagccctcataggataacaaggtgatttaaatgggatttgtttgaaacaaatccttagtttctaatcagtatgtggtttggtatgacatggtttacagaatttcttacttttatcctccaccactttttttccccttgtttgcaatcataacaagtactacagcatattgtagagtttagaaataattctggtatctttatagggtttaaggaaaaggtgttttttcccccttacttttgctttaaaaaagtagagattgttaccgttatgccttgtgcactttgattaaaactttaaagcctaaactaagtcatctttctggcagatatttcaacaaactcttttaatgttcagcttggcagcatatgttttatggacatacaccgtcctctataaagatgtggtgattatgtgtctagggacagaggaattgaagccctctctgtaaagcatatacactgagaaaatatgtcattaattgaacattctatcacctatttaagaaaaaaaatagactgtcagatattcaatgtttttgttcctacttacactttctgtccttgtacctttaatagaactatttcatcttctgctttgtgtctttctccaaatctgtcttttgtgccatttatattcagaatagatatgaaatgaacttataaatcacttattatttttttgctgggtacctttctgagatgttatgtattagcttatcacacactaaaagggttctacaatcataaaaaaaaagtgcctgttcagttgagatttcagaaagcaacaggggcagttcttctagatatcagaaacaaggtgcttgattatattttcatatgtaattatacaactactacaatactttcaaattttattattacctaaaaaactttataccaccagaatgaacatctttctctatttcttcttgactcctgagctctcttgggaaatatagccatctctttttctattgcatatagtgttcaatacagaaacttgtcaggtggatgtcaaaaaacttagagcattctgagatggtacagatttgctcttccattcaaagtaatactgtgaaatgacagaagcagagggagataagtctcctcctggtcagagtagatttcaaggtaatgttgacagttttcattcaatatttttccacatctgattctcttccagatatttcccaaatcagatagaaatgaccatgaaaaagcacatattaataatcaaactataccatgctactaagtcacttcagtcgtgtccgactctgtgtgaccctgtagacggcagcccaccaggctcccccgtgccctgggattctccaggcaagaatacggaggggtgccatttcctt

SEQ ID NO: 60805 - DNA, 1046 bp, Bovine  19866880794051
tggagttttaatagtgagatatacccaataataatcccataaaagttacctagtatataagctatcaatgtcagtgtggagaacataaattttaagtcactacagagcttatggcacatgcaaaatagagctgtgtcactgtccagttggacaccaacaggcttgcattactctagctgtcttttcttttcactactatctctcacaatttcagtggtgagccagatggctttacaccgtgcctagacatagcatgaagcaatatcaaatcacatcatgagataatgttcttttgtcagccttcctttcacaaatcttgctttttaactaagagaataagggcttctgaaacagaattttcagggagcaaccatatttacagataggattttggttttattatttctgccaaatacgtatttttatacagagcaaacaatactggtcttccattcctattctcggcataaagtccttctctaagacgcatttatttaataaacaaaaaaatgacttaaggagaaatgttgagtaatcaacaagtttttgacctgtaaatatagcaaaaataattaagggaataaaagactaagcgtatattttaaaatgtcactggaataggcaaatgactatgtttgagaaaatggtggttatttatcctagattggaatatttaagcaatagtattgtttggggcctagcataaaacttaagaaaaaaggacagactgacataaaataaaatctctttaacttctctgtggatcccttgaggcacagcaagtggtctttagaattagttaatacatgtctaattaatgaggcttggtacttgaacatctgcattttgctcttcatttattttccttctccaacagaataaacctctgaacagtcaaattatatataatagggccaattagtagagaaggagcctgaacatctttagagaagatgtgagaaggtatggttggcttaagatttaaactaattgtcgtacttcatttgttctcatttctttttctctgcaactttaaataaagtacc

SEQ ID NO: 60806 - DNA, 1728 bp, Bovine  19866880949953
ctagaggggcgggatggaaagcgaatgggaggctccagaggaagggatatatgtatgcatataactgattcatgctgttgtacagcagagactaacacaacactgtaaagcaattatactccaataaaaactaattaattaagacaacagcaaaaacaaagaacagagaggagcctgtgtggctggggcatattgttttggaaagagagccagagtggcctcaagcagtaactgcacggggaggacagtgcaaggccctgcagactgtggtaagagaaagcaatggagtattttgaaacaggatgatttgacatacgttgggcttccctggtggctcagacagtaaagaatctgcctgcaatgcaggagacccaggttcaatccctaggttgggaagatcccctggagaagggaatggcaacccactccagtcattattcttgcctggagaattccatggacagaggagcctggtaggctacattccactggtttgcaaagaaccgtacatgactaagtgactttcactttcacttgttaaaatattacagctctggctgctctgtgtaaaatgaattgtgtcagattacgactggaagcaaacagaccaactaggatgcttactttaatagacaagaggtaactacccaaagtttgaccagcataggactccccaaaagcagtccctggcttatattagccctctactaaagagataccgcaaataacttttttggggaaaagctctcaattcttcatttcccccagttaaccttctggaaaaaccaatctcacttcatctcagctctactgacagtgtttgtattttggcagatgtgaatgataagacgtgaaggaacagacccctgcccacaagatctcccagtctaatacaggagatgaaatgggtacaaataaaatcagaggatcagccatttgcctcacgaaataaaatttccatttgtttctctaaaatctacctccttcacacttcaaaggatgtttctaggactggatagtcaagtttaacagttatgatttttgtgtctcctttctaaaccctatccaccttttttctttcttatgtgaaaacctatttttaccttcattccaaagagaattgaggcttcctatggcattgatatacactcttaggaggtcatagctgaaggcaaggatgaaatctaggcatgctgttttttgttttttaacatataaaagcgttagatgaaaagcaaaatgctcagagattaatgtgtattttcacagctaggagaaagatgcgatggaagcaaattactttgagcagatatcttgctttaaacatttcagagcaatttcatcacaagctaaagtggaattatccatatgctggagatattataatcaacttaatcatttaatcttaacctttccagcacttgctttcttctcataaataatacttaaggacaccaattcaaatcaatattaccacactcacctaaataaatctaagtaaagtatcattgcactccagctaatctccactttcccacatttattctacgtttcaggtattagaactccatttctttaatactgattttcttcacaaatcaactgggaaaaatagagcagtttttttttttttttttaaaccacagcagaataaaacatgtataacaaattaattgagcatggttagaaaaagggagtcatgatccactcgtaatcatacctgcaaaa

SEQ ID NO: 60807 - DNA, 788 bp, Bovine  19866881235261
cctgactcctgtgtacatgtgtgatcttaggtaagggccttaaaccacactgtgcttcgttttcctcatttgtgaaataacacacagtaccttccaaatagagtttgctctgaggataaaataaaataatggctgctaagggcttactcattacaatgccattgtaaattttcaatgatgctgttttttattattattgttagtatgttactgcaaacagttcaataaaatattaaatcagtatatgaaagagggtgatatttttcacctaagttggttttttatgtcttttggtttaatgaatggttttccaatattttttcattattggcacacctatgaatttagtgaatagtgtgaaagaatgaagtaaaatggatgtaaaaacaatctaaaaagtaaattatttcttcttcaatcatctcaaaactaatatcattgtatttaaatatataaagttaggtattttattacccaggtgattttcctactatttgaaattattacttgtcctgataggaagtatatcaaaatgagactctaaaatgttgctttcgtactgcagagctggtagagaagagctgtcaaaagcaaaatggaacaaggtagagatattcaaggcttgaaatgtacccagggggtcttaaagtctggacgggaaaagagtttcatagttctactttcatgaaaaatatggattgaaaaggagtagaaaatctgcccttcctcctccatcggtttccatttcagcatagaagtatctcagttccctggacagtaaaatatgg

SEQ ID NO: 60808 - DNA, 3266 bp, Bovine  19866881363284
caaatgtatttagtggagctgacatctgctctgaagatagggaaagttcactcaatctggaaaaagcaagaaagaagagagggcataatgacattcctgcatatgtcaagtgaaggctgagtacagagaatggtgggtcgtaccacagtgagaataaacatgattttaaggatagtgaaacacacacatatacaaaacaaacaaaacaaaaaacaaaaacttgagttggctcactccagactgtgagctccttcagtacagtaactattcatagcatttgtggcattttcagatcaagatgtagtagatgataaacaagaagaaatgttaaagagaaagaggaataatggaaaggaaaggaggagggcatgataaatgtggtataggagggaggagggagagtggcagggaaaatagaaaaaaaaaggacaaagaagaagatggatggaaggaaggcttcccttccttccaggatgggaggtagaggcataatcatagggaatacttagaagtacaatattcatatattcagatatatgtgcttctttgttggataaagaacacagttaataaaaatgccataaatggaacagtaaataaaacttcaaattcaatcattaatataccaaggcagacactgaattttgagcagttgaatgatagaatgaaaatataatttgcccttgagtggtaagtgcaggtgtacaacaaataaatgttgacattacctgatcatgcagaatgatatttataataacacattattgctaatgataatcttcctataattgtaatgtacaggataacattttcaaaactccctagtctgcttaatctgtctgctattcattcatatttttatttatagaggaaacatctattgtatatcttatgtgtaaggagcattgttccagatctaacaggaaaaggatgattatttctttgcatatgtacatgtgctgcaccttattccaaaaaagtagacagcagtggtgatatatttgcagagctggaggatattagaaaaattaaggagatttaaattataggcagttaagaatatcaaatgaagtgtagattttattttctatgaaaataagatttctattcaagaggaggagaattaaaaagattttatgaagcaacaaatgctaagaatacaactttgctaagagtacaaaagtgaattacagaaataacacgtgggaatcagacagaccacagggaagtattgtaacattccaaagtagctatgattaaggctttaatttaggtttttttgatggaaaaaaaatgcagaatttaaagaatcaaataaatttagtgaccaatttattgagagacagtaagtataaggaggaagttaaaaagacaatatttctagctttagtaaccaaggggttaataacttcagaggaatcttagactttggaagagaaattaattaaaatttttggaaagtgatttttttggactagtgggatatttaaaagaagatattacacaaaaagctatagaggttaaaaagacattaggattgcaagtacagatttagaagtcatcttcatcaagaagattttaaatcaagcaaccggactgaaagagaattctccaggaaaggatgctaaaccagaagaaattaagatgaagatacaatctggagaatacctatactttaagagcaaatagaggcatgaagaagattaaaaaaaaaaaaaaaaagatatcggtcagtacaatttgatttgttgttgatttgtactgcaggttattaaaacagacatttttattatattagacatatgtgttatattctgtcaggaataaaaatgaccctgagcagctagcatgactttatctataggaattattatattttttgttcaaaggagaactcagaggcaaaattgtggcttggttcttctaaatgtgtgtgttctttttattatttcatttattaaattatcatgtaatacaattgactttttggtatgcatatctatgtattttaaaataaatatttatgtaaacatcaccataataaatatacttaacagtttcatgacagggaaaactttctcatgctacctcattttgcaattgtatccttcttccaccccagcctctagcagccactaatctattctccatcactacagttttgcttttttccagcaagtcttctaaatgaaatgatccattacagacctttgaggactggcttctttcccacatcttctcctacagagaagctctgtcccacatctaaaaggaattccatgggtaagagaataggcagatggtggagaggatgtattcaaagagacaatgtctacaaaattccagtttttgtgaaaaatataaatcctcggcatgaggcctttgagatacacgcatgattttgtatgtgtcagtagtccattccttttcatttctgagtagtattctactggatagatataccacagttttatctatttactcattgaaggacatttgcatttttccattttttggcaatcacaactagagttgctataaacattcatatacaggttttgtgtgattataacctcatttatgtaaagtaaatgccaagaaaggaattgctgggtcataaagtaagaaaccaccaaacttttttggtgacattttatattcccaccagcatgtgaaagtacaagttgtcccatatcctcacagatgtcaggtactggccgttagacattttaatgagtatgaaatggtattgcattgtggttttaatttttatttcactaatggctaacagtgtcaaatatcattttgtttatttgccatgtatgtatattctttggtgaagttgtgtgtaaggttaaagggcatttattttgcataatatattaacactttgctctacttgtttccatatcttttccccctcaatttttagcctgtttttaagtgtatccattctttattatacgccctctaataagccactttaaatatttgtgaaacaagtatcaggaactggatgagagagagagaaaaattcatggtgacatataaatagttaaatatgcaagaaatggaatccctcctgcaattaaaaactagggaaattaatttaattctctcaagggcatttctagtttaccaaatcagacttgtaattatgtagtcatatgaaggaaacttggataaaagatgggaacagaaagagtcctagttttcctcactatctttttatagaaagaattattttgatgggtaaaaaagacaaa

SEQ ID NO: 60809 - DNA, 891 bp, Bovine  19866881634468
aaataatctatgtttcatttgacaagaagaaaagatgagccagtattctgtttttcctccaatagcctttactagaagattttaaatggatccaagttttgaaggaacttaagtttacagaggtgttctgattcaatcagctggaaagcaagaaaatagcaatttcaggtatgtaatcaatcaaaactatctttgcttcaaaagctctctaacaatgaatgaaggaggagcaaagctggaaagttacttccacttaagtatattactctttctttttattgttatctatcacaacgaatcataacataactcaataatgaatcatctccttgactgcagttggtcctaactataggatgaggtgatagatcacggcctggcttagtcaatgatgatatatccctttcaactttacaatagaatttgacttaagagtccctggtacctttgaaattgaaatgaccatttaaaagcctatagaaatatgtaatacactgaaacggtgtacatctggatgggatccgaaaagtgattggtttagcctgttaccccacctcaggccaaggtccctagaatgctgaagcatcagttctggatcagggtcggactcgatccacatccaaaattaattaatgatacaggaaaacttgaacaaggttgaccgttaagcccttgagaacaactgaggcttgcatttcttattctgatgagctaacaacaacaacaacaaatataataatgaaactacacaatcttcaactttaagctaatttttccactgaccacaagtatacacagcattctctcaatattcaatagcttaaaaatactacttctaagtgcaaaaacatctttactttatttgagaatatttgatatttacatatagaa

SEQ ID NO: 60810 - DNA, 1179 bp, Bovine  19866881758904
taactcaagagagcatataagaaccaaacaagtggtcagatgtagattttgagttcaaaggagaaaacaagtcaaagttagtatttcttttcaagtgctttcttaagtgttttaccagtcctctctcatttaatccttaaaatgcaactctgtaaaatagttattattatgcccactttacagatgcaaacatgtcaatagttttgagtgatgtgcacaagataatacagctgcaaagtggtcaaacttaggcaatgactccaactattgtaccccagtgtgggaaggatagcaaaactttggttagaatatgagaggtgcactaggacataaagcatgcatagtatttccagttattagaaagagaaggagtatcatggacaaagagtgaacatattgtaggcatcaggaaaaacatgacattgcagcgacagcaacgtgatgagtccatgtaaagcagtgttagaaaattaagatggaacgttaggaagggatcaaaaccaaggtcaagtgctgggctttctattgtaggcagtgggagataatacaactgtctgggtacaggaggagtagatagaaaacagacttttactaaccttaatctggcaggaatatggaatttaaaaagagaaaaagagcagaaagacccaaaacggaattgaaatatttgaaatccagaacagcagcctacactagaaataataaccagccagatttgtttaaggagtcctcaccaataacacaccagattcatttcttaccagctctgaaaaatatgccctcactcccaatgtttgtttttacgcactggcaccattttcagttacaaatatattcaataatattttgaaaaattgaaatgttgattcttatttactcaaatgtttttgtctttgtttagtctgaaattactgaggactgactctggttaccaaagagtccctaagaaaaatagaatagtcggagtatctatctaaaatctgacctagattaaatgttccgaatgttttccattataaaggacacgtctacacgaataaggtgttgagaacagcacactgcttataataaaggatactgtaatcaagtacttggtagcccattaaaaaaaaatacattctcacataagaacccaatgtcaaaaatctgcttctttttaacaaggcaaaaaaagaatat

SEQ ID NO: 60811 - DNA, 731 bp, Bovine  19866881780760
cattttagaaaatttagaggctaaagagagctatttgagaacattatttataatagttcaagctgtgttaagctttatcacagacttttaaaatgtgagccccacttgaatgtttgtgtctggatggaaattatgtgtgagagaaaaacaaaattatctctaagagactgagaaatcaagacagtataaaaaacaaaacatagcaaaaaagaaaaaaacaccaccaaaagctactttctaatgtatttgtatcaaaataacatgaatagtgacataaactttcaaaggagaaattgttttgcagttgtacattaggtttaagtgttatttgctcattcatgctcaacccagggatcgaaccagggtcttctgtactacaggcagactcttaaccaactgagctacaagggaagcctgttagatttagtgtaggaaaatagagttcctcatggatctcaccttacagctgaattctctcccatgcaatctcaagcatggccagggcctcacttaacaaacacatgtggctattcaggcttgcttctccacaccagacccttctgtgagctgctgctgctgctaagtcacttcagtcgtgtccgactctgtgcgaccccatagacggcagcccaccaggctccctgatccctgggattctccaggcaagaacactggagtgggttgccatttccttctccaatgcatgaaagtgaaaagtgaaagtgaagttg

SEQ ID NO: 60812 - DNA, 1569 bp, Bovine  19866880427806
tagttctgtgctttctgtgctttcatagcatagttaagacaacatacctgaggacagtaagaaatatgtctggggcttccctggtggctcagtggtaaagaatccacctgccaatgcaggagacaaggattcaatccctggtccaggaagattccacatgccactgagcaactaagcccatgtgcccacaactactgagcttgtgctctagagccctggagctgcaactactgaagctggcacaccctagggcccatgctctccaacaagggaagatactgtaatgagaagccaatgtaccgcaactagaaagtaagttctgctctccacaactagagaaaagcccatgcagcaacgaagacctagcacagccaaaaacaaacaaacaaacaaacaaaaagtgtgaatgggacagggacagatcacagaattgaagcctctgacctttatcctccaagtaacagaaacagttgaggattttcaggaaaggaaactatgaaatcaggatttaagattaatctggcaggagagggaaagacctgatgccaagaaacctattaggaagctgtttaggcaggacaaacagcagaagttgaaaggaagggaccagttgtgacgagaatagcataggaagaatcaagcacactctgagtaaattgacttatgaatattctggaaatgacaatacacctgaaatacaatttgaaaacgacaacatattttggtaatcaaatcattaattcaaacttaccctctgcgatgtccgagcacgatgtgccaatggctgtgtccccactgtcagctaaacttgaacaacgactgaagcggctccgaaaggcctctgagataactggggtctgccattcagtccccagggaactgcccttctgaatcacgctggaacctgaaacaaccagcatttcccactgttaatgttaatcagcttgtataataccacaaaactttttaaaaaaaatcacttaaacctgtgagagaagagccatacctcacccctttcttcctcctgtgcctatttcagctactctgaattagttaactttatttttttttaatgatgttttttaaaattaggcattcatccattcattcatggctgcacggggtctctgttgtggcatggggactcttcattgctgcaggtgggctttctctagttgtggcgagtaggggctactctctagttgtggtgctgggcttctccttgcagtgggttctcttgtctcagagcacgggctctagacactagggctcagcagttgtggcacacaggttcagctgccccaaggcatgtggaatcttagttcccaaactagggatcgaacccatgttccctgcattgcaaggcagattctcaaccactgaaccaccagggaagtccttgaattagttaagtctaaatggaaatagcataagagatgagaatgttcaaagacacaaaaaaagacctaccaaggatccaagagtactgagacagtaatagttaacagcggctccattctttgaaatctagaagccacggcactttacagacatggtctcatctaccta

SEQ ID NO: 60813 - DNA, 1168 bp, Bovine  19866880456162
cctcttccgctctgtttcctgtttcattttctggctcctgctccgactggaaaacaaggaggctgaatcttgtgctcacaaagctctggcttgtcagaatggaggaagacttaggtgggatgggaggggttctgggcctccaggactgtgagtaagtagtggaggaggcagctctctagtctgcttttagagtctgctgctagaatggagcctgcagccacgcagggagccagctgagcggccagcgctgtgggagagccagggaggcagagacttacccagggctcccaaaagattctacaccactcagccacttccctaaagaagtaaatacgccacaccaccaagacacggtttcataatacagatctctgactaaattaaccaatgtaagcagtgtaccactgtttctagaatcctagaatgtaagagagttagaacatttctctttcttgaacttgcctagctatgctcttgctgtttcctctgcttgaaatgcttcactgccgattaccctttggccaacccacttcaggtctcagctgaaatgccacctccttggagaagctttctctgtctaccccacggcagtcaccaccctgtacttcccaccaccctaattctgctctctttatggcatttatgatcacctggttgtcctgtccatgaatcaagtatttgtttcattgtcttgttttcctcatggaatctaagtgctatggcggggagggggccttgttcaccaaggtgtttccagcacttagcaccttgtatattgtgtgtactcagtaaggatctagtgaatacatctgttcgtttaacctgcactttatggatgaggaaactgaggctcaggtgaaaatgaccagttctgaagttacacagctagtggcagatgtgggatttgaatgaaaaaccttcctggctgttttgttttttttttaccaccccacactattttaaatctttctcaagtttacctctttgcttctcttccttttttcactcaactatgggtctttatgggctatattgaaaattctacatagggcacaccaagtcttaacagctcctacctactgtttccttcattaaattccaattttaccttttgatttactcaacaaaatagactactatgtaatgaggatgagaacaaaacactgaa

SEQ ID NO: 60814 - DNA, 696 bp, Bovine  19866880473331
ttcaccaccgccacgcgccggcccagcgcgcgcaggaactcgctcatgcccagacaatacgtggtcttccccgagcccggcgggccgatcaccgcctgcccaaacgccgtggtcggagcggctcccgccatgggcggccggcatacggctccgtgcggagcagctgagcgcggcaggggagggaggcgggagccacaccggagacgacctctgagggcaacgacgggatcccccaacgtgcgcttcgccccgggctggccgcgatgccgggggctcgcctgaggaagaggagggaacccacgcgctgtgaggggatcagaaggccaggtaccgacaggacctgcacccgacttccggatgacgtcgggaaagcccggcccggagaggaagtcccgcccttacggtgacgacacagcttggcgccgagagctgtggagatgagccccaagtggtgacgctggggcgtggagccgattgggggccccgcagggacctttccgggggtttccccaccgtactcctggcccaaatccgaagagaaagagaaattcggtagttaacctttttattctcccgttaggtcgcagacccggcacatctgcggcgggttgttcgctgccccagcccagcactggagcccgccccaagaccgtctgttaggaacatgagccctctcttcttccgtgtccttaacgc

SEQ ID NO: 60815 - DNA, 4219 bp, Bovine  19866880478061
cctgtcatgcaagaaacagcaaaaaccctcacatccaccacccgcccaggccagggcactttatcccttcctggaggccttcttgtgtctggtctgcccctttaggtccatcttctctgcagcagccagatggagggttccgatcacaagtctgtgccctgtctgtaccctttctctgcccttgggatagcccaggcaatgagatgcttgtgatcttagcctcctttcgccccactccacagctcagccacgcccagcttctcagatccttagaggagactctaagccattgtacatgctgttcctgctaactagacaaccattccttgtccatcctttgaggctcagctcacacactgtcctctgagaaacctggcctcacgctgctcctccagcccgttgcccctgctaagctgcacttgctgagctgcccagagctgactttgtgtctctcccactgcagcctgagccatatgaaggcagggcctgggtctgtcctgtgcacagtcagtccccacatggctggcacactaacggacctggtacatacttgtcagataaataaagatgcgacgggctgctcgggggaagtgacaagttccccgacatcagagacgtacaagcacccctctgctaaaacctgtccctctaggaggcctttcagaacactcctccccagtatgtggccaaaacattaggatttaccaagttccctctcagaagccccctccttggcttctatctgtaatcccatggactgagtgggtctgtggctaagtccgtgttccagatgcgtcaccgaagcccagttgtcagagcagccaaagccgattcccacgctagcccctgacctctgggcaccgtcacccctgctctgccagaccgtgcacctcgcgcatttgccaggtcagattcttcacccctgacgtgagtgggagcctgatgtgtctggtctttccagtgggctgaaggtgcccggggccaagggtcctgacttttctattgtggcccactcacccactcactcccacccccttgcccaggcacaaagaagcccatagagccccagagtgggacagccaggctgaatgagacggggacaaagagtcagagactccccgcctgtctgcccacacacctgggcctgcctcagccctcagggcccctgtgccccaaagaggccccgactccccacttccctcctggggaagggaaagcccaggacaaagtcagacgagggacgcacccttgggtgtgcgggacgtgaactcagtgtcaaagtagaaggtgtcatcgggttgcgccacggccggcttgaagggtggcttgatctcacgccggtacagcttctgcaaggtggagtgggcgccctggttaccttggcacccccacagcccatcagcagccccatgcaggaggaggagttaatggcctggacggagcacaggctatgcagacagggcataactgctcgccctcgggaggccggcccgtgcccccaaggccacgctgtcacctctgcttcacgtcggaggctcgagtcagcagaggccccctcccaccacagccgaagccctgcctggggccccagggtggatagactcactcacattccagtcaatggtggagtagaagacatgccgcttgatttcctctgccccatcagggccggagcctgcaagagcccagatgaggggcctgccccagggccttccgaccccagacagccgccctgtcctccgagtggccgcgcctcactggggtctgggaccagaggctgggctcacaccaccccaagtccagctaccatcccgaggcctacagaccactcagcattttccactttctggagcctcttgatgattgggctcccatgtactgatgggagaaggagggtccagagaagagaagctagacaacttgtcaaaggccaaagtcaggacaggtcaaacctgtcctgagatttgcagggggtccccacctcccccagctccgcaccaacttaggcctcatctctgctgctcttagcccatcgcccttgtcagccaccagacaggctctccctcctttcaagcccagacacctggatgggaccttacgaagctggtcaaggtccaggtgaacccgggagccaaggagccaacacatactgatcagctactacaggcacgttcatgtgagttcatttaatccacgaagctcgagatcattgtccctggtggagacaaggacctcgggctctggggggagacgtcaactgctttgggtcactctgctcacaaacagcactcatccgaccacagtatctgtggagggaccaccgcgtgccagcagtggggtcccgagcccctggcgcccgaactcgtgccccttctcctgagccagcagccttggcggaggagccgtgccggcctctgtcctcatccccagggggagtggagatgactcagttccttgctttcccccagacacaggtcacccccccgccccacactccacacatggggccagaaggcagggtggccgccggcattgtctgcccacacaaaggacaacggcccctttcagccccagatgtggccccgtggcctaggccacagctgtacccgctcccctcccctgggctggggccacttaccgagccggttggcaggattccgcttgaacagggccctcaggaggctctgggcttccgtgcttagaaactggggcatgcccagctttgccctgcaatggcccccgggtctcgtcagggttgagccccgccccggaggccccatctcacctcccgcctctgtccacatctcatttccagctcagtccagacaagccgtccactagcttccctcccagagactcaggattctccacccacaggccccgtgggtgaaaagggagccctagcaaaagcatagcactcgaaccagaggagtgtctcgttcttggagaatctgaggataggtgtggggtgatactctggcccccaaacgaggccaagaaaggagacacctggaggtgtcagagagaggctggagcttacttcagaatcagggtcatagtctccttccggtccttcccctggaagggcagggagcccgtcagcatctcaaactgcagggaacaagggtccgttcaggctctgctcccgcccctcaggccccccacctcctcccacccgggccagccactcagccccctgcccaggaggtccacctggatcaagaactgtgtgtgtccctcccctctccatcaatcagaccaccaggagcagaactaggggcctgaggttggggagaggcccagtacggggcgggaggcaccccaggtggggccaagcccggaatccttccaaggaaggaaactgcagctcggaggagtgtgaggccagcttagctatgagaggacaagagaagagccttagagaccagaaaccaccctcccttgcccccatgccccacagatggggaaactgaggcccaatgcctgggctggttgctggatgctttacccctgcctgggcactcaccatcaacaccccataggaccaccagtctgcactgtgggtatggccctggcggttgacaacctcaggggccatgtactccactgtcccgcagaaggaataggccttcttctcatggtcgatggcctccttgctcaaaccgaagtctgtgacaaggagcgcaagtggacacaccttcaggaccccctaccttcctcgctgccacccctgcacacccatgccctcctgcccagaggcctgagggcatcaccgccatggtactcaggaggaaggtgaggcccaggggggtgagatggtctgctcagcattacacagtggggacctgggatgcaaacccacgtcatgccaggcctggacttttgaccacttctaagtgcctggcacagcctctcaggacacgcggataccctagcactcagcccaggtccctctagagcccacccttccctcccctgaaaccagaggggcaggcgccctccactcaccagtgagtttgatgtggccttcctcatccagaaggatgctgcaatggagagaagggttcagggcccctcagtcgtgggcctttggtggggtcaggtgacgccacgggtctgtaggggctgggctcagcccagggaagctggtccaccaggtccggctgatgaatgggtgggtggcgcagggactgggggtgctgcacaggtgtgttgccta

SEQ ID NO: 60816 - DNA, 1777 bp, Bovine  19866880543353
cctccctggtaaatggcacttctaagaagagtaagaataagaatcctggtcattataacatcagttcacgagtattcagggctgaccaactcaccagattctgtgctaagagcttttcttgatctcatcagaacttaacagccctagatgtaggtgccatgattatccccacttagagggaaactgaggctggaaggaggaaaccacttgctcaaggcccttacagccaggctccagaaccaggtatgttttccgagcccagcatggagttgtaaagagcatggactccagagccaggctgccttgggagaacctggccgatcaccagctgtgtggcctgcagcaagctgcacgacctctctgtgcctcagttttcacatgggaaaaagggagataataattgtacggctcctaggattgcggtgaggatgggatgtcctggagcacgggaagccttttagccccgcctggagcgtggtaaagtcagggccagcccttctgcttgtgctgctcccgctggtctcttgtctgccaccaagtcctacagaccccaggtccttaacagggccagtgttgtttctctccacttgtccctggtctaggacatcattatttgtcctggttctctgtcgcagcaccccactgccttcccccgcccacccctctctgcccatgcagcagagccatcttcctgtttcactcttccctgcccagaaccaccacctcagtggtcacccctgcccccagcccaccccgagcgccagcctctcctggccctggcccaccctggtttcaggacacaccactctgcgctgtaatctttctgggttccttgaaggcagggctgtgtctgatttatttcagggtccccaggatctatctcagcagggactcaataaatccctggtaggctgacctggctttgaagcactggggtcaagaggccctggggtcattctgaggaaggctggatttaagcccaacagctcactcagcagtgggaagaggcaggctcacctctgcctcaggggtgcctggaactggacaggggcactcaccaggggcaccttccggagagagcccaggactgtggaggccaggcagcccatggctgtaagagtagggaactcgcccctcagacagaatgtactgctcaccctcaaaattcttctcatcaaacaggatccagctggggaaggaaggggaagaatagggggacatgagtaggtattttagcccactctgtccttggcctgcacggcccccctgagatacagcagactgaatgcaaccttgatggggatcccccaggccaggggaggccaaggatgaccaggcactgcagcagcacgaactgaagtcagacttaagaaagaactgaatggactcacactgcccttcaggagaaatctggcagtcacgccaaacgccatgcacaattactcagcaagcctatttctcagaatctgttccaaggacacccttcaagaaacaacacatacacaaggctagtgattacacattgtttgcagtggcagagtggcagcagccaaatgtccatcaattggggattggttgaataaagcacgaatctggagtataacacagcagtcaacaaggatgaggaagagctttcaaagggatataaagtgaccttcaaacagtctaaaaaaacaagatgcataacagtattgataatatgtttcctgtttaaaaaattgagataaaattcacataccataaaattcacttttttaaagtacacaattcagatgtc

SEQ ID NO: 60817 - DNA, 1674 bp, Bovine  19866880550748
cccatggtggccatgggagtaggcatgtatttctgagagcaaaggcctctggggccagggctccgctcacccaccagccctggccagtgggagatgctcaggggacacccccgcccccccgaggacagggctctacagcagtgcttacaagagaggttccaggggccaatgggggtggggagggggaggagatataacaggccagcatgagctgaggaccaggcccagaagaaggtcccaagaggcccagcatctatgagttagagaaagtcacgatggggtgtccgtgtgtgtgtgtgtgtgtgtgtgtgtgtgtgttgggcatggggggtggtgaggtcatttctgaaatcagagccctgtgtacaaaggactgatttggggaagtgttgggcagacaggcacgtatgcggatgtgtggtgctctggagttaggatggcaggagttctgttcaggcagaggtttcaaaatgttttaaaaacaggaatgccctctatgcaaatagaatcgtacatggaagtgtgaacaaacaaaacagataaaaaggcagcactctctggaactccgatcagcagcccctgaagggcccagtggtccccgctggagcccagtttggagaagctgagtcccagctccagacagagctcagaggtgccctcagcctgcagctctgagtaaggacaggtcaggtgaggtggccagggtgagagccggcagggggacagcatggccacggtccccaacctctccccaagtccaacgcctggtcccctagtctcttccctgttaatggaggccctggctccttcccttcccaggagggaccaaggctgagccagaggctctttggttagaaactaagattgacttgaatgagtagggtgacggaatgggaggggccccgcagaggtctaggggactcagaggccctggtccaggtagggagagagcttggcttgggagggggcagggtttgcctcacagccaggcaggtccacctccaatggatggatctggaaggcagttctggcgggagggagggcgcttcccaggaggcaaggggaagccgtgctgcggtgggggctgtgggcccagctgccatgcggtgggggagggccggggccagttcaggtcgggaaggaggaggggaaccccgccctcgccccccgccagcagccctagctctggtgggagagtccgtggtgggagggcaccgcccgctggcccccccccgtgctactggcccttggggatgaaaggctctccctccccaggctcggggtgggggcctgggtcactgaggcagcgctgtatcctctgagagctggggctgtcgctcggtgccggggtgaaaacatcgtcggtgcccggggatgagggctccttggtccgcatcgtaaggcccccatcggggtccttgtcgtcctcctcctcctcagccagccttcccggatcccggctcagccccaggaccttgcccttcagctcctcgttcaccaggtccacagactcaggcgactgcggggaggccgggtcgatggtgatcacaggcaagtcggccttgggctcataggccagcgggtctgcaaaccaagagcaaggagcatgctggcttccggccctgggtcctcccagtgtgtggcccacctctgcccacgccagtggctcccaaa

SEQ ID NO: 60818 - DNA, 875 bp, Bovine  19866880641869
tggatggggaagatcccctggagaagggaatggccgcccactccagtattcttgcctggagaattccatggacagaggagcctggtgggctacggtccatggcgtcacaaagagtcagagtcagacatgactgagtgactaacacttccacttccataaaatgtctgaagcatcatagatgctcaaatgatcattaatattcatataaatgctcagttctttcctgtgctaacattctaggtttgtttgttttttttttttcaatttatttatcttggttgcactgggtctttgttactatgcgggggctttctctagttgcggtatgcaggcttctcattgcagtgacttctcttgctgcagagcacgggctctagcgtgtgggctcagtagctgtggtgctggggcttagttgctctgcagcatgtgcaatcttcctggaccagggattgaacccgtgtcccctgcatcggcaggtggattcttatccctatgccaccaggggagtccaacattctgattcttaaaaatttctttttttaatcaacctctcccctgaccacttgccatctgatgacaacggtagttttgagggactggcctcataccaatcaaatgagagagataagaagattaatgctgattctttccctactattattctctgcccaggcattccagtccacgtgggctgctgttgacaagtggtttatttagtactttttctccagaggagcctcagggcactttaccaaaactgacagctctcctcagagtgcctctgtgaaggaagccgccacgttgccaccacaggcctccaggcccctgggatccctcagctgcactaggacactcacctgtgtgtctctggagag

SEQ ID NO: 60819 - DNA, 2174 bp, Bovine  19866880642752
aacccccaactccacctgacataggaggagctcacggcttggcccgtgagaagccagtcctccctgcaggctctctgaggcccgtgcccagcctcgaggcccctccccgggcccccacggcctgcctcacctgagccgatgcgggcccgagacatggtgggcgagtccagcttgtgggccggcacggtcaggtagttgctgatctgacagaggaagagcagatgggggcagtggggtgagcagaggcggctcctctggatggcgccccaggccggtggccgcacacccttcctttgggtgcccggggtgcccacacctactctgcccatacccgtggagcctgggccagtgctgggtcctgagggcttggcccagcctcttgtcgagctctgggatgaccttggacacccccacactgtcccacctctcccgtggggacaccagcccagcctctagctctggccctcatctgcccctaaggacagacccaccatcaactcaggaatgtcacccgggccctggatgacccccgggattctcagtgcaacacgctatgactgaattcagctacttcttttcttccaaaacctgctccttcctccgtgtcccctcaaccaccccacctgcctaccccaatcaaaggccagacgtgacccctgcctccttttccccttccctcggtcccacctcaaactggtaaccaagtcttgccactccaacctcctaaatgatccttgaattctgcctgctcctcccctccccctgccacccccctaatccacccgcaccccttcccatgtgcttcccttactgagaacccttcatgacttctccatgctttggaaggaagcccaaacctttaacgccattaacgagcttccttgaaagctgagccccctgtgtgtggtcaggaacttatgcagtttcttcctttctgcctggcccttcccctgaccacactccctcccctgtgactctcattcctaagcgcactctgaccacttccttgtttgaggtgctcagagccccttgcacttccggttctgcccggggccactgtgtgctccataagggagggactgggtgaggcagttctgccgcgtggcacttagggagagctccgcaaatattctcctgaacgaatgaatgaaggcatgcgtgtctttgccttctgattctgagccttagttttctcactagaaaatgagaggttagagcacatggacagactcttctagatctgatacccaaggacacagtggggaaggggggcctctttgctgctctgagtggagaagaggtggagaaagcagctttctggaactttccctggggctcagcctttgaaacacatggggggtgtgtgtgtgtgttcggttgccaagttgtgtctgactctgcaaccccatggactggggagcctggagggctgcagtccatggaattttccaggcgagaacactgggggaggccaaaacaccagatgggagtggctctgtctcccagagggctggctgggggtgatgcaggcagaggaagagcccaggttcccagagaaaggcaggagccggctccagctttggacacaccttctgctccagttgcctggccttctgtctccggagcagcatctggttccaggcctcctcgtaggggtcggccaccagcgtgtgtctgttgtaggaccgcagctgtgggaggaacagctgtcaggcaggcccggccagggcccagaagctgggcctggaggggctggggtggctctgggcgtgtggagcggaggcgggtggggcggggtgggggcgggggcctcctctgcagtaagtgaagtgggccgggcaggggcagcccctcacccgctgcctggtcttctgcaagttgttcctcaggattttgcggatctcctcttccttgtccttggacagtgctggcaggatgcgctcggccggcagggacttggggttggatgttcctgggataacggggcacagatgagacaattcctgggactctgggggctgggccgggccagaagggtcccctgggggatgatccggttgggtgcaccaagcctgggtcctcagtatgatccgcccgcccggtggagtgacctagggacccgctccaggtgggtattgagggctcaacgtgtggcttgcagacgcggccggggt

SEQ ID NO: 60820 - DNA, 1162 bp, Bovine  19866880720739
caaatgtttatgaaacagggacttctctggtcatccagtggctaagatgctgagctcccaatacagggggcccaggtttgatccctggtcagagaactagaccccagatgctgcaactaagacccagcatagctgaataagtaaataaataagtattttttaaatgtttatgaaacatctactgagtgtaagacatatgctatggtcctgtcctaccccttctcattcggtcttcccagcgggaagtgttaacggcgttcacagactaggaaagtcagacccagtgaggttaagtgggctgcctgagggcacccagcctgtaagtggcaggggccaagaacagagcagtgcagtttttgttcactgttgcaacccagcacgtcccagtgcctggagcacactaggcaccgaatcaatgctgactgaataaaaggaacccaagtccaccggacttcaaagcccttggctctcttttgtacctcattacctcccacatgaagatgaatttatggtgagaagctcacaataaattgtctacaaacacctctgtgtttctggagaggctttgaaaattctcgtcccctcttttgcatggccaggccactgccctagttaacataagattctcttcctctcttaccaggagtattgcaacagctctggactcaagggttattttgtccttccattaaaaaagaagaagaagaagaaaaaaatcccaaaacgtctgttaggccctgattttagatttctgctttctcttctgggtctctctggtgtccaagatggttttgtcagcttaattttagtgatttgtaaatttgtgttctgaccatggtacttcccctccttagcgacatgaaactgtaatactggctgtgccctttccgaccacgtcctgttgtttagtccctttggtcgtgtccgactctttacgaccccatggactatagctggccatgttcctgtccatgggatttcccaggcaagaacactggagtgggttgcgacttccttctctaagggatcttcctgacccagggaccaaacccctgtctcctgcattggcaggcagattctttagcactgagctaccagggaaacatctgtgtgtgcgtgcatctatacgcggcacctcaactctggctgtgggcctgaacgc

SEQ ID NO: 60821 - DNA, 2199 bp, Bovine  19866880811619
ctacctgaggctggttgtacttgtccttgaattctatgaaatacctccataccctcaaataaatgattcctttgaaaaaagagaaaaactagcttgtcatacttgccactgaagaggtcttattaacagcagaaagatttagagttccttaactagccccagaaaagagagctgaaggttaggataaggctggaggtggtggaaggacgcacgctcccctctgacagcatcttactgttcttccatcaggcggctaaacttctcccgggccagatccattagcccgtctacttcactcttggagcgtttgaagttctcgatgctgaacgcatagaccgtcacctccaggatgcccaagttcaaacaccaacgcagagtctgagggggagaaggcaaggagctaggatccaggaagagcaggaagggaaacggggcatgcctcagccccatctcagtgctggaagtgggagacagactttcttccttcccactctgggtagaactaggataataccagaatagtgaaccaaacaagcagaaagccaccaattgagagactgaaaaatgcgaacttaatgagtattattacgctgatgctactgtggtttactggaaagaactcttcactgagagagtaaagttctaggtcctagcccctgactccatcatgcactagctatgtgactgcaggcatatcatttaacctctcagggcctaaatctccttatctgtgaaacggcatcacaatccatccctcaacaggtggctaaaggtacataagaacacaggtgcccatagcatcattattccagaagactgagaggctgatgagttacaagaaaacacgcaacaactgcacaagtgtgtagcatttaagtctccaaagtgtttccacatacattttttcatttgattcttcaagcaaccctttgagaaaggcattattgttttcatgcctactttacagatagtaaaactgagcctgggaaagtgaagaaatgtatcaaaagtccacagctctactgtacgaatccattatgtgaggttctagaacagcaaacattcatcacactgagtgacagaaatcagaacagtgggtgcctgtagagaggaagaggaggtagcataggctttcactggggtggggggggcacaaaggaaccttctagaaagatggaaatgttctatatcttgataggggtgtggaatagacagacaagtgcaattgtcaaaaccccaaatttgtgcatttccctgtatgaaattacatctcaatgaaaagagaagtaaaactcaaatttaaactcagtcttctggtacttctctaacccagtgccactaaaggtggagaacaaactggagctgagaacagcagtgctgaaacagggagcctagaggttaaaggcaagggatagaagacatccaaacagaactgaagaaataaagctgaagaaccacctttctaattcgctatcagatacacaaacacattaactgccaataggcttgggccctgaagaccttaccaggcagcgaacttagtgggtacatccgggttggagcccaccattgacctcagtcagtaaagacgctaataacaacttcaatttttgagcacttcctttacgccagcatgtgccacatgcttttcattgaaccatattatttaatccttatgttatttccccatactgtagatggaggaactgaggcaaagggaagctatgtaacttaaagcaggtcacagagccaggaagtggcagagcaggggtgccgatgaattctaagtgaccacagagcttaagctcctaagcactagggcaaaaccgcctctagtcataaaagagaaacttcaggtcaacagacctgaagactccacaatgttggagagaactccacaaccactcattcaaggcaaaaagtatcacctgtgctggctgtgttcttgtgccaggaagctgagatccatgggctagagtttcacaaagatcaacacagtccattgttatcgttaaatttaatgtttcccaatttgcaataggcattaaaaccataaaatgccgatgacctctgttggagtcatgtccttgtttgtctggtccttttcctagtttaagcacttaaaggcccgtgtcctgaaaaacacctcaatctcaggatgggtagttaccccttacttttgctctggaaatgtcacgt

SEQ ID NO: 60822 - DNA, 1829 bp, Bovine  19866880847324
aaactaaagtcttgagcctactgggagctgggatggctggagtgctctgtgcagggagaggaagccttgcacacacccacccacctgccataataggccctgggccacaacgatggaatttcaaatgtggaaggacagctaagcagcagaggtgggcttgggattagctcaaacccctggcccagtgctccagccatctgactttgctgtctcacattctcccattaggaccctgttctcagtgctaagtcgcttcagttatgtccaactctgcaactctatggaacgtagcccgccaggctcctctgtccatgggatttcccaggcaagaacactggagcgggttgccatttccttctccagcgcatcttccccacccagggattgaacctggcctcctatgtctcctgcactgacaggcgggtcctttaccactagtgccacccaggaagcccattaggaccccagctcccgttgactcagaaaagccagaccctgccagttgatctcaccttcttccccaccagggaccaggggcagaggagctttgaggaagctggattccccagaaccaccaccctgtgctttaaatttccagcctgcccaggctcccccaccccctccaaagacagtcacctcctgctgcttggcactgatcccccttctgcgacatcctttctgctctccccccaactcctacacagtccttgtcccaaaccacttcctgcagcttcccatctgatcagtttcttaggaaggatgattatccgcggagggaggaggcggaacattccctgagccaagaacatgggggaaaacgtcaccgagttcattctccacccgccaggagggccttcgccctaaacacaagccattcagccacggcctgaagggagtcacgcctcgctcccaaacctccgcaattgctgccactgtactgttatcctcactgctcggccgtggaccagaggcctttcattgggggcccgactccggtccgggccccagcaccactccgttctaagagacggcgccagaacggagcccgtctgccaccagggcccacgcggcatcgcgcctcctgccggtgtccctccggcctgccttgtatttaagctgtttgcatgtctatctcccacacagaactgtcagccgcctcccacacagccctgcagatgtgtacgtagtaggtgctcagaggcgagtcggggagaaggtggggcgccgggggcagcgggctcaccccttggaacccagcaggagcaaaggcccactcccaccaccgccgaagagctccagaccagggcttgagacctgaactaacccagctctgccaccgcccgctgtggcctgtgggcaagccatttcctccctggccttctgcttcctcctctgtgacacagggggctgggccagacacggatgagccctcgctgctgcgtgctccccacagcaccgtcaccgaacctcccaacgccgcccatcagtcaccgcacagctgggtgaccaggagccaggattcgagtccaggcctcttaaaccccaccacccttatctttttccattacaccccctgaactcctgactctgtctctaggatccctgtcaacaatcgaggctaattctctgattccaggccggccctttctgggcctgataactccccaggccacgtgggcccagggttcagccgggaacaggcatgtcagggtcctggggctcagcagtgccacgcctcccacacgacaggtctggtgacatcctgcccggggcgggggggtgcagggctgggccaggagtccagcagagccggcacctcactggcccct

SEQ ID NO: 60823 - DNA, 1616 bp, Bovine  19866880866016
ggcaggcaccagacccccaaagaggaggctgcctccaagacgggaagtgggccggctgcctgcctgccactctggcccaggttctgggtgggggcccttggcacctgctacatgcttcttcatcatctccagaggagagcaagagacctgggtgggccgggcaggggaggggtccctgggggggcctagcctggctctctcctgcctgcgctggagcttttcatcgtcgctcaggtaggggttctctggctcttcttcctcctcctcctgtgccttctcctccttctttacttccagggctggcacctcctgggggctgggtcccagcacacatggcccaggctggtcctcctcgatggcaggcagggtggcgtacatggccaggtaggaggagcggggggctcgaggtagccggtgagtgcgcaggatctcaggaggctccatgctccgcagggtatccaggaaaatctccaggtcagcagtcagggccacctcctcctcctccctcgatggctccaggaatgtcttgtccttggtggcttcagggacaagctgggactcctggctggtctctgctcccatcatcaccggggctgggggacctcctggaccagaggataccttgcccactgaggaggagggggcgatgagagtggctggggcctggacagctactttctgggtggaagatgggacattagaagcatcagggtcctggacaacttctttttgggtgggagatgagacgatgctttcttcagacccctggacaaccttttcctgtttgggggatggaacggcaggaattgtcaggccttgagcagcctcttccttggggaggggagggaccgggctgcctgctgtactccagacgacctctttctggctgatcaggctgacttctgggccctgggcaacgttggttggtttggggcctgaggcagcaggagcactcagaccctgcactacctctttttggttgggagatgagtcagcaggaactccagggccctgtactatctctttctgggtaagggagacaacagggactttttcagagtcctgaacaaccttattctttggggaggatggagcagaaagacctcccgggctggtgatggccttccatctcatagaggatggagcaagagattgtccagggactatcacaacctcagtcttcaccataggaaggacggtggccgcagggggatctgaaagcccttctcttttgatggagggcagggcctggggtccccggggcttgagagtgagctgggcccgagcctgagtaggtgcttcaggttgctctggaggttgaactaggtccagggagagggttcgggtctggagtctgggagaggaaggtactggggtgtggccctgagaggtctggagaggggactgggtggggctggcgggtctctgcacccttgggacctcatggaccccggcacccagggttctgtcctgttcctggtctgggtgggctgcagggacctcctggctcggagtggggtgagcttcctccaggaagcccgcagggcccggggcagatctgtccttcggctctgctgtcctcgtctcaggcagctgcctcagggctacccttctgt

SEQ ID NO: 60824 - DNA, 769 bp, Bovine  19866880937395
gggggcgtttccacatagggcatgtctgtggaaatggtttccgatcagcggactctgtgcatctgtgtgtgtcagttcctgtgagggtactgggtgagtgatgtggtgaggccatgtggcaaagggccgggcctggtccccccctgccccacggctacctgtgaggtccatgccttctgcaccgtccccccccaccgcccccacctcagggccctgggcagacaagcttcttcagggcagcgctgagtgcggtcgtgcctgctctgtgggctgccattttgggtgggcccagccatgggaaggtcaccacagggggaggaacgcctgtgctctgggccagactgtcagaggtggtggccctgctgccttttaccccccattgtctcctggaggtgtttgcaagtaaagggtgtcccctgtgtggctgccgcctctacttgtgacttctgtctgtgtccggctcttctttccttaggatcagagaagacgaggagaaaggtctctctgcatccaccctggagttgtgggcttggggtctacggtgtcccctcctccgcaggggagccttacccatgttctgtccctcctcccggcagagggggaagtgagaaggagggggtcagggaccctgccttctgggccaggaaagttgcaaaagcagaagtgaggggagtagccaggctctctggccataggcgtgggacccaccatgcagaccccagcagatttccccagggctgagagagactcacgcccctgccccagaaag

SEQ ID NO: 60825 - DNA, 2258 bp, Bovine  19866881009197
tgaacaagataaataagtaaagcttgtagtaattgttagtaataggtgcttaggtggacaagacagtcagggattgagtattaacaatttggggaaatcttagctttgagagtgctgcttacttgggaatctgagttccattcctggttttgctcgattggccgggcactgccctcttcagaccattgtttggctaaggaaaaccgaacgtgcatctgagttctcgaggtgctctgtgctggagatggaggcaatttggaaggaggccatggagcccaaatgcttccagactggacctgagaatcgcctgaagagattcctggccccatcccagagctgctgattcagaatctggagggcaggattctagtatgcggctgaggaggttaaggtgcgacctggctagcacctgcccctctctccccagctggtcagagagctgggatggaaacccagtcgttctctcagtctggtgtactcttttcaccacgttgtactgctgcctcactcttcagattaaaaagttgtaaagaaggggatgtttaattttatcaaatggcatttcattcttgtttagttactgtcttggggccttgtgtgcctacatgctcagtcgtgtctgactctttgtgactctatggattgtagcccaccaggctgttctctccatgggattttccaggcgacgacactggagggggttgctattcctcccggggatcttcccaacccaacccagggatcagacgtgtaactcctgtgtctcttgcattggaggtggattctttaccactgagccgtcagggaagtcttgtcttggggcctcactgttttatatattttatccctgttttactagtacctttctcaagagggtgtgtgtctttcttagaggtttttgtaattcattggaaattgggagaatttggtttgctaagtttggtgtttcaaaaaagtgatcatttttggaagaccactttactttctctgtgaaaggtggctaatgaaagtgctctgaatgagaagaactttatcatttgttggggaatttattactttgatgctctagctgctttatttgaagaccctttcaggaaccaacgaagaaataaagatttatcagccacctggttgtggtttttctgtcatatgcctcttttggatggacagctgtgaggtggttattacagttggctctcatgatctgaagattcaatgactttcccgctctggtctctcttttctgccttgagtgaggttgtttcttttaatcccctgatcttctggtttggaaggatggagcacaacagcctaaatacctctgagcctggacaagccaagcctcgtgtcactttcgagacagtgtgggttggaaggtctctgagtctgtcgtctggttgcagcccctcctaggggttccgtgaggttgatgcttcaggtgatgtctttgaaatgcgctcttacttaaggctgcaaagaggaatgtgccctcatcttcaggaatcacttccggtaaacagaatgggggtaggtataacttttcattgactttggattttttatttatattgtgaacatgtacagaactttgaaagaatttttttttttttaaactgtctctttggagtggtagttgtaaactagtggttggtaattcctctcacaccacaggcgtatgaccagtttgttgagcacttgaatgaactagaactaaactgaaagaattttcactctcttgtgaagtagaaaaatggggtgtgattctcaggttatgagtgataagacatataggctaagtgggttgatttcctgggttaggtatgggtagatttgatgagagatttttattatcaatttagattcaggaaatcatcagtgaatgctgctggtgagaccagataggaagtaaagaatctcttactgccctgggtcacattatcggtggggaaatgactacttaactgcaagacaaaacgaaaaggaaggaatctcattgttggaggcaggatctgggatagaactaaataagcaggtttctgggcagtttctccgtgattggggttgggctcctagaccagtcttcaaagccttgaagtgtgctggaggagtgagaaaagactgaatgaggatacagatgtctgtatggctggggaggggagcacaacgagaatgatttatgctggtcaacacgtgtatctcggggtgcaaagggtgggttctgtttatggaagtctgctcagtccttcctaagatctgag

SEQ ID NO: 60826 - DNA, 1058 bp, Bovine  19866881018801
catccattgaagcgcacgattcaatggcttttagcttattcaaagtgcacacccatcaccacaatcaactttagaacatttcatcaccctaagaaatccccataccctttagcggtcaccccctctttgtccgcctgcaataccagagaccacctgcaatgcaggagacccagggtagacccctgggttggaaagatcccctggagaaggaaacgacaacctactccagtattcttgcctggcaggctatagtccatggggtcacaagagtcagacacaacttagtgactaaatcaccagcaccattctctttgcccccagcctcaggtcctaggtaaccactaatctaccttctgtctctgtagatttgtctatgttggacatttcatataggtgaaattgtacaatataggtctttcgtgattggcttgtttctcttcccatgtttgcaaggtccgtccatgttgttcatcgatccgtcttgctccttcctctgaagtggcagttcttttaacagatgtgtgggtgtcaagcaatgtgaccttctcccccattccttccaggggagttcctgggtgccaccgctcctctaaaagaaggctttttccttccatcgctaactaccctactaaggaggccttttgcagagttctccttttccatcttttcgctgggactaagcagctcaagtacagctggccctaggccaagtttctctccacagcacctgcaggcactaccagtgctgccaccttatgcccattccttgaagtagtggacactggggcaggcactgtcttcctccccgagagcccagctctttgctttttgctcagcactcaagggtgtgactcatgacagagtgtgaccaggagaggtcgagggtgtgctgtgtggccatgcatgcctggcacctccaaacagccaaaagccagagaaagaagcaaatgcagatgcacttcaggctaaaggggggcatgttttgcaatctctcttcctgattcttggctggttcttcagctcccatttctcttcctctcctcaattcactttcattt

SEQ ID NO: 60827 - DNA, 1480 bp, Bovine  19866881047686
ccgatgagctgagcgtgatgtgatcagatgtccatttttgaaaagcacctccaagtacagaaagtgcatttaagggatgtgattggaagcaggagcgtttttagtctccaggtgagaacggatgaaatgttagtatgagaatagaaaaaggggtgtggcctgggaaaaatactaaggagatagacaaccagagctggtgaccaggtggttataggatagaaggaggtggagcagaagttagactcccaggtggttgggctggttgtaggcctccttggtggcttggatggtaaaggatgtgcctgcaacgcaggtttgatccctggatggggaaaacctctgactcctggaggggcatggctacccactccagtatccttgcctggagaattccatggacacagaagcctgatggtctgtggtccatgggttcgcagtcagacatgactaagcaactaacactttgacttttcggggtggttgtgctcactgaggccaaaaaaggaagaggagagggcaggtttgtcaggtgggtagcagggatgggagctgagggttgtgccatctttgaggggcatggctccagagcacgtgccacaacacagagccggaaggttggcgcgctccagttctctgctgcttagcactgtggggaaaaggcacaaagaggagcgtgtgagtctggttgcttcaagggacttctcagaccagttggtccccatggcctgaagctataattatgaggaagggaacaggatgggaggaacctgccagacacagttgggaggcaggcatcacagagatcagatcctgcccagaccagttccccatccttgcctgtgctgtcagccttgacaagccccccatcagcaccctgggcctccaggagaagtacctggcgccctcagagcagtcagtggagcaggaggccatgcagctgtagcagcaagctgggctccggaggacgagacacacgacccagcactggggggagtggcggctcccagtgaccagctggacagctcagctgcagcagatccaagagcagccctccgggctagagctgggagacaggcatgaggatacctaggcctgcagaggacttctggcctgaagccagacgtgtcgcaaagcagagcatcagtcacacccttatgagctctggatgctgccactgggcattcagcactgacccacttgggctgtgatgggatgtgctgcaatacaagagcttattttctacttcttgtggcttccaaactttcttcccgctaccctggccaagggaggtgggaacgtgggaaggccacccttccccagaagaggcctgtttcttggtattccagggcaggctcgcccccaagcccaggaccatgctggagggatgacccagtctccagtggtgctcctttgtccatcttcagcgctaacagtgaactcaagcctgagctttcacaagcaccatttccagcagatcttg

SEQ ID NO: 60828 - DNA, 2348 bp, Bovine  19866881115218
tcaagcagcaactctgggcctgaagagcacatagcccagtgcccaaaagccccttagtgtttcatatcaacattaacttcctggagggcgacaaaaatctgtcctggattactgagtgatttctaatatgtaccataaccaacactaagtcaacatttcagggatcaaatttcctagttggctgcatgttggaatgcattcttggcatcagacttcctcccactgcagtccacccttagaaaatgcagacgccactgggaaataaagattcaacctgtcccaagaccatcttctagtatgcacaaatgactaacaaaaataaacaaaagttcactcagatgtcccttcaaattcactaatgccatccatttaaacagggggaagagtgagttcaaggaagaatactcaggacagttaagccaatattcaccctaacttggattcttctaaaacctagattgactgagaagttcatctcagcacctacaaacttgctgctgaaccactgtgcccatttccaagttgctggaaactcatttttgcaaaatgccagaacggccaggaaaaggtggtgaaagagatatttccaaactagaatctgtattcaagactccatacaactttacatgggaacagcataacccaccctcctcctccaggtggaagccctgtagtaacctggcactggatcctccatgcacctttagctgttaagcatctacttagagccctttgagaagtgccaaaaattgcttgtgatccaatcacacatggaccagcaggtaaagagaaaccaaaattactacattaaagaggctcctataaggaataagcatgtgtttgcagcatttaggagcttcttggccacagccaacctagtcaaaaacaatattgaaggccatttctgtgaacagatgggcaaactgcgtatatgcaggtttacccgtccaacaaccctcaatataaggtctgatccaagcaactcagcttgagcatggctcccaaatcttcaaaaacagcagcagtctaagatctggacaggtacctcatggctcctgttttaagaaaggtcaattacctctgccaaaaaagaaaaaactcaggttctctaaccaaagttgaaccacggacactgaagcatccagggcacacaactctgaaggtgacacaaccttccaaacccaaaattactacaaaagaggccctgaactggccaagaacttggcaggctgtactaaaggccccatgtaaccacaggaaccactaagaccctgaaaccactctctttcatggaattggttacagtccaaatccccaaagtcaccagaatgagacaactacaggtctggggatggatgtgtaatttggattctgtaaagcccgtgaaactcagagtagcactatgaaaaagcaaattagtaatttaactttcccttttttggacatttaacttcataaatcactgcctctgaaaagctgtcccaggtttaccctgcccaaatctcattgctccttattcccagattccttcaggccatacacttagtttggtctatatccatttataaaaccttgctctgcaagttttccacatgtgtgcacataagcatgcttcccaagaaaactaaattcctctgaagcagatattgcctctatctctcaggtccctccctagtatctagtagatatgttcagacagagctacttcccactctcatctgaaactccagacctccctgagctagaaatcaggctcttagcaacaaacctgaagttctaagaccctccctaccaccatactgggaaaggcctggataaccaatgtgagtgtcaacccaagtttttgtatcttgttttaaaacaagctgatagtctttggtaagtgagctgaacctaactaaaaattatggtcagagccataattacattcatactccctactatcgatactatgttgggtcaaaaaggcacttccaggaatctggtctaaaaaacacttcttgagaagaaaactggtgtcagagctagtggattacgtttgaaaagggactttgagaaagtaaatccagtcatctcacaagaccaccaagggagattacgatcagaagacagttcaaacaattctaaaatacttcctcctccataaaaaggatgtttcactaaaacaacccagaaatgtgtttaatcctaaaatggcaattttaaaaacaaaaattgaatctacccacataacccttcaggcaagatttgttgagtccccaaacactgtactgaaacctggggcattaattttcatatataaataagtgatgcataggagtccagtaaaaactacataaataaacaca

SEQ ID NO: 60829 - DNA, 668 bp, Bovine  19866881120400
tggctttgggtaagtgacttggcctctatgagtcctcagttttcctgaataaaaatggggcttgttgtgagcattaaatgagttgatggaaagcatagcagagtggatggtaactattaatatcatgtgaaaagaaaaccgagccttattattataaacatacacacttaaagcactaatatggagctgatttctatgcaataaggaagggccccaaaccaagtctcaaccaaaggccagaccctgcccaactggagagacgatgaacgaatggtcagaggcactcactcagcactacctccgccctctccagctcacacattcctctggcctccacaggccttgggcccttgaggaccttccttggtactagtcatccagcctgggctctcccaggtcctggggaaagctggagattccagaacattagaaacctggagggcagggcctgggagacctagggattttggcagatgttttctgtctcaaggcaggaagacttctcttcctgccactctcgccaaagacctggtggcggctcacaccacgagctccaggccctcagtacagtgctgggcagggaaaagggagtctcctcactccttcccctcccctgctgaagctcaggggtgaatttgggagccaggctacctaacacctcctgcccg

SEQ ID NO: 60830 - DNA, 1247 bp, Bovine  19866881141364
agagttctagactattgcaaaaataatgtcccaaaaagctccagtgcttgaataatttattttggataagcaaacttagtattttataatgttacatagttctggagaatcagacaaacctagattcaaatctgaactctaccttttactagttttttttgccctagggcaaatttctcattcttactctactttctcgtctgtaaagtgggaggagtaacagtagaacccgcctttcagggttttgaagattaaatgaagaaattcatggagacacacaagcatagtgcttggcacacagtaagtactcaaagacatggcagttgtcagtaatagtcacctctgacatgccatcagtagaaaacacggaactcagtgaggtccctggtctatccctggcccaggacaaaattgtggacacattaactactgaagtgatccccaaatcttttataactttggcagcccagactcctaaacaagtaaaaaagttagaagtctagaaacaaaaggcaggctaatgctcacgaaactccatcactttgtggccagaacagaatcttgtccaaaatgcaagagagaatgccatctgtattcaccagagaagatgcagtaacaaacagtaacctatttccagcatttctgctcaggtgacttctttaagaacagcagaaagcagtaataaggtctacccaagagacaggggaaatcactgggcaagaagagcccaaagacatatctgtttcctctaaaaggaagcacccagcacgaggtagcctttaatcctctaccacgtggctgaactcacactcttcttaaagtcaaagtacaccaggcaccagtcagttgagaataaacagctggatccagatgcactcatgcaagttgtgacctcaaggaaaacaggaggcaaaataaaaaacactaagcacacagcaaatgggttttcaaacgactgacatcacaccagtccctcatctcccctgctgctgtcatgctgctgctagatcttgaagggggagttccttttaacagagatgtctataaacaagcaagctgaaagctaacaagtttaagagggaaacgcatacaaaattcttggctgctgggtgaagagccacaaaaaaatcatgaatgcgccagtgccaagggaagaaggaagtctaatatctaacactgcagacttggggaacccagaagcaatgaagccataaggaagcccaaatgcaaaaaaggcgagggggaag

SEQ ID NO: 60831 - DNA, 1248 bp, Bovine  19866881177497
cctgcatgctctggaggctgtgcttcacaagagaagccaatgagaagtcacactacaactggagtgtagctcctgctcaccacaactagagaaaagcccatgcagcaaaaaagatgcagcacagcccccccagaaacaaataaaaaaagtatgtaagatagttcaagatgttttcagaatatgaaagggaatgggagggacaaatgatttggagcagaggagttataatttgcagtaggagtcacagacaacttggaagacaatgtgcccttcacaacccacaagaatccctttacttgaaacacaagatacctgaggcaggtaggtatcagccataaacctgaaaaataggggaattcactggaagtctatattcaggttagctggatatcattctcaccctaggttttcccaaaaggagactggagatttattctttgaggagaaatcaaatcagagagagcccagctcaggggtatcagtcatggcagagagagacagagagtgaagcactgggttgaaaataagcataaataagaatctatgtgtagaactatgggactttaaatctaatttccttctcagtgttgagaacccaaaggccaaaagcattcctgtccccagcctccccaccaggcagcaggctgaagattcttttttagagagagtaagatgagacatcagatattgacatttaagggttcccaagtgaaaagggaagactaagtctgatcatcccacagagaagcccaccaggcaacttccatgaacccagagcttccatgcaatttaaaaatactatattcttaaatatgagcactctttcattcaaggatcatcaatcctctaacgtgtaagacacaaaaacaaaataagacctgaaagaaacactataagcagatgcagatatcccaaaaggcataatcaatatcatcagagaaaagatactgcattcatgaaacaaaaatagcaaaaaaatgcattaagtaagagaacactattcaaaaatacagacgtgtatgtcaggagaaagaaaagagttgaggacagctaattctgtagagtggggctgatattgatattgatgttgatgtttgataacatgttggttatttaacttagacacatgtattatttcgattacaagttttttttctctgttttttcaaacaagcctctaagtccacgctgtaccaatgcaccaatatcgcctggtaagattgtcagaaatgcagaatcccagggctg

SEQ ID NO: 60832 - DNA, 1538 bp, Bovine  19866881244277
tccacactcctccactgcccacctcccttgaccctgcatctccccttctccttcaagttcaagacaccaggcaaactgaagccctcgtgtctctcccaagtgaccagtgccccttcatggctgggcctctgtatttgttgctccttctgatcagattcctacttatcctcaggtacaaacaaccctgaagccttccaagggaccagccaccagggagcccactggtcaacaggaaaccaatcatctgtaagggcagacgtggccattcctcagcccctggccttctgctcttggccacggtggaggctggtgaggaaggatacgaggagaagtggaagtcagctcccatggcggcagacatcatggcctccaggctccgctgctcctggaccccaaagcagtagccgttggctttatccacagcctgcagcacctgctggatactctccttgtcctgagcagggaggagagaaacagaggtatgtggaactgaggttgtaccaaaccaactgcattctccaaatatgccccctccatcttgcctcgtgaagcctttaatccatgcagcttccttggcctggaatatatctagtgtcgccagaggcccgactacaccccttctttcctaactgccaactcacccaaattagaacagataagctcctccatgcacacttaccatcccctgggttgatccccactgtggctatgagcctaccatcttactattaacaagttagtaactcccccactggactgtgcacccttggaggtcaggaacctgtttgcccagacatccccagtgcctggcacaggcatttagctaacagcaggcacccgtaaatatgcatgtaacttatttgttcctccatataaaagtggtaaggatggtccctatatcacatgatgggaaagagatcaaaacagtacatgtaacagtcctcagcacacacacacagtgtctaatacagaaagccttcaacaagctgtaaattgtacgattaatattatagggttcacctcctcactgtagaggagagaagtgtggcattaaacagaagagacaagttctttaagtccaccacagcagaaaggataatctaacacgcaccttttcctcccaggttccctttgcagggtacaaggtgagaggcacaagagttgggtactactttgcaaagtcaacagtcagttgcccatctggaaagagcctgaaagacttgtctctggccttggtcaagtcccttgctgggcactttctgaacccctccattttcacacagaggaggtaacatacgtggagagaacccagcaaaacagaacagacagggccaaagtctggtccaccctctttactggaatcctgcctcccactggcctcgaagccaatgagactgatgagctgagaccaggacaaagactactgttcgaggcctccacgcttcctatatccttggtctgcaagtgcagtcccaggcacgtcagagccgatagccaagggagggagtcgttccagtgcctagtacaagcacacctcg

SEQ ID NO: 60833 - DNA, 4367 bp, Bovine  19866881254889
agcttcttggagtggggagtgggattcacctgcctgtgcttgtttcagaggggaggagccagaaatccatggcacacgcgtgtgtgcactggattcagcccacgtgcgctggctaccccttcagggggtggaaacacaacagtaaacaaagaccaacatccctacccttgtgaaaatcacactcgaatgggaaagagaaaataaactaaattatatagtcttagaaggtcagcgacgcctaagaatatacgtagctgggtaagggattggaagtgctgaggtgtgcaactttaaaaagggtgtgcctccttgaaagggcaacaatctgactgaacaaagacaatggggagcaaaccatgcggatgtctggggaaagagccttccgggtggaggggactcatcacatgctcctggcaggtgtgtctggggaagggcacgtgtgcctgaggctgcccggctcaccctgcacaggtctgtgtgctgcccaagagaagtggaagacgggagtttcctgctaacagctaccacttctggagagctctcccccagactgggcgccaggctgaggtctccccaatcacagcatcccaatgcaccccggcaacaactccacgagagaaggacaagtatttccattttacagacaagaaaactgacgccagagaggcttgtgggccattgctgttaactcctgcaccatcctgcccttacactctggtttcacctggttgggcatgacagtatgtctcctatacatacatgtgacatggcacatttggcatgtgacagataaaaaagcttgcattactgtgacttggccattttacaacgatggcagagtggtagcagttgtgcccacctgtacattttcttgatggaactgtgacacctgatacggcttgtggtggcagtgtcagaggcctatatgacagcgggcgtgcctgttggggtgtgtttggaggaggtgtagtgtttccgggtgtgagagaaacactgactcagtggctggcattgttctctgatggacaatccctgtagccatctaagatgccaggacaggaaagaatcaagaactaggagccagaaagggggaagactgagggaggaaaagacccataccccttctcctctccaagcaacagtccatttccccccaagacctgcagtgggtaggagagccccagagcaggaactgccttgttgcgaaatttggggattgaaagataggcccccaggaagctgctggacgtgttggcccttccagtcccactctctgccctccttcatgctctgtgatcctgggaggctgacctctatgaactgtgcatcaatggctcccttgttccctgcctctctgttgggttcagccaatgagagtccccagcaggaggtaccagagggaggaggagaatggggtgtttatttccctgctcccttcccaacttcccttctcggtggttgcctacatcgctcaaccagaggccactgctcctgtcagggtccctctccgcacagttgcactctccaattcccaaagcccttgcctcccctctcccctctttaccccttcaggcccaggagtcgtgaaggcttctctctgttgctagccctacagatagctgtggtaccttgttagtttcttaagcccagcccacagctttggaaatagtctctttaaaaaaaattttttttaattttttaaaaatttatttatttggctgatctgggtcttagttgcagctcccaggaccttcgatcttcattgcagcaggatctttagttcccaactcttagttgcagcatgtgggatctagttcccccaccagggatagaacctgggtccccggcattgggtactcagagtcttagccacaggaccaccagggaagtccaagaaatagtccctttttaaatctctccccagtttgagtgtgccctgtctctgctgggaccccgcctgacaggggcacccatccaccagcacggtcacacgcagttccccacggatcaccatgctgccatgtcatcacactcacatccctttgtcccatgagggcatcccatccccgagcttccgcatcacatccttcattcaggaagcttcctggagaggttcagcttggagccaagtcaagggagcagtcagtctgcaaatccatcaacaggcccagactgccaaacgaaactaaacggcaactgctcaaagaactgccaacttaaagagccctgccagacacgcgaaaaggcaaggtggtgcaggcactcacagagtagacctcaagaccacacgggctgatctcacatcactgaggtttattcttcctgaatgcacacaacaggcaactgactccatatgcgttccttttgtggaattctacaagttctgggtgaggtgtgagtccatctggcccccttccgtctaccatcaagatatttgaatcaagtgctcccttttttcatttaaaacttaatatttttatgtggtcaacccctcttcccgagaaagaggtgtctcccctgggagccagcagcccattatctttctgaggggccgcaggcaggcacccacacaggacaaggatggtgggcaaagaaaactgagggactgttcagagcaacattttccctcaaacagccctcctgccactgtttgactgagcagcaacggcacctaccaaaatggggaccccagctgcgctgagacttgttttttaaagagaaatccttttctcagtggaaaggtttgctgctctgttaatctgattgcatctcaaaggacttgtaacatccccagttgtaccatgtaagccagagtcaaatgcgggaacatataaattcctagtagaggcaacttccctagaacccagccccttgccactgtcaagtgaggggctcctttgaggtgaggagggtgctccgcttgtgcagggctgattagagaagtcttcctgaaggaggtgaaaggagcagaatccagaagtcagatcctgagttgaggctcgggaggagctgggaggagctggaaagaataatttcaagagctttcattacctctctctctctcacacagccacccagccccacccaaacccttcagcatttacctccttaagagaggccattgtggagagaaggcgcaagggcaatattttggaaaagggctccactggctcccgccctggaaggggtgggggctcctggggtgagctcccttgggcctctgtccttggctgggatccccactggtctgagcagctggaatggaatgttcctgggataaaacgcctgcccctcctccacatctccccttatggagttcctcggggaaggcactggggggagaagggggactgttctgggatgcctgatatggcgatgctctggacaagcaaaggcccacactacccaggggctctgtcctggcagcctctcctaggccaggtaggctggctccactgagcatttacagaccttctctgtgtgctagtgacctctcacttaatacttggaaatcatctccttcctaactccccataaaacacacacacacaagaaacgggctcagagaagggaagtcatttgcccaagttctcccagctgagaagctgagctccaggctaggactaaatcccacgtctttcttgttctaagtatcaggacactttctgccccaccagggagccagtcagcctcctcctctaccatcccaggctctgcactctccaatcatgctagcccaggtgcacagaggaggaggaagccctccaaggcaaacccaggccctaagcatccctgacctgcccttgctgactcagcctgactcataccccagagcacaaccaagctaggcagccagcctttggagggtgtggccagaccttggaggggtggcaccttttttgccaccaatgtctgatcacatccctcctcagaaccaaggactagggtttcctgtacccagactcaaagagcaagtgctcagaaacccatgtggagccctcaatatcttgaaaaacagaaagccacatagcctaatgttgaaggtgtcccccacttaggtgttccatgtgattgggccagtcactcactctccctgaccctcagtttcctcatctgtggaaatgggaataactcctactttgttggcagagtagctgggaggattgaaacagctaatgggtgtaaagcgcttagcacagtacttggcatagatgtgggtggttaatatattattccacaacaaaggattcccttcccctatcactcctagccagggtgcggtcaagatctaatgcaggaataaataggctgggggatgtcccagctttcccaaatacctcctcccaagctgaatgtaaaggcgggag

SEQ ID NO: 60834 - DNA, 1434 bp, Bovine  19866881259105
ctcatcactcaaaagcccaaattgcagaagaagcttggccaacatcgttcagagctactgacctgagtgaaagcatagttttccctcagttgctcctagacatggaagaataaaaatgggaatggctctaaatccagtgctacctctgcttctctcttcatttggccagggccggtagatcaagacttctcagaacatcactcaattctaggaccttactatgaaccttgctctgccttccttttctcccaagtatgtcctgatatcaaggcacctggacttccacttgattccatcctcaggccttttctgccccctcaagagcagaacaggagatgttctataattaagaatgtttactttctgagggcaagaataccttacttcacttggtccattttctatctcctggatacctaccagtgccaagcacagggaagatactgagttatgacaagcagaatgccatcctggctgccaaggcttacctgcagcctcagcaagcagacgtccccaaagggggcagggcggcctaaaagagcactgtggacttgcagttcactctctcgcaccttctgctccagctgagagatatgtttcctctgcctgcaaaagtcagaacagaatgaggcccagggtccctgacacaaacccacttgtaatatgagccccaacttttcttaaataggtaaaaacctatttacaaaatacactttgtaaacaaagaccttggattctcgggtagtgctgatggaggaaatgcaaagaagaaaactgactgaggcaaaatgaagaaagatcagctgcaaagacccagctgcctcctctaggcattccccacagcccctacagagatatgtaacaaacctatcatattattcacacacagaactaggctacttatcatgaggcaaagtaggggtctaaacagaggaggatgcactgcccttggggagatgtcatcagttgggggcctatggccccttgcccccttacttgtcaataaggagctccttttccttcagaaggtgttcattactgttcaagatgctcatccattgtgctgggtctaacgtgggcaatgaaggagaaaaaccagcaggatggtggcagacggctccattctgaagctggaagacaaacaggcccagtgggacttaatgttaacctacaggcacctgaaagcacctataaagtgcccagctgtgtctatagtcaagattcactttggctcagttggagaaggcccactgtttatgaaataattttagctcatgatgcatgactggaaagaacctgcctgacagacttctgccaactggacactccctgctcagaaaggctctagtttctaagaaaaggtcagtttatctttctttatctggaacaaaagcaaatcagaagctaagatgccctcaccaaccaggaaaggag

SEQ ID NO: 60835 - DNA, 975 bp, Bovine  19866881340411
ttggaaggagaggtccccaaagtagaaggtatcacatgggctgttggaatggttacgtggcttttgatgggctggaaagaaggactgctaccttgaactgcaaaaatctgtggagagaatagtcttccgtaagtcaaaatcaaagcagcaagctttttttgagtttggctgctatgccagacattctctgcccgagagcaggcagagagggcactttcacaagtatcaggcagaaaaatatagcagcctaaatgggagatgtgtgttctaggatctcaaatgccattcccaaggcaaaccaaagaaaggtaacattggcttcacttttaatttatactgtcctttgtatttgaaagggcttccctggtggctcagaggttaaagtgtctgcctccaatgcgggagacctgggttcgatccctgggttggaaagatcccctggagaaagaaatggcaacccactccagtattcttgcccaaagaatcccatggacggaggagcctggtgggctacactccacggggttgcaaagagtcggacacagctaaaatcctgccagtcaataaagctgaaaactgaacttaaaaaaaaaaaatcacttacttaagggaactggattaggtcctactcttccaagagctgggcgactctaagctataatccaatctaataaaaatgtcttttccaagggctgctggaatcttctttgatctccaaaagctccacagcacaggtgaacaatggatctaaactatgcaaagaacaaggcagactcggtagtgctgctttgtgtctggggcagggagcactgcgtctgaatcaggattctgctctctctcccacacgccagacctgactgccaggatatgtcaagttattcttagcaactctcaggtttcattctagcacagtgagcactctcaactggtaaacactgaaatcctcttattttttactttgccttttatttaccc

SEQ ID NO: 60836 - DNA, 1476 bp, Bovine  19866881350712
tatcaaaatgatttttaaaatgtacagaacagaaaggcatgattaataaaaaaaaaaaaaaaagatgaagaaccagacggtggtctcctgaggccagtatggggtgtggaggggccaggtgagggactgaggccggggagaggatgtcagccagggagaactgctggagggccagagtggagtgtgatgggaggaaggccggctggagactgagggcccacatgacacagaccctgcgtgcacgtgaaggcctgctctcccctgctggtcatcccctgctccagaccttccgtggagccctctgttggcctctgtggcccttagttggccttcgaggtctgctctgcagggagaaacctgaaggtcattctcctctcctttcccctcttcacccctccatgtccagccagaaacatttatcaaacgtctctggtaaccagacaactgggcatatatacacagaaggcatgtctgggcttatacacatcgggcagctgagtggacgtagctcctgcccttttggaggtgacagtccgcctgtgtcctgaacggctccctccagctctccagccatcacctttccagtctagcccagccttcaccttgatcgccagtggcttcctgtctccaaccccacgaatgttcctcacgtgctcttctctacactgaaacaaggagcacagtttaaagatacaactctgcatttcttacgtctgagttgtcctgcggctgttcatgtctcggtcttgtgtttgtttcctctgtagcatcacagtctgtaattattatcttttaaatatttatttatttggctgcaccaggtcttcattgcagcaggcatactcttagttgaggcatgtgggatctagttccctgaccagggatgaaacttgggcccccttgtattgagagcacagagtcttagccactggaccaccacagaaatccctcagtctttattcatctgtttactggcttaggtaaaaacagaagctctgaaaattatggcaaattgaacatatgcatctaatttcactccctccccaaagttcactaaaactacagtaaagggattttgtttaaggcacaaaccctttaacatgagcagaatgagggagaagacaagactagggcattggaagctggaaaacagatggtcgggtggtaactacactgcaaacccaaggaaaccactgcctaacctgggtgtggggaaggaaagccaacacagtttagaccccggctcccctaaaaggctcaggtacctctttaaacgggggtgtgaatacgaaaaaaggagaagaggttggaagatgtttctggatcagaactgttaggtccctacgtcccttccccagtcctggaaggaaactggaggtttattctctagacagaattaaacaggatcactgggatggtagaccattggcatagtagagggcgggggtatctttcccaaatcaggtggtgaagcga

SEQ ID NO: 60837 - DNA, 932 bp, Bovine  19866881411257
caagatattatttgctattattagttacagctaattaaagcttttgtttgtacaactagtaatcagacttacactgaattcttagatcctaccattagaaaaagtataaatgttttatttaagtaatggggaaatgggaagaaaatctcatgttcccagctgaggattggagttctgcttttgaccaagaattctgtccatcattgtacatcatatgactaactttcattactggaggaatcagggaattcattttatgttcatcaggattgaagctataatactttgctgttgttttggttacttagtttttttcctacctcactcttccatcccattccagcaggtaagaatatctttggcagctttttaattaaagtaatattatttttaatttttgcaataatcagaagggttctagaccttataggatcagtattgagaatctctgtttggttctaggtgttttcttcttgctttgggagaagtagagtgaaatattgggagttgctttgccttaaaaaaatatccttaggagtaaaacatgtggaagaatacttgaatactttatatgcattttggcagtttcagctgaatgggaatgaattacagggaattaaaagataatggagagatctgactgcttcctttattttacagctggctcaagtaactgtgttcgtggccatgcaggataaatacccaagtgagaggatctctcatgccacctcaccaggtgagtagtcaaagttttctggattaaattctgaccattggtctgttattttataacagaaatttccttaaaaggaaatactgaacaaacaagcatccactgaaatgctggtaccaaaagaacaaaaatgatgtggggctacatgaatagaaaaatagatctctcgagagaataactatttatctctcgtgctaca

SEQ ID NO: 60838 - DNA, 1170 bp, Bovine  19866881435099
tcagctcatggtctcattctatgctcatcccagtcacaatgacagtcagccctaccccaacatcctcccagcccccttacctaaaatcatcctccactgctagacttcaccctctcctcttcttttaaaacaatttctttttttttttttccggtcacactttgtagcttatgggatcttagttcccttccaggaattgaagccacaccctcagccgtgagagcacggagtcctagccactggactaccagggaattccctcctcttcctgtaatgatacaggatggtggtaactcccatttctgagctcttatgatgtgctcggggctttacagacattatcccacttgcttgtggagactgaggctcagacaaggtgatgcagttatgaactggcagaatcttctgcccttaacactggcacagatcacctggcacctcatcagagctgagtctattttaaaaatcatcatctgttctgcaaaatttagtgcttttatagttacatatcaaattgtcatacaaaatctcgctttgctcattcaatgcttcaagtgataagtcttgctactccagcgaggtggggaaaggactgttacgtaggagatacagcagcacttggaatgggaagccctgggtctggcttcagctgtgccacagtcaggctatgtgatcctaggcaagtcacccaagtgctctgggccttcttttgctcgtttgtataaaggagaatgacagtatctctccaaaaggttttctgatgcatgctcaaaagcgctccacccacttcattgaaataataaattttatttatccgcagccacctcacccctgtgtttagcacagcactagatgcccagcagggatcaggaagtcttgctgagtgatttttcagttgctggagattcaggagtcacagaaaataagccactatttctcctcctccttatcctagaaggactcctaagtgccatcactgatcattatgttcagaatgtgtcaaactctatgccacgcatcttacaagggcactctccctgaatcctcccgacacccctgccaggcgttaccccatgcttgcacacgtgcatgctaagttgagtctgactcttggtgaccccaggacagtagcctgccaggctcttcgtccagggattctccaggcaagaa

SEQ ID NO: 60839 - DNA, 1190 bp, Bovine  19866881554728
ctgtgtcctagaaattaggggtacccgtggctacagggcacagcaccctgggcaagtgaacccattcctcttgttaccataacctctatggcactctgcactgtgacctgtacttcctgccaaagcggggcaagggtcagctctggtggctggattggggcaaaagagaacacctctccagcctgagcacagcctcagtggctcactctgagaagccctaaaatctgcaagggtccaggtcaaagacacacaacaggctccattgggcttccccctgccttcccagccagatccccaccacacacaaagcccatctgaggcctaggcagtgcccctagcctttgctgcttgctctctgcctctgggaagtagtgtgtagttttagaaacacttgctccaggactagaggacagacccagtgcagtgggaaattgtctcagagatgaaaacggaaatcaagtcaggctggtcttaaatgctgcagagtcatgggcccctgggagaatctgacatatgtttgatgcctgtaaccaacaccttttgttcaaaatcatacacagactaaaagccttgtctgaatcctctaaggaatgagaaaccgagcccagggaggggcaaggacttgccctagatcacatggcagagcctgggtgagcagccaagcccccaggtcgcagcagcagtcttaagaggcctgaaccccagagaaaggccagagggaagagaagacacgagtggaattgggtaaatggttttaatgtgtaacagcaggccagctggggaggacaagacccccccaaggccccaacccttctcccatgatggcctgggacctgtgtgtgccggccagccccgtgcctgccctggccctgcggcccaccagtcccagggagggtgggagaggagagtggggagccgggagttcagcctggagagttcaggggagcacacacaggggctagttgaatctggccttggaaaagtccatctctggatgctgatccatgaacctgcagagacaaagcgggaaggtgggacaggccatccgtcccccaactttgcccctttctctcagcctccaacatgaggtctcatctgtttacaactctcagcaacctggagccatgccaggcaggagtggggcccccaaggtctccccaaggttggatgctgaggtgccaataccggca

SEQ ID NO: 60840 - DNA, 1089 bp, Bovine  19866881763473
aaggaaaggcatgcctggcaggctagaccctttgaatatattcagaacaaaccacttacagactcaccacttgcatagagtccccctgctctaagcaaatggaattaaaagccccaccagatcagagggctaacggaataccttacaacttcttattgcaccaagggaagccataacaacctaaggggttgctgagatataacacacttgacttcccaattctcttgtgatcacgactgattcagaagggagtagagagggcatgaccaaggacccaactaccaagcgatatacaattcatcaaaacacaccgtaccacatggcaggggcaaaaggaaagagaaacttcttaattttcttgaaataaaagctccactcagaaaagctccaggtttcagtcccaatccaaagatgcagaaaggaagtgaccaggcagcaaaccaaaggagccagatttagtacccaaggaccagcaagaacgtgatcagagagggatgggccgggggctgccacaaaatgcatccatcagcaagcagaagtcttgactgccactcgacctgtcaccctaaatgccaactagttggggccagcagaaacctagaatatcatttcttactccttgtgctttcaaatttattcctggccagatctgttgtatgacttttaataataacaataaaaaaaagcatccctggctctttaacccgaaagaaccccctaattgattcccacagtaattaacctgcattttacctcagagagcggtagttaaggaagtcggcactgctatttataactcatctcaaattgagggcagactgcctaaaatctaacacatcccagctgtactcctgtttgaactggggccaagggaattttttaaagcaatcttggcaccgaatgaatgacaccaacagtatgagagcgcgagtggttgtgttgtggtgacgtagcactggaggtggaatgggagggggccagtgtactgtgatccctctcgtgcacgcctgctgcttgctgagtcccagtacagtaagctgggaaccgcccactgagagccaaacacaggaaaaggcttttcctgtggaa

SEQ ID NO: 60841 - DNA, 776 bp, Bovine  19866880396586
ctgggccccaatgtgatgagatgattctcatttgctggttacaagatgccctgtaccagaaaaacacatagccgccaatgagcactcaagagagggcattcctgcatactgacagccaccactatcctcaggcatattttcacccagaggaataaacatcctagtaggaagagacatgaaatgcgaaccttgaagtcataattcaatgtctaaggactcacaaaccagttcaagtttattagatggctaataaaaataaatcatggtcatgtttttaaaatgacttcccatgtgttgtggttacttcttgggcacactgtaaattagctgtgaagggctacttcctgctgggactttttttttttctccctcaaatataaagggttataaggctaaagaatgcagacacgcatcatgtctgcagaaatcattaaaaaagatcaaatgtaatatgtactttcaacatggacaacgggctttgagattttccattcaggcagcctcgaacactgcctccagcgtttgccaattacttctgacaaataccatttgggcctgagtgatgctgtaagtgaaataaaacagtgggaggaaaaaaaaacagagcatgataaaaggcattttttttggtctgctgagaacttactgtaagttatccattcacgggggaaggccttgcttcctgccagggacgggccccatgcgatccagagttctaagggacttttgtttgacagtaatagaaagagaagacaaaactcagttttaaagtccct

SEQ ID NO: 60842 - DNA, 1073 bp, Bovine  19866880457097
tgttgcagcaagagcattgattaagagcttctacattctacataagagaaatcccttttcctccttttaacaaatgaagcaattggtgacttaaatgttgcttgctaaaactccccaaatttttcattaataagagaagaaactagaataaaaagagagtataagcagcttgattattagactttatgtaaactttaaattgtgtttatctcctcctcaagtaaaaagaacatttcactttgtataagaaccacttcttatagacagactgagttgatagagtttaaatcacaatgtctagttcagattcattttaatcattccacttatataaaccacaaatcaaaataaggtgattctgacagagcagaatcatttgcctaccagtttcatccttgtgattaaggcatgtttgtaataaattgtttggttttctttgggataacattgaatcatatttccttacctccaatcagaataagcttcatactgatatgagagaaaaagaaccaattgtgaaaaaaaaaagactggaaagcagccatatttataatcaagggctcctatttatagaaaggtgctagatatgatgattgcaaaaactgcctccaagcaattccaggtaccaactgctgcattaaggaagacagaaagataagaaattacatcgcattctgtgtacaaatctaatgaaggtggcatagaaatgtgagtgctgagaattcaccaagcactaagaaaaagactgatttctgacatggtcctgccagccctttgttctaggaatacaaggaccctggagagtcaatcaacggttcttctggtgtaaaaatgtgagagggctttatcccatgtaggtcatgggctagatgacatttgtcttaatttccaactcctttccatctccatggctactcaccctttacagaaccacctgaccaatgtcctcttttgtcatgaagtgcacaggtgcatcactttaagggtatatgtatgaccttcaccttcctagagtcgccactgccctctctccccaccccatcactatgttcatgtaactatgtttttagaga

SEQ ID NO: 60843 - DNA, 1853 bp, Bovine  19866880527920
gtgagaacgtatcctgaaagcgtagaaaacaactcaacttcaaaacaaaagtgcagaccaggggcatagcaagagcatcactgaattaggcaccaatcgataaaaacaacacttcctgtctgctggacgggggcaaggagagtgccctgctgtgttctggaactcaccttccacacccacgctgtcatgactttggacaagcaagttcacctcccagggacccgctgtcctcatctgggcaataagacaaactgaccccctggtgccctactatcctaacacccccctcactctaacaccagcctctgatgtcacgaaagtcacatctgtccagaaccagcagcatcagagggaagggggcattttaaggtcagacgccacacacagttctcctgctgtgaacttgacagagaggtttgcagaaaacgagcctttctacaaaaagagtgtcgctgtgtcagtctgggaagctctgcaggccaatacagccacctgtcccatctgcacaggaggaggaacccaagagatggacatgagtcctgagggaatcaagggacagtctgttgtgagacaggaggacagaggaatttcgaagggcagcccttcccgctgagttcaggcaagccaaccaccatcgctcctgaatcttaacaaggaaattgatcaggtgcatgtttgctaattccccagctacttccttagctgccaagaatcagttaatagctcccacatctgtaaaattgagaaatttgtcatagcttcacagggtggaggagtgaattagaagatcccctcaaggagggcatggcagcccactccagtattcttgcctggagaaatcccatgggtacaggaccctggcaggctacagtccatggggttgcaaagagtcaacatgactaaagcgacatagcatgcacacacgcacaggttacgtaagatgcaaaaccccgtgtctggcctaaaggacaagtcagtacatgttcacacattctaagcatgctgttctcaaacctgattatttcccaggatgcatctctgatatgctgcttccttcatcctacatccctgtctcaccaccaacactcttctttgcctttctttgggtctggaaactcaaggcattctgtaagtggatgaaagaaagacccagaaaatacagatccaattgggcatctcaaacttcttcttacagttgacactgtgatgttagctaaaatattggaataattttgttttccattattagcatgtttcttccttaccagggtgaaatatggtttcctttggttttttaaaaaaatgttgcaaaagatgaagtaatgcctagtaaccttggttgttttttaaaaccccttcctatcaacttcttaagggacttggttgtaatgttgatccatgccacagtatatttgcttcatgcccagattctggctgacctcttaatgggtaaattaattaggtaatatgagtcaattaatcagaatgcatagttatttttatgaactctactgccagcacatgaactcatgacatgtgtttcataaatgggaagaatggctaaaatataggtatagatttttacatgatatatggttgtaaaagtcagatgctgtgaataattcatctgttcattcacccaagaagtgttcattaaggatctactaagaaccagccgcatttctcagcactgggtgtaatagatggatcaagacaaggagggacagtaggcatgcacacacagatttatgatgaggtggggttggggaacacagatttatgatgaggtggggatggtgaacacaatttatgaggaggtggggatggagtaggatggtgcacgcggtgggggc

SEQ ID NO: 60844 - DNA, 2494 bp, Bovine  19866880528240
gcacagcagcggtgggcgcttatgtacacagccctggtgttgacggcgcaccaggcccaccgcagggcgcggtaactaaagatggtctcaacggcctcagaaaacagaggctgcagcgaggagaaaaagcctcgagaagaggaaaagaactcccacacgtggcttctctgctcccaggcctttgttttcaaagggttgggaagaagattcaccacttccggctccaaacaaactgggcaggtgtaggcctttggtaaaacctccaggtaaggcttccagggagaccgatccccagcatgcttctctgacactaaaaaggtgcacagagccagcagaggagatggaggaggctgccaccttttaaaacgaaaatccagattggaggagttactttgattcaaaatatggaataagcaagagatgcagacacctgagggcttagttctgcttccagaggggctgtggccaagtggtcagtacactccatgttcaccgaatgcatccaagagagggtcttccttcctcaagggctcctcccgggaccacccccagtacagaggccatgaacaggccacactgacacaagaactggctcgctaacctgagtccagctttgtttgcaagagattactttctgcaaaaacctctttgcttccaactctgttctccagttttaaagctgttgctagaatttcacttgttccactttagtaaggatataaaattgggggatatggggagcaattcatagaaagaacctagacgttccccattcgacagggtacccactgggcaccaggagctattccaattcttgctttctagttaaataatattgaaaattcaattccccagtcataggagccacattccaagtgctcgtcggccatatgtggctaccatacaggagaactcaacgtgaaatacttctatcactgcagagagttctactgcgcagtaataacccaggcagaaaaatgaataagctcattatatacctgttacagtttggaagtttttggtcttaaactcccccattctattgcaaattatatactgcagtatttttgtttattaccaataaaaagagctcacgtggcataggtgtacttagaaaagttttcattaatccttcaaaattcaggttcctatataaccatgcattctactcaaaactccagaaggatacagaaaatgttaataccaagagcatccttgcctctactcaggctcatgaaaatatatcagccttcttacaaaagtaagccagaggggcttaccgtgggttgaaaaacaacataatctttcttcctttatcatttagaaacctcttatgctgaggaccttcctcaatctgtcctcgaaaacccacccaaaagaaagagagacccccctataacatcagccagaaagtagttttcagctcctatgttggcctcttctcctctatgccaaatctaaccagctccttcatattgtcaacagctcttcatagctgaaggagaattcaagcaagtacagtaagggtaaaaataaaagcgtaaatagcatctgtcaagacccacaacagtggaagaggagtggagtgctgagtcaaggcactcagttatggtgtgtgtgtctatgctcccatgtaatcctcattttttggtaaggtcagctcaggattcaaatccacttcctaagaagcctattaaaaccttaaaaatgcagtttaccatgaattaagagccaacttcatagaatcaacttttcacatcacttctgacatatactagccacatgaaggaactgggtcctaagggactatgtcttagctgacatactttctgacgatacaaacttgaaaggagaaacactcacgccagatgagctggtgagcggtcacttacttagcaatgtacgcccctaagtagcttctgatcactgtgtccgtggtgagtaggcagctctcaggcaatgagataatcgtctgtccctccttaccagaaagaaagtaaagtttagaacacccgtgcttgggggaggacctgagtgaatcttctgaagtccccgattccacagtcatctactaagaacccagtggagcccaaccatagacaaccaaagagcttccaaagagcccggggacgggctccccgggccgagtcagcagacatgggcagaactgctcccacgccgggcactacaaccccaacgagagtcagaggttaatggtgtgactgacacccaccaccagtcaaccttccatcagaaaggaatgcagaaacactatgactcaagtcacagtgttccttcatgttcttacaccagcaaacagtgccacctacaggcaacagacagaaaccacaccaaaaatttcttccagtgaaatgcatgtgcctggtcattcccagtaatgacctattcgccatataacctgtaacaagtagctgaatttaaagggcaagggtggcccccccagcacaagaatcccactgatcaccgcaaaagt

SEQ ID NO: 60845 - DNA, 2044 bp, Bovine  19866880530254
tatattaatatcatgtggccattataagttctcatttttcacatggaaggaaatttgttaggaactaaattgatacacacacggttaacattttttgaagtaaagaatgcacttgtataacaatcacaatgcagcctttacataaaatgctatataattaccctctgatttaatattgaatccccccaacctgggaaattcaaattattgaagatttaccataagctgaaaattatggactcctgagcaaggtgattgatgctagaagtatcataatttggctctttggtggttgtagtaaacagttctttttctgtctggttgcttttttggcataatgtcagtttaaatcaagcatttgggcactgtggtgatggacagataagcctggatagaaagatagctctggtttgatgctcaagatgaggtctttttaaatgaagggtcacctcacttcactttcactcttaaaagtttgaaccaccctgaaaaaaagtgacatgggcagatttgtgctgggaagttttcagcatctgatgaaattgacactctaacactttgacgaaagatgtgggggtaggggtagggggcctcaaagagcaagggggaaactccccagtctcccagctatgtgtcttgcttaaaagcagatttcaccactggtgagtgatggggtcatagagccagtggacacaggcgatggcagggaacaaagatgagcaagtgcgtacatgcgtgtgtatccacatgaaattcatctaaattctccattctttccaaacacttaaaatttaaaaacacatttcactgtgctggtaaggaaagataggctgtggaagggctcagcagtttttacaaagagcaaggctgaaatcttaaaaggattcaaggtgctttcccgctggattccctctccacccccaagggagttcgtgggttaataaattaatcaaaagcaagtgtggactgccatggaaaactgtagagaactgacatctctttggatccagctgcgcataccaatgtcaaagcagcaaaagcatccaaaagttatttagggctaaaatgaaacttgggtccatgaatcctaaacaaagccaatgaagcaagtgagttgcaactctgaggcagtgtaggacaatagtgcttaaaaaaaaatttttttttttctttttaatcagaatataattgctttacaatgttgtgttggtttctgctgtacaacaatgtaaagctctaggtatacatatatcccctccctcttgggctccctcccacccttccatccaaccaccctcccatccaagccctctaggtcttcacagagccccgagctgaggtccctgtgttatacagcaaattcccactaactgttttacacatggcgatgtatatgcatcagtgctactctctcaattcatcccatctctccttaggaggacagttcttaagcaccaatgtgggcaaatgttgctcaccatgagagataataatcaaggcagttgctagcatttttgtctttgagatgctctctccctcctgctagttaatccacacacgtaaatgttactcttacccttatccacttcacaccgccccccccacacacacacttttcagccctctggagacccagtgacaagccacaggacatctattagcatgaattaaaataaaaagcatcacttggaatctctcctctggttgggaccaatccagcttccttgggaacccagattctgccaagtttctctctctcctggaattcagacatttaatcaatgatactggctttgccaaggttgtaaaaataaaacatctctcaaagtactaagcctttattttggtctgtagtcacatgcttcagttggtgatcaaaatatagagaaccagattctaatcgagtagaaaataagtgcatgcgggttcacgatggcaagcactaatgccatctgatgtgaaaaataggcaccgtgagaaagatgttgtacgtcccgaagccagccacccatctgtcttggaaggagccttcttagacataagt

SEQ ID NO: 60846 - DNA, 1281 bp, Bovine  19866880540401
aggcaaaaatctcaatttttctctctttgtccctcttccctgtatgtaatcattattttatgaactgaatgacaattggatatattgtttccatcctgtaagatgactctaagaagatactacttaggaagaacctactgtgtgtcctaaaggaaggccagcatcttctctctgtggtccttccttctaggctgaccctaaatataaacatctcaaggacttggcactgaaccccacgtttacctggctgaactccatggttaaatgatgctgttttccatctaatatatttgccctgcaggcacaggaaaagggttggttccaccattttcagaagccaggcaaccgataaatttaacaggattttgttgacattaattgagtttgcattggtgtgacattctcactcctagcttatttgtcttctggatcatttgaatcacccaggttctgggccagctagtcattcaaccatgtgattccaggcttaacaatatctccgagtcactggtgactcaatcacactttcgtttattgctcaataaaataataataacaatttgttcaaacatttaaccaggctgcatttctccagggacaaaataaagctttccaaagaaataagtcaaatgcattcggtgttaacaaaagactctttccagaggtgtggctaccaacacctgagcaaattctaagaactggttttagaattgaagacagaattgagaagcgtagggacaactattgtttctatctttcaaatacatgaatacaaattgttatatcttatatatttgtaatatatatgtaatatatatgtaaatgtaatatataaatttgtaatatttaagttcttataaaactgtactttgcaaatttgtccactgataataatcaatatcagttataatagtcttgctctgttgccaagtggcaagactatgttaataattaagttttggtttttactacaagtgagcataggtgctcacttctgtacccctgtgctcaagaagtttttatgttggctgtgtgtgagttaaggcatatataaagctgagtgataatttgcaaatgggcctttatatccacaaattggttactagaccaattgctatctgggataaagggccatttaaaaaaaaatgtcaagtctcttcagaactggtgcttttatatcaatttgctgtttgttgttcagtcactaagttatgtccgactctctgtgaccccatagactgcagcacgccaggcttccctgttcttcactatctcccggag

SEQ ID NO: 60847 - DNA, 2859 bp, Bovine  19866880591165
agaaggaaagctggaaactgtgagatctgttaggaggctagttggggtcatcccagagaggtgggtgggttctggatattttcagaaaggagacccaagcagattgcagggagttgaagagaagagtcaaagatgatgccaaaattttgggcctgattaaattcaaaaagtatcattcattaaactcacatcatggaaaattatagctatgagaatcagctgtagcacttttctcaaatgatggagacaaatctcattgtgagattcaatttccaaagaattggcagttgactatgagccactggacacctccaacagaacacagcttataaaattccacactcgttttttgtcttcccgtgttgattatttcacgagctttttttggaggttctcgtttacactggtcaaatcgtgcagaatgactgtggaaggcttttgaaggagccagactgcaagtttggtgccagatttcaaatcaagtgtgtttgtgcaaacgtgtcctattaaaataacattttgtagcttacttccacagacatgtagctgttgctctgcatgcgggcaattaactactgatgtatggatgttttgttacagctggtgctaaaaaagagacacattcagtgaattatttttcaagatttgagtactttatagtgctgattgctgtgaaaaaaaagggggcaggggaggacgaaaatgagaatgctgccatgtacagttagtagtcccagagcgaggctttttaatctagtccagataaccaaagcttgtcttaagatgtagaatttatagcaagaagagattatgtaaatcatagatctcagccaccagctttaaacagtgaggagaaggaggcccattatgttaactggctgagccaagagcatgcagagtagaacctagctggatgaacggctggctggtgttcttttcagcatccagtctatttcccttctttctgtactatgaaagtggagatacagtgggcttgcatttcaggagtcaatggaatgtccagaaagcctgggttcttggggctttgagacccaccagaaagaagagccctggtcaattttgtaatctaataaatgggtattgtttaaagcagctcagcttgtgggactttgttgcagagcaatagaaaactagtacagtgctcctcaaggcaagagatacgacatctaaaatgtcagaccttcccagagtcaacacagggcttctaggtattgaaataataaacttatcttgaatgagtcaggtgaaaacatcacatcgtttgatttttgccccaaagcatgggcaaatttagccttctctgatgtcacaccttatcaccaagcctcagtccagacagacaggaggtaccagtgacgggaccagagcttttgagcatcatcttttgtcaagggctgtgctaaaccagatggagcacttgaggcgatgaggtctttataagccaccctggtcagctgctcgtcagtactagaactttaatcaagtttctcatctaatgagcgttctgctggtctatgttttcttccttatgacttcttaggtctatgaagttcagcagttaggggactgtgagtgtgtgtctgagggtgtgtgtgtgtgtgtgtgtgtgtgcgtgtgtgtgtacattttctttaggcagacacatttccccccttactccttcggctatcgcattgtgtttttcaaagtttacacagcaaaaagaactatagcttaagccattattatactgctgctctatttctatatatcattattcattttttttctttcttacaagtacagtacatgaaagcatcagtatgaactttctctaattccctctcatcactgtaatcctttaaaaatttcctcttatttcttgctgttccttacctgttctgtttactttattaaaatgttctttgaatgttttttgatggtgagaaggaaaaggaaccagttaaagagtggtgaagccaccttgttcttatggaaaatgaagcaaatgaaggcagtacatttagaaatttttcagtctcttgggttgaaattgcctgggtattacctatactgcttactctacccttcagcaaaataagtacctgcctttccctcaggcatgccccttagaacataatctccctattcttcaatttctccactggtaaaaagaggcaacaattgtgcccacatcatagtagtatcaggattacatatagttgtcatggaggacagaataaagcccatcaaatttttgaccctttggtctaaatattattttgagttaaaggcaactgagaatcaatgatggagaaagagttctctgtctaaaagcagagcataaatttcccgttgggaaaggtatctccccaccaactctactaggaagaaaagagcaactcttatcattgaagacagggcatcaacactaagatgagtttgcataaacagactgtccttaaatagcccttatcttccattggttccctcatatatttcctagttacttcccctaaatttatcatttttgaagcccggaccctgttttcttgtttgaaagggtaccaggtctaaccacgtacttgagtttcacttctattctataaattctcatacacataaatattaataaaaactgcgctctttctcctgttaatccaacttttctttgtttaattcacatacccctaaagaattattctaaaagggtggggaaaaagtttttatttccacttgattaaaaaatatcttacactccaaagaaaacatatagatggctaacaaacacatgaaaagatgctcgacatcactcattatcagagaaatgcaaatcaaaaccactatgaggtaccattt

SEQ ID NO: 60848 - DNA, 2352 bp, Bovine  19866880688027
taatagtagtagtagtagtagtcagttcagtcgctcagtcgtgtctgactctttgtgaccccgtgaatcgcaacgcgccaggcctccctgtccatcaccaactcccggagttcactcaaactcagtagtagtagccgtggtagtactagtgatggtagtactgggagcttcccaggtggcacagcggtaaagaatccacctgccaatgtaggagatgcaagagaatgcaggttctatccctggatcaagaagattgcccggagtaggaaatggtcacccaatccagtatccttacttggaaaatccctggatagaggagactggcgagctacagtccatggggtcaaaaagagtaggacacaactaagccgctgagcagggtccccctcaataactgggcagaagcagcagtatccagtgatgacgagaggcatgggcacttcctctgactcacttgaactctggcctgaaataggcaaagccctaacatactgacacagccgtgacctgggcacgacgttgtttctgatgagtctgtttctgagtgcttagactagactcagccagaccagatttcactctgatatcccaccacactttgttgagtcacaaaactttcacaaaattaagtcaggcaaaccaaggcttagctgactacagtcacaagcatttaggaagagtggtggtaaaaaaaataataataataaataacagagatgcttctcaaggttgacaagcactctctttgctgttcaattatgccctgtttattctgcatgctttatttcatccatcagtctctttcgatatcccttttgaattatatatagtaaggctatttcttatcaaacaccaggctctagacattcataactttcatgggcccagaatataaaacttaatgttgcctttaaaatatctctcaaagatcttgactttgccaaattttattgtgtcagagttcatacaatatagtaatgccactaaccaaagacatctttaatgtagcatcatactttcaatgtctctttagaacatgagtcaacataattttttcctaacgcgttgatatctcaatgtctttatcctctgctgatatcaaaactccaggaaaaatacagtgtttaagaaacactacaatgttccctgaaaatatatagcacaaaaattttacagaccaaatacagaaataatcattttctcctcctctttctgtgtctttcttcctatcttctaccctttcttcttccgctgctgctgctaagtcacttcagtcgtgtccaactctgtgcgaccccatagatggcagcccatcaggctcctccgtccatgggattttccaggcaagagtacttggagtggggtgccattgccttctccgtttcttctaagagctttcaagtaaaaattcgaaaaggaggaaacttcccaaataaaactaaacaggcaaagtcattgacatagtatttaattctgtacatgatcataaaataatgctttgtgttaaaaacattttaaaaaaatatgaaaagttgttaagagtgaaattaaaaccactcagaattccattagccagaaatgatcatttttctgtaataaatatagctaaattggaattaaatagtataaacaatgtattctagtttttttttccctttaagatagtgggaagtgtattatagcggacttagtgtactttgcaaacatgacttttcatagctgtggtaagtgtctcgtctgtggatggtaataatattggcgtaactatcctcttgttgctggaaacataagtcttaataatgtattgctattataaataacattgtgacgaacatcttaaggtaccacttggttgttgataatccttcacaacagcatgagccatgggcctcttctcagctactatgtggatatggattgctgattttctgacttggaccgctgagaaaatgttcctggctggctaagacacttttccaaggaaaatattacaaagcttattttcagttatccttgataatggagggaaaaaagagatgaaaaccccaatttcatgtactttctgctggtcctgaagatgtgtgagaacagatccaagaattcctagacaccgtgggtggccttgaggggctatttttaaaactaattcggttcactttcttttgtgccagtcataagtttggccgatgaacccttttgccccttctctccgaatttgagagattagtcagtgttacagcctacatgaagagagattatttttcctcagacaagtcacaaacacaggaaggaggaccatatacgagatggaaatgcaattaattttgtctacgccctgaaagtagctcatga

SEQ ID NO: 60849 - DNA, 947 bp, Bovine  19866880719132
aatgcagttacagatcattaccgatgacacaggcctggagtcaggagactctggctgagagatccagcccagccagtcttcagaggtccccttgagcaagtcatctaggctctaggtgcctcagtttccccttctataaataaccctgttcacctaggctgaatgttaaggtccctgtcaacctaaaacttattttacttctagaagagtaaagctcatactctgagtagcaagaatgaggaatattgtcagttgattaagataagaaacatcattactacttctgggctatttgccaattaacattagaaacatcataattaacacatcatacaaattctccttccattaagaagttttttccaatagatctccttcaccctctctctcagctgattttttttttaagtttcaaataccatacaatttgatccaaaacacaatcattcaatttacccacctcagccagaaaaaagtgcttgtgaaagctatgtcaaagatcataaatttccttaaacagatctaagcaactggagtgtagcaaaactttaagttcttattaaatctgattatagagcaaactgatttagaatagtaattcagccaaagtcttttagattctctgaagaacacctttccaaaattatgacagcacacagtaaaattaaaaaaaaaaaaattttttttttttttttttggcttgagagaaaagtgctccgtgtatatctgtgggagtcttacatgtaactatagtaaaaattgttatttatgtgcttttttttgtagtttattcaattatcggttttccaatataggttgggtcttgtgtaaggacccagcacacatgctaaccgaggctgggggacagtcagagacatccccaggaattaccaggagccatgaaagtgacagaagactccaggattgttcgagaaaacaggaaggaa

SEQ ID NO: 60850 - DNA, 1905 bp, Bovine  19866880773347
actcagttttcctattctttaaaactggaaatacaaacactgcctgcaaaagtttactgggatgatgaaatgaagaaagagccaaaagggagaacagaaaaaatcataggagaatatgaaaggggggaaaaaggttaattgtgccagggatctgggatgagagtctgttaaacccaagcctgacttttcaatgtgaggtttttgaaagctttgcataagaagcagtgatggctttgaggggacaagcatgaccctcagattcgtaagtagaaatctgtgagtacagcagcctctatggcttttaattcaccatgggaagaggaaggttaaggctcagaattcctgagaattccttaaaaatctctcgttcatgactaagaaatatttatgttctttgtagaatatacagttgcttttctgggcttcccttgagggaaaaagcagaccccatctattacttttatttattttctgaaaaacaaagcaaaacaaaaaaatctgagccaatacttacagcaaatatttctggacttgaacaaaatgttattacaattctctgagtaatctaggctgggctgggccaactctctgggcctttctagctcatctgaacaggaaacagattaacttaaagaattccatggacctgtgtggagcatctggttcacgccttgccctgtgctgggcacccgtccatggatagccaaggcctccccatcacaagtggggatggaggggtgagtgtggggacaggagtcacttaacctgatacacatgggtggtgttgcatcaggtggtccacatgccgtgaagaaataatgccaggcagcagaagagagcatgaagggggcagccaggaagcaggaccgggcatatcatagaaggcttctctgaggaggtggcatttgggctcatatttgtgtgttacggaacctggcgcgaagcatgttacagctggctcttttggaagctgccttcacagaatgctagggaaggaagtcaaggcagcaaggaatttggattttgttagcaaatgtgaagctgtaagaagatgcctttactgggatcttgtcttcaacttacatacactttctatatcctccacattgtgtgtgtgtgtgtgtgtgctgtattcttttatgaataatcattcagatacggccacaagatgagatcaaggagaggctcaggaaaaaaacaaaacaaagtttattatattatggcaacttgaggcaggaccttatgggaaagaccccagaggggaggcagaagttgggggtggaggggccgccctgaggccttggtctttactgaggtttccccaggaaaggcaaggcttccctgggggctcagatggtaaagaatctgcctacaatgcaggagacgcgggttagatcctgtggagcagggaatggcaacctactccgttattcttgcctggaagattccatgaacagaggggcctggtgggctacagtccatggggttgcaaagagtcagacatgagtgagcaagcgactaacacacacacacacagggaaggcaaagcagggaggatgcacagcttaggatagtctagtcggaatgattcccatgggctttgggctctggagttggtcctagtgctgaagggaaagtggtatctacccctggggtgtaagggccagggagaggagttgtggttttggactggttagttcatctgtcaaagacagactcctgactaggcccttggctatccctaaggaaggcaaccagaaagctttgttttagaatgtcaagacatcattatgtaactgggaaggggtcatttttttttttttccaatttctttttttttttttggttaattttaaatttacactggatctgcttctgtacttaaactttttttgtatgtaacgt

SEQ ID NO: 60851 - DNA, 690 bp, Bovine  19866880787585
gtgactacacatacacacaaactactgattcagaaagtggcatgtgaagatgccttggggttaagtgttacctatgtaagggagaaggttctggaaagaggatttagaacaaagagaacagctctgtgagctcaggttatttgttaaagagctccttatccagacccatcccggggaacaccccctcatcatcccctaatctgcctatctgctggattcattccattgctttgcagacttatttgtgatcagcccagtggaggctttgcaaatatggtcattaagtgactattgagggcctatcctttaggctttaagatctaggactcctgtcttaattgggaagtgcttatttggaaaatccactccttcaggatgtgatcagagacccgatttagccctaatgatacttaatggcagtggcaggaatttagtggggatgataatttcgtgtaattggggagccttcagacgagttaaatgctcccgagtggccttgcactggggcctgtgtctgagtcaaacatgtgcttcctgtatgcatttctccttctgcagctctgatgaaaaggagagattctgcagagcttgcagagttctggctgatctgcactcagcatctgtttgtgtggtcctccctttagagggtgtcaacaagaaattaagaaagatctaagaaagaattggaga

SEQ ID NO: 60852 - DNA, 1051 bp, Bovine  19866880825327
ctgaatcaatacatcttcagtgaaacattacaaatgccacgaagcaaaataaagcaggggacagagacatgatgttagcaggcagtggttgaacatgggtggagggtggtggggaagatgcttcagaaagaggaatgggctctgtgaggaggtgagctttgagccaagccctgattgatcggatagagaagccatgcaaagatctggtgagtgctgtcattgcttttataataaaattaattatggagaatttttgtcaccactgccaacagaagatcttttaccctgtcttcagtgcgctacaatacaagagtaaaactggaagtgtgatggaaaaggaaagagtttctgaaaactggagggagtctgtgtgcttagtcgctcagtcatgtctgactctttgcgaccccctggactgtagccccccaggctcctctgtccatggggattctccaggcaagaatactagagtgggttaccatgccctcctctgggaatcttcccaactcagggatcaaacccaggtctcccacactgtgggcagattctttaccctctgagccaccagggaagctggagacagtttggttcctgcaaactctgaaggtgtcatgaatgaaaagagaccatttccaactctttgttgataattcacaaagtctcccaaagacaaaaccacagttggccacagttatgttggtttcacttaattctctgactctgactccttgtgtgactaaaagcatatcataatcacagtaaattctgcctcactttgctccattaaagggaacccaagccatttcacatatcatcctcccattcaatcttgattttacaatgcttttcactgaagattagagttaatgcttttctaagaggtttgtcacgaagggagtttaactgtggctcattttctccatctatacattttgttcaaaagctttatttttagagagtgtgtttagtcatatatatgactttggagcaataagccataagggaaaaccttccttgacttcctgggcatataaccattttgttcctcata

SEQ ID NO: 60853 - DNA, 1059 bp, Bovine  19866880843872
cacatgtggatccatgtgggttggaaaatttaattacatctttgtgctgatgttgtatgtcataaaaaattgttaacagttaaaaatatgacaagcttaattgtttttcctctccccacttctagagcacctaagctttagcctaaaaaattaggctgtttgacatttttggtgctcaagctgttgggaaatacttttatttccaaacagaatcaaagaaaactttttattttaaaataggaaacatttatgagttattagtgtcatgtactgttgggagatcccagaatatattaggcagatgagtatttaaagtggtataaataagatttctcttgtcatcacttacgttgattaaggtttggagtttctctgtggatttctgacaaaccatcaacaaccatgaacgatgattttccttcgctggttttgctaataagttgtcaactgattaacactgagagctggtcagacttgggcagtgtgtggtttgtgatcacacagtatgggaccgggaaggggttttgattttgtcattagagtgcctttgcattagatagtaaaataagacagaacacagcttcactatcaatctcttgagcccttgagtcagatgtgtcttgaaacttggaaagtttcagaatttggaccgtaatataacaggcatgtcacatatcatatgagagccctagcgaggtttgtagcataattccataatctaaactgttaataatatgtctttaatcaaatatactcatattctcatcaatgggagaaggactatttgtagagacccatcacttaaggacaggttttgcaccaaatgagttagcacaaaatttcagtttccaggaatttttggaccttgaaattgtcatgagggattgtggatgagctaattaaagtccaaaatgttcatgtcgccaacagaaactctaaaagagcatcagatcaaataaccacagcatctttgataaaatgccacacaattttgtcctggggaaggactgtattcttagatgccactgaccttccctggtggttcaaatggtaaagcgt

SEQ ID NO: 60854 - DNA, 1019 bp, Bovine  19866880844565
ttgaaagtcccatttctttccattgtttaaacttaacttctcaaggtctttagtgtcaatgactcagacagcaaagaatcttcctgcaatgcaggagacctgggttcagtccctgagtcaggaagatcccctgaagagggaaatagcaacccactctagtattcttgcctggagaattccatggacagaggggcctggcgggctacagtccatggggtcacaaagagttggacacgactgagtgactaacattttggagagaaaaactgcaaggtctatagtgtatgaactggtccagatactgattaaaaattatgggaaaatcccagctcagaataccagacatttaacattctgttaacacacatatatgtttattttgcaaacttatcgtctaaaatgatacccaacccatagtacatgctcagaaaatatttgaatgaatgagtcttgtgcattcacctgggaccttttgtgtctctggcagctagcaacccgtgtactgccttttctttagcatcctaccttgccctgtagttcagccaggagaaaaagagaccagatcctgcagatgtgatggaactccaatggtgacagaatgaccccctgaccctttaaactgaaaatatgccctcatcaaatatgtcagtatccttcttcaagttgggtggccatacctttctcaatgtaatttactattgtctgattatttaatctacaaacagatatattgctgatgtattttaaccagcatgtttgtcttatttatgaattagttttcctctttcacagttttgatgttctcttgccaagaataactagaactaatttcaaataatgaatatcttttgtagttaataaaaggcttcccagatcaataaggttaataagtgatacagtcacttgggcatgttaataagttaaaaaaaaaaaaaagaaagaaaaagaggctgagccaactgaaaagctggaactgaaaatagattatagcattttgccctgaggctttggcagcaatt

SEQ ID NO: 60855 - DNA, 1462 bp, Bovine  19866880891776
agtactgtgtgatagtaaaacaaaggtaaaattctccgaacactgttctttacatctggttatatttactaagcaattatttttaaacataacaataattttagtaaatgttaaataacattgtatattttgtactaattttgcattatgtttttgagtgaatttttatgtttttcttttccctgttcagtcatttgcttccagtagaaattttctaccaggctcctctgtccatgggattctccaggcaagaatactggagtgggttgccatttccttcccagggggatcttcccaacccagggaatgaacctgggtctcctgcattgcaggcagacactttaacctctgagctaccagggaagcccaatctactaagtgggacacagcaattatacattttgtttagttaaatgacaggtaatattttaaatatatatacacatgcacacatatgtatatatacacatacacatacacacataattagggcttcctttgtggctcagctggtaaagaatccacctgcaatgtgggagatctgggtctgatccctgagttgggaagatcccctggagaagggaaaagccactgcagtattctggcctggagaattacatggactgtagagtccatggggtcacaaagagtcggatatgactgagcaactttcacttccatatgcataatttagctactgctgctgctaagtcacttcagtcgtgtctaactctgcgagatcccatagacggcagcccaccaggctcccccgtccctgggattctccaggcaagaacactaaagtgggttgccatttccttctccaatgcatgaaagtgaaaagtgaaagtgaagtcgctcagtcgtgtccgactcttatcgaccccatggactatagcctaccaggctcctccgtccatgggattttccaggcaagaggactggagtggggtgccattgccttctctgttagttcccagagcaggaatcaaaactgtgtcccctacattgcaaggcagtttcttaaccactggaccaccagggaagttcctaatagtaacttttttttaaaaaaatttgatctgccctcaagtaatatgttctgattgtgaggtttgaagaggcagtgggtttgtttactagtttccaatctgtcttcatccacctggtttttcaggagcttaaggagcttaatagcaacctgcctgtattatttttttctgacacaaagagcttatattccaaatataaccatcataataaaaaatcagggaattgggtcccatcatcttaacactatttttaatgttctcttcaaaattagggtaaaagatccataacattgcaaacttttttttaaagaaatgccccaatggaagaagtgtttcagaccatgcttgccaatttttttaaagaagggaaaattttaaatataacatgtgcaagtcactataccaattta

SEQ ID NO: 60856 - DNA, 1984 bp, Bovine  19866880895012
tatttttgcccacataagctagtttgtattttaaactgatctggatccaatacataaaaatctgatgacctgccaacagagatgatgttgcggttgcttgtggagcagctggtgagtcaggataactctttccaaacaacatacattttcccaagacttgaggaccccagcctgcttctctcaaacataaaacctgtgcaacacccaaggagatttgaatggtccaccttcaatcgataaactttttgaaagtcaggaaaattttgataagaaatcaatcaatttttagtcatggtgtgttcagttttccaacacgcttttgtgaatcctcttcatgtctttattccaatcacatccctatccacatccagtgactatacctctttacttttcctagtgatgaaacagggttggttcatttgcgtacctggcatctgaaagatacctgggatctgatgagcatccatccggggcattaaatattaacctctcacttatgagtcacgggccataggcttgtgaaccaaaccaactgttgatccataaacggtgtcctcatcctgaagattctgcagtgagggcaagcacaagaaaccagcaggataatcaccttccgttatttacaagtctgtaacataaaacacataatgttttatgtcttggtcaacatgtctaatatgtataatcagtagaggttccatttttatgagctcaagacacttcaactcataggctttttattcatatctagaatataggtattatatatttccagatataacgttatccggcctcttcagctgttagtactaatgatttcaaaaatactcaggcaatagggtggaacagattcctctagaatgaaacaaacaaaaaaaattaataaaagcaatcataagaccaaaatgatacattatcagagcttcatctgatgagcttatataaaaaataagccatctattaatgagcataataatactcattatttatgcattcaatcattcccatctccaactcattgttctactttttccttcaatattttttctatatgatgccctttgacccctcagtaggtttcattgggaaggcatgcttttagaaaaaacaaggtcaataaaggtatcattttcaactgtgctatccttttcacagatccaagttgaaatgaaatcaattatgagaacaaatagcactgttttattactaatgaatgaatttagcattgtttcccatattcccaccacttaaaatggaagaaatatagtaaatgtggtccagagaaagctcacatagtccaggctaatggtggaaatacttaagcatcatccgtatacagctaatataaaccaaagtggcttattaccactgttttgtgatttatgactcacattatgattttattttgaaatggtggcatgaaatattaatgtgtggtaaaagaacacacaacaaggagcagggatcatgttctatcagatgtaaggctgttcggtgatttattccttgtaataccctgaactcaagtcttagtatcctctttgctctcttattgtaatcagtccctcacattcaaacttttcaaggtgaggtagccccacttttgttcttagattagaggttgcgtactgttaatttttaaaaggatggagtagtttataacaaacatgaataatttatagcaaatgttctcagcattgattagtgttcttttgaaatagactatcttcttgatatgcatcactcttttaatgccttatgaaaagtcagaagacctgttactgcatggcttaatggacaaatcaactttaattttagtcatatataatatgaaagataagtacctatgtttttccctgtttgggatttgccaggcattaacactgaattagctcaaagcagtccacagaggagttaacaataggacacaattgctctcccttggaatttgcattggatctggcctctacaagtttgggggctg

SEQ ID NO: 60857 - DNA, 1022 bp, Bovine  19866880931002
ccaattaaaataaattttcaaaaaagagtatggtttgcatagtagagaagggacaaaggagaagagttgataatgaaagactggattgctggtggagccattacagtcagatgaagcaaaagaggtaaaggaactcagattttagggagcataattggtgtctgtaggcccggaacatagttatctggatgggaaaaggggagaagatgttactggaaagacaccatgctatggaaactggacttaggatttctcaacaggttaattgaaagctgttaataaccttttaatttaatttttttactggactatagttgatttacagtgtttttctagttcctgctgtacagcaaagcaagtcagttgtatgtatatgtatatctggttttttagtttctattcccatataggtcattagagagcattgaaaaaagttccttgtgctataaagtaggttcttattcattttccactttttatatagcagtgttaataactttcaagtaggaagatagcactgtcaaatgtaagcactagaaaactgactcaggagatgacacattgaaggaagacagtggtgtccaaaagaccctgtgaaccgtctgaagaaaaagagtaaagagccaaaggtgtctttctggcttaggtgagaggtgtgcgggtgatatccttcactggggaaaggtcaagttaggggcagaaagcaaagttctggagctcgtgagcgatattgagagtctgggaaaatgaatgcatgagtcatgtgcatggaagtgatagttaaagctctgggaacaaacgcgccttcctaggcgggtgtctagacttgagatgtgaagagctttgagtacaaaaccccggggagcactaacgtgaaagagtggagccaagaaagatgagtcagggaagtgaaacgaaggacaggagtcagaggctcctttggagaatctggaagcaccatatgaggcagacacaggcttggggggtgggggagaggatctcagtaaggatttccaaagcag

SEQ ID NO: 60858 - DNA, 4327 bp, Bovine  19866880944056
atggggcacgtatgcctagagcctatgcttttcagcaaaagaagccaccacaatgagaagcccatccatcccaactagagaaaagcctgtgcaccagtgaagacccagtacagtcaaaaataaatgaattttaaaaattaaaaaaaaaatgagagggagagatcataactaattggatttctcaagttctacttgcctttttacctgcattcaccacccatagcctttctctatgtactgggaggagaagaaatctaagaaatattctataagactataattgctcatctaaaaacattgaagtcaaatgtgtttaaaaagacagaatttgtttcagtttttatcaaggtaataggatgcatataccatatgatacatgcatccagttgcatcagagccatgggccttaactaaacacgttatttctgcagtgagctatgtgaatattctcacgaaatggaataaacaaagagtgcaggacaagatggcagagtagaaggatgagctcacctcctcttgtgaaaacactaaaatcacaactaactgctaaacaaccatcaacagaaaacgctggcacctaccaaaacagatattctgcatccaaagacaaagaagacacagtgagagagcaggaggggtgctttcatgatataagcaaatcccatacctgctgggtgggctacccacaaacaggaaaatatattgcagtactcccacaggagaattctgagtcccacaccaggcttcccagcctggggatctgtaataggaaggaggagctactggagcatttggctctgaaggccagcagggtttgagtgtaggagttccacagggctaggagaaacagactccagttttagagggtgcacacaaagtttcatgagcactgggacctaggccaaagcaatgacaccatagaaacctgagctagacctacctgcaggtcttggagggtatcctggctctctgtagggatatgaacactggtggtagaagctccagggaatattcaacaatgtaagctcccactccagtgttcttgcctggagaatcccagggatgggggagcctggtgggctgctgtctatggggttgcacagagttggccacgactgaagcgacttagcagcagtagcagatgtttatctatttcaactcaacagattctagatgagcgttctctaattattgaccaaaattgtttataattttctatctttaagtttggacatgtatatttctacttctgttcttcattcctaatctctttaattcatgctttctctcttttctgtaaccagacttacagaagcatctctatatttattacccgtttcaaagaaaatgcttttctcttgatgttcctttgtttcaatgtctggactgaggtgcactccaggattggaactgagtttggggagggacttggaccattagactgtggagagagggaattctttcaagaccaaactaaagaagatcactttcagaaacacagtacatattaaaagcaatgccgtagaaagaaagacaacaacaaaacttccaacactaatatagattgaattattgtgtgctgaggactaggttaggtgctttacgcacattgactcatttaatgtttaaaattaacctatgatatttctattattaaccttattttcagatgagtaaacaggctctgtgtcaataaataatttgctcaaaatcattgagcttatcagtggtatatgacttcaaaatctgtatttttttcctgttattccattaaccatgaacagaggggaaactgggtgtattgctgggaatcttgaaagtttggaccattaagacatgaaaggccaatgggacggacaaaatttagcttttcacctacttgattgggcattctgggccaaaccaataaggcagacccagttccattctaaatgacttgatctttatgttattctgggaactctagggagaggaaacataacctggtggaaagatccacacggaaacaaattatttttttcaataccagggagaagtattcctttagaaatgaatctttagtatgaaaaatgtgggtaaatggaattaaagaaatgcaatattaatgtttgccataaaaaatgagctaccatgagtaaccaaaaagctttcattgtctccgctttctgcagcaaaaatacaaagaacactacaccaaaatgagtgtgagaccaccaatcacacttttgttcaaagtgttgttctcagtctgtttaaaaagccatgacaaccataaaaataattacgcatggcacatgtactattactacctcttaacggaggagtattgacgtgtgtagtcctggaggcgcacgtcaagtcattaacgggtttgccgtgtttgagcgcgccttcagccaacactgagagatgcacccagtagttaagtctccaattaaaaacaaaacaagcccttttatttctttttaagcctcctttccttctccctttcttggtatttagtcttgtgctgtccgctaacacttcctgggaggatggaaatgttttctctttttggctgtgctgagccttcatggtggtacacaggcctctctgtttgtggtgcgggttctgtagttgcggcaggtgggatctttattccttgaccaggaatcgaactcacgtcccctgcattggcaggtggattcttaaccactagctccatcacagagaagttcctgaaaatgttttacgtctaggcccaagtccagagctcggcatagacttgagcactggacatgtgtgcttagcatgaccgaggagctgaattttaaattttatttcattttaattagctgaaagttaaataactacatgtgtctagggatactcaactggacagtacacgtttagtctctcaatccatcccaaggtgttcatttctgatggaaagacatcatttgtgatttatagtggcttgaatcatctatttgatctccctgactctcacatttcccacatcaaaatgatcagtggctgaaagaggctggcagtgtcaccttttaaacaaacttcattttgttgtttgggagctgctgccctagtcatggtttattctgggtgagggttctgtggttgagtgtggatgagttgtggctttctactgtactgctggtgttcacacactagatgctgagggaaatcagatgtaacctaggaggcagggtgtttgcttatctttcagcttgtttgaagaccaaaccacagccatgctgggataaagtagctgggtgaaacagaaccagcaaactccagggaggttccatctccgctcaccacaaaacctcaatgttgactcgccgttctcttctctctgggcctaatgacagactttcctgggtttcagttgctgtgaagaggtcgcctgaagtggagagtagtctttttactgcagggaattatttctgtagttgccctagcgctttaaataaaccgagagcaacacgttctacaagagcttccgatggcttggcaattcctcgtaggttgcctgtcctggttcccagtggcatggtttccagtcttcctctggacccctgatggatccagagccaggtgtctttcgagatacggctacatgcaccggctcaaatgacagaaactccaggtctggtgcagaaaaaggcccatctaatggagatggcccagaagatgtcctttccatcgtttctgttcacgtttcctaaaagaaacttcattggtccctccatccctgccccccaggaccctgctgagaagcagacgtggtttctgctccctgggacattttgccttgtgcatcttgtccaaatccatggctggcaccatccacaggctcggcagagccagtccatgtacagatgttgttggcaagagccttttcttctccaatcttctgaagagtgaggaaaagcatctttctcccctctttgaccgtcttgatgtttacctgcccgtggttgaagggtgaagggtgcttgtctattgagcagtgagtcttcctccctagggggtcaagtccagggtgacatgtgccgtcccttcctgttcttgttgccatgggtatccatcccactgtcaacttgacccaggaagacggactgcctttcctgttgttgttgtgttgctaagttgtgtctaaatctttgtgacccgatggactgtaacccgccaggctcctctgttcatggggtttcccaggcaggagtactagagtgggctgtcatttcaaactccaggaggtcttcctgacccagggattgaacccacgtcttctgcattggcaggtggatcctttaccactgagcca

SEQ ID NO: 60859 - DNA, 1039 bp, Bovine  19866880945056
tcaatttgttattcataatcctgaagtcataaatcactttgatggtaattcctaacgcagattggacctttctgcttggcagaaaggatccctttaaatgaagtgtgtgggggaggttagtgaactggagccaaggttaaaggaacctggaatcaaattctacttctgccatttttctgtggtgtggcaaacctgagtttccttgactcaaaaatggggctggtactgctacctaattcaagagatggttgtatttttaaaaaataaacaaaatcacttactgcagtgcctggcatattctaagtacttcagtaaattgtacctagtctgtctacaaatttctacttgttttcaaatgctataaatcaaaggcaaacattttccctgtagggatagatggtaaacatttcaggttctgtgggccctgtggcctctgtcacaaccagtcagcttgaccactgcagcatgatataaccacagtcagcaggaaaccaatgtgtgaaactgtgttccaataaaactttatttataaacactgaaatttaaatttcatataatttttgtatgctatgaaatcttcttcttctggctcccccccaccccatccactgaaacatataaaaactagtcttagttcaggggccatacaaaacacttgtatggatttggaactcatggtttgccagtccctgctataaaccataaggatatgttagaaaaattgtagccagtagttcttttgtgaataacacattttcttgtcaaataagactaaagattaaaaataggcagtttgaaaggaaggttttaaaaacactgcctcgaatgtatggcaagaagaattgtgggattgttggaggtctagaatttctgaggctcccttcttaacccatggaatagtggactgaggcccatcaggctatgtgatgtcctccaggtcacactacaagcttgaggactgttccagagtcctggcttggtgtcctttccacggcaccgagtatcatgatgttataatgtgtacttcattgtgagctag

SEQ ID NO: 60860 - DNA, 1098 bp, Bovine  19866881020920
atttgaaatcgctcaactggaattccatcacctccactagctttgttcgtagtgatgctttctaaggcccacttgacttcacattccaggatgtctggctctaggtgagtgatcacacgatcgtgattatcttggtcgtgaaaatcttttttgtacaattcttctgtgtattctttccacctcttcttaatatcttttgcttctgttaggtccataccatttctgtcctctattgagaccatatttgcatgaaatcttccctttagatgtagcttacttttgaaaaacattagaaataacacgttgtcacttataataataaaacacataaaaccctatgagcaaccccctcccaaaatacattcccttccttccctaatgtcctctttcaaaaggtcaggcctgtcccaattgggtatcatccttctcgtgcttgcccttctatggactgatttgtgttgtattttaggcagagtggtgaatgtatccagctttgtcagtgtcaactctctaaagaaatgcagccgtgaactgcagcagaagtttcgaagtgagaccatcacagaggaggagctggtggggctcatgaacaagtttgtggaagacacaaagaacggggtgcacaggaaggagggctggcccgataccgcatatggagtgacgaaaattggagtcacagtcctgtccagaatccacgccaggaaactgagtgagcagagaggaggggacaagatcctcctgaacgcctgctgcccagggtgggtgagaaccgacatggggggacccaaagcctccaaaagcccagaagaaggagcagagacccccgtgtacttggcccttctgccctcagatgctgaggggcctcacggagagttcatttctgagaaaagagttgtgcaatggtgagctcattcacagctacaccatggatccatttatattgctgtcccagattcaccaaacagacactgacaaaattatcgctgtgcagaaaaaaagaaaaaggaatcaaaatatccagatcaagttctcactgggagagggctgctaatcttgtaaagagttttctgacttcttctgtgatcccaggggaagaaa

SEQ ID NO: 60861 - DNA, 728 bp, Bovine  19866881021063
ccaactacttaatcatccacttgttaaaaagatatttatatatgtagtgccttctgtgtactggagtgcggcaaaatagatggtgcacattctttggcacctccccatcaagaggcaggcatattgcttctccacttgatgacgaggtggcctgaagcttctttgaccaatgcgacttggcaaaagtgatgctaaggcagtcctggacctagcctttacgagcagtgacacctgctgccttggcctctagggtcagccaccacgctgaagccatgtatagacccagtgaacagccctacacgtgctcccagatgacagccagcatcaactgtgagctttgtgagtgtgccatcctggactcccagcccacgcaagccttcagatatgaagattgcatcaccatttcttcagctccttgtttagagccaaaaagttctttttctaaaaaaacttttgttaacactagctgtcaggagtgtttacttacactacatggtgtctttaagatgaatctttaaaaatttcataccatcattggcatgaataaatgacatatgtttttccaggttatgaatgttttccttttaatgacttcatgtccaagtaataatcattgccttcctagaatcctttcccatttgcaccacagtgactctattcaagagatctttgccagtttctatgagtatgacccttgtattcagtatctagttactggctactggcta

SEQ ID NO: 60862 - DNA, 1822 bp, Bovine  19866881056661
tagctcatgaaatttccaagccaaaggaaaaagacaaagattgttgggtgagaggccagaattgggagccaggagagctagatggtgtgataaggcagaagcaaggggtgggggatggccctggcggccaaagggtcaacagaacgttcaggagccagaggtcaacgacctgtgggaatcaatgggggaaggggtttccttttgtccacagttcagaggacttgctgcttggaaacacagcttacgactttcataagcactctgaccaaatccctaaaccacagcctaagcaaagcctgcaatgtatcattggacgtaattaaaggttcataccccattggtggcagagggtgaaccaaggtgacttactaaaagtaagtcttttcccgtcccacaagtctcagaattctcttagatttggcgaggttccacgaacagaagacagacgcacatttaccacgactccctccatcttgcgagaaacggcattttcctgaggaactcagtgtgcttctccagacatcacatgtcctcccacccagaatctaaagaagactctgggaggagaagggcggagaggctttaaaaatgcctagacacacactgagtcactgagggctcttccagtgtgggtaagggccaccactgggcagaaggggacccgatttcagactggagccctggagacaacaggggaagagggggaagaaggggcggggggagctcaagtagcaggctgctcttggcaggggcggctgctaattttctttggctggctctgactacctgtctgaaagcgcagcaatgcaggaaggaaatttttcaagagattaaactattattgtttcctgtgtggctgtcttcgctggtgtatgaaaaaaagctttaagggcacttgaaaagagatttgtctgaatagcagggctgttatgattcatctccccctccagtcgggatctggccaatttcctcaggaaagtggttgattaggacccatggatttatccatggcctaaatataagatgtcataaaggtgattaatggtgagctcaccatcagggggagttaagagtttgtaaaagctatttttaatggttcagagggaggaaaaaacctcatttgtcaccttgccaatgtgtttcaagagttaaaaaacttctttgtggcccccgatcattcgtgctaccaactgttaaaggtcgttgtattttccgattttacaagtttgtttgaaaaaaaattgattcaatgtgttttgctgtttatagaaaagtacacgaggaaaggaaaatgaaatgtatttccaccatgattagtgactgttgcttctggtagcacttaagtacaataaacttggctctttttttccaccctgctttgctgtttatgcccctgccatacaaatagcaattaatggagggtatatggagacagttttcagagcccaggcgaaactggctggggttcccatataaggggaaatcagagtagttcagaaagcagacgatggccctcatgggcactgatggtgtccagtgtagctcagtgatgtcacattatccagagatgccctaaaatatgaactcattgtcctgacaactccacaaggcaagatgctttccccagacacaaggcaactagctttgtttaaagggacttagaggatcagccttcctgtaaagcagctactgaattatctaaaattggcaatcaaccactggccaaatcaagcagaagagcaccaaaaaatattcactgggggaaaaaaaaggggccagtgtggctaaatatttgggcattttgggataggaaacataaggc

SEQ ID NO: 60863 - DNA, 738 bp, Bovine  19866881061774
cttaaatacatggaaccaatatctggttgaatttttttttctatgtaatgagatataactatttcttgaacccttattactcagaaaaaagtgttcaggcaaatgcagtttgctaaataattccacttgtcctgttaccagtttgagcctcgatcgtggttgtttggtatggcaggaagactgtgtcctgactgtatgttattaaactgtttgttttttaaagtgattttttaaaaagacaaatgatcatcaagactgctgaccttttattaatcttaagaaagttcttgggattattccttaatgttacagatttttatggaacaactttccgtctttggctttgatgggatcaaaagtagttgtgttcatttctagtttgcaagatgacagaaaagaagaggcaaagaggtactatttttcttgttggattgacaatgaaaatgagaatcagatggaggctttttttttgtaaatgtaaaaaatgttcagtcatttgtataaatggtttaaaagccttgagattttaggaatgtgtatttgcaattattctcttttaataattaatttctaatatgttttaatcactgagaacattgttttgatcattaagaatttacaatgtaaagattatttcaaggtcagatttcaaatgttaatcattgtaacctaatgcatgtaaatctctactgaattgagcttaaaaataaaagtaagtcattaattcgagctagcata

SEQ ID NO: 60864 - DNA, 938 bp, Bovine  19866881070364
aattaataaaacatctaagtcctgcgtgcctgggggctcactgtaatgtttgtaataagtagaatgaatgctgctgcttgttggaactcaggcctttgagcccagggtccttggcatcctctacgtctgaaagtgttcttgaacttcagtactgtttcacttgcaccaacagaacttgtctgggaaaatatctaataagccatggtaagaaacatctcactacagctgtaccgcctgccttctctcggccccaagttatccgatcttgctcttgtcagtgaggtgtgtcgatgaagtcaaacccaagtgtgtgctttgctttcgagccccaactgatgacagccgtgcccagttgatttaatgagctgggggcagataaaggcgaggatttgcaatgttcgaagtgtcttcccaggtgagaagacaaagattgctgacatgcctctttctcacagcccgggtgcccaacccgggcctggaagcacatcaaaggccacacttcccttctttttatgctctgggtctgatctctccctctctgattgcatgcctgcgctcctcacgagttgaacaatggaggtattatgctcttgggagaagaaggagccttacctcaaaggccaggtgccaggggtaagtttcctcgtgtccaatgactgtggtaaatggttcaggctttgtttttctttctcttctattttttcagtctttgctgtcaggctgccagacactggccctgagcccatatcagcacggggcatctagttgtgttacaaacttgagttccattgtctttcactctctcccaacctagtatctgattgtatttctgtctccttatcagtgctaaagagcaagggcaaatcagcttcagtaaaaattgaactgcagtcccaaagttcccatttcatcacctgaatccacattgttttctatcg

SEQ ID NO: 60865 - DNA, 1449 bp, Bovine  19866881075772
actttagaccttctgaaaaccctgtgttcttggctgtgtgttagttccctggtttcattgcacagctgcctctcatgctcctggcttcaacctaagggaaggcagaaaagtgaaagtgaagtcattcagtcctgtccgactcttagcgaccccatggactgcagcccaccaggctgctccgtccataggattttccaggcaagagtgctggagtggggtgccattgccttctccatccctttgcatgacctacagataatccacggagttgagtttgcttttctgaaataaaggccttcatttttactctgccctttacagatgaggtgaggagcccacaaagacttaagattctgatacaacctgaggttatctgatgaatttattccctacaaaactgcttacattctgatgacatgtgtaaagtaagacatatttttatccaactgggcagagaaacccactagatccagactttagagtggattctaattctcttagagagtataattcttcagcagaaacagacacagcattgtaaaaaaacaactgtagtaccataataataataataaagtggaattcttaagaaaactataaggccacagcgttcactttgtcctgagctggcattattgccatgggtgctaagagcactctaagtttgtacagaagcctgaaactgatgctgaattcttggtttctcagactggcctattataaataaaaggggtgaagaacaaaagggaaggcagaaacccccagttatttttaagagatgccacctctgtatgtgtttttcactcagtgtcaactctccactctttgaccctttctacatatcatgagaaatacccttggaatctccctccctcttcatttctgtgtttttttttttttcccttcctctggtatcgctttgtcatccctactatgacaagctaaggagatgcagtcaaattttttgttaacaatttcattgcagccttcttatccttgacatcatccttggttatctggcaccagaaatgcagtggaaattacttaacgaaaatgacacttagttgatgtcactgaaagggagtgctaagtgcaatgagaaacaacagctcatgctcttctgagagataaacagctctgctgattggccccaaatgtggcaaagtaattcagccagggagttggaggaaattccaactgagagctaaagtataaagtaatctaaatggggagctcgagagtaagcccaagggatacctgcatgccgaagcttaaaacatagcatagttcagcattaagacaacatcactgcattgccaacactctgcgtgatttgtattacctgaaagtaatgttgtcttacaaaatgttcttgtctaagagtcaaggccagcaggaaactgtcaacatttcaaccaagcagtttgccctgtgcctgaatcagttcaa

SEQ ID NO: 60866 - DNA, 1645 bp, Bovine  19866881080462
ctaggatggggcagacggctggggagaaactcagctggacgaatttaggacctggtaatgacaataagcgggcaggcttacttcccacgtatgggcagggtgccctccagtttcctggtgcgtggatgacaggattagttaccaagaggttttggggaaaggacaagtctttggggggaaggggactaatgaactggtggtggtgcaggcgccactagcctgagtaagagggggacaggagaaagaggtctgggaaggactcctgagggaactgcccctgtgatgggcacagagcagctcaagggcctcttggaggaggaaacctctgagctaagatgggaaagagaagaaagagccagatgtgcaaaaagcaggtggacagacagcaccaaggacctgggcagtgtgtggagggacctcagggtgcaggacacccagctgggtggagacacggtggagggcagggaagctgagcaggagtggcaggggcctgtagatgagaccagagccaggtgggcccagatcttgccagaagcactgctgtcggctccaatcagactcacctttgcggttttattagaggcaggagctccgtgcacacatctctggtgccaaagaagtttgttttcatagtcacctctgcttgaatgtgaaatggtgtggtgtcagcagctttcaagagaaaagcaaagtggagtcaagaaacagttctcgcgcggtaacattccctaagaaggtatcgctcatgaattttgtgtgcaactagtgaaggtaaaaatcggttgaattttgtgcacaatacaatcagtattggacccgtgtgaatttctcaggttgataatgaaccatagttctgcaagaacgcaccactggcacggcgctgtacaaagggtacatgggacctctgtgcatcagaaaggggctgtgcatcaacctggaaaaggtgcccgggattctgagccagagaaactaaaagttctctccggctagagagcagccaattcctcgcaattcctctagccgcacctcttcccctttcccttctccttctctagggagtcattctggaccccacaggcgggagaagcccctctacagcgattccccgacagatttggtccatcttggaccgagatgctcagagcgggtgacagcctctcctggagcacccagccgcttcttactcttgaaggcgatgcccgcgttgttgaccagcacatcgaggcccccgtactccttgcgcaggaagtcacgcagggcgcggatgctctgccggtcgtcgatgtccagctggtggaaaagggggctcaggccctcagcctgcagctgctgcacggccgcccgaccccgcgcctcgtcccgcgccgtgagcaccacgtcgcccgagaaccgccggcacaggtcacgcacgatgacgaagccgatgcccttgttggccccggtgaccagcgccacgcagttggaggacgacatggccggtgtgcagggcgttgagttgccttcaatagggagcggcgagtcccagcgtttgagcgagacagcagtgcgcggagcgatcactggcttgaatcacccaggggcgcctgggctgagcgcgcaggcgcagacgcaggctccgcccctcggggctcggctccctggggac

SEQ ID NO: 60867 - DNA, 1138 bp, Bovine  19866881127641
gtttcatggtaaacaaacttatttagtatcatcattccacttaattgaaccatcatgttttaataaaattattgatgtcttaaagtttctgaaaaaagtttgaaaaatatcgttattgcagaaaaaagagcatagggataaaccaggctagctaagcacatgcagctacaataagttattatcatcaagtctggggtcaatgttgtagtcaggagatatggtattggggagagtgggagggaggctcaggagagcggggatatgtgtattcttatggctgattcacattttcatatggcagaaaaaccaacaaacattgtgaagcaattatcctccaattaaaaataaataacaatctttttacaatatgaactgttttagatacaaatattaaattaatatttctgattatatatatattatatgtggttaaactattctgcatttctttggttaaataattggaactgtcttggtttagcaactatgaattttgtggttaaattatgttgtctagttttattttaacagctatgtatatatatatgtgtgtgtgtgtgtgtgtgtgtacatttgtaggtgattttcacacaagttataggtcattgtaactaagccacagaaatctatgaaactagcctatatatgagaatcatataaatcactttcacttcaggtttaaattttgtcctgtaagtcttagccattagtaggaacttgaaattgctcccaaggcttataaacagagcaaattcttcatattactttttagagatacaattaccataatggaactgtattatgtaattgtcaaatgtaactctcatcctttatataaagtgtaaaatgtacttcttctgtttgaaaatgtaattctgatgttttagttcacccataggaacaaatttttctaggaaactgacaaccgcaatttcattatcttgaacattttttccaaatctcaatcttttttatcagattttaaattactgtttatattgttcttatgctctctgatggtatgtttctgagtttttatttacatgaaagtgtaaatttgttctctccaagaacaaataaaaccatacaaaagccatgtttttatatcagaaaaagcaggttaatataactagtatgt

SEQ ID NO: 60868 - DNA, 2573 bp, Bovine  19866881153510
tcctttgattctccccctcgacctcctgccttgggagccgccagcactgagaactttcctccatggtgtgcgggtgtccccaggcttccttcaggattccaaagagttcacggaacttcttctcccagctacattccttttttctaaggcttggttcctatcataccctccttttaaaaggaggtcaggggttctattttatgtttaaaataaaatttaaaatcatcatttaacatatatcttagaagtccttctaagagtctccagccccattagccatggaatctgcctattcccttgttcttttttgcccagcttgcagctcatttaagtatcactggatcactgaagataacctggacttccctggtggttcagatggcaaagaatccgcatgcaatgccagagacccgtgttcgacccctgggctgggagatgactcacgctctagttcttaaaatcaaacttcctctgccaaattcaagaccctgaatttatccaaatgatagaaacatgcttttcccaaccatccaccaaaatacctcccattcagaccaacaatagccttaatgggtggattcagtcccctccagttctaaggatagtcttcctgcttcaccattgggccagcagccttcaatattcttcacaccggctcagaagatgccactcacccttttcaaagagtgaggtccaggtttgaaaatggattgatttctaattacattaaattaatgatgttaacacatacacagaaatgtgtccccatcaggtatgaatctattttattaggcagaactctaatgttgttccaccctcaagcctttgaaaagcacttatggtggggagtggaggctgagagaagggacccttcctgtatttccaccctggcttcctggtgatgcatttttcagaaaagtttaccttgaacttctccgcacctcctaccacctccctgcaaatttacacacagagcacctttgtgagcctgagacagggacagagcacagagaaggtgtgtcaagccaaacaagttgattcatgtgcaaaaatcccccaactgcgtttacagattgaattggaaaaactctccgctgcttctgggtgaaattccactgaaacccttcactggctgcctatgccttcagtacatatagttgccaatgcttgcaccacagttcacatgtgcaaacgcacatgatcagaggtatgtgagagcgtgtggctcccagatgtctgtgtcatccgaaggccaacggtttgctgcatatctgctgtgcatacacatcgctgtctctaattgtgctgtagcccacaacgtttaacatggtttgcttggtgcggtgcttggattttgaacttaacaacactagatgcttgaatgtattgagcaatggggcgggacttctttggttggcagtcatacgtttatgaagagctccaatgactgggaaggaacagttatggatctgcaactgtactgtatgacagccactagccacttgtggcttttgacacttgaaatgtggctggttcaaattaagatgtgctgtagctataaaatgcacactaaatctcaaagattaggtaccaaaaaagagtccaataactcattgataacgtttttggtatttttttttattgaagtatagttgatttacaatgttatgctagtttcagctgcatagcaaagtgattcagtgattatatatatatatatatatatatatatatatatatatatatatacatgttctttctctgattctttccccttacaggttttcacaagacatgtaaacttccctgcttggagtatactcctgtagtacattagcatagttccctgtgctatacaatatatcgttgatggttatctgttttatatatggctgttgtttagtcactaaagcatgtccaactcttgcaaccccatagattatagcccaccaggcttctctgtccatgggatttcccaggcaagaatactagagtgggttgccatttccttctctaggggatcttcctgaccctgggatggaacccgtgtctccagcgtctcctgcattggcagacagattcttcaccactgagccacctgagaagcccattttatatatatagtagtgtgggtgtttaatcccaatctcctaatttatctattcctcattaataactttttagaatgataatatatgatataatgataaattggctatactagattaagtaaaatgttactaaaatgtcacttgtccttttttactttttgtatgtgatcactagaaaaatttagcttgcacatatggctcacattatatagtgactgtacagtgctgactcagagtacttattaaaaccagagtctcatagaagtggcccaggaatctgcatgcttaataagcacccaggtgattgagatcattgccatttggggacccctgatatagcaggcactgacatggaccccaaggcagaacacctggattctaaatttgtttcaaattctttctcatcaacataatgcagggcttggattagacctaaaaagttgtatggtttaaggcttccag

SEQ ID NO: 60869 - DNA, 1077 bp, Bovine  19866881157284
acattaaagtggagtcttaaaggaaaccttcttggtcaatttctttttttctgaaggaacagaaactcacttgaattataaaaaattcaggcaatatcattggaagtatatggaagtatctcaagaatcccagggaacagttttagccaggatttatgagaggcagaaacatgagctgtaaagctaactatgcaagttactccttccctctctccagtggtccttggaaccctatttctggttctttctgaggctctccattcagtttttcctgcctacagactggctttctctgcttctgcctacatctaagcaagagctgccacatcagataccctagagatcctctcaaagaagatgattggtataggctgggccgaatttatgtcctagtccaatcagctgtggctaatgggtggggcaacttcaaacaacactgattctttttcatagaatggagggaacacccaaaggtgtccattggaatattggtgagattagacagactttcatttaactctgggataagtgttggtggatccaacacttcacagtttgttttgctgttgtttagttgctaagtcctgtccaactcttttgtgatcccatggactatagcccaccaggctcctctgtccatgggacttcccaggcaataatactggagagggttgccctttccttttccagaagatcttccccatgcagagaagaaagaaaagcagagcaagttcagctcatttgttcatcccttccaggagccccgagatctgggtgcacctaaggaggaaagtggttccctaagggtgcagttgtggcagcagaggcaggactggcgtggggggcatctttagaccaagggctatgtttcctgtgcccagatgcagttaggggcaaacacgtatggcacagtattggggaaggggtgaggggccaaaagaagccaagtcattagcaagagcagcaccaccacagcaccatttttcattgcatctcctgcattggcaggcagattctttaccactgagccaaaagggaagcccattttgttattagtcccttatttttacaacttac

SEQ ID NO: 60870 - DNA, 1307 bp, Bovine  19866881174648
aatagaattccatgacactgataaagcaatgacacatgtcagacataaaatgttctctggttttaaagttctaccatatattagactatgaattcttacattactgtaaatgtggtagtcatcagtgccggtttccaaatattctaattcttcctccttctcagcaattccagcttctggaggattgcccatcctggctcctctgtggtgggatatgactagctctggccaatatgctgtgaatatatgtgtgtatcactttctggctggagaaattcctcaacctagtgagaccctgctgctaaatcacttcagttgcgtccgactctatgcaaccccatagacggcagcccaccaggctcccccgtccctgggattctccaggcaagaacactggagtgggttgccattttatagagctcttgttttcttcttccacagtgaccataaatgttctggtgtgtcccaaagtaaaaatgatgacaacatggaacagagcccttacaccagcctcaggggatgaaagtgcatagtcagccagtcagctatgtctgattctttgcaaccctatggaccgtagaccaccaggcaagaatactgcagtggattgccatttcctcctccagtggatgaacatcttgggtgataaattaactttgctttaaatcactgatttgtgggattatttgttactgcagcataatccagactatgctgactgatacattaaggaaggaaaaaaaaaagtatatatttatctacagtcccatttcatggataaaattaaaaatgactcaaattcttgtccagaaaaatccttctaaatgttaagaatgtcctatttatttctcctggccttttactttgtatggtttatacaaactattcaatacagaagatatttgaaaaatgtttgacatgactggatagatgaccaaattaatccctttgaatgagtccatatacaagaagacaagaaggcaagatattatgatcttattgatttggaattagataaatatgaactcaagccctgattttatcactagtgtgcaaccctgagcaagtttctgaatttccctaactctctgcttcctgaacagtaaaatgagaaaaataatatcaacctcttggggttattccaagaattaaatgagataacatatgttacctcattagtgtagtttctggaattaagactcaaaaatggaagctatcattattattacccttcaaacaccatcaaaaaaaaagaaagaaaaatataggaagcaatgtagataagaatgtcaatattttagaagtta

SEQ ID NO: 60871 - DNA, 1475 bp, Bovine  19866881175511
cctcaggggagttacagcagaaaaaaaacatgaaggtgagactggccattcatgcttgggggcatcacacagactgacttggttggtgaagcaagaccatggtagagagtgatggaagaggaagtcggagcaataggaccagctgtgtctttgaatatgacactatggcattgagaggactcacaaagaacgatatctgcacatacgtgccagcctagcaaaaagtagagacaacggactgtctcatgcatccgaggtactctgcctaaattatctttgatctattggcacatcttttatgatctactaaaaaattaaatttttcattcatctattgtattcaacaagcgcaagtcgcaagcctgggttattaatgatgtcagatcttgtattactgaaacaaatgcataaaggttccatttctgatgacaaaaagagagtcatttgtttcaatcatggaagacaatcttattaaacattgccaacttactgccaagctggctggtcaccaaggcacggccacagaacaaatggaatcgagaagactgtcaatcttccgacagtgtcactgtccccaaaatagtaaacttagggagagatcaatctatgatgacatggacacttttacttcttaattctggagcctttcaagttcagtgttttcataatcctttcaggtagcaagtaagctgtttggcaaatactagtgatgctgggttaaacggtccgatctgcgtagaaactgcatatatattcatatgaactgacttaacctttcagaaacgtcatttaggaaaatagataaaaagccttaaaaatgtttctaccctttgacccaatgattttacttctcagtctaaggaaataatctggaatgcaaaaaaggcaccatgaccaaggatgtccattactctgttgctcttacggctgaaaacaaaggagccaaccaattttctaacaggaggagcatgatgtagtaaagtacatttcagccacagaaaaaaatgcttttgatgtgatcagttcagtgcagttcagtcactcagtcatgtctgactctttgtgactccacggactgcagcacaccaggcttccctgtccatcatcaactcccacaacttgctcacactcatgtccattgagtcggtgatgccatccaaccatctcatcctctgttgtccccttcttatcctgccttcaatctttcccagcatcagggtcttttccaatgagtcagttctttgcatcaggtggcccaagtattggggcttcagctttagtatctgtctttccaatgaatattcaggactgatttcccttaggaatgactggtttgaccttatagcagtccaagggacccttaagagtcttctccaacaccacaattcaaaagcatcagttcttcagcactcagctacagtccaactctcacattcatacatgactacggaaaaatcatagctttgactatacgg

SEQ ID NO: 60872 - DNA, 1317 bp, Bovine  19866881199753
attagaagcaacagatcacagctcgtttcaagtatttgcagtggctggtgtcaggatgctgacaattaatcccccatctaaggacgtggccaaatctgggatttttctaaatcaaaaggaagcatgttctcatctaaggtcttgttaaggttttattttattttacttcattatcaaggactttttcttttttttttcctttttggatccctccttggtttgggaggtaaattcctatttaggataaaggttcattttttttttgttttttaccccctaaacttggaggagttactcgggcagagaataacctttgaagttaagagaaactgtgctatcaagccaggatacaaaacagaatcagaaaaggggctcctaatgcattatggaatacaatgcagaatctgccctaaggtgatgctaatttctgctctggtcaatgaaaaccagacttcaggacgacttgctctgtatttatctgagtcctcgagactctgagttgccacatggtgctacgggaaagcctgtgggcctggtgggcaaggggggagccccgtgatggggcaagagctggctcctttattttctttggcatggcttatggaaaagttagagaaaatgaatttcaaatgatgggtcaaaactcaagatttgaaacacacttcctccatcctgtaggtctcctgcatccatggaaatgatttttataactttaatttcattgtcagttgcaggtatttgttcatagagttctagatacccccctccccagtctcttcatttcagtcatttaccatgcaatgactctttctcaagcccgtaaaatcatggaaaaaagttcaaataggctgtaaatgattacacgaatttcctgttttcttttcatttcttttctcctttgccttttaaaatcgtccctttctcctgtggcatattttacatcaaaattgtggaggggacagaagacctacattaaggcagcagctgggatgggccttcgcacaggcaacttgcttcctcactctgtaatttttgtccacatcgtaaaaatgtttcaaatgctcaacaaaggttggcgtgctaaatgaaaatgtggaaataacaaaatgccgtttggtgaggaattttaagagattagacagaagcatgaaagcgctggtgagcaaaggagaggtgattgttttctaaagacaccctgaacttccccaaaagtgggagaggccgatgctagaagcagaaggaagaatatagtcagcagcacctcttcttgctgctccttttggttaatttggttcagcttctgaaaagggtcacacg

SEQ ID NO: 60873 - DNA, 1419 bp, Bovine  19866881261470
ccataggtatacctatgtcccttccctcttgccagttctatttctctttgtatatatgtatgaaatatatggcatatatgcacatgtgatatatctattttatgaaacatataaaattatcatatattttgcatatcttgtacccatattatatatagatatagagagagagagagaaagagagaagaaaacaaaccgatgaagttttaccttgtaatctgtgtacatagttttattttctcttcgggcatatttttaattgttattccctgatctgcatcttttaaagtattctgctgctgctgctcgctgctaagtcgcttcagtcatgtccgactctgtgcaaccccatagacagcagcccactaggctcccccgtccctgggattctccaggcaagaacactggagtgggttgcatgaaagtgcaatttctccaatgcatgaaagtgaaaagtgaaagtgatgtcgctcagtcgtgtcggactcttagcgaccccgtggactacagcctaccgagctcctgcgtccatgggattttccaggcaagagtactggagtggggtgccattgccttctccttaaagtattctaacttggggttaatcatttagcatcaaataatacctattaaagacacagtacactatactatttatcataaccgagtagacactcactaggtctttttttggtgttatcagattattgagaactccgagttctgttttaatgtgtataaggacatttgttgatagataaaagatagatagataggtaatagacagacggacatacacatacatacactggcacacacataaacacaaatactaaatgcattaaagtgaccccactctaaggggtatttattacaagataccagtagatttatatcatttcagaagctgaaattagatttgtgcagctcctttggtcatgttttattacgttatttccacataaaatgagaccagaatctcctgcatggaaatcagcttggcatttgtcacgtctgtatcaagtgtctgaactcatttttttagcagtccttttccccattacacttcctgtgtttggtcatgcaaacaagcagaacattgtgtcattgtgctggggacacttcttacgaaagccagggaggaacaaaagctggaaccagagttaatgagacttattaataaaagggggaaaaatatgtttgcgtaccactccctgaactggaggacctgctggtctccaggtgtgaagtaattcagactccagggcacgcagctccttcccaggcatctgctgtttcaaggatgccctgaacttggtgtcacagtttgttttatacgcaatcagattactctctttgtgaactgacttgcgaaatgtttggaatatgctgggaggagttctcctgcccaagatgcaa

SEQ ID NO: 60874 - DNA, 1988 bp, Bovine  19866881265386
aattgagatgatcctaagacatgcttccagtcccacagggctgtgctatttcccacttaacaggctcttaggatatgggcttgggtgtttcaaaccaaagcatgagaggttttctaagccctgctttgtggggggccctgaacttctgttattctcacgctcaccatgtgaggttggcaaaagatcagcacattttgtattttcaagttctgagctccctctttcagaatgccactcacttttagaataaaaatgatcccaaatgctgggatcatctctcagtatttctgtctccttttggatcttggccttggatttcttcattgcattgacaactctccaaagatttcagttactccaattagacggtgtgcatgtgtgtatgtgcgggggtgggtttgttttatctaactttctctttgtcttcagcagttgtttttgtttaatcagtaagtcttgtctgacttttttgtgacagcatggactgcagcctgccaggttcctctgtccatggaattttccaggcaagaatactggaattgccatttccttctctaggggatcttcttgatccagggattgaacccacatcttctccattacagccagattctttaccactgaaccacctgggattgtcttcagcagagagctgatccaaattatttggatcacctagtctactatgtcaagaagtagaagtccaaagtttcttttttcaaaagtgtgaccttctgaattattattatgaaaagagacccagaaaaagatatttaattcagaattccctaacttattttactactgatgcctttgtttttgtgaagcagcccatagaacaaatgtcccacggcatctcaacttacaaaaggcttagatttcaaaaggctgtccctaagaactttgccttgtaagttcaaagtgatgttcaacaaggagccattgtattcacgtttatgcaaagttaagttacaagagaagaattccgtttgatgattttgttgtgactcatcccactccacgtaacaactgtcattctttcaccactttcttttgttttaattatttctagttttattttcattgtaattgtacacgcagagaaaaaggcactttgggacaggtatgtaaagacatttttaaacatattttatttgaaataatacattcatccatgcatgtgtgctcagtaatgtcagactctttgtgactccatggactgtatagcccaccaggctcctctgtccatgggattttccaggcaagcagactggagtgggtagccatttctgcctccaggggatcttcctgaaacagggatcgaacctttatctcctgtgtctcctgcattggcaggcagatttttttttttttttttttttaaccactgagccacctgggaagccctaccttcatctagctctccccagtgatgacatttcatacaactaacataaaataccaagacccagaagttgacaccaagtactaacattgatacagtactatcaagtgacctgcaaatcttaattagtttcaccactttttaacatgcattcatttgtgtgtgtatgtaaatatgtaactctatacaatgctctctagtgtagagattcatgtaactgccaaacacaaggaagatacaaaactgttttatcatcccaaagaaactccctattgctactcttttacagccatacccacgatccttgtctactggaaacaacctatctattctcaatttctataatgttgttctttcaagaacggtgaattgtacacaaaagatcttaatgacccaaataatcatgatggtgtaatcattcacctagagccagacatcctggaatgcgaactcaagtgggccttaggaagcatcactatgaacaaagctagtagaggtgatggaatttcagttgaactatttcaaatcctaaaagatgatgctgcgaaagtgctgcactcaaatatgccagcaaatttgggaa

SEQ ID NO: 60875 - DNA, 1669 bp, Bovine  19866881267998
ctcttggttttatttctttagacttctcccaactgcaaattgcatttgtgtaacgaacttgatcacaagcacttaggcattttatggtgaagtctgagcattatctggagacttttacacactggagaaaacggatacatggaaaatgtaatccgaatacaacttgtcctctctgagcacaggataactaaagagaggaatgttgttatcttcagtcagtcaagggctgcaagcttcgagtgctgagcctacaaaccttctgatggttctatgatgacatgaaactgctgtcgtagaaactctaaaactaacaagggtattagcttcattgattttctgaaaatgggaaagggaaaaaaaaaaagtgctcggctaagtccaggaaagagatttaatacaactgtcttttaataatattaagtttcctagaatcaatattttcaccccctcatattataccatggcttgctacccaccagttgctatgtaggagaatgggaatcaatagaaggcttaccttctttggagactgtctcaaaggcttgcataatggagcacagatgaggaagaatgaaattgaattttaagtacactgacattatgctatcatcttcaaccaggggaatacagattgttctggggcccatgggacccatgaggctcagggcaaagaggtaccaggtacagattggttcacaaactccagtgtctgtggcttcctccaggactgctttacaaaatgataaatccaggacttaggggggagcactcctaaaaatatcttcaaacacttccaagcagtacttgatgagtactgtttatgatgtgttaagtttaacttgagtggctttaaaattataccagatccagtctgtgttaactcagactctgatgctgaaacccgtttctacttagctttattttatttttctttatttcagaaattcaaatgggtatttcttagctgataaaaaataactcttgatagaatcacaaaaaattatttacagtgtgagagttggactgtgaagaaacctgtgtgccaaagaattgatgcttttgaactgtggtgttggagaagactcttttttttttaattttattttatttttaaactttacataattgtattagttttgccaaatatcaaaatgaatccgccacaggtatacatgtgttccccaacctgaaccctcctccctgctccctccccataggagaagactcttgagaatccctcggaccacaaggagatccaaccagtccattctgaaggagatcagccctggaatttctttggaaggaatgatgctaaagctgaaactccagtactttggccacctcatgcgaagagttgactcattggaaaagactctgatgctgggagggattgggggcaggagaagaaggggacgacagaggatgagatggctggatggcatcactgactctatggacgtgagtctgagtgaactccgggagttggtgatggacagggaggcctgacctgctgtgattcatggggttgcaaagagtcggacacaactgagcaactgaaatgaactgaagatgacattttaaattttatctacggaaaatactcaaaaacagtacaaaatacccaaacctcaaattttgagagagggtagagcacattagtttttgagtg

SEQ ID NO: 60876 - DNA, 1325 bp, Bovine  19866881268913
attcacgggctttgggaagccagttctagcagcgctaagagcttgcaagggtaattattataatagatgactctaagcaaaccagctaacaaatcttattaaaaaagttgtctttgggggaagtcaggtgccccacacagcataaatccatgtcgaatccagccagcaccactcagggcacagtgcccaaggtgaaggtcatgctgctcagcatgacggccagggaggactgtccgctggctgtgggctgcgtggcccgtgtgtcacccagcaggagtgaagcccacccttgcatcccttgggatgctcttcttttttaatttttgcttttgcaattccacctatccttccagacttcagatatattctccctcttggtgaatgtatcctttatttcttggaaatgctactgcacagattatcaggactgttcgcatctgcagtgctcagcaagctgcttcaatttctgagtttgatcttccgtctgcttcaagaacacctggatggtgtgaatgacccttaaacacctcctggtcccctacttcaggggtaacacctggtccagcatctttgatgtgagcactcaaggatatctgctgaaggaacgaatgatcaattgtagctgtcttggctgcttatgcgtctttctttgccattaacatctgatttttatttgcatgagcccacttattggactatcctttcctaaccaactctatggagagaatacgagactattcttttaagcatagtatctgtccctggtgggctacatttggcagcaacgatggtctgaaacctccaaaggcttggtaagagctgtggggaagcatgaaacgtgttcaattaactcctgttactcaaagtaaatggaggtgcttaagccaacagtcatatattctcagttgctcctgtgactaggctgtaaatgccctaaacacactatccatctcagcacaggcaatgcaacacgtgcctgacacatagtaggctctctagacacctaggccaagggcacaaataatgaaaggaacactgagccttgggctcacttggaagggacaagctccccagtggcatctcgtcaggctagttaggaagcccactgagaaacagctacaccatccttgtgaagggcacactacattttcaccgtccaccctggtccaatttagatgttaaaagacagcagcaaacaggtgaaaatgtaatgataagtaggatcaactatttcccttctttcctatcacctgccaccacttaagagtcgcatcattttctaccaccttcatccatcctgtcctatacccttcattctttttttt

SEQ ID NO: 60877 - DNA, 846 bp, Bovine  19866881304850
tctcggctcatgaaaagatggagcaggcctgtaatcacatatgaaagtattggttgtcattagcagaaagattgatctgaaaagacagcagacccagagtgaaaggacttaaaattttccactgggcagcccaacaactttcaccttccagataattgaatacagataacagattaccatattagaggaaagaattggattggagatattcagtagatacccgctttagcaaagcaataccaaatttctcaataatgatttttgtttgatgcaaaaacattaatgcagactgacagtacaaaggcacggtccaatgtgcattgaagacaaagttgttggatcagatttttatacagttacctgtggcatcagaggttctaacaaatgcatgtgttcagttgactgtaaaaaaccgagttaaggaacatattcaggcaaatgtcatggctttattccatgaacagagcttctttcagctttcttcagtgagttattgatataaccctgagtggtaattgtataaaactctcaagaactgaactcatgggcaggcatgcaaacggttttcttcactgcataactctcctttccagaaacccactaacggtgcagtaaaaaatgttagctataaaacaagctggaatttttataggaccttggaagggcacggtgaatttggaaattcagagttgtagtccaagaacactaaactgaaggtcaaggttttctatatcttcatccttgtcctacaaatataccatattgacaacctgaagatgttgctcccaagctccagaatttatgcataaaatgagaggctgagaccatgaataagagagatgctat

SEQ ID NO: 60878 - DNA, 1175 bp, Bovine  19866881353882
ccaaacacttagatggcactccccgtgttccaagcacaggcggatgactgactgtggattcatttaatggtataataacccccatgagatgggtactattattattcaattttaccgatgaagaaactggagtctagagggatgaagcagcgtgcccaaggccatcagtccagcaaatgatggacacagattgaaccctattttcacaaagctctgctccctttcccttcgtgacaacagacaaactcatttcaagccaccatcaggttttcaggatccttctatttctaaccattctaaattctctcagataaccctgcaccctataccacaccattacagcttctgatgagacttttgcacaaagcattttatagttcatatcatcgtgtgaacatatctgtaacaaggcaacctgttttccccatcaccaaaaatgaacaatagactataacacccgaatagccatcttccaatattctaaagtgctttaattgttaagaacagtacaagtaagacacattaaattaataaagtgtagaaactattatatggttcaaaaatgagcttttaccttttagggacagaggaaaacaaacaaacaaaatctctaacgatttctctcaaatgggaaacacagattataaatgaccagggccaatgactagagtaaaatgcacataacattcgtagaaaaggaaagaattcaagcatgtgttcaaagagcaataaaataaaattgagaaaaaaatgtaaaagaagagaaagccacaaaaatgtccttctttcgatgtttatttttgtgttaagtaacacaatgataataccatcaacggattgtgatttgcagaacataacagagtattttaaagcagaaaaagaaaaccttcaaagacccagcctttagttcccatgcaatgttctaaaaccagtggaacaagtggactgctggttttctgtttatgttttacagaaataaaacctggcagggaacaaaatggttcccctcttccagcatctactcatctttttctccccccagctgttattgagatcaagtttaagaagacacccttttaagtctcctggaagtctctgaaaaataaaaataggcagaaaagatgattatggaggattgtgggtgggaaaatcatgtacccaatttgttcctgaag

SEQ ID NO: 60879 - DNA, 779 bp, Bovine  19866881752321
ttttaaaagatattatgaatgcttaatatcctataagcagtaatataatgcctgcctgaaaggtcccttttgttccgtgtatggatttattaatatctccacttgactggaacagacaggaatttttgaaactgtgctgtgacttatgtcacaaaggttgttgtggcttcagtttggttaccccaccccacctcagaaataccaagtctgtttaatagagggactttcatacttaaccctgtgcaggctctaaggagagagaattttgttcacattgttctttcccagttttaaacagttctcattaaacttggacatagctgatttcctttccacaatttggataaaacaggcaaatccaaacttgagaaaaactgacactagaaatagaatcagaataggagtttctgtgatcaatttatttaacacaaaaattatgttctaatttttagcacatgttctaactaggtagaattaaggggattcaatttagtgccattagattagtaaaaaggaaattatattttgccaatgttttaagaggagaagatcacctcttaaaaaggctctgtaaacagtaaaaaggacaaggaaaactaaatgaaaagctgcacttcagacatatcttgagattcttactgttcaaaatatctatataaacatacaatgcattcattattcacaattgtgtctgttctatgccagtgccatccaattagatttccttcctgacaggaggtgggttccatctaataaattcattaaattctgtcaacacg

SEQ ID NO: 60880 - DNA, 1304 bp, Bovine  19866881775844
aaatgaatggtagaaggaaagcttcatggtatttagccggctccgatccctttaatgcctgtagcttttggatacagccctgcacccctctcccctgacctctctcccctagtttacactgcactcccctgtccactgactgctgcaaagtctgataaaagggctgaaattagaccttgtctcccagcacagccagcagggcccggctctgccaaaatggcagtggttgatagcaggcaaaaggcagaaaactgatttcccatctctcttctccattttctaggatccaagtgagtcctagttcagagaagaatgactgtctcccggctgggagcagcaggtacgagctcctgcctacgctgtgtcacgtgggctgtgagacctccattccttctcgactcctgcctgcccactgaggtgagctctttggggtttctctgactggtgggcaccggcctacagtcatttcttcgggaaggaggctctccctggaaaagctgatctgcaattcggctgggatcgatgccgtggagactgcataaattggtaagtcgtaagcagctagttttgtctcagctgacaatcatggattagggtgcccggagcaagaatgagcaaatggtctggagaaaaatcagcactgaaactcgacattttttccttttttctttttttttttggaaacatctaaatctgcaaagaaaaaatgctataaaagaaaggcatataggagaatatggggaagtctccaggcagtttaatgtatagatattccctctacttctttcattccacgcctgaacttctaggaggccacaccggatgttctctatccctccttctccttgccctgtgctcactgcgtcttgattctactgatgtttccaggcccattcctgcttttcccctactcctcaacgatctctactctgcatttcagaagtcctttgtcaaggcatattaagaatggccaaaacctagttttcttcagaatattaatcacgtcaggttttgttatcactgaagatccatgattagcaatctttcagaattttgattcttcccatgggctaagtaaaaatacaaaactaaaaagactctgggagttaccgtaactctgatctcttagttttcctgggtttgccctctcttatatggactgctccaccattcctttctgtaattctgtctcattaccctcccagatttttttcatgcactagtcactattaaaaatggaaaccaaaataagcaagaacacaaagaaatattatcccagaagccttgagcaatgccagatgcat

SEQ ID NO: 60881 - DNA, 2059 bp, Bovine  19866881831833
tgtttgtagtgatgcttcctaaggcccacttgacttcacactcccaggatgtctggctctaggtgagtgatcacccccattgtgcttatctaggtcattaagatcttttctgtatagctcttctgtgtattcttgccacctcttcttaatatcttctgcttctgttaggtccatactgtttctgtcctttattgtgcccatctttgcatgaaatgttcccttggtatctctaattttcttgaagagatctctagtcttttccattctattgtttccctctatttctttgcattgattgctgaggaaggctttcttatctctccttgccattctttggaaccctgcattcaaatgggtatatctttccttttctcctttgctttttgcttctcttcttttcacagctatttgtaaggcctcctcagacaaccatttttcccttttgcaattatttttcttggggatggtcttgatcactgtcttctgtacaatgtcaagaacctctgtccatagttcttcaggcactctatcagatctaatcccttgaatctatttgtcacttccactgtataatcatgaaggatttgatttaggtcatacctgaatgatctaatgattttccctattttctttcatttaagtctgagttttgtaataaggagttcatgatctaaactgcggttagctcccagtcttgtttttgctgactgtatgccccttgctgctgctgctgctgctaagtcacttcagtcgtgtgcgactctgtgcgaccccatagacggcagcccaccaggctcccccgtccctgggactcgctccttactgactaccaaacatatgcctgctcttcaggaagcagtcaaggccttcaaccacatgctccatctctcctgtcccagtgtgtgctatttctccccctggacacatgccgtgtcaagctttgcctgaacatgccccatccttcctcagtttcccacctttgcttacgttgtttttggcaccctgaatcaattcccatcatttcctcctaagcatgcctcttctttgttggctcatctcatatgctgcctcctctcctgatttctcccaactagaatgtacctttcccttctattgtacagcctcatcctactattatcttacctgtcttatgacatataatatgatttttgagggataatgttcttagactattagcaaaccctgagtatccatggagggtggagatccttaagatcttatccaccatccttaagatgaccagtccaagttagatgcgtaagacaaggatcttatccacctccgaggctctagcaatgcctagcactgtgcttggggtacagcgggctgctcagtgactcctaagggtgttgaactgcctccctgcccccacctcatcatccttatactgcaagggggtgggctgcatgtgcaggtgccagtgggaggtcgggggcgggggagcggtctgtgttgctttccaaacattaatgtccacagacagctctaagtgctgtctacctttggctcagagtcagatataataaaacaaaatcagccgttacgactaatgctttttaacttttgttgtaagactcacaaaagacgcttgctatccctgactggtgtcagatgcaataaatataattaatctctggaaacacatagatggaattacttaagtcatggcttaattcgtttacaatcttctgaatctcccaggcctagagcagaccacgtggccctctgctgcgggaggcccctcaaacaagctctgtgcccaggtgtggaggtatggatggtgactctttctgggccttttcaacttgaaagtggaagacactgggctctccatatccatctcttggggaatcactgaaaaaaaagttatctttcattgaaaggtgacttctcttttcatctccgactgtgatttcacattgaatagagtcaagagtggactttgcacccacttccctgagtgcaaagtcagtgagaccacagttctagaagtgagtggcactgagctctttctcccaacttagtgtcaccaaagaac

SEQ ID NO: 60882 - DNA, 1415 bp, Bovine  19866881871561
aaaaaaggctaagggcaaactgaacagtcaccccaaaccagacctgcgtaggggaatttcccaaacgtgggaggaaggcttcagggacagttattaaagaatcaaaccaggattctcaattgcttttccacctccactctatcctgttgagtttttttttttcctttcttaacaataaaatacacatttttaattacactaaaattagtagagaacatttctacttccaaaaccttcaattattttttagttttaattattttacctccacacacagtaaaatgacttcttaagtttcaagtgactttttaaaaaggtgcttatggttgaacttgagactgacttttcatttggggaaatgtcaataatctttgtttttgttgaacttaacagctccccacacatactcaaatgcatatttttagaaaaaaaatccttccaagaatggtcatgaagaacaatcatgatcaaggatgaaggtggtaaactgaccctttttcaaggcatgaaaatgctggacattgcatgctcgtcattcctcatgcaaaattgcccagggaatgttcatgcagcttttctggcttccttgataatgacaaaatcagctgtcctggtgctttcgcttctttctacgagacaagagaagaaaaccaaatggaagagacgcatggaagtcaaagtacgtcaatggagtttagctgattggtgaaggatgtttttagtttcttaatacatggtgttgcattgttgattaagacaggatatatatgccttatatctgctgcacttttgatagccttggtgtcctaagaggacgtcgcatcctgggaaggtggggagactgactgtagcagcagacagcccatcccattagaggcaacactctgtagcagtggcctttgcagcagctggcgtccttatgggatgaagtggttcctaattgtgctattgatttttcccctctttaatggattcttctcccaacacactccgagttgagccactaccgcatcccacagacctgttgccagggatgtgtatcaagctgtgcattagaggcgagaggatgctttgcttggtgggttacttaacagtaacccaggtagaataacccggaaggagggattccaacagccttgcaggaaacatgtgctgacttcaagtgtgggcactgggtaggcgcttcccaagtcatttcatttaattcagccttggcaacacccttgttattactactctaaccatttttgtagagaaacaacagaagctcagaaaggtgaagaaacacggccagggtcacacagccactaagacatagaaccaagatttcaccccaggagagtcccaatccttttatatcagaacaggaaacccaaaagcaagtgtgccaaccaaaggactaacggactgcctgc

SEQ ID NO: 60883 - DNA, 1028 bp, Bovine  19866881928489
agagggtggatgggggctggagggtggattgaggggcagctgtcagaatgaatgaataatactctgcctttagtttattcttggaaaaagcagccatgagaaacactctttccctaagcatcctagcttgatttttctagaaagaactttctgctgcagagggttaaaaaggcagaggagaaaggaataaaggacaggacacaggcgttttcacacaattcaacaaattgtgtttacaacagattgagtgtcttccttatctcaattccttcacaataataaagtataataaaatgtcactttgctctgtaaaatggtatgtgatgaggatgtgtaaaagcttttgtgcattttgttaatgccattggctcaataattttttaaacatagagatagcttaaaatggtaacatttactgtctctttctgaacatttgaggtttaattttgacttatgctcagagatacttgtgaatcttctggtaccagagtgatcctcttctatctgaactgagctaattctacagaagcttttgactcaactactcacaacccattccaggaaacgcattaggaaggagcccacagataacaaatctctaacttaggaagaattgcttctggaaactgcagagcaccagataaggtttattccatgggagctgactttatccaaccccacacttgagtgatatagtgggctctgagtaagctgtgtacacaaaactgataaactctgcactaaattaattaagaattctattgctttaatagcttgtcttcaaagaccaatgactaataccaagatttattatgtgaacaatgaaacactggctatgtaaattttataatgggagttctagggtcatattaaatcatctccagttttgttgattttttttgttgatatttctggtatccaagctatactctatagaattactggctcacagagatccaaggattctttcagaagtagaatggcaaatcttgccactgagcttagagtctgtatgtgttttaaccaaa

SEQ ID NO: 60884 - DNA, 1188 bp, Bovine  19866880547824
gggctccgggttccttgccactttgttccgacaccagaagcatgtgcaacatctaaactcacgtgcaccgcttctctctgcaaccaaatgccccctccacctttccagatccaaagcattggccccttctcaggaggcacccctcaccatttttctgtttctgaaaggagctactggtttgcactgcggttttggtggccttgactcccttgtagaatgagcacagaggctgtgaaacaccctaacatctattcccctccgttcaaggtgtgcacagagcccgtctttcccactctgcccctgctggcctgtgccagtgctggcccctggccctccttgtccagccctaccatgccctaaaactaaaaccccaggctctccttcaatctgctggtcttggtgggatcccaatcactgtctcccctgtgctcttgtagaatgacgttagtaccaatgacaagactccggcaaggctgggccttgccccgccccagccgcccaaggagcagcagcagctttgactaaacaatgtggcagaggaccaagaggttaggaatagccccaaacttcagctccctgaggaagtgctatcctctcctctgggtgggcctggtttaaatgctttgctggacctaaaccaagatggaaaaaataaattaggatctgattaatgctctggattgaaaggagaacttgggggagtgggcttagcgacatagtaggacagagcagctgcagatctttcaggggatgctgccctctgactaaggaagtacatatgcagcttgctaagaacagtgtgggctgttttaaggttcccccagagagaccagcatgctacgaagaactgctactggagacgagagcagcgttaacgagaagggccaaggacgactagggtacacctctccgtaggacatgatggaggtccagcctctgggttaaatgcagcctccttcaggatacctttagaccttaagtcctcaggtaattaaagtgggatcagtggcttccagaacatggatctacataaaagtgaggggaacaagaatacacaaatagttaagggttttaaaccctcacaactgaagaaaggacacaaactgtaaaggtaccccagagacttcagggagtataaatcatagccaacctccaaatcgcccctaaaatttctcccaccaaactgcc

SEQ ID NO: 60885 - DNA, 1120 bp, Bovine  19866880561617
cttgatctcaagcgggcggctggctctgcaaggggcagaaaatagggaacaggctgtctgaactaggacgctcagtgcctggcaagacctcactgaggggggggcgcaagacggttccgggcctcacccaaacctttgtggagaaaggaactgacagtgccagccagaagcagggcccttcaaaacgggcagcgggcagcttgtggtgaaagagtctgaagccttggatagacccagctggagtggcagctcccacaaggcctgcacagaggtgacattgagcgctttggaggggaagccgagggcagcaggggctgcagaggaaacgagatgagctggttggcagctctgtttgcccgaggccaggggctctacagggctggagaagctgtcgctcatgctgcccatggtggaagcatggatggaggccgagtcctggctggcacgctctgctgagtaggcccgcacatgaatggaatagaccgtggcaggctccaggttggagaagacgtgctcaagaggtgcctttgcccacagcctcttggagctctggaccagctggctttgagaagcagagaagcttggcaaccagcatccctctgccttactataaacatcccccatcaccacaaagtgggcacagagcctcagctaggtctccaaggagagaagggagggggctgcaggagccaggatgagaaaggctgaggataagaagggggctgaagagcaaaaggaagtaccagaggtccaggcaggtctgggtatcactaagagtaagagaaacttgaccagggactcctgtccatccacccacatccacctcccaccggccggatgtgcaacacaaagctgatgatggatactcaaatggcagaggtggagagagccatcgcctgcaggcccatgggaacgggatagctctggataccatcacagccaggcaggcactggcctggttggagcctacactgttctctgccatgtattggtagatggcctcgtcctctgcggtatccgcaccagggaaaagcaaaagcagcccctggggctccttccctccgactcccctgccctggtggagtggcaagcccagaagcagaaggacacaccacccatg

SEQ ID NO: 60886 - DNA, 1615 bp, Bovine  19866881290999
tttgaatgactgagtcacaaacttattttattagaagttaagtacttacgggtagagattgctttcatttagcacttatctttattgggcacctggtagagtgagaggaagttgtccccaccttagccagttaatagtccaagatagataacgacagcacgagtgagcaattaaggaaccagaaacttactcccagtgctaatcatcagccatttcccaggcactggagccaagtgtgggggtaaattgggtgggtctagatggagcgcaggtgcccatgtcttcagtgtcttccctccctgtagggaatgggtactgaagagcagcatcctcattgccatggctgtttacacatacctccgcctcatcgtcgaccaccacgggactgcccagctccaggccctgaggcagaaggaggtggacttctgcatctcactgcttcgggagcgggtgaggacaaaaaacccgtaggaaagtgagacccagaaagggatacctctcgtcagttctctggtgacctggggccagagatggtggtggagactgaaggtggttcaaggtctgctgttttttcatcactgtaagacagatgaggctagcagggtggagaaatcagtgtggagcagccctagttcctgtgatggcagaagatgagatggtggttgggtggcatcactgattcaatggacacgcacttgggtgaaccgtgggagatggtgagggacaggaaggcctggtttgctgcagtgcgtggagtcacaaagagctggacacaacttagggactaaacaacaacaaagccccagttactggaacgctgttggttacactggcatcctggggacttccctggtcagcttcacgggcgctgtcacacagcacgtcccagacagaagctgtcttgtgtttccactgctacgttatccccacccgccccctgcctgccggggtaactgccgtggtcacgtgggatagtgaattgtccactgtcagctctcccaggagaggcagatcctagagttaaagctgtctaacgcagtagccactagccacgtgtcacaatataagctaaaataaattgacattagggactccctggcagtccagcggtttggactctctgctcccggtgcaggagtcatgggttcagtccctggttggggaacttgggccacacatgctgcacagtgtggccaggaacaaaaaagcacacacacacattgtaattagataaaattttaaattcagttccttagttgaattagacacgtttcaagtgctcatttgccacatctggcaaatgggtatccttctgacagcacaactagaggtgctgtcattaccacagagagttctgttggaccaagcaagtcctgggtaaggtgtctggagctcaacttaccagccctagccttttggaatgtttgtgttccttgacctggactgaaaccattctaggaggagagggccacagattaacatgacagcagtttccagcaacctctcctcctcgatttcggtccccaacttcagctctcttgcccttgaacagcttggagccaatccctggttccagaaaaaattgtgtatccattcgacccctttcctcccctcc

SEQ ID NO: 60887 - DNA, 624 bp, Bovine  19866881319528
acctcattgtagttttgatttgcatttctcaaaaaattagtgatgttgagcatcttttctgtgcctcttggccagctgtgtatcttctgtgaagaaatgtctttgtaggttttctgctcattttttttattgggttttttgctttttgagttgcatgagttgctttttttattttggaaattataccctcatggatcacattgtttgcaaatattttctcccagttcataagttcccttttcattttatgctttccttcactgtgcaaattcttttttcaccaggtattttgaccagcgtgacttggccgatgagccatcttgatgtagctgatctctgagggatagaagatacttgtgatgaagacagcctgagtgtgaggaagtgcagtgccagttcaagtgcagattgcctcacattttcagcactgtgtgaagagtcttcaacttaacctgtgcaactcacgttgatcttcagaagatagcttgtattattttgaacatctgaggtatctttgaaagatcttacccagtttttaatgaataagcagttttctgtaatcacgtgcttttaaagcaaaagtgaaagattgattgatgaaacatcctacacggaaactgtatg

SEQ ID NO: 60888 - DNA, 2011 bp, Bovine  19866880216587
aagcccaagaatactggagtgggagcctatcccttctccagcagatcttcccaacccaggaatcgaactggggtctcctgcattgcagatgcattctttaccaactgagctatgagggaagccatcttctcttttggattagtaatgtacaaatataaaggtttaaaattttggtgcagattaagtgcctacccaaatcaactactgctgaagtatctgtggaagtcccggttgctgttttggaagattcaactaaataagagaatatcataaagagtcactaatttaaaacattagaatgaataatttcagtgaggaaggaatataagagaccaagtgctgaaaaactgccctttaagcaaaactttaattataataaagtaatatttcttgcctttataaaaggcatggtttcctttgttggacaaaaaggtttcacagccataatattatctgaaaaattgtatgagtaaaaccatatcaaagtaatgtgacaaaatgatgttttattataaaccacacctgttctcctccattcctctttacattaagaaaccgcaggggtgcactactttctccaacctgcatccttacccttccattctgtaaatgacatcctttaatcttattaagggaaaaatggagagaatcttcagagcttattgaatcaccttgtctacatgccataaaaccttcttaaattctaaatcagtggtatccaagtatgtcaaatttttaattaatcccagtagggaataaatttctttgaaaaccaatacgaggaatgatttctttgcatatgatttaggttataccttgttttttgggcttccctggtaaaagtccacctgtaatgcaggagacctgggttcgatccctgtgttgggaagatcccctggagaagggaatggctatccactccagcattcttgcctggagaattccatggctagaggagcctggtgagttatacagtccaggggtctcaaagagttggacatgactgaatgactaacattttaacttttcactttagcaaatatttaataatacagtcatggagagagtagtgtggtactatcagagctaacagtggaatgagtgaaatgcttattattaaaatattttaaatctttttaatgggcaaaatttatacttttttaatataaaaattaaactctatcattttcatttatattaaatatgccagacatttatttcataattttaaattgggagtagagatccagcttccagaaagttaaatgctttatttaaggtcacacagatatttagtgtcattgactggctcagctttctcattaaaaatgtatatatgcatcctttagccatataggtaaacactggtcaatttattaggctattttaaaatgtaacaaatttaattagttgtatctggtagtataaaaagctgatgtgtgtgtgtgtgtgtgtgtgtgtgtgtgtgtgtgtgtgtgttttatcaaaggaaataggtgttttcaactaagcaggcaaatctagaaacatgaagaaagtccacttgtccagccaggcagacagcagcctcttcatttagcaagcttttcggcttgattcaaatattcagcaggctattgtttagtatctgttcaaagggctgttaatttcctccatcaacctttgttctccatcttcccaatcatcactgaatcattttaagtaaagttgaagagacagaacttttatgaagcaaattgatacagtaatttaggtaccataattatttctccacctgcttgtgttttaaggcttttttaagtcaatttaaactccaactaccatattttatatgtactaaaggtaatgtaaaaaggtagaaaaggtgttctgagggcaaatgtgattcattaaaatagataagtgcagaatttttgtcgaattagaaggagagatataatcaagggcttattggtgaagcgctcatttcgttttgagataggcatatttcttcagtaattcaacaggctta

SEQ ID NO: 60889 - DNA, 1018 bp, Bovine  19866880479717
tctgtggtcactgtttatatttccagtgcaactcatttttatcttattaccctttggcaggtggtccattttcacctcatttttgaaactaattgaattgtgttcactgaattagtaagaggacaccatattacaatcaaaacatacaaaatcattttatccagttaaactatcaatagattattataattatacaaacactcctgctgatctaaatttttgtttcatagctggaagtatttaacccaatatcagtgcatcactttaactgggcaaattcttatactcagtaatctgttttgaccattctcattcctattcttctttcatcccttctaccatgtttcatttgactagggctaaattaacatgatttattgctattcaagtagaaattttacatcacctctgtagacagagcagctgaggtcctgcatataaaacagacaactggcttacatgtaaggttaaagtaatgaaatatggatcacaagtagtaatagctatatatgtgtgagaatgtggcttataattccaagagcatatgtaattgaatgtattgcttgttcaagcattttgagatactggatataaacctttccaacaatctattcgtatttgattacataatagatactgtcctttttctattactctatttactataatatttatttaatatgttgttgcagtgactcaagtacagagcttacaaaacagaatatcatctattttatgcaggattttatccagaaaaatctacagtaactctcatatttctacttctcttatacaacatccataacactggcccttaaataccgcactatctttaggtaacttaagtatcatgaagaaaaggttaacatatcgaacagaatgaatagtggagtaaaattctctcaaagtttataagtcacatagagtgtgtaaggcaagttaattttcctttaacaagacccttaaaagatcagaaaacctactttttacctcatttatcaacggttttccggaatcc

SEQ ID NO: 60890 - DNA, 2098 bp, Bovine  19866880500952
tcaaggctatggtttttccctgtggtcatgtatggatgtgagatttggactgtgaagaaggctgagcgccgaagaattgatgcttttgacctgtggtgttggagaagactcctgagagtcccttggactgcaaggagatccaaccagtccattctgaaggagatcagccctgggatttctttggaaagaatgatgctaaagctgaaactccagtactttggccacctcatgtgaagagttgactcattgaaaaagaccctgatgctgggagggattgagggcaggagaagaaggggaagacagaggatgagatggctggatggcatcactgactcaatggacatgaggctgagtgaactctgggagtgggtgacggagagggaggcctggtgtgctgcaattcatggggtctcaaagagtcagacatgactgagcgactgaactgaactgaagatcaagaactcaattttttagaattttatcagaattctaaatcagaattctaaatcaactgtgcttggtgattttcttggttcttcaacaaattatatctagcctatactaaaatttaaaaaatgactctttttcaatttctcaactgtatacctccagttatttttttcagtcatcaacatacaatttgtcgtggatcaacagacaggtttagacttgccaactaacagccaatgattgtaatggctagtgaatgtggtaatgcatgtgaaaacattaaacaatctaaaaagtagctttttgtataagtgttgctaatgtatttatttgcattgtatttatttgtttcaaaccactcatatatttatatattctgatttattaagtaccttttgtatatggcagatgtggactggcattgaagagttttggaatattgccaatgaccttcattgattggtgattaggtggaagtatgaacccatgaacagatgattaaataaaagtgataaacatgataataagaatgagttgtctgataggaacacaaaagaaggcatgttttcttggaaatgattggaaagtttccagagaaattacggcaaataaactgggacttgaagtataagtgtagtaagtatattgagtggcaagaggaagaaaagcattctgcacaggaaaaaaaaaattcacttgaaaagaagagcaacctgaagaacctgaagaaaacaaattggctagactgatgcataagactggaagaagctaggtcatgatggtctcatagtacttgtactgtggtggtcagggggtaaaattaagaaggacctttaaccctatgttccagatatggacctttatgtatgtaaaacaatggaatgattttaaagtcaataatatggagaactttaatttaaatggtatcttgccctgcctttctgtatatctcttcttccccccttttctcctttttttcttattctgttctttttattcagtgctccagtccattttgtctttacgcatgaattgccagcaagtttccagctattgcttaaaatatttctttcttgggagtcttgatatctatactgacatgatttatagggcagtactgtatattttataacatgatattttaaagaagttctctttaaaaattcatagcagtaactttaaaacctaattcaattgacaatgaaaataaagcttgtgtagtcttgggaaatagtatttaaacttactaaatatttaaggaaacacctgatgctacaaactaaaagaattgtttgttattgtccttgtgtaatatacttaatattagttattatcacaaattaaatttaagaacattcagtaataacattatagtaaataaaaaattattatgtcaccaagttacagttatttttattattattaatagtaataagcagattttttaccatttgtgtaaaaactgaattgagaatttaaattagaagacccaaaatttatatttggaactcttatgtaatttttctgactttatgctgaagctatttaaataagcacatccatacatttaagtacttggaatttttcaactcaatttgtagataaagatggattaaaaatagtgcagtgtaaatgcatgtatatagtg

SEQ ID NO: 60891 - DNA, 1697 bp, Bovine  19866880544357
agttggactatgaagaaagctgaacactgaagaattgatgcttttgaatgtggtattggagaagactcttgagagtcccttgaactgcaaggagatccaaccagcccatcctaaaggagatcagtcctgggtgttcactggaaggactgatgctaaagctgaaactcccatactttggccacctcatgcaaagagttgactcattggaaaagactttgatgctgggagggattgggggtaggaggagaaggggacgacaaaggatgagatggctgggtggtatcactgactcgatagacatgagtttgagtgaattctggaaattggtgatggacaaggaggcctggtgtgctgtgatttatggggttgcaaagagtcggacatgactgagcgactgaactgactgataatctttcatttagtgacactgttgaaaagattttactatagaatacagaaggttggagaatagagggacaattagatgaccaaatagtatggcaaaaagtactctgtggaaaagcaggggaaaaaatagaattgagaaagttagaaatcccaggaaaataggttcacttctctctatctcccccctttaactaaggaccattggtttgcaagaagcctgttaagtgtctgtggacttgataaggtccagagggtttctaaaggcaggaaagtcacaagattaccttgcagcagcttcctggaatcaacttgacataactactgctcacttctgccttgcacatatatacctgtccacaacccagtgcaatggaatcctcatttttgattatgagtgggcatgggacaaggttcaagacaattattgtcatcaatactgtatagctaagtcaagtaagttgatcaagtcctttcccaggagctttactatcataagaaattgataggaaaatttcctttcctttggctagctgtatggaaatgacttgagagctgtgtttggttcttttcagcttcgatgattgtctattcagtaagagaaacaaagcccaactgcagagaaatagaaaaacacgatttaaacagaaagagaggaacaatgataaaacacaagtcctattaatagattccaaactctcaagttcccaacttcttcaggtccatttagtttcccatctgatgtgtcaataaatagatacacaagctaggaggtattaactgtgccaagatttaactgttcatagggttgaagtaggaaccacaattataaggaagtttaagaaagattgaatattttggtattataaaacacagaaggtaaaaataagcttgtatttaacaagcaagaaggaacatataaaaatggtcaagtatcattcttctggatctgtccctgatgtctcatagtatattcattatgtgaatattcaggtttaacattaccaagtcagtgcaagtaaactgatagtttaacattctacttacgttctacatggttacatttatagcactagccatcctttataaaaatatattgtgcactggtaatggctctacttggaaaatttctttttaatcctagtgtaaaaaagagcttttgtttatagccacatataaaatctaaaaatattcttttacattttgatttagaaaatacaagagaccaagaagtacaaattattgctaagaaccgctgtgaaggattcaacaaagagattgtcatcagccat

SEQ ID NO: 60892 - DNA, 1883 bp, Bovine  19866880612189
taatgctgattgatcaggattacatgtggtgaacaaaaggggataagtggtcaggcatgagtgataatgcctgaaaagaagacagagttaagtagatggttacaagccatggccaagtatgatcagctctaacaaatggagtatagtaacagaagctgaaagttgtaatgaatgtgtgaagaggcgggtcaaaagattcacaggacatttaatacttaaaggcattaacattatgggcataattggaaaaaacaagaggcagcatccattacaggactgttagaggcaaggacaaaagaaacactgaaaggataaaatgaaatttcattttcactgatggtgcttaatcaaaactttggaagcagataaacaactggagaggtttacttaacaatgcttctattctccagtggattaatatgcctctttagttctcaatagtagacaaatggatgctgaaatagctaaagtaaattacatgaatttactatgtccaatgacaatttcttctattctgtgacaatatgtctctttccataattggttcggtgttataattgtaaatgcattatgcaatgtgagatttatgttcactgattattgtatataagttggcaataaaatgatgcatgttacagaggcttgagggtcactattcttcgcaattgtcagtttaaagtttggttcaaatttagctaaataaagttcacagagttaagagaagacaatccactatattgaaatagaatatttacacagacttttccttttttccatttttaaacttattttcttttttcatttagtcttccaagtcctttttcattttagagcagaggttaggttctggaacttcttaagagcagatgcactgctcactgtatgctgtagttgaactggttcttgcttgtcttatagatattaaatacatatctccttttatatttgttaaaacccaacatacagtctcaggcactctatttcttaccaaaatgtatttatgtatttagtatataattagttacatctaacattgtgtgtgtttacgtttgtatgtatatatgtgtgtgtgtgtgtatactggaggagggcatggcaacccacttcagtattcttttctggagaatcccatggacagaggagcctggagggctacacaccatggggtcgaaaagagtcagacacaactgaagtgaccaagtgtgtgtgtgtatatatcgacagatgaatgtttatggaaggtttacattactcatgatcctgcccacctctgttctctattctgtcatgggaagttttaatcatcagccattattatttgatcttttagtctagggcaggacgaaggggaaagaaacagtgacaacccacaaagtatcagacaagtacaacagctcttcaaaagtcatctcatttgatactcacaaccaccttggaagatatatatggtattctccttccttttcagatatggataatatactatttaatacgtaattatggagagtgaaatagctttccttcagtgaggaagccagtaagaagcactaccgaaattctttttctgggcagaatccttcctgacagattttgatcaaaagataagcacccagccaagagaaaccaaaaagtgtggatagtagatgttttgttttgctttccaaataaaggaagactttttagacttggaaacagaggtatgtggaggaaataattatgtcttcaaatttctgctgtttttttaatatgcaaaggaatatcttccgaggacaaggccacagtctccaaatgtaaagttcacaccaagagttttggattattataaaaatgttctaaaaatctagccacacacacttcaactttcttagaaagtaggagcctcc

SEQ ID NO: 60893 - DNA, 932 bp, Bovine  19866880663707
tctctttgtgaaacttgctttgcaaatgcttctggatttcttcatcttcaaagctacggaacttgcacacggaacaagcaaactgaatcctggagaaggaagacaaaacgaaaagcagtgttggagataaccagcttatctctgcatcagagtaacagttactccaagcttctccatattaagaatcagagtacaaagaagaaaaaaaaaaagaatcagagtacaaccttgcaagtatttcaggaaaatgattactgtagcactttactaccataccactttttttggcccaaagaggtggagacttttcagaactgtggattccctaagtctctagcccattgctctgaggacctagaacccaactccatagcttctcagatgtttctttctgcagccacttggaagatacaagacaactgaccccatttagtaccacagaattcctgatgatctcataaaattcaaaactcacatgatctcagttcgccaatgggactcaacggaaggacacatgatacctaaggatgaaaactgaggtttcttcgttgtgtgctttcaaaatctcaccagatacatacatgccgtatgacaaggggagagcaccctacagacagactcccaaacacccagagctgggtgttgcctccctcagctctgctcctcatgggtctaagagcagaggccctgtgccactcaggagtcctcctcggccaaatccgagttctgctggacaagtgccacagacacccttgcctttgcagatacccccgaaagaggagtgaagaggaaaatctcctgggtcctgtgtgcacaactgtcaggaagccaccaaataaatacagggttcccggttctctgctgcatcttgacctcccctgtgacagcttctccaatttttttgaggatcattagtcactaaggcagtctaa

SEQ ID NO: 60894 - DNA, 2152 bp, Bovine  19866880703874
tttttttttaagaacttatatttttaaaaaagggaaaaaaaaaccctccctctaaaaatggtctggctatctaagattcaaatatggatttcaaaatgtatttcaaatatcagaatgtcttataagggtcagtgatgatgaagaaaagcaagtatatagggatggtaggtcttaggaatttatcaggcttagggaaactcaggatatcataaaattaggtcagtagctctgggaagtagtggttattgtacaacttatctcagcagttaggaaaatgctttcaaaatgaatacacagttaagcccacacactagaacttaactgacaagttggcacatataaatggacaccttgcacccacatttagtacatgtttagttccctgaatatattggttcataaactttatattcaagattttattggaccaagcctcaggcatagtctccattcctacttggcattcttgaatgtttgacaagctcatggacagaaaacctctgtgtaagtatttttgacagagatgtagccaaatgaattaggaaacactagagataagatgagaaatagcatcttaaaattatttcattattttcttaaattgaatagccttattttaggcagtggaggagattacagaagagtccaatcattcttgatacacacaggacaaaatgtgttgaaattaattcccagtgattttgtctttttttcaaaaattctgcatattaattcctgtagtaattcttatcttatactttgtggtgcaaagtgtgataagaactttgaatgaaaagtccttggcagtgaagagagggaggagagcacactttttttttctgttaattttagatataagtgaggacagagagaacaagttatgcatgtgatttttatttgtatatatatgcattcctgtatacattcatatatatgaacatgtttatggagaaagatgtaaagacagagaaaaagagaattaattcaggattttgaccatagctctgtcttttcacaaaagaatcatatttgttcttttggcatattataatcttcagatgagtcctaaaagaacaggactgcccatagtatcttagatagccagaccatttttagagggaggtttgtttgtgtgtgttttttttttttcctttttttttaaatataagtttaaaaaaaaaaatacagaatatgaactcaaatgatttgaaaacttatggtcagtgtttttcttctcaggaacctggggaagtgatcacagtgatactatgtgatttttcaagcctctttcatttggtgctagaaagatatcagttcagccgtgtctgactctgtgacccactggactcctctgtctgtgggatttcccatgcaagaattctggagtgggttgccatttccttctccaggggatcttccctacccaggaattgagctcatgtctcttgtgtctcttgaattggcaggcagattctttacaactagcacctcctggaaagcctagatcttagcagatagagactgtataaatattttattctctctgtgtagtgcatttgtgtgtatatatatttaagaaacaaaatataggtaattttaaaggaacaaatgaaccatgatatactgtctctttatgggtcttaagccgcaaaagagttgtcacttctgaactcttgatttgttttagtagagtgtattttaaaatttatcttttaatctctttgctttgactcttgtgtaagagccaaaatataaaaccttcattaaatatctatacaagatcataaaacgtgatatgaatattagtgatattctagtgaatactaggaaattagtcatttcctagtgaatactaggaaaacatatagatttccatttgttttcctagtgtactttaagcatttctttaaacatcttcagatatttttgtaatgaagagacagtgtaaatatattagaatgctataaaggaactatttataatagagttctaacgcaatgctgatcaacttgatattgcaaaacaaaagaaaaaaacagcaaattttggattgaaaacttggctcggtccattattagttataagaccataggcaaatcacttcatctgtctgtccttcactttctttctataaaatcagagataaaaagca

SEQ ID NO: 60895 - DNA, 1126 bp, Bovine  19866880752582
tccctcttaaatttgaagatacatgtttctttcctttgtccaatcctcagtgaaaaccttgccctgcattttcactttgaccttctaacttttgtcaaaataacaatttgtctaggcatttagactaaaacttgcagctcacagtgaatgaatcatcaggctctgtcaacttttttaaatgcaacctaactatcagtgtttatttatctctgtttcagctgccactacttaggtaattgttttataattgttttattggcttcattaaaaagtgatctttttgattcttgtttttttctttatttataaaatgttatgaaagattgttacctaataaatctgaaaacacctctttgtgtataatcagctatacccccaaccatctatgtccaatacaaacaagggaaaattctaccctataattaatttttattacttgaaatccaaaatagaaataataagatgtgttttaaaattcaagagactgtcctttattagctagactactaaaatgatctttattccatcctaacttcttgaaatctatattttcattgtagtcagttcaatttgatctctataccacctttcctgaagtcttaaatcacagtggttattacatcaccatccatggtgtaagtacagaaactctttacaatcaggttttaagtccttacaatataaagggcagactttgatcaaagtttctaagaagccaatataaagaagaaaacatagataaaatttccttatactttatgagctaaatttagtaaatgttcagagtgagcagtcatcttataatctgggagcacatgaaatcaacatcaaggaaaataatgctctaactttcatacaggaaactaacagctttctctcatattttaaaaagcaatatttaaaaagcttttaaacattataaaatgtataactacaaaacacacaaaacattttcagaaataaaagttttttttaaaaaatagaaattaatattttctcttttaagaaatactaatgccaaccactaatactgaagaagctgaagtttaaatatgtcttttgcatcccaggggactggaatgcaaaaggaggaagtaaagagatacatggagtaacaggcaagttt

SEQ ID NO: 60896 - DNA, 1007 bp, Bovine  19866880755128
cccactccagtgttcttgcctggagaatcccatggacagagcagctgggtgggctacagtccacgggtcgcaaagagtcggacatgactgagcaacttcactttcactatggcaataacttagtttcaaatatctacctcttagcatttagttcaagacagtgtacctctcagtggcaattcagctgtgtagcccgatgattaaatatttatgtatatttagttttgttattggtagtacttatcaaagaatatggcttaagaaaaaaaaatagccagactacttgcaaaagataaagccttaaaaatgtcttttaggatttaactgaaaataataatagatgctatacataacatattgcatttatatacatatattcagactcactatgtttaaaaaagtcaatttgttcccattttcacaatttatcctgttttgcattctgattctaatctaaattcagggcaaattccagcatcaaattagattcaaattaatgataatcatagagtcttaattaatggaaaaccactagtatttgcaggttattctaaaaattatattatgtacgtgaagaaactagagtaaaaatgacatttcatattagagacttataacctgttcacagtatagaacaagcagctatgcaactgactggggcataaaaggaaaaatattactgctgaggcattaatttaaagtgtaattagattgttataaattggaaaggaaaataaagtatgaaatagaaatctttattttgctgcactcaaatagggattacaaggcaatttcagataagaggatttcctgtttttatcctacttgaggtcattttatatactttgtgcttctttctttccttttattcttctgtatttactcaggcaaggtcaacagtctgtctggagtgtcctgaagctacccatttattttaaagaaccaatctctgtaatgttaaaatactccctataccatttgggagatatattcctgtctttctcctt

SEQ ID NO: 60897 - DNA, 817 bp, Bovine  19866880865493
aatttctgataaagttaaatacattaaatgttaattttgctgaatatacattttattctctctaaggctgcaaaaattttgcaaccagttcttcctgcactaagacagtcttaaacagtcatctcttttaggtcatcatcaatcttacttttgtcatagtcatgtagaacattatttggctcagaaaaaaaattaatcagaacaaatgatatattctctgtatttattttaccagaagtcttatctcaatttatctacttattcaacagatacttaatgttagccagctagatgacagactccagttgaggcactaaaaacagcagggggatgagattctttctatgatagaacttagtttgtaatatctggcttcttttctagtattttaatgtgtcatggtcaggttgggctaatctgagactgggttgtttatatagaacatatacaatgggacaaacagatgtttatatagaaggagaaattgatctgtagctgttgtacatactgaaaaagaaggtgggtttagaagcagttaagagcattccagtgtcataaagataaaatcttacaaaatcaagacatgggaagagagattcagcagcagtggcacaagctgctgctgctgctaagtcacttcagtcgtctctgactttgtgcgaccccataaacgttagcccaccaggctcccccctccctgggattctccaggcaagaacattggagtgggttgccatttccttctccaatgcatgaaagtgaaaagtcaaagttaagtcgctcagttgtgtccatagcaaccccatggactgcagcc

SEQ ID NO: 60898 - DNA, 795 bp, Bovine  19866880920176
acatcattcattctacttctgaataagtttgaaaattcccatgattacagtcatgaaaatatcaaaatataaaatataggaattgtattgtgtgtcttagcacacatcagtaacaacgccttatacagtgttaggtacaccattcactacagctctccactttgctcctccaaaatacccaactaatagattttctttcactttgggatagcctgctctttctgtagttttccacatcctggagaactatgaagtggaactccggggatatgaagtaataatagtaatgccaaactgatgttgcatcgccatctagaggtcgagattataactgtaaagtcttaatttcaatgagcctctcacatataagctttcaaatctggacatatgtagccactgtggaaagaggtcatttgtttgctattgttttctctccagttgagtttccagatcatactacaaagtaggagccacctgtgtttatagatggcaaggggaagtatatatcatagcaacatgtatcaacagcactatagcatgtttgtaccaaagatgagcctcccacatatcagacaaaccacctacagaaggactgtgacactgacagtgggttttttagcacattcctgataatgaaattcatgttgaactcaacatgagtagcttttcttttttcttggcagtcaacagcctacaccaacctgcatttgactgcttggtttttctctctggctagaataaagggaatagagcagaggatattcttaggatttatgatactatcaatgtattttt

SEQ ID NO: 60899 - DNA, 1898 bp, Bovine  19866880928504
aaaatcatactcatgggcatcttgcatacctaagagagctcattctctccagtaagggaaagaggatcctctaatcacattatcatcttctactaatattttgtacttttctaaatttagatttttgctaaatgtttcattaacttagtaatctttctatttaatgaaaatactgctcactcatatcttattaagcttaaaaagaaaatcaacaggatttaaaaatgcctcatgtatttgccacaaggaaagatatatgcttaacttccttatctaattgtcatattagtccactgctgggaactaggagcaatctgtaatcttgaagtcatgctatttgtcaataattcagagagattttaagaatgtgcatcacaattatttattgctttatctaaagccttccagaatttatctgtagtctatattttatgattctttaagtatgcaaaaagtaagagaggagtccaattccagttcaaattaagctattgcccttggaaagaactgtattattaaagtttggtcatatattttgctatcatgtttggataatatttgtttggctaatgtactttcctccacccatgcactgatcagtctgtagtgattatttaaaaccattctattggtgtttgctggtatgaaaatatttgattcagaacacttaagatttcaacagatgtgtcttccaccttacctttgagagagtcaattcctaggcaggttgataagaagtctgggggtccccaaggagagaggggtctggagttctcaaggaggagatagggttctggaattctcaaggaggaggaaaggacatacattttttttttctcctctatattacttagtcttagtcacataaaacatttttatctttaagccttgaactgatgattacacaacaaacaactcagtttaaactctgcactaaggaatatataacaataatgtatcctgcttgaggacagtttctgaaaaaaaaaccttctggctaatcctgttatcttaaaatgtaaattatgggagtgggtctagtaagatctttataacctccagagattcttttgactcattgtaataactaattagaaagtatataactccattgctaacactagcaagggggcactctttctgtccctttctgatgtctatgtcagaagctttctctatctcttttatgctttaataaaactatattacacaaaagctctgaacaatcaagcctcctctctggctctaaattgaattcttctcctctggaggccaagaatcccagcatctttcatggttcagcaacaacttttcaccattgtcttacttaactgttggctgttgttgttggagcacttaacagtctttgataagaaaataatggttacttatttaagtttccaacatctctgaattgctcttaacacattcaatttacaaaaatctatttgtatccagagaggtcaaaatctgtgttcctgacacacatttaattcactaaaaggtatgataagtgctattcaacaacacttgataagttattttccagtttactgaagtgaggaattttaaaatgcttttatcattttaagaggttttaaaagtatatttatattgttatttatgataaatttggctcagcacatggttgaaaacatctcaaacagcaaaatattcattaatttaataaataggagtctcagatgttcatgatcaaaacaatgttttaaggtgttctggagccaagggaaaaataaatcattgttctgcttgattagttccatttgcttacttcttcagttcactagagtattagtttatgaaatgtctgtggcctgcaattaacagatgccatcattctattttacatgataaaataagtcctatgatatttatgg

SEQ ID NO: 60900 - DNA, 873 bp, Bovine  19866881002630
ttttctactgttgtgttaaatataattttcttataataagtaaagattcttaatatttattcattagacattaaaatctagcatctactctatgatgtgatagtatgaagtctggagttctataaattggtgaaacaaagaaggacactggttctagagctgtatttggtctcagaagggtacccccaagcttatatctgtcataattccttagtgataattcctttgtggaattctgtatcattgtattatgggtaagccatctgaaaaggtatgttcttctctgagtattagaattgcaaattaaaggaaaacatctgcacacaaattgtgccaatcatcagagcatttctgagaaaagacaattttcctatgggcttgctcatcaaatcttcctgagtatgtttgacagtgacatcaggcatttttcatttctactgaattgaaacagaatactgatggataacatttcaattgctcaccccacagaagaaagacatttattacaagttaagataggaagatttcaaagaattctcatgatgtgtgatattctctctgtttcttaaccatttattaaaattttaagtagccgcctatttatatttagagagaatgtcaagttgaatagccgcttacttgttactgggtctcaaatgaaagtagtaggtaaaccactacttttgtgagttcaaatgctagtgggatttatcaaacaaagcaaacaaagcactgacaccagaaacgaagtcctaaaagcttcacaagagcaaaatgtattactgtctcttgaaaagaaatacagctatttttttctaagctgttaagaaaatataaattacatgaaggatgtagcatataaaagccatgtgt

SEQ ID NO: 60901 - DNA, 1342 bp, Bovine  19866881067799
actaatggtatataatgtcattcagaagctctatctagaaggagtagaatttagccagttaaaatccttgattaaggagactagtgagcttatgtttcagatgcaatatagaaagaatagacattcgactagttgagtttacacttcatcaggtttttattttagaattgtatgtttgggtgcatcaataatatctattttctaacaatgattgatttattaaaatacttaaattatattcttaatctagagtattttttaatatatactaatactattactttaatattgaaaacaaattcataattgtcactcattttctcagaatcttagtttaattttactgacagttaccaaaaacaattttttcaatgaagataacatatagggccctattatcatttattttttaggagagcttttagctttatcagtaacttcctatgaagataaaaatgtacttagaaataaaatttcccaaatatgtactacactattcacaatctattgcatttttgaggctgaatcaggcaaagagacatgacccttgctttagagagtaagtcattatttagaagcaaattttttccatttgtttcagcattaggaatagttagcatataaagtgttaacatcttaaataccaatattcttttctgcacagtaaattgcacatgatatatacatgtatattaaagttcacaatcaacagccacaccattctcttgtaatgttgtattctcagcctctgatacactgaaagacagtatgtgcgcaagaagtcttaatttaatgagtaaataaatttaagcatctattttttgacatatgtaaatttagttcatgtatatttttatttgggtatttttaaactatatgattattttgcagaatattgatattttctgaaaattttatggtggaaagattattcctcttattttcatcatgaacataatggtggatatactgaattactttcaacctttttaagcaaattcattgttaacaatataaaattattataagtattaatttgtgtatataaacatcaagtatgtaatactactcagggaaaagagacagaaggacatgtgcccaaaatttaattttccctattattctgtatatatttcccatgtatcttatacttaatatttatggcttcataaaaaaaatccatgttctcataactgccattaaacaaccagtattaagtagttgaaaagtattttttgtaagagaagtgtgtgaagtcattagtagtaccatacactgaattgcttacctagactgttagttaataacggactttttattattagcttcacattataagatt

SEQ ID NO: 60902 - DNA, 1933 bp, Bovine  19866881101876
caattgtggagaattaggatgtaaaggtcaacatggactctttgggcctaagtgctatgtctttttcagtgctactctacatgatcaactaaagacaatgaccagcattactaagattcatatggctgacaacatatattcacagatcatctataataagaggaacaaagatttttgatcccataaaaagacattgaggctgacttatagagtggaagttgtatttctgatgaagacaactggcataatttgtagtttaagaatatttgatcaattgttgaggactgtgtctaataaatacaacatgacctgtatcttatattattattttttaaagctttagtattcagagatatttatactctaaagttaaaaataccttctttctttttctctcagagtataatgatttatatattatatgtatatatataatgattcacacatatctcagagtataataattcacatatttgttcttctagactcttaactttttaagtatacttttaaagtaggcaatatacacacaaatacacttctctcacttataatactattaattgtacttaataatcacagtctgtttcagtcatgtacagtaatgtaatcattatagcttaaaccacccactgagtaaaagtagatagtaccatatctatttgacatactgtattcaacattaatctctctgtttcttagcttagcataaatttgtataccagctgccttcttgtaattaacacgttgggatttaggagcagtagattttgcttgtaacaaactttccatcaagtcgacatctgtgatttatacctccgactcactttcaatatatttacataatcagttcaatttaagccccgattatacattcttcttacatttttataagcagtatccccaaaagatagttaaagagtaaatcaaagtgaagtttaagtttttctcctcttttcctaatcaaaacacttatcataaacatataatcaaattcactgattacttgcatttattttaaagaaaaaatacggacttttattttcataaatgctacataagaccattacaaagatactctgctctaattactatcatcatgataaaattacttgtatgtgtagagacatatttttaatatatttttaagatttagtagaatttggctttacactaatcttttgaaacatgtttacatgtcagtactcccatttaaccactaatgaaactgaggttcaaaaaggttaaatgactgcattagcagggtggaactttcaagatcatcagttttatggtttgtttttgaaagtacttcagagtagactccaggtctttccttccaattaaggaatttttccattctaacacattgtcactaaagataggtaattgtaaaacttgaaaatattttcaaattattacacaaatatgtcatttaaaatatttttcagataaatctggtgttttctaagattctttaatcacagtataattaacatctgttttatatattacatattagaatcataatatttcttctgaaagattctagcttaggcaaattatagcttataaggtatcattatgaaaaattctagaagacatatttgacattgctagtatgcttatttggttgtcatatatcactggaaataagatgtacataattacaaagactgtcttaaacaaagaatattgctcatgttttcaagttttacttcaatgtaaatagctgataaattgtcaactaaattttacttatgtgagaaatatggtatgttaaattgcttttgcctaattcttgtctgcccttcattttttgtagactataatgacacttcattagcaaattttaatatgaatatgatgaattaacaattaaaatattttataaatattagaataaattttagaagaataaaattattaaaaa

SEQ ID NO: 60903 - DNA, 872 bp, Bovine  19866881101935
gatatcaatgacaattgaacaggcagttatgttctttgtaagcaatacttttactgaaagtgctattataatttcacttagaaaatcatagttagcatgatgtgttcaactatttcaaagtattaattgcttatttattctatgaaatatgtatcatatgacttttcatcatagtctcaggtcatctgtaggatataaaaggatatatatttgttatctttaacgatactctgctacatacagggttctacaacatatgactaatgtatcctagaagaaaattggcccagtatttatagaaatctatgtttgtctcagctagattatgatagaatcacattatatttttcactatgtttagggtagtatgtttttcaataaagtggaaaatgtcaaaccatatattagaaaatacataattatacatgacatttctgtttgggctgtcaggtgcgttgtgttaatcttctaagaagttttcattgataaattgtttcatttttgttattaattaataagaaaaaggaggataagagtttcccaatatactgataatcaaaaaaaaattgtgcaataaactgtcaagtagtcttacagaacatgtctggagtctaaaagattatgccttgggcttagacaagtcaatatagaatcacctagaaatcagagcacttataaaagtagagccctgataagaggggcaaaggcaaatgctctaaaaccattgttcaattaaagaaacagcaaacatattcaatgttttaagcattgaatttcaatcattctactagccttatccacatggccagtgaattttcaacagaggctctacagtttgaactagtttgaaatggactttttttcttttgatg

SEQ ID NO: 60904 - DNA, 1009 bp, Bovine  19866881152108
ttaaatttagataaaataatgcaccaaggaagaagttattatactatgatgaaaatgtcgtatccatattgaaaattgaagaaataaagggctgacatttagaatatattaatttcagagtattataattcagcattatatatacgtatcacatgcatgagccaaagagaaattttacactttaaactgtatagtaagatgttgtgtattgccaacttcaaggcaacataggggctatatggattgccccagaagagtgagttttagaatttttatctgcttgttattgtttttgactcttacttttaccttatctaagttgcatcatttaagaaaacaactgattttacacaaaaatctggattactaaaatcttctttcaaaatatcaaaagatttagcaattctgggcccaccttcaagtaaagttcagctgtggctaagcaactactgcatgttatttttagtttactgtagtatcttccatgacctattactttaaactctcttttgcttctgtctctggtttgtttgccagactgtttaactcactttatttgatctacatagatatttaagctgcaaactttatcaagtgaaatttttacttaaaggtactcctaggagagaatgcaaaactgttgtattttaatagtatactctgcaaggtttcatattatcactgaaaaagataaactaattcaaatctaatttcaaatgacaacataaaatctaattaactgattaaattaggaagataacattggcaagaatagccccctccaaattatttttttgttgatatttttgtctctacttcacaaagtactgtttatagcctaacttttttttgcattagtgtttctatacagctcaaaatgtgaagttttgttgccagtctcaccagggaaataaacccattgtgtgtggaattacattttctaaactatgctttagcaaactaataaggatctctgttcagaaaatagaatgtgcttgtcctatgaatc

SEQ ID NO: 60905 - DNA, 927 bp, Bovine  19866881152330
tgagtttttctagcctacaaattgattgctgatgtgtatttttatattgctgcaaaaattcaataataatcatccttctttgctgtattgatgcctatgccatttccgaattcacatatatttttatcgtaagtgtatagaaacaggaaaagcccagcagcaatactaaatttttaacagctatttcactactcatttacaaacgtattacatttcttgtgttctacatgattaaaaattatgactatatccttgaataaacaaagtaaataagtaaagaggatgtgtcacctgtcagtgacacgaaacaaagtcaagggcacactcatgatgcatgtagaagtcaatatgatctgatggtctcccagtgagatgcatgtgaagtccatactaattaacctataaatcagactgatgcttgagtttatttgggccagaaagactacctactgtcaagcaatcaagcaatacctctttaattgcaatttattccaacaaccacactttattgatcctagcatacacttatgccacagcagtatcattattcaactttattttaacagcttcgaaaggttagaaagttagaaaccacagtgaaagagaccattaacatgttgagttgctaacattgcttcatgctctatgttgagcaatgtcaactatatttatgaaattgtatgataagacaaggaaaagggactaatatttaataggcacctaaaatacctattgtttttttataataaatattactttttagtcaccaaaaaaagcaaacacaacaaaaagcacataaaatcagggaggatcaatattgttatttgcattttacagataagttgcagtttagaaagtgtgttagtcactcagtcatgatcgatgttttgtgaccccatggtctgtccatggaattctctaggcaag

SEQ ID NO: 60906 - DNA, 1510 bp, Bovine  19866881238767
tccaggtcacttaatcaactgtgatcacttctcaatttggatatcaatattttagcccttcttccattcagtcattgaaatgttacatgtttttctttttttctgttttgtgccctttttattgaattataattagtatacaattttatattaatttcaggtattcaacatagtaattcaatatttttatacattatgaaattatctacacaataagtccagctaccatctgtcaccatacaaagttatattattgcctatattccctctgccgtgtattacatctccatgacttatattatagctcaaagtttgtgcctcttaatcccagcctagtttgtcagtcctccagaaatggtgcagctactgtggaaaacagtatggtgtttcctgaaaaaattaaaaatagattttccaactctgtagcccgccaggctcctctgtccaaggattttccagggaagaattctggagtggtttgctttgccctcctgcagggaatcttcccaacctagggatcaaacctgcatctcaggtctcatgcattggcagatgggttctttaccagcggtcccacctggaaagcaccactgttaccatatgatctaccaattccacttctggatatttacttgaagaaaattaaaatgcttaattcaaacaaacatgtggttaccaaaggggaaagtggaatagagtgatacattgagtgtttggaattaacacatattactgtatataaaatagataaccagaaagaacctactgtataacacagggaactagattcaatattttataaaaacctataggggaaagaaatctgaaaaagaatggatttatagcctgtatatatatagctgaatcactatgctgtaaacctgaaacttctacaacatggtaaataaactatacttcaattaaaaaaagaaccaatataagtttttttaaaaaaaaaaagctatatgtattcctatgttcttttcaacactatttacaatagccaatgtatggaggcaacctaaccattcatggatggacgagtggacatagaagatgtagtatcttttaataccttaacctagattttcagctctttctctttctcttcttcaaacctccaaaggctacataaaactttttaaactaatttaacacttccaagatgcaaaaaacaccttgaaactgaaactgacaaagtgaatcacattcttctcccaattaagatccacagaggcagagacactcacacatatgatatatatacacaaacacagctgggctgatttacctacattctaacttcacttttcaaatttctcttagtcccgaacgtgcatggcctttggtgttctgtgaatatcgaaaagtacttctgttacacattctcttgctaaagaacttaaattcacaacacaaatttttatttaattctaacttaagaaatgaagatgatattccttgaagaagcaaacaataacttaatataaccccacagtttacatgtcta

SEQ ID NO: 60907 - DNA, 1145 bp, Bovine  19866881258649
aggagcctggcagtctatagtccaggggaccacaaaagagtcagacaggatttagcaactaaacaaaagtataatgatcattaaaaaggatgtaataggaacacacagaactttcctggttctctatgttttgtttgtttgtttacatttcagcttctgtggaatacttctaagttgctcctcatggaataaacctgcccaaacagattagctctgaagtgaaataaaaaacatgaaggcaaggtattataaaagtacaaacataaaatttcttccctgcttggtaaaatccctttagggtattgcaatgttagtattatttttcctccctttttcttttatcaactggaaaggtagtttcactttctgctattatagcatcatgccctctagtcacatggacactagaataacaaaaacagaaagtgtattctttcttttgtctccatcctttgacaaagtttgccaataagcataccttctaactaaaagaaaacagaagaaaaaactctccatttgttcatttctgctttttctgagatatcacagcagcatgggcaaaattgactatactgctgaacaatgtatggcacaaaagttttactctttagtatgaaaaacatatgaatattttttccaaatatatgacaagaaacaaaaaattttgcatcgatgtaactagctctacacaaaaaaactcttgttatcgtaacaacttcattattcacttgatttaatagtcaaggcaattgatttttttgaggtacaattcctgtatttatactttgagggatgtaaataaaaaaataagtaaaatgtgtgaaagactgtgatgtaaatactaaaaattataaatatcaagcagcacacatagaaatcaatacataaaattgattgaaaaataataagaaaatagcagtatttgttatgatggagtagtgacagattagatttttgcacataagctcctaattgttaataactataaaatgcacaaatgcatgtttttgaagacatcagaggtacaccaaaacatccacagtttaaggggtgagaatcacaaaaagaagagaagaatattgaaacagatgcaaacaattcaatgcttttccccaccaaacatttactatttttgaaagtagcaa

SEQ ID NO: 60908 - DNA, 861 bp, Bovine  19866881279544
ttagattcttgagagaaataaggatatttccagtagttgtttgatgtgctctagttgtttaaactatggctatatacatatatccattgtaattaaagttcaaagtctaagtgaatgaaaccaagatgcagcttaatggcaaagctgaagcttgcttgcatgggccagtctaaatttttctactaatctccactctgtcaaggtttttatagccattttctcagatgaagttttatccctgttttctttctttttttttcctctcgcatgcggcatagagatgggagataaattttgtgtcatcttttgatgctttaaattatgcacagagcctgagaaacatgggagctagaggtaactgagaatgtaaataggaatgaaaaggctagaatgatctggaagagatatttaggttgctacaaccagaggagaatacaaaaaggggacaaagttcattggtcagtgcattattccctcattgattttccctgccagttcctttcagctcattgatttccattgctgattgagtcatgttcatctgctgttaggaggtcacctcatttctcttttgcttattttttctgcctactcagcactcctgcacatgtgtgtgtcactatcactaatctcaattgtctgctgtcagaagagtgatatactttttgcacaatgggccatgagattcagggtgggtgtttcaggcagccattgcataaacttaaccagagtatactcacagattcccttgtacactgcattcattatggggttttactcctttatatcagatttaaaggcgtgcaatgtgtatggttcacagttgtcatacacagtacacccgaagactggtaggaggaa

SEQ ID NO: 60909 - DNA, 1732 bp, Bovine  19866881337698
aacaaaagcttgtagagagctgcctataggaccattactagcaccaaccaaaccaatgcccaagcacttactgtgagccagggagtgtgctaataagtaaaagttgtacttcttttaatacaacaacattcattttaatacattataatccacatctgtaagatgtggatagctagtctcatagttattgagtaatgtattcaaaatcacgcaacttataattggcagagccagagacagaaacatagagatcccagcttaaaataccatgtgtaagtataccctgtcatgcacatttctgtagaagatgttagttctgaatggtttgatgaaccagatgggaaaagatagctttcactggaaatgttgggtgtgtaacaaattcataaacacttgaaggtgaatggtaatatagtgaacattttcagtattctatgtggaagttggctagaaatctgtttcctgtagtgcttaaaagtagatctaaattcaattgacattttcataagctctcttgtagagttatgttttatgtatatattctttctctgcaagaactatctggcctaattaagggcacaggtcattcatttccctttgctttgtaccatgtagctccttgatttacactcttgctacaggaggttatagaaattagttcatgccatgctctacaatatagaatgtgagagagaaaatgaatgtcaagtacttatgctctgcaggcttcaaaatcatatcggaattcaaggtacaatgatgtaggcaacattcatatatacagatcctattataatgcttttgatcaaaatctgattgaacagagaaatactgatcctgagctttatgatctagggtactagaaaatgtagtcttaaatatcctaattgatttttttaaaagaacgtactgtattttttttattttaccagcacctgcacatcacataatgactcttgtttttataattgaatttgctattgttttgcttctttatacacttaagcacagaaggtggatgagtattaatgagatatttttgaagtagctttatatatttcatggaataaatagtatgagagacaggatgttagtaccaaacacatgtaatgatttgtgattcaactgaaattttcaaagtttatttcatcaactcttctaatatgtattaactttaatcaatttccattgttgtgaaatttgaaaggatgaaaataataatacctaattgttgtagttgttgttcagtcactaagtcatgttgcaaccccatgtactgcagcacaccaggcttccctgtgcttcactatctcccagagttgctaaaacccatgtccattcagttcagttcagttcagtcgctcagtcgtgtctgaccctttgcgaccccatggactgcagcacaccaggcctccctgtccatcaccaactcccagagtttattcaaactcatgtccattgagtcggtgatgccatccaatcatctcatcctctgttgtccccttttcctgccttcgatcttcccagcatccagctcttttctaatgacaactctttcctccaggtggccaaatagtggagcttcagcttcaacatcagtccttccaatgaatattcagaactgatttcctttaggattggctgggtttgatctccttgctgtccaagggactctcaagagtcttctccaacaccccagttcaaaagcatcaattctttggcgcacaacttt

SEQ ID NO: 60910 - DNA, 982 bp, Bovine  19866881623951
taagtcatctgatttgagtattcccatgaagcaaattaatgatattcactggaatttagagaatattcccattattttaaacatgttctcatttggtttgcacaccagtgattctattaacccacaaaaatttcatttgtgatatttaattaaacaggattaagacatgtgatttagatatataaaaaatatgaattttagatcctttttaaatggcttgagattagtactctttccttgcctaaaaattggcaatccagtaaataaatcaagaattcatatattttagcaactttgcctttatagtaatattagatagtttttaaattatgctcctcgctcttttcccctttcttacaaaatgttttcattgccaactactgttacaatagcctattaagattagcttggctatgctattagtacaaatatttaatttgatgtattctttgcagactaggcaaggaatgggtgtattaaaagactatacttaaaggcatatttatacacacacacacacacacacacatatatatatacatatatatgtatatgtctccttttaatacttgtggagaaatactatagctcccagtcctactagtgtattgatttttgtgtattcaatttaaaaaaaaatcatgtgtgacctagctgcaaaaatgcagtccactttggttcagattactttcctgcatgactcacgtcctatggacttggaagggaatgactacacagagataaagagtattggaaatgtgccaattgactattctctgtgtagtcttaggggaaatgatggcaacagcaggctgtagaggacattatttgtcttaaactttattgtattggctggtgattagagctctggtgtcagactttctgggttgtgaatactgactgtattgtttcttaggtatgtgacttcaagaaagtgaatttccatctctgtattcagtttctgcacggaagaatttacatc

SEQ ID NO: 60911 - DNA, 654 bp, Bovine  19866881790473
ctcctttgtagctctgtcacacttaaaattaaatctggggactgactttctgcagagtgccctgtactcagagatattaagagtctgcataaatgaagccatggaggccctctggctttcacagagtgcctcaagttggcaactggctgttctaagcctatcattttctctttcaaaacttccaatatcattaacaaaagccagcccaatccacagtccctataattatcattgtccccatatcgtataagcaatacagccactgcacatcctaaagtcttatcttccacctgcaccttatcccaattaaccacaagggaaagtcttagtaatcgtgatgtcatggcattcctgagctaatcaccatccctctcagcactagcaatgggatttttattgctgtgagaatggtcagtaatgcagttttcaatttatttccctaagggtccactttctggggccatttctgataccaactgttttagactaagttttttagaaacagagcctgaaacaaagtcttacgtgttaagactgtattcaagagtatgatcctagggagcaaaggtgagagcaaagggaagtaagacagagaaacagggaaagctgataagtggtgcactcccaggctgaccactacatgatattgtgtga

SEQ ID NO: 60912 - DNA, 600 bp, Bovine  19866881833049
tctttgcatgaggtggccaaagtactggagtttagctttagcatcagtccttccaaagaacacccagggctgatctcctttagaatggactggttggatctccttgcagtctgaggggctctcaagagtcttctccaacacgacagttcaaaggcatcaattcttcagtgctcagctttcttcacactccaactctcacatccatgcatgagcactggaaaaaacatagccttgactagatggacctttgttggcaaagtaatgtctctgcttttgaattcttagtcaaattagaatacattttcaacaacaaacagaatattctatacatcataattttaaaaattactcaaaattttttttcagttctaaatctacacaaaatggcaaggttatttcatctttatagattcagaatcagtcataaatatgaatcacaatgctttttcatgacttttgggagaaaccattttaagttataaaaatagaatctgagtaaaaatgtcattcatgtcaacatttggcttataggctcacactctgtcttctcaacatttctgtttttattggcaataaaagaagagagtttaaatataaaag

SEQ ID NO: 60913 - DNA, 1398 bp, Bovine  19866880404317
gtaactaaaacagatttaagatataaagggtattattacctgtaagatgagaaggaccaggaaatagaaattggccgctctcttaaactgctcaaacaaattcattggtagaaaggtcaacgcattgtacttgtatgttttaattgcgttattctgttggaaaaaatgagaaaatcattctaaacggtcccacatttaccacaatacacgatgtatgaagtgaaagtgaaaggcgcccagtcgtgtctgactctttgtgaccccatggactatacagtccatggaattctccaggccagaatactggagtgggttgccacactctcccccaggggatcttagcaacccagggatcgaacccaggtctcctgcattgcaggcggattctttaccagttgagccaccagggaagtccaagaatactggagtgggtagcttatcccttctccaggggatctttccgacccaggaatctaaccggggtctcctgcactgcaggcggattctttaccagctgagctaccagcgaagcccagacaaaaatcagccctgtggcctacaggcacacaaggctataatttgtttgaaagatactgagattttctttaagtttttacttctaactgggcctcaaaatgacgccttggaggcttatgtcagagtcacaagacacagagatttcacctcaaaggtctctgtggcaactctcactgtgaccaaacagatcctgctgttgggttccttgatccttagagcctcttagaaaacagggcaaagatgaggagaaaatgagacgtgtcaacatgggtgggaaaggaacattcttgtaagaacaatggagggtgtataagagtaaaagacacaggtgttggttgaactgtgtgccccccaaagatacagtcaaattctgaccctgtgacctgcgatggtcagcttactggcttggccaataagttcgtttgggtttccccatcagatgggacagaaaaatccaaacaaacttcttggccaaccaaatattagaaatatggtctttgccaaggtgatcaagttacagtgaggtcatgctggattaaggtggattaaggcctaatccagtgattaggcctgctggcctttgtagaggaaaattgggcacagagaaacatacagggagacagagactggagtggtgtgtggctaaggatcaccaaggtctgttagccagaaaccaaggagaaatctgcagcagtccctcccgcggatcccccagaaggaatcagcccactgacaccttgattttagactttgggccttttcaaattgtaagagaataaatttctgttgtcttacaccacccagtgggtggtattctgtggagtagtcccaggaatctaacagacaacatttcagcccaga

SEQ ID NO: 60914 - DNA, 1730 bp, Bovine  19866880457945
ccccccagagttcccgaggaggacgccgcagcgggccggcccggcttccacgggagccggcgccccggtaagtgagcctgcgatacccgtatgtccccacgaggaaggggccgattctagcccagcaggcgtattctgcagcggaattaaaataaacaacatcctcctcccttcagggactttccctgctttgggccagagtaacttcgtgtgtttggccgggttctgggtccacgatttgtggtcccgcctttggtagaagtccatgaaactagttagccgattttagaaaatatcgtagccttaggtcttcaaagtctcataactctgttttgaaaaatccagacaaccctttcccccgtttccctcccttctcaataaaagactttttaagatgtcattactttttgagttaatgtgcagtgccccagcgtgttgacgttggaaatgcgttaaaaagctgcttgcagatacaagctgtgaggacactcgcgtttaaaaaataatcctttctaatccaggtgagagaatctcgggttaaatgtgtctggttgcttcataattaagcatatgtcaagttggacccattcttcctcatggccttttagctgtacagggccggccctggttgtataacgtattgtctttgtgggtttgttgggttttttttttttttgtcccattaagttatagtgaacaaaggtagccacagttgtgggccgggaggaaatgtgtctttgaagcagattggcctgtgaggccaaggtgaggggaaactgctgggggcttgttaatggtcagaccgtgcacccctgcaattgaacactgcccactcgagtgtctaagctgggctgctgtacatagaatagttaagtgcccagcctccagctgtggaaacggaagcccagcaacagattttggccttcattgctcctgtgttcttgctctctccctttcagtgaaatggagtacagacagacagctgctaactccaccaggcaaatgatgactctgcagctttcatagtaggtcatgggatgcaaagtttcaccagttagctttcttttactactaatcactagccacgtgctttatttttttccaaaggacgagctccttgtattctgagttggggttgttttccttgaatttcctccgacggctggatttcaggatatggcagtgaaatgtctgggagactttgtgtttggtttcagttgggaattacgacttttcaaagtggatgactgagtttggctgtggaaccatatcatcttttattattttgtgtcgagaaatacttttggccgtatgagtaagttttatcactgatccattgttgtctttcagtattttgaaggcatataatcaggtgctaaatgtcaatatatttttcttgttaatataactttataactgttaatgtaaccgtttcttcttcttttcccttttatacacccttttcttttattatctctagccctttcattagaaaatgctgtatttttggtctgaaccaataccgtttttatacagtggtacatatttcaacaaaattctgataatagcatctaaccttcatcccaagaaagtaccatcacgacaggtgtagacttctttgggcagcatattttcatgctgaatttggaccacctgccacgtgaatattgacaacatggatatcctgagttttgacaacttatcagacttttaaatcattttgcagttag

SEQ ID NO: 60915 - DNA, 1966 bp, Bovine  19866880468627
ccctcgccctgttgtttttctgattaaggagacagaattgagtagtctaaatttagtctgtacagcctggaggtgccagtcatggcaaataatgaattaggggatctccttccgcccccttctgcgttgaagcattgagctgaaaccaacaaattcattttatttaggaccacaggctgaactcttgagtgttggctgtgacaagagaatgctttcttcactaattaagtcacctgagctcagacaagccctctctccatgtgatgggggtgctgcttatctgagttgcccagagactgtgccttctgtttgttaaggaaagtggttattattttgctacagatatttaaaccagaaaaatgcatttatatatacatacatacatgtatatatacatagaaatatatacataatatataaaaatctcatatagttttttaagttcatttagccttttaaagattttctggattccttagtaaacccatatttagaattcacagtttctgatgtaagggttgtattttccaatcagttttgaaaaggacaaatacaaagcatattttatctgctttcatttcaaaagaacataaaaatttgctcactgaaaagctgttatatttgatgtttataagaaataagccatagattagaaataacaaatgtcatgaagttgtctttggggaaaaataatcaagttctgtttccatttgtaacctatgagtcttaatatgtgtatcgggggggtttatacatgaacataattttgaatgagtttttttaaaagtcagtaaaaataaaaatataagatgtgaggaaaatgtatgaaatggtgcattcattttttaaaaaatgttattatgttgatacacttaataaagcatgttttgctagctcctttcttatttctggcaagacacaaattgaactcgccccagtgttgattatgtgagatttggcacctttatgccttgtcactaatcattggcatttccctgggaggggccagaaggccctccttatcttcactgagcaggtggggcccagtaccagggatggagaagtgacttatccagagcctcccagaagtagctgaactgttaaaaacccttgaacttttctagctctctggccttgttcatactttctctagcacagcatttcaaaatgtagagactttttgtgtagttgatttaaaagcaataggtttagactttaggtagaagtctttaggttgacttctctggtggcttagacggtaaagcatctgtctacaatgtgggagacctggatttgagccctgggttgggaagatcccctggagaagcaaatggcaatccactccagtactattgcctggaaaatcccatggacagaggagcctggtaggctacagtctatggggtcgcaaagagtcagacacgactgagcgaattcacttcacttcactttaggtagaagagtatattatctacaaaaaccaccttaataaaattaaaaaaaaaaagaataaatttaagaaaaaaaagtctttaaaaatatttacttatttattaatacttggctgtgctgggtcttagttgtggaatgcaatcagtcttcattggagcatgcgggatctttagttgaagcgtgtgggatctaagtccttgaccagggatcaaacccaggctctctgtattgggaaagtggagtctcagccactggaccaccaaggaagtccaagatcacctctttaaagggcaaactaaagtgtgttagtcattcagtcatgtccgactctttgctatcccatggactgtagccctccagactcctctgtccatggaattctccaggcaagaatactgcagtgagttatcatttccttctccaaaaggccaaactaaactcatgtaatttttgtcctaagaaggaaagttagccaagcatataggaaagcagtgtccacttctcaggaacatct

SEQ ID NO: 60916 - DNA, 2866 bp, Bovine  19866880598829
tatttccttaggataattctaagactggaatagttgtccagaaaatctctaaagatggagttctgttgccaccgcttgtatcaggaactagtagtaacatgtcagcatttacattttcatatactttttccatttcttgaccttttggctaagatcaagtgtggtatgggggctttccaggcggcacaatggtaaagaacccgcctgccaatgcaggagacgcaggagatgcaggctcaatccccgggtcaggaagagtccctggagaaggaaaatggcaacccactccagtattcttgcctgaaaaatcccatggagagaggaacctggtgagctatagtccatagggctgcaaagagtcagactctactgagtgactgagcacaaacacacatgcctgtttttttttcttttttaatcaaatttagacaaacattttcaaggagcaactggaataaactctattgattttatttctttcaatttagcaatttattatataataggtactcaatgtataacttttaattgatctaagaaatatatttaaagaatttaaaagctctttctctgacgctatcctagttaactttctctttcaagtactcaagtatcaaaaacaaaaaataacaagtgttggtatgagggagagatggattgaaagtttgggattagcggatgcaaactattatatatagaatggataaacaagatcccaccatatagcacagggaactatattcaatatcctgtgagaagtcataatggaaaagaatatgaaaaataatatacatatatattgaatatattagaacgtatattcaatatacattgaatatattagaacgtatattcaatatacattgaatatattagaatgcatatatagaatgtacttttttttataaaaagtactcagttcttcatatcctctggcaaaaggagaagaaatttaaattggtttcaggtaaaaatctccttacaggataagcagcccaaagcataaccaaagtaccatgtttggaggtgtttcttgaacatctactcctccaagccatgtagtgtgctaagggacacagtgtcgaataggaagtcatgaaccttcatgaagtgtatggtttagctcagtggttcggtaacttgaagtggcatcgggctcccctggagggcttactaggcccagtgtttggagtttttgatttaggagatctaggctgggagctgagaacatgcacttctagccaatgcctgggtgatgctcatatggttggtccagggacctcactttgcaaagctttagtgtaagtgggggcttcccaggaggtggtagtggtaaagaacccacataccaatgcaggaaacgtgacagacttgtgttcgatccctgggtcaggaggattcactggaggaaggcatggcaacccactccagtattgttgcctggagaatccccatggacagaggagtctggtgggctacagtccatggggtcgcaaagcatcggacacgactgaagggacttagcacgcacacacagtataaagggagagacgtacaggaaaatcagtgacttcaatcaagggtgctaggtggtatgacggggatccacttagcatgcataccaggagggacacctacctgtccgaggagggctccagaaagcttttcccagaggagatgctatgggaactgacatccaatctgaaacccacaggacaggggggagtgaatcaggtgaaggggagggaaagcgcattccaggcagagggcacagtgtctgcaaagatctagcggtaaggatgcacacagcccgatggtggaacggaagtctatccatgtgatgagaaatcaccagatgacggggaaagtgatgagcaagaaagtgagaggtgagcagataataaaagtcattaggagcctagagcttatcctcagagcagtgcggagccttaggagggctttcagtattaaagctcagaggactaagggtagaaaagcacttcccaaggaggcttacttccagcagagacactgcccaaggggttgcctctgatttttggttcatcccacccctaagggaactcgagttcctcagaaagccggctgctgcctgagttacaggccgtttctgataggaactgtccaagcccagggcgagatcccacatggacatgtgagggtatttacacgctattaactcaaaccgaattaaaagccagttcctcagtcagttgcacgagccacatttcaatgcccagtagctatgtgtgtctagtgactagataaaggacattttcatcaccacaggaagctcgatgagacacactagtctgggagattaggcaggacgggatccagagcttgccagaaacttggatttattgtaggaaaccagtacacaactggtttgagccttcattcatgaaaacacacacacatacagctctaaattgattttttttttaaatcacagagtaaaaacttagacaatcggcagttcttagtaatatatattcaagctataaatacccatatcacttccataagaagagacaaggaaacttttttcctgagtcactaagaagaatcctagaatcacacgtattccccaaatccgttttgaaatcctcagagtcattggccaagggaactgaagggctgataacatgccctagattaaaattctaaaaggctgtttttactgcttatgtgtcaaaaaaatcaagctttcacagctttttctctattgtgtattttacctaattcaattcacccgattcttaatattacattgctaatccttactctaagttctaaaaataaaaggcaagaggcattgcctgccaagttggtaaaaaatcccaag

SEQ ID NO: 60917 - DNA, 1465 bp, Bovine  19866880721910
tcctattgttgacttccttgtccttttatggcgcgccttgagaggagggatggggaaaggttattttaatcatctcaaaacggccagtataaatgccactagaaaataacgcttgcagcggtgaggaggcggttgcatgagcagtccttaccacatcatccacaaggtctttgacggccgtgacgcccagcaccacaagtaagggcaccagcgtggtgtaccatgccagggtcgagatttgggggattgcctgaaagagattgaaaaatggcagacatgggtgcccaggaggacacggcagagctacaggcaaccgctaaggttaagtctaatcgccaccatcatccagctggcatcctgtgtagcaggcatggaaaggtgccaaagcacccagctaacccttctcctgcctctctctctagcttctggcttcctggaacagagcctagagacagagacacgttacagaaaaacccacacgaacttttcggccaacccaatactaatctcgcagactacaagaattacgtgaaggaacagtgcaaggaaagggctaaggctgttaccagtacccgcacctggatcgctgtgccttcaggaaagataatcaaggtgtggggagatgggggggaggaagttcatgttccacgttactgtgactataaggcagaacgccccttttccttctggaaggaaggaagggaaagtggcccactcgtcatgcagcagcactgtaaacttggcagtgtttctctctacacgagcctgtctctaaggccctgctcgataagaccacgccttatgatcaagtcagcaggtctcagattcctctaaacctgttgagggtctagctctccctcctgagtcttccctccacccatgcgtctgccatctccactcagacacacaggttacagtttcccaaaactatactgggcgaatcccagcaggtgagactattctccaaatcaaacgcttgacataaagaatctgatgaaaccaagtggagatgccatcctttgtaaccagcacttcaagtgctaaaggtggaaactctgagtggcaactagaggctatatagtttctttgatcgtaaaacagttcctagacagataaaagtaatgctctctagattaagtggacttcttgccccaagtaggaggaaaaaaaggcctttccagtgtaaaaccagatcagaaaaataattatgagaattgtgagcaaaatcctaataaaaatcaataaccttttggcaactaaataaaaaataaaagccaagcataaaaaatagatttaattttaaggtacaactgtttcacaaagtgaacatttgaacctgactcactttaggaaaaccagttttaacaatgacatcaatatgttttaactgacatcagtatgaaactgaactttttaaaatacagaattaaaataacatccgcatttgctcaggttcataacactg

SEQ ID NO: 60918 - DNA, 913 bp, Bovine  19866880741827
ttgtggtgggattggttcctgggaaagaaaacaaagatgacatattaagcagcagagggagcccatggggtcctcccaagagactagaaacactggtaaaagagactcccagagtccctgtaaggaacctgtactagtgaatatctggttcggggtgactggacttgcctggtaagtaatgcgattgcacagtggagcggctgtcttggtgtttcttgctgccagtgttgggcaccgagatggctatatattccacattgtgtggcttctacatacaaggctttcgatgggggtattagggagggttggaatttctactatctatacgttccagagagaaacgtcttttagtaaaaccttggtgtttaaggaagttttcgatgtgggtgttacgttacttttgaattattgggcagaggttggaaagatctactaaaatgttgacagtagttagtggttactccaggtcatgggattatagtttattttctagcttgtgcttttctgttttttaaacagtgtgtgtgtgtgagtgaattactctgaaagaaatattaaatctgtcaatatgaaattcaattactgggtctttgtgtttagaagggtaggctggtaaagatagcttcttagaaatataagcttactgaaaatgttgccacgagtgaggccccctcgccctgtacactttctgtctccttctccctccctctcttcctccccgccctgtttaaaactaggctccggggggccacgagctgagctgcgacttctgggagctgatcgggttggcccccgccggaggtgctgacaacttgatcaacgaggagtccgacgtggacgtccagctcaacaacagacacatgatgatccgcggggagaacatgtccaaaatcctaaggcgcgctccgtcatc

SEQ ID NO: 60919 - DNA, 3253 bp, Bovine  19866880774770
cttagcacacatgcgtgccactctaatcagtggtctgaaccttttctaccggctccttaccttcatgagtagcatgttgccatcataacatgcagtgattctcttgagggatcatatgaaaaccggcagccaaagcagggagaggaggcttccaagaaggttgcgtgcaggcagctgtgatacgccatcccaggggacaccacccccatcccctcagacggggcttaagagcctgcacccacctgcagagaaatgctggggaaatcgcctctgctgtagcatccctttaaatgttaaatccaggaattatgctctgagggtctcttcaaaagaaattactttccagctagatttcatgctgccactttaattttgtcacagtgctgtacggcggctcaagggcctgtcagccacggaggtgccagtcaggtgcggccacagcggcggccgccacggaaaccgcccagcgtgccagaagccccaagcctcaggctcagccggggaacaggtatgagtctgactttacatactaatcaggatttccttttttctgacgtaaacaccagtggataccagctacctaggaggagaggtattgggaaaacccagtatgtaagaagtggtatgttattttcttggcttcctttcaaaagctgttaaactatagatttcacctccaattaaggctttacaagttgttttgaattttgatagattttttccattttttaaaaattaaacttttttgcccagcttcattgagatctgcttgacaaataaaaatcccacagggcttttgttaaaggacacagagttgtgtgcagtctgcaaatcaggcgggaacttagttctggaacacgtcatgtaacagagattatgtgtatgctggaaatgtgtttatgaacctaacataattatacttatgaaatacatgtcctgtgcagggaaaagaataactaatctaccacaaatttctgtagtaaactgtcaaacccattgaacataattataaacaacatgataggatttacagtttatcaaagaacaaagcacgtcccctccctcgcctctgctgtttgcagcttggacgtcagcaggcctggcgttgctgccgagtatccttttcaatatcagaagccacagctgttttcaagtctccctctggtacagaggcattagaagactataacgggcactttttagacaagtacacagatggaagtagcacacttgaacactgggcaagagagaaagaaagtagctgtgagccattaactccctgacctttctggtagaccagttgttctgccggagttctatagctttgaaaataaaacagttttattttgtgtttgttactttttgtcgcgtgtgaccctgggcatgatgattgagcatctgcagggaactgagatttgttggggatcgggcaccagggtggggcccaagtcaactccttttgactcttgggcgtcctaaaagagcacccatggggaggaagaccggaagcacagatgctgtctgtgtcctggggcaggcccagcaggaagccatttctccccccgtcctgcccctcttttctcatcccagccatagtacagagtgctttaaatatttagggtttggtgtaacctgaagaactgattggatgtggaaccctgggagaaaaattatttttttactatgttatcctagtggccaaagtcaacaacataaatagccttaagattaaatgattaaaattgaattaaaaaaaataaaaaaactcccaaattctagtaagtaactttatgtcatatttatagaaaagaaatcagttcattttagaaagtacagacaggagaaaaaaatctgataatctcaccacccagtatcttgtctctatacttgtatctattaatatttacttgtatacctattaatatttactcagtatatatttatcaaaatgtgataatggttgcataaattatttttataacttcctgtttttgtttaataatatgactgtcacgtaactataaaaagtttatattattttaatagcctaaaagtatttcctggtagctcagctggtaaagaaactgcctgcaatgcaggacaccctggtttgattcctgggttgggacaatctgctggagaagggataggctacccactccagtattcttgggcttctctggtggcttagctggtaaagaatctgcccgcaatgcaagagacctgggttcgatccctgggatgggaatatcctctagagaaggggaaagctacccactccaggattctggcctggagaattccaaggactgtatagtccatggggttgcaaagagtcagacacgactgagcgactttcactttcacttgaaacttctcgagactgtatcaaaacaaacagaaaaaaggctgctaacactctgtctttccctctaagttatcctcttctatttgaattatttgaattatttttcttttccagttcttcatcttcctactgctcccctttctccagcaaaggagaattaaaaaaaaaaaaaatcagaagtaactatagttcccttcaggagctgcacacccaggacctgagcagaacttagtcctggctaacgaatttcccaacccgagtcaggacctattgagatttgctgaggaattcgagttaaccatctggtcctattagtctgggttttcagatctgtgtcaattaatacagctgttagtttctgaaaaggaagaaaagaaatgaataaagaaagcagggtggaaacatcccttaatggatcttggatctcaggcttacattgaatgcaaggatttacctcaaaaagtgctcaaacttaacctagagttttcccccaaaaccttagactgaacaataattcaacattcaaaggattgaatgagtccattctgggctattatgaaaggtttgaaaaaaaagttttgagagaataagttctaattcaggtgattcagtggtaaaaaatctgcctgccaacctggaggtttgagttcaatccctgggtcaggaagatcccctggagaaggaaatgacaacccactccagtattcttgccttgaacttgcaaagaattggatgcaacttagcaactaaaggacaaaaataggagaacctgagtttcactccttataccttaagaccagaactctcatgaacacttttagaccatctctaaacttaggaaaaaaaaaaaaaaaacaggaattgaagctagatatcttgttgtgt

SEQ ID NO: 60920 - DNA, 2914 bp, Bovine  19866880823892
atttgttaagatccgaagcaatgaacgctgtcttggagggattccagaactgctttttactgatttgattaaaaattttgatggaagtaagctggagttgctgatgttcaaccttaacaatgtggacatgaatgactgaagatagtatttatttacaagatgggctactccccagacccaccctatcattcagtggttttggaaggctgttctgctgatggatgctgagaagcatatccagttactgcagtttgtcacaggaacatcctgagtacctatgaatggatttgcctaactttatggttccagtggtcctcaggtattcacaatagaaccatgatggagtcctgaaaaactgcccagagcgcacacatgccttgaattacctccaaatgaaccctttggaaattttcgagagaaatttctcagggctgtggaggatcctccgggattcgaaggtggattaagcgccccctgccttgggatggttggttgtctgtggagtgagtcctgctcgcacgtttgtatttgcctaacagacttaacagtggcggtggcagaagagcagtctcagggagtgagtgactcttggagcagagctttcgcttgtgcacttgcccaagttcagatatgggatctcagtcccaggtcacattctcgcattttctaccacaaattatcaacagggtaatatccactgaatacactaattatgtttcaggaggatttattctactgatgttatgccgctgtaggcaaggcccttaatattttatatactttaaaaaaaaaaaaaaccctctcagtgaccatgactctcaaaaactgaacctctatcaattagtcaattatagttcagttttctctaccttggcactgattctgcagaaattgtagttcatggatttttgttctagtaaatcatgactccctgtactcacctggctccccagtttaggggacagcagtttgccctgtgatctcacttctcttatccttcttagaaaagttgctgacttttcagtttgtttagcttgatatttgttaaaatggaatggtaacttcaagccactcacatgccagaaccacccacttcttttctcatttaatattatatgtatattccatctgcctcagtacatattctgtaacctaagcatttgttctgatgaaatttagatcctctactctcttcttttggctatgcaaaatatgtaagtacaaacaagtaaaaatcctgcttgtcttggtcaaccacaaattgacacctgccatgggtgcttgccatctacctctataagaattaagttacatgctgcggcagctgctgacctccaacaccccgaaggagtttagggtggagagcaaaaatgaggcattctactccaggaaactggcaggacaggtctttagatagatattctcaggagctgattttatgagcccaattcttgtatctcctcatatctaaaaagctcaaaagttcttcacagtgacgatagtttctcatgactagcagaaacttcaggagaccagcagaaactttctacaaaaaatatgtgcttgagtgtatgtactctccttttgccagcatcgcatatatactgtcttttcccctacctctttggaacagtttctcagagctatctgaggtgctgttccctgggctgcagttctcacattgccccaaataaaacttaacttgtaaccctcgcattgtgcatttttttaagtcgacattttaaagcatgattataatttatgttagtcacctttgattcctcttacttgcaatagacagcatgaaagttttcattttatttttagaaaatgatcctgttcacaccataccactcatccggtcttcttttaaagcctgatgaatattaccaagcatagctaatttgctgtcacaacttacttgctagccaaactcagtgaataaatcctcctccattcacttgagaaatagaggtctaacatcattatcagagaataacttaggtcttttgttagatctgcaacaatggtgttgcttttcaatcaaatgtttaaaagaataaaacttgcttagagtttggcaacttataaatcttgatttatgtaatggatcatttaaatgttttaattgtctaacttttaataacagttttttcttttgccttagagttctgaaggggtgcaaagtggaattctgtgttaatttagaagctttagtatgctagccaaggaaagctgacccctgtatgctggaggtttttgctttccgttttaaagctccttggatgttgtccttcattgtcatttagtcactcagttgtgtcccactcttttgcaatcccatggaccctagccctccagattcctctgtccatgggattgcccaggcaagcattactggagtgggttgctatttccttctgcaggtggtctttctgacccagggatcaaagctgcatctccttcattcacaggcagattctttaccactggaccaccagggaagcagatactatcctttattaaagccagaatttcctacagaggtttatgcatttttttatcatccctggtaaaggaatttgattttgcaaatgttgacaactaatgggtaaacatgaaaaaaactaatggtttagagggaggaagaaggctctgagccttagaattgcacattggtatatgtgcagtatacacaatgtactataactctgatcagaagcacatgatgataacaacttctgaaacatacagttttaaatgccaggaaatgtaacccagcaggaccgtatagggcctttctggaacagacccctccctcgtatcctctgctgaagtacccagataatagtatctgatgcacgtttcctgagtcgtttcacagatgccaagtggagaagactcgagagttcct

SEQ ID NO: 60921 - DNA, 1188 bp, Bovine  19866880851358
tggtgagacacgtaatgcaattaaagtacttgcagagatcaaaaaaagacgagaaaatggtcatgaggagtcatgttaatggtctgagaattaaaggcagtgagtggatttatagataagaagggtttctactggctggcatggaccaagacgtctacatggaaaaacccaacacacaggagggagccaataagtatttgctcaaagaataagcaagcgtatgaaaacggagctggctaaaggaatcttttcatatttatttcactattacattctatgtaggcttaccagttgttgagagcaacatttttctaggtccattgcttattttaaactaattaggaatgattagcactgtaaccgttcagaagattaactgtatagttttcttaaggaatcaaacattaacttggttattggcttttccttctctctcttactttttactagtaagaaccccagaaggcaatatcaggctttactgtaagggcgccgacactgtgatttacgaacggttacatcaaacgagccctatgaaacaagaaacgcaggacgccctggatgtaagtctcacttccactctttatgccacggattgcaaacttcctttctggtgctatctctgaagctggagtgaaagctttgtgctacctgttgacccttctgctgtcttggcgtagttgagtggaaagagcacccaagtaggaatatggcaggctggttctgattctgccacagaggctgacttcctaggaaacgagctcagtgcatctaggttggcaggacctgcaggactgacccaggagaaaggctggtctttcttccggggaccttaagcaagttacataaccatcctgtgctctcgtctcagtatctgtgtggcctccaagaattccagtgtcctgtgtacagtgaagttgagagaacattcctataggatgggacatgagaaagcagtccactggataatcaatgtctttgttagagaatcagtttggtctttgttacttcaaactcgctattttaggggatggtgtgggcgcaagagagtcggacacgggtgaggaactaagcacgcacacgtgcttggttcagggatactgccgtttttcagaacgcttctggaaatctgagaattgtatgcccaccctcatattgttttgtttttatataatgatggcagtgaag

SEQ ID NO: 60922 - DNA, 766 bp, Bovine  19866880857668
tatttgcttgcagaattcctcctgctcatatgagcagtcaggttattgcagaacattctgtctgcgtgaaaaggccaaatctgatcattttataaccaagtcctaaaatagacatcctccaaagagctggccccctgcaagcgtgaggaagtcacctaccttgggaccacctgcaaacgtgaggaagccacctaccttggactgccaaacaagtcggtaggggttggagtaacccagcttgtccatgactctctggacagtggcgcctacctcttgaggataggggtcccctctgttgaccacctgcagcagagacacaagagttcagtcgccaacactgtgcagggttctgagagcctggggctgggcggggaggcggcctgagccctgggctggaggctgcccctcgtcctccgcactaatgcccacgccagctgagctcagggcccaacttacttggatggatttcatcggccaaaggcacacagggtaccagatcagctctcgggttcctaggaatgcatcagattctacatccacgccacccagaggagactgacaacacacaccacaggaggatgggtttctccagccccccggctggaacagggacgacacagagacgctggcacgggatgggccttcacttttggtacttacctgaagggctgattttaatttttgactgtgctctgcagcttgcagggtctcagttccccaaacagggactgaacctgggccatggcagtgaaaccccaggatctta

SEQ ID NO: 60923 - DNA, 2822 bp, Bovine  19866880891871
gttggcttaaagctaacattcgaaaacgaagatcatggcatccagtcccatcacttcatgggaaatagatggggaaacagtggaaacagtgtcagactttattttttggcgctccaaaatcactgcagatggtgactgcagccatgaaattaaaagacgtttactccttagaagaaaagttatgaccaacctagatagcatattgaaaagcagagacattactttgccaacaaaggtccatttagtcaaggctatggtttttcctgtggtcatgtatggatatgagagttggactgtgaagaatgctgagtgctgaagaactgtgatgctgaattgtggtgttggagaagactcttgagagtcccttggactgcaaggagatccaaccagtccattctaaaggagatcagccctgggtgtttattggaaggaatgatgctaaagctgaaactccagtacttcgggccacctcatgcaaagagttgactcattggaaaagaccctgatgctgggagggattgtgggcaggaggagaagaggacaacagaggatgagatggctggatggcatcactgactcgatggatgtgagtctgagtgaactccaggagttggtgatggatagggaggcctggcatgctgcgattcatggggttgcgaagagtcggacacaactgagcgactgaacagaacaatcatttttaagagcaatagggacagcgtaaaggaataatgtgtgtaattaaatagttaataaagggacaaagtatgctattaaatagttcatcccactaggggtctgtaagtaaaaaaatatgggagacccctgtaaacgaatggttactcaagagagcagctttgcttaaccataagcccaagcaggcttgcttataaacaaaaccatgccacagaagcacaggacatgcccctggacaataaaacaatggagacacgagaaacgcatcctgccagcgagctcagcaagttagggatccctaggacgtgctctctgaacacataaaacacagtaatttgtggacctggcttgggcacgtagggatagtaaaactcccctgctcaacctggaggaggagctggtgatggacgcaggatgtccactcaagaaagaggaaggcattcttctcttcctccccacttctccttcgattataaaactgtatccccatgagtgatcttggggcctggcaccctcctgcccacctgcctgtgagcctcagaagcatcctattctaacaaatcacttcccatctctcactttgcctcttgctgaattcttttctgcgctgagacataaaggactgtggtactggaggctcttcagagcccccgaaacgacacccagatggtttgcagaggcgcaactggagtgaggaaccctttatacatctcaaaggtggtatcaggtgctaagtgctcttcctccagaaagtcagatgacttgtatttttaaaaacagctacttttttttccctaggctccagagaagctggatcgaaattcgacttttttgatctaccaaggtgcttccacgtgagctatggacaggacacaacctctgacgtgaaggcgctgcggtctgggctcatcttcaacggcccaaggaccaccccctgcttccctctctgtgctcagtgtcactgtgatcccccttcgctcccccagctcccttcacaggacctctgcgggcaggagagcaggtttcttctgcccgcgcgctcttcaccctcgcagctcacccgtcagacccggccacactcagccactgagagggcttcccctggccacccttcttcacacaggcctccccaccactctgtctcagcctcctgtttacctcctttggcatatttacataaatgctcacttcatttagttgtatctttttaccatctagcataactagagtaactggaacacgagcctcccaagagcatggccgcgtctctcttacggaacacttgcacctccagagccgcatctaggaggtaaaagggattcagaagggtcacggatcctccctgaccttcgggttcataaaggaagcaacaacaagcaaaccacaaactgctctggagttcattaattttttttgttaaagggaggaagttgcattaaataatattaatttcctgccagctttaccactgaattatagcttattccacagctgttacctagagacttgggtttagtaaacagatactatttaatcagttaaatttccaataaatttaacactgcaaaatcttaatacaaataaagatttgtctggggtaaaaaactatccctgatcttatattacattttaagtatcttaaaggcatataagaaaagtctaatatatggaaaaatcagaagtaataaagtctatatttttcatacactggaatttatcgtctataccagggatgatgtccaatctataacaaactgcagtcctatgtttgaagttgtaatttgctgacaatctcatttcaagcacatccaaaattagcaactaattctttacacatactttattaatagactcctgaaattcagagataagagagaagcacactcagtgtgaagtagggaaaacatacaaaaagaaaaataaaggctcactttaatacaattattatcagataaacataatcaatgaggttaactcaattcctacatttttatcctattcaacagcaaaagacacaatatgtgcaattacataactgttgataaaattacttgatataatcaactgtacatcatggtttataatttggttttcatactttacagacctaaaggggacttttaaat

SEQ ID NO: 60924 - DNA, 1263 bp, Bovine  19866880912147
acatcctcacccccacatgaaccgcactggtgaacactcgctggccaactcagcttttctggttttctctcttgcctcttctgttaggtcaactcaactaccaggcagcctctcctgacgagggcgctctcgtaagcgccgccaggaacttcggctttgtcttcctcggcaggacccagaacacgatcaccatcagtgagctgggcacagagaggacctaccatgttcttgcccttttagacttcaacagtgaccggaagcggatgtctataattggtaggtctccctcagagtatgtctgtcagtcattcactgagatgctgcctcttgcacattttacttagcaacaccaggataaaacaggcaatgaacgagccccttggctcctggaggacttctgcagacttgttgaaactagtgtttcctcgcttcattctacacgatgtccatcactcaaagggacaaacgcagtagatctgaaccttgcatcacgtcttcaacgatgtgggctgtcagctgtgaaatctgggtagcagttccatggctggtagacccacagcacgagcttttctatcgtgagttgccccatgcatttctgctggggcctttcgggatgtcaggttcaggagaacagcgaggctgtgcttatgaatgaagattctccctccagctcaggcacaacataacaggaacccaggaagaagcaatgatcacttcctgatagtgcaatgttttcagttcatagtgtgaaatcattgcaaactcacagaaaacttgcaagaacgctttaaagaatcctgtagtttcttccatgtccagttgtcagcatgcgtcaaaagttctttgtcattgttatttataggttcttgttttctgaaccatttgagagtcgattaagggcattgaggtctaatgtccctttcccccaaatacttaagtaggtttttcttaagatcaagaaacttcacttactgttatgtccagtatggtgatcagaatcagaaaactcaacagtgcagtgttattatctaatctacagagtgctttcaagttgcaccagggattttctttctgattcaggactctacccaagatgccacactgcattcagtgatcattacactggtctcctttattctgtgagagttccacaacctgatttttgatcttctgcacattgacatttttgaaaagcacagggctgtcaccttgcggagagtcccctcagtttggggtctgtctgatgttccctcatgactagat

SEQ ID NO: 60925 - DNA, 1101 bp, Bovine  19866880993872
tttacttgtggagactgtccagttcagccaagtgccaattaacgtgcacaggcaagaactgcagtatcttacttctagcctttgactaagagtgctaagttttcaaacttgcgagtggagaagtccgtcctttgtcagggtctctagggactcgacactcttcccttcttcctaattagaaaagacagtaggcttttctctgcagatgctaaggaaggatgctaagattctcggccagttctctcaagtcctgtgatccattataatgagagaggaggcaacctggcctgttgagacgatgttctgaatgcaaacaagttcaggccacggctgtaactcactagatgagcagaaactaagaccctgggagccagccactgttacgctgacctgcccaaggttagcgagggcaacctggcaatccttagaggataccagaactgtgtgcttgaggcacacatatataccaaagaggaaaatgcaagctgcccaacagagaaggaccttctggccactacagctgtcctagatttccaaaggactcaacattttgttccaccaatggaggctgaggttgagtaaagaaaattacacacgtcaggaacgatgtttcagcacctgctgaattctccctatccgttttaactcttttcctacactttcatcatggaagagaagtcaggagagagaggcagtatcctctctttggttgtctctaattttaccccaattggcttttgacattgtgttccatcgctgtaattctcagttttagacaggacgcccaccggctcccagagttatctgctatgttactcaacaaggacccttctctcctcccactgctcctgtctggcagctccaagaagtcatgacacaagtcacactttccatcccgtaattcagcatcccatgagcccaaaccagaaaggaacccaggctgttaagaggatgtccacggcatgcacaaggtgttctggcgagggcaaaagaaagggctgtgtgtacgtactcgatgtactctctcttgttttcgttcgttaccattatttctgacccgttgggcttcagatccacttgatatgtctgcaattacaaaga

SEQ ID NO: 60926 - DNA, 849 bp, Bovine  19866881174843
taaatcttcgaaggtttcatacggaggtaagtcaaggcgattaaagctgcaaaagtaacaacacagcagaggtaaacgccagcatgtctgcccgtgagctgcacccgggcctccccgacttggcttaggagcacacttggtgtttgagcaggactgcagaagcctcagcacaaaaatcctaatccagtggtgactgcccacagtgcaccctgcagggggcgagaaaaggatctcgaatcgtctgtgaaacctctctactaccgtcggccgtggatcctagaaacccacgctgggaagggaaaagacaggcaaggtaactggcgcacacgctgaggcttccaaactgtggccacccgagggctttccgcagcaggacaaacggaggctggctgatgcccccccatctgccgctattctaggcagtcagtgcttctgcacgcagctcctgctctcagcgcagcccctctgagcaggtcacattccgttctgcagatgcgggtgttctgcagatgcgggcagccggtggccgtgtcccagcctcagccctgacagcaccgcagacctgagaccggagcccaggcccccgcagctctgggcccgacacggagcggccctcaacccagagtcaggcaagccactggcgtgtggcgtgaagagctgccttcacacaaagcccctacacagctggaggccttggctagggtggtacaagtcaccctggtgacagtgagacctccagacacacgtggcctctgtgagcaacgatcacacgtgttcacaggattgagttcaaatcctgtctccgccacctgcagctgtgcggcctcaggtgagacagttccccctctg

SEQ ID NO: 60927 - DNA, 2812 bp, Bovine  19866881180536
ctctgagtttctattgtggaattaactgacgtacacaattaaatcagccacattcagaataggactgctccctaactgtctggacagtgaagatgtctgtgctgactgttgcttgttaagaggtacatctttggcacctcacggccttgtgcatggtgggcggaggcagatgcatatgaggaaatagaagaaaacagagcctcatcaaaagggtggggactcttctcaggctttggcacactcagccagtggtgatgttgatctttcgttacccttcacgtaatctagaggagacagacagctttctagtcaatcagattttttaaattacttaaaaggacattctaagtatggagcaaatcattgcagtaaatctcgttcacatttacctgctgccactttttaaatgcaagagaatttttttcaagtgcgtttgaaaagttcattttataaattagaaaatttcacagtgaagactgaaaataagagcccagagtttggaatttggagctctggattctcttgggctccttctcaagctggtagtgggacaagtctgatgatgtctgtgaagaactttctatgataggcatttgcacgtgggcgtttttgtggtttttttgataaggttgtcgagggtggcggacgtcatcgtcatgtttcttccggttcacatcgcggcccatctgggtatcgggggctgtgacacacatgcccctaaagcaggacattgtgtccgatggcctgttggacaccccagggtccaggccagggcccctgaccctgactttaagacttaccatgactcccagagtctgaaagggcacatgtgagcttatccatgtaaattttcattgaggcctgtgcagtagatgtagataggaagaagtaccatgtgtccaaaattataaccagtagataatccacgaacttagattgtgaagcagtgtaattactaggttgaaagttcagggccattttttaaataagtaatgtataagatgtattagtaactggcttctatactctttgccaagactcagctctcaaggagctctttcatttatgacactttataaatattcatgaaaattggccccaacgtttctttaccgactgttctttaaactgggccagctgtgcccccaggccctctggaatcccaggtatcccttccctggctgactgcctgctccccaagtccaagagaggctctgtctccagtctgttgggtgatcaacgccctgcaggatgtctgccagctgcagatcaggtgtgtgaggccttgggctcacccatctccaaggcaacaaccatctgtggctcacctgggcctctgccttcgacccatccccaccactgtcccaggccaggccctggacctttctctatttgtaaagaaacacgttttagaacgttgacactcactcaatagatgaaaacactaattattttctctcttcttaacagacacgggacgacttcctgggacaggtggacataccccttagtcatctcccggtaagaacggttgcctgctttataatgcgtgcagtgaacagcagtttctgtctgcaattccggggtattttcagggcagtatttcctccacactgtggagaaggctgaaatgaaacacagatactgtgagcctgaccccttctagaaggtggtcctttcaggaggctaggagatcactttaattgtaaaaacaggtgtccttgaaccatctacaggtacctatcagtgtcgccagctactttcttatctcatcttcctttgtcacgtcatacaaaacagctgcctgcttctgccaaaccccttctccttgtcactggaatgtccttgctttgaagttcatccttcggctctaatcacgtgtgtgttccctttgtctggaattgtacacgctgtttctcctgcacttcatctgcacagactgtgtttccgtgactttggttatggctttctcggttggcacagagacaaaagaaaagatgctattggtcctaagtgaacttgtcagctgcaaagactctggtttcagaaacgatactgggtcagcacgtgtgctgttgctagtaagcctctgctcaaatgtgtagcaaaaggacgggggctgttgaccgtgactgagctgaagggtgactcccgcgtgttccagtacctatcgaatgggggcccaggcctccctggcgaaaggtaaatggcctcgtgctctggctctcttccccctgccacggggcatcatgaagctcagtagcacctcctcattgtgcccagtcgtgtctcactctctgagaccccatggactggagcccgccaggctcctctgtccatggaattctccaggcaagaatatgagattgggtagccattcccttctccaggggaatcttcccaacccagagatcaaacctaggtctcctgcattgcaagcagattctttaccatctgagccaccaaggaatcccccacaatagcaactaagagagactaagtcaaatgtttctgccttccaaggacattattaaaaaatgctcaatgtgagcaaatagcataaatcgtctataaactaaagtggcccaaaccacctagtatgagcctgccgctgcgttgaagctgcagctctcaccctctgttagagaccaagaaaggccgtcttacccaggaagctcttggaggtctggtgtgaaggactgtgacggcaagcactttactcctgtttactcagcggagctattggggatgaaaggtttgaagctcgttcccttcccaaagattggaaacagcagtagtgacattagaatat

SEQ ID NO: 60928 - DNA, 1087 bp, Bovine  19866881215717
cgctcagttgtatccgactctttgcgaccccttggacccatggaattctccaggccagaatactggagtgggtagcctttcccttctccagggcatcttcccaacccagggattgaactggggtctcctgcattgcaggcagattctttaccaactgagctctcggggaagcccgcagcaaagtgagtggaagagggcttttgagggcaaaggccctgcttcaagccacaatgtccagcaaacacagagatgttgtggattagtcactcagtcgtgtccgactctttgcgaccccacagactgtagtccgccaggctcctctgcccatggggttctccaggcaagaagactggagtgggttgccattgccttctccaggggatcttcctgacccggggatggctctaacccatgtctcctgcatcttctgcactggcaggcagagtcttcacccctgagccacctgggaagccccacacaaggaacccctacctgcaaagacagcctgctccagggaagccccaggaccacactgcctctctgccccaggacagatctctctccaccttcgaaagcaagggccctacattttccagacccaggggcaacacgaacatcccttagtccaacagagatgacgggccgtagatacctggagaccggggggctgggttctctaccctcgggaactatgtgatggagcaccaggatgtgcctttttttaaaatgtttctattggataaacataagctaattgctaaaaccctttaatactatttgtgctggagagcttgggattcgtctttcgaattctagttgttcagctctcttacaaattagaggagtgcctctggcagcggggtcctctccctccgacccccagcctctccccactctggcccgcctctgtcctgtctctgtgcagcctatatttactcagaagatccttgcttgttcatcaggtgaggttatcaagggacatgccctccccatctgaaggcgtagtcaaacaaaagtcaggcctttgaaccccaggctccagttaaaaagtaacaggctgggtattgggtcaataagaggcaaatat

SEQ ID NO: 60929 - DNA, 1369 bp, Bovine  19866881264836
tgtcctaccaggacctttgtcactagtgaatgattctttccaactgagctaagatttctgcagcctctcagcatgataggtacatccctggagtgaccagaaagaagggtttctgttctatgtccctcaggcaaagacaaagcagatgaacctggctaagtcatcaggagaggggaaaaaccagagatggttcatcacatgagcagccgcacccagcatgccagggctttgcagtagcaatcggggtcagctggaactctagagccagtctgcagtgggagtcctgggagtagtgcccaggggaagaattccccctgaagagagcagacctcacatgggctgggtgggactctgctgacgctctgcaccctgtaaaggtgatccagggtctcagacaggaaccaaaggaggtcagtccttaatggaaagatgagcacatgaacccagtaaaaaaaaaaaaaaaaaaaaacacacagaaaaaaaaaaacaaaaaacgctgatgttgtacacctaaaatgaatatgttttacatttcaaataaaactagaaaggaaaaaaagaggcagggatcaacattctgaccgtagaagctgagtggcttttatggtatgctcacaaccacacagcccaggctgaagagggccgttgcaaggcctgcctgtgaataagggccatttttactggaaaaaaaaaaaaaatgcagaagctttcattttccagttattaagaatgggttgattttatgcccaaagcaaggctctggttaacaactcagttatcccgggggaaagagtaaactggcctctacccttttccatttccagcatttgggggaaagaaaggattagataaaatgctttatttcctctcatgctccattgtgggcaggagtgcatatattaggcagaaaccattttcaacaggaaatcaagtaaaccaggaggatttattcacaggaggctcccttcggctagaaaaggagaattattaacacaatggaatagttctctctttccatgttcctcctctgcccccccccgcccccagcccccaccaccatctcccactcgctactgtgacgggaaaccactgcggtgagattcgacatctgagcccctgtaaacgcctctgtatccaacagccatactgagagtggatcacagcttgtctaaacgctaggtccccatgcagcataactgttctcagactgcaaggctgaccccagttactgatgctggactggggtagaaggtgaggaagagagtcagggaggatccattactccagtcgtgttattaccgtttatgatgttgtcttccactaagtatttgttttctaaaatcagttcccactagggattctttttctc

SEQ ID NO: 60930 - DNA, 764 bp, Bovine  19866881333621
aaaccgcttacagggtctttctgaatctcccttagtttggctttcaggcatatcacattaaaatacattagacagaagtaaccgaggggataagaaaatatggttccttttttacgaccttggcctccctgagtcagtcttcataatgaccttcctaacagcagacgagacggttgcaccactctcgttcaattcacagaggagagacgtggctgactggggggcccgtcgggtcccatctgtagaacctgggccagaaggcagctcccgctcctccacatctctgtccaccagaccagccaagccccttccgtggccggcacgtccagagtcacatcagtaggtgctgaaataccagacctgaggaggcttcctttcatctctctctctaatcatgctgtcattcaacttataaagcaaagggctacaaaggacatgaacgggtgaactgacaacactggagtatgaacgcaggttggacagatttcagtgtcaatatgaagtttactgaagttgaatactgtatcattgcaatggaaaagaatacactgtttaggtgtaaagagtggttttatatgtctgtgtgtgtgtatgtatatacatcttattctcaaaaggttcaggaaaaaattatgtatacatagacacgcatatgcacacacataaagggtatgcaaatgataaagtgggataaattttaacacaggaatctaaataaagagatgggggttccttatatactattctgggaactcttatgtatg

SEQ ID NO: 60931 - DNA, 1780 bp, Bovine  19866881793146
ctgagtaataggatcccaactttacatgtgaaaaatctcctattagactcctgggctttgacttttgtggatctttatccaagaggccttgacagtggaagttcaagttcagaaaacaccctcaatgaaaaagcgtcctcagaggtctacttatttatctgggtttctgcttttgtttggattttagcctaatattaatagttctttaatattacgtgtgtgtgctaagtcacctcagtcatgtctgactcttggcgaccccatggaccagagcctgccaggttcctccatccatgggattttccaggcaagaatactggagtgggttgccattttcctcctccaggggatcttcctgacccagggatcaaacctgtgtctcgtgtgtctcttatattgctggcgaattctttacctgctgagccatcagggaagcccaactctggttaagcacattctagaatccagtcagggctgaagattctaaccttcatatctcagtctccttttctgtcaaagagagataataacagcacctcctttgtgggttaaataaagcacttagtccggagtctaccactctggtaagagctcagtaaaatgctagttgcaaaaatttccactatcttttctttcttgctttatctctctctactttttgttactctcatgaaaacagtccacttcaagaaagcataggctgagaaaaaacagggtccagggagcatctggagaggtggagtctgtcactgtgatccttttctgctttctgaaaacacacgtgacgcagtgtttggatgaaaagcaggaaagagcttttcaccgtgcctgcgctgttacccttttcattctccagggtgttactttagcacttaactagagaaaatgtacacacatttatagaaagagcccagggctcctcgcacccccatcaggcttcaccatttgatttacatttagtgaaataaattataaacttttatgaaagtcatccgagcaaagtaatggagagttctgaggaacagaaggaaaggaatcgatttcttaggtgggaaatacttgcctcctgggcctgtgaggaataagacacaaggccttccaggtgcagctggaaatgctgtggatgttttgggtgccagcctccagacaggtcttgtaaacgtccaaatctaggttacagttgatttccatttgtgaggacctcgttcatcatcatttcaagtgttgccattactatgtattaccagctcccatgaggcttatacatcctatttcccagctcatggaagttgcaaaaatgagtttggtcctcaggtatatattgtaggccagctttcttatctcatgttctaaagcaaaaaggagaaataatgttacaaaatgagtaacacattatattgaagctagagtgtggtggttctttgagccgaaataagtggcaacaaagccaaaaaaaaaaaaaaattaatgaaaacacgttttgttcctactggaataatggccgtctaagccctgtcagcccgcagtggtaactgccaacttgctgtcaatcacagctgagaggaggggtagcacccccggtggttatttgcataagcttttaaaaaatgctcatttaaatggaggtatcatcgtattcaaactgaatgagaatgaaatgtccttaaaattaactgacagcagtgctttgaactgcacaataggctaacctgggagattttaaaatgttctgatgcctgggccctacccttgaccaaaacaaaccagtattctggagaca

SEQ ID NO: 60932 - DNA, 902 bp, Bovine  19866881877413
tctcgggcagcctgagtttctcggcgtttatggacgggctcgcccccaagagcaagcactgccctagtttctccatcccgggatcacccaactccattctatatttgccacagagccattatttgcgtctaaagtgtcaaaacagcaaaccacattaattcctgctagtgagattaacctcacctgggaagacaatgggttctcggagattaatttctgggtttgtaacgaggtgtcacgtgagtgctcgaacagtctagaaagtgtaagtgccggttttcttctctctcaaagggaatacaagtttctatgtctggaggctgaggaacgtggggagaagacaatgaacaatgatctaatcatctggcacctcatttacaatttttaaaagttcgtaactgattatacatccatataagagcaaaaccgtgtaatctctgaacacaagtgaaaaactaaagttaggagtcatgtgactcatcctccagcacttcctgtaaaggttataaaacaaactaggaagacatttataccccaggaggtaaatctagaataaagaggtggacacctgtcccaccacgacctcactagtagcatcggctatgatttaaactgaacttcatgcacaatgaggtaaaaaaaaaaaaaaattaatagacgatctgtcctcatttcccctggggttttgtaccaaatttccaaactctgcatgacagatcccttccactgtgtctattttcaacatttcaggcacacagggatgacaaatgcagtaatttattcataaaggggccgctgggggagggaggcaccggagcagtagctgtattataatttttcagtgcacagagaagaggtttccaacaaggtgagacgggggaaacaatttttcacgtctatgt

SEQ ID NO: 60933 - DNA, 1134 bp, Bovine  19866881649203
aaatgaaaatagaataagatcttttattttcctcttcttttttacagggttgtgtttatttttattttatttattgtttttggctgttccacatggcatgtaggatctttgtttcctgaccggggttgaacccgtgtcccctgtagtgggagcttggagtcttaacccctagacctccagggaagtccctatttttcttattcttaatttatctactagacagctgagcaaagtgatagtaataacaatgtattagatgattatagcatataggtcagtgaaatccatgacagcaatgttataagggatgggaggaagaaatcagaaacgctctatgaaaagctgtctgcattttccatgaatttgtacagtattatttgaaactagacttcggacacgactgagcgacttgactttcacttttcactttcatgcttggggggaaggaaatggcaacccactccagtgttcttgcctggagaatctcagggacaggggagcctggtgggctgctgtctatggggtcgcacagagtcggacacaactgaagcgacttagcagcagcagcagcaacagacttaagttaattgcaaatatgtactgcaaattctagagcatacaccaaaaacaatttttctgaaagatgtacaattgatactctgaaaggagaggaaatggattcacttaaaatgctcaattaaaaggcaaaaaaacaggataaaattttcaaaaaataacaagtgcaacaaacaaaaaaatggtgataaacatggtagatattgatccaaatatatcaataatcaccttacatgtgaatagtctaaataacaccaattaaaagatatagactgtcagaatttaaaaacaagatccaagaaacacactttaagtataaaaacagagacaggtgaaaagtaaagagctggagaaagataaatccatgccaacactcattaaaagaaagctagggcagcatgtgaatttcagactatagaataaggaaaattatcatggataaaaagaagtattatataatgataaaggggtcacttctttaagaaagcataacagtccttaatgtatatgtgtcgacaacagagaatcaaaatacaggaggcaaaaactgccaggaga

SEQ ID NO: 60934 - DNA, 1168 bp, Bovine  19866881281702
gtggcagaagaggagcctgtgggtcattttgaaggaacgggggcaattccactggattccaaccgatgctggcaggacagctcttgagtggaacacacacacacactcatacacacactcagatacactcacagacactccagcagacacacatacacactcccataccctcacacacaacacagattcacacactgaaacatatacacaaacatccacaacccacaaccaggcatactcagacacacacacactcaaacagatacacagacactccaacagacacacatacacactcacataccctcacatactcaaacacagattcacatactgaaacacatacactcatacacagacacccacaaacaggcatactcagacacacacacactcaaacagttacactcacagacactccagcagacacacatatacactcacataccctcacacactcaacacagattcacatactgaaacacatacactcacacacacaggcatactcagacacacacacacactcacttgctcactcaggccttagctcgtctaaacagtccctctgtgtgaattagaaagaggcgccactcaagagagacagaggccttcagcagcaggtttgaggaggggagagtagcctggacttcagcccccacgtaccctctggcagggccccctgaagggtgcactctgcacgaccacgtgggatggccccacctacacttctcctggtgcacggaggggagccccacgtgcggacctgtgggtgcagaggggcagggcagccaagagaagatgtggccttcccttgagtcacatagagcatcctgtccacaactattcagagcttgtaagacaggccccatgtcgcctgaggaggggtccctctgcatgcactgagtacctgttgggataggtgatgttacacggcactttgcccacgtaattctcattcagccagcgattcgccagcgcctgctgaatgttgggcctcttcacaggatctggttccaggagagaacgcaggaagttcacggctcctgtgaagacattgggcaagtgtcacatctgttacaggctgaaggcagaccaaggcaggtgacccaccacacctcccgggccactgctcatctattttctggatcttgggggggccacccat

SEQ ID NO: 60935 - DNA, 1108 bp, Bovine  19866881802076
ggagcttgcagtagcttctgacctcatcacaaggctgctgagtgtcaaggctcagctccaggctgggctcgtgacaaccaaccaaggcctctttcaacaacactatgaaagatttatgaaaggctgggcaacactaaaatgagcttatgcaacacttcccccaatgcaaattaagaaactgatttgaggaacagaaacttggttaaggcttgcctacctgcaaacagcaccgcagagaaagttgaatacttaaaaaagaagaaaatggtctctcaggggactgggagcattatttctgctctgaataactgagaagttgcatgtgaaagagcttctacccaaattgagaaacttcaaaatctgacgttaagtttctccagtgtcgttgtcattgttgtttagtcactaagtcatgtccgactcttagcgacccgtggactttagtcctctaatctcctctgtccttgggatttcctaggcagaaatactggagtggattgccatttctttctctaggggatcttcctgacccagggatcgtgtctcctgcattggcaggcaggttctttactgctgagccaccagggaagctcaagtttctcctgtagactacaaaataaacaatatttgtagagcttcagttcagttcagttcagtcgcttaaaacacggtcatcctaaacatcccctcatttagtctttgtgataatcctgcaaggaggtgaaaatcagtatagtcgttatgcccattctaaaactgaggagactgaggctcagagaaattaaatgacttcctaaaaccaatcagctatgccttgaacatcaggccactgaattcttttcataagcggtagaagtttcagttgcgtacatgcctaccaagttacttcagtcatgtccgaccctgcaaccctatggactcatctgtaaaacagggagaataatacctacatggtagctattgtgagaattaaatgaataactgtataaaaagcaccagctcagagcctgacacaatgcagatctttgctattatttacagcttctttccattaatctcaatttacagcttttctagtcactctttggataacacatgattaaagaca

SEQ ID NO: 60936 - DNA, 1809 bp, Bovine  19866880473233
atgctggaaagcatgtggagaaaagggaaccttcttgcattattggtgggaatgtaaattaatacagccattatggagaacagtatggagaattctttaaaaactgggaataaaaatatcatatgatacattgatcccattactgggcatataccctgaggaaatcataattcaaaaagacacatgtaccacaaaattcactgcagctctacttagagaagaaagacatggaagcaacctaaatgtctattgacaaatgaatggataaagaagttatggacatatatacaatggactataactcagtcataaaaagttttgaatttgagtcagttgaaatgaggtggatgaacttagagcctgtacagagtgaagtaaatcagaaagagaaaaacaaatattgtctattaacacatatgtatgggatctagaaaaatggtactgatgaacctatttgcagggcaggaatagagactcagacatagagaacagacttgcggacacagtgggggaaggagaaagtgggacaaattgagacagtagcattgaaacatatacattacaatatgtaaaacagatagctaatgggaactcaactggtactgtctgacaacctagaggggtgggatggagtaatgggaggaaagagaggttcaagaagcgggggacatatgtatccttatggctgattcgagtggttatatggcaaaaaacaatataacattgtaaagcaattatcctccaattaaaaataaattttaaaaaagaaagaaaatatatgcttgctatataaattcagtatactcagaccctgaaatagctctgtcactaattagcagtatgactttgatcttggccttacaggtatatgaagattaactgggataatatcttcaaggttccctcttcttgggctctaaattactgcagatggtattagcagtatgactttgatcttggcctcacaggtacatgaagattaaatggaataatatcttcaaggttcctcttcttgggttctaaaatcactgcagatggtgactgcagccatgaaatcagaagacaattgcttcttagcaggaaaactatgacaaacctagacagtgtgttgaaaagcagagacattactttgccaatgaaagtctgtatagtcaaggctatggtcttcccagtggtcatgtatggttgtgagagctggaccataaagaaggcagaacaccaaagaactgatgccttcaaactgtagtgctggagaagactcctgaaagtcccatggacatcaaggagatcaaaccagtcaatcttaagggaaatcaaccctgaacactcatcagaaggattgatgtagaagctgaagctccagtattttggtcatctgatgcaaactgctgactcactggaaaagtccctgatgctgggaaagattgaaggcagaaggagaagagggcatcagagaatgagatgactggatggcatcaccaatgcaatggacatgaatttaggcaaactgggagatggtgagggacagggaggcctggagcgctgcagtccatggagtcgaaaagtcagacatgactgggcaactgaacgacaatcccactacgatgaatggtgcataatagtttgtcaacccatgttaatttcctgtcttcatcctttctgccttttaaagcacatacaaccttattatatttaccaccataaatttcagtcattcacttattttctaaagtatttattaagtatatactatggaatcagtttctctgcattgcactgggtaacaggtgcatagacactaaacaaagg

SEQ ID NO: 60937 - DNA, 1326 bp, Bovine  19866880647987
gtccttggcttactttaaactcttgaatctcaccctgtcccctgttgatacagtcaacatttttcattgatgtctatcatacctgattcatctttgcattggttggagcttctgtttctgcatttcttgcttattgaaagaattcatccgtaaagtattatgctcagtctaattttcttaggcgtataagcattctttgtttccagagcaccgtgtattatattatagttgctgacatgtctgtcttcccactagattctgagcttctttaaataagcatctttgtcttttcatctttgtattccctgtcatctaacataggacctgacatataaatgtttggatgaaacctctaatcatattaggtatgtaaattgtgtgcctggaactacgtcatatgtcatgtttgttttgtttggtttggtctcccacattgacctagcccagtgtttttcccaagggtacttaaaggtgtttgggttggtgcagttctttatttgtgtgggactgtgcattttaggatgtttatatctctgatcttcaaaatgcacctacttatttctggggagtagggttgttgtcacaagaagaaatttccaggtgagaaccatttgctaaaaaatgctgggcatgtagcatatgcttaataaatgctatcgctgcaagcttttaaatacgctcttaactcggcatggtaccatgtataggtttttttataagagtcaattgctctacaagatttagcaatttcatttactagtttgacacaccatttaatatatactggaaggccattgtaacattgatattaagaagtaagaactatatacatgtaatatgtgattgtctttgttatgtcagtgatatagatattactgtgtagtgaaaacagttttgttatattatatcaaatttatatatcatacctggtaatattataggtagcacaaagtgaagctgaaaagaagttgaagaaagatgacaagaagaaagaattgcaagagctaaatgagttgttcaaacctgtagttgctgctcaaaaaataagtaaaggtaaactttaaatttcaaaagtgtttttaccaatgtaattcacatttgaaaactcttaaatgttttcatcagttgtatatgctgtgaaaataataactgtcaaaattatcaatgtcgattcttattccttttatatgtgcatggctgtgtcatacaactgttaaatccagccattagccctccaccctgcataagggaaaattaaggatttcggcagtctactagttgatttataacctttgatctttggtagtagacaaaacaaacctgtgg

SEQ ID NO: 60938 - DNA, 2303 bp, Bovine  19866880717681
aaatgcttgcacactatttgagttttcggtttttcttttccgcctcaccgtgcttcttgttcacaacttcttccagttttttctcatcccaattatccatagtatctttctcaagttcttcatctcttgcatcaatgtaaacacttcgcttttcacattttctctccagagtcaagtcatgagagaacttacacttatctcctttagtacactgtccttgcttgaagaatgcacatactacggatttgggatctgcacctttacttattttttgagcagcaactacaggtttgaacaactcatttagctcttgcaattctttcttcttgtcatctttcttcaacttcttttcagcttcactttgtgctacctgacgtggattctgttgaccaaatttaacttgatgagtgacagccttgataaacttctgttgctttgctcctttcttattcttcagaccaaaagttttgtcttcgataatcttctccttctttttctgctccgcctttttgctgcccccggcctgagcctgtttcttggggggcattgcggagacaggtcgagccggccagacttaagcgcagctggactccctcagggactctggccccgcggtaggaagagccagaggcatcttgagggctacagtccatggggttgcaaagagtaggacccaactgagggactgagcacacacacacacattgaggtttaatcgacaaattttaaaaatggatatatttaaggtatacaacatgatgcttttttacatgtgttttaagggaagaattgattgaaactgcccatcctggccaggcaccatattaactatctacatgagttattttatgacaggaggtcctagtaaggaatatggaactaacgagccaccaccaaacagaagaattcaagaattagggaggatcaaaagaagacacaacgtgtcctaccaacctcccagaatcctccttgctggaatccatcttggctgagcaatgcgtacaccaccaagaaggaaggcccctgagccagaatgaccggccagagacaacctgaaaactcatcctattatgataaaactcaagactgtgaaccaagtggcagagcagtcctgctgagttccctcaccctgctgttctctgctgggacgccccttcccaaaaaagtctctttttcgttagtatgtgtgtctcctcagacaattcatttttgagtgttagacaaaagcccattctcaggccctggaagaggtccccctttctgcaatgtgagagaagtaatcagtacagtcaagctgattaacatagctgttacctcacatagttaccattttgtgtgtatgtgtgtggtgagaacatctaagatctacctactctctaagcaagcttcaagtctacaatacagtattgtaaactatagttacattgctatgtattaaatctgtgtggtgtgtatagatacaatactattcagtattaaaaagtagaaagtcctatcatttgaggtaacacaaatcaacctgaaggacattatgctaagtgaaatatgccagtcaagaaaagacaaatattgcaagatctaacccatatatgcaatctaaaatagtcaaactcatacatgcggagagtggagtgggggcttccaggagctagaggacaggaaattggaggagagatgttgacctttctcttatggcatgttcttctctgagacactgaataacagatgagaaatcctagagctatgttgtacaatatagaagccactaattagaactattgagcactggaaatatggatagtgggaaaaaaggactgcattttttaatttaaattttaaaactggcacttgctttgattattagaaaacttttaaatatatttggaataaattggttatgtgcttgtacttttacactgtaagttttatgaaacctaaatagagagcaaatacttaagatgaaaatgtagtatcagaactgagatgcattatgagtcaaatagaccctgaattttgaaaattttgcagaaaaaggaatgcaaaatatttcattaatactttttatattgatacaggttgaaatgttaaaatttggacgtacttggttaaacaaaatatatttcaaaaattaatttaactttttgctttttaaaaatatgactattaggaaattaacaatcatttatgtgatttatttgtatttctactatataatgccgacctagacaagagcaccatgatccaaaggaaatgaaaactatatcagttaatattcaaaaatattgtcctcatttcagcattta

SEQ ID NO: 60939 - DNA, 1751 bp, Bovine  19866880874134
cccaaaaaagatccatatagtcaaagctatttttttcctggtaatcatgtatggatgtgaaagttggaccataaagaaggctgagttctgaagaattgattcttttgaactgtgatgctagaaaagactcttgagagtcccttggacatcaaggagatcaaatcattcagtcctaaaggaaatcaactctgaatattccttggaaggactgttgctgaagctgaagctccaatactttggccatctgatgtgaagagccgtctcattggaaaagaccctgatgctgggagagattgaaggcaagagaaggagacaacagaggatgagatgtagatggcctcaccgattcaatggacatgaatttgagcaagctctgagagatagagaaggacagggataccaggtgtgctgcagtccatggagttgtaaagggtcagacacgactgagcaactgagcaacagcattacagaatatctgtatactgatgggaaatgatttacgagggtagaaaaattgatgatacagaagagaggatatatttgaaaaagagagatcctggagaaggtgagggaatgagatccagtggagctactggatttagataagcagatagacattcatccatggtgaaaggtcaggcagggtacatggggcccgatgcaagaagatcagtagttgtggtgttagaagtatgtggaagttctcttctgactgcttccattttctcagtgaaatgagaaacaagtcattggagaagtggcaacaaaagtctgaaatgagatatgaaataattaataaatgaactgacttagaaagtagagtaggctttcagggctatgccgtgtcatgaatttgaaggaagtataatcagcatggttattagtcttcagcttgttcagtttcccaaggacaggcaggagaagtacagaattcaatttaaccagagaggagtttggcagaagtgtgtaaaggcaaagagtatagactctggagttagactgctcatatttaaatcatggttcaagcacttggcaactagcttgtcttgaacaaactgcttacgctctctgtgcttctgattcctcagctgtaaaatgagtacagtctgtttcccatttacagagatactaggaccatttagaggaaatcttttacatgtttccaccaccctgtctcctagcttacctgcgtctgggcccatatactcctagggtgtggttgagtgtctgggtggataattctaagcactggaaaaagaggagggaagggtaaaggatgggggaagaggggaaggacacatagaaagcacaatagaagtgctttattatcttctaagagggtaaggtggaggagcaaagtagcaagaaagctgaggatgtatacagtgcaatgattaaagtgatgagttgtgagtgaggaactgaaatcctgcttctttagatctcaacagaagtgcaggaaactccagttaactttagggaaaccccttcatccaaaagaaaactctagaatttgatttgaacctaaatgaaagtgaggcagacttgaaactcatgatctctcgtacagttccatgatgaaaggagaaatatatgccaagaaaacaacaaattcttaatgcaaatcagagaaattctgctacttcgttgaaaatggtctttctctttctactgtaattatttcagtggtgtaggattgactataatccctgctcaaaagcagccatagggcagtttttataccaatttca

SEQ ID NO: 60940 - DNA, 1095 bp, Bovine  19866881154197
aaaacataatgaatgcttaaaaatgaaaatggtgtttcaggaagacgcatggagtaagggtatggtttgagtgaggggcaggaaaaacacagggagacctaggagattactgtcagagtccaagcagatggagagggggatgggctagatgagcgagtggccgagagaatgaaacagaaggaatgaacccggaagacactctgatgaatacttaactgaaaccagtgagtgctaggtgagtgtgggggagaggacagaatcgatgaatcctggtttcccaggtcacatagagaagggagagaaacagatctaaagcagggagcagatctgttgggctaagacgatgtctttcattaaataggttaatatattgcctcttccctgtgaatcatgtaagtacagttcacatgctgaatggtggtgtatgtgctatcatctcctcctcagtctctgaaagcccaaaagacagcatagcacaccatcatcctcagagcaagagcagcagacacagtgagctggagcccgaggcggaacagcgtgcgtcagcccatatgctccccctggcaagccacctgcctcagtgtctcagctcccccagccgggaagatgtacaaaatttaagggctttttaaaaaacacaaaaactgcaggatagggtgctttaaagtggtaagaacaaacctgaacttgatccacaaaaatacatccaagcctacagcttcacgtaaatgtgagagggcttcctaggaacctgccagctaattcaggagacagagacgtgggttcaatcgctgggaggggaagatcccctggaggaaggcatggcaacccactgcagtaatcttgtctggggaatcctatggacagaggagccccatgagcaggctgcagtccatagggttgcaaagagttggacccaagtgaagtgacttacacacaagtgtgagaccttttctcatgcttagataatgtcagttaaatggcctcttgctatgcagacacctctagagtatcttaatggagaaaaagttcatgaatacataaaattcctctctattagttttcttaaactttcccatttagcagaaaaccagg

SEQ ID NO: 60941 - DNA, 2417 bp, Bovine  19866881160522
tgaatagactgaaaaacatggccatcttacttgaagtgcaggaaaggtttttgattaaataactgttcatgatatttgcaaacaagacaaatacctcaagcttcaactatgaagaaataccattttatacgcaaagtctaccagtacctattgcttggtccagctgtgaattaatgagaattcttatgtgttgctgatggcagtgtaaatgctgtgaagattttagaagataatatggtattatcttagccgacaaatctcctttccactgtgtagaatgatacatttttttttttttgtaatagcaaaaataaaccaaaaacccaaagaaatccaaaaaataattgataaactgtggatttattataagtattactcaacatgggcttccctgatagctcagttggtaaagaatctgcctgcaatgcaggagaccctggttcaattcctgggttgggaagatcccctgaggaagggatgggctaccccactccagtattcttgggcttcccttgtggctcagctggtaaagaatcctgcaatgtgagagatctgggtttgatccctgggttgggaagatccccttgagaagggaaaggctacccactccagttactcagcaataaaaattaaccttgctacatgcaataatgcaaatgaatgttctaaaaaagtgtcgaagcaaataacagaagaatacgtatggtctcattttaaaatgaacaggaaaagcaatctgaagaacatgctgttttagagacctatacactactgtgagcaagctaatggaatgattacctctggaaggaagacagagggatgaaaagagcatgtaggtagcttaagcaatataggtaatgtcctagttattatttatattgggtgtgtgtcagagtgctcattttattaacaggtctcatatatttttgtgtgaatcaaatattacattgcaaaacaaagttggttaaggattctcaatggataatgatagtcttctttatggatatcctattcttatgtaagtgtagttttacagagagttttggtagaactggatcaagggctgagtacagctggctttgtattgtgcgcttacggatttctacagatagcttgatgtcttacttagggttgatgttgtaattaattcaaagcttttccatttttaggatgaatctgaatttagagacaaactcactccaattactatttttatggagtattggttggattatagaacagctgctgatgcaacagggttgcaacctattcttaaccaatttactcctgccaatgttagtcgacaggtactgtacttttttattcttttatctttttaaaaaatattataattcattttttaaatagcataaaggatggcttttattttatatttttaatctttttgcattggagtatagcagattaacaatattgagatggtttcaggtgcacagcaaagggactcagccgtacaaggattgcttctataatgttgcctttttagtcagagaagtcagaggggaggagacattcaaagccactcagcttatatgcagaggaagacaaggtcacattttgaatacataaaacaataaagtaattcaaggaaaacaacaagatgctaagtaatacatagtattttagtattttgctgaacaagtttatgttatctttgatttatatttaaaaaactagtgtatatacacacatatgcatatatagtatataaatcattcttttgataaaatcaaatacagcaacacagaattttataaggaacatattttatatgtttgctacattttatagttttaattttataatttattttatatagctatcttatatttattttgcatgtaaatagtatagatgctgctttccactacccattagtatagaacttacaaacattgttcttagttcttattttttacaatttatatttttaggggatgcacagtcttactttgattaatttaataatgaacatatgagcctcttatagtctgttgttcagttttacagtttttaaaaaagttaattgttaattttacattatgcattttgatatatgggttatgattattttctgtttataattgtggaatttttttggaaactatttattagtgttaacattagtttactgggatcaccaatctctttgataccaatataatttaaaggcagcttatcaaactgcctaactttggaatctgatttgagggaaataataactttaatatttgactttcttccctttctctacctccatttcttcattatttgaatctttgtttcctctgtgttctacttttgtttcaacaaggacattacctattctcaggcatctttctttctctattccttagttttattatgaactcctcatttctgtgttaattacctac

SEQ ID NO: 60942 - DNA, 863 bp, Bovine  19866881164036
aaaaacaagatactgaggagagactagctacagttttgcctaagggtaacctgaataaaatgaggggaaactgtattcagttttcatggtaaaacaaaataatttaaaatatccttattaaattgtcataataaagttattggctacaaataggtcattttatggaaaaatatttcttttattttatagttaaacttatcattgaagcataaaaatacatttatcatgacactcaagctataaaagataattacgtctttatcagtcaaatggaattttactttgttcctttaaacagtcagtagaattttttcctcctgatgtttgtttagaaaaaattccaatggtaggattgtttttatggctctctcctaccaaaagaaagcaaatgtgatttttttttttttcttagtaaagtcatttaccagctgttgcttggtagaattcaatcatctgagcggtgaccacaattgggaaagccgaatttcttgatgtgtgtttataaaagaactgctgcaagattggactagcaaacacacaaaaatcaacaaagttggggtccctaatttctttctattaggtatcagaagagacttcaggagacataaaaagaaactgtaatccccaaagaaaatgctgagacaaaactgcctgagtgataggaaaaacatatcttggtaaggggaaagagaaaggattaagataaataccagagttttcagaacacaatcagaagagctgagactaataatctcctgttgacatgtgataggaagcactgatgtaaactgcctttcaagatagcgccactatgaactgaattcattgaagaatattatttacctgtgcttgggttataaatg

SEQ ID NO: 60943 - DNA, 953 bp, Bovine  19866881678357
aaatgtttttttaggtctgcttattcttaaattaggttgttttttttttctggtattgagctgcatgagctgtttgtatattttggagattaatcctttttcagttgtttcattttcaattattttcttccattctgaagtctgtcttttcatctcatttagagttccgtttgctgtgcagaaccttttaagtttaattaggcaccacttgttaatttttgtttttatttccattactctatggggtgggtcaaaaaggatattgcagcaaatacttttgagtacacaaagatcactacttaaagtaaggaagcaataaattctattgtgttataaataatattttatggaacataattgcaagctgtatacatggtctgttttagttttctaaattaatctagcaacaaatagaatcttagaaggatagatggtacatgaacccatgatgggacaacactttgccctcagcctacttttttttcctcacaggaccagtcataggaaccacggacagccctttggggctgaaactttctttacatcaagtgaattactgctgccttgaatttacctacttagtaataaaagaagaaatgaattagctatcccatctgctaaatagacataaaaaatgctggtaggattcttattattctttgagcattaagaccttaaaagtgtaaatgtttaaggtatttttatatactttctgggaaaatatatagaaatgaaagttgtcagaagcctctaaatatcactagtgagcagatgatcctccaaggctgtcagggtcaaggttcagttcagttcagttgctcagtcgtgtccgactctttgtgaccccatgaatcccagcacgccaggcctctctgtccatcaccaactcctggagttcactcagactcacatccatcgagtcagtgatgccatctagccaactcatcctctgt

SEQ ID NO: 60944 - DNA, 1209 bp, Bovine  19866881802145
ttttgtttgcagttacttatcttggaggctagataatagcaggggacagcctgtatttggggttttttcccagtgtaggatgtggttataattttctgttcctgaaatattgtatattccatattaatagatcctctattaatgttaagtattcatatagtaagcatgttttggttcaaatgtaaaaattagcaagtaaattttgcattgatctgtatactggattaagagcttaagcaatgaaaaagtctgcagcttcttagacaatacaataaacatagtccagtaccggtgagtaattaggctctttctgctggtctggtagtaagggaaggggcaaagcttcattcaggggttggatttgctgtgcaacattaacttgtttgattactaagaagttttaaatattaaaaactgttaaaagtgcattttttctgtccagattacctgtctatggttccattcactaatttatcctacttgtaaagctagggctgagattagaagccagggagtgattccatttccaactctcttagtacaccctgttgtttattcttttccaagaagcacaacagagcaattaaaaatgatagcctttcaaggactgtgtcttggtctaagaggggtcactttacatcagtcttttgctagcacgtcaatcctatggaagaatatctgccctaaaactggcagtagaaattggggtaaagtgtaattgatttctcttttttcttccctttattcacaatacagaattaataggctttttctcctttttcgtgtttggtagtattgagtgaactggggagaaataaaaggaagctctgtaaagtaaataagtgagctcagaagcaattttctgacactatatagtaatgattttactcttcttagtaccaggaatatgtcaccatagagaatttttatagctatcagagaactaataggagaaaaaaaataaccatttgacattggtgtataaaattaatactaatgatagtcatcaataagaataatgaaaactgcatatcatccatggataattaccttatgtgtaacaactgtgatgaatgtcattaatatctgtcaaattattactatagattttatttgattacaacactaaattatgttcagatatgctcaggttcttcagttctgtttcagaaatcttaaactgaaatctcactctttcatcatcatctc

SEQ ID NO: 60945 - DNA, 1143 bp, Bovine  19866880493774
tgaattttatgacatgtgagttatatctcaataaaaaaagtgggagagcacagtacacttgctctgccagcatggcaaatagaagcactggggtgacggccagagcagaggctgattcccggacggcgccgcctcactctgtgcctttagtgacattgccctgggggtacagccaagctccattccaggctcactgggcagcttccctctgagcccagggctggggatggctgggaggccggggcgctggcgggaccccgcccctgccctccggccccatggctcacctcctggctctctgcctgcagcgtctctaacaaggagctgtcggagctcatcgagcagttgcagaagaatgccgaccaggtggagaggaacatcgtggacacggaagccaagatgcagagagtgagtgcccgcctcccactcggtgcccccgagatgccagccccctggggacccggggctcagatgacccccgaggttctcacctgggcgtgattctgctccaggggacgtgtggtcatgtctggagacatttttagccacggcaccctggggagtgcggggtcaggtatctagcgatggaggccagagaggctgctatgtagcctacagagcacagaatgattcagcctcaaatgtccagtgcccaggtggagacacattgaagaggagccttcttagtgctgttaataccagctcctccaccccggataccgagttcctgcagccatgggccctgtctggagcagaaccgcagtctcaggagccaggccttggctaggaccttggttttgccacttactgtgtgaccttgaggaagtcgccttacctccctgtgcacccgaaaggggaaaccatcacccggtctcctgggctgctggagagatttgatgagattatgcaggtggcgccagtggttaaagaaccctcctgccaatgcagatagaccttaaagtgaagtcgctcagccgtgtccgactctttgcgaccccgtggactgtagcccccaggctcctccgtccgtgggattctccaggcaagaacactggagtgagttgccatttccttttccaggagcatcttcccaacccagggatcgaacccgggtctcccacatggcaggcagacgctttacca

SEQ ID NO: 60946 - DNA, 931 bp, Bovine  19866880575028
cctttcataaacaatgccccattccaactggaggaaaactggcttcaagtggaaaagaatggatgtttcggccaggctggtgtataaattactcccaaacactgtggaaaaataattaaaaagtgtaccagtgattttcaaatccagcattcaccagtcacttcagatgacccagcagaccaagccaaattctcaggctcctccaagtcataggattttggacccctcgtacctggcgccaaatgctcacagagggttaatattaacaggaaggaggaagcaacgactgcaaggctttcaagggcttttcacacacaggcccagcaacaggggagcagcgggcgcacccacgccaagggtaaggcagcgtgcaggtgaccaaacatcacagccgcgcacgtgaccaaggtatgtctataaagtaccaagtgggaaaaaactgcagaatgatcccacttttgtaaaaatcaacactactccccaaagcgaaaacctgtaacatggatatgtgattatatacctgatggttaagtgggtatgccaaacggtctggagcgagttaaataaacttgacagcaagcctgcgccagggtggactcgcacacttctgtattcattggcaattaaaaagtgtcgggaaaagcacaccacagtgtcaggctgggaaaccagctctgaggctgggcttgtcatggcccaagggaggggtcattacctcactcacgttcggctgccatttaaacgtggccatgggtccagccatcatccccttcacagtactagactcagggatgcctgaggtcctacagagggaaagacaggtggtcacaacactgtggcacctcaggagcacttgtcttcctccctcaattgggggcccctcttcactgctttgcttccttcagtcacactccgtcccaaactatcctag

SEQ ID NO: 60947 - DNA, 778 bp, Bovine  19866880594886
caaatacagtgacagctaaatataggaacttggcacatggaccaaggcacactcagcctcaaagcttccagctcaccaggaacacgtgagcttgtcaggaaccatttcagcacagacctcagggaccccagtcagtgtcgttctttgttctgaattaaaggaagtcttgtgttcagtctacgcaaacatccttcacaatgggagatggcccccaaatgggacacccaaccccccacatgcagacactcactcggtgtgcaggggacaaggggaggaggccagccagcgttcctggccacaacctgagacgctgaggggagggagggatccttacgtccttggctgcctttgggtccgacacgcaggcaaaggtgatgtcacaagttgaaacgacttcagcgggggttcttcctaggcgggccccctcctggatgaacaaatcacactgcaaaagtcacagatcctaatgtgagctgcaggcagtgcacaacacacacactagccaggccagagacacagcgcccagtgctcctgtgtggcctcccaaggcaggcggtctgactgctcgaggggaagtggatgggagccccttaaggacagtcttgtgtgtctgcaaacttggtgccgaggatgcacgttccacattctgctccacaggaagcacaaaacaagtgtctgctggaggcttcctgaaccaagaatgggacgtgaaaagtaattgtccacagctctctgtggctgtctcagctgtggtgaaatctgcccagtgctgtgtgag

SEQ ID NO: 60948 - DNA, 1579 bp, Bovine  19866880650076
ctctccttgcacaagacatggttaagcaacgcctctttcttcatttactacctcatggtcttgtttccagcttgtctctctctcagctctaatgttgtctgcagcttctccactctgaccgatgttatccttcagtattttcagtctcctgggagccatatctgcagccacctctgctaacgggctcaaaggttccccaatccttgtgggaatacaacactctcatgtttctcgtgttctctgtctagcctgctctaagtcacctgaattaaatgctgaaaatggaacccaccactctcctcaccaaaggtatctgttattcacagctatctgggtgggtggcaaccagttttctctaggattgtaaatcatgacagactaattctctttcctttgttcagtgttccaggacacccggaagacctggggatatgcatttgtacactgacagttgctcgcggtgtccttgaggcaaggaaaatgtggaccaggtgcactgggtgcaacgcagctaatctgctcagcagctggctttacactcgtaataaaaaaggatttgagtgatggcagaaaacactggactctgtcctcagcctggagttggattttttaaaaaaataagccaacacattcctcgttgatttaatgggcaacacccattcctcctttaattagcacatgcctccagctccttcacaccacaatggaagttcaccaaatatatctggttgaacaagtgacttcaacagcacaaaaaaagtgttttagtctgagaaagaaccgcacagaagactcagatgggagattcagacgttctttaggagaatgctccttccttaagagccctcatcatcacgactcagaagcacaagggggcatcagaatacaggcaaaggcgagggtggatgccagctaaggcctggggatcgcagtcaaggctccccacttgtctgggtggggcggagggcagccggcaggtacattgggaggactggggaaggcaggacaacaggctgccttcatcttttgctcccatctgcccccaccagggccaaggtgaggagttcttcaagtgtggtctcctgatgagcagccacttatctgggaactggtccacctgagactgactgatccagaaactctaggggtgcagcccagcaactggtgctttacgaagggtcttccaggtggttcaggaaggtctgagaaccactgacccaagtgttccctgcttaggagactcactagtgagcaaattcatggtacgaatgtacagggcaatttctgtcttccgcaagtcaagttactcccaggcaaatcgttaagaattacaattttccctttctctttccacttagtcccagcaacggctgggacacaacccttaagaagctgccttgaagtcacccccagacccacagaaccagagcccaaggaagccctcccccgaaggccctactttttgtctgtgggtgtgacgctgccattcaccgccgtgctgtctgcggcctggatggaggtggaccccgtctcctgggggaggaaacacaggtcgtcaggccggcctgcccatgccagg

SEQ ID NO: 60949 - DNA, 1513 bp, Bovine  19866880705836
cacacacacacacacaccctcctacacacacacacacacaccctcctacacacacacacacacacacacacacacacacagtttctggggtccttggccccctccgttgtgggtgcaaccttccccggtcaacagaggaggcttggaactcagagcagcgccgtggcccttgatggggctcgtgccagggctgggaggggctgagccaaggcctggtacgggggtgggggcgtggctgcaaactcctaagccacatggagtcgtatgcatctcgtcagggttccccctaaagatgagtagcaccatccccgtggagtagtgggaactggaagtgcttggtgtcacctgttggttttcatcagtcctgagtccccgtcgggtgcatcagaacccccagggatgctcattctagaccccgactcctaggccagtgccccagacgcccaggcagcctccaccccagggagggtgtcccaggggagaggggccgctggttgcggccaacacgagggctctggtccccacagaacatcaccaacgagctgctgcggatcgagcccgagaaggcgcgcagcacggccgagggcgaggcgttcgtgcgggccctcccggacagcggcagcaccgccctgctgaggacgcgggtggaggacacccagcgcagatacgagcgcctggtgcagctgctggaagccgcccaggagaagtgggtgcaggcgggcagcggggaggccaggccgggtggtcaggggccgggccaccctccacccctcagctaactcctgactcgtgtcctcaggctcgacatcgccaaccgcctggagaagagcctgcagcagggccgggagatgctggccacgtatgagacccagctggcccaggaggacacggtgcccgagagtggccaggccctggacagcaggaggcaggagctggcggtgagtgtgcggactccgggccccgggagccccttgctgagctgggcgtgggctctaagggcccccgtttgctctccacctctggacaatcgagggacccaaggcccaggacagcaggtctctccaggtttggaatcccagccacacaaggggtttgtgcggcctgcggaaatcaggtgctggtatcttcaaatcaggtatcagcgtagccaccccctctccctgtttctctgaaggagcagacctggccacctgtgctcagacgcccgccgggcaggtcagccgagcagaggcagctctgcccctcgcccggcacctgccatcttcatggtgccactgggccactctaagcgccagtctgtgagcccgtgggaggcccctcattcacgaaccacctcacagaccccttgccttgtagcgacagcctcactgggagtccaggaagcatgctcggagggcagcgcctccaccgggggcccttccggtccgtgcgcggcgtcaccggccttgcgctgtgcgccacagggttttagaagctgtttttcccgggtggtgttcattgtcacgggacggaa

SEQ ID NO: 60950 - DNA, 1388 bp, Bovine  19866880736107
tccctttctagaggttaccaagggaactgaactgggagtcagcgcaacgtttaccaggaaggggagtagtcaggtaaattatggagtattgggtgggaatactgcacggcctccattaaaggcaggcaggcccgagtgtgcggacctgaggtgatgcccactgtgaatctcaggacctaaataactcccagatccaaggagaaatcacaagggaggtgtggaaatcttttgaagtcactgaaaataaaaacatcgtttgtgggacaaagcgaatgcagtacttagcgagatgtacttaaatgcttagatgagggagaaaaaaaaaacaaagcagactctcagatcaacagtccaagcttctaacttcaggaagaaaaagaagagccaactgaacctaatgtgagcagctatagtaggaaataatgatgagcagaattcagtgaatcaggaaacaggaaaacggaaagatcactgcaaccaaagctgtttcattgaaacagtcagtgaagtgatcaaccccagacagaatcatcgggggagaaaacagaataaacaaacacgacaaaagaagatacgatgtcaggaatgaaagcgaggacgttccctcagatctcgccagacgttcaagtataagagaatattatgaaccatctcatgccaaaaactcaacagcttgacgaggtgtacagtgtgtccttgaaagacacaaacttgtgaagctgctcaagcatcagatgacccagatcgtccaatatctaataaaagaggttgcatttgtagttaaaaaccttcttaccaaaaaaaaaaaaaaaaaattgcaggcccagatggcttccggggtgaattctaccacgcatttaaggaagtaatacccagtcttcacagaccctttttcagaaaacacaagaggaggagggagcacttcctgactgttcaggccaggaaaatacacgatggggaaatagtaggacacgctgggtgttcctacatttcctaccaaccctggctcatacagagtggctctggaaggactcacgagaaactcacagcagggctgatcttcgggggaacggtttggtcattacaacccctttgggttttttaattttgtatgtgtattgctttttcccaaaagcggcaattatttggaaaacaaacagccttcagcgctgtccacagaaatcccccctgggtacctcaggcagactagctcagccaaggcctccgagaccaccctccccacccccagccccgctccgtggcccctgacctgagctccgcctgctggcagaggccgtcgaagcgctggcacagcttgtgcacctcggcctcctggcgctccaggtccgggcagtgctcctggaagcggcggccagcgagcccgagca

SEQ ID NO: 60951 - DNA, 2608 bp, Bovine  19866880987655
cagctgcaccaggcacaagtcactgagctcctctgagaaggagtcctcctgctcaaaagtggggtagaccatggaggactcggtgcgggtccaggcatgtggaagcttccaaaacccaggttcgatggtcagctggaactctgtagagaggcgggagtgggggaagacacaggagcagtgagccattccatgattaaccacccccccaggctcctgtggttctgagcccaggaactggctgtccctcccctggcagccctgactgcacttgggtgccttcagggctctgagcattacctgagggttgagcactgcatttgaaatattcccaaagctttttatctgaatttttttttaatcactaggaaccatgtggggacaggctctgagtaaatctactgcaccccatggaagcttgagatatctaggtagggttagttgcctcatttggttctattagaacatggagctcttacagaaccaacctcaggatgagccagactgggatggtcttagggaccaggcctgggagagggtgtatgctcagttgctaagttgtgtccgactctttgagaccctatggactgtagcccgccaggctcctcatccatgggatctctcgggcaagaatactgggatgtgttgccatttcctcctccgggggagagggtggagcaccccacatacagagaagcaggccgatgcttgggagggccagttatctccccacctaccctcctggacctgggagagggagcctgggaggcagggctggaccacacaaggagctggcttataccccccaccgcccccgcccaggaacaactcaggccagggcttatagggagggggcccttggtaggatgactccaggctgacaaggagacagaggctctgcattctaggccgagaagaaagatactggcaagatgttaatgtttgccgtgcaaagggtcagattacctcttagatctcaaccctccctctcctctgttctgggatgatcctttgcccccaagcctggacatgagctgaaaaaatgagggagagtcgctccctaccttccacctgccctctcaagctgaagtcaaggatgacagaacaccccccagggcagatggttacaggtcctcccagagcctccctgacactgactgaagctgcaccaggcgtcttcggtggatgcccccaggagctgtgtgtgctcctgaagaaatgggaccccccccacgctcttacgtctcaggtactcggggtcactcaggttgaggtagaagatggaatcgtggaggagaggagccaacttctccaccagcttgcccacacgcaggctgagcggctgcagctgggagtccagagcccacttctcctgaacgcctctgagctgcactgcaagggggaagcagagttcatttgtcccaacattggacaaaccacatggacaggaaaataaactccccgttataatacatgctgagcctctcggcttcttccagctcttgaggggacaatatttgctgagtttattggaaattaggcctctgtggagctcagctgggtactggcggggcggggagtggtggtcagagtgagggaaggtggtggctaagagcttgatttctggagaggggggccagggttcagatcctgtctctaatgctttctcattgggtgacctgaggaagtcatttaatttctctctgcttcactttctccatctgtaaaatgggagtaatgatattccttacttcttggagatggggttataaagattaaatgagctaatgcatggcattagtgctaaagaacctgcctgccactgcaggacacgttaagagatgcaggttcaatccctgagttgggaagatctcctgtagaagggaatggcaacacactctggcactcttgcctggaaaatcccatggacagaggagcttggtgggctgaggtccatggggttagacaaagggttggacatgactgaagtaacttagcactaatgcgtatagaggacttagcattgtccagagtgcaaaaaaaagcacttaataacgtttagctattactatttgttagagacttaggctttgtggtccaggaggggaaaaatgagggagagactcagattgcagagtggagaggcgctgtgtacagttgagcaggttgtacactgcacaagtgcaacacacattcctatcatgggtttgtatatgttttaagacaattttccagcagatgtcagtcaagtgactcgagaaaggtggtacccttttctaattctcacagaggtgccctgtggactagcagtggcccagaaggggtgggagaggatggggtggctggaagagaaggtcatggggtagccagaaagagaggagatgtgagggggagcttcagggcagagctgagcagtgagatgaggtagggcagctgccgtcaggttgggcactgcgtggggcagagtggacaaggtttaaggagggtgctgagcaagtctggtgggataatgggctctgtaacacccctcccccaattctgctccctctctgaacttgaaccaggcagtctagttctgaagccttgttctagatcgtttggctgaacctgt

SEQ ID NO: 60952 - DNA, 744 bp, Bovine  19866881118167
ctcttggcaagggcccgccgtgaagggcagcagccgaaagccaagcaccacggcttgccgcggacgtctcacgtgcccccggcaggcaccgctgtgcccggcccccaggtcaaggtctttcatgctggcacacagccgcagaagagcttcacccctccggctccattcgtcaataagcttcagggcccgaagcctggctcccctcagtgtcaccgatccctcctgcagcttgtcaagacagcaaccaaaagccagagcttccatgcttccatgccagcctcctcgggcacgccagcctccagcagcagctctcataagaccccagcttcatgctctgctgccgtgagccatccagcaaaaccacactcagccagctcttcaggaccaccctacaagaccagtcccttcctgggctctgcctccaaacatggggtgtcgtccggcagcccctcgtctggaggaacgccagttcagagccctgcttctgggaacctgctccccacgacgcagcctccctccacaggacagtccaccagccgacccgtccctggccctgcagtgaagaagccacctgtaccccagaagttgaccctggtggcccctcccggtggtcccaatggagattctagtggggggacccagggtgtggccaagttattgacctcctccctgaagcccagcgcggtgagcagcgtgacatcgtctacctccctgccagtgagtgtcctgctgcagcccgccgcc

SEQ ID NO: 60953 - DNA, 1206 bp, Bovine  19866881144444
atgctggttcagcattacctttcttttgtttttcttttgcctcgtggcttgtgggatcttggttccctgaccaaggattgaacccatgccctaggcggtgaaagcacagagtcctaaccattggaccttcaggaaattcccagcccaacatatcctgtgccagctacacatgcccctagaatccctacagctccacctgggatgtaggtccagacctgacatcctcttggagcttcaaatctactccacggtagagtcggacatgactgagcgactggacaacaacaaaagaatttgaagcatcgtttttagaaggaaactgacacagccatgtcatgaggccggatgcaaaatcacatttgtttttaaaagatagaacacgagctgtggccgtttcatgttgatgtttggcaaaaaccatcacaatattctagagtaactattctccaattaaataagtttaaacattttttaaagataaaacccaaggcctggaagaaaccactattgagtgcttactgtatgcacagactttccccacccatcttatcctcaggacaactgcatgacgtaggggatccagtggtccccgtctaacagctggggctcagagaggtaaagtgacttgcctgatgtcacagagcaagccagaagtgcttggaggtcttaacctccctgtctctctgtcagcaacactgggggagagttgtcctgtgaggcataattctagactgttctagagcaaaccaaacccagtttgatggaattctaggagtgaggaaaggtacaaataggagggctcaggcccctctttctcccacccacccaatcagtctggtgtgttgggcctctgtctggggtttcatttgaagggaagtttctgcagctgaggctgaagcagaagagtgatacgatcgctcatgataaggggctgagccactggaaagtttatcggtgcccacgtcagggccccacccctagagaagctcaagggcaagtggaggaggtgagtgaagtgcccccagcctggaaggaagagacctcaggcgtgatgcaggcctggcccggcagtaggggtggggagtcgggaggccccatacctgaagtcctcagacgccagcacctcgtagtagtagaggagtttgcacctggggccggggctgtgcagggccgtcaggacatcctctacgcccgggaggctgcagg

SEQ ID NO: 60954 - DNA, 1192 bp, Bovine  19866881228242
ataaggaaataatacccccattaacaacataactttgcaatatttggttcagaccttttctggtttcttaagaaacaacatcacagatacagtcaagccatctcacctgatcccatatccctccttcccggagggcagcaccttctgaagctccttcctgcacatgattccacgagcacgtgcttgccccacagactaacctgtgtggtggcttctagccaggacactaccccaggagcaagtttgtgtgtggccccttggtatatgacaggacaactgacctgagagctaaagagaaagaaatatacaactggtttcatcattttcttttacacatgtgtgtacattattttgggcttcccagatggctcagtgggtaaagaatgatgcaggagacgctgatcccattcctgggttgggagaatcccctggaggagggcatggcaacccattccagtagaattgcccggagaatcccatggacagaggaacctggagctacagtctgtagggttgcaaagagttggatgtgacccaagcgactgagcacgcatgaacgcacgtacattattttaactcttgtctcttttctatctctcagttgcaacttgctgccaaaagttaaaatgagtgttgagataactcagtgactgacttttagtttctgtctggatgctcagcatagcaaaagagctgccaaggggattatttgtgtctgtcacctgcacaagtttgcaagtatgtgcatgcttaccgtcccccgcccctgctgtcctgcccaccagcgacacagagttgttccttccatggttgtattgctgcacaattcagctcagtgtttagttctctggaagaaataagaatgttcttatcaattcccagttgctgtaaaagtaggtagggttgaaataaaacaaccactgcctcctagaatgacatgatgaaagtgaaagccaagtagctgaatgagtccatgtgaaaaaagacataaatatatagttttgttgtctttcagttataaatatttagtaatttctattgtgatttcttctttaactcacaggttattcagaagggtatttttaattttccaaatgtatgcttgtgttttaactgtctttttactgtcagtttctaattttgctgcattatagtcagaaaatgtcatctgtataatgccaattatgggggt

SEQ ID NO: 60955 - DNA, 1326 bp, Bovine  19866881235384
gcaggaggacatccttctgcccggcttagcccacgcttgcctggcaggacgtgaacctgaagatgcccaggaacaaccagctgctgcactttgccttccgggaggacaagcaatggaaactgcagcaggtaactgggcccttccctggctggggcccaaggcacaagggcaggtaggaataggcccttgcagcgctgaggcctccagggctggccgctgcggggccttgtggctgcagcaggcttacaacgatgtttcctagcagtgcagctggggtgggcagtgcctggtctcctagcctgtcctgtaattgggtctggcttctgccacctccctctcccctctcactggccaccagctgtctccacttcacggcctttgcttgggcttgtccctctgcctggagtccactcccccaacttttgccactgcacaggcttcagctaaagagttgccttccctcgccgccgcccgccccccaatcaccttgtttccttgtgaaagctgagcagtctattatcttgtgcctttcctctgttaccctctgtcctcctttggaaagtgagctgcaagggaccggggactgaggccacctcactgcaccagccaggcccggcaggcggcacccaccccagcccttctaggaagataggccccctcagggtagggatcctaggttgggcccccagagaccattgggtgttctgaggctggcacctttccctgccgaggccaagcccactgaccgctcagtgggccctgcttttagatccaagatgccaggaaccacgtgagccaagccatttacctcctcgccaaccgagatgagagctaccagttcaggacgggagcagaggtcctcaaggtgagccacctcaggagtgggagagcccggttccctgaccaccgattggtcccctgggaagctctgcccccaccctcaggtgaagctgagtgtcaacccttcacctctcggtgtacaccatgtccttccagccagttgaatggctcacggcccaggccccagaaacagatgtgggttctgatcccagggcctgcactatgagccaggccacctcaaatcccttacttagccattctgtgcctcagtaccctcacctgataaaaggaggggacaagctgtcatgcctgccatcatgacaacgcgggtgatgttgcctctagtaagcacccagtagatgggagctgcaggtattactgtcaggaacagaaaagcttctgtagttaacaaaagtgagtccacgtggtgtgaagggacaagatgagctcaggttccctgagttcacgctttagccctgcctccaa

SEQ ID NO: 60956 - DNA, 2251 bp, Bovine  19866881301581
agctggctcaggtatggtgacatggagtggctgggctctcctggaagcgatcgggcggatcgttgctggtccggaaccacttgcagctcacggcccagagcagcccttagtgggtgctccgttgtctgcttttctgggctttcttcccatcccaagcaagggcacagggtcagctctgcctgtccttttgtgattccttcacgttggaaaatttactttcttctggagagatttttctctcctccttcgtgcctatcagactatccttccttttgtgtgacagatactcatgttggcagcaggcagctgaggcagagatacgtctctttagtaatctcctgaaggttttgaacattcatagacgtttgcagacatgttgggcgtggggcatatgcttagttgccgctgggtttagtgttaggtagtgattataggtggagaagggaatggcaccccactccagtactcttgcctggaaaatcccatggacggaggagcctggtaggctgcagtctgtggggtcacacagagtcaaacacgactgagcgacttcactttcacttttccctttcatgcattggagaaggaaatggcaacccactccagtgttcttgcctggagaatcccagggacaggggagcctggtgggctgcagtctgtggggtcgcacagagtcagacatgactgaagcgacttagcagcagcagtagcagcagcagtgattataggaatctggaattgtgataagtaagaagggctgaaccgtaagtactgtccaacagccccatgttaaaaacagtaacggtctttggaaaatagcggacattccgcgtgttttccccctggggatggggagttgatctagtactagagcactaaggactgtagattccgtgatccatgaatactgatgataagccgagcacgggtcattagttatagtgtgttttagttaaaataccatttcaccttggacatcatgacttgtgacaaccctggggacacttacactctagagcttcagttttaaaccagtgactctcagtgtttcagaatctctgttgtgtatactagtcctcatatacactaggaccagggcaggataaaatgttaacaacttctgcaaatgattttctcatttgcaaaaaatacttgaacatggcatgtgaaataattcagacgtcttattcggagctctgttcatccttatggaatgagcacagtgttgtttgaatgtacccatttaaataaattatgccctgtcaggattcaggatttgtcttaacaggatgttaagggagaagtagttaaatgggaacttggtgtgtatgagtttactgtcctatggttgcactcagaatatatgttaaaaaaaaaattatctcttcttttcaatcttgtggtttgtaatcagattatcctgtagattctgaaagccttgagtcaagtcagatgtgtgtggcagaggccagtcattccttagaggaaagttaaagtggctctgtatgcgtctctgcttctaccacagggggtgtcctagtctaataactgagaatcattattgcattttcttgggaaggatggacaagtctggtggaaacaaagcggcgtcatgtggaacagcgttgggtcgtgatgtgagaaaaccttactttgtggagtccgtcaggtggacgccgagcaggctctccttcctcaggaattgccgagtctcggtcgtctttcaggcgtgatggagacaggtcaggagcccataggtaaggtaggctcaggtcctggtgaggaggtggtgacgagacgtcactgtactggcttgaacatatattcacgtgtgaaactgttacttaagtcatcacctggcccttcagtgccagcattaagaaacgggaaattgggaaaatcctgccactctgaaaactattttcaactcactctcttttctagcctctgtgtatatgtttttatgcagttgtaattgtagttgtgaataattgttttctgctcttttcacttaataaatattattataaagtcctcattatttttaatgattgcatgacaaagaaggcttattttagaaagtgacttaacgccgctgtgtaggctcccggcactgggggcacttggtgccgcctgcacgtgtgcacaggcactctatccccaggccctgctgtgagagtcgctggcagaggttcctcccagggaaagacgcctgtgtacacagaaattacacatattttcaaaagtcacg

SEQ ID NO: 60957 - DNA, 829 bp, Bovine  19866880520713
ccatggaagtaatgatgatggaaatccagcagccattctggaccatgaggcagcctgcagatgaaagccatatgctaaggatggaggaacaggaagatggaaagaacccgggaccctgaggacaccatggactctccgcctagactgcttgtctcttcatttatcacacaagagagaaaaatacccataacttacataagctactgttatttctgatctatgttcctaatagccaaacaactcatttttgcatttttgtgcatatccaaaatagacatatacccaactcatgaagaactctggaagaacagtgttccagatctgtactggaaatgcaaagagctgagcactttccaacacaaagttcttaataaaccagtatgtttctcatgttattgtttagttgctaaattgtgtctgacccttttgtgacctcatgggctgtagaccaccaggcttctctgtccatgggatttcccaggcaagaatacttgaatgagttgccatttcctccccgaagggatcttcccaactcaggaatcgaacctgcatctcctgcataggcaggtggattctttaccactgagccaccagggaagccctgcgtttctcatagatggctgcaaatgtgcatgtgccttccaaacagtaggatttatttagtttaacaattctctagacttgtcataaatacgccaaaggcacactttcctcaagatttcatagcttaattggctccacgttctgaagcttatgaagtctgcagtcaccagatctgcttttcatccttcaccaagcctgcataaactctctactagacactgcagca

SEQ ID NO: 60958 - DNA, 995 bp, Bovine  19866880576350
ccctggctttggtgggaaagggatctagctgccaaaggtgatcagagctgtcaaaggatcctccagactgataacactcagcccccagtttttcccagttcaaccccctaaaaagaggtttgtttgttttttgtttttttttttttaataaacccagtggttaacaaccagcttgttagataaaagcctgagggacacagagggaggcttatgctctcctactcacttcattaactggagtaacaaccaattttaaggtgattattgctattataagctctgatcaattttttaaatatgtttccaggttttgaaccaaaagcgggaatattagagcaaggagagcagctgtgttgagaattagtcatatccccagattaataactgatctttccatcaaaggaacacaggacacatttagttagggttctaattgtacctccaataaacctccaccacagtgaaatatgagcacccataattttaagttccaacttcctatacataatccatctgactggatggtctcgagcaaaggcagttaaagcaatttgtttcacttatataaaggaataaatcagtgcttaattatgtgaggtttattattaacagtgctggcaatctgaccatatgccatgacttcatctttttacatcaagaaaaaatatgagaatatactgattgcctttatgatgcctttcccctctccacagtggcgcacagggaggagggtggcatgtgatatgaccagatgaggaaaagaaggggccaggagctccctgctctgagtgcccagtgtggggtctgggatggttgtggaatggtgagagaacagttgccatggagcaggagcagggaaacttcgcaccatcctaggtattacatcccatcataagaacaagaccctcaaatctttttctatagaacttcaatgtctttcctaaaccaacatccaattgctggcatgcaacagaggacaggaacacagatcagtt

SEQ ID NO: 60959 - DNA, 3029 bp, Bovine  19866880637465
ctggtgtggtgcgattcatgggggggcaaagagtcggacatgactgagtaactgaactgaactgaactgatgtgcttatggatatgatgcaataggaatgacatagcaatgcttatgaatttgttttgaccacaaatttgaatcataatcctatgtaatgtctagatctcatctgaactcatggtatattaaaagtacagaaaggaaacagatgaagcagaggtaaagaaagggcagatcattgtggaccatagagagtaaactagttcatattttaggttaagtgacaagatattgaagaattttcatctttgaggtagaacagtccttcgtccctattgcaaaggatctgcatgggtaggtatggaatacccttgtgtatcagagaggggaaaatgtatctgcctcccagctccaaataaatctttttctatattggctttaattatgtacatataaagcatttcaattatctcaaaagattaaaattagcttacttatttatttatggttaagcagaaagtatactaagaaagtatgctacaatataaaggagtggcatgcacaaaaggcaggaaaaattaaaagaacctgttgtacatgcgagtatccacgagtggactaagtatgacccttcagcctatcatcacactctgaccccctccaaggaaactgacccatctctctggaaaatctctggtgcccagattccatgagattggtcttgctttgtttcctgtctgtaggtacctggcatgatatcttgtttagcataggagcaccatgtcatttgtagaagttgggatgtaaggaaggaagacggcagagaaaaggagagggcgggaagaaatgaggaaggtaaaaggaaagcagcactttgggtttgcggttgacatttttacctcttggttttgttatcttcttggctgtttccttattctcactattccctaacccatcttcctgggacttaaaaaaaaaaaaaaccatccaacatgacacttccaaaagattaatattttcatttcaacatttctgaaagtatttcagtgaaattgctttcaaatggtttattttatattagatcattgagagatagattaatgtcataaacgtaggtactagcaagcaatatttttgtctcctatgcgcacatactgtatatttcataacctctgataacttaaagtcactaatttaagtcaaattagggaaaggccagtataataattgctatatttccgctctttcttgataacaaatgagtcttttttccccctccaccagtatataatagtgtgctttttctctggctaagatataaaagcactgctctacacgaacaaaaatatttttactggctatgttattactgagaaatgcattgggaaaatgtaaaaatatttcacctttatgttgaagaaaataaacatagtggattaaataaaattttcacagctcctgacacatgccatatgtaatgcttggtgaacgtcaaagaggctttgctgcttctgagaatcactgactaaaacaggagaagaccttgagtatttatttatccaccacccgaccctcaacacattggacaaatgagacctgaagatgttgaaggacaatcctacaggacttccaggactgaaaaccttgttatacaagatccagccctgcattaattccatcacaaaatgctgcctcctgcatgcttcattgcttagtgttgaaaattagcttgaagaacaaggagctgggactccggaatcaggctgactggacttcaggtccttacctggaccctgactagccctgtgagccttgacaacatattctagcctatggaagcctgaggttttcctataaaaacaagatttaatcatgccaacctcaaacatgtgtttgaatgtcaaacaaaataaagtactggcacatcataagcgctacataaatgtcatctattaaaactattattattattattattattcaaacatatagcatatgaaactcaattttgctgacttttgaatgcagttattagctaaaatgggacttctaaattcttatattcacacatataaaactctattcagaaagcttttaatagtctgactctaatgatctagatactaagtatgttttgacaattttgcaaactcaaataaatcaaaaaatatgtcactaaagcaatactctgtaaaggatgaacaggagttgacccttgccttcaaagaccctagagtctgcatgcatgctaagtcgcttcagtcatgtctgactcttcacaacccccatggactgtagcccaccaggctcctctgtccatgggattctccaggcaagaatactggagtgggttgccatgccctcctccaggggatcttgctgacccagggatcgaacccacatctcttatgtgtcctacattggcaggcggattcttcaccactaaccctcgtggaagagaaagacatgaatagccatgaaacttataaaagacagagtgtggtgtatatactataacagaagtgacaaagaggggctatggtagcatagcaggaggaagaaattcaggctgagaaaagcaagaaaagcttcatggaagaaggagcacgcctgcatgcctcatgttgtggccaaaaagaaaatgtatatgactctaaattattactagaaatatagaaaacctaggttaccaaaaagaactaccaatttgcctggtaggttaaagacctatggcacagtctagtaaaaattttattcacatttttaatttgtttagctgtatagaaagtgaaagtgaagttgctcagtcatgtccaactctttgcgaccccatggactgcagcctaccatgctcctctgtcaatgggattttccaggcaagagtactggagcggtttgccatttaactgtataagcagtagataaatgcatttgggttgtaaaagtacaaccactactggaacaagaaagtaaaaagttaaagttattcctcaactggggtctcccagttcccagcatcaactcat

SEQ ID NO: 60960 - DNA, 1565 bp, Bovine  19866880700897
taatcatctattgaataaagtaaacctggacaatctagaatctggatagaatagtgaagaaaacatgcagcatctgaatgaagaggaaaaagtggaatagatgttgtaagcttcagaaaagtgtagtaaacacttgctggatggtatgaagtggctcctacaactaggtggagattatactccagaagaaccccaatgaagcaagtcttctgggtttaaaacagggtgtgatgcttctgaacctccggaccttccaatttcacttggccttagcaatcataagctctggactgctgcacactgtcttatgctattcccttggttgtcttagaagcagaggaagaatcacttatgaacaagaaattttattgttttcatcacaccagcttcagttgggctattacaaaagactttcttttatgaaatttctcttcgaaaacaatggattataagataagaggaaatgacctcaggcaagtgaaaaaaatactgctaacgctgtaagaaaactttgcagaagtttctctctatttttgtgttctgtcaaacttcaaccatgtttcatctttcctttctccaactccaggtagcaaaactgtgtgatggttaatttctcatctaacatttatcatcctgaatgagagtggatttattcctccctcacctaagataactgtcataacagagatggtttgacctcatcttcttgaaagagctccctccttctagccaagataaacaaaacaaaacaacaacgtaacctttgagaagaaactgatttgctgctttctgccatttggaaaacagaaagcagtgtctctgccccagctcttatcaaaaccataagcaagtttgcagtgctcttttgggggtgaaccagagagtttagcagaagactgcacagagatggaaagagattcccaaaccattgcctgaactttgccctcagctctgctcccagctctttttctctagaaagggagctagcaggtggcatgctatgcagcaaaccagcagcaggccgatcacagctgtgcatgtttggcaaacaaatgtttaattttggaattggtctcaggccagttccactgagtgggggtggggacaaaaacctgtggctgtcacgtagaagaagcagaacacgtccacagataccaagaacccaattcactgccacagagagacgcacagaatcagctcccgcatcactcttgttgcaagcttctcaccctctgtcccaggccctgatggaggaagagggtcccaggagagaagatccccttctcggaagtagaagtcacaaaaagagggaagtgactaaccctcaatgtttctcaccatcatctctcttttacaaaaagtaggattctggcatcagatggaatctgcaggcatttcttcccaccattgggaagtttcaagttctcagtgtgtcatgttcccagctcagctcccagaaaccatctgatcctgtggaaggaactcaaaaataatgtcatcaatgactggggtgggttttatccctccaactctaatctaatgtattggtgcttccattgctccat

SEQ ID NO: 60961 - DNA, 1677 bp, Bovine  19866880733661
aaatgggttgaaagttcctgccctacatttaacaggaaggctgtagagacggcgcgtgaagcagctttagaaaggcaaaatgctatgtgaatgtgaggacttacccacattggctctggtggtagacttggagcccagggagactagctctttctctcttgccacgagcaaggaattttgggaagtgcatattgcattggcgtgactgcaggagaaacttctttcttcctgttcaatcccatcctcacctgtgaggtggaaccttttaatggacagtcattttttggtgtggtttctcttcaaggagtgaaaaaaaaaaaaaaaaaagaactgagtctttgctaacatttttccctttgatttttttccccttttggaaaagggataaattttgagtccttttcaagtttcctccaggtcctgctgagcacctgggtgtagtttctgagaaaatcaaacctgattgttgagcattgaaagcctctgtagactgagctgaggattacctggggcacagcagtctgactcctctgtaggtagcaatgaacacaggaccatgcgctgctttaggctagagatcaggtcttgtgatggagggggatttatgagttctgttcctgcctctattattgcttgctgtgagatatgaggcaggcatcttttcctctacttgcctttcctcctctgcaaaatggggaaaataccagtgccttcatcaggcagagtattaaatgaatgaggtaaaaagactcagagtgaccaatcaataatgttagctgttatgagtatctagggatcctttctgtttggagaggctgaggctggggaactccaggctaaagatttaggtccctatgcaaaatagaaagcaacctgaaacgagataaagcattaaatacttgatgacaatgggaaaacagaacttgacaaagctgattttgatgctaactttagacactcatctgctccaagatgaggccagacctacaataagatgccaagcccttgtgttggcagctatgtatgtgcttgactctctgggagattttgggatggattttctattgctgtgttgaaatatcagggagagaggaaaatcctattaaatctaaatactccccgttttatgggttaagacaaaagaatggatgagatgtcaacatcagatggagtatcccagggagtagactgtcaaggatttagaactttcaaatgatcttattttccactgataactttatttttaacataatcccatgctatctcttgcagaaagatgccacttataaatgatgactctgaaaaagttatttgttaaaattcaagtaacttgaagcaaacacttttctgcacttgacatttgtttggctcattttcctttatctgtacagtataataaagtcacttgtaatcacatgcaccacagaagctcagaatacatcttatctttttatcccagagcttgttatttgatttttgtgtgaaacgaaaaactttattttctggggtgctgactccatcattagaatcttcctgaactgtggctggaatcaggctttcattgtacttccacggtgggattaccactctgggaatgaagacaaaggattccttgatcctctcctttgctagctgcttcttcactagcagtgggactgcagaaggaagtggtggggg

SEQ ID NO: 60962 - DNA, 1247 bp, Bovine  19866880830133
aaatttataccaataggtccaatggaagaggaagatgatggatgggtcaaagaatgcagactcagaagaatgtactttcacagggaaagagagagcactatatgcagaatgagtggctggagcaaggacctgcagttggggattcacacagacttttcagagaacaatagctaaactatgatggcttaatagcaaaacaataaaacaaaaccctgaagagaactgctttttaataggcagttgtaggtggaattggacagcttagaatgattgaacggtactgcaaaatctttaaatggcaaccttcagatagaccaatttatcatcattgcagagctattgattaagattggagaattgatgttatatattacatacacacagcagtcattttaagtaaaagttaggaatagcagtctttcattgccaagcatgtacctgcagcctgagacaaatgctgaaagcagaaatttgaaatttttctcattgtttgaggcttttctatcatgtggcaatggcaacccactccagtactcttgcctggaaaatcccatggacggaggagcctggtgggctgcagtccatggggtctcgaagagatggacacgactgagtgacttcactttcacttttcactttcatgcattggagaaggaaatggcaacccactccagtgttctcacctggagaatcccagggacgggggagcctggtgggctgccgtctatggggtcacacagagtcggacacgactgaagtgacttagcagctgcagcagcatataaatgaaaggcaccttcttttccccttctcttcccttgaccttcttcttgaaataagaatgtactggttgtttctttgactgtggtagtcacctgtgatctgtgagcaatatcaggatgcacagatgttgtaaatggcagtaggcctacccattgagagttttctgaaatctgtgccagactctaaaacaacaaaattagcccaattgattgggccagtggaaagcagcctcaactttgccaatcttacagagtcaaggagagaatcctcaactgacactagaattctttggtttggttctgtaaccaaaaggtggcctttgctaaacttgagccccactcgagcacaatttactagctcaagttacttccacttgagtcttctgtagtgaaaacctttcctctttccaggtgtttccagctgtgcaataagaaaaaagaatcagttctaaaaaataacagaat

SEQ ID NO: 60963 - DNA, 934 bp, Bovine  19866880833443
ctgggcatctctgcttgtgtcaggaggcaagggacctcagccatgacccagcaggtcagtccaatgcagagttgttcattctgctcctctctaatcgcaactaaactctgcaacattgaaatgaaacaagtattaagtgggaacacattaaaaggctcctgagacttattccttggttgtagaaactctaggattctttgatgcttcagaattttccacagcagcagcgtctacaaagggcagcacaaaatttgaccgcacagtttaggaaaagtggcctaatagaaggaacacaaactaagaagaacccctctcttgccatagtcagtcatcacaaacagaaagctttttccatgagtctggccaactgcactgaaccaaaatggctcagacaaggccatgtctatctttgaagtgttcttaagggtgattctgttatttaaatagggaacagcaatttcttaggaagtcccttggctgataatacatttgttttgacttgtatagaaatcgtctcatcttagctgtttctaaggcatgccaaaagtaagctgaaaagtgaaaaactagtcaactggacatttctaactatctggatccttaacaacatgcataacaaacatctatttctccagttagcatatctttcttggagaaaataatggtgtcttgccaccatagatgtttgagtccctgtgaatacatgggtagaaacaacccatccaaactcatctcatatgagatggctagaaggtcttgtcctactctggaactaaaaagctatccttaagcaaaaactgacttttccttcctgcctctcacatgttcagtggctcaacaaatatatgttgatgcaaaagtgggcaattccagggagttcagatctccttttccggtcaaggagcaggagacatgattttcttctctgtagagc

SEQ ID NO: 60964 - DNA, 1813 bp, Bovine  19866880851951
acaacagcataggcaagggtgtcttttaaatatttctttttttttctgaaagactccagtgaaatctttcctgaaaacttttcataccaaagtcttctattacatgagagggaagttacctgcctacatgattatttgccatcacattacagccaaatttctaactgaccgtccatcttttttccagtctcatgaaggagaaggaagaaatcacactgagaaagagaatattcccaaacatgctgggtgaaggcatctaattggcagctggggctataaaccacattgcttccctcaaaaactgcttactctggttgattttcttgtacctatcttaaaaataggacagtgcccctgaagtaggattagtagcagcaaaccctgttttcagcagtgaaaacaaattataagcctttttttttttttttcctcactacagagccatgatacaatagcagggaggaaatcatttgttcacttgagttcagttcaagattatactcaagtctgattgcaaaagcccattcacagggaagaagagacaaaagactaactgctctctgggtagagtgtcagaggctcagtgtttacaagaagaaattgaggggaagattagagaataattttctcctagggaattataatagcttaggggtcttttgtagagaaagtcctttgctaggattaaaggcaggattattggtagagagttgagaaattgaaatggagagcctcttaaaatggcaatttagttggaatatccagggagttcttgaaatgtgaattctaaggaaatgggtagtacttaagaaaagaataaacttggactcactatttcaagtgatgatactataagcggatcacaaaatgatggaactgccaatgcctgccgaagaaagacaagagaccgatagtatggttactgggtcatcttttaagtaaaggcacacgctcaaaatcctactgagggagaaattgatctaatctacatacttaagtaatggctacactcactagctaaagaacagtaataattagaaactgaactaatgttatattactggtttttttgtgaaaaaatactttattttttccctttttatttcatattggagtatagttgatttacaatgtattcatttcaggtaaatagcaaagtgattcagttatatatgtacatttatctattctttttcagattctctttccatataggtcataacagaatattgagtagagtttccgtactatacagtatgtccttgttaattattttatatctagtagtgtgtatatgttaatctcagacttctaatttatttctcaccctagcctttaccctttgataaccataagtttgtttcctaacaaacttttttattactctttaaatctaattcccaaaagttggtgttagcataagtcatattttagcagcactgttcgttacatgtaaaaaggtttgagcttggcaccttatactaaattcaagacttgtaaatttaaagtatacaaaatgaaaagtttcatttggaagcaataactactgagtaattctgaacttcctacgattacattggtttcccaattacctgtaaaataaaaatcacacttcttttcttaatatatcaactagacttttggcaggaaagagctgagagtttaaagataatttgttgaagggactgttgatggaggtattggcaggctttcgggacctctgagtgatgctgaaacactcagtaagtagcaacgactagaggcctgaaggcgcttctaggcctgaaggtgtgagtagttgtgctgactcaag

SEQ ID NO: 60965 - DNA, 1877 bp, Bovine  19866880904593
agggcatggcaacccacttcaggattcttgcctggagaatccccatggacaaaggagcctggtgggctacagtccatggggtggcaaagagttggacacaacttgagtgactaagcacagcacagcacactctccagagtaattcaaagtctatattttaaatcatttaattagttaacgattctattattagattctaatattaaataatgtttatttggagaaacagtttcaataatgggtaaaacttatctataggtctttggagaattttgctcacatgttccctctttagcatggttacctaaagaagaacaatatttatcttgtcctctttacctaactgatggatatgtttcaaacccatgatctctgtggttaagttttagattaactttttcagcttggttcacaaagtagtattatgactcacacatttatagttcctgacacagtagagaagcagaagcttgaccaggagcccagcatcagagaaatgaaaatggtatatagatggataaccagggttgacacggcaggaaaaatgtagatgttctatgggtaaacattcattgtgaagtttggacgcacatttaagtattttctgaatgttacgtgacaccatttgaattgattatttgttgttattttaagcgtaactcatgaattttagacctttttccagacacatattattgttcctatgttatatcccataacttgcttaaagtatttggctctcttcgatgtggaatatatccaacttggaaccaaaaatatgagagttatgtgagatttcaatagtactttcaaaaagtaatacaccattttcatcagcagtattctgccttctctcaaatataaatataaaaactacatccaacattttaaaaagaggcaagtgtgtttgaaacattatatagttgttaagtgttgaaatagctatattatttcttgctatcttagaaaacaaaggacagtaagtctacaaggataaacaacaatttagaggggtgggcaagggtcaactcaggaaaaaaattgtgttagttttttgtctgccccacatttctcctttttggaaatcaccctcttgtctgtcacatgattctggtaaatttgtcaatttaggagctacttccctgccccaaagtttgcatgcgactaaacagggataaccagaacttctgttcagtgattgagatgaaaattgggcagggcagggggttggggggaggaggaagaggctgtctcttccaagaggttgagattaaaaggcatgtaacagtacaaatgttgcgatccatttttttcactatgtaaagagagcttggctgaagatgaaatcaacagagagggacacagaaatagagtgacaaacaaatagactgaccacaggacctcatttaagtacttggataaagctattcctaaagcatgaaaagaataacagaaattacataataaggtaaaatggttgatttcattaatattcagctattttggaaacaaacctatttgcagaatacagctgtaaacctaaattttgtaacaccacacatcaatagtccttgtatctttttttgtatgccatattcattggaattaaatttatgtactttacctagtagctcagcttgtaaagaatccatctgcaatgcaggagaccccattcaatcaggggtcgatcaggagtcagaaagatcccctggagaagggagaggttacccaccccagtattctcatctggagaattccatggacagaggagcttggcaggctacagttcatggggttgcaaagtcggacataacaaagcaactttcactttcaccttataaaagcttacagttctgtttgttagcatcaggatactt

SEQ ID NO: 60966 - DNA, 1190 bp, Bovine  19866880956211
cctgacccagatgtcagccccagaaaccagacatcagaacaggcagctgctggaggagatgagcctgtggcagtacagccagagatggatgctggggttcttcggggagctcaaggagcatgcatctcaggcggggtatcggggtgctttcctggtcagtcacaagctcagctcacccctgagtccttttgccagactctggggacccatgacacatcccttcccaacaggcaccaggacacttacacacactcctcaaggctcttaacttatatagcaaggaccggtaggaccacccagagctcatattattcttactctagtcatgatttttgcttcacatattctattttgaaaccatacactgtgctgaaattttatggtggctcttgaggtagtttatggttttatcacagattgatcctttattttctaaataaatttagaaatttccttccgtttcctcaaactatagacaaatgtgtataaacataaaactaggtaagtgatggcgtcatgttaacaacatggctttttcgaacttttaaaggatggtagttatccgttggtcttaggaaccaaaaaatcagtgcaactccaaataaaagtaataaatctattctcttccttcaccttagctaccctgttcctattaacaatacctattataataacaagcactgacagcccttgagtatttttttcttcaaagtagatgaatttagtcctttcccttcccattctcttatttctgaaaaagggaaagagagaaggggaaaggaaagaaggaaggaaggaagagggggtggaaaaagtgaacgggcagtgataaaagctcttttataagtcagaagaactaaattctcccaatatttaataatcctttttcctctttgtagggactgaaggctgaattatgccaaggtgtgacaattagaaaaattctgagtcagggaaagtttaccttagcctgattttatgcctttaatacatgcttatattctaagatctgcatttagaaaggggttgtgagatattaaagaagttaggaaagccacaagatacatttttctctaaatcatataaaaggcacttctttaactcacacagatgtgcaggtgaaatccagggaggacttgactacgtactacagcagggcggccaccgtggtaggtttcacggactggtag

SEQ ID NO: 60967 - DNA, 1479 bp, Bovine  19866880995825
caagaattttcttgaaagtaggatttagtacaaaggaagctacattgaaatggtgccctaagattgactttgctttccaagagagcatgctaagacgccagagtgcacgctgaaatggactccttgaaaatgtgatgttctcgaattccttgctgaggggttgagtgccagctggagcagctgggacacagcctgaggtttcagatgttgtcagctatgacttcaattcctcctcttctccaaaaattcacgactgcagatatacacacacacacagagtcgttacgaaatgttaatgtgtcattggatggcctgttagaattcggatcccaacttgaacgtcaagtaaacggtgtcagggcaggctgagcatctgtgggccaactgccttgagaagactgtagatcgtcttggtggtggtggatgctttcctattttatgtggatgttagtgcattaagtgttcccagcctgtagtcgtgatccagtgccaaagctgagatttacatatgctagcagatgtaaaataaatgcttcagtaaatgaacatcaggtttcaggggagctgaagagtctggtttgtggaaccactcaggttctgttttgtatggagacagggactgggccaggatcaactttgcaaagcttgtggggtcttccaggagggagttttcaaactcccatagttataattgcaatggctctgccctgtcctcctcctggcttcctactggaactgtattcaaccagagatcacacaaggaaaagcattctgacacacaggctaggatccacctctcctcctgaaagctgttgagaatggggctttgtgtctcctcttggctcttaaaacttcttaccaggctccagggatttgtctgacttgtgaaaaattcatttgtgcatttccagatgtgacatagctcttgagtgattaagctacatcacttagtatgttagcagtgttagagtgggtagactttaataaaagtcctctcccttatatgtgggatctacaaaaagagtacaaatgaactttatttacaaaacagaaatagagtcagttcagttcagtcgatcagttgtgtctgactctttgcgaccccatggactgcagcacgccaggcttccctgtctatcaccaattcctggagcttactcaaattcatgtccatctagtcagtgatgccatccaaccatctcatcctctgtcattcccttctccacctgccttcaatcttttccagcatcagggtcttttccaatgagtcagttctttgcatcaagtagccaaagtattggagttttagcttagcaagagtccttccaatgaatatttaggactgatttcctttaggatggattagttggatctccttgctgtccaagggactctgaagagtcttctccaacaccacagtttaaaagcattgattctttagtgctcagctttctttatagtccaattttcacatccata

SEQ ID NO: 60968 - DNA, 1704 bp, Bovine  19866881045630
tcttgcttgattctaaaattaattagagaattaacattccttatgaaaatttgcctgctttttatccttttctttaaaagaaaaaaaaaaaaaacaggactagaccccaggccttttctgttctctaatgaaattgcaaattgacttgtgttcaaatggtgattgagtaaaatgaacaattaaaaatgtattgctaacaatgagatctatcagccagtctctttaaggattaattagttgcaggaacaatctttcttatccagtataccaaggagaacagagccatggtgggtggacaaggatgtgtcaaggaataactttttaacatgtgcatgagcacatatgtatgtgcatatgttgtcctacatatacacatatgtaggacaagaatgcccagatatatgtgggcatctttatgagtttaaatgataaaaattagctgcagcttccttggaggtatttatttcaccttagctagaatgattcgactgttgctgattagtgatccattagttagcttgaaggcagccaacagattttactgatcgtaatttatcattaaagcagagaaatgctctaggtatttaaataatgtatgcagataaattcactcttattttttaaattatccacctgtacccaccttgtaagaatctttgccccatatcaaaagtttgctctctgaggaaattttcaaagttaactgaaaggaaaagcccttcttcctggtttatcagttctgcatgtcaacccaccactttacaaaatatctgaaatgtttcaggttacctttgcagtccttaaaaatcctgaaattatctccacattcactgttacaaactgagggcttgtcctgcaaaatctgatacctctactgtttctttagcaaagatttcagataccatagagataaactagggtccccaggacccattgcaaagctccagggaaaaatggacatagctttcttcttcacgacttgtttaaatagaggatgttctagaaaatgtcatttttcttaggttgccctaaagtcagatcttctcactgcctctattgtgccgagtaagcctaaaaaggcatttagagttgaggcatttggtaactactgctttcttgggcttcattctccctacagggcattccaagagatgaatagtaagtgtgaataggaagaacaagtttccagtcctgtcaaactaattagactagtgtagaatgaagtgaggtttgccgttagattaagttgaaagcgtgtaaagaaaatcattcaaaccatctgaaaggattttaaaagttttcatgtttttgtttatttgtgtgagacatattgtatatgtagataattgtgcacgaatgtatattatctttatttattggttttttttaaattaattttattctattctcaaactttacataattgtattagttctgccaaacatcaaaatgtatattatctttaaatggagaatagtccatgtttttatagaccatatacaacatatgtaaaaacagacatggcaggccagttgaaaaaaggacagccacaattcaaatcactgctgttaaatgaaaacagacaagcaagcatgaatggacctgactcttttacttataagagcaaaccctggttcagtactaagaactgtgtgcaatgagctaatgaggggattcactggggcacagggagtggtgcaattt

SEQ ID NO: 60969 - DNA, 1271 bp, Bovine  19866881101722
tctgattcttctgggatgtgctagggcaccaactgctttcaggttgtggaaatatcttttaataaaacaaatgaaggagacttggaatgagaatgtgcttggctgattggattcccaactggctccacatctcttactaagtagggagaatcaagccattatccccttggctgagctggatccactccactccatatttcttgcctgtttaagatagggtataaaatttttaatatttctgtaaacaatattaagcagaaatggcacaattagatgctaaatctcaacgatgattgttcaaaggtgaattagagttctggcccacttttagggaatgcaattaatatcacatttctactggcaagccagcaccacaagctaaccattggatttcataataaagtaccatcgtgatccaccaaagcaatactatccttttaggtgctggattagaatccaggcgagtccacaatatagtctttacacatcatcaacttccacacaggacataaattgcactaatatagtaatacactgaaatctcagaccaactgtttgtcattggattagaatgtgatgacacaaaataaagatgtgagatgggatctgtgctgaggtctaaattcacattggaagcctggaaataaaagactgtttataaaattatagcccgggaattgctgccaaagtcagcctttggtgcagctgtaagtcggatggaatccacctccctgacatcagacccacccactgaaatgctgcttctcggcctagagcttcccccagtggaaactccatgtcatattacaaagcaggtgctgtcgtgccagggctgttggcttttttggatctttatggcaggttggttatttacccttcttccctccagcaaaaggaaggccatcagtgcgcttgtgggtttagaatccatatttgttacacatggcttttgagtttggttcaaaactgcagtgtcttgagtcctactctctaagacttccacttctgatgatgaggtacctggttctgttttttcttttctccttttttaaaattcttcttcaactgcctccttctacatcttctatgcccaagaaatgatgacacccctaatacagattccacttccgcaggcatcttgctatatcatttaccaaacataggaaaacatttttgtttcctatcattgagaaacatttgggccatctataaagatgacacagattaagtgtcattgaagatttgtcagaactagaaacgaaacaaaattt

SEQ ID NO: 60970 - DNA, 1032 bp, Bovine  19866881160590
gtcacataatagttccctgccatttcctttattgtctgccctcaaatcctctttctgtagtaagcaaaggaagggaaataatgctggcttccaaatttcattataaaagcttccattaaaacaaaacgtattgcgtattataattgtaaccagaagcagtgagggcagtggttttcaaccttgtgagaattgtggggctgctatgaaatgcgactgtcttcagtgaaccccatcctctatccagcctgtgaattatagggcattttcaaaaaattactacactgcacaaaacccagacacattttatatctttttttttttttagttactaaaatggatataattttcttaaccaaaaaaaaaaaaaaaaaaaatacagtaatagttcttgtggttcactagtattctgttttccctaaagtccaagtttgagtttgcacagacaaaactgtttggaaaaacaaaaacaataatgtcaattaaaacctgttttttgtttttttttttttttatctcccaaacaacaagctgctgaattcaactgctatttctgtatgtagtggttggttgtttccaacctgctggtgaatgtaaacacaatttctgtctcttcttaaagttacaaaggagttcaatgaacttcagccatgcaaacaatgacaactaacattttctgaatgcttaccctgggccaagtccttaacagccatgaatttatgtaagcctgcctggagagacagatattatgatctcccttttacaagtaaaaaattaggcttaaagagatggagaatttgcccaagttcaccctggcgggacagtgggggaagcagagcatctgggtcccatggcccttccttcaagctgcatggctgcttgtcaagacacttgcctctgattcacactgaggttctgagtctctgaaaagccttctccacaaccactagttttacgaaagatacttggaaaccactattaaaaatgtgggagttctccatcaaaattctcaaattaaattcaaaatctgtttta

SEQ ID NO: 60971 - DNA, 881 bp, Bovine  19866881324057
attatagtgcaaggatgtcttttacaggcaaatatagagagatggtggaaaaggcaatggcaccccactccagtactcttgcctggaaaatcccatggacagaggagcctggtgggctgcagtccatggggttgctaagagtcggacatgactgagcaacttcattttcacttttcactttcatgtattggagaaggaaatggcaacccactccagtgttcttgcctggagaatcccagggacgggggagcctggtgggctgccgtctatggggttgcacagagtcggacacgaccgaagcaacttagcagcagcatagggagatggtgttttttattcttgtgtgtttgtgtcaggtttttttgtttttttttgtttgtttgtttgttttcaacctccaggaccacttccttcagctatccatctatccttccatccatccatccatccacccattttccagcaaacacttataggaagtcttctatgtgcccagaacagaactaagtactgtgaatagagagatgaatgagaaacgactcccgcccttggggagctcacagtccagtgggagagagagatgtaaacattaattacaacgatgtgatgaatgctctaataaagttcggagcagggtgctcagctatcccacagagctggagggcagtgatcatctatttcaccttagctgtctaaaggtctttgattcctccaagagtaacctatgagccccaaacctcaggaaagctgggttaggtgcagctttaaaggaaaccctgcaggttgcagttactatttattcaaagacagcaaagagtcagatgatggtgagatttattcccagggctcatggatttcttaatttatgttctcttgactct

SEQ ID NO: 60972 - DNA, 1108 bp, Bovine  19866881384458
ccctagttccttttcctgcaaaacctattgcctctctcagaagcctttctgattactgcttgttttctttatttttctcaaatgcttatgtatcaagcctacatttcattaatatgatcttgttgttatgtagctttttaattattcataaatcatttgcgagttagtgagatatagtgggaaaaggttcaatttgaaggcagaagacctaggttcatgtttaagctttgcagtttattatctgtgtgggtttaggtctatttgtttgaaactcagtttctttatgtcaaagaataggaaaacctacctatgtactcaatggagttggcaatatgtcacctaataattgcacactacctcaggtttataaaattcttgcatatgtatcttgcttaatccccaaacaacagtataagatgagcactattacccattcatttttatgtgaattacttgaaaatactgtttttaacaccataaggtattattatttttagtctgccgattttatatcatcaatttaatactaacatccctaggatctaggtcatatctatcttttatttattttttattttattcttccctcatattcctttcttttaagtgatttgaagaatagattcagaagatagatttttccagtacagataacaaaatgctttgccaaataaatgcttaataagattgtgtctgcatgttgccagagtaactgattaattttacttgatgccaggaagaaaataataatctaccatttgatcaatatttttactttttaatcatttgtattgctcttgtgcacatattaaaatgttctcagagagcacagcaattttggaagtatagaaataaaacacacatcttctctataatgctgttgatcaaacaaaagactcagtacatgattctggaaagcataaatggtagcctcaggtacagaggctgcaagctgttttgtaattatttaccctactagagggcaaactctatccaaaataggcccttgcctgtcttattcacattcagtattttgggtgcctggttcatagttggtgcacaatgaatattagctaagtataaagtctcccattaagcttatacaaat

SEQ ID NO: 60973 - DNA, 1151 bp, Bovine  19866881394480
ttggtgatggacagggaggcctggcgtgctgcgattcatggggtctcaaagggtcggacacaactgagcgactgaactgaactgaactcgcctgccagagagataacttctgtttacaaggaatgcatgagtaaaaacacaatatcaaaatgacactccttcctgcatttattggtgtgaagtgaaaacccaaatatattcctcaacaaatgaataagggatgaataaacttctaaacttgcatgatgtgttaaagtgtcagaactcttgaagtctgcatcatactacagcctcaaaaataaacataaacatttctctttgtcagaagggagtaaacaaaaataggattttgctaaatccttcagttgttcagatcctatgctgtggtctcgaatcagctcaattccatttccagctgaagtcagctctgcttgatgccttaagcaaatgagaggagagatgaagttgaccatgaagggaaggactgacttgagattttactttccttttggtcaacagagtagccagaggatcagaatgcaatgcacaaaaacacacaaaaaaactgccttcacaaaattccacactcagatcctgtttttccttgatgatccacattttaattactgctcttaggaggcagacttagaatagacctgttcagaatttaccaagggtgcacagggtaaaggtgggaggtagatatgacacaaagagataagcctatctcagatgtaggaaactcttactgataattcaagtaaccctggcccctcacacagctggagaagcatgtcagtcttcccaccaaattctgccagaagacatgcagtggtcagaaaatggtgatttcccttctccaacttttgctttttggtgattccaatcatcttcttatttgtgctacttcctcttcacttttctcttgaacttcaagttccatttgttttgaatatttctttacaattgattaattaaacacgcaagagagatttgtgggtctttcttgtgtttggtattgtacactgagctgtgaagaacacaaaataagtgaaagagattgcctttgacctgaagtatgctatatgattggaaaaaccacatcaaactgatattacacaatggaatataagcaaaagttaaatagtaag

SEQ ID NO: 60974 - DNA, 812 bp, Bovine  19866881407282
atcttccgtctgaaacagatcctctttataagtctcccgaaccttctccagattattcatctgtgtatcttgaaagctatctgtcaaaatggtagggtttattgccagcacttggtcccaatcatcataccactggttagttacaacaggccttgctggtctttctcgaagagaactgttaaaacgtgttactcatggggcatacctcacgtttattttccactattcttaacatcgattctattcttccacctgtcaaggatagtcacttggcctcaaacacaccttgttatttctaccgcaatagctttgttcctgttgtgtctcttacctggaatggcctttctgctcccacccatcttactagattctgctcagttttacctctcccatggagcctttattaaatatccgagctcatagctggttagtcaaagcaggtaagggttaatgctgcattctgttttgataaatatccatgatatctcagcgtctttttatgaatattgctgaaccgagccctctggtcttttaggccagagctgagtatgtttctacatgcagtctgaccatctgcactgtggactaatgcaacttcttgttgtctggtcttcccgagaatgcattatatagattgctgttcatttagaatgcagctgccggggtcgtgactcacacagagattaatcattacgcctgggttagcttcattactttgactacccattacatcttaccgagattataaaatgttgcttttaacttacaaggcctacaccagcatccacttatctccaagacacgcatttatg

SEQ ID NO: 60975 - DNA, 1806 bp, Bovine  19866881475294
tataggatatgcttcaagaaagtagggccaagcccctctatatcaggtaatttgagggacacaaaaagctctgacatgtgcccctgccaacatgctattgcacctgcaagttacccttttagggccagacttttgcaaaaaaaaattttaaattgaagtatagttgatttgcaatgttgtgttaatttcttctgtatagcaaagtgattcagatatattatatatgagcatgctaagtcacttcagttgtgtccaactgtttgcaaccaactctttgcgaccctttagactgtagcccagcaggctcctccgttcatgggattctccaggcaagaatactagagtgggttgccatgccctcctccagggaatcttcctgacccagggatcaaatgtgtgtctcctgtgtctcctgcattgcaggcagttctttatcctctgagccatcgggtaagttcatatatatttataggtcattctttttgatatgcttttccattatggtttagcacagatattgaatatagttccctgtgctctaaagtggggccttgttgtttatccattctctatatacaatagtttactaatttcagacttccaatcctttcttccccttggcaaccacatgtctgttctccatgtcttggagtctgtttttgtttctttctggcttacttcactaatatgaaataaggtccattgttagtttcattcatgttgctacaaatggtcttatttcattcctttttatggctaatattccattgtatatatgtaccacatcttcatccattcatctgtcaatggacatttaagttgctcctgtgcttagctattttgaatagtgttgttataaacataggggtgcatggatcgttttgaattacagtttgtccagatatacatagggtcaatctttagaagtaaggcctgacctctaaagaactctttgtaaaataccaatgtccttccttgcatgtgacaccaatgagctggtggacatgtagaatggaccagttggcaactgtcagtctgggatgtcaagagcagcctcctgcagtgagaggacataggaccagtaagttttgatgagagcaggaagatgggatcttcgttctatgggctgcacaatgtcaaggccaggttgaaggcccagcaagagggctctggccacctggaatcctcatgaagaaatctgcccaaaggaggatgagaatggtctgagacatgtcttctctctctctctcccagctgccttggatggagaatgttgtttcctacctagatcaataccattgccctttcttaagggaccccatacaaattgctttcttacacctgttctgtagttaacagaaatagagccattaagccgaggccccagaattgtcctaagagatgattatgatactggaaggctcagctcctccccaactccccatctgatattctgatcatcaggtcctgcctttgctggtgaattttcaggactagactaaggaggcagaaacacaaggcctgggtgggaagttaagggatgtttatagccatagaaccaaaatatgggaggaagcaggtgggcgaaatttgcctaggttgcctctgtggatataaatcaccagcttttgttcgtttagggggaaaattcagctttcctgaaacagacccatttccctctagctttttcaatgtgccttttcatggattttgctttcaaatctgcatgaattatttttcttctattaaatattaatgtgtctttctaagtagaaaaaggggcagcgtaggtcaggtacacatctt

SEQ ID NO: 60976 - DNA, 1517 bp, Bovine  19866881612001
ttgtacaaaattgcacaaagtatgccagcatttattatgcgttcactggaaggactgatgttgaagctgaaactccaatactttggccacctgatgcgaagagctgtctcatttgaaaagaccctgatgctgggaaagattgaaggagggaggagagggggatgacgaggatgagatggttggatggcatcacggactcaatggacctgagtttgggtaaactccgggagttggtgaaggaaagggaggcctggcatgctgcagtccatgggattgcaaagagtcggacacaactgagcaactgaactgaactgaactgattatgtgtcaagaatgacttaagtagtttaaatattttaaacattttatccttattataatcctatgtgatgaatacctttattatcattgttttacaagtaagaaaactgaggcacagaaatgtcaaccaatttcccaaggtcatctagctaataagtcacagagccaggacttgaagctaggaagtcagcctccagagtccttgcttttgctatttactgttaccaagggagaaaaaagtgagagagagaattcatgcagacaagcaaaataagataaagaatgaagaacagaaagctagaagcaatactctgaagtattggtggaataaaagagttcatgttgtcaaaagaaaccacaaatgcccatgaattcccttccattagactctgtgcatgaagcagagagtaaatcttgatgccatcactcaaagtagatccaccaatgctttaggttctaaaatatctccatctctcttggtgaaatatctatccttcaaattgtaccacaagtcaaagaacaatgtcaagttaagctcttgagcaatcctattttctccaataaatgcatgaacaaatacattaacttcacgtagaacctgtaacatttcttagaactgtagattttctttagaactgagataaagtaatgtaataaatgcattgcttgattttttttctttacatttttatgtatgattcctgaaattagaattatggacttctgtaaaatcaggcagttttctccattgcaaatattattttatatcactgtagtatcaaatatttatttttactatttcagagtataaacaatgggctaaattgggaaacaaaaatatatgactctttatgccttccaaactgcaaacctagatgacttctttggatggcagtattgactggaactttccccaggatactgcattttggttccagcttgctgttaattacttactcacagtgaaagtgtcacactgctctcctttcagcactttgttggccaagtgtctctggcaataatctctcaacacgtaagcaccgttccctttcatcacattatttaatcaataaagtaatgccctcacactggccaggcccagagccatcttgtcacaagtgctaaataaatgaaacaaacaccagtcgagtttctacaacttctctattaataaatagaatgaagatgcctttaat

SEQ ID NO: 60977 - DNA, 833 bp, Bovine  19866881857062
aaagcaactagatgctaatgtctatcccctccctccatggcaatgtatgatgaagcaaactttaaaatttaaaaataaatttaaacacattcttaaaatagagttccttaaaagtccatgaagtctaaggaagcaaacaaccaacaaaagacctttattgggaaaaaaaatttgcagtgccatttctctcccccactttctcctatgaaagaaaggagaaggcatcaagactaatgattgaatactggggagaagatgaaggtttcgagaaagtgctgggttatataatcgcaccaatagtgcctaggatttttgtgtgatctgcacaacattgcatctttttacctgtgtaaagtgaagtaaaaatatttgaggcaggtcttttgggtgtgtttgcctggtaggagaaagaaaaatagaagatatattttgggttttccagaagtgaggacaaatctgtaaaacgaaattgatttctctcaacacacaccaccgctttgataatgctggtctgaggaagagatggcatggtttttctctctcatctgttcctgtcagccttcccctcacatccggtattttgtaataaaatttccaacagatacgggttgttcaacagtcactagcaatgcattgattaattatgtgtaccagactttcagtatataattaagctaaacaaaactgcattaaagtaatatgaataatttgacttcaagccaccaaaacaaggaaacggagtgaaagcagaatctctgacctcactcgctttagcatattggaggagacaaaaatataatcagagttataaatcatacagctgccataataca

SEQ ID NO: 60978 - DNA, 1454 bp, Bovine  19866880367551
tgtctgcacttcatgatcacaaaaaatggaagtaacactgagagatggaaaagaagtgcccaggtagccaggttagcaaaaggagccacgagtcgtcaaacaaaaaaaaaaagaaaaaggaaggaaaatcagagacctgggtccaaggaagctgctgctgctgctgctgctggggctaagatgcttcagtcatgtccaactctgtgcgaccccatagacggcagcccaccaggctcccctgtccctgggattctccaggcaagaaccctggactgggttgccatgtgcttctccaatgcatgaaagtgaacagtaaaagtgaagtcgctcagtcatgtccaactcttagcgaccccatggaccacagcctaccaggctcctccatccatgggattttccaggcaagagtactggagtggggtgccattgccttctccagggaagctagggaagagcaaagcacatatgtccaaggtaaccaaactagttgttatattgtttgaccttgaaaccagatcccctgcctctggttgtgatgcccattccagctgcctactctccatctgtccctacaaaaaaacagctggaaaacacaagttgtttaaacttcagtcaattatattaatatctccatattaaaatgactaaaacaaagcaccattttatgctctttaccaaccccccccaaaaaaaaatatttccaagtttcttaaaattccctgatgtggcagagtaagatagccagggtgggtattagtatctccatattagatatgggaaaattgaggtttccaaaggtttagtgacttccctaaagtctcagagccctaaaatccagttcagtaatccaatttggaccgtctctctccaagtttagtcttccttctacttacactatattgaaatttatacatactctcagcttaaccataaattttttctcatttcttaaagattcagttctcaagcatctcttcctaaaacagatataactatcctccaccagtcttcgtgcacatacctgaaattctgggagatgattacatatgatctcaatggatttctataaaagagttgggggaaggtttcatgcacatacaaatccagcagatactacactgctgacgaagaagtagtgttcattgtattatcagtttcagtctgataattcgatatgacgggtgtgaggcacaagcgacaagtctctccttcttaaaacaataattgtgagtctttattcttcaccaggaatatcaaggtcattgtctggatcaaacctaaaagggagcttccatcagcggatgtcataacagataatcaccaatttgacatgctcttgcagaactatcacctgctatcagagctgctatgacagctgtggagtaagacaatgcaggccaattcatcggtccctgggccccaagtgctcccctaatgggtatgacaaacatatg

SEQ ID NO: 60979 - DNA, 1360 bp, Bovine  19866880655623
catcatcctatcacctctgttataatctgttctttagacgtgagtcactaagtccagcccacactcaaagggagtagaattatgccctatctcttgaggggaggagtagcaaagagattgtagatatctttaaacccctacatatgtgtttaaaatttatttagcatttggtgatcacaagagtcataattttagctcagagggtatttgcttttacttcctggtcctaaaaggaacctacataattatttaatcattggcacacagctaaagtagacttctaaaattaagatagcttaaaagagtcttagaggttgcctagtttataaacaagggataatacaggcactgaaatttttaacctgtgtgtcttcatgctcaatcatgagatgtgtttaatcatgaaatgattatgtgttaatttattcatcacatgatccctttctccaccaaacagcccattattttgagtattccataatggtctgtatttttagcatcagacccataatccctaaaatcttaatgcctaaaatccagatgtttttaatctctaaactgtcagggtgttactgggaacataaggtaaatgccttgaagcaaaacagtaatgcgtttttaatgaagagtcctttctattttgctgatttctgagtcaagagtttgcctctctagcaatagccttttcataccatcctttgtaatgaaacatatggcttacatcacagtaaaacatgtagagttggaaggagaaaaaacatgtttcacatatgtgccatgtctaatgtaatgccatatgcccagcaaacacagagaactaagacttgccttcagtcctgaaataattagagtaacagactattcttaatttgttttaaatactgcaaatggtttcacattttcaagtaattaacactccattcacttttaatatgtgtatttattattaaaaaaatgcccagtaagttttaatgaaccctcaaactgagacatttagaaagcattagctttccccaaataaattatcaagagaaaaatagttcagctttgactttactatgttgaaatgagcttaaaaaaggaattaaaaaaaaagtattttgtgcattttatgaaatgtgattgtgttttgcttgtctttgtgcttatggtcttgtttttgatgagaaattttcatctgatacattgacagtggtaacttaggaccatttccccctggtaaaacaagaaaggaaaaaaaaggagtgctttcagaaacttaaaaaagatggtacctatgttttttttggtctttcagtttagttcagtcgctcagtcgtgtctgactctttgtgaccccatgaattgcagcatgccaggc

SEQ ID NO: 60980 - DNA, 1002 bp, Bovine  19866880775489
aaaacaaagaatcccctacattcaccgtgttagagccataaaacatctctgagctactgacattcttagtaagatcgaccatacactttggtataagacactgtagacactggtttagcaacacaaacttcagaaaggtagtaccagtgctcctgaatccctcttagaatcagtggagccattcttaccattccttatgtcagactcatgcatccttaatgaaaggttgttaccagcagcactatttagatgttcacttaacattttccacttcaagcctccaggttcacataccatctacttacgcattcaaaatacacagactgtgtatccatctttgttcaatggagtgataaaggcccatatactgacagacaaagtcatgcaatctctgctcattggtaaagatgtaggtgaataacacattatttactgttttctttttttttcacctttcctctaaatggtaatgtactcacaaggttatttaacacagacactatatttaataaaaaagaaactcttagcatcttagcatcttttcatagttaagttttcaaatcagattcatttacatcattcactgctcatttactcattaatcataacttatcacatcagctgtgctgatcatcattaaaagtaatcatttattcttccttctaacctgatgcttatcatgtatcttcaaactggatcataccggaaaggtaattggtttatttaaaaaggaaaatgcaaagatataattaaagtggcaaagaaagggataaatgaaaaaacaatgtcatcattggcatttttttcttctaattctttctcagttttatgttactaaattccagaatacagattctattacctcccctctaacaaatttccagtaagtcaactatgtcaattttgttttattattaaggggaactacagcgagaaggcaatggcaccccactccagtgctcttgcctggaaaatcccatggatgggaggagcctggtaggc

SEQ ID NO: 60981 - DNA, 974 bp, Bovine  19866880820425
tcttcatttgcagactgaaatctaccccaaacagtaccttcacagaagggacttcttgtttccaaaacccaccaaattaataccatgccacaattctagtagctgcctttaaaaataagattgaagtcacactagacattttcttttaaattttagtttcagttcttctcagcagctcattttaagaaacatctgtccagtctggctcttgcgaagatgttcaaaaatgaacgtcctcatttggatcctaagggactctcctaagggacaggatagtcctttgaaagcaagcaaacactatcaaaatatttacaattcttgaacttcttaatcgagttcaatgtatagtgcagaatatgacctagtttcatccttaatcaaaaaacggcttttgagtgcttccctgacaccttctaagacatcatgctgtcttcatgttaagtaccaaagtagtcagtgaccaatcagttcaaaggcaatcttggtcgagcctaagattacagagaatattacagagaatattcaagattgaacacaactaacctggaatctgagtttttctacaattcatatgcacaaacccacatattagatttgtgtatgtaggtggaaagtgaaaattctccaagttcatgtccacaacacaaccatctcacaaataattaatacataatctaattcttgatgaaaggggtccaaataggtttggttcagttcagatcagtcgctcagtcgtgtctgactcctcgcgaccccatgaaaagcagcacgctaggcctccctgttcatcaccaactcccggagttcactcagactcacgtccatctagttggtgatgccatctagccatctcatcctctgtcatccccttctcctcccgcccacaatccctcccagcatcagagtcttttccaatgagtcagctcttcacatgaggtggccaaagtactgaaatttcagctttagcatcatta

SEQ ID NO: 60982 - DNA, 1234 bp, Bovine  19866880822036
tttcctttttgtaagggtgattctgagttgctttagcctgacttaaacatctccattgttcaagaggagtggaattaaaatatttaccaagagaataatgggttatagggagagaggatgataaggaaataaaggaaagtttaaaaatgcatttatcccttgcatatataaacttggtacactatgtagcattataaatttatttattagaaccaaaagtggattaggatgatttatttatacaaatgaaatcctagtttttaaaccagtaaattctcatattgtcactgtatagtgaacctttttttttttattacagagacgtaatttttcaggcatccagaatttcaaaagacagtaaaagtgacatacctcaattgcttattttttggcctcccaagaggttacacctatggctaattaaagagcaaagatttcagcccaagcctctcaactgttaaacaacttcagtatctacaaaacaaagaaactggtgtgtgtaaaattctcaggggatttgtacactaagaagagccaagtatctgctcctgcaatactgaaggtcctctcattttgtataattcagaacttggtgtttgacttttccctagcccacatatttgctttggatagtgatattgtacccccaaatgtcagttttcttggttgacattaaaaaattagactgaggctcacagcgcccacacttctgtcgaccttggctgtaactggagtcacagtaaatattgttgtttgttgatattggcacttgaggtgaagcgtgttgagtgcaggaagcctcataggctgtgtggctcacaccacatacctggaacatgtggtttgtgttgtcctcactgaactttctgtaaagggcatacatcttggttttcttttgggaatgctgtaattttttttctgagtcaatttgaagactttttttccccctatccttccataagtttctggcagagttttgagacaggccatgacaatgtttaatgtaagaaactgggaaggcttgaaggaaaatattttaagacctagtgtaggaatcagtatatttatgtgtatgtgtgtgtgtgtatatgtgtgtacatatatatatatattatatatatatgtgtgtgtggattatgtatataatgttttctgtcaggtgttccagatattgccttaaacttgtaaaatacaaggacgaatttatttaacaaacaatatatatacaacattt

SEQ ID NO: 60983 - DNA, 3492 bp, Bovine  19866880891182
acacattatgttgatgatttttttttttttttttgtcctagggatacttcttgaacagagggtatgctcaacaagagatgacatttaacttatacacactttaatttccttgggtttggattagctgtggtaggtaaacaggtaaactgtcaattactattattaactgtaacattctttgactctcaccccacaatgtaatatcaaaagcctagtgaagctagggagttagtgtcacatattcagtcttaagcctctgctccagttctaggagtatctggaaaacatcttccttctgggggaaaaactaaaatagattcttccaaataaatggaaataaaactattctaaattcaccagaccataattatagacacaaaattataaagtataatactcggtgttcaataaaaaatctagtcaattattccaccacaccagatcagaccatctattcaacaggatcataagttcagggactgtttcaagtccaaccatttccctttgagatgagacacaaacatgtaaaagtattccttaagcatcaatcctgagtgccacactgtgccaggcactgcagaggactgcaaagaatgagaacactgttgctaaactcgggtttacaaactgtcaggagcctcctggtctgccctaggactgggtgatggctccctcagaccctggggattaacttctgcaacactggaagaagtggacaaaggtgtcccaggacaaatgtccatagaagcttctgctgatccagggcgcttttattctttacaggaggtacctgcagtcacctcatagtcaggtgggcacttcagggtcaatccctagaaagacctactagaatcttgggcaaggcctgatgatcttccttgaattaacatgaataatcgtgtctgacctttaaggccaagagatactgtattcccaagaagcctgagataagtaaagagaaacaagcaaagaatcctaaaacccagtttatagaggccagaaaaggaaggagatcgtgccaaaattaagctcggaagcggctggatacatatcaattccttgagcctgtgtttgcttacagtatctcctgaacgcattcctgcacatcacagacttgttattgatccgctgtggtcagatattgtaagtataaattaacctgctccactgaaaaatgcccacaggagccattccactctgaagaaatcttctctttaggtttaactgtaattacgagaagaattcaatgggagggtgggggatggtgagctctgatttccctgatcacttcttacagccctgattaaaagagtctgtagtacatgaccagctccatgctttgcctcggcacaccttcagactgaaggaatggcacaggaagtacaatgtattgtagcagccagcaatcagctgtcaagaggcgcttatctaaagaatctcaggggttacggggctgctttttaatcaactttggtgatttctctggaaagctcagaggtggtttctgaagcccagggtgaggcgactgttccatatgagttaaatttatcagttccaaggataatacccttaggagataaaggtactaagtgaaagaagagaaaggtggtcaggagatctgcaccccaactgaggaaaagaagacgccaaaatatttaccaaaaatgaaaggcaggtttttaacattagagtacaactaatgagtataggaaaatagggagaaagcattacacaggaaggaataaatagtgaacctctgtattttgctaccaatttctaaacttttaaaggtcacacagagcactatgctaatattttgcaataatggactccagggcagtgctttaattaaatgaattccagagctctctgaatcttaatcagactgtgcaggggatgtggggaaggtcaagctgcagagcaaatgatgcaagctatacttacacattacaccgagcaccctttccccaaagacgttcagcgctttaactttaacgtcctaataatttctgacaaggtgagaggaccttccacttcactctgtatgtctaacaggtatgtccagcaagtatagcaggcccatggtcagtccaggagactttccagtaaatcattttatttaaatatatggtgtttgctgccaacattgttgatttcttttaataacatggctaagacacgtgaagaaggctgagtgccgaagaattgatgcttttgaactgtggtgttggagaagactcttgagagtcccttggactgcaaggagatccaaccagtccattctgaaggacatcagccctgggatttctttggaaggaaagatgctagagctgaaactccagtactttggccacctcatgcgaagagttgactcattggaaaagactctgatgctgggagggattgggggcaagaggagaaggggacgacagaggatgagatagctggatggcatcactgactcaatggacgttgagtctgggtgaactccgggagttggtgatggacagggaggcctggcgtgctgcgattcatggggtcgcaaagagtcggacacgactgagcgattgaactgaactgaaaacatgcccagtatactcctttcaaggataaacatgaagagaagcctcaactgatcgaaggctgagatgaggatgcatgaaaacagaaagactttatacatcctcttcatatgaaacccaacagcctacatagtcagaaataatctccaaatccataagcagtgacattttacctcgaaataagtttcctctataacctttgcccatttttctctagcccactgaatctcaccaatcctagcaacaaatagaaatgctcataaaggttaagaatacaaaaaagcacttataaaatgactgtaataatgtgttttaaagtacagtgacattcagaaatgaatgtagaatgatgtaagtagagcataatcatacattaattatccaccacaaaattcgagactcttcctaatgttacaagtatcagttgctgccatttttactgcgtgctaggttctgcgttagggcttccccagcggctcagtggtaaagaatccacctgccaatgcaggtactcttgcgttgtatctcctagtgactactctgtgagtaagtactatttagttccacttcacagattgagaaactaagacttgctgaagttaattcgcctaggataacacaaggacaaagctggaaattcagtctcaccacaccaatcattccgacactgcctcaaggtgaaggctactgtagcttgagtggccactggcttggtctcttacactgctaaggtgacaaatgactccattccattgtgatattgcagtactggtctgatgactgggttatacaatcataggcctttcactcatattttattcctctagagattctcagacagggcaggagagaaggtaaagaaaacatattactttccaaacaggaaaaattaaaaaataaataaaaattt

SEQ ID NO: 60984 - DNA, 724 bp, Bovine  19866880917664
acttatcactatctcagtaatattttaatcagagtccaccttagaataaactgtaaggtctttttagttgttcagtcactaactcatgtccgactctttgtgactccatggactggagcacaccaggattccctgtccttcactatctcccagagttatccttttagaacagaccaaacgttttagtggcagaaaattgctacaaaatcagtttcttgcaggaaaaatggatgacatcccaaagtcaaagtatctgcagcaatttctgctattgttcaccatgttatatgtaagatctaaagaatagcagtatatcttcctaatgcactgtcactttgaaaaataaactcaaacaaaatgtacagaaagaatccgccaaattgcacataaaaaaataaaaagacattttttatctcatatgaggtagcaaagaacctttaacactgatcaggaaacacatctgaataaattaagtgccaaactacctgaatttttaattgccaagaaatattgaaaaataaaatttaataatattggaatggactattttatactttctgggagggtatgtaagtatttgagaatgaacagtattctacaatagagactagtgaaggccagtggaacagctgaactttaatattaatacaatatgctcttcatcaggctgacactcagatgtaagaatggtctcactaaattataatgaccctcacttatcaat

SEQ ID NO: 60985 - DNA, 1110 bp, Bovine  19866880964281
tgaaggaaaatatcctttaataaaatggatctgccttgcttctccatccattctgcttatcttaaaaagctagttagtaaatgctgcagttttttctatgtaagttatacctatagtccatgtgtatttaaaacgcatatttgtatttgcaaggaaattactataaaagatttagcaagatttaggaattctctttgtgttccctagaagatagggaaagattccatatttaaaagaccaagtactgccaggtgtatttctttccttttattcctgttccaaaatgcatgccttcaagaggtttttttttttttttttttaaacagactgaacttgactgatttaagatgttaatatggaaggagtacatatttccctaatttttaaacagatttgtgcctctcacctatctctaataaggtaacaaatgtagtgttaatttagatgagttatactttctatatgagtttgctaacagaacttgacataaaagccgttgtgaagaagcttgattggtttggttaccatagcaacactgttgaatggaagaatgatttcctttaggaacctttcctaaatgctgttttgtaccctataacgatattgctggcttgccatcccttgtgaggaggtaagaagagatgacttcgagggtcagcatggtgtctcgtgtttatagattatcctcagccatcaaaagactgcttggctcatcttattcttcccgttgctgaaccaattctgttcttcagtatactgtgataataggagtcttgaacagacttttatgtcttagaatacacaaaaggaaaaactggatctagaccaacgattatattctgttaagctcgtttcctaaagctaatgtcttgttatggatttttaattccttgcttatctttgtttgaaattctgcagtttatcaataatttgtcctgtgagtgatgttatcctttggaggagactaaagggtttaaccaacaaacatcagcaggggcttcatttaaaattctttagtggtggtttggtattctggagttactataaaccctaaggcttacatatgagatttcctttgttatagggtaaatgtctgctctattagcacag

SEQ ID NO: 60986 - DNA, 875 bp, Bovine  19866880966218
atgtttctttttaaaaatcccttattatccaatgtgctatttcaaatagtttgttttccagatttcactcactttttttttttttaatcactgcaagtgacattctcctagtgtttattttaatggaaaccatgtaattttatcttcataccacaatattactttcatttaggaaactgtgctgccatcagtaaaaatgcatctaaattattattttctgtattgtagtaaactctcaaattccacttagaaaagaggtcagcaaagaggaatcaaaagcagcttttctatttcagaactttcacaatcaccaagcaatcactttatcgtcatgaggtacttaaattcatttcttctattgactatctccctctgcaaaaagtgttattcaattacacagttccacagcacactggaggtcagttgttaatagcaaagatgtattatgatgtgcttttattatttctaaggagtgggaaaaaataatacattctaatacagagcttcagtcatagtcaacgttttcattcatttgtaaaaaaaaaaaaacaggcaactgaatcgagaagtacagagaaggctggggaggagacttttttcatgggttgtaattagagaaaagtccttatttttaacatcactaaatagtaaacaccaaaacaaaaactgaagttgcattaaatctgacataccactttcaaatcaacctttgctcagtgtttgagttgctagaccactaatcatgtttatttgaggtgtctcaatcctgtaaataccactgccttttggtctgtcaatgatttaatctaaattgaaaataagaaacacacaaggtgggggatttctagtgaaggtaaaacttttctttgtaccat

SEQ ID NO: 60987 - DNA, 902 bp, Bovine  19866881031436
tgttgttatatctactgcttgatgaagaaactaaggccaaaagcaactgtctatagtcacaggccaagtggaatcaggttccatgtaccctttccattggttggtgttacttgcagtgtgtgtgtgtgtgttatagaaagatgaagaaaatgcctttcttcttagttgttttcttttcccccaacacctggttctttgaaatgtaatatgtatagaatgtaagttactataacactagttgttgaatactgatatatgagtatacttttgccaaagaatcattatttctatgacaactgctatgaaaaatctatggttaaaaaaaaaaaaaggtattccttttccactggcatatctattatatgtctttagtattagaaaatggggctttcaaaacatattttggttattgcagttgccatgagcttaaaatgactgtaacacaaagaaatgtcagctggtatgatttccttcaaaatatacagagtacagctggcttcttatttttgtccattctaaagatactgtggctagcctaatttgtacgggcccactggatcatgcctaattgagttaatgaagctcttctgtaacaagaaccctctaaaggaaaataaaacacaatgaaatttcaaaatgcaaattagcccagctttactgggtttcattctcatgggtagaaggcacggtaaaagaaaatccttaaagccaattataccacatattcaaagatcaggtttacctaaaattgtcacacgcgtgttgcgtgtgttctgggcagaagagcccggtcactggctgcttgttgtcactggagcctgcctgggatacagaaagcttttatttgctgcttaatcctaccggcttgattatttcgtgtctgctggcatcttcgagaattt

SEQ ID NO: 60988 - DNA, 822 bp, Bovine  19866881114224
tttaaaacttaaacacccaaagaaatattctgttgcgatggtgtcactgatgttcagacttgttattatgtttgtgaaagttaattatttgataagataccctgcggttattactaccaccaagaaaaacatgtgtatgtttattaattcaaagtgttccattaaaataaagtatgctaactaaagaactgaacaattattttctaattattactgcacaatcatttgggcattttataacagctttttccttttcctgaatgaattatactttacatttaaaactattcgcattgatagtgttttattttaatagaatttgctatttttgtgcatatttttactctgaaggatttagttgtaaatctagtgtttgaagtcaaagtttcttcctcactgaagaaaagtgttaacgtgtgagtaaatcattaaacatcttagaacaagaacctacaactcaaagggtgactatgattcatgttgaatattttaagtattaggtaaacattcaatgaaggatggaatcaaatggtttgttcagaaggaagagcaagatatttccttattacttcttccatttctgttgtcttacaggaataaaccatacatgtcttatgtgagagaaagaaatttgaaaaatgaagcgtgtaactataatggagttaatgtggcttcttatcccacagccctacagttgtcactttctcataaaatccaagcaataaagttgaaattagatgttgtcctttcacagaaacttccttcctgcaaaaatacctataaatctggggtctaagacaagtgggagggaaaatacatgca

SEQ ID NO: 60989 - DNA, 1535 bp, Bovine  19866881248335
ggtagatttagtctgcaaatgaagatgtgattagacttggttcatttatattggcctgttcctcttgtgtggccatagttttgcttgacatttttgagcattaccagttctatatgcttctctgtctttcaccttagtaccgtacttatacaagtctaccattcagtcagcttcaaaataggccatttatggtaaaaatcagccccaccagttgattgacatcatataaaacccaaaatattggctgatttccaacttattcctgatgtgtctgttgccttgagatagacacctcacgttcagtctgttacacatgcagagtttgcccacaggagttcttctggaaccccaacagaatggaaatgttgtggctgtgagtattttaagctcctggctgtcagttttgttcatggaaccttcaaaagtgattttttttttcccccaaaaactttaataatagtaaaggaagacagttggtccattgggctttcctacttctccagtctcaccaaaatataatgcactttttcccccactttctacatttatgcactgcttcgtagaggcctttttatttcctttaaaagatgattcctttcatcttttgcctttgttttcataactgccaaagaaaagctttctcttgaaggctccagaatataaggatgacttctttttaaagcttgatccattggaataaaaatacaatgcttttgcctttgaagataccaagacagaagggtattctgacatccagcttctgatgccaacatggcccactcccagaagagctgctttacgggggcagaaattcattcagaacaaccccagactggggaaagctgatcactttttttctgtttctaggaccaggaagtttgtgaatattgtttgagcacatgcatattaataatatgcccagagagagcagtaaaattctttgaatgaaaacattcattgtgaagtaaatgaatgtaattataattcataggagcacttttgtcaaagtgcaatttgtaacccttaatatcaaaacacagcaggcatccttaaatattgttcaaaataagtctcttctacctaaataatttcctattaatcaactttaacgttactccctaatttgtgtaatgttctacttgagtgtatctaggataactataatatactgtttatctataaatgatatgattcattgtctttgatttaagacagtgaaattagttcaatttgaggttagttaaaaagggagaagtgagtgaggttagtgtttctaagcccagaacaatagttgggacattattctcaatgatttcttctgcagtgtggacttctagggtaaggcaaggaaggaaagagggtgatgggcatcatggtcaggagaatctcagttgtaatctgggttccaaccttctctgacagtgaacaagttattagcttttcttattttttcttattttctgtaaagtaagaatgatttgtaaaaaattgttgtgaggagaagtagcaatatacaaaatatggttcttgcatgt

SEQ ID NO: 60990 - DNA, 727 bp, Bovine  19866881343017
aatttcttttaagtttaaatgatcggggactccgagagcaccattacaacagctgggatcttgtaccaacatgctacaccctgccagtcctgccttctgagactaataaaagagaaaacccttgacagctaacagctgggctccttatgaagctgttcaatagaaacgactaggcctcccaccgcccaccaaaaataagggcttggtgcatagacagagaaatgcacgggagaggagcttcggtaaggggaagtgtatatttcaaagagaactgaaataagatgatgatgaatagcagggaagaagctaatcagtggaagagacaccctgtcacattcaaatctggcacagctacccaagatgcaggagtttcagagctgactgtattgtcactttgattagtgcaaaaggattcatgcatgcgttttaatccagccaggatcactgacttctattacatactatgagctacaactggaggcaaacaacaaccctctcagtaaattcatgtagtcacggttccatccaaaccacaataaacatcctgaatactcttgcgatgacctacagtttgtattcacacttgcactaaggagaactactctgaatagatttgccattgcttcctgccaactcctctgcctccatattgatgtccttcctcagatgggctttgattaccagcatcaactcccctagtcaaagccacgtcacagagttcttgtca

SEQ ID NO: 60991 - DNA, 1389 bp, Bovine  19866881393984
agtgagtgagtatatgtgtgtatgtgtgtacatgcgtgtacctcttgttatttaaacaactcatgggacatagctgaaaaaaattcactgggactggttttatgaacaatacactcctggtgtatattggggaatggtcataaaaccaaatgaactgatgaaaagcctgcattctagttaacatcagtttcccttcccctttcaactctggaaatagaccaggaaaccagttttctgtgggaaaaatgttatgaatcctgaaaactccttatgtctctaaacctcctttgtatgttcatgtactctaatattacaggataatcactttactgcaatatcctcagaagaatttggagatttgttatttcctggttaaaggtttcattatttctcctggcagaaacctagtcagaaagaattcattggctgtttaattcttagttaatatcctttgaccatttaaatctgggaaattcatttgcaaaaataactcagcacatttggtgtttttaaggactgcagtaaaactttactgagtgacctggtaccctttaccaagagggacttagtttgaaatcatgtgaatgaaaaacacaaatatatttgcatatatctttaaaatttacaaagttcaagatcatgtcatgatatgtggcccatgcaaatgtattttaaatgtatccttttaattatgtcattcttgtccctttccttaccattctgtttcactttttaaataatttgtattagccaaattagaagaaaaaacctaatcagggccttgttccaaaaagtcaaacatgaataacccagagtaacttctatgtcaaattaatagttcattagaactaaaggaggcttatctacctgagtgagtaaacatcttatttttagctgtttttagaattttatgacacactgacacacacggacatttacaatggtagagtatttctcctattgtaaagaatttcagagcaacaataaattagcttattaaattaatctctaaatagatttacatattttaatgagcaaatagtctttggttattttggtatttttttttgatgactctttttctgacaatagggcaaattataaaaattcacatttgcttccacttacaaaatgatagaagtttatcaggaaaaaatgcaaaagaactgtcagatctcacttgacatttttttctggcaatgtttgctaagaatgataaccctcagtgacatttcacattcacaaaggagacaggcatagacaaagcttccaggggtcatcattttgtcctttgtccctttaacatttaaacactacaaacaagcgtctccaacttttctcagatgatccagttcttaaagatgaaggcaattcagggcatgggatgga

SEQ ID NO: 60992 - DNA, 1421 bp, Bovine  19866881750361
tctctaggataaatattgtaaacattttggtggatattcttacaggcttttttctatgcatgcttgtttaatcctactctcactcttaaagagattaaaaaagcttctttctaccttattccccaaaagagatatgctaagaaaggatataaaaattgataattcgtttgaattttttgaatgaattcagttgaatcctttgtgtctttaaacatgttggctcaagaaaagtgggtccatttttcttttaaataataaaaaaccagaatctgagataatggattatatttatcataagagtttaatgaagaataaaatgaattatctgaatgttgttaccgattcagattctgtagttatgtcaagccacaaaagcctttgggagtatagataatactctagctagggttcacagtgtccagggccacattgataaagcagcagtgagcttgaaattgatattgatttaatgcccgagcaaaagcttcagaaatctgaaatgtagttctaaaatgtaaacttgaatgcattctggatttattttatttttccttattttctctttgttcttgtttcttctacaaatttaattttttaaattattttcctcattgtttgcataaatgtaaagtgttctgaattgtttctggaacaaggcatgtatattaacaaatatgtaagtaaacagacaaaaccaagagtaatgtagagtggggataatgtttggtttccttgaactgaaaggtgattggtgagaggagaaaacttactttaccaaaagaggaataagagaagtttagatatttggatatcctttttgccttgatgttttgtctcctttctttctagtttcttgactaaatatggatccctgtagcattcatattattgagtgctagcacaaagtctgttgttccaggattaaatctagtaaaacaaacaaaatttccacttaaccccttacttagaaaataaatgaaaagtaggaattgataatgacagcaatgagtaatttattattgtaatttagaaaatacactttcttatccctattacaattgatttctttgagcaaagacatctaccatttttttagtgtaattaatagaagccataaatctttgcaagctgtttctgtagcagtacagcaatataggaacatgaggttttaggatgacatcttgttagatatttagctaaaaattgcttgcaccatttaatgaaagtgccaaatggagtccacccacagcaaactaaaactaaaaattaaagctatgaaaagtttatttggtttcccaatactttacatagtgaagctatatttttcttaatagttattattaatttatttacatttatagctaaaatgggaattgagatattatagcattacttaggtgttttagtctaaattttattaa

SEQ ID NO: 60993 - DNA, 883 bp, Bovine  19866881876828
gcagcatttcctgttgctgtcaggcagcaatgttctctttaaaaactccacatctttctctaaagacaggcctagaaaagccaggccctctctcctcactgttcagtctgcatttcaccctcacctgctgtgtgtagaggacgttatggtacgatgctattttccattggctctgctactggagattacagcatgcgactgtgacaaatggatattcccattaaattctttagtagagtggggcattccattaaccactggcactatcccaacccaagtgaaacattgggtcattttttttcttgtgagcaagaagtgaaggaggaaaacaaaggatagactctaattacctttcctatttttttgtgttgcatgcattatgatagccgtatattacaattatttataattaatatatgacaagctgtcagctaaaatttaacaggtgatttgtcaagaagttgcattaattcatacatgaagctgtggatttcagtatctccagcaataaaagtgtgtttcggttttgttgacttaaaccattgtgtttaaatattgtgtttaaatattcgaaggccacctctctatatatgtgcagcatctttaaaaagacaacacatgctaacacaaatgggtaatttgttagtaattttaaggaataagcacattcttctgagactttaacctttaaatgctaatgttttcactgaagaaattaattgccttgtgtttattttgaaattttaaactttatgatttgtacacattttcaaacggtgtctttggtagtaaaggtaaagctgaatggtgagaaaagtaattgccatgacttatgttccatttagggtttgtatcttacactagggaattctgaaaataaaga

SEQ ID NO: 60994 - DNA, 1385 bp, Bovine  19866880126665
gaaaatcccatggacagaggagcctggtaggctgcagtccatgggatcgctgagagtcggacacgactgagcgacttccctttcacttttcactttcacgcatcggagaaggaaatggcaacccactccagtgttcttgcctggagaatcccagggatgggggagcctggtgggcttccgtctatggggtcgcacagagtcggacacgactgtagtgacttagcagtagcataggattgagatcaccaggcaatttgacctaactcctgacctatgctctcctgagtacacaccatgtcttgtctaaactgttgattcttttcctggataaaagaataagaatgaagaattaagtagttagagaatgactagctcccttccccaaatggctcccttaacaatcctgcagtcagatcatatgggcaagataccatgtagagatggatgtagactccatccttctgattaaagcatctttcctttctactgactcttgcctctcaaattattaacttttgagtaatgaagagccaaacctgaactggataacattgattgctaaagtacagagaaaagtgtttaggaagagacgttagtttttcactattctctgaaagcaattgcatcatgttaactctatttcctacttatgattttgtttcagtttatcaatgatgttagctgcacctaggattgtttgttgaagcttattaattatgaatttgatttttaatagcattttgatttatttaatgattattcaagtttcctgtatctttttgtatcattatcaatagattttggttttatatgaattcatcattttatttaaacttgcattgctatattgttcataatacctttccatcttttcagtagccagaaggtcaacacttatttctatttttcattttctacattggatatgtatacctaatctctctttttctgttcaattatgttaagatgttattaattttatatatattttttccagaaagctttttgttatatattacatatttagtttatattttattaatttcttattttatcttcattattagcatcaattcattgtttaaaaattaactttaattttctatgttgctgtcatatatgcctgaataattaagcttctaattttttttttttttcctgatatataatgtcagtttcaaactgagtaagacccactgggctctggaatctgcattttaattaagtattcccaagagattcccatagttcctattctgacattcagtcataaaaatatatgcatacacacaggtatttacagaatatgcagtaaagataggagcgatcaatgatttcactatgcttctcacagttgtcaggaagggcttctaggaacctaagga

SEQ ID NO: 60995 - DNA, 861 bp, Bovine  19866880419076
cttctcaccacaatatattttaatacactctactgcattctctgttggtgaatgatttattctctttatttttcttagagcaatgggttatattctggagaaagtcaccaagggagtgttaagtccagggagaaatgtaatgacagcatcaaccacagtgaccaaaatttggtcttggaattacaaagacattagagtgaaatttatgagataggaaatagatatgctgcgttgttctactagggtagaaatatgtctcagtataaaatggaggcttggaggagggcattctcatttcttccttgcttgggcaagagagaattcctatgaggacaaattttacctaattcaaaaagcaagcatctttgtttacatcatgtaaagctcatttctggtgatgattgtctctcaccttaccaatgagtaagtaaaagtccaactgctttgctgcttgcactggttgatttactatcaaagaaaatgtaaaatcctcacttttaaaaatgtcaggagaaataccctaggacttttaaaagatagaaacacattttattatcacattcttcacttggccattctcatgaacagtactatcaaataaaaagagttcagtcagcaaatagatttcaaaatatatttttaagcataaggagagttcacatctctttaactattttgaacacagcttagtaagtgaatacattattttcacactctcaaagtatataattatgcactgaagaccatagcatgaagatttaaattattcacaaaaggttcttggaattgcttacaaatgcattacctgttctgtgattcagttatgcagcgtcaaacttattaatgttcctattaataaaa

SEQ ID NO: 60996 - DNA, 2728 bp, Bovine  19866880466618
tatggatgtgagagtcggactgtgaagaaagctgagcgcggaagaattgatgcttttgaactggggtgttggagaagactcttgagagtcccttggactgcaaggagatccaaccagtccattctgaaggagatcagccctgggatttctttggaaggaatgatgctaaagctgaaactccagtactttggccacctcatgtgaagagttgacttattggaaaagactctgatgctgggagggattgggggcaggaggagaaggggatgacagaggatgagatggctggatggtatcactgacttgatggacgtgagtctgagtgaattctgggagttggtgatggacaaggagtcctggcgtgctgtgattcatgaggtctcaaagagtcggacatgactgagtgactgaactgaactgaactgaaagccattctgtttcactagtccatgctaggtttctggctttcagtgtgattgtgagaatattggttttcaaggccaccatggaggtgagggaagggtgatgagaaaagggcaagtaaaatgccataaagactttcattattgctaagattcagctatctttcttgaataaatattccacgatttttcaagcctctgactaatttacagactcctctaaaaggagttaattctgacagcttttgataatgttctcactgcttttaagaagaaatgggtttttggaggtccttgctccaccattcccactgatacagaaggttcacatactgagatatggagaagtcattctgacttttacatgagttaatgtgaattttatacctgtttgtggcttatcaaataagcattgtacatttactttaattattaaagaaaagggtacattggccaaaagtaaagaaagtccatgctataaatgaagagtaaatgctggggtctcagtgctggtactctactgttgagcagacacccttcccaagtaccaaagccatactgactcactgtgcacatgctgagcttcttttttttaatctttaaggaatgtatctctgccttgttttgatgttctttgttctgacaagacagaaaactgtgttgacaaccatgcttcttctccagggcagttcctcaaagtcatctgagaagctgccttcaagggtatagtcctcagttgggctcatgtaaaactctttcctatccatattatagattgtttactgattattttcatcaacaccactgatctcattcagtgttttttattattaaccatgatttgagtacaggtattcctacatgttaacattcaagagagaacctgatgggaaatcaatgtgattattagttagcaagtaatttgggaataatctactgaacattctttgtttgtcattctgactttcacatgacttaaaccacagaaatatgcttgcaaataaaactcgtgcagtttaatagacatgaaacattcatatcaaaactatctttttttgaggcagaggtgacagaccctatgcatttctgcttgcccctctttctgcttgtggacaccctcaagaaatcctgggatttattggaaaataaatgcagtctgagaaataaagtaacagttgaataaagtgggtccatgaaaagatgtgatgggaaggtggcttccctaacatccacagatggagatgtaggtactagaatttctagtccaagacaatgtatggaagcagtatactttcaaggtggaactactcattactcatctttttatttaagaatattatgagacaatatttctcattgttcagcctgcctgagtaaacattatatgactacaatcattcttatatagatagtacatttgtaactaacactgaacaaaagtatccataacaagctggatgaaaaacacaaaacattcctttattttcaaggccactaaactgtaaatgaaccactatttcaaattgatcttgggaaaattgcttatttagctttcctgttactttgttttcctgttagtgtaataaagagtaactgaaaaagcagtgatgtttaagagcaccccagcacagaacaatagaaaacatatttccctgcacacagagagatgagtgagatgacttgcctcaatgctaaagagaaataaattaattggtcttattgaagtctttgttttctgttgtttttttcacatcagaaatgccaaatgagtctgacatatatgtcagtctctctgttttgtatgagatagcacttggatttttaatctgcagaaataagctttggtgtgttcagtgatgccagtcaaagttgtttttatttatttttaaagcattcaatggaaaagtaatccacaattctctttcatttgccagatcttctaacgtctgtatttctaaattgggagtttatatcttcaagaaaataagtaactcaaagggagtgcattttaaacaccacagtggtcagagagaacatgagggttttgcagtgtgctttctctatgcccatatgagataaaatcatgtctaagcacaaggctctaaagtaggaatcagcgacaaaggtctgtgggagaaatccatcctggtgcctgattttgtagggtccatgagttcaaaatagtttatacattttaatggtttggaaaaaaaataagcagcttatttggtgacataagaaaattatataaaattcaaacttaagtttccatacaaagtgtttattggaacaagtaatgctcattt

SEQ ID NO: 60997 - DNA, 1689 bp, Bovine  19866880638112
ctcatttcagagatatttcatctttgtatttatattctctagctaccccccaccaatggaagttgaaatatatttgagagatatttggtattgtctagagactagtcttttacacccaaggatagaacaggagtaatgcaattacggacacttgatttaatgtttggagaaaagtttccctagagagttgtgttactttgatcaaacttaatttaaacaatagaatcatctggggctgatttctgtggccatcaaattaaaaagaaaatcagcttgtttactcaaactctacctctaagctgtgtcacttcatttaagtaacagtagctgcataagcaaaaatatattggattttttattaaccctaattcatatattcagtatcttaatcttaatcctgaagtacttaggttcagcaagagttgctaaaatgaataaaattcattggatcataaaagaagatagaaaagttaaatgatgctgaaatacattttatatgagactttcatttttcaataaagcttccgaaaacatgcctatattctacaggatagaatatattacagtcacattggagatttcaataacttctaatgctcacaaaagattatttaggtgtttataactgaagggaaatgttttccatcaaaatctgctgaattatgttttccaggaatatctttccaatacaatcttcacacagtgagcaaaaaagaaaaagctttagaagacaatctatcttggaaagaataacagattttactgaaggatcttcatgttcttaattcttatatagagagtttttcagtacttgaaaatctgcctcaacacagacacaattgctgtttttcccttctggtgtctgcctactgaatgctattttgtgcttgtcaaccacatccaagtgttgtcagccccccatttgtcaagggcacaaattctacctgcaagcctttacagcttcacctcaaaaaaaaaaaaaaaaatcgcatttccacgcaactgtaatggaacttcttggtatgccactttgttttcattgtttcccaaataaactgggatggattctgagcttccagtagaaaataaattaggatgaaccatcacagggtgttacttggattctcaaggtgtgccactcatcatgtgctaccatcatttgctaccaagaacactgatgtacactttaatggtggttgaaatttactgagcacttactgtatcccaggtccagtgctcagcattttatattttaactcatacatattcccctacaaactctaggaggcatagatacaatgattatgctttgaaatttatttaatattattactggaaagaggtttagattaattcaaagaagggtaacatctcatttatcaccggcaaaacactgtagcttgatcttagagcttctaaacatccacattgatcccccacctagcattcacttattctttttggttaaaagtaagtcagatataacatatcccattttgaaatcacagtgtacaggagcatagattaggaagaacagagatgcagactccaatgtcaattctgtcaccaccctgtatgatcctgcattgatggattcatttctttgattcaatttctgtgcgtgtaaaatagttagatatttacttaaaagagtttttgaagatttaaaagttaatgatatataattag

SEQ ID NO: 60998 - DNA, 4014 bp, Bovine  19866880673450
tttcaaatgagtcagctcttcgcatcaggtggccaaagtattggagcttcagcttcaccatcagtccttccaatgagtattcaagattgattttcttcaggattgactggttgtatcttcttgcagtccaagggactctccaagagtcttcacccaacaccacagttcaaaagcatcaattctttgatgctcagctttctttatagcccaactcccgcttccatacatgactactggaaaaaccatagctttgattagctaattgacaattaatacctcaaagtgcatgcatacatttttatatccccaatcatataacaattgccttgtttaagagaatctggtcctcattcaatccatagttcctaactcatgactttatgcagctcagggaacatataaatattcattcctttgattaacacacttttgtttataccacatctgagtttttaaaataaagtggcattatattcactgtacaggactagttcccaataattctgacttaattaaattaggatgagttccaggtattggtatttcaggtcattttatatatatatatatatctccagggttaacaatcacaactttcagcttggccctgaatggattaagtctttaggtgacttttttttaagacaatggggatttccctggcagtccagtggttaaacctctatgcttatacagcaggggttgagtgttcaatccatggtcagggaactaagatccctgcatgctaggatcccacaagctgggtgaccaaaaaaaaaagcatttatcctgctatatttacttgctcctggtaaaaatcaattactaccccttaaaaaatatgctcagtcttttcatttattaacatcctgctgcaccagtcagtcagttcctgtttcattcctgttctcaagcagagatatgtgaactctctggttctctttatacttcaaatgcaaacaaatcctttaaaatcaaattgattcagcagagaggaagaaatagtgtagagaggtatgttgatatttttataacttctaagtgaacaatccattttaaatgattaattccattacactgcaatttatgtctagtgctagctaatgaaacaaattagtttcaccatcaattcaatcctcttccttttcttacatgctcttattagcttcatcctgaaagttttgctacaataatttctctgccacaccagttgtaccattactggactttccttattgattactgaaaattcagatgtaaaaaagatagatgagcaggaagttggctaccaggaccagtttacagtctggggcaaacaagtcatcaacaagatatttattctcttgtctatttattatctagaggaaatggtatatttctgaccctacatacattaaacagctctgacagataagtaggttctaaaacagttttcgggaatgatttattgatttattccattaaacaataatgctaaaaatgttgcaatacctttctgtatgtatagtgctttctcatctactatctttaatcttcatggaaaacctaagaatgcagaaatgtagacactttaaatatgttctattaatgaagaaactatgagtcaaagggtttatgtaagtgaccttaggctccttagtggaactagacttttcctttccccattatccttcaaaggcaagaatcataaatcaagaaggtggactgggggaaactgactggtaagttgtgaagtaaagacagatgattctttatcaaaaagaactatctcatccatcctctcaaatattggaatgggaaactttaccctgaatgttccactgaatgcccacagtatccgaaatgcccacacataaggtacacattgtctgacatatcaagcaatgttttgaatacataattcattgagtctcatggaggcaacatttaaatccaatttctcccagatgcacacatcatattaaattaatatgtctataatgttaggcaacaagtcacataagtctagcataaatacattttgacagtcaagggaagagtggattcaaaggctctttagaaaagaaaccagaggaatattgaaacaagggtccttggagttagtattcagagaagcaggatggaaagtgggtgatgcactagccagtaccccaaacacttcaaggaggatatgggatcagtatttcttctccattatctgcagcgtgccataccttgagagcatgaagtaatgtaaaggatatcaacttggcaataagagaggcaaaattcctttcatcactgtatcagctgaaagacactgaaaagttgtttcatatttctgaacctctgtgtcattatttcagaaaaacatgtggccattgattaaatgaactaagaagattttaaaagttccccagaataatgagtgctcaaaattgcttcccccactttcccatcttcctttcttattcctaggaactattacattccccaaatcatctaagttgtaaaatatttatctttagtagttcaaagttcagaatatgcagtcatatatgtgcatgcatgctcagttgctcagtcatgtccgactctttgtgatcccatatactgtagcccaccagactcctctgtccatggcattttccaggcaagaatcctggagtgggttgtcatgccctcctgcaggggatctatcttcttgagtcagggagggaacctgcgtgtccttctcctgccaaagaatcttggcagtcagattctttacagctagtgccacatggaaagccttgtagtcatatatgctagaggacaaatcttgcctttatcacttataactgtaatcttgggtgaaaaatttaatcacactatttcaggaatgtgtgaattcctcatttataaaataatacatactcccattgttgttatagtaaaaagtacatgaagaaatataggaaagatctctagtgcatggtttttagcaagtcctcagcaagccctcccccattccccacattattgtatggtacctgaagcatctcgaccttcgctctgtcttcctcacaggtctgttcctggcagtgtgctgctgctgctgctaagttgcttcagtcgtgtccgactgcgtgacctcatagaaggcagcccaccgggctccactgtccctgggattctccaggcaagaacattggagtgggttgccatttccttgtccaatgcatgaaagtgaaaagtgaaagtgaagttgctcagttgtgtccgactcctagtgaccccatggactgcagcccaccaggctcctccgtccatggattttccaggcaagagtactggagtggggtgccattgccttctccgggcagtgtgctggtcaccacctatggacaacctaggtttggctgatgtccccctttttgaggcagagtgcttttgtctcaacccgctaacatatgtttccttccattcctcctggacggacaaactgtttttctagtgacaaaaggacagatgtatcctcccaccgagtatcttcactccaggcaagaccagccaggtgcttctaggcttttgggactttgctaggtgatggctatcctcagtcattttcaagttaaagcttcatgcttaatcattctgtgatttgcatatatgagataaattggctcatttcagctttaaatggatagtgaggatcatcttttaaagtgaaaagaatttgacttgaaatataatattgatatttttctctttggtgtgtattctcaaatggaatatctgttacttatatattcataattgagatagaatcagcatgtgaaacctgttcaaagtcagacaatatactggaatatattgatatgttttattttaaagtcaagatgattaaaacaaaaagacaggttcagctatttaattttttaagctaaaccaatttggaggagtctggctaaattgcagacagcaggttttactgctaacattctaatagtcaatcaatctttgagaaaggattttctgcctcccagctgcatt

SEQ ID NO: 60999 - DNA, 1924 bp, Bovine  19866880690631
tgtacatatactgagtattggcactttcatggagtttctgtctcatggaacactcctctgaccacaagttttattattttttactcttttgttactcactttgataataactgtctgaataccagtattttgcagaatatcatttacttcaattaatttacatcataattattgatgtaaataattgtggatttctcaaaatggaagcttaatcactgtgaagattctttttacagttacttatcatttgtagttcatcaaatattttaatcttcattctttcaggaaaaaaagtatttaaacattatacagaactaggtttaaatttcattatctttattcacaagaatggtcaaagtttttctttttttaactataaattatggagcacatttattccatgagattgctgtcagcacatttcatgagggcttcaatatatattttctattttcaatcaattctaagactcttgcttttcctacttccacctttctgatttcatatcttcactggccctttgagatactggcatcctacaatgaccaccagagacaaataaagtcagtcagtgatatattgaaagaagagtttcaaaggacagcagaaaagaaaggaggggtcagagactgagtaaatttgttcagtttggaagaaacaattataatctgggctttaattatattcaaatgctgtgcttctgatttttaagacaaatttacaatcaaatttggttatccaacaactcctaaaagtgtttatgaaaaaggaaaataaattattgagatttaatatctaaacactagtttgttttataaaagcaaaaatgcacctgaaaaaaattatttttaacaccaagggcttgagaggaaaacaaatccatttgtttctaccaaaatgaaataaccttgaacttacgtgaatccagactcttcagactgtttctaaattagtgataaataagcaaaggcagatgacccaggaaatgttttgatattatctccagtaaaccttgttttataagcacattatgtacatattgataaataacaggacatatccttcctataatagttgccccatttcctccatatgtcttcaaaagtatttagtcttcgacaagtgcaaattcctttcagctgcggctcacaggagccatttctgttcctgctctaagtacttaaagaagtgaattaacccagaaacctaattcataatcatcctaataccttaaaaaattggatcaaaaaaattcttattcaaaagtcagtagaaattattcaatcctgaactgattctttcgcgtacaaataagagcctgttaactcactgttgtttgaggaagcacatgaagtttatcctattgtcaatgccaagtgtagataccaagggtgcagctcctccttatgatatgcttgtctcatttttagcatgagtctctgaccactgggtcgaggaaaaataactagtggttatagcattaaatagcagtgatagaatgctaacatatactgatattaagaactgattatgcatctacagtagtaattggcacttatttcattttcctcccaatccatttatggatgttattttaagtttaaggtacggatgttattttaaattgaagaaaactcaagtttatgaaactgaattaatttatataacatcaaacagccagtaaagggtagtgctaagagtgatgctcagcctcacgtgatctcagagtccatattgtttgcatctgcattagctcctcactttggtttctctatattttttttatgatgccaaatgaatatattttaggaggtctaagggaaacattttgtttttgtttgtttgttttgctgtttgtttagttggttgttttgtatattagagacaataaaaaaatgtaagaacaggagccaagctccaaaat

SEQ ID NO: 61000 - DNA, 1095 bp, Bovine  19866880725852
ataatcatgcataatagctgaggctaaatataaaatgaacatatatttagtggttctttgaatgcacagttaaactgcccttactaaggtacaatactcagggtcagattctattttatgatggagacaagggaacaatttaagggaggaaataaccaaggattactgtctaaagacaagaaaaccattggatgcacctgtgtttggaataagagccagagccgccttctgtacctataacactttcttgcccagatactcaggaacccacaaaataatttctcggtaatgggattgccaaagacattaattacaaatgatttcattggatacactctgtctcagcctctctttccacatagccctttgcaagtttattcaaaagcctaccatttctgctgccactccaatatgaaccaccattatgttccccatcgactgttgagtaactttcatcttggcctttgtgggtgcaaccttccacactcgtagactggtagtctcatcactgatacaaagggaaactgttacttgctcagtcatgtacaactctctgtgaccccatgagagggtagccccgccaggttcctctgtccattgggattttccaggcaagaatctggagtgggtagccatttccttctccaggggatcttcctaacccaaggatagaacctgggtctcctgcatttctggtagattctttaccatctgagccagcagagaagcccaccctcccaagatttcaagttcaaattgccaacaatactccactcagtccagttcctcaccttggggcaaaagactcttcttgattctttgcttcttgttcattcctcttttaattccttggttccctctcagctcctcaagtacacagtatctgtctcccagcaatctgctaatttactctttaacctgctttacatttttcctgggtatcacctgctcatcaagaccttgcctatcaattctatttggcattaaactgttgttcacaatatttcttttccaatgttttacattattagttttatcagagtacttaatatattttattcctatatataatatatttttaatttttgagtttct

SEQ ID NO: 61001 - DNA, 2356 bp, Bovine  19866880827985
tttaatcttataatacattgaaaagtatagtattccagtacaacagctggtgcttttagcaataccagctacatcaccattgcttttacacttgtgtctatatatcctggacttgtaataatgatgctgtattaactgtattccatagagtactgtacagtaaagtacacaaaagcacaaccacttttgtgtttgtgcacacatgcaggatgcacacatgtaacaatgtacaccagaaacatgaactaacttacgtaattggacatgtgaacacatgctcaaatctttgaaagttcacgaattgaaggcctatattatatgtagaatttctgtagttgaaaatccacaaatagagacagcttgaatgtataaacttaacatttcatttaaaggaaacattcaatagaaatatttagttggtcttctgtagtttatcatgcagtaccaaggcacttcaatttaaaatcttttcaagccatgagattataatcaacatctggaatgataaacttttgtgacctgttcccttctttcttgtgttttaaagtttgggaggaaattcccacaactgagtgcttaaaagtgtctgatctttcactttatctctcttataaaagcaagttgtatatatcaagtatcaaaactatggagagatgtccctaaaaaaaaaattaatatgccaagcccaaattttgtagccagatagaattgaaatgaaatctaccactctgtttgctaatcactttttctgtgatgttggacatatggtctccctgcaaattcattatgatatacagagacagatgttatgttgatatatgtaatgtatattatatacaggtctacatgtatatgtatgtatagatatgtatcacattacatctaaatttggtcaagggccatgttacaaacctctgttttctatattaaaactatttgaaatgagcttcccattttgaatacatgaattcattccaaggaaaaaaaataaaaagattgctatcagttaaattcctattcccaccagaaatactaacattttaaaaagtaataaaaataagaactctgattcttaggaatgtcagtggggaagatattttgggcaagtcctgtaagcaaatgtgtgttttgcccatgccaaaatgaaactatctctcaaacccaatcacagaaggccataaaaaagtcagaggtaattgtaataataactattgctttaggctcctgaatagttgggggcagatggactgtgggtttagatgaaaggagattgagtggagatgaataaaaatgaaatatgcagatatttaccaactactaggtcatgatatatcctacatgattatgcctcaagcctggaaatattctatttgagtggatttaattctcttctttacctgcactgtttcataatcaggttgcttcacgattctctgtaatataactaacactataaaatagtatcacatgcaacctttgacttttttaatgctcacaagcacttctgtgaagacaggaattctatcttcgtttgaatcataatgggaaaaatagaacggaaaagcaaatggagtggaaaaagacaaccatatctgttaagagcttaatcatggaggatcctacatgtgtacagatcatagttcatttattctacataataaccccatgaggtaggatgactttccctcctttttaaatttctttttataaatgaaaaaagtgaaggtcagagagtttatgcatcctgtccaatgtcacatgcagaaagatgacccataatcatgtgctgtgtgtgcatgctgagttgctgcagtcgtgtctgactttttgtggcactatgtagcctgccaggctcctctgtccagaggattctccaggcaagaatattggaagaggttaccatatcctcctccaggggatcttccggagccaggtatcaaatccacatcttttacttttcttgcattggctggtgagttctttaccactggcctcacctgggatactgggatttaaattagcctttacttgccttcaaagctaactaatatttaatgccttaaacacaggcattttattgacttcaaatgcattctcttgccaggatgtcacacgtatttgccaccacatgaccagtcactaagcaaatgactctctaaaatgaacttcctcataaaccttgagatagtatgcttcagaattcttctctctccacttgccgcttctaggtcaatgtgacattataatgcaaagaagaattttctgggatctcaagttttgcattattattattaactttgtaattgtattatttaaaatgtcatcttattcttgcctttctgaaaagaaacaaaat

SEQ ID NO: 61002 - DNA, 914 bp, Bovine  19866880993592
ctggtaagtggcagagttgaggttagcactctggttgatcaaaattcatgagttgcaccttctcaacataactagtagcacttcctaagggaggaatatttgagagttaggtggggacaatttctggaacaaatggtaaaatcaatatgtttcatgagcagtttaattaagagactccctaagagttgatctgagttgttctggctggaatgatcatctgagtttcattgtaagaatttagtttgtaatggcaaaaaagataatgtacagaaagcaatactacacagagaattatttgtctaaagtgtatttctgtgagtatgctttttaaataacagctcctaattttactgggaatgtatcaaattcaaaagaaatcaaagcacaaaattttgataactgtaacaagactctctctcttttcttttctttttttgtgaaccttattctagaaatatataaaacaagagaaaactcaatctgatgccattctattatctatcattatctgttcagttcagttgctcagttgagtccgactctttgcgaccccgtgaatcgcagcacgccaggcttccctgtccatcaccaactcccagagttcactcaagctcatgtccatcaattctgtgatgccatccagccatctcatcctctgtcgtccccttctcctcctgcccccagtccctcccagcatcagagtcttttccaatgagtcagctcttctgttagtttctgaaaaaatcatattttcattgactagttgaaggtttctcatccattaccataacaagtagtttctatccctttattagattggcaagttatttatatgtaaaaaagttttgtcagtgagttaaaagctgcttgctatagttgctataatagaatgtaatcattttcaggtaaggcaa

SEQ ID NO: 61003 - DNA, 1599 bp, Bovine  19866881148682
tcatgtgttattacaagaattttctgtcttctgttcctattttaacctacagtctgtgtctgtttgagtcatcaggtcaattgaatgaagttatgtagtggaaagctttcagatgagatttttcactcacatttaaaaaagtcgtattgctgtggcttcccctgctagccttgggaaaagaaaaaaaaatcatatatcaatacctaagtgctgcaaaaagcacacggcgcactttctcttttaactggttcataaaactgaatttttatccacagcaccaaagttaaatatgaactcattctgtaagggcaggaggactaattttctttttagtgttccatatggctaaatttcacataaaagtcctcatgtgactgggactaaagcaatttccatagcatgacaaaatacaagaaaaacttcaagaaaaatgaggaaatccatattagataagatcaagaggtcaacttaatcaaactcttttaaatagcattattgtacatgctaaaattttttaggtgtaagaagcatgaaaggtcagacctcagatagctcatcaaataattaggcagataacaccaatatataaaaggaatgtgtgtgttggtctttcagtcatgtccaagtctttgtgaccccatgaattgtagcctactaggctactctgtccatggaattctccaggcaagaatactggagtgagtagtcattcttttctccaggggatcttcccaagccaaggattgaacctcggtctcccacattgcaggcagattatttaccttctgagccaccaggaatactaataataatatggcatgaataactctgacagtttcatcaaggtaaaccatatgatttatttttggctatatcttcagtaaattgtgtatttcttgttgccgttgttcattgctaagttgtgttcaactctttgtgacccccatgaactatagcacccaggctcctctgtccttaaatatcttccagagtttatacaaatttgtgtcctttggggtcagtgatgctatctaactatctcatcctctgtcatctgtttctccttttgccttcaatctttccaggatcatcagagtcttttccaatgacctggctctttgcatcaggtggccaaagtattggagcttcagcttcagcatcagtctttccaatgaatattcagggtagatttcttatagaattggctggtttgatctatatgtaaacaaacatggagtggaaagcagctcttttgctccttttcctgttttcccatttccagttcactttaaccttagaaaaacctatgtttaggagtgagatcactgggcaatttagcctaactcctgacttttgcacaccactctttgcctaaactgttgatccttttcctagataaaaagaagtaagaataaagaattaagcagttaaaaaaatgacaagctctctaccttccaacagttcctctagcaatcctgctgacagatcacaggggcaggataatattgatgagagagccagcccatttgcacacaatggagaaggctacagaacctaatctccttcctcaagattcagaggttcttcacccattttctc

SEQ ID NO: 61004 - DNA, 774 bp, Bovine  19866881390771
tgtattgcattccttcctctccctctccctcttcctttctctctctctctctctctcacacacacacatgcacttctcatgctatcactgtgaacacaagcacggagttatgtaaacaaaatcattgttgttttccaactgaacctggaagcactgacatggaatgacatttttctctacatcccatatttttttatttgcaatctttacactttatgccccaataacactatatagtcacaaccaactctctccacatccctaagacatcaatcttgtcaaatctaattgaatcaaaccacaagcagttataaacggagtgcagcttgacaaataataagggggaaaaaatgaaagagaaaagaggcatgcttcaaactgatattttttcttttagatattctcttatggaaatattctgtaatttcctaaaaatttctcctcattttttccagattctttgccagtcagaattttgctctttatttagaaatacttctctattttcaacactgattttgattttgttcaagttaaatatttcccagagtagaaactgaacatgctgttttgtgatataacattgtctacattttcacaggaggctagccttgggtggtagtttgtgatttactgtagcactaatgcagtcaggggaatgaacacatcacaatacgaaatttaacttgtggacccacaactaggctctattagactgagaatttttgcagtttgtaatgtcacaaaatatctctacaaagttagcagggctcc

SEQ ID NO: 61005 - DNA, 1106 bp, Bovine  19866881864257
agctgtattttatttataagagctttacaactgtgtttgtatgtgtgcttttatttgctttctcttcctgcagccctgtgaagtgtgtcaaggttattggccttattgtgtagattaaacatttgaggcaattaagatttgaaggtagtttcaatttatttttggctttggaagaacagttcacaggtaacaagaggtccatttacaagtgcaaaggatgagtttacagaatatagcaataaaagaaaaacaaatacattttgcttccagtaaattaagataagccctgtttcacattaaaagcatttttaaattctgaagctttgtttttcattaatcagtagaatataatgcacctgtttaaaccaaatgcttttgattcaagaagacttaggcttaaaggctattcgctagctgtgtagttctgatacattccttaatctcattgagtttctaagtataaggcataaataatagtgtgttcttaattggtttttcatgaatattaacatcttatttgtacaatatctaacaggtgtagaaatattataaggaaagaatgaatagcattcatctttaacttaattttcatcatgattaagtatttattaaatattcaactttagtgtccccataagaataatagaataactagaacattattatacactaaaacactctacagcatttttaaagattatatattgttttctttacatacttgtcataatgtttacaaatgtcaataacacacatgtatatatcattgcctcacttttagtacttggtttatcaaaactttagactgcagtcaataatgtttaccaaattacacaaatatgtgcaacaagtacagatggctttagagttcagaccctgagtcttaataaagtaacacctggaacaatttccaaaaatggtgttattaaatagctaattcccagaagaaatgaaataatcagtaacctgaatagccttgtagaaaataagactaaagattgagtgtgtaagtacaatattttgtcacatatatgaactgtactgtaagaggaaggaggtggggatagttcatgatgaatcattgcatgtatcatgtcaatatcaaa

SEQ ID NO: 61006 - DNA, 1719 bp, Bovine  19866880702076
aaatcaaaatttgcatagaaatgaatgaaaatgaaaacacaacaactcaaaacctgtgggacactttaaaagcagtcctaaggggaaagttcatagcaatacaggcatacctcaagaaacaagaaaaaagtcaaataattaacctaaccctacacctaaagcaattagaaaaggaagaaatgaagaaccccaaggttagtagaaggaaagaaatcttaaaaattagggcagaaataaatgcaaaagaaacaaaagagaccatagcaaaaatcaacaaagccaaaagctggttctttgaaaggataaataaaattgacaaaccattagccagactcatcaagaaacaaagggagaaaaatcaaatcaataaaattagaaatgaaactggagagatcacaatagacaacacagaaatacaaaggatcataagtgactacattttttaaagtctatttgctcttcattaacatttcttagactaaaggaataggattttgcacatcttttgaccaattcatctttcttgtaaaatttctgtgtgatgtatgttaaagtttatttatattttaaatctattataattccatttacagtatgcttaactgggatttctctttttcaaagcttcaattaaatgatttcatcttcagtgggaattcattcccatgtagttattcagcagagtatatagtggttgcatcaaaaaaaatgcattttcttttcatttgacatgtatttagactcaacattattttatttgtcaaactttgggtggaactattttctgagataattgaaaattaggctatctcaagttatttgagaaggcaaacatgccatgcatgtatgcaaacattgagagtaggctcctgtggttactgaatactaaggagataatgaacttacatgggtatggacctcagaactcaagtttttcaaacaatattgactttccctcaaattatatgaatatatattgatagaacattgccacacatgttaccagttgttttctcaaacaatgaaagtacactgcagaattctgaattctgcattacagctgtctttacagtaggatgaagcgaacagaattaaaagttcaaaagcatcgactccaactaaaacaaagcagcattaccagagttgacttcatattcctcgctagacaaatgcttgttttcaacttgatgtttcaagcagtagatttctcacttgtggccagcatctgtgagttgtttatcaggttaaaaagttctggatatatcattgatggaaccttgtagtgacaattggctgtgatgtcatagactcttagttaaacttctagaagttatatttagtcataccagagattaaacaggaaagatgcttactaaatgaggtgggatccaacaggagtgtagtacagaatgtaataatttatgaactaactttttcctgaggtagctcaacagaagaacttttaatgaggaaggcaaaggcttaagtatctggtacatttgtcattcctgatggttaatttacttgaaggttaataagtttgaaatctaccggtcttagaaatggaagagaaggatgaatctgaacagtctatctcggcagggaggcaagaaattcgaaagagaagacgaccgagccagcccatggtagataaatcccagcagacgaaggacagagaaaaagaaacaattatctataccacaatcatcggccccaaag

SEQ ID NO: 61007 - DNA, 1501 bp, Bovine  19866880741232
ctgttagtaaaatgctgtactatgtgcacacattacttattcaaaagtattattattgttttcattttcaaaggtaactgattttatcagtagctgttttcagtttgtgtgcaaggctagccactgttaggaatcagagacaatgtcacaaaaaatcaaattgtgactcctttgtttgagatagttttgactataattcagaccactgatgggttggaaagcatcacaagttcagatcagcattttggggagctcgggtgtgagtctggcattgatttttatgaatctgggacattggaacctacctgctccacagaacaagcttcagtcttcaggcaggtaatcagggaagagctgttagtttggcaaatggctgatgaattatatacattttatgaattatatttttacagttcatacttatgcttgcataatgtgaaaaataacttgcatctaaaaggaatggcataggaaagaatctaccgggaggagagatacaccagagaaagaggaaaacactaaaaattttaaatcatatgccaaaatataagcaaaatttgatttatttaaccaaaatatattgaaaataaggattgtggaagtgattcaatagggatctattaagatttctaagatatttactgaaaccaagatttagctatcttggaaaaccaatgaagtttaatcaatatatattcattttgctttgttttatttttaattttataagtactatcgtccaagccttgatgtcaactgtgccattaaacagggctgagattaataggtatgaaaaatgtcacctggatagggatttggaaaataatttttagctctatgagtttagattaaatgctataaaaatctagtgctttaaccttaaacatgctgaggataatgattgtttagacactttctgagacaaatatcatatactatgttatctattcctattagatacacagaatagtggctctgaatatataaaatgtcttttatctcaaatatttgttacaaaaagtttaactttttaacatgcatttatagggctttaatttacaaggacattttacatgccaaatatgtgcctggctctctgctaaggcatacaaatgtgtaaaatgttatttttaacaaaagagcttcatgatctagaggggaataagacatactaatacgaaagagcattatgaagtcattacccaggtaaagaatgtaaaaattttgcattattacttagagattgtaaaagacataatagggagcccaggttaccgaaatatttacatattccaaaacatcttacaggaaacccaaactttttggccaaccctttagaatattctcaatagtatacctcaagggacaaaatttcaagaaattcttttttttttttcattcctagttagctaaaagactcacacaatgtaaaacataaatctcttttgaaacccttgagtttgtctcatgatttgacagcacttcttattacatgttccat

SEQ ID NO: 61008 - DNA, 804 bp, Bovine  19866880783233
ggaagaacaaaatgaagtattttttccttgtgactgtccttattagtatgtatgctcaaatgcatcaaactaatgaggctgcgtcattacacggaacagctgtattgagtattttggaagtttcagtacattggaaggataaaaccaaaaaagctattagttaaacacaagtagtcataaagtaataatgaagacagtcaagcaatatgttgacttcactagtaactactgcatgtggtgtcaagagtggaattttaacatattcatttgtttccccaagcataaattactaaaagctacattcgaaatacagggcacgctgtaaaaactttttccattacaaagtgtgatcccagtacatttaacctctcctttttatttagaaacaggacaaaaacacattaacttctaatatcatcaatatgatgctccatccatttgcttactcttaaggttaaaataaatcatatcactattttgcacatttaagtgaaaaatccaatgaaaaataataaaatttggagaaaatactaagtccttaatctctatcctcagtatatgataatgaaattgaactcataattaaatcatgtcatgagcattccaaaattaaacagaaatgacaattatataattacaaatgggaaacaagaaatatttaatccttttggcattgttgcttagtatattccattattagctgaattttttcaatcacaataatcctacaatcccttctggtccctgtaacacagcctattcagcataatattagatacagttcaacacaaccctacactaaac

SEQ ID NO: 61009 - DNA, 795 bp, Bovine  19866880807801
tctcttttgctgtctcgtatacagggttattattaccatctttctaaattccatatatatgcgttagtatactgttttggtgtttttctttctggcttacttcactctgtataataggctccagtttcatccacctcattagaacttgatttttaaaaatgttgatattctagcttggaagcaaacaaatcatttggaggacatatttcacttcagttttcctagtgcgttggtttagaatgctaagattataaagaatttaaaataccatggaggtgagttgaatttaagggaggatagtagacaggtcacccaaataagctgccctaggtaagggtacactgaagtggatgtaatagaatcctttcattctacttcaaaattttgtttccccaaggactgtagatagtagtgaatggagaatacacttagaataggctttttgtaccagaacaaaggtaaaacaaaaacatatgttctttttcaacctagtaattttttttttttttttaaagacaagaagcaatatacaatcctgaagtttgctgccttgacagctgataatcagcagaagctaacagtcccagtggggctcactttaatcttattcttttgatattgagctgcattttaaggctccatacaagatgctcttttaaagcttgtatgtataaaaacagtcttgccttgagatttgttagctgcacatgttaagtgccatgagatcaggtggaaatctttgtttggggtattgccctcatggcacatcaataaatggtgaccttctgttggtgt

SEQ ID NO: 61010 - DNA, 1516 bp, Bovine  19866880842845
gtcatattctatcctttgcccctgctcggaaatttccaaggtaaaggagaattaaatgatgtaacttttattttgtcttatcgaaataatttatactatagcttatgttggatataaaaaggcaaaatagaagctgaggttataatttgtagactggactcattatttactgagtggactcagttaataacaatattaaaaatttaatacaattaagtttaccctgaaaataactacattttaaattttggatattaacttgaatatatttatctaggcacataaattggtaaactctaaggaataaatatttcaaaataaaacattattcaagcatggaaagatttctatgcccatcaatagttttgcttcatgataaacattaaacattatttaatgtttaataaattattaatagttttcaatgaaatccagtatgacgctttcatttctcttgattatttttacatttactaaaagattgaaataaaacaatcttaagttcaggaaaatactgtttgatagcattagacacttttgtattacacaatctaaaacacaagtggggcataagtactcttgactgacaaggatcgatgttagaatatcacaaaagtccaaatgatggggaaatcttttaatatttctcattcttcacatcatgaaagtattcaagtatgtccacatttatagagggactctttctcaaagctccaattctgaattaggtcaagtgtttgaagattacttccatagattatattaaaattaccttaataatgaatggccacaaaagtctccttttagttatgatgcaaaaataataaaactttcatttagcattgtattaataaatgtttatggagatattattactatcttgctggttataatatgtgaaattaaaaaacaaacagattattattttttctctcttaaattacctctaagccatagtcatagtgtatggtagttgggattctaagatggccccagatattcacactcccctagaagaaaagctatgaccaacatagatagcatgttaaaaaacagagacattactttgccaacaaaggtccatctagtcaaggctatggtttttctagtagtcacctaagggttagggttagggttaagagttggaccataaagaaaactgaccaccgaagaattgatgcttttgaactgtggtattggagaagactcttgagactcccttggactgcaaggagatcaaaccagtcaatcctaaaggatatcagtcctgaatattcattggaaggactgatgctgaagctgacactttaataattactttggccacctgatgagaagacctgactcatttgaaaagaccctgatgctggaaaagattgaaggcatcttgatggttggatggcatcactgactcaatggacatgaatttgagtaaactcccagagttggtgatgaacagggaggcctagtgtgcctgcagtccatgggggtcacagagtcaaacacaactgagcaa

SEQ ID NO: 61011 - DNA, 1769 bp, Bovine  19866880869071
agggacagggaagcccggggttgcaaagagtcaacacaacttggtgactgaacagcaacaactactggaaaataaatttttgaagcttatagtgtagatttggtttctagtaagattcttctttgggcttaccaggtggagctagtagtaaaggacctacctgccaatgaagcattcatgagagatgcaggttcgatccctgggtcagaaagatcgcctggaggaaggcactccagtactcttacctggagaatcccattgacagaggagcctggtggactacagtctctaggaaaagagttggacacaactgaagtgacttagcacacacaggatgctttttcattctaatcaatgagatctattcacaaaagatttagaaaatggaaaaaagtcattattctcccaggcaactaaggcaaggacgtgtgtttcagcaaatggcctttgagagattgtatccagaatactaagggttctaccaagaccactgtggaattacatgcaactgaagcaagtggaaaccttcttgcaaacattgttctgccattccctgaaaaattcctgacttaagcttctcctgtgttttaaaagttattaagttctcatgtccctattttaacccactaattctaagtagtaagtaatctgcttactcttaagtgacctctgtttcttgactgagccctgaacaatatctgtagatacccagatcccttctgcatttcttttataataatagaaagaagtttaaatttccacttcagtgttctccatcatttgtctccctgtgttatatcattcctctaatacagcatggtgtgtgtgtgtatggaaagggagttaaatgtagaatgaaattttgcattgtcaaaagtcacgcaagagtaacttacaaaaggtaaaagagggttttttaattccctgtggtttcattactcttgcaggataaaagggagagcgtttttacactaggtattgtcaagctttggacttgtcacttattcaaatcagataataagaataattaatggatttcatgaaagaatagaactttttaagaaagataatttttttaaccagacactgtctccattctaataaaatagacaataacttcatcacatgtgatagcagtaagcttttctaggaaattgagataaacatagtaagcttccctggtggctcagatggtaaagcgtctttctgcaatgtgggagaaccaggttcaatccctgggtcgggaagatcccctggaaaagtaaatggcaacccactgcagtactcttgcctggaaaattccatggattgaggagcctggtaggctacagtccatggggtcgcaaagagttggacatgactgagtgacttcactttcactttaatagtgcctggaaaatgataaattattaacctgaagtaaaaaggctattaattatatcatttatgatttatggtacacctgagcttatctagataagtaagataagcttggattaaattggcattggatgcttatttctaaaaatattataaacattttttatgtcctgtagtcttgtacaggccactgggaacatgattcatgctaatgaagtaatattcctagtcagacaaagtttcaaccaacacaaatcagataagtatatatagccattaaaataaatagtaataaatgggggaatttttcaaatttatattcaccttaataggtttaaatcctaagcttcaatccgtagttcaaattatatgagtcctttataatgtca

SEQ ID NO: 61012 - DNA, 748 bp, Bovine  19866880937912
tttttttttttctttcaatcaatcacgactcgccattacagcagttaattctcaaggcagtcacaataaattctcatccagagagctctccttattaattttccaaagaaaccaagatgtctgtgttgatccgtattttaccttgcccaggctgttcattaatgtcaatacaaaagttcatgagctgtaaaatcctgaggttaagattaagcagctattacaagtgtaccttctggcctaaagtgaaagcctcatagagtaaattactctgctgcatatcactgcctttgtggttccagagtgattactttttttttttctcactattttataagatcttatggaagcctctttgaatcttttattactttccttgcagtaaactggggaggggggcaaaaataaaaactccactctgaatagaatctattacttttcatcctctgaagatttacacttcaattgattttttttctttcaggacaggggaaaagatgcacttcatatttcacaacattctctttactgtaattctaagcaccatttttttgtaggaataaacataagatgaagggtactttgtctctttatatttttccttgatgtagtcggttttctttgctcttagccaaagaatcatatgcaaactgtaatttcaatatacaggacaaaggatgccaatgtaaaatgtatcccttgataaaggtcataaagatttcttataaagaatcaagacccttttctcaga

SEQ ID NO: 61013 - DNA, 1856 bp, Bovine  19866881055831
ccctgcccgcatatgggctttcatacgccctctggtggtctgggatgtggaggcagtgctactctgcaggttcagaacagtattcccaggacttgagaaaaatcctgagctcagccaagatcctggggagtcctcagaaccttaaatttagcttgtgtgccacagcagcagtggctcaaagcattggttttatttgtttcctctgctaccctcctcttttctctctacatcagacctccccatcaggtggcccttcttcacagctgatccttcagcagttgggttcttagcctactgaatctgcatccagctttgatagcggttggccgcttgagtaggaataaaatttttcttgttcttcttgtgggtagctgaactcttaaatctgttgctccaacctgaagtatgaccttcaaaaacatgaaattgttttaactgccaggttgcctagcacagagaggtaaagaactatattacatctaataaaagggtttatgatatgtaacaaaagtgatccctaatgtgggtctcactgacctctgtgtaaaagtgaataaattttccttccttaaaattcttagcagtagagctactttttgtcaacaaaaagccagtgaacttgaaggttttaatatctcagggttttgttaaaacatttctttcactttattctcacttgctaagttttcatgaccctaaattctatttccattgaagtttgtgtagcatcattctctttaaaagatgttgtctgagaaagattaacttagtctgtttctctgttgctaacctacatctttataaactgtaaaagcctagtctaacatcaccccaggtgaactctttctgtggttgaagcataatttgaagctgaacggagttttcctgtaaaagacagtggctgaagtcagcctctgaaattctaatatctttcttcaaattctggcacttactgttcatactcgaactttttatttgaattctctgagcctcagatttctctcagtaaaatggggatactaacatccaccctacatagttgtattaaagaaaaaccattctgtcacttgttaaaatgctgaggagtattttattcaagattactacaacatggtcatgcctgtcataataggaaagaaagaatggattcaagcctaaatacagcaaaggcagctggggattttgtagccaaaaccagaatgagaaggtcagaggatggagaattactcacaggagacatcagggggagaaggattcttgctaacctggtcttacagaactctagctaaaggcaagctaaggacttaaacatcaaaagtgagggatgaaatacttggtcagatatccaggtaggggggattcttactaaactgatttggtaggattctttatgacaaggaaggggccaatgtcaaggcagagttgactagaaggatcagagaagcctgacaaaactcagtcaagtagggaaactttgtcatttgtgaggcttgcattaaataacattaagtcactacattaaatcagtccctgctgctgcagatgctgctgctgcttcagtcatgtccgactctgtgcaatcccatagacagtagcccaccaggctcccccgtccctgggattctccaggcaagaacactggagtgggttgccatttccttctccaatgcatgaaagtgagaagtgaaagtgaagttgctcagtcgtgtccaactcttagcaaccccatggactgcagcccaccaggctcctccatccctgggattttccaggcaagagtcctggagtgggggtgccatcgccttctccgaaatcagtccctagtacccagtaaaggctgattgattaaatggtaa

SEQ ID NO: 61014 - DNA, 1421 bp, Bovine  19866881184677
tttccttaccctggtgaatgatatttagtaagtttaataaagaaggtatcagcgatatttatttacataatttcttaataagatggcagtcatttttaaatcaaactattttgagactttttctagctccacatatcattacatgtaacttattaaactgtgatgttaataatcccagttctactatttgccagctgtgtcatcttggataaattacttaatctttttgtgcctcaattctctcatctgaaaaaaatggtgataacaatggtatccacctcttaaagtggcaaagaagaccgagtgagtaaataaaacactatcaccattgctggaagtaatgggcaccatacaggtattagcattttgtagcattattatttttcaactcattcattgtattaggagtacctgattgattacagaatggctataaaaaatcctgctatcaaatggatttcactagacaaataacctaaattctccttagagattagataaacgggaagtatttgttaaataggattctaactagtgatcattcttatcactactttaatcacttttatcaaaggcaagcaggactgtttaattaaaactcattgtgtaacttttaagggtggtacctaacccagaaatgtcaaatggagctgaccaaatgaaggagcacactgcttcatccaaaatgaacaccatgatcccaactcagttgataggagtttcagctagacttttcagtttcttttaaaagggagtaaaactatccactgaaatgcactttgcctggtcaaacttttgatgcagtaaaaatcagtcataaaacctaaaggcaattaagactcagatcccatgcctgtcattctaaaaagcaagcatcaaagaccgttgtgctagaattcggccatttgtttttaggagaacatgatcggaatgcttcctgtcccagagcttcttgctgctagctactgaagctgagaagctcaatatttaccaaaagaaaacactactattaagaacagatttcctagttctttacccaacatctattctgccctcctgtcaaattaactgaatcccagttttaaaaactccaaatatatattataaacattttaatttaatgtatacctgtggtggattcattttgatatttgacaaaaccaatacaatattgtaaagtttaaaaataaaataaaatttaaaaaaaataaataaaatgtgtaagggtagtcttaatttcctgtcttttgatgtgatgccaaaatcctttctttgaaagactccaatgattgcaatcttatttttcttgcataaatcatgttcataatttatcttctaaaatttctagtttcagcttctttaaagaattaaaaagggacatttaggaggcaatgaatgtacatcttcaagcagtttggcaa

SEQ ID NO: 61015 - DNA, 1495 bp, Bovine  19866881221351
aatacttgtaagcctctgggatagggcatatctacatgagaagctgcatgataggtagaaggctgctggatcagactggaatctgaagaaggactctaatgagtgaaatgtttaatggcattaagggaaaacagcctgctgcaagactgtaaccaaaaggatgatctttccaataggaccagaatattcaactacggctcccttccctgatctccaagtcagaatcagctttgctgtgtcatcgggtgactgaaaggggaagctagaggggattcatgtcccctaggtgagggggtcttcacacggggatgggcttaaacaacgtggatgaaacaaagagtgctttcatgcagtctctcaagacccagtaggaaagaaaaggatgcctagctgaagaggagagataagggttacagcttgtcatcactacagaaagggtctgggacacatagacagctgagcctaaggggtggatttatccccatggtccaccaatcctcaaggaagcagagtttcgtgtctggcaagagcagtagcagcacttgcattactcactctgagcccgccgccaagagggctcgaggcaggatgtgttcggtcgttgccttcagccgtcctgaggagacagactccacacttagccggctggcttggagtcctctctgactgtgagaccagccaagcagaggcaggcagctgaatcgcagtgagcacaaccaggtgcctcatgtgcggcagcccaggcttttaactaaaccacagtctactgccaatactggacttcttgtgacctacaaaaatggcattgtcatatggttgactctatctatccaagttggccataaaatcaaagaccttgtgtgtgtgttagccagtcagttgtgtctaactctttgcaaccccatggtctataacctgctagactcctctgtccgtagaattctccaggcaaggatactggaaggtgttgccattgccttcttcaggggatcgtcctgacccaggtattgaacccagatctcctgtattacaggcagaccctttaccatgtaagccaccagggaagcccaagtatactggaatgggtagtctatcccttttccagggaatcttcctgacccaggaattgaactggggtctcctgcattgtaggtggatgctctaacagtagagcttctggggaagctctcaaaaactctgtcagttcagttcagttcagtcgctcagttgtgtccgactctttgcaaccccatgaatcgcagcatgccaggcctccctgtccatcaccaactcctggagttcactcagactcatgtccatcgagtcagtgatgccatccagccatctcatcctctgtcgtccccttctcctcctgcccccaatccctccccccatcagtcttttccaattagtcaactcttcacataaggtggccaaaggactggagtttcatctttagcatcattccttccaaagaaatcccagggctgatctc

SEQ ID NO: 61016 - DNA, 830 bp, Bovine  19866881229337
ctcttgtttatatttggggggcattttgaatattaattagatattaattatatatctgtctccttatattgtactttcctgaatgcagagactatatattacctaccacagttggcagtacttactgactcaaggaatgtcgtgaaggatgttagcaagtacttcccagacaattagttctgtcaaaacttgaaacaattaatataaaagacaacgtaaaaatctgcaaattaaccttaccacttggaattaaatctttgaagacttatttagttttttgaacaagaacttattcttaaagtatttctaagattatatctttaatgtgatatcactgtttcattgtcattatataatgttaggatttttttatacattgccactttattactcttaactgtatgatatgatgagctaggttatttgggagtgataggcaatcctccaaatttcagcatcttaaagagaaagaaaaggaaagtgtactatttttttcttgttgcctgtctgttgtggattggctataggtctgttccatgccatcttcactccaggagccaggctaatagagcagcttttcacttgaaaattgccaattgttgtggaagcaggaaatgatagaatggcaaagcatgctttaccctgaaagcctctgcttgaagtgatccatgtccctgcccacactgaattggctgaagcaagtcatatgctacttctgacttcagcaccgtgaggatgtttaattcccgctggaggaaaggcagtacatttttgtgaatagttacacaatctactacagcataaaaactgttacattttccaaaaacatt

SEQ ID NO: 61017 - DNA, 777 bp, Bovine  19866881371023
ctctttttacctgcctatttatatataacacacccaccagggtttgaaaagtggggtgtggtaactctacctcattcttggctaggatgaatgactcattaattttctaagcagtagagctcaaagcatactttctcttttcaagttttagaaagtaggtttgcaagtcctgtggggtttcctttactattctaggtcaagcatcagattcttttatatagaatgaacgtcgcttctgaaaactgcttgtgaaaaggactgcatgtcttttagaaatgtcaggttttagtctaccacatggctccaacctgactctcttctttgctccatgatatgcacaccgaacaactgaactgtgcactaaaccaaaaggaatggaaaaatatgttttcctgttagtaaaaatgtccctgtgagatatggaataaagtctgaatatttttactgtagaacagtgtatcaagtttctctttagttcactcataatgtattatttaagcagacagaaggctgaagagaaaaaaaattgtgttgaacaaggcctcgactttatagtgttgtaaatatagtacagtgacatgagggatcagtaaaataaactgctccaagctggccagtgaatcatgtattttataaatacaccacatttgcaaatgtaaaataagatgggatactatggattaaagaagggtcaattaaactacatttatgctcttttacatacaagataacatgggaggggaaagatagcattcattttcataccaataatattta

SEQ ID NO: 61018 - DNA, 2852 bp, Bovine  19866881374260
attgcctgtggtggcttttgtattgcacaagcagaattaaatagttgtgatacaaactgtacagcttgcaaagcctaaaatttttaataactataccctcacagaaaaagtttactgatttctaaagtatatctcattagcacaatttagcacaattcagtataaaatttcaggcaattttaataatatgtaatagcttaaaatgattaaaattggataacttaaaattatgtggcaaaaagtgaaagtcgctcagtcttgtccaactctttgtgaccccatggactgtgtattccatggaattctccaggccagaatactggagcaggtagctgttcccttctccatgagatcttcccaacccaaggatcgaactggggtctcgattgcaggtggattctttaccaactgagctaccagggaatccaattatgtggaaaaaacacatttaatcactatcaaaaggcataatagaataacaaaaatatttacaacagcctgacaatatgacttaactatttagcataaaaatagtagagggaataaaaaataaaataaaatgggtatctatgtatgtaaaagcatgaattttgaacttaagatacattatagtagttgaaagataatcctctaaactaaaatcagaaaacatgaatatttttcagccaaatttctatgtttaagtctaagtatggagtgaattcatgcattaatttattttgtagggatacattctcacattctattttcaaagaccatcttgtaagtgaggcatttgtctttcacagcttttgctgaccttattctttccatttgtgggagtgtgaacataaatatttcataataccaaagtgtaaaatatttaaatgctgcatttcataccactatatgtatattttaaaagatggttcagaaacgctctagtttactgtttcctggaatgtttagtatatttgtaggaatagtgctttttaggattattgacaactccctctgatcataaaaattatatacattttataatatattaagctaaatgttttggaaattaatgacttctgaatggaatcatgatatcaattataaagtagattttttattgcataccttaaaacatgtcctatatttaccttatttcatggaatgtaggtttgcagtttataatgaaagtgaaagtgttagttcctcagttgtgtccagctcttcttgaccccatggcctgtagccctccaggctcctctgtccatgggattctccaggcaagaacactagagtgggtagccattcccttcttcttgacccagggatagaacccaagtctcctgcattccaggcagattctttatcgtctgagtcaccagggaagcaaaccattattttatgtaccaccaagaaataaagaattcatccaattatcaatgaatcatgaactataaggaaacaaacattttcagagatgctaaaatataaaaacaaatacctcgggcctaaaattcatgacaataatataaagtattttatcagttttttagacatgacctgctgcccaaagttcttagcacttgtttagtgccttgtattttcaatttattttctttattctctctgatattctgattagcattatatgttgcatcttatacttcaaaacatgatcttacattttcttcaactttgcataatagtttctttcaacaagcctttttgtttagagagatcaaaggttttcctttagttacagttgtattttagcatacctgatatcttactggatggtaaagcaagagctttgctatgagactcatgttatatgaaagctttatgcattactgccttcaagatagagcagatgctttcctttttctagattattagtgctgaaagataattctgttagaaagacattctataaaaagatagtccgttcggtaaaatatctttgtaccttccactcaattttgctatgaatctaaaactgttctaaaaacagtatgtgtgtgtatgtatatatgcatacgtacatacatacatgatattctgaatgatcgtttttaagtttgactgtaaaacaacaacacaaaaaagtaaagttctgagaaaaaggacaggacagatcacataggaaaagtgtttaatttataaattgagtgacattcaggagtgatgtaactattgcaccagcagcataatgaccatatgactatgccatttctgcattatactcataggggcaattcacactctgaaattagatgaagtaagctttacagcttctgggtattctgtatagatctaatcatacatgtactgaacatcaatgacctataaaacactctgctggcaaatctagacttcctaacattaagaagtttacaggtttgtaagatggagaggattctgagtggatttttggagaaggaaactgaaattctctggaaaagattcattttggcaagtgatagggtttgattttctaacggtagaaggggtggagcaagagattccaactgggttttatcttacagtaattattagaagtaattcaccatggaattgaaataaaaaagaggtataggtagataggaatgtttcaataggaaattaaggagacagaggatgctttctgtgttccagatctaaggtaaaggggctgggagagaaaggagttagagacaaacatgaaaagaaagagattaatgtaatatataatttttaattgtaagatctaaagaccaaaaagattatattgacattgtaatatactcaaaaagatgatcaaagaatatttttagaaactttcctgttttaccatgtttcctacatattatgtaccaaaatcctcactaagaagg

SEQ ID NO: 61019 - DNA, 730 bp, Bovine  19866881413952
aacagcagacatactttagtgaatcagaaatagtggttattggatggccgactaattctttttcaaagtcaaaggaaggtgcacagaagcgcaaatcttcagggaatatttttcttagtgaacatcctgaatttcaacccacaacaagtagcaatgaagaaattaggcggccaagtattagcagaacagtgtctatttcaccaaccaaaaaagattctcctgtacctttagaagatgagaaagatgttccagttgaagtacagcctcctgctgcagaagagatctctgctgaagaacagcttccactagctgagactacttcagaagaggttcctgtggcagttcagcctccaccagctgaagagcctcctcttgaagcacagccttcccccactgaagaggctcctggagatgaggcccctgctaaagtagagcctacaccagctgaagaggctctttcagaaaagcctcctgctgaagaggctcttgttgaaatacagccttccccagtggaagaggctgctggagatgaggcccctgctaaagtagaggccacctcatctgaagagactcttttaaaagagcctcttactgaagttcagcctcctgcagctgaagaggctcctatacaagataccccagaacttcaactttcaccagctgtggaggcccctgcagaagaggccccagctgaagctgagcctccaccagctgaggaggcccctgcaga

SEQ ID NO: 61020 - DNA, 1354 bp, Bovine  19866881518166
ataccctggagtagaagaaatggcaacccactctagtattcctgcctggagaatcccatggacagaggagcctggcaggctacagtctgtagggtcgcaaagagtcagacatgactgaagtactgagcacacatgcgtgcatgttcttaaagaaacgaggccgacttttagtgagcccaggtaagtaatgcaacacatcattatttcttaagaaactgacttccatatttagctaaaatcatatcagaattcattatatggctttctcttcataaatctaaatgagttgcaaaatttaacagactttctacagttgtgataaaattaaatcttagttcattttagaaagtcaacctgaaattgcctaaagcgtaaatgaagaattttttcaatgaaaaatatgtttctagcttacagtactgcagttgtttcaatcaagtaaaaagaagctatgaaacattcttttgaaaagctgatttatcttagaattgaattaatgacttagaactttggtgctgccttcccaatagaaaccagcacattttatcctgagcttgcttctaatccttcattcacagcttagattgtccctcagctcctgggattttgtttaaagatctcctgccccttgacaggaaaagcacaccctatcaccctttatttgtttcctttttttctgtataacactgatcacttagcattactttttatatgtatgctgtctcttttgatagaatataaagcacacaagaaatttctctcatgttttcacagctatatgcccaaggtttataaagtgcatggcccattgcaagttctcgacaaatgtttgtggaatgatggatgaaaaatgcatagacattacagtgatattgctatgcaactacttcacaatcaatgtactaggagaagaaggtgggaaacaggatataagcaaaaccaccagtcaaaaatgaaataaaactcttcaaaacatgttataaaattatttaaatgtgaaattgggttaaacttacatctaatattttagatacatactcaaggaacataatctgtaagtataaaatgatataaactatacagcactgctaaatgtcacataaattgcttgcaaactacagtcaaatgtcactatgtttgcaattaatgtttacaatttgttatgtaaatccttctttaattcaaataatagcataggacttgatttggaaagaaattcagtctctgccctgactggctctatctgccctttgatctctaatctcccatcttcagcatattggaattcactcccatatatatacctttattgcccagatagaatatattttttaagttcagaaaaagaaaaaag

SEQ ID NO: 61021 - DNA, 2123 bp, Bovine  19866881533223
tggataatgagtgcatcaccccatcaattcaaaatcagccatgttatgaataaacacactctatcaatagactgatgcagaaatgatgagttttgccctctatgaatagactgatgcagaaatgatgagttttgccctaacaaatatttttaaaactatttctgtcactttggagctattaaaaagaaaaaatcatctaattttcaatttaatttcttgaccccattgtagggataaaagggaaaaaggagaaaaaaataaattttaatttgttagaactagactgcacttttggaacaagtactttcattcctaagaaaacactcctgctgcttagtcacttcagtcatgtctgactctgtgcaacaatatggactgcagcctgccaggctcctctgtgcatgggattctctaagcaagaatacgggagtgggtagctatttccttctcaagaaaacactgaggcttctgaggtacaatctatactcgtttgcactaatgaagatatataaacggttgcaagcagcaggaatcctattattactactttgatgagaaggaatgacatcttagtacctggtaatgccctactgagtctttcaaagatgtttaagtgtatttcttgacatggctcatcctggggaattgcagcatccttgtaacctacattgtgaaacacatcagacagcatgtcaagatttattaaatgaatagtccactgtccattttttttctaattcacatggaaatgagagacacatttcaattctccccccccccgccccccccccgccgaatatatcagaggttgtgaaagttctagagacaaatgccatagggataatgataatacgattgttgaaggaatgttactgaggacattgttcattaaaatactgagttaaatgtgtggaatctatacaaaagtgatgcagattaagttatttacaaaacagaaatatactcacagacatagaaaacaaacttacggtcatcaaagatgatagcagaggtgggcggagaggatgcagggagagataaattaggagtttggggttaatagagatgtacttttaaataaaatagatatacaacaaggacctactatttagcacagggaactatattcaatatcatataataatccataatggaaaagaatctgaaaaaaaaatatatatatacatacacgtacatatataattatacatatatacatataaaaaactgaatcactttgctgtacaccagaaagtaaaacaacattgtaaattaactatacttcaatcttaaaaatttaatacccaatttgggtattgaaagaataccaaaaaaaaacaaaaaacactgagatttacaaacggattaccatctaatatatcctttcagaatttgtcagttgaaaacttttgattacactgaggaacttagtataagtgataatatcatctgctttcacttcgattactagaaagtacagaacccaaatagatcaaccatagaaaccatcatggcatatagatccattgatgtccttaccattgttgcactgcttttaaaatcatgtatttttcctgattgtgattctctttttattttttatcattatgtaatcaaatacattattttcacaagctgatttttaggacttgatttggagaatagaaaatatataataacagactaaaagtatgtaaaaagattgctaagtaaaagaaaaaaactaacagatactgtgttgtgcaactaggagccaagagagtgagtttaacagagcatctgttagacaaatattaataagaattttgtaatcattctcctagtcccaaatgtgagcagtttctcttaaaagctgtctacagccccacacatgtttaagcagtggctaaataaccatccatctggcatgttaaccaaagttcctgaattggaagaaagattaaactagaagcactcaaaaatttcttccactccataatttcataattaaatatgttatacttaatgaaccatttgttatctccatgggatgaataacttatggcatgtgtctccatgctatcctccctgccaggtctagaaactaagttaaatttaattctatcaccacctacaattaggaa

SEQ ID NO: 61022 - DNA, 720 bp, Bovine  19866881864757
cctcctaccttttttggaaatagtaacacaaggaaacatgataggctaagcaaaagaaattcacgattttactcttggtgactagagataatccctggttaactcatgctgtttttatttttccagatagtcatgataaaacatatatcaactcctatatttagaaataaaactatcaccaccaacacagtaggaacgtcatctctttggggaaaagtttttttacaactttcatcagaaaaaggtgttgaggagaccaagcagacataagaaacctggagttgtgcacgcatgcatgctcaatcactcagtcctgtccaattctttgtgacccagtggacagcaggccactaggcttccctgtccatgggattctccaggcctgaatactggaatgggttgcaatgccctcctccaggggatcttcctgacccagggatcaaacccacatgtcttctgtctcctgcattggcaggcgggttctttatcacgtagtaccacctgcgaagcccaaagttgtacattagtggaagataaatgtttgatacttgttccagagcaggagaaagggctcccaatgtcatgtttactgattttccactttactacttttgcagaaaaccttagtggcaagttaaaaactgtttgattaactgctgagctaaacctgagggagcatactcaggagtccctctcggcaggttcttctaacctgtcttt

SEQ ID NO: 61023 - DNA, 660 bp, Bovine  19866882148356
aggagaggcgacttgacacagattgtgtgtgtaacagcaggcatgtgcccaaaggtcatctatcaaagaatacatgcctttataaaaagatgactagaaacctaggagaaaataattttcccttgtttcctgtacacacagtagggcagcagacactgcgcacaaacccttctgcctttcactctgctgcagtgaatcaaataaatttaaggagctggcaagtgctttcagtgccaatcaacaatggagaaagaagcgttgctattgacaactggaagcttcgaggtcctgagttacagaagctgtcttttaaagggttccagctgttatattcctcacatcagtgaagcatattactctgttccatattgtttgacaaagctgtgggtaattgccttctcatcttcacaatgttttcacaagaatcatttatgaagtggcaatgtttagtgggaaatgatagctaaactttcgaactatgaggaaaaaaaagagtatatctggtacataatttctggtttccagaatttggataatcaccaaacatataattcacacataattttactgctttatgcagtaaacaacctgagctaccatacttgccaaccctagagacacacttaggtcattattattattatttaacaataggaggca

SEQ ID NO: 61024 - DNA, 2747 bp, Bovine  19866880533434
ctttttactttttctgccaatatttctggaattaaaatcaagaaaatggaaattagggtaccacacctttgaagtacactaaatacttgacaaactgttaccatcttataaagatttccaagtagagttcttcagtcagtgtctcaaaagattttgtaaaaagcaaatatctaaattaacctccaatattaagctgaaacacattagtaaatattagcatttgagaaattgaacagttccctctcttaatagtcactggacatggaaattattaaatttgagcatttaatttaaaaaatttcctgttactgttaattttgttaccacgtttaatcagcatctcactatccttttgttctccctttctttagcttttgttgttactttctgcttttaatacagtcaaatgtccattttctgtccatattcaacttataataatattcctcatatcccactgttatacagtgataatagtaccttatctttcctttaaattcttgtccccccttccctaacacagtatatatgcagctacttagtacattgtcaagtaatgggtaacttttacattctattctatgaccatacttaaaacttcttatgttttgactctaggtagattgtaatacctgatattaatagtatttacattaatttgcatgcatgctaagttgcttcagtcgtgtctgactctgcaaccctatggactgtagcccactgagcttctctatccatgggattcgccaggcaacgaatactggaatgggttgccattctcttctcagaggattttcctgactcaggaatcaaaccccagtttctttgtatctcctgtattggcaggaagattctctaccacttgtaccacctggtatgattatataaaaatgtttcactccacaaccaaataatagatttctttttaccttcaacatcatgaaccacacaaagaatatctttagtacttagatcacatggttactctttttatacacgccacaagttgctcaaaattgtgctgttttctgtcttattttgagcctgattttattattgttttttcctccctaaagttttttcctcccttttatttcctattgtgaaaataagcatgtatattcttcagtatgccattaatactttgtgacgcctcatttcttttatctgctgtttaaaagctgtgagattcttttttctgaatactttttactttggccacatagatttcattctagtttgggcttattactatctatgattggtgtaaaacttttcctgggattgctttttctttatataaataagattatgtgattcagcctctaagtcagttctatcatctctagcatgtatcttcctcttttttggctttcatttttggttggcttgagtaataactcatgtgccttaggactgggtcatgggaggtaaaatccatggaaatactttatattttctttacatatgatcatttgctgggtataaaattcctggtcagaacattttccaacagattttaattgctgcctagttttcactccctctttgcctccactccacaaaccttagtaaaatagtaatagaaagctgttccttgatatattaagtagtagctgtcccaagccagaagcttcacacaggcttaattacaaaggattcacattctattcatgttatgaataacaaaaggaaccagtcagctattttctcactttttttgtattggtatacaatactggtacagttaaatgagggaaaggaaacaagtatgataaaagaggatgtaaattattatttgcaaattttactttctgtatttatttctgtctgtcctaaccacccactcgtatcctgctctccaaagtgtagccattgttagtaacatatgattaattttaagggggaaatgggagggaatacagaaatatatatttatataaaaaatatatttttaagccagacttttagtcttattagtatagaattataatcaacattttcttgttcaaatatcttctgagtctgtcattgtattcccttttaaatttttaattttcatcatcaaaataaatgtatcctctagtaatgacagtgtgaggaggttgggtgattcccctttgtggaaaacaagtataagaatgctgaagtaactatattaatatcacccaatatattttaaagcaaagaataatactagagataaattataaaggaatgaacatagcagggaaatgtgaaattctaaatacacgtgcacttacaacagagacacaaaatacatgaagtaacactgccagaattgaaagtagaaataggcagttaaatatttagagttgcaattttctgtattcttctttcaacaactggtagaataagtagacagaaaagcaggatatagaagacttgaataaggcagtcaaccaatttaacctgacatctacagaatacaatacccaacagcacattcaaagtgcatatgaaacattcatcaggatgagccatataatggcccacaaacataaagtttggtaataaatataaaaagattgaaattatgcaatgtgttgaaattacatagtggcgatttaatttaaaggaattaaattaaaagtcagtacagaaagaaggacaattcccaatatgtggaaattgaatcacatatttctgagtaatctgtgggtgaaagaagaattcacaggggaaattggagaatatttttaactgaagtaggaaaatatttttag

SEQ ID NO: 61025 - DNA, 748 bp, Bovine  19866881890318
attctaatccttattctactttagtatatttatgggcaattaacaactatgaaatacttgagacacacccttctcattaagaaaataaatgtgatcatagccataaaatactgggagatcctggaaagcaggcactggtccacactggtagtactctacaggagggagaggaagctaactttcttatttgtcctcgtaccccagtactctactacttcacaagaagtgtagaagagacaaatggagctaacactcactatttagtagatatcttacacttatgcatgcaatacccttttgggataagtaataaacattttacatatgagaaaactgagggtcagagaagtaaagttatttgccaccagtaaatattaaatattttgaatccaggtctacatgatttcaaagtacacattataaccatacagttatggcaggaatattcactggtggtgaataatggtgaataaaagaacaggctatgaagttacactggattcagattctgtctgccttagttaatagttgtatggccttaagcagttcaattcatctcaccaaaccttatatcaccaccaccaccaccaccctggccccctgccccaatttgttaagttgggataatagcatacacttcatcagaccatggtatcgatgaggtaatatatgaataccacgtaagcaaagagactggcacactgtaagcactcaaaaaatgttaaatataattaacaaacctgtcaag

SEQ ID NO: 61026 - DNA, 1239 bp, Bovine  19866880284825
attgattatattctttgcagccaaagatggagaagctctatacagtcagcaaaaataagactgggagctgactgtggctcagaccatgaactccttattgccaaattcagacttaaattgaagaaagtagcgaaaaccactagaccattcaggtatgacctaaaccaaatcccttacaattatacactggaagtgagaaatagatttaagggactagatctgatagacagagtgcctgatgaactatggatggaggctcgtgacattgtacaggagacaggaatcaagaccatccctaagaaaaagaaatgcaaaaaagcaaaatggctgtctggggaggccttacaaatagctgtgaaaagaagagaagtgaaaagcaaaggagaaaaggaaagatatacccatttaacctctctggtcctctaaaattgacgatgacaatagcactcaccctacgggttgtgaaggaagacgaattaatgcaagtcaagtgtgtaggacctgcctggctcacagtcagcaaaaaacatgtttgatcatcctcatcaccatcatttagtcctcattttgcacaagtggtgcatcaaaatggctcgggttaattctgtaactactaatctgagctatgtgagttctttttaaggtttgaccttgggggcctgaactcttatggagatcacagattctgaccctaaaaagagagactagacccaaatgagggctgtacccacagcacatttatagaagtctgagatgtttccaaataaagctccatgtatcaagaacctgagaagagagatactaagtcaccaaaaacattcagcttccttcaaggtaggaggagggggggggtgatttgttttcacaaatattaaactttccaattttcttataacagtggtggcttcatcaaaaagacggaattgtatgcccagattattatgagacaggccatggcttaatcttcacaatgtttttgtatttgagaataaagaggcattgagcacttatctaaaattgcaacagccaacagcagagaaggcaaaaagccctggaggtgcatggctgtgatctgcatatgtacatgctttacagttcattatggaatcacacagtcaaggcatctcagagctagaaggaacttcagcattcctctctttcaactctttcttcttacagatggggaaactgaggcccaagggaaggatgttagttacccagcttcactcagctagtttg

SEQ ID NO: 61027 - DNA, 2141 bp, Bovine  19866880352096
ttatcacttaggcatgtgacctgccttctttccccaaaggactcttcttaaccccctgccccaatgggctcaagactttacaacttgaggacacactcagccagggaaaaagcagtcccgatggtactctctaagctcactttcaactttagaagcccttccacacccttgacctcattctctccttacagtggccccatgaggtttgtgtgatatacaatgttagtccaggcaacaaagggcaatgggagctgatgtcccccagggaggccactgtgagagtcccagggcccatctgggtactcagaggagtcttgctctgatctccacctccaactccatcatcatctccaacgtgcctcagttttgacctccatgaaacagagtgatgtcctcatttaaaacatcacaaagcctccaaaaatgtaaaaccatgaaaaatacgaaaagttcagactgggctttaccttctaaactacaatcttccctcagcagccacaggggattggttccaggacccactgtggacgccaaaatccgaggatgctcaagtcctgatgtcgggcatccatatccacagttctgcatccacagattcagccaaccatggatggtgttccactgtgtacacttgttgaaaaaagtccatgtacaaacagacatatttcaaacctgtgttgttcaagggttagtcgtactttgctgtttgtacttacatgtcatcatagcaacagtttagcagaaaatcatgttatcttattcatcactatatcctggtgcccagcacaaagccagacacagtacaaaactgttattatgaattgatctttgtttatcagagaagtggggaaaagtgggtgagcgattataattttttaaaaggtcatgttatggagaaggtctcagtcctcctagctgttgacagtggccttgtttgtcttgtggctcaggtttaatctggaagctatgatgggccatgccttgggaaactcaccctcttcccagctggagtcacagctctcagccctctgggtcatgtgttactgtcagctcatcacactggagagataggtatctgtgaggcaccagaggtgtgtgtgtgtgtgtgtgtaaggggaggggaccaggagtgaccctgtgagcctgatacctcctctggcagcactctgccttagggaactgggcccccctcctgcctgcaccgtgagcatccctaccccgactcccacccatgagccctgaatatcagctccagcaggggcaactagagagcaagatgctgacttcctcttctctcaggcacaagcaagcccggtggaggcttccgagtatgctggtttgcagtgaggcctgcagcagaaatcctcagctccaagacagagcaacccgccaataatgacttttccttgcacctgtgcctgttgcaaccatttttatcattttgccacgcttcattgaccaatggattttttttccagctttgcactttttttattactattatttttatcttcatcattacctccgcgcctctgatggcatttagatatgaaccgcccatgaaccttcaagcccgattgtgccatgacaaaaatattgtcgtttacattctgtgccaaagtattatataaaaacacatcaacgaaaaggaaattcaggaagctgggagtaaagatatatagtcagcaaagtatataacttctggcatattactgcttaatcctaacataattattctcatccttttatttgattaacttctaatggttcctcttggtgttaaaggtcccactctgatcatttgattttagtgtctgctataattaccgataatgttctttgcaagacaatttaatgataaccgcataatggcctgtatgaagaaagctgcagggtttcaaagcttttgagtaatataaaatacattagactaacacaagctatcaacatgacagggaatgtttgatttacactcaggactaggttatagcattgtggatttttttcttttccttttctttttcttttttttcccccctctttgcagccgttgacaataaatgacagaacagttggacaatctgcaacttgctgattgcaagaaaaaactgtctggcaaagtttggaggcagccagaggag

SEQ ID NO: 61028 - DNA, 1469 bp, Bovine  19866880359879
gcccggggggcctcggagcctctgcatgcgggtcgcgttcccctcctgcgggacctttgcgttctgagggacagactcttccgatgaagggagttgacagcggaggcctccctgtccccctctcactttcccttcagaagccctccctccgccggctctcagaggggaaactgcaaggggaaagccagttgtgcccgtttctggaaactgcacaggcaggaagtgccggcggtgaggtcccaggagaggaggaaagggggtctgtgcagaggtgtgccgggtgtggcggggacctctgctcccctcgggaagggcgggccctgggctaggatgaaggcctgagagagagacagtcttaacttcctgttgcttcattactgttctgtcacacctccgggatttcacaatcaatcagggccttttctacactgagtcctgtttctctggccccaagctgctgtaggtcactgggatggcgggtgggggggcagcaggcagccataagcccccacactgagttttgtgaaggtgttccaacgtatcttcttcattcgtcaccccctgaccctggtacggtccttcttccatgaggatatatattctcctttttataagtcagatggcatgacccaagggacaggccatccagaaagccctccttccacgtaggaatctttgcttcttggaaggcgaggttaaacccttccagtgaccaagagctcactccctcacaagggacctcattcccctttaggataattccatgtggtagaaagttgtcttcctttgcttgggcacctggctgtctcctggaatctctcccctattggtttgatttggccaaactttgggtatgatcctttctctacctaacagaactttagaaggtccaaggcctgttctaacacatcttaagccttcttctccaggtaaagatgcacctgcttctttgacctgtattcagtggcctcagcctccttcctgtccgtccctctctactgaaggtccctttgctgtccatacccccactccctgagcacatcaggagagcctgccatgtcctgtgtggctccaggaaacacctaactggccaggactagagaccacttcactcatccgaggtgaagtgacatccgaggaccacagatctgggagctacggagcccccagaagtcagggtccagtgggcccacttccctatcctttccccctgttcacctacgggtgctcagtggacaccgatccccagaaaggggacccaatgatgctagaatacacacactgagccagatcctgacaagcagctgtcctccttttccttgcacaggcccagatttatgacacaagtgctcagtcagccacgcgcttgggcctctccaagctgcaaggcagccaaggggcactgacacttactagaagatcctggaggaacggcaagtcacgttcaagacaatattttaaaattaaga

SEQ ID NO: 61029 - DNA, 3369 bp, Bovine  19866880360458
agcaagcaaagcagaaaacctggctaaaacaaaagaaccgttttgtccaaatcctcttggtcatcactcccccggctctctccctcttcatcagcatttggtatctgggagcctggcatgtgtacctctttcacttgaaatcaagtaatcactcaccactctggccaaatgcagcataattgatggtgtgagtggatggagaaaatttcctgtcagaaaaaaaaggttaactgtggacatattacaccagggtctctgattccaggataatggcatttggacaaaagtagggccccgtccttttttatagcactttatgccccattagtattactgcaagtcccaggacctgtctgttcgggcacttaatcaaaagcaatgggttgaaaatcatgttccagctctcctcatatttgattcattccttctagatagaagaagtaaaaaacacattactagcatcaaaacagcccatgcattatgtgctaagcagttgagaaggctatcattgggttttatccctttgggtgcttggatggacaagtactttcctattcatccattcagtggactgaagcagccatatttcatttttttttcttcccctgacagacaatccgttagttttccacagatctctcttttaaagacacattcatgtcacttgttttaattgtaggccctaggcagcaaagcccagaatgtgtgttcgcacatagacgcgcgcgcacacacacacacacacacacacacacaactggaaacccactacttggatgtagctcctctgagagccaaatctaataataggagaggaacatttcttaggggaagaattaatttatacacttaattactcgggatccacttcaagctctccgccttaatgctctttcttttggagagagtttttaactaaacgcccagtgttctgacagaccccgaggagagcccgcctcatttagagggagggacctggcccccttcccagtccttgccaccgtggcccgctccccccacctttcccggaggagcgtgggcatgagccgtggaccggctaccctgcgcctggtggtaacgatcgctgtctgagcgagaggggcttcggctcagtgagctgccttcgcgcggctcccacgctctccggggcttccgagtggattttctgctgaatggctcagccccagcgtaacagtgaaaaacgaagcgatttcttctgtctgttcaaaatgaggcaacagccaggcccctcctcattcaggagacctctgcctgcggaatgggcttctcccattttagggaatttgttccatttaccaatatctcaacaaagagtggaggaaggacacagtcgattatgaaattgctccgggacgagcgggttacctctgctggatgaaagagggagtgtagtgatctctttctgacatctgcaggaagatggattggacaaaggggcaccgccgcatccgacagcccggggaggctgcccatgccggctgcgtggattgctccaacagactgggaattttgggcaccagggttcccaaagtgagctccagctgggtgcggagggggcaactccctgctcccccagaagctgatgcaggccttcaattgtccagattaggagggggattgtggtaggaggggggttgtggtaatgtaggcaaatggagcagagacccagggaagggggccacagcatgtgacccacccctgattctgaatgcggacctgtttatgcccccctagtgtatcaccaccccatcagcctgccaaggggcctacaccgggctccactgtgtcaacacttggggctcagccattgtttgctgatgagttttgctgttgcacatgcctgatacctaggatggggataacacagcacaaaactgacatgtcatcacattaagatgaatttaggttcaatcctttagtgacttcatagaatattttacttaaattaagatatcatgttgaaaaataccttttttaggattttatatcctattatatgtcaataaaaattctatatgctacagagataattatttttaaacctcgagaaaatttagaagaaaattaaattgaccatttatcaagcctcaggagagagagatgaaaatgatttttctaagcttagaagcaatataaaaaccctcagaggaaaagagtgacagatttgactacacagaggaacaaaacatttctgtatgttgaataaaagaggcaaacaagagattggaaatatttatggctactatgataatgggttaatatctttattatttaaaataatcataataattgataagaaaacatcagtcccagtaatatgctaaaaacacaggcataattcatataatagaaaatacaactagtaaacaagaatacagaaaaatgttcagcttcactagtagccaaatacatgtatttttaaaaaaattatttttgtgtattaaatgaatttgtcaataatctaatattgacaacagcgtttctcctctactgggattctaacctgaagggctaatcaaaaagatgaaaaagctaatgtgtaaaagtctatcacagtgtgacttacaacaacaaaaatttaaaacaacccaacatcaataagaggtgcattcagtggaatatcagtcagttttaaaatgatggccatgtggacaaggatttcagtattagtttaaaaagtggtacacaaaattgaatgtaactatgatttccagtacgcagaaagcatgcatatataaaaaaggacagaagtgcattaaaaaatcactctatatctactagaatggagaagattaaacaaaacaaaacaaacaagcaaacagatacaactaactataccaaataatagcaagtctgtgaagcagctagaactcatacattgttggtaggagagtgggatgctgagatggtacagactctttagaaaacagttgggcaatttcttatcaagttaaacatgtccttaaccatatgacatagaagtctcactccttagtatttacccaagacaaatgaaaacatatacctactgaaagtctgcacgtgaatgcaagtagcagctttattcatgactgccaaaaagttaactcaaaggttaatcaactggtacatggataaaaaaagaaatggtacatccatacaccagtctattactcagcatacaccagtctattactcagcaataaaaaggaacaaaatactgatagacccaatatagctgaatcaacatataacaacactgttatactaaatgaaaataaaaacagacataaaaaactacgtatcatatgattctatttcaatgatattcggaaaatgcagaattatagggacagaaaacaagtatca

SEQ ID NO: 61030 - DNA, 1193 bp, Bovine  19866880383909
acccattagcaggcagcgagcgccctgagcagccgctgacacgtacaaagcgtcgccggtgggtggaccgtttgtttgcttttcggcagtgtgaaggttgagttgagtcattttgcacccaattactttgcagtaaatttgccggatggttcttgtcctgcggtattgatccagcatctcaccttgagcttgtttattgacacatcaaattcagaagtcaggcccgctcgattgaccacttcccaattagggcatttatatgatgtcaccgaggctccttgtcatgttccgaagagagccatttgtccccccaaccaccgccgccgcccgatcgcctgcaaccaagttgccatttttctttgacctttccggagacagatggcagtccataaaatacatcattagcaacgtgtcattttatcttgctgctctttctctacgtgaaaggtgcctcattcaacaaaagattctgctgccgatttctccccagagagaggcttacaactgtttatttgctggagtaacggacggcagaaacaagcacttccttttgcatcagggggatgccccttggccctatttggaaaggaggtatttgggcagtgacacagagcagactacaggggtggggaggggatggaggaggagtaaagaacacggccagatgtcaataagacggcacccagtgacgtggtgatttgatcacacccgaacagtctcccagtggagagtctcagtccatttcagactgctgccttttaatctgcctgtgtgtgttgggggtggaaatgactgtgaaattcagaatgtcgtggagtgtgtgctcttagccttgaacttgaggtcagaagattccagcccttcacacagcaaggtagcactttttactccacttctgggaccagctcccagtggaggggcagtggggtgaattcaggtcctccacttcctgacataaggctagaaagagctagtgtggaagctccatgacggcaggcaccaaagacaggagggccagagaaggctttgcccgaatgcttgctgaatattgattgacagaagttcaactcagcatacatagaaaggtacatattgtgcaaatactaaatatatattcgtaacaccaggatccgtagtttgcacagaatttcagaggtcatttatataatgtggagaggaaatacgactggctg

SEQ ID NO: 61031 - DNA, 1747 bp, Bovine  19866880454288
cagggcacagtagagccctgtgtcctacagcctcattggtggacaggagatttcctcggcctacctagctccctggaagagcaccaaatatgtttcctagtttgtggaagggtccagatgactgcctttgattgtgacaatcatcatttaatattctgatgaagccaccaaattcaattatcggttatatttttctaagtgtagtcacatatctctcagtcattcaagcagaagtgttcttctcatgggacttaatgagattcagaaggtgtcaaagtgtgagtaacaaggtcagactgggagctgtctacctattaaccttccagtttggtaaccaaacagccatacccagcacacaaggtgggccctagaacttgtcactgttaatactgtcactgaggcaaagtggcttgggtttttctaagctattccaggggcaatatcatgcacacacacacagggggccaggaaggtgagggccctttccgcacagaaatcctgccctggacacccggtctttgcttgtgtgggagggatgtaggatcaagtctttgcctgccagagatgggggtgatttagggtcagccttcctcactgcaggagagactggccagaacatgtgccctgttaatccagaagcacccaccagaaggaccaagcagcccctcattggctgcctgttctgcttggccagcctcgcgcagtgctctctatttctccaccactcacatccagaatgaagtggtggtggtttctccctaggggcgatggagtggaagacggtgttcggcagtggactcaagggtgaaggccgccggggtcgggggctggctcttgacaaaataagggctgctcttgctgatgtcacttgtggggcaatctttgaaggcttcagctcatggaatcatgaggattacattctctgtcctctgccctggcatgagtaaaggaccatccctccattttacagatgaaccagcttaggtagggaggccaaactgttctgacttcaaagaatcgaggaaagcacatagcttcgaggaccacttctgggctagaagcaagagccttggacagaatcatccagaatgagccctgtttattcattaaattgcctgtatttgggtcctgatgggatttggaagcatattcactgtgaaatatgagtgattccaacgcattattctcactcttcctgtaaataaaaaataagtgccagagagccatgtcaggctccgttgtttgatcgcttctctcttggtacgtaattttgtttcacagcgtcaagtaagggggacttaagggggtgggaaggaagaagccgacttctgtcaaagtacagtctcattggttaacacctgaggggaaaatgtctcaaaagaatttaattcaaaaaatcctttaggcacataggagcttcttccaaccagtaagagtcagacagctatggagagagagacatcaataaataatcagcaggcttagacttttaaatgggaatcccagcatcactacccagaggtagattgcatcttttccaccagcctcagagcatagcttcatgcttgtaaggactgggggacttcacttgctacagttgcaatctggcccttcttcctaataagatgcacatctattcttgtatgtttcctttatgcttcatagacaaagagcatgtaggaaatctacagcatcctattgcctatctatctatatctcttaagttccctatatattatgtaagaaa

SEQ ID NO: 61032 - DNA, 2456 bp, Bovine  19866880489584
tctcctttccctatttggaaccgtctgttgttcctgtccagttctaactgttgcttcctgacctgcatacagatttctcaagaggcaggtcaggtggtctggtattcccatctctttcagaattttccacagtttattgtgatccacatagtcaaaggctttgacatagtcaataaagcaggaatagatgtttttctggaactctcttgctttttccatgatccagcagatgttggcaatttgatctctggttcctctgccttttctaaaaccagcttggacatcaggaagttcacaattcacatattgctgaagcctggcttggagaattttgagcattactttactagcatgtgagatgagtgcaattgtgggtagtttgagcttgggagtgctgttagccaactggggtgggaaacccatggacagtcctcggggatctcagggctgcacaactggagagagcagctctacaagactgccttttacatctgaagaagtgattcttggagaaaagacaacacaagacctgtcctaggagcggggatcatgtttcagcagctaggatggtatcggccgtacgaacctgcttttcctagcaaactggacagacttgtgtgtggccccttcctctctggtactttgcctgctgtatgaatgaagattgtattcctctggaaatattttacagtctaatattgagtgtaattaagaatataatcatgttatcaaaaatggtatttaactctgttgtagtttctttaacattcatgtggataaaaagtctataataaaaaaactatgaagtaaaagttgtgttcatgtaattataaacatctgcttaggggcaacactaatactttttagagttattttggcttaaaatgtttgagtacattatttttggaaatggaattccttcagaaatggttattaaagtctaagtttgcctttggccattgtcagcagctggagtcctcccccatcatgatggtatctttgtatggataaggaaaggttataaattttgactatgtcttctaacagtattggtgagggagtcggtagtgtgcctttctccttactgtgatgttgaatcaaagtccgtgagataattttatgccaaaaattctgcctctcagatgaaagagataggccaaaatggtgaccccctggagccaggatttctaaattctgaggttgaatggaagtctagtggatgtgagagtggatgctctcctgccctggaattgctaaagaccatcctaactgaagaggcatctcaccaatggcatcccttgacagacttcagatgaagtttaaaacgcattgccatgatatttaatgcttatcccccaccgtcttcattatcatgaactatcaacacaagcttcacaattagcccacctttgagataaattttcttatccttatctgctgcattaagaaaccaaaggagggaaactcattagtgattttcttcccagcccatgaaggacgggaagctggatcagagaagggatataaacaaagtcctggggtctgaggacaggtccccaatgacactagcaaaaaacaacatgaagatgctgcatctgaccgccaagaggaggttgttcttccaggagcctgggcatggggctcacacagcctttcggacatgacacacatttctgaaactggcacccatgcttggcacgaggagagaagttggtcagtaaagctgatggagaattgcctcctacagaggctctagattacacttagggatggaagcctagcatccttagctttgtactctaagccaataacaccggaggtgacagaaaattaccaggaaaggcacagacctgtcttcatgaccagccaccaggggacagcagaggtcatcttctgcagaaactaagggaccagataacttttcagagtaagagcagaagctccagaggagcaataactaaagacttgcagatgaatttaaagtctttttcttaagcagccatgtaaacaaggtgggccacagtatatagggtctcaaagagtcggatacaactgaagtgacttagcacgcacgcaagcaagactgaaatgtcatttttttctttccagttgcagctttatttgtctcagagttattagtgctaaaataccagcaaatgatcttgcagcaaaagaaaaattagaaccagataaattaaaatatgtctgagagcctagacaagttattcatggcatagccctgaattgagttaatggtcaagctcagagtgggagaccattgacctctgctgctagaatgctgaaactacattagtgccttgtggatctccagctaaattccaggttccatggaagcccagctctgcggctttccttgagtgctggagactcctgttcctttttctcgtggcctcagagtccccccatctttcaaggttttttgttttcttttcaat

SEQ ID NO: 61033 - DNA, 1290 bp, Bovine  19866880507024
ggactgggctggtcctggcaagagagactcaaagtgggaggggaagaacttaacagtcttcactgctgactgtaaagatgcagcagagcatgcagctggcctctagttgctgagagtagcctctagtggacagtctgtaggaaatgaggatctcactgctacaacttcaaggaagtgaactctgtagtaatcacctgtgagcttggaaggggacctcaagcttcagatgaggtagggtgaaaaagcagggtaaccctacttatttagaagtaaatacggtaaagttaacctcctgttacatttctatgcagagccctaatgagaacatagaaaaatcagaactattttaaagaagggtttaaactagttaaagaagggtggatattcagaggccttcgtcacttacaagacatctgagtacctcagtgagattatgtaaagtttatacatcaagcaagatctgagaaatttcacacggagccaacaaacatctctgaagtcactagcactttgcagtatcacagactcttcagtgatcagcattacttctcataggaggtaatggttaattaaatgaaaacagaagcacactattattaaaagaagtttctttaaggtgatgagaattatgttcagttattttagtagcactcaaactatttccctcattgtcaaaaaacaaaaacaaacaaaaaaccccagtgtgccaaaatgttgctattcatatgtcttaaatacatgcaaacttaccacactatgtgttaaaactaaagattcaaaaaaaattaattcatttgaaaatcaaaatagtaaacttactacatattaacataaacaagtttatgaaaactaactatttcccaaagtaaggaaaaaattagtgagaagagttttatatctttgcaaacctcttaatgtctggcttaaggcagaagaattctcatcagagtctatgtttaacttcttgcaaaatcgcaagccttgtaagctctggaacacttcacttgtcgatgtaacaagagaatgagagtgaaaatggcaaatggcaccttagtaccattacgaaaacagttttcacctcataaactccctgagagggtacctgggacaaccacattctaagatcctctgaattatttctgaacaagttaatgggtggtttttgttttagatatcttgctttagattaatagtgtacagatctatgaattcactgaagcggagaaaaactagggagatgtacacaaactgaaaaaaattcatgatttgctaaaattacaaccctaaaat

SEQ ID NO: 61034 - DNA, 5278 bp, Bovine  19866880568555
caccccccagattcatcatccaaagactggctggggctgctccacccttccgtctctctgtgcctcagagagaaaggcaggcatcccatcctgctgtccacacctgccatacgatagatggcgggctctaaataattaacgagaatcattttgtaatgtgctgaccccggaacattgcacatcactcattttgatactcctgctctactctgctccctctccgtctctttcattccaacagctcagccttctctcctgggcgtccaccaaacaccatgtcaaggcaagtgcccctctgcatttcctataagatgcatcatgtcagcaagagtgtctggcctctgagattcctttgataacacaagtgattggcataggtggctggaagggggaaggtgttgaggcctttcccttcaacacctgctgctcctgcttaggtcgaggggtgccttggattcctgggactcacccaaaagttctggccttgggggaggccaccctaaagagccattggcctgggagaagaatctgatgacagtctgggtgactctgcactccagggccttatcctctatgtgagacaaaaagccacacacaggaaatactaagatctatacaagttccccgaaaaatttcctctgtccctgaatttcatgccagcctatttgtacagatatctcctgtgtgcccaggtctgtaaggctgatgtggaaaagcatgagagaagactaacccccccttgtctggatgcttgttatccaactgggaaatggggactcaaacacaaaattattaagaaaaattcaaaagtctgaaatgttctagaagacatgtaagacattgatgttcccaattacctctgaagagtagaaaggagagaatagaaagaagtgccttttttttttttttaacaatttcattaagatataattggcagataaaactgtgtatattgaaagtgtacaatacgataacttcctatattaatgtatattttgtgacattattaatactatctagttagttaacccatccatcccttccttacctaggttctggtgtgtgtgtgtctgtgtgtatgtgggtgtgtgcgtgtgttgaaaatgactaagatctactctcttagattcatattcctcaaggatactggtctttaattttctttccttacattgtccttatttgactttggaatcagagtaatgctggcttcataaaatcattttggaagtgttcctttcttttgaattttttggaagagcttgagaaagattggtattaatttttctttaaatcttttacagaattcatcaataaagccatcaggtcctgggtttttctttgttgggaagttctgatgaatcatcaatattctattcagattttctatttcatcatgatttagtcttggtaggttatgtttctaaagtttatccatttcttttggttatccaatttgttgctctgtaattgttcaaaggattcacttataatcccttgtatttctgtggtatcagttgtaatgtctcctctctcatttttttatttgagtcttctttctttttctcttagtctagctagagtttttttctattttgcttatcttttctttaaaaaatcaattctttttttttaatattttatatcattttctagtcttcatttcgcttatctctgttctgatttttttgactccttctttctgctatgtttgaacttcatttgttccttttttaattcttatatgttccaggataacttctgtagattcactgtgacttcctacataaacattcatgtcattataccagttcagtataaaaggatttaattcgggaacagccagatgaaagagacgcataggacaaggtgagcaggaaggagtgcggagcttccctgccctctccagatgcttctctctcatcacctccgcgttttcaccaacccagaagctccacaaagttgtgctttgccttgtcactctttaggctctgtactgccccaatttttttattaatatatcaatgtattacattttataattttttaaacactcttataaaaagagatcaaatcaagactcaactgtaagcttctctgaggatctgtgctgggcgttgtctgtttctgttatcacctggaacattccctaggcagcagagacactgaaccaagaattattgaatgtggaataaagacagtgctgtttgaatgttgagctgaaagtagaaacgaacctcagaagaaagggcaatggtgggatgatgaccataaaagtttcaagaaggaaccagaagtaggatcaaaatggcagaatcagaagactctaagcttaccgctcccaaacacatcaaagctacagctacacgtatagcaactctcactgagaaggacctgaagattagtagaatggcttttctacaaccaatgctataaagaaagacccacacggaccctagtagaaaggaagggcaaacaagagagtcaggacccatacccctagtgggtgacccagaagaggagaggcatatcacaggcttggggagcttccctaagaagcaaagggtttgaggctcatattaggcattccagtcttagcatccagcccagagaagacaagagcccatagctggtttgaaaacaagtgaggcttactggaaggcttgaagaaactgaagttccactcctgaagagcatgcacacagatttgacacttccagtcccaacacagaggacgcagactgaaaactgccttgtgctctggccagcctgccaagatggccccaacacacaccccagcctgctctgcactcctgctccagcccctcctgctccagcatcacttccctctggatgcaaagctggatactgtcatcacttttgcacatgtgtgttcaattcagttcagtcactcagtcacgtccgactctttgcaaccccatggactgcagcatgccaggtttccctgtccatcacaaactcccggagcttgcttaaactcatgtccattgagtcagtgatgccatccaaccatctcatcctttgtcatccccttctcctcctgccttcaatcttttccagcatcagggtcttttccaatgagtcagttctttgcgtaaggtggccaaagtattggagtttcagcttcagcatcagtcctttcaatgaatattcaggactggtttcctctagagttgactggttgatctccttgaagtccaagggactctcacctttcacatccatacatgacaaaacaaaaaggcaaactatgactgggagaagacattggcaaatggcacgtctaacacagagtcaatgaccaaaatatgagcttccccagtgactcagcagtaacgaatccacttgcaatgcaggagacacagcagacttgggttcaatccctgggtcaggaagatcccctggaggaagagatggcaacccacaccagaaattttacctgggaaatcccatggacagagagacctggaaggttacagttcatggggtcacaaagagtcaaacacgactgaagcaactgagcacacacgcatacaaaatatataaacaattcatacaacttcctgctgctgctgctaagttgcttcagtcgtgtccgactctgtgcaaccccataggtggcagcccaccaagctcttccgtccctgggattctccaggcaagaacgctggagtgggttgccattgccttctccgtcatacaacttaaaattttttaaaaatctgggtttcaaatgggtaaaggacctgaagaggcatttttataaagaaaacatacagatggccaacaagctgatgaaaagctggtcaacatcactaaccatcagggaaatgcaaataaaagccacacttagatattgcttcacatctttcagaatgactatcatcaaaaagacaagtgttggcaaggatgtagaggaaactgaaccctcctacactgttggtaggaatgtaaattaatacagccaagcaacagtttggcgattcctctaaaatattaaaaatagcgatttcactcctaggtatacattcaaagaaaatgaaaacactaattgaaaatggtatgtgtacctcaatagtcatagcagcattatttacaatagccaagttctgagagccatccaaatgtccatccaagatgagataagaggtacaaactactagtataaaataaataagttacaagaaggtaatgtaccacatagagaatataatcaatattttataataactttacatggaatataatccataaaaatatttaatcactatggtatacacctgaagctaatattgtaaatcaactatacttcaattgaaaaaggaaccccccagattgtaactatatgtggtgataaatgttaactaggcttattgtggtgatcattgtacagtgtatacaagtatcaactcattatattgcacacctgaaactaatataatggtatatgtcaattgtatcgcaatttttttttaatttggtagagaggctgaagaagttttaaaaatctaagtaaattttgaacttttgtaaacaacttaactaaatagtcttaatctaaagaaaataaaaattttaaaaatattgaaaaagcaacagagtgcagatgaacctatttgcagggtagcagtagagatacagagttagacaacaggtttgtggacacagtaggagaaggaaggagtgggacaaattgggagaacagcatggaaacatatatattaccaaatgtaaaatagatagcaagtgagaatttgctcaacccagtgttgtgtgacaacctcaaggggtgggacgggatgggaaatgagagggggattgaagagggaggggatatgtatacctgcagctgattcgtattgatgtgtggtagaggccaacacaatattgtagagcaattgtcctccaataattgtattttgttctatacttaatattgtacaattataatctttggtaattaaaggaaaaaagaaaaagaaagaaccggaaggataaggatttagacaaggagaaacgagggaaatgatgtctgggttacaggaaaatgttagcataagaatttggggatgaagaaaaggagaaagggagaaataagcaaatagaattccatgagccaaggcaggaaggtagagatggggaaagaggtgttgccagtgaatgaaggagcatggagataaaccagggaggcagcatggagccctcttagggaggcgttggctctgccctaaaggttggaaggatgtgtatgtggttg

SEQ ID NO: 61035 - DNA, 1672 bp, Bovine  19866880586684
ataaaagagggttagacagtgagcagggttgagtggtctgtgtctatctaggccggcgctaagtgtgttgagggattcattccagtcgatgaaaagctgcgtttcaagttgcttcagattcacataacagttcacagcaaatgctccagaatgtggtccacggcatgtgggaagctctcacaggttaagtaaggagctgggttaattttgtcttcgtctggtgctcaatatttccctgtcttgactaagatgtccctcatgccagcattctgagccccaccaacatcatctccgcagtcatctccaatcataacggtctcctcaggttcacagccagtgccccgcaatgcctccatggctttctctaaatcctaatcctttgtttacttgataaccacacataaaagcataatatccccatcatttcatggtcagaaacaaagagtgtgagtgactctttgagctgaggaaggaattgacagattgggagacagaggttactcccctcagagaacaccacgtggaggagctgacccaaagactgtaacctcaaattcccaggacctgtcatcacacacaccaccacattccacacactgccttcatctcttaagtttacagcccagagttgttcaagaagttcaggaggcaacatcattgcccagtggagatgcctagcttcaagcaagcagccgcccctggctgggccttagagaccttttgtggatcggatgacagatgaggaagttaagtcctcctctaggtcccagtgctttgatcataagacagtctgtgactagcctggctaggatgttcaagctcaaaaccttcttgagtggttttcctaaaggtgcatctctgggagactcttagcgttactacctaatttaaggagttagtcattaatttctgaagccgccttggtgcatcaagcctctcttgattagcatcgtgcttcttcaacctgtcactctgcagccacttgagaatattagctcgttcctacctgcttctaggtttggatgtacaaatcttcaagcaggcacaggactcacctctctggcaaagcatccgttctttctgcaagcccttccaaaaggcactgtctgggtgctgtatcagagaaccacacagataagtcatttgttaattgccaggacatcatggtgcaggaggaaaggcaagctgctgacaaaggaccccataaaccatcagtcttaaatgctatggaagaatcaaccacttgctcactttgacgtgaaacaaagaactacttgtccaggcttggaagcacaagatggaattattttaagttttcaaacgagagttttagccccactttactctctagcttcatttcatgtgatgaattatttccaccaagtaatactcctcattttgcttactctgttccctagaaaatgcctggagcaccctctcccaccaagcaaataaattccagcctcttctggaagtctagttcaatatattctataaataacttctataaatttagtcatcactatttcagcacatactcttcttccctccctttaatttatatagcacttagtaaatgcaatataacactaaattataaaggttgcttatggctctctattttacagcaagaatataaaaccggatcaaaggtcctgggatacagtcccta

SEQ ID NO: 61036 - DNA, 1693 bp, Bovine  19866880761335
taaatcatatttaacgtttttgcttacttcatctgttctttagacattgccagattttcttctttgttaaaattattttaatttcactttatttgtgcctttattgtcagtttcatcaagactaagattttgaaggtgaaaaacaatcagtctagtctcttgctagttcaaatcaaataaaagagtatatgtacccagttcgtttctctacctcttccaaaaactgtccaaatatatctttcacatctttaaaaaaaaaaaaaaattaaatactttgagcatttattcaataatcagcgccttcctggtctggttgatggtgggatgtaatataacgcaagacaatcctcactgttcttaacatctgtctttatgtacagtcttgactttcatagctgagtggttctgattcacagattgctgcccctccaccattcccccagtatctctttagataattaagtagtctgtggacataagcaacccatgatcttgtctctcactctggtgcaacacgttgaggtttagacataacaaataactgcctattttctttccttcatgaactttgttttactgagccctttatattcctcagctgaatttctttcttgcttgcttctcttgacagcatgtatccctagtggttttgctgattgcccccttcctttccaaccatgttttatctgcatacatcagagtgtttctatcctttgaactttactaaagaccaaaaaggatggtgctgttcacacccagggtcctaacttttttcaccacgaaggttgatgttcagattagttaagtcacttataagtggttcagaaattctgtccagttaaatatgtgtggtgtatgtgtgtgacgatcaaatagcatgaatcatcacattttgtttaaattgtgtttaggattatgaacttttctagcagttgcagccaataatttccccataataccagcccagtttccaccttggagcatattgagttgttgtgtttagtacaatcaagagtaataacagtagagtgtggtgtccagaggttgtcagaattctgttgagttctttttaatatcttccatttcaaagtttttataaatattttgtctgttcagactaccttttgtgtgtggggatcgaggggcaaattttatcttgggagtggaattcctgtgttgggagcctcaaccaggaaatgtgagctatactggatacagatagcctcatgatcgcttttatgataagttgtctgatgtgttcacataatttttggggtaggaactgttttctcttggatattatagctaactttatatatagcataactgccttaagtctttttagtaggaaataaattacataatgtgtatgtatggatttatatatacatatacactcgtataaaaatcttaacagtaggggttgtctgcacacattttaacagtattcaatgattttatttgttagatctcagtaaaaaattcctaagttggcttgcagacatcttcctttcatggacagaccatcagggtaaattttttattctgccagggtcctaatttggtggttctgttagtatgccatttttaggcagcttgacaattaagaatcagaactgaaactgacataaaaaaaaaaaagcttcttgagtggtctctgtgaaaggtactacttcagattacataaaagatt

SEQ ID NO: 61037 - DNA, 1615 bp, Bovine  19866880847709
aaaagaatttctaaaaggcaagaacactaatgtctttcaatcccaagtggtgacatacaggtagcaaagaaacatcacatcactgagcattccatctgcatcagttggcttaaatagagaaggcaagagaggaaaaaaactagtaactttttaagcactaaagccaagtcaaacagaaaaaagtttccactacaaaaattgttgggaagcccagtacaaaatagccggttggaggaagtccttgggaaaatggtgaagggccagaaataccccagcttgatgtacccgggcagaaaaacatctcctgcctttggttatgcccggcaccaagatttaataataaatattaaggatgttgcttgagaaaacgggttatgggataagctcatgggtcacttagagcacgctgtccttgaaatatttttactgattaggtgttaaccccatacccactctgctgactgtatactctaagctctttgttaatacttctataaaaaggcttgactgcagaaataaacttgtcagtccttgcaagagactgtccaagtgtccttctttcaggttcgttgcttccaagtcccggggagaaaatctccaccaaaaatgacattcacactcggaagttttgctacttaaaccacaaaattaaaatgaaagagtgttctactagttttgcttcttacctctcatcacggttcttacagatcgaataaggttcattagctgagatttaattcctggctcttctccgaatcctccaattccctggtctgttccccagccaactgcataacataaagatgataagctgtgttaaaatttattaagcacttgccttgctccctcattagtcaccttctaaaacgtaactttgagtctctgttaaagacataaaatatagtcatatgatttaaaaattttagcgtgtattttttacttttgataagcagcacatttaatttcccttttaattttataaaataaactatagcctagtaaattattccatggcactgaattcagtaaagatgactgttgtgacaacctaactgttatctttctccttttttaaacaaagcatttttcaggtcagaactgaaaaccaaagcatattgtcaagttgaataataaattagttcaactcagaattcataaaaaccaatgtaattattagtataaaggtgttgcatctaagtttcactatgtgttcacctggggaaatattaatacaaacctgtccatagcttggataggtcttcatagcatggcaacagaggtatatatttttaacttgaccattcctcttcatttctcaattttgaggtgaggaatttagcctactatctaatcccacttatttttagtaaatgggtcttttaccttcttctgtcattttcctgataatataaatcattacttctttacctttatttgttcatctttttttttattgccttacacattcttctagaggctcacacatcctcatttctgcaatgtccttctcttgtccttatttcaggtccacttttcatatctcttatgactaggtatttttttaatctcctatgactacagggcttaattaattcctgacacactaaccatttaa

SEQ ID NO: 61038 - DNA, 1994 bp, Bovine  19866880893519
attctaaacatacaattcatgagttttagtatgtttacaatgttgagcaaacatcagcacaatccagttttaaaacttttctggaagggatagctagggagtctgggatcgacatgtccacactgctatatttaaaatggataaccaacaaggtcctactgtacagcacagggacctttgctgaacgggaggggagtttgggggagaatggatacatatatatacagctgagcccctttgctgtccacctgaatctatcacaacactggtaagtgactgtggtccaatatacaataaaaagttaaaaaactttcccgtaattccccaaaggtccttttgcccacttatagttattcagcatttcacttttagccccagactatcatctataaatttgctatttctggacatttcatataaataggatcatataatatgtggtattttgcatctggtttctttcatttagcatactgtttttgagattcatccatgtttccaggatcaaaccttaagatttattggaccacataagtagcatgaattcagaccaaaatcctgtgtgagatccggcttgtagacatagattctgatggaagaaatttttttccatccaacactagggctgaaatagacaggtttacttgttgacctttcctgagtggcaggtttatttaccgtttgcccttttacagagtatccaatcccaccttcacgttagagtcgcacatgtagacttcttaccttatctccagcaaagccctcaaaattaaaattcagggtcttcagatttcagaagagactctcagggcgagtctagccttggaacccatttagctgccagagttcttgctgtcacattatctttgttatctgtgtatttctttgattttgatactttagtggtagatttaaaatataatttttatattttatccagaattttttatttacatggaaagggaacttcagagccttttttttccctgccatactaagcagaaataaaaggttgggaagggctgcttataagagtcatctgctcaccttttcagatctcagataggtggataatgagaggaaattatttactttctgagcagaagaccaccacagtccctgcctgccaccccctcctcatcctcacttacctgcatagcaatggggagtcgcattcatgggtccattgtgtttagcgatgatctgcagtcccatctgcatgtacttccctcaaggacctttgctaattcttttgccctcctggtcagtaaaaacaattgtttcttagaatggattgggaattgccagtgtctctgatatgcttagctcatgtcaatattgataactgaggtggaaaaggcaggaattagagatggggaaactgaggccagagaggtgaggtggcttccccagtctcatagagaactggaatttgagtccagtgtgcagactctctgggacaatactctttcctccatgccactcttcctcttgttggtgactaagggaaatggagtgggagggtgtagcattgatacagtaattgatataagaagtaatgtttttggagattctgtgggttttcttcatctttgatttcttggtctcattgtcccttgttatatgagagtagtggttgacaacaaacaaaaattctgctgcttaatatttctgtttttaaacattatgaatcatttcacaaggaatttttgacttctcagcatgttagagctgcccacctggtttgaccttttaactggagaaggagggagcccagagtttcaaacccagtccatcaacccctcttcaatgaaattcttaccctattttgagggaaggataacgttattaatgtcctttctagcaatttgaaaaaacagacaagcatggcttagagggaaatccttggtgattgaaaatatcattagaaacaggctcctggtgttcacgctgtcatttccaagtgttctgatgagtttcagttgagcactgcc

SEQ ID NO: 61039 - DNA, 1373 bp, Bovine  19866880929237
cacaggtacgtggctattttctagaagtaaggtgctgtctcatctttaagttctgtgtgtcttcctcattttattcccagatagaggatgtcctccaccctacactgaaagaatagaccagaaggattctgtagcctcttttagatccagtgcagatgatttaaacatggtcgtctggacactgatgtccctttttgtcatgtcggcatttgcttgaggactgtatggtttagggcaatgaaaacaaaaccccagcgtgtcgcaggtactttttagaagatcaacattactttcatttctttagagatggaaagagctgttggaagacagtaaatgacagaagacttttttcttgttgggaagacctattatctatcttgaaaataacatgaaaatgagtattggtgaggctaatagctcatgtatagataatgaaatgcttctgaaagccatcaatccagataatgatcaatataatgcaaagacccagtataggttagcagtcaaggaggctggctggagggaagatctaaagttagggccctgtgttttgtagtgacattgacttagaagtctgtaagtgggggaagtaattataaaccaagggagatcattgtcctgtttacaaggcacttgttaagccacagactttaacatttcatgtagggaccaggaaaccaaaaggaacgtcaattaaaaatagccagggctgaatcacagagctggaaggggtccgagagagcaagagaggtttcatctgcactctcttccagttcagggttcatagctctagatccgtggctggttgatggatctgggttttgacagaaaaaagcagagactcctaatcactgggccacaggactgttactgacatgacttgattttaatgctagttctagcttggagccacactctcctgggatattgggcacagtgtctttagtttaaggtaaacgggcagggtttgactgaagtgttccattctggtgtcccagaaagtgaaagcaaaagtgttagttgctcagttgtgtccagttctttacaaccccatggactgtagcccattaggctcctctgtccatggaattctccaggcaagaatactggagtgggtggccattccctccttcaggggtcttcctgacccgaggatcgaacccaggtctcctgcactgcaggcagattctttaccgtctgagccatgtcccagggaccacagcaaaatcgtgtcaagttcatgaaaacttaatgaaatggtaactataaagcagcccacactggagctgccaccgagtctgtggtctcccaacacgtttaatatcttctgaggcctttgggttctttgtgtggaaatgcttgggaagcttggg

SEQ ID NO: 61040 - DNA, 1657 bp, Bovine  19866880933341
ctttcttttctcttgatcggcttggaaatcaccaagattggcatggacaaaaacctctgaaaattattatgtaacttgtaaattacctagttggctctagagtatcaaaagtattgagattttgccaaaaaggataatttcctagtttgtgccaagagagagttagcctgagctggggcggtaaagtggatctacatctcaaaaagagaaagatgtgaaaaaggatatataacttagaaacaagtgactgcattgtcaaaatgcaaggcaatggatcaatacttggaagaggacccactttagtcaaagcctatctcttggagaatcttaaggcagcttccacagatgttcagacttagataaactcctctgatgtgttacacatttagtcacaaaatcaaaatcctctagggacccagggatattttctaaaaataaagtgtttgatcaaccttttaaaaatatgtaaaacatattttaaaaaactttccaggttcagagagtacaaatctgggcaagttcccatcctagttaatcccagagcacctccaagaaaagaccgtatatctctaagagctgtgtccttgctgaagagggaacacttctacagcaatggtaaaaacctgtcactgctcctttccctgcaaggaagcacagcgctcagaccatcagagagttgtaaactgcttttttacaagtccacagtgaacgaaacattagtactaaatctagtggactaacatgatgttaattgaggctttgaatgaagaactttaagaccggttccccttgcctgtgtgtgactgcagcgttctggaaaaacagtagagggcacctaaagaccagcacattttaaaagcatttttttttttcttaatctatgcgccccttggtagcgctccagcaagttcaaaggatgtgaatctgagtccagtcatttattgtgtgttttctgttgcagcttcacaatgttcttcaagaactatgactaatgtcttcaataactacggcttcaaatatgatatgccttgaataaacctaatggtagtagcctctacacatatgtacttgcttaaaaaaagtgttgccaaattagcaatggaaaaaaaaagttatcaagacattatagtaatctcagctcatgttgtaaattatattatatcctaatccttggaaaaactttaatcaaaaggttacatactcttatagatgtagaaagaaacttatgcttaccaggggctaaaaatggggagggataaattgggagattgggattgacatatacacactactatatataaaattctgtcctttattgagcccatctttgcgtgaaatattcccttggtatctctaattttttggaagagatctctagtctttcccattctgttgttttcctctatttctttgcattgatcgctgaagaaggctttcttgtctcttcttgctattctttggaactctgcattcagatgcttatatctttccttttctcctttgctttttgcttctcttcttttcacagctatttgtaaggcctcctcagacagctagtttgcttttttgcatttcttttctatggggatggtcttgatccctgtctcctgtacaatgtcaggaacctccaaccctagttcatcaggcactctatcta

SEQ ID NO: 61041 - DNA, 1319 bp, Bovine  19866881032216
tttctgtatgacttgaatgagccatacctatgattcacttttttcttgtaaaaaatgatcctgttctctgtgaaagacacaagtgtttcactgagtcacagggatgacatttgtataatgttaaacggagtttgggaaaaaagaatgtaaagtaatattgaattggtgttaacatcatgacatttttatttgtggtgtagatttcacacacattacactgtaacatctgtgtaggaactggggcgcattaatgactgaaggtaagaaagaccatcaggaataattccggtgttaaaaacagttccagatgaaaggataatttgcacaacatgttgcaatatttttcaaatcacttccattgtacttgtgagctcatgataaagcgaatgcacagaacagtacaatgtctaaccaacaagggcttgttttaggaggtagttgaaaataaataacctacagtttacacagctggcagctaaacaaatagaattcattgccccaaagggagctatgcctaggttgaagaaaggtttcgatgaatccgtggataatggatctgtaaggagttatcaagggaaaattaagagttattcagtgtatacacctaaattttgaggttggtcttgttaaaaacacaatttggctcttctaatggaactgcatagttagtcccttggtatgggtggacttttattttaatttgacatggaatctctggtgtcctaatgcaggacaaacaagatttgtagggcagtgatatgtggcagtacttgcccagcttattaagtggactgcctgtggttttgaaaagcttcctcctcctaatagtcacactggaatccactgggtggcaagaacacagcacactaccttaaggtcactcttgcgtaagacattaatgcatcagtccctaatttggaaacctgtggtcactcagcaagacagaatttgtctctctcccttggtgtaatgatttttattttgtcatctctcctggggtaattccttgcaggcttggcatgttgagaatcaaatactgcctctaacaatatggttgtgattctctgcttggctgatttagctcagcatttaagtaaccactaatcttctgaaagcaccagggtctacttagagaaatccctgttgtctgcaaggatggaaacaaaaccagcatggaggaagcattacttactaaacacaaatcaatctttttttttcccacctcgctgtacactatgccaccatcaaaggcgtggtttctgggtggtaggtcttcattttgtaggtggagaccagctcatgtgcgacaagtagagaag

SEQ ID NO: 61042 - DNA, 1358 bp, Bovine  19866881033141
taaattgctgctccctagatggaaacacaagaataagggctcaacaatcgacctaatggtgatcaatgctcttgaaacgctaatagaccttctttcaagacaatgcataatgcagcattcttaatggttaatgcagcaacaggcaaggctaaagaaggttgggggaaaacatctttaatgtgcaattcagcccctgaagcccatacacaaaatctgacttaaatgtatcgttaaaaagtattatttaatatttatatgtgccgcaaatagatccagccccacatagtgtaccagagaaataaaagcccgagccctaaggagtttatcacctgggggcaaagttgatccaaaacagaacagaagaggagaaaggagttgggtgcagaaggaagatttccaccaaagaacgagtggcagtgtagggagccacgaggaacagaggcgaggcgccacctgctggcgaaagctaaaattttaaacaattttctctcccagagccccttggctgtcatcctcaccgtacctgactggtgattttcaagggcgttgaagatcttcctcacaggccgcatagctgcttccctgcagactagcttaatgtccgagccagagtagccttcggtctcctgaaacacccgcagacggagccattaggcagcaggcagaacgcggcgctggttacatcctcacaggcaggaccaggtgtcagagcccctgtttggattccgtgtctgtcacccatggacactatataaaaggttcccggataaacagtgtctggggggagggaggctggataacctaaggagctgggcaacgaacggcttcctaataccatccaagcaaaggtggggagatgctggtgaaggactggcccgcccaagtcagcctaatggggcctttgtgcccagatcccaggatgatcaaattcggtggacacttttattcttgtaaataagattataacctgtctctaaggaacctcagagaacaccacattcaagagtcctttcaagcaatgacacccgtggctgtgggataacagacaggtgacctaaagctttactgtttgtgaaagatgtgcatttaatcatcacagtaaccctctgtggcctgttacccattttacagatgaagaagctggggctcagagaggacgtgatgtccccgagggcacacagctaatataagcgacagggccaggatctgaccagaggccctgagtctaagcagaggccctgagtctaagccctatgctatttccacttcatcgcatctctttctgctggaatgcttgcaagggacaaagagctcactccttcatgggaggagaggcctgtcgggttgtttgggggtag

SEQ ID NO: 61043 - DNA, 943 bp, Bovine  19866881081131
cgtgggcagcgcatttaactctcacaacacgcctgcgtggtgggcaccgtggttatctctatggagaagggagcagaggcaggaggggctaggggaggggctagggtcctggaggggcgagctggcagtgctggccaggctctgcgcccctgccactgcccctccttcccgtccgggtggtgtcccagcactgctgtctttggcactctgccacatgcgaggactaagtccagcatctgcacagtaagaacagcgagcggccaacggccaggaggaggggagtggccatttagctttgccccctcccacctaagaccaagctgctctctaaacaagcatcaaaacccgaagctcatccacaccgctgtgtgcttcagtacggggagcaccaagatgatgggcaattacgtgctgataacccaaggcccaagagcccagtaaaacaactgccgaggcccaggatcctccgagtatgcaaatgcacaggacaatcatcacctcctcagtccccttcattgtggtgggtttaacatgagaagaatcatccacgctacaaggcgagatttcattttacagccgcggtaaccaagtacataaaagcctgaatctgtcccagtagtttctgaaggatttttcccacagtgtcagaggcaaaaataatgaaatcttgcaaatgtacagttaatgggacccgggtggacactaacctcaaaaatgcatggtctgtaagacattaaaggcttgattttagtttctgcactgttcctgttaataacaatgtctaattaaaacatctgtgaaatactgatagttttaattttacataaaatttccaaaacaactgttacacagtataataggtatctgcaatgaataggttattaatggaaatattattttaaattaaaatcaggttctaaatttaaattagttatctctggtt

SEQ ID NO: 61044 - DNA, 1233 bp, Bovine  19866881112792
ctcctccaggggatcttccagactcagggatcaaacttgcgtctcttgagtctcttgctttggtattggcgagcaggttctttaccactagctccacctgggaagccccagtatatacaatagatacctaataaatatctgtttgatttaactttaagctctttaactctgtaatgggggaggaggaataaagctataggtaggaggcgttataaagtgtaataaagcgtttggcccttgatgttattgaaaatgtccttttcaggagtgagggcatttcctgccaagtgcaaactttgtgttgaaataagtcctccttcagggttagaaatgctcctggaatgatgctggataggctttggggtgattgaggtccttcaagatgaacagtgggcttagtcttggggttagtggaccaaaagggagatactatgcacagttctgcttcaaagaatgtaatttaaactttttttttggtctttttttctttgtagtctgaggaattttaaaaatctgggtgacctcttgcagaaaatatttgatgttaaagtaccccaagaaccacacgacttggttcccatccctggctcctatctggggtccccttgggagtctaaattattcccccaccacacttctgaccaccctaagggcccagatcccaggatcacgcttcctgaccctctgtaggaggggagtcagggcgccttcagccctaggtgatatggctgtgtctagatgtgcttaacaaattgcctgttcactcaattacattttatttaatcatctgtaatcatataaattatgcctgatggtagtaaatgttcatgtcagttcctaattacagattgattaattggctgggggtgatctgtattactacttatataagaatatatgaagatgatgataaattagggctggtgatgctgagcccaggaaaatggaacacttccaattgtatcccactttttggggttggggaagccattccccttcctagttgtattcatatcagatgcctccaggagggtttgtgttctactgattggttgattttggtaacatctgagtctagaaataacttattattatttagttagtgtatatgtgcatgtaaaattttgccatgcagtgcttttctttttggctgttggcagaaatgaataatgacgagctcattaagttcagttgagctcattacagcctgctgggcctagaaagttcccaagg

SEQ ID NO: 61045 - DNA, 1381 bp, Bovine  19866881132630
ctctctccctctgtacagcactaggacgggcctggcgttccaggaattgcttgcaagtggtcctccaagcctggagccggcctctgctgtccccatgcagagcgcataatgggtcctcccagggacaatttgcataaaggataaataagagaaacacaatgtgaagtttattcatttttaaatcctgcagcgtttgtgattgaaggcccaagctcagatgtttgccggatgcgtcccattaaggctcagggctttgtctaatgtctgctctgttcctgcagggggggtgtaatgtgcaccccttcccgcactggagggtcgtttccagagcctcccgcccaacaagggatggaggagcggcgggctgcgttcccttcttccaggccccctcactttaatttgctgtaacagagccagcgcattaaatacaaaacatattgatgttcctgagaaccctggagggtctttacccttcctcgtcagaggagcctggcatgccgggagggggaagagagggtgtttggcacagatgcggggtggtgcctccggcaggtcacaacagatcttctgctgagagctgtgccctcccagagggcgggggtgggccggggagcagaggtgccatcatacgtgtggagagggagcatgtggacaggccactgtggacacagcagtggtctgtggactaatgacaaggcaggaaggaagagaggaggaagaggagggagaagggggtaataaggagaggggagggtgggcagaacgctactcagcaatagtgtttgacggtgcctcgtcactcccaggtcagcgttgtccagcaagttcccaagatggtacaagagttcgaggaagctggacgggactctcacttttggcatctctctgttcaaaatgccctggagctccaggaatttggcagggtagatctggctgtcatcttgtacatatttcgttataacaagtgatgcaagaagaattgaggcatctcctccagcaaattcactatttccctaacagtgtgtcccccagggctggaggctcagaaccaacagagggagcaatagagccagcactctggcaggacggggcaggaccaacagccagaccccaacgggcatgtattctttgctcaagttggccaagagcctccaagctcgggggtgacaacttcccttttcctctgaaatgattaaccgttaaacaagtctgtcttctcttggtccatgcaaccctcctaacagttacaaccacatctgtggtggctgcctatgctcctgggcatgagttgcttctaattcttatgactccagaagttactgttaccaggacaccgagacagtttaaataaatttcagaaggtcccaaatctaagaactga

SEQ ID NO: 61046 - DNA, 591 bp, Bovine  19866881146778
gatgagtgcttcctgaaggtgctgagacttcgctggatctcaaaggatgcaaaagaccaggatgatatatgagttgggggttagagaggttacagggcaaaaggctggttagggcaggggtgctggaggcccggcatccccttccttatctccccttccctccagcacaggggtcctttggtagtaaaagaaacacagcgtgcataagactgaaaggagccgctgccgcctttcatatactttcccgtttcaggtttgcatcttattttcctgcaaatgttttttccttccctttgcccctccagcttttgtgggtgtaacctcaatttctcactgcctttcaaagcttttatttcccaagtggaaggaaagaacttttaatgtcatatctggtccttagccaggccagttgtctctccaaatcagtccagggctcagggcagcaggggagagtgggaggctcggccgagagcgggagagagtcaatagcgagaaggaaaacagcaagtgcagcggatgaaggtccccgaggagatttgcaaatctgctgaaatcctgaacaagctttgatttaacccaagcttgaaatgg

SEQ ID NO: 61047 - DNA, 908 bp, Bovine  19866881242902
cagaaaaagtccaattgcatgaagttagttgactagacctctgcaagtaaaacctacaaacaagtgcttaacccagtacctgtgttgcttcttcatagtcctcattttatctacatttatgtctaaagatgtaagaggaaagacatgttctgtgttccccactcaaggaaagtgtgttaggagaaaaccatgtggttttcctattacttagaaaaaggaaaaatattccatttggtgtaacaggttcaaattgtttctaacgtctgcaggcatccttcttgatatactttggtttcccttcccccaaccctatctttcctgactatatgaggttgatttaacaaaggttaataaggtaatgtttggaaaaagagctcttttctttaataagctatgtaaataaccacagacataggaaaaatcccttgggagatattaattagttctcagaactcctaagaggtttccttcctttaacattaagtaacaaagaaggaaaaatcttggccacaacagacgggtgttccatcttctgcaacagaaatttttattcttaattctcaaaagcctaggctaatggatccttgtagctactccagaaccaaaatgatttgatatcatagtctcagatatctgaagacttaaaaactaatcattttgaggtgccacaaacatgctgtataagaaggcaaattaaatagatgaatgttgcaagtcttctgactgctcctctgactagtcatttccccaactctctccctctccttgggcctttctattccctgagacacagcaacattgaaatgaagccaattaataagcctataatggcctctaaagtaaaaggcaagcgttgcacatctctcattttaaaatcaaaagccagcgatgaagtttattgaggaagg

SEQ ID NO: 61048 - DNA, 1270 bp, Bovine  19866881275847
ggctgtggtggtcagaggcaggcctgagggctgagttcagtcctgttttgttataatttagaccccgacctcactgagtgcagtgtcttcatctgtaaaatgggatgaaaaaatgtcactgcttctacccaacgtggctattatgaatctcagatggaacaaaacatcttttgtcaaatactataaaacgcagtttctagaaaagacaccagctgtgctcatccagtttcccaggtggaagggagcttccaaatggctacttgtaagctgagcttctctcccctgacatctcccctggcatgccccgatcaatcaacccacaaacatttattgaactttgtaagatattatggatgatctttactcccctcttctgatctcacttacaggaattcagtaacaacaaggcaagggaaaatattggcttttcccagtgaagtgacaaaacaactctaatgtaaaaccaattccttaggcaggaatatcttttgtcttgtggttccaggaatctggcttatttgtccgcaaactctagtccactgtgggcttccctaacattctctctgtgattccttttctttccgagtcattgtacttgtagcttccttaaaaagcatggaaataggaatgtaatttcttgtgaaactagacaacaaaacaaattttaaaatgaaaataaaatataaacagaaagtaacaaaattcagacaacacgtcctagctgaaggtgaccctcacctgtcttgtgctgctcagtgggtgcaggctagcagtttccatggccttttgttttgttctttccctgggccagtgaagtctctggttttgccttgtagtttgggccttccagttctaagtgagtgggacactcagactgaggttaggaatggaattggtctggaatagctgctggggccagaggattctctgtgcttcctggaccattttggacttagttcccaggcccacagcctaacaaggaaggatatctatctagccctccaagactcttctgctgcacccagaactatgagccctgaaggagacacctcttcctctatatgactggggctcttcaccacctctaatgatcgctgtctctttctgttttgaaatctctgccaattcctgtttctggtctgagaggtctcttgttaagagttcattggctaagcaggtacttgacagacacgagactaaacattttctgtttgaggtacaccagccattcatctcccaaggctcacctctctgctttatcacttaggca

SEQ ID NO: 61049 - DNA, 2470 bp, Bovine  19866881302138
ctttcccgtgtgtctgcagaaaatttgtgggcttattaataggctcattctgctggtaaatgtcgatgggcttccgaccatcaaacacacttacaggaggggaaaagtgaggaccaaaaaaacccccggtctgttacccaggagccgtgcctctctggctcatcactgactccagctcgtccaggaagatggtggagggggcgtgatagcgggcaagttcaaataacacctgggtgggagaaaaccaacatgttcaaatccatatacttaaagttctcagatggccccagagattaaaagattaggatggctgtaatattaagcatctatgctgcactttagctcacaacaaccttaaaatcattagttatttctccctagcactaccccatggggttggatggtccaattatttgcatctatcagctgataaaatgagagtcagagagagtaagtggtgagctcaaggttactaattataagtgggagagcttaaggtaaaactcagttcctgaacttccagtcagctagttaacccttgagaccccctgccaatgacgtgttctatatggacacaaagccgtagaaaatataaaatcatgtaacaattttttttgcttaacatttagggacaataagaaggttattctcggaagaaagaactgcagaaaaaaaatagagttccagttgtgagtaacagggctgaagaattctgcccttttctgctccccaaattactccccaggaccccccacactgctgtttggtaggctcaggtacttcgaggcaattcccgattgaataaaatgttccactccagagtaaaatattatagactgaacaggaacggtaaaacaaccagcaaaagaacagacgtacaaaaacaaactcaagagctctagagggagatgtggtggtgaggaaaggagtataagaaactataccttttttcaaaaaaccctgaaactgatcgcttgagcaccatatacagtttttccctggttgatcagagaaagcattagagatttagaaaagaatagatgttcttaaataggcataggggatttattctccatgtcaattagcactagcaaaccatcacagagtaaagaagaggggaagggctcagaagaggccagactgtggttttcgtagtagtagccagtcgtcttttcaggcctcgctgtcactgaatgggcacagcctcaccttcaccactgctgtgtgtgtggtccctgcctgtttatgtgtgtgcgtgctaagttgcttcagttgtgtccaactctttgcaacgctatggaccatagcctgccaggctcctctgtccatgggattctccaggcaagaatactggagtgggtcgccattcccttctccaggggatcttcccaacccagggattgaacccacgtctcttatgtctcctgcacggacagatgggttctttaccgctagcgccccttccatgctcatatgcactagtgttttcctttcacagaatcctattttatgtggccaggacaactggctcagcccaaggagcttccaagaacagtgtcaatgctgggacactcatcacaaatgctctttagacagacaacagagaccacctcattagaggcaggtaatctctcttcctgtcacaaatagaaaagttcaaatagacctgatactaaggataattacagcagcagcaacctacccaataaaaaatggactcttttggaaccatacacattttaaggactccccaaattgcagagaggccatcaggttcaataagaccaaacatcccattggaaggagaaccacatttgaagcccatgtctccacgtggaccactactctcccatggccagagaacatgaggaatcctgggtaagcactcgggaagcattagtctaaaatttttcagaagtacttggaggaagttaaatcatgcaatggggtggggcatggcggtgaaacattgaaagatgtaagcaccaacaggtgtgtgcatttgctaacgagaccactcaactactcaatagcatcaactcctcagaggcctaaacattaggagggaagggagcaacaaaagggttccctataaataactccttaattggagtagaaagagaagcaaatggtaggaaagcatctctgctttaggtgaaggtcttgaggggctttctttatctgaaagcttcacaatgagaatcttgagagcatgaccaagatttgctaggtgtggttctttccaggagctcagaaaatagaggaatttcagaaagcacagacgataggttccttccaggttgcgtgattgtgtgcacacctagttgttgggtcatgtccgactcttcgtgaccctatggaccatagcccgccaggctcctctgtccaaggaattttccaggcaagaatactgggatgtgtagccctttccttctccaggatcttctccacccagggatcgaaccagggt

SEQ ID NO: 61050 - DNA, 1652 bp, Bovine  19866881405108
cttgatgtggcattttaaaagtgctatgcaagtgttagaaattatcattgagaacattaagttagatggtacatgaaaagttcttagaatggtgaatggtacatgttaaacattcaaaaaaaatttgctaaggtacctggacctaagggtggaacttcaataaatgttacttctctttcttcccatccctagtgtatagaatggggaacccctttcctttcacttagccagcatgcacagagagcctggccaggtaggcaggtggagagatgctcttttggttaaaaaacaactaaggagccaagtaaaaatcctaccataagcgttcttatttttggtcaatatgctgctaggaagcaaaaggaaatagaaggctagattaaagcagcatttataaatactttaataatgatgaataaatgattcatcacagttgcttggcaaagtaaattattccaagatgcacagagacccgctggaatgattgtaaactagttaatagatgatattgcaacttgtgaagaagcactttagagcagcagctcaagcaattatttatgcctccgcacattctagcataatttaagaaaaagggaaatttacttatcagctcttagtaaagtactcatgatatttcagtgtgaaatgttgccaaaattatttagtgacttattgattcagttaagattttgtgttacgcttggtattctttcttactaaaaccaggtggcaaagttaactaagacagcatggcctttgatttaaacagctgtcttttctggaagagtctcgagatctcaggaaaaattgcagggggctggggtaagggttggggggttggaggaagccctggcaggctgcacttcaggggatcagatggtcggcctcaatgtccttcataaactatatggatctagggatggtgagagttcaaaggaacttcatacttcttctcacaacaaccctatgggatagatacaattgttaatcacattttacagatgagaatactgagtcctagagattaaggaatgggcccaagcaacagagttagggcttaaatcgcagactgtgaatcaaaggcattgctctcggtggctgtgctgcctgtcctacccctggggtctttcctgctccgatctgacagcagtgtcctagagttgccgtctctccgtgaaagggttggtgggagacatcccaaagcaggggggtaagaactgaggtcaaggcagctctctccagcccccagcacagaggtttgcccagagaggaaataagggcagaatcagacacggaatttcatctggagatgcgtgtcacagatacctgtcagccacccccagccttgagcagaagggaagtcagtgcttgggtctgcagctcctgtagcccctgccccgcattgggtttcatttccccctcggtggagtcctgcccttccttcgtatgaccactgcgctgccatgctgtctcctgattcaagaaaacaccttctactagtgagtctgcatctcagcagactttgtagaaaatcagagaggttgactgaaccaagtcattcacttccactccttcattttacagagaaggaaactgaagccagagaagagaagtgtatccccgattttacacagaggtcagcagcacacggg

SEQ ID NO: 61051 - DNA, 2302 bp, Bovine  19866881469734
ttcccagcttcagggtcatttctaacgagttgtaccaggtggccaaagtattggagcttcagcatcagtccttccaaagaatattcagggttgatttcctttaggggcttccctgctggctcagacagaaaagaatctgcttgcaatgccagagacccgggtttgatccctgggttgggaagattgcatggagaagggtatggctacccactccagtagtcttgcctagagaattccacagacagcggagtctggtgggctacagtccatggggtcacaaagttggacacaactgagcgactcagctagctagtgacaagctaactgcacttcctgtgtagaaagctgtgaaataaaagttgggcagggagacggtccacttattttaataacaagatgccctccaccttccctgtctggacaggactcttctccaaaaaccttcactttgagcccctctgtaatatgcctctgtccaaccacactctcctatcttggcttccattcagccaggctcatctcccactgccaccagcatggctcccacactgtcaggaatgccttcttcagcccactgtgctaatgcgaagtctttccttcaaagacaggtgagaggcaacttctttgaagtttcctctgagcaccacagccacaagagtgactgtgacctcccaggcaagttcagtcaccagacgtgcactgagaggcataaggagaagtctctcaagggaattccagagccccagtcttcaccccagccctgcttcatgactgcaaacagatcatttccctctccaagtctcaagttcatctgctcaaaaatactttgcatgtttcaaaaattaaataaaattacacatcatagcatattagggactcagataaaggaaatatatacttaagatacattctttggttcaccaatatgtagtacaggtttttgtcctaaaattggttcctatttatattggctttgtcatcacaactagatggtaaggaaatacaattaaactccatgacaccaggaattttgccccttttattccctaaacaacccccccgtgcctcatacaatgcctggcagacagcaggcactcggcaaatgtttgttgaataaatcagcaaacttttcttatatcccctaaagagttcagatcccacagtaataacaggaagtcttctgtttgcataaggaattacattattcaaagcattttcacatataaaaaatgtgcttgatactcagacaatgctgtgcaggaggaagatggggtactattatctgtccccaagtcctaggtgaggaaactgggatgcagaagccagttttcaaggtgacaaaactaggaagtggcgaaacagggattaaagccatctcccaaatccaggttgagtccacttttcgactgccacatccagtaagtgctcctggaaggactgattaatttggattctaattttgatcaacttggtgaagcatttgatgactgtgacgagttccctgacttccagaaaaaagacatctctgagtgtggtggccagataaaggggagctggggcagtgggagggaagtgaattagagaaactgttccttcagcaagacaaatttgtccggggaaaccatgcctggctggggaagccaattggaaaagaatgatagagggccggctcctgaggttcatcaaagtcatttgttgcaggtaagctcatttttcacaggccaaggggatatttacctggagtacacctttaaggaatagccgacagattgaatggtacgatgctttattatatttcacaccctggtgattcaatatgatggaggcagaggaggggggacagcgttctggagggagagcaaaggagaaaggcggaagaaagagatattaaaatgtccagcaaaggggtgtcctccttctcgggtgcctggggcagaaatcgactgcagtggaaagtgtacaaacggcacgccctgtggatgacactgatcagagagcgggtggcccacagcagttgacctcacccctctctcctgaccgctccctcagtgcctggtcaccccgagaccattttccaaaaggtcttcacacaattcttggaaacccaaagggctgtgttctgtcctggttctgccactactatagccaggcaaactgaggcagcacatttaaccttggcaacacggttgactgtctgtacagagaccaattccctaatgatttctaggctcccttccagccctacattttatgattccaagttagccccagagatcttttttttttatttttttaattttct

SEQ ID NO: 61052 - DNA, 999 bp, Bovine  19866881538248
gctagcttgttatctcaaagcccaaggagtgagaaggaagagttcctctcttccttgtgacaagagcaaccgtgcctcgctgattcagtcaagtcacatttatagtacctctagtacgttccaagccctaaggacattgtaatgagtgtaaaacaccccctgctcttaatttgcttccagtctgctgggggtatacaacaaaaaatgggctcctagcgtgatgtaatagtgggagacatataatgatgaggcaggtacaaggtggagatggaagaaggtaaaaccagcagtcactgtagcctgcagtgtggtgggggagccaaggaaggtgtccccaaaaggggggtttctaagttagtgtctgagggactaggccattcatggataagaagttggcagaggagtaggcaggaagatgagagtagaaagactcctgctagatcaggaattgggaggtccagggcttcggttatacttttgtctctattagccgtgtgaccttagcaaaatgtctttctgtaggctttaaacgtcctcatccatgcaatgagagtggcccatgacctctcttccagctcaaaacctctctgattgtcagaagaagtttcttctgaaagggatttatatggaggtgcttaaggaatgcatatgtttagttaatttagtagtttagcttcctgtgtacaaattacggctacctccagagagagagggttctattcaaagcctggcattcgttttgatcacgctcagaaatactgcaggaaatcatcaacatcgcgcacgaaacctcctctcactcacaccccagacagatgacaaagtgatatgcagaactaattccctggggcaatatttcttcccaaagcatagatatgggtgaattattgccattcttaattgcctaatgatttttttccctatcatgtaatctttttcggggggttgtatttttaccatcttgcaaattcatattggcagagtgatatacattgtcga

SEQ ID NO: 61053 - DNA, 1695 bp, Bovine  19866881546801
aacactggagtggattgcctttccttttccatgcatgaaagtgaaaagtgaaattgaagtccctcagtgtccaactcctagcaactccatggactgcagcctaccaggctcctccatccatgggattttccaggcaagagtactggagtggggtgccattgccttctccgtaaaagtgatgaagaagccactaaaataaaggcatgatctaagaacagtcatgcatggtcatttgtagacaaattttccaaggaatggggaaaggagaatgtgactgaatgtaggtagaagtgctccaaagatgaatttggagatactcaaaaggaatggaggaaggaaatgtaggtgggctttggaaatggaagattacatggatttgtgggaaggatggccaaaccacacttacctgaacagagtcagaaactctcgggcagtaagctgaggggtcccagccctgttgtcacaaaacatgctgtccacaggagccctcctccactcctttgccggttcactcttaagtacacgtctaggacatgttaagtacacatgtagtacatgtcaagtaccctgtatcttaaatacaccttaagtacacatacagtgcacctgcttttcaggtggaggttccacccacttgagattttatgaaatcagaaaggatggcaaaagccacaagcgaacgccctaacagctgtaagaaatgtcagctgacagccgggcaaagaaaacaacccagaagcacagaaggcagctcttggaaattgagcagtacagcagtgaggccgttgaacttggagacctctgtatcccagctgtcagcagtgccgctcagggcctatctagtgaccatgaagaagtttcagctgcgcttctgctaagatgaaatgtcttcttggttcttttaaagtcgttttataagcgtatattttcaatttgattacattttccatgaaatgatgtcttaagaggcatttgagaatattctattcaaaatgatcaataccccaacgtgtttttttttttttaaagggtgagatcctttggactatttagccaaaatgtcctttttttcctggaagtgttttctgaatgagtctgacttgtagggatgaagaaaagaaggcaagggagacgacagaaggtggccaccatgggaaaattccaggtgggggtagggacagcattacttagtgaaagccttcaaaatgtaccaggatctgcaagctgatgcctcagattgtgggtttctaaatgagatgtttccagctgtttccaaccccataagaagattaaggaggagcctaagagcagggaggactgttccagaagctcagatatcccaccctaagctttggatccaacaaggagccgtggcaatggaaagagaagggctgaacacacagggtgtgagatgtgaagacgttaacaggggccagaactcaaaacgctgcaactggtgggtggggaaagtggttgcttatccccactgctatcagctcgtctccagagatggccttccctggtcgctcagatggtaaaaatctgcctgcaatgcgggggacctgggtttgatccctgggttgggaagatcccctggagaagggaacggcaactcactccagtattcaggcctggagaattccatggactgactacatggggttgcaaagagtactttcactctgagatgggcca

SEQ ID NO: 61054 - DNA, 749 bp, Bovine  19866881606510
taattcttttcttaaatggcttactgaaatctgtactcaataacagcttatatgaaaataagatatcagaaaaatttcatacaatgtaaagaatcaaaaaactaggtagataagattgataatagatttatcacatgcaacctgctcacccacccattaactgtataccccaacaaggagtagaagaggcttcctttaccaaggcactgggaaataccacaaagggaagagccagcacctttgaagggagctgcaatggctcttatgctttatgctgagtgagtgctatagctgaaacgggatccttgatttcactggggatactaatatccccaggggaagagaccaaggagcgacactttaaaagcctccagaggcaagttggtacatgtattatttaatgttcttaattgcaacataatccatgctggttggcttaaacagaaaagggattttataaaaggatattaggtacccatgcaggatgcagagcctggggctgtggggaggctttagtgaggcaccactgctccttggcactgggaattctcaggactggacaccagatgctctgcactctcaccatcgcagagctggctctttccaccgtgtgtttgccagatgtcgggtccactgcacttaggctcctcttcattttgctcacttctgaatccaattttcaggcagatctgtctgattagtcagaatctaagtcacatacctgcaaactaatggcaagagaatttgag

SEQ ID NO: 61055 - DNA, 723 bp, Bovine  19866881650444
ctacactagcccctccttgggcacagagtgctcgtgcccagtcccttggcctctccgccgggcaccagggagacacagcggtctgttccgggggcctgagccacatccagcttcctgtctctttttcttttgttaaagccaaatgaaacaatgtaattagcttgttacaattaaagtgactcgactggataaattgtaatcacccagaatcaagtcaggcatccctgcaggtcccggacatcgcagctgagctgcctcatttgcataattaaaatatacaaatgataatggattttgtactcaatttccagcggctgtgaatttgaggaactctgaaattagagtaacagagatgaagcccgccttgaggtaatggggatgacaagttttgacggtaggggtgtttataacactagtttctcgccacaaaataaataagtacaaaaaagattagaaagtgatattagttaatagttccatgggcagtgggaagtggagatagactctgattacctcagtgaatttaccctgctttttttttctgacaagctctcacctaaccttaggggataccatccccctgattatgagaaattgagaatgagttaaatgcataaaaagggttgtcacagatcgactcaccaaaggaaaaggagagaaatgaaattagtcctgctgttcttgcttccagcgaggggtgggctgaaggcaagtgtgtgaaag

SEQ ID NO: 61056 - DNA, 863 bp, Bovine  19866881824905
aaccctagagaaaacagcctctgcacggaagcattaacaaattgctttgcaaatctaagctaaagcgaacattcaatttgaggaggtcaaattgagcttgggccccaaaacccaagcttggtccagcagcccaagttggctctggatggacgtgaccatgggtttgaccttgctttagctggtgccacaccccccccacctcagcctctaattggctgagtcctttagggcccttccagctgccacgtgcctctgcccaaggtttgggaaatttagggcccaggagatgctgagacttgaggccctctgacgaacagcccttgttctgctgtgcaatcacttaggtgagaaggactcgcagaagcaaagtctaggctggtatggacaggggcgacggagcacttgcttctgtgccttcactttacagggcaggatgccaagaccggggggagggttcagtggctgtccagcatctcccgacttgtccctgccatcattgaaacagtaacattgattgtcaacagtttgctaagcatcttgctgagtggtttacattttctcgtgtaaggcttctagtcatcctctgtgattagacttttttttttaaccaattgctcatttatctaagtaaggaagctaaagcccagagaggttaagttacctgaggttgggcagctgaatttgtgcctggacctgctcttcatgattcttcattagaaaccagcgccgttggcttactcttcctggagtcctgctctgagtggtcctcaccacactcacctcgccttgtctttcctctcctgtcagagacggctctgccctaacccgccagccttcagacctccctgcccttgcatccactc

SEQ ID NO: 61057 - DNA, 2335 bp, Bovine  19866880158402
actgcagatggtgactgcagccatgaaattagaagacgcttactccttggaaggaaagttacgaccaacctagatagcatattgaaaagcagagacattactttgccaacaaaggtccatctagtcaaggctatggtttttccagtggtcatgtatggatgtgagaattggactgtgaagaaggctgagcaccgaagaattgatgcttttgaactgtagtgttggagaagactcttgagagtcccttggactgcaaggagatccacccagtccattctgaaggagatcagccctgggatttctttggaaggaatgatgctaaagctgaaactccagtactttggccacctcatgcgaagagttgactcattggaaaagactctgatgctgggagggattgggggcaggaggagaaggggtcgacagaggatgagacggctggatggtatcactgactctatggatgtgagtttgagtgaactccgggagatagtgatggacaggggggcctggtgtgctgtgattcatggggtcgcaaagagtcgaacatgactgagtgactgaactgaactgaacagtcatcctcatcagctgagtacttccttctgtggcaggacaagacataccatagcactcatcacactcatgtataaattgctgtgctccctcagtccagactttgcatcaagtactatcaaggtattgctatgcatgtgccagccactattctaagccccggggatactgtagttgttcaggaaagaaagggtgagaaactgaactataagcagagacagtaaaaaatagaggaaaggggggcaacttgatatcaaaattagaacccagtgactgacttggtgtatggtctgagtagatgtatagtggcatccattccctgacattagaaaacaatttggtggtgtggaggatgtttggaaaatttggcttagtttgcactgtctttggagcaagacagagcttcccctggctattgactgtacaactagagcccagaggaatggctagtgcagagaagtggctttgggaattaccagcacattaacagtgaatgatgttttgggtttgaatatactgttattctctgtttctcagatgaagaaatgggctcagaaatattaagtaacttgtcaaatgtcagattctgactctgatgattttttccacattccattcttgtgaaattgaccttaaagtctgagtcctctccaagggtcacacatttggcctgaaaattgcaaaaacacatgcccagggattttgtaatgttttccttgtgttgtgattttgctgccctttattcatgtttatcatcattgtctgaaatgattctctggccactttagccagaagtttccttccagagggaaaggggtgatccaaatcttttacttatacttaaccttaaattgagtagaacaagtacagccttgagctatgctgttctgccatgaacttcttaatggtctgtggttccagtcttccttccagggagaccagttcctgctccaacctagttaacaggagaagctaggacagggtccacttatgcctcctcaggaggtcaagggaatatgagtatgatggccaccattaagaggtccattctggcgcttccttggtggtccagtggttaagaatctgccttgcaatgcagggaacactggttcaatctctggtcaggaaagattcccacatactgcagagcaattaagccagtgcaccacaagctactgagcctaagtgctgcaactactgaagcctgcacatcatagagcctgtgctctgcaacaggagaagccactgcaacaagaagcctgcacactgcaactagagggtagcccccactcacagctggaaaaatactgtatgcagcaaagaagacccagtgcagccccaaataatatatatataggcttccctggtggctgaagtggtaaagaatctgcctgcaatgctagagaccagggttcagcccctaaaaagagatccattcatgcattgggtggtggtgctggatgtgggggtgggatgcaggctgactgcacaggaagcaggaaagagctctaggaatatctcagtatggcaagttattcaagaggcttcctataacagtatgtaggaggaactccattcaatctaagggtttcagagaatttcatgtaattacattaatgataaacagatatttctctgaagtatccaattattgggcatcgtcagagagaagtaaaggggccatagaccctcttctgttctgagcattttatctgatttttgaagattcatgtgggcattaaattctagattccggcca

SEQ ID NO: 61058 - DNA, 1200 bp, Bovine  19866880362491
tcgggcagatggagggttaggcgcagggcaggagatctgcaagcgggctgaggccggcgtggctcggtcggcttgcctagcgctacagcgtcagtggccgggcaaagccgcaggtcttgcctcgcctcctcctccgccgccgcctcctgtcagcagctcagccactgcggtgactcggcaactccacttccgggtccgggacaccgcctgaatcctgcattattcatgaggaggcggtgtctggagaccgagcccctcccgcatgcaggagttctagtggcgcggccgctggtcgtcttgcctgagggggcggggcctaatggagccggtggttccccgagcgcccagccccgccttcccctcgagccgggagggggcatcagaggcgcctgcgccttggctgctggttagttgctgggtaaccgcgtcgagggaggagacgattcccttctgcaagggcgcggaggacccacaacatcggctgtccccaaagaacccctgagactgggaattgaagtgaaagagaatctggattttctgtgcattattgaggggacggacaaacttcttgtcctcaggcagaggagcgttttgtaggtgctccaagtgttgagatgcttcccgcttcttcaaagatgccccacaaacaaccgccgcctcctcgtaagcaggtaacacacctcgacctgctctgtcttgatgacctctgaccttcgctgccagtgaccaccgatcatacctctgctactgacgcttcatcttcctttccctgttgactttctccctgactcctggcctgtgttcccagtgacctctgaccccgtcctgctctctccctctaatcctagcgtcctctcccacactgccccgaactgctgtttcctaccactctttcacttgtcctcctttcaccattccattccctcactccatgacccatcctgaccagcccatcctccttaagcccccaccctctctcttaccaatatgttcattgtcctcacagtcttgtcccaaagaatttgtttttcccatcctttgctgagtgcccagtgctgggctaggtggagacacaggcctttgggagctcacagaagtgcaggagacctgtacaggagacacagattatatggggtggtatgcttcaggtcttctgtgttgggagacttgtaggagagagcactcagacaaagaggaaag

SEQ ID NO: 61059 - DNA, 2710 bp, Bovine  19866880759324
ctctttcaactgctgacacctgcccccatgtgccaccaccaaggcaggcgccactgcactaaccctctcatgccagcctggcctattccccaccatggccagggaggcaagggctgggattttggctgggcctgtaattgtagccagctgggggaggggtggacttggctataaatactcagaaggctgctgagtgcctgcagctgtggcccagaggctgtggtgggctgggggtggggtggggtgggggttggggggtgggcgtggtcctaaactctgctaagccctgctagttggccttcagcagccagaggaaggcagtacaatttgtggaacagataaaatctgttcttgatttagtgaggagcatgacccaggcttaggctggtagagttggatagccccgtgggtgggatggtggtgaccctcggggctgggggccagccatcacacgttgaaggcagtagatgtggtgggaggcctgccttgcccactctgacccagggaggcaaggatctcccacagtctcaactcctcagagcaagggtcagcatcaatatctctgaggacctgaggacatgggtacctgggagtcagagaacctgagcaggtgacagctgggggctggttcttgcatggactggcagttcctgtgaaactgccacctgactctatcagcagccaactgactcaggccagaggaagtcctatgggctgccccgctctgcaggcggcagtctccctgatctccccaagagggctgggccacagaggcctgactgcccagcccgaggatcgtcccatgactggtgtcagagcccaccaaaagtcaaggcctactttccccagctactgtctagatggcaactgtagctcggaaaggcaaggaacttgcccagagtcacgtagggagttagcaacgaaaagccaggcttcctgactcccagatgaggtgagggtgagaagagaacatgaggttaatctgggagagagagagggaagggagagagacatctttgtcttctgcctcacgagtgtcggagtcagtggggcaggggcaaaggcgctgagccttgaggggagggggagacagatttgggaacaggtgcaggactcatgccaggaggaaatctgagctccactgggtgtcagcagccaagaagggccagaaaagggcctacaggccccgcctctccccccacctcacagccatggccagatccaggctgggtctccagcaggcaaggctggggcaggtgccagtgagccctgggcacaggtggctgagagggcagggggcttgggtacagagggaaggcgagaaatggcagctcccccagcccagcctgcaccccactgcctggacagaagggagggtggcactggtgctggtctgccaaggagctcacaggcctgggagttgcacacacccagtggcccaacactttttcacagggtccagcttcccagcgaaaggattagagtgccctataggcaagtgtgtgtgtgagtgtgtgcgtgtgcgcgctcagtcacatctcttttgtgaccccacggaatagtgcgccaggctcctctgtctatgggatttcccaggcagtaagttgccattttctactccagtggatcttcctgacccaggggtcgaacccatgtctcttgcatctcctacatcgtcaggcaggttctttaccactgcaccacatgcgaaaccccgtggccaggggtgggggggtggggtcattaattcaagacccgctgttctcggggacagtcccagctgaggacatctggaaccacatgggacatgccatctgccctcctgacatcctcccccacctggggataactgagacagcaggcctggccccaggtggtaccccactccctgcctgagctggaagtactgggtaagagtactaggtgagggcacctgtggctttgtccacactttccctccacaaacacacacctcttagctccttgttaggactcagccagagaccttcctgtagtagaggtctgagactacagctcttcctgggattgccccacccctccccgcccccaccatcagggtccagaagctaactgggcaggagagggcgcggcagcgctggggtaagctaggctgaggcaacgagaggttgcccgtccctcaccagtcctccctggtgtgtgcttctcttctccccaggagaagaagggccaggaagtacagaaggggccagctgtggagatcgcaaaattggacaaactgctgaacctggtgagggaagtgaaaaccaagacctgagggcctggcctccgaacctggcccatgtcttgaacctagtacttgtagcccctgaccctggtaccccagtccagccttgtacccagtatgtgtctgacactacccctgatcaggttccagcgccctgctctggccctggtcccatcacctcaccccaggacttggtcctcaacccctgttaccctctcctactgggcacaaataaacctgtgtctggaagtccacccacatcttgaattttgctacagcagggcacccaggaagaggagagaatctcagggtagagtcttagatccatttattatccagcaaacagtaggaggaccagaggaggggcccagcctggacaccctcccattattgccatggattctagtttgcttccccaaccttgagggccgagaggcgcttggc

SEQ ID NO: 61060 - DNA, 1550 bp, Bovine  19866880769728
ggatggaggccccagaacacgctgaggggatgggcaggataagtgggagaaggctcgcccaccagtgagctgggatggctggaggggcggggggtgcccaggcggggccattggtcgcctcctccccttcctggaccacttgtccagtgcaaggtgtgtcttcctcacaggaacacaaacacgcagagcagagacgggggcacccctgctgggaagggtgaccacgtgacccctagcccgtctgcatttgaggcagcacttcaggtggccacattagcccaagttctgacctcaaaactcctcgaatgaggctccaagtgtagggagctccccccttagttgtgtcctgccccctacctcagctggcccaggtagaagcagagaaggcggggcccaggcacatagcaagcccggatgactgagctccatgaccctcaaggctgtgggttcacagagttcagtaggtcaaggctcccgtggcctcttccttgtgaacccaatgctgaggcccagagagatcctggcctacctcagggctgctccccagtgggtagggactgaagggaccaccaggccagcccatcgagccccacctgcagtcggcatgccaggggctcctgtattgacctgaccagcccaggcctgccggtggcctctcccagtggcctggcccctgccctgtgggggacgtaggctgcatctttgggtgtgagactgtccttgtgcactggactgtgttcttgtgtgggtgaggctgtgtccctgtttgagtgcatttctctgtggttatatccttgtgggctgtgccctgtgtcctgtgtccaacgtggccagtatgtgactgtggcctgtgagcagttgtgtcctcgtggctgagactttccaccatgcatgactgtctctctttgtgtctgctttctgtgtttgtgtctctgtgtgtgagaccacgtgtctgtgtgtaactgtgcctctcgctgacagtgccattcctctacacgtatgtcatcatcacgtccctgcatgggacggtgtcccagtgtggccttgacctgtggatggttgtcctgtgtgtgtgtgctcttctcatggtgacggtcctcatcctatatgtgtggtgatgtgaagttgcttaggacaccctgggggggaccgtttccggcatgtggtccccatgtgagcctgtgtgcacaggtgtgagggagccgtcggctctgtccctgtgcgttccccgtgtccatgacctcatcctgtctctgtctcttatcctggcttctaacaaccttttcacagctgattccttcggagcatttgtcactgcgtcagggccaagaaccccatcctccccctgcggcttgatttaatttctgaaatggacagcacatcagtaggggcacccatggggcggggggtggggggagctgtccagagacaaagggttgaatcacggccatctttggagctgtggcgtggccatgtgtatcgctgctgttgtgtcattgtagcagttgtgacgccgtgagggtcgcctcacgttttcccctgcctctgcc

SEQ ID NO: 61061 - DNA, 821 bp, Bovine  19866880784061
tcctggacaccgagcagcagggcacagggaagacacggggagacacgggcctgccctcctcatcccgcccctcagcctggaaggatagatgcttccccagacctgaagttctgtgcagtaagggtgggaggggcagagcaagggggcgtggagggagagggggctgccggatccctcgttaacactccctgggtctcccctctagagagccaccctgctgagttgggggattttcagaggcaattcctgttaacgagccaattaagttgggccagtggcctcttaattagacttgttaacaccactggggccgcaggaggtaagggatccccctacgctgccaggcccccttcccctgcctcacaccccctccccagccctgcttttctctgggctggaacatctgtccccagttgctgcctctgtggccctccccaggccaatccctgtgtgtctgcagggccccgtcctgcccctctctgagcctctctgtccctgtcaaaggagagggaagcaggaaaccccgccagccctgaccactcgtccgtggggcctgggaccagccgaacagaggatgaacaggcggaagggccggcggctgggggggaccttggaggccgcagctgtgaggctagagcagagattgactgggggcctccctctgaccagaggcccagggtccagggctcaagccatcgagccccccccagtccaccagccctagcccccgagcccccctccagcctcccttccaaaaacctggagcttccaggaagcaggccaagcccctctctctgcacaccgccccccaccccagcaga

SEQ ID NO: 61062 - DNA, 1073 bp, Bovine  19866880885442
cccttgtctgacttttcgggtgactcttaaaagaaaaagaattaaaagagtgtgacgctggggacatcattttttttcacatcccaaaatgaaacaaaggaaatataccatttcccagtctctttctgtatatctgtctgcattttatacacttgtctatatgttcgtcctgtactccagtttttcacctgaacatttcatttttttacttatttcgcacttacttcaggtgctttccatgttctatacctcctgtcccctttctcaggacaagtttgtcagggggcttaatgtgatacgggaggaataatggaatgcattaaatggttggtggccctcagccaaggacttctgcttactaagtccaccaatcagaaaaatcccccatttttggaggtcagaagaaatccagtgaggtcgattccattttatctagcactcaacccaagttagatagaaattcttaatttttcaactagaatatacagaaggggtgggctagcagggcattatttctaggctctgagaaagataagtactataaagagtaactgaatgtgtcttatctaagatttaactagtgtagccatggtcatagcatttccctaccgggcagaagctccttttatgttctgttaatccatggtaactctctttcacttgccagatagttaggataataatgaagatggaaccatagatatataagagataccctaaatcccacagaacagaagtcgggatcagcatggtctaaaacctcattagcatgaggagaccaaccattcctatatgtaggcactcagggtcctggtgcctaatgactctccatgctatgcctgtggtctctacctcacagatgacggaaccagccatcagactacatcacaaagccggcctgtttcacaaggcaggtgtggtgtcagaagacatacctgtctagagaagctcacgtggtgattcagtctgtaaatgagggcatcttgttgtaaggactgaaggtgttgcttgcaggcagtgtctttgcttccagtctgtcttcactttccacagcctccaccagcctgacagct

SEQ ID NO: 61063 - DNA, 2397 bp, Bovine  19866880900064
ctgaataatgaatggtctattatgctagctagtcagcatatttaccttatgccagtttaattcattaggttagctcaatttaacacatattaagtgattattatggaccagacactgtgcttttatggatgcatgatcccaccactgagagtcatacatacctatttcagggcagggaaagtagaataacacagaggatgtagaaaactctgcttctggaggaagacgtcagccaagggcacatttccaccgtgccttaaaggatgggttaagtttttcaaagttaaagtaggacagtgggtgtctggaaaagcctgaagaaacacacagaggtgttaaagtacatagtacctccagggaaaacgagacagcttgtacacaaaaggaagcagcacccagaaattaagcattaactgtttactggtgagtaactgagttacagtaagcagtcatcttcttaccggatttgcatggaggaggagaaaaaacaggccacagagtggtgaggatgtaaaccctaacttacctgaataaaacagtttatataattatatattttaagataaaatcataaggataattttaattgttttctttttgtattaacagattttaatcttagaaattaagactagaaatgttgatgagaatcaagcccatgagaggctgtgttaaaatctatacatgtacaaaaatgaagatgccatgctccctatttgctaggacttggtgtttaacaggaaaagggattttgtggagaagccattcttctccagtgcaggagaggtcagatgacttaaatcctctctccagaattctgaaatgctctctgcagagaccaagagaaggactccaaaaggtcagagccttgtgccatgacaacatggtatctcagagggcagaggcaaattccaagtttcccaagcaaacgttgatatattcctagcatctaccaccaattatggaacagtgaatacttgaggtgtgccctgccatgagagttttcattctcattttacctcttgagctgagggggagctggaaggtgggaccggtgctagggttataggatgggatgagcaaggcttcatctccctgcaacatcctacatgaatcataggctctgacacttcactcagctcttgactctgctgagacttaagaatcctgaaggtctttgtttcagatcaactctctgcccctggctctttgttgcaaaacttggtcagcacagcgaattcatggttttctagagcaggcagcttgtggaagaccaaagaaaggacttgctccacctcagcccagaatgtgggcacattaacctcagcttcccacctgtcactgctgtgacccttttgagtcacattccttctcctgggcatcctcctacatggctctcagcccaactcccaccaggaagggaggatatgcctgtcacaagacctcttatgacctttggggatgctttaggaaaactctggaagatgtggttcagctggcctgggccttgtgcctcctcgccctgggggccacaaaaggggctgggctgccaccccttaggcacagagtcaccattcagaggtgggacacatccatgcttcttcccatcctgccttttctgcatccagctggcagtcgacacactgtgctaagtactgggtcctatcagaggaggagactcccggccccactgctggttgtggtatgtggagccatcctgaatttccttcagaatcagtgaggcagggcatcccacagcccccatagcacaccgtgaggagaccacagccctttctgcccttattctcccctctggtaggtcagaaggtgggaatgcagaggtgccaccttctgagagaaatgaagtgtccagaacagagccctcccatccgctcagggcaagctttgtctttctgcttcctacttctctcctccagcccctgaaactccctggcccctggctgacaattaggatgccacacttcctcccacgtgaccactaacctcaactgtgctttcctgctcaccaggattcacatgctactaccaatttcttaggccctaacaaaaaaaaaccttgccatggtaacttccagaattcctcttcatctctggctttggctcttggtatcaaccccctgcccccagccatgatctttcctagttccttatcaccccttcaggtatttgccttgctcccttaaccatagagaaaccattctttgcatgagacacagagtccttcctcactactgttactttttctctacttaccaccagtgaagcatctgtgcttttagccaaggccaacccctcaacctgggacttactcctattatgttatacttctgcaccatgaccctgcctctcttgcagttctctctttctctcctgcat

SEQ ID NO: 61064 - DNA, 2003 bp, Bovine  19866880943287
tgtctctaattttctggaagagatctctggtcttttccactctattgttttcctctatctctttgcattgatcacttaggaagactttctttaatctctccttgctattctttggaactcaacattcagatggatatatctttcgttttctcctttgcctttcacttctctctgtttctcagctatttgtaaggcctcctcagttaaccattttgcctttttgcatttcttcttctttgagatggtgttgattactgcctcctgtacaatgttatgaacttctgtccatagttcttcaggaactctatctatcagatctaatcccttgaatctatttgttacttccactttataaagtggaagtgtgttactatattaaagatagagcaaagatggttaagtagaaacctttgaaattgttgtttcatcttccttcctctctgagccaagatggtaatttagaaacaatatcacattcctggagaatgactgaagaccattgctgtcttaagggatttgatttaggtcatacatgaatgatatagtggttttccctactttcttcagtttaagtctcagttcagttcagttcagtcactcagtcgtgtccgactctttgcaaccccatgaatcacagcacgccagtcctccgtgtccatcatcaactcccagggttcactcaaactcatgtccatcgagttggtgatgccatccagccatctcatcctctgttgtccccttttcctcctgcccccaatccctcccagcatcagagtcttttccaatgagtcagttcttcccatgaggtggccaaagtattggagtttcagctttagcatcagtccttccaaagaacacctaggactgatctcctttagaatggactggttagatctccttgcagtccaagggactctcaggagtcttctccaacaccacagttcaaaagcatcaattctttggcgctcagccttcttcacagtccaactctcacatccatacatgaccacaagaaaaaccatagccttaactagacggacctttgttggcaaagtaatgtctctgcttttgaatatgctatctaggttggtcataactttccttccaaggagtaagcgtcttttaatttcatggctgcaatcaccatctgcagtgattttggaattttgcattaaggagttcatgatctgagccacaatcagctcccagtcttgtttttgctgactgtatagagcttttccatcttctgctacaaagaatataatcgatctgatttcagtattgaccatctggtgattccatgtatagagttgtttcttgtgttattggaagagggtgagttctcttggcaaaattctgttagcctttgccctgcttcagagttaactgattgaaatgcctttatcatgttctcagtaccgtgacaaccactgtggccagaagtataaaactctacaattggctaggtctgggtctcatgcctatgctatggccaggaagtagaatactataattggcagtcccttgagaactcatggagtgaaggaagggaagttctctgaagaagagggggaaaggaatgtcaagcaaatcaaaaacaaaaacaaatgtccactccatcctgtcaaccgaaccacctctttccttaggactctagagctgttgatttctctttgttaaattccctctcattcattagagcaaattaattactaatttctgatgatttgtccttctaaatatttctcatgtttgtcttcctgtccattacaaatgctatctccctagcttagatttttgtgacttcacacctgcttgtgttaatgaattccaaattgacttccctgccctctctctgtaaaagagtccccctaattctgtagctaaatgcaacttcttaaacctcttaatgagataggccaagaaccagctaccaataataatgattgtaacaagaactaacaaaatgcatgtgttaagcatttattatacactagatatat

SEQ ID NO: 61065 - DNA, 1039 bp, Bovine  19866880956685
ataaagcagcaacatcctattagaaactagcaggaggcagaatggtgtggcttataaaacaggctcagaagagcctggaagaatagaagcctagactcgatcaaaacagaaactaatttcttttttaaaaaattatttatttaatttatttatttgttctgtgccaggtcttagctgtggtatgtgggatctagttccctgcagggattgaacctgggtcccctgcgttgagagcacagagtcttagccactggactgctagggaagtcaccaagactaatttctaagtcagagtttccctaagaatattccacaaaacacaacggttctgtaagatgttaatagatataacaaggaaaaagttccatagttacataagcttgagaaacactgggttaaacacagctggaaagggttctttattgcagggcttctcagagtctttaaaatgctagcaaacattgtgataggatagagtgtataggttcccaaaggaatttgtctatagactcttttatccccccataaagtacctcaaaggaccaatattcctaagaatgtactataggaaatgctggtctaagccaggcttgcctgagagcttcactaattcctttgtaaggataaaactggaaattaatatgggaactataaatcatttatagtttatacataattatgtttaagttaactacattataaaatatatatggttctcacaccacagtttgggtgcaattaattcaatcaatcttagttaaagtaccccttcaggtactgttccaaatagatagatggggtggactctggttatgacagccaagagtctggtgatgaaaacagggaaaaccaggccaggaaccacagtagctgggctcatttgtgcctgggtgtagcctcttgtcatacttaatattctcagggctagaaaggtcatccagagagcactctttatacccactgtgtgtgtgtgtgtagtcgctcagtcgtgtctgactctttgtggccccagggactgcagcccaccagactcttctgt

SEQ ID NO: 61066 - DNA, 1529 bp, Bovine  19866881042275
cacatccatacatgaccactggaaaaaccatagccttgactagatggactttgttggcaaagtaatgtctctgcttttcaatatgctatctaggttggtcgtactttccttccaaggagtaagcgtcttctaatttcatggctacagtcaccatctgcagtgatttcagagcccaaaaaataaagtagggtggcataaaggggtcacaataaaaacgaccttgagaggcaccttgcgcttaacaattaaaatatctgagtacttaccatgtgccaggaattgtgtcagacataacagtcaccaagacacatgccttgaccaaggtcattatcttatggggtagaaagtctcatacgcacaaaccgtctaatcaaaatatacttggatgtccaatgtttatctcaaaactgtttatccctgtcccaccacccccaccacccaatcatacatactaaacctgctccaatcactgtatttgccacattagttaatggcatctgtcttttgccagttgttcaggccaaagataatggtgtcatccctgacttacgtttctaacaatcagcttccagtacatcagtaaatcctattgtccctgccttcaaaatgaaaccagaatcagaaacaaaatgaaaccccttcttgcttcctctgctacgatgattgcagcagtagtttcataactaatcaccctgcttcttcctgagaccatacagtctattctcaacacagaagccctatgtgctcagggagggtactggctacagatgatgggtggacagatagaggaatataaaaccatgaggccagataaggtcaccaaaggaaagagtgtaaatggacagatctgaggactggactctgggacattttgacattaagaaattggaagggaaaagaagaaccaggaagcagaggagactgagaagcagtaaccagggaggaagaaggaaatccagaagagtgtggcatactggaggtcaagagcggggaatatagcaaggacaaagttggtcaactgcatgaaaagttgcaaatcggccaagtaagatgaggatgcagagttgaccactagatttaacaacacagagatcactcgcagctttgagaacagactcacacatgatggaggtgacggcatgactggagtggattcaaaagagaatgaaaggagggcagttggtgatagcaagtgtaattaattccttcaaggaggtttgttccacagaggtgcagaaaaacaaggatatagctataagagaaaatgcaacccagggaggttgcgaggggttttttaaaagggggagcaacccccctaggtggctcagatggtaaagaatctgcctgcagtgtgggagacctgggtttgatccctggattgggaagatccccaggaagagagcatggcaacccaccccagtattcttgcctggagaatccccacggacagaggagcctggagggctacagtccatgggttcagaaacagtcggacacaactgagagactaagcaccctagacttaatgt

SEQ ID NO: 61067 - DNA, 769 bp, Bovine  19866881092485
tccaaacaagatctcttcagcagcaagtgtcccgggccagcctccctcagaccagtcctgtcacacaggccctctcagacccactcacctccagattagccttccccatcagagtgactgtcaggtaagtcccttccagcctccctcctcagaccagctccatcagactgctctgctcagacctccctcttctctgccctcctctgagaaaaggggtgaggactgcactccagtccttcctgccccccagtctttagccccagggaggtgctaccccgtgaaggttctgtctctacctgtccacgttcagtagctctgggcatagtgaacacatggacctcaagacacaaagacacgcaggtgccggccccagggctggctttggagccagtatcctattctttacatgtgaggataagctttctcagagcaccagcctaaggaattagtgagctcactggctctggggagttctcaatgccgggggttgcatggaggtattcctgcctgcagtctcctgaccacctccctctcttggctggctgctgggaggcaggcgtgggatgcctgcactgatcactgcctgcccgggaagatgaagggcaggcaggcagccgagagggggcagcagaagccaggacagcccctggctcaggccagggaggcatggcagccaggggctggggtctggaccaggacaggaacacggagagagaggcagacagagggaagggatgccagagtctgaagaaggaagagagacacacag

SEQ ID NO: 61068 - DNA, 478 bp, Bovine  19866881095819
gcgcagaggggcgggggcagggaaggggaaggaggggacgattctggggtcgcagaactgagtggagctgagacggtactgtagctggtgggaggaagtcctggaggccatggacggtcagccactgggatcaccgaggtagggcagggctgagcagggtaaatgtggctggggggctggggtaagccactggacacactcggacagacacacagacccatagaggtccctgctcagttctgtgggtggagggatttgggctctccctcttctagagcccttgcctggggccctttccccatctgccccttctcctgccccagttcccacctccccactgcctttctcctcctgttttctcccagcctgagtccctctcttgtagcaccccaatcccccacacatacacagttggttatgttttcagcctttgtgagatcctgctgccctagcccagcccccaccgcctcccggtcct

SEQ ID NO: 61069 - DNA, 1042 bp, Bovine  19866881140809
gtgtatacacgcccctccctcttgaacctccctcccactttccccctttcctacccctctagattgttacagagccccagttccaattccctgagtcatacagcaaatttccattggctatctattttatatacccctcaacttttgactgaataagttggaccacaagatttctgggacctttaacggagtccttgttgttgctgaggctgctgaaacctctgtccccaccagagaagcctcctcccggccctgtctgctctcccctccagtaccccttctgggctctcctcagggccctgtcttgtgtttagagatgagccatctccagaataaactcaggatgaaagagcaggaggcaagctttacctaggggccaactatggcagtgcagactcctcatgccacttgtgagctgggcattcctggaagagggtggtgaggaaaacctttacagagctatctggggtgggtggggtcagagaggctttgctgaaccgattgcaagtcagggctatagctcagggcgagaccttccagaatggtggcttatgaggaccggtggcccctgtatctccacagagtgatgacatcaccaaagtgacccaagcagctaaaatcgtggagcggatggtcaaccaaaacacatatgaatgatgttgctcagggtaagatttaaagtgccagcaactgctattattactttattaaaaatcgctcatacaaagtgagtatttgagtgtcccatgctgggtcctacaggggcaagaggacctcctctgtatgtcacaagggaaataagacttacacagttcaaacaggaaccatggcataagaaaaaatgggtgtggtgatgtgatctgacaatggtgcataaagacaccagcacgctagttatttaatgtcatcttccccgcaatcgtgggaggcagtggagcagagattttatcccttctccacacacgaggaagccaaggccaagggcacccaaacctgggtcttaagcctcctaattccgtgttctgttctcgctctgcccagc

SEQ ID NO: 61070 - DNA, 1176 bp, Bovine  19866881231837
tagtgactgtctgtacccgtgggcattgtcagctgtgcacctgtgtcattttagtgaatgttgttattactgtgtagtggtgtccttgtgtcgtcgtgggacatgatggtaagttgggggccaggatggtctcttgatgagtcacctgtgtgtgtgtatgtggcgacactgggcttctgtgttgggagaggtgctgggcttctgctcacaaggggtttgggctgctgggcacttggtagtggggtgccttctgctctctcctcactgctgggtctggggctggaggccaggctggccctctggaagggtctatggagcctgggccagttcacatagccctcatctggggctttacagcatttatgctctagatctatcccagagccgtgggtgtggacttggaaaattcctgggaaagatgctctttgccctgggatgggtgacctgaggtgagctagggcagggcagaggtgtagcctggatgtctctggcctcagcttccctacctgggaatgggtccagctgggactcggagggaagagggaagtcaaagtggcctgggacttcctgggcctgtaggtggggtggggtttccagccactcttatcccctaggggctaggctcttggctttatgggcagaagccccccagccccctggaagccctgcttttgtctcagatccgccagtatggccgcactgacagcatcctccccttacactgccggagctgagtcggcttagagagatgctgtcagtgggcacagagaccctgcttgtgtcttgtttctgtcgctgtctccaggtcatgtctctcccgctgcccttggatctctgctagtatcgtgtgctccctgtgttttgctgtgtctcttcttccatttctccctgtgttggtcttttcttgtccctcagggattcggctcacagctttccctctctgttcccctctccctgggtgtctcccttttccgggtgcccccaaccgtgcagcatctgcttggtaccccatccccctgtctctgcagctctctcagcagcacccggctcccatggctgcagcctctttggcccagggcccggcccttacagtaactcatcgggctgatggaggcgactttgatgaagaagccacccctccccctgtggggacccgcatgtgtgtgtgtgtgttgc

SEQ ID NO: 61071 - DNA, 3320 bp, Bovine  19866881262324
actctccaaccaaatgccctctatcaattccttggcagcatctctccttggtgttccgtgcctccttccttacattggggaactagaatccacatcctggaaagaaaccaaagggtcctctggaccacactccttaaagccctattacccctgaatatccatccccttctttgcctcctttggaccctgtccaagtagaaggcccttagaaccgcagatcccttggcccctttaactcccttgattttgatcgattttggaatcatttctatgcaaagtctcatctccaaagtctgtgttggctgaaactgaattaaataagagacgggactgcctccttctccactgcctaccctcataccatcttcttctgcctcaggccctaccagttaatctcttttttccctcattttttcctattgtggtaaaacaaatataacataaaatttatcacttcaaccattgttgatctactttttaaaagaattttacaccttcacccctttctccattaagtgagatggcctctccctaaagaggttgaaataggagcggtgacgggggagcaggaagtgggactcaaaaacattttggttcaccagactgtagaggctaagacctgtgtctctgcccagtccaaggtaagacaggagcctgcttaatatctggctcagaggatgagcttggggatagggatgaagttcaaggactaggccaagtcaagcctcccggaggaaccaaggtttctcaatttctggccctgcccctatctcctgggtcaggaggctcatcccttaggcctttttgcagaggcttcccccaagccactgtttctatctaattgtccctgagttaggcatttgccctatctcccagacaaaggctttttgttcataggatttccaggtgcataggaacaacagagcatcaatctaggatgagcagccctaaccacagagaaggcaaagcaggattctaaatcattttaaaaattcacaggtcccttgtctcccccaaatgaatctggggcttccctggtggctcagtggtaaagaatccacctgccaattcaggagacacagtttaatccctggtccagggagaccccacctgcctcagagcaactaagcccatgcaccacaactactgagccctctcgtgattactgaagcccaaatgccatggaaccatgtgctcagcaacaagagaagtcattgtaataagaagcctgcacactgcaactagagagtagcccctgctcgccataactagagaaaagcctacgcagcaacaaagacccagcatagccaagataaataaatgtaattttctttttatatgaatccaattctttgccatcccagtgctagctttgtatctttcaccatgcttttctctcctgtttctgagtagctatttttgaaaactaaataataggtaagggagtgggagctgcctatctttctgaaataactccaaagccattttggttcattgtctcaccccaaatctgaaagcaagagagacctcctcggtgaggtttgcctcctggacctgcagcttcagtcccattgcctgcagctgatgtgcacgggccagggaccagctgaagcatggcagccagctacctgacagtacagtgctccatgtagagccttggccaagctgcagtgtaatagtcttctctccttttgttcttaatcagtagcttcaagtcaggaatattttgtctggcaggtgatgcccagaggaaattctattctttgaaagaagattccccagagggaaccaggcaaataggactagagaagagctctcttggaaaacagttagatagatgtgatgacctgaaataccctggtacacagtgaaaaataaaatactaaaaaaccagctatagctattggttgtgactagaagctttgtaaattggaacaatcctctgggaaagcagtttggcagtatgtatcaagaatcttaaaagcattcacactttttggtttataatagtgcaatattgcaaaccctaaatgtccaaaataagtgaagggttaaaaagttattgtatgtcccctttatggatatcatgtagccattaagctgatggttaagaaaactatgtaaaaatatggagagttgaatatgccctaatactaattttttaaaatatagaatataagatacagtatgtttttcttgagagtcccttggactgcaaggagatccaaccagtccattctgaaggagatcagccctgggatttctttggaaggaatgatgctaaagctgaaactccagtactttggccatctcatgcgaagagttgcctcattggaaagactctgatgctgggagggattgggggcaagaggagaaggggacgacagaggatgagatggctggatggcatcactgactcgatggacgtgagtctgagtgaactccgggagttggtgatggacagggaggcctggtgtgctgcgattcatggggtcgcaaagtgtcggacatgactgagcgactgaactgaactgaactgatgtttttctttaaatgttgttctatgaataattattagcagatactttctgattatagtaacaaaatccaactcaagctagtttaagctaaaaaggtaactagactgtaaggacactagattttctcctaatacaagaggacaggcatgtaatcaaaccttagagggacaggacaagttctagaaccagaacctgaaacctagggaagactttctagctcttgtgtttcttctttctgaacatcagctttattcttgtctccctgccagtgaccttctctgctacctaatctatagtcttaagcttcacgtctcctcatagaagccccacttcccaattctgggggatgctctgatgggctccacctggtgtaagcaaggacgggaccccacagacccaacaatgtacctacctagaggcccacacctgtaaccatgaggacaggcaaaacaccagctcctagagagggaaaccccttagtgttgctactgtagtatacataaaagactcagatacactagaatgttaacaaagattgcctcaaagtggtaaaactaaatgtgattttttaattttagcatgtgtctctttataatagaaaaatctattaaactcgccatggctaaagttgtttctagccatgggtctctgcattttggttctcccaatgacagtcaccacaaagctactaaagcttggtgggtggtgcttcttttggggaatgaattccatcctaggagctgtttaaggaaacagaaaatcttcagctatacacaagac

SEQ ID NO: 61072 - DNA, 1107 bp, Bovine  19866881317984
ccatgtccctggctggttatctggttgatctacctgtttctctggcttgtgccccacacagtctctccagcctgtgtgtaggctcgctctttggggctctgtctcttgttgggggcagagtctttgctgtgtgtctgactgtacctctggtagtggccctggttgagtgtctgggagtggtctgtctctggatctctgcttctgtcttgttgacagaactttgtctctcttcaagactggagtgagagagatttggaacctcttgggcaggagatggttgtttccctctccttaggtgtaggtgtgtgctggggtggagcagtgtgagggcagctggacccatcctagaagcaggacaacacactgaggggccactggatccatcctggcttccggaaacacgtcctgactgtgctgtgtgtacccatgtgggagtgtgcagacacatgtacatctgctggactggggctctcaggctcctgggctggagggcgataggctggggtccctgactgggacgtatatctgaaaatccttcatctttctcatggtcactggtgtccactaaagcagaaaccacatctgaccggctcacaacgtaccactgccctgataccctgctgctctgaacttcccagagccctgccgggcaaggctcacctgggggtggagggggggcaggtaggcgtaacatggtagggcagatcccagagtctccccaggagcatggcaggggccttccgttcaaggcagcttggagatgtatagacctccaatcaagttaaagcattaccctttcagtttgcagtgtttatagctaattagctaacctcaccagtaaagttattttttttctagaaaaatggccctagcattaccagtgttctataactcatctgcggttgactacatcctgcagccagcttccttatcgaacaacaaaccactgtaggttgccttctaccatctcagcaaacctttgcctacagatgccaataaggttattttctgttacttgaagagggtcctgagctccattaagaagggcgcttggggtcaaggtgccctggccctaggcctgggatttcccagtcttccctgaaatgg

SEQ ID NO: 61073 - DNA, 1191 bp, Bovine  19866881324237
gatgacactcccgcagaggctgaatgggagggtgggggacggtgatgggaggccaaggggaagctggggggctgcagagcagaaacaaacaaaaaagagagagagacagacgcagagagaggaaaggagccaccaacagcaaggagaaaccgagagagaggttctctgcaagggctgagtgctagcctgggagacagcagataccttttatttccaaaaacagtttttcatccactttgttaaattaaaaagctgtttttaaagcggtgctgaaggtgctgctggaggagggtggacagaactgccaagtcctccctcacagcctcctcctctgcccccacagaagccgcctcagcctttcccccccgggggtgttctccagctcccctgctctctgtgctcctcagggatccccagggacagggtcagggcatctgagctactgttcattggcagaaagtccttcctgctgtctggcctcagtccctcctgctccatggagcccattctcttgcctgaccgctagccttctgtgctccgaccccagttccggctccctaaggtgtccccagtgtgtcgggggtgattagcacagctcaacagctcagtttcccaaccggccaccaagctcctcccagatgttcccctcactgttgtgccaatctgaacttctgatagacaccccactccaagtcttcaggtcctctgggaaccgggagactgaagcataaccctctccagccttctaaagtcccttttctactcttcagaaccccagctccattttaagtcccttttatggccatgatgttgtcagcctgggatacactcggcttggaccccaccctcaacaacaccccactgctagttctgaagggtcagccccccacccccaccccacttccaggccgggaaaatggccagtctgtttgggagctgagatgaaaagccctgcaggcctttgtgggcctctggcgggttttcgacaataggcccttccgttccgctccagtgcctcgatttcttgagcacccccaccctggggctgccaatccaggggccttgcctggcctgaatgaaaggcagggagagtcaggcccaacccccaaggctggcctcagaagattttggactttctgaccctccatcccatctcctccaagctcagcggctccccaccaattaaaccag

SEQ ID NO: 61074 - DNA, 1542 bp, Bovine  19866881340475
cagctcccttctgccatttacaccaacccaagtgaccttcccaggccctttcagcctccaggaagccttccttcttccccggggcctcctagactgcccacacctctgccagcatcaccagatatcccattttctcccccaaggccctcgcagccagcccctgggagagcatgcactggaacgaggccaacccagctaggagctgtgacctaggattcctcccaccaggctgcacatgggccgtgccctgccagccctcctgagcccatcttgtcataggggacaggatttctgagtctcaaagacctccagtggagggtggataccagtgcaaaatgccaggggtctggactcagggggcgacactgggctcagaggtcagaacagtaggcttagacaaggtcagcggacaggggtcaggacctccacaccaccaggaaggggatgtgattggggcccgagggcctgggcctcactggctcccccactgaatgcagcgggggtcacgcgaggggctgggagtcacacttacagcccacatggagaagcacctggtggcgcaggtgccaggagtcccggtggaagcaggcgtacaggccgccgtggcccagctccaggctccggagcacgagctgagagccgttgagcaggtcgggggccaggtctgtgccattcacccgccacgtcaccgctgcgtcccagctggcagtcccacacggcagagtcacgtctgagcccaggcgctcgtactgcacgtggggagtctctgtggcgggtggggaaggcacaggcagaagtcagaggtcacagcctggcccagcactcccagatgatagcgagagcaggccccctgaggctcagggcgcgagtgtcttgaggagacaagggatctgcaaaattccttcatggcgtgcaagggcacaagtatgtgagtgtctccaaacttggacgtgtgcatgcgtgtctggggactctgtgtgtgactgggtgatcctgtgtgcgtgtatgagagagagagtttgtgtagagtgctgggacagaagacctaggtcacctccagtcaccaggtccttttgaaagctttcctgacccccataaccccagcctcctgccaccaagaggcccagccccagtcactgacatctgctagccaggcaagctgagccaaggggcaccctcctgaactccttcctctttctcttcccttctcttcatcctctccatccttgtctttgtgtcctgcctttctccctctccccgacaactctgaacccccgacaaggccctgtgccccagcagtccagggcagcagaaggaggaagagtgggcacaggagccctagggagcgcctggcagctgtcaacgtggtggtgaggcaggaactgcatagggtgcgggtgggggttggggggagcgcagggactgcaggagctctgaccctgactctcctgcccccaggaggggcctgtcagagcccaaagcaaagcccagccctggcctcagccgcccaggcatgatggacagagcccaggagactggagt

SEQ ID NO: 61075 - DNA, 1379 bp, Bovine  19866881391601
tcctataggtctagggctccaagtcctgacaattgtaatttagagagttatattctcaatgctttcttgatctccccattcctatttccctacgtcatttcaatccctcacctacactctcaaatgccttcaatccctccttctacccagccgcccaaatcatccttctaatttctgaatatgatcacatttacccctctgttcaaaatttcttcagtggctccccactgtcttctggataaaatctaaactcctgcagctgggtcacaaattcactcatattacactcagatgtgcaatattattagtcttctctctttcctagaactgatttgatcttgttcacagtgcccccaccctgctgggtaacaggagcaggggaaactaaaattaatcctctctggtaaattcagttgggtctgaaattttattttagacatgtctaagtaactcaataggtttggatgactcagactttcaggttgttttacccttccttgtctcattttcaagatagcacttggatttatagagatgtcattgaaggaagggggtcccttacccatgtggtccctgggggttgtgtcatttggcatttattgagatgcagcatttgctgagatgtgtctggtataaataccatcctcagaggtagctattacagatgaggaagctgaggctaaactattttacacatgaggaagccaaggctaaaagaggttgagtaacttgcccaagatcacaaaattagttaagtggcagaaccagaaatcaaccaccaccctgattctggctgggtttgcatctagaagtccagagataagttaacattggatttgggagcactcagaagtcttcacagtatagcttcagagctgtgcttacccatgggagaatatgtctagtggaatgagaaaagggtccattcagaacactgaggaatcactggcatatgaagtcgggtgggaagccctacttgatggctcctgcccaagcagacttttctcttaggagagcttctaaatggaggagtcaggagcttctaggatggacagtcgtgcctgattatattccagccggggctaagccatccctcaaaataccccattcccctctgtcctaggctcccccatagaaggtcagaatacgaagccctgaccgatactgggtaggaactcaacatgtgtcaaaacaacttatgttgtcagagctgctcacacgtcctgaggccagggaatgtggaaccaaccacagaccctctgaagtggggatgcagggttcacattcaggtgagagtggacgtgcggtggtataggggacttcaacaccaggaggttcggtctcctccccggatgtggtatcccagtgccttcctgcag

SEQ ID NO: 61076 - DNA, 677 bp, Bovine  19866881520636
ataaaggctaacaggtgctatcatacactattgtgggcacgccacctcatgcagggttaactggcaatacctgccaaaatttcaaatgcgtatacctcgcaactcagcaactatgcttttttgaatttttcctatataaatactatagtatttatatatatactgtatatatatgcatactatatgcataagtatacttatgcatactataatacatatgcaaaagatgtatgtacaaaattgctcactgcagccttttggtaatatttcaaaaatggggaaaaaaatctaaatattcatccataggggcctagtgaaatacgttatggtatagccattcaatgggatattatgtatatttttaaaagaatgaggtaacttttatgtattgttatgtaaagcctccaagctttttttattgttaaataaacaagcaagttacataaacagatgacccatcattttactttaagaatgtgtgcacacacgaaatttctggaagaataatgtagattctgttgagagtggtttggtccagggaatgtgactggggagttgcagggaagggaaaaaactgcggtttaccttatactcatcctcatggttttaatattttaaatgtaaatgtgcattacttttataatttaaaatgctaattaagaattttaaaagttaat

SEQ ID NO: 61077 - DNA, 668 bp, Bovine  19866881828430
ttccctaaatccagtctatttccttccccaaatcttgtacatgacttttagagtgtccttctccatctcaaatctcatcatgttactcccctactcaaggcttcactggctcctctgccaccatcttctgagtaaagaacaaaatcaaggcccatcttccaccatcatctgagccctgctggccctgcaactttatttcctgtcactgttcatcatcataccttctaggtttccactgtagcaaaatattgactgtttcttgaatgtgcaatgctagtttcaggcttctgagcctttgcagatgttccctgaacatccttcctctcaagataactgggaaactgatgtttggagatcttttcaaaagtcctcctctgggaagttttctctgaccaccctccctttgtccctttccctctacatttatggctcttgttacatttactgataattaccgggagctccttaagaatgggtctatttctatatatcttgatgagccccaggctgaccgctgataactgagggaaatgcagcgtaaggaagtgaggagagagaggagacagaatgctccctgatcaggcccctcctcaccctgttgagtgagcatctcttccacagatatctccccacataagccaggccccaacctgggtgggacaggcctg

SEQ ID NO: 61078 - DNA, 1326 bp, Bovine  19866880454734
attaaatgtcattgttattatagttcatagtaaaaggtatacatctatatttaaggcacaatagctgtacaaattgatgtactagtcaacagttttctggaccatattctggtgctcctgttaaaagacaggcaggtgatagaactccacagtgctgacactgggtcctggaacactgtggaagtcagtctgttaatgttttcattggcttactgcaatgctgaggtcaggcagaactcactggtctcctgcttctgccgacccagtgattgacagtaatgcaatgttcttttagaatttatgactctgggtaaaggacagagtgaaatatgtgactcaggtcaaaaattaggacaaagaatatcagagatgagatgttcattttaaatacaagtgtagagtcattagtttttaaagttgtgttttccaattcaaacttgagataattgaaaacagatatattttccccctatggaggctaaagtttctcttaataagtcaaaaacatattcaaaatttaaagcacatatgtgaaaattaagtttgctttctaatttttcaaataggcattttggatcattgggatattcatctatttcttttttgctttgtggggtatttattatcttagataattctccataatttaggatctgttgtgaatttattatagttagggctggtgtgttggaacctttgtatttccattgtcctatagaataacccaattctattctatatgacaaaatgtaatctagtcagtgattgcatatgctgtattttcacataagcaaaatttagatttttaaaaaatatattacaatatatagtatttattttgaataaaaattttatatatgtatattattctgtaattgtgatgaaagcattgtgatagctgtgcactaaaataaatgaggtggtcacatcatagttctcagccttactagaatcacctggctagcttcaaattatattgtgattggtctcattccagaaagttgtaatttaatcgatccaggatattgtctggctagactatttagaaaataaaaaatgccaaccatttcttgatctatataacttcaatttactggttaaatttttgcaaatctaggggctaatataataaattttaagatttttttctctattatttagcttaatcatttatttaattcttcagtttgcctaagtataccctaaattataatgtatttgtgtgtgtgtgtctatatatatctgtgtggagtatgtgtttgtaggtgtgtttatgtgtggagtagactaatttctcagaaataggttttaatgcaaacatttcag

SEQ ID NO: 61079 - DNA, 1147 bp, Bovine  19866880614520
tgtacaagttaatttttttattttaaatagttaatgagaattcaggatttggagtcatttttgaaagtaacactttaaagacaaaaacataaaagaaaagaaaaaatcctctctccctttctcccagtgcccacaaagaaaatgacttgccatgttgtgacataatctttaattgttgattagcagtgaggaagtaaatagtctttaatgaatagaacccaagcataatttggattataaatctcttttacaaaagtgaaataaactgaactttacagataagaaaataagtactttctgctcagatagtttacttgtattaggggtgagattagacccaaactggctgtgtttcatccaaatttagctcttctggtggtttggacctagttttacttttttcccctcttttttaagaaaagggaaaatccacatgggacttttaaaagagatttcaataagactgtttttaagggttaaaaattcaaggtgctagaaaaatatcaagtactttgaggaaccttaaaaagcacactatgccttttagtcaaaaggtaagacagaccagaaaggaagtcaatagatgagtttaacaagttgatcagagtgaagagcagcaggccatcacaaaatcttgacttccaaaaaagttatgaattgggaaatgggtacacacacccacacagaatctcaaataactgaaagtgttatttcaacctagaaaaaaaaaatctctttaagtatgattctaacttgagaagaccttctttctaaacagtaagaaaacccaggtccatttgatgcaagggaaagacagatatagtaaactgtcatacaggatgttattgctctgaaacaatagggagaaaaaaaaatccagtcgttttgagtatagattgatacggattctctgatttaaggagagtgtcctggatgttttttggttgcattcaattttagcttgcagaagctagaggaaatgagtcataatgtccagaaggaagaattcagagtaataaggggagggaggatcaaagataatggcaaacaggaggaatttcattagaagagcaccactcaaaactcggtctccagaggtgtgcagggaaaaggagagtatgtgctgaagatggtttgcaaacaagaa

SEQ ID NO: 61080 - DNA, 2686 bp, Bovine  19866880814923
atcccagggacgggggagcctagtgggctgctgtctatggggtcgcacagagttggacacgactgaagcgacttagcagcagcagcagcagcatgtgcttggtattaccgtctgtgtctccccagtgaaatcactgcagtctggcagtagcagttggtttcaatctccagctgttttttgtgttgctgttttttttttaaattctaagaaccatcttcatcttgactcctcagagatgtgaagagcagcctgatgttcccctatctctgctgctgcttagtcgcttcaatcatgttcgactcttgtgaccctatgaactgcagcccgccaggctcctctgtccatgggattctccaggcaaagtaactatagtgggttgccatttccttctccaggggatcttccccacccagggatcaaacccgggtctcctgcattgcaggcagattctttactgctgagccaccagggaagccctttctgaacttacccctttctctttcctttctttgcccacccccaaacctactcctgggataccagtactagtagggcaccctccccacaggtctgagtccataggcttcccctataaactgctaagttctgtgaactcaactgaagtctcgtcccttggtttttcacaagaagctgcttacagtctctgttttgccatctatttagcccattatattaaattatttctgtggaaatacctagtgtgatttttttttccttgctcgaccctgagtaacttctatggctcatctttcacctattgaggttgggagctgcaggaaaactggattttgagaccagcaggcagttggaaatactgaactgtaattcaaaaaaatgttaagactagaaatatcagaataatctgcttctgcttccttctccacataaacctgggcttcagtataaacaatcacttctagctttgactttactgacatctagaaatgtattgatgcttttgttataaagttggtttttgctatgagagtgcctgaacagctcactttggaatatcttaagttatggaacaacgggacagaataaaaactcagcaaaaaatctccaagcttcatgctatcaattaaaccaaaaattttacatggtatactgtgccctctaaagtttttagggtggcaatagaaatgaaaatgtcccattattttgagtggtttgaataaaattggagtgaagatgctaaatgctgtaatcttccacaacagaaggacttggagtggatgagcccattatcatgctttaagaggctctcttctttcttctatcagatttcacaaaaggaaatctaaatactattggagagttttagatattaggctaaagcttttttagatccttgagaatggaagacaaacagaaaggttgagaaaacaaaacactacaaaaaaactatatcatactattattaagccatcgaaaacttttcactatacttgagacttctattccccttatgttgccaaccaattgaagtagccatcttagttcataagctgatgtgagatgatacttttgaaaaagatatcgcttttgggaaagacctctatatgtgcctttgtaagacaataagttcaggggaaacctagctgagatactccaatggtttcaaggcagtttaaatgtaataaaataggcgtgaaatgctctaataagtgctcttaagttcggcttcctcagtctgatatttagaggtttaaagtagaaaagccttcttcaagtacaacaaaacatgaggcaggatcaagaatggcttatataaaaccagcctgagtactgctttaaagtttataatgggccacgataatgaaggagcacactctacagttgtaacaggttttcccccccatttcttatttgttggacttttacttttcttgtcctttctgttgcctccattgtttcctgctcatttgttcaacagggaatatttcaagtactttgttatgagaaaaagtgtgtcaatttttctttgagactgtattcgtatattattttctactggttctgtttcttaaaatgtgattagttctattacacatgagaataaaaatgttcagctattggtaaggtctataaatcagatttgaagtcgtttgaccttaagttcttagaagtttgacttgaagttctatgttttcactttacatatttttgatcttttagtctgaatttttaaatttaatattataagcatcttccatttcctaatttttctttaaattttagagataaagtgaaaggacagaaacattaggaataagatccttgttttaagtatgaagtgaacccatatttggtaaaatgcgggctgatggactccttaactatttcttcatatctaatcttcagtatggaggcttccctggttgctcagacagtaaagaatctgcctgtaatgcaggagacccgggttcaatccctgggtcaggaaggtccttggagaaggaaatggcaacccactccagtgttcttgcctagaaaactcttagggacagaagagcctggcaggagacagcccatggggttgcaaagagtcaactgaggatgcacacatacacaatcatcagtatataataactatttcacattttaattcttggcccagaaggaatgtttttaaaagaacagccttactcatataaaaatatca

SEQ ID NO: 61081 - DNA, 942 bp, Bovine  19866880839209
aataggtgtgatattttattgcaaatagttaaggtggagcttgcaaatttgcatttcaatagttggggaaaactggtcggaagcttataactctcagctgtgataatgttattggctttttaaaaaatatcctcagtcctgtttctcacctttctttcctcctcttttcttgccctaccctccatcctatcctatgccaccccaccgaaaataggaagaaggtcctgcttaaaaaggattttgatcgagtcactatttttaccttagaatgctttctaccaaagtcgcctgcttaggattattgaaatgacccatatttcaagtataagctcttgctaaaagagaggctttctgcctagccagtgaagtatgaccattatttaccagtggcggctgtcagccgatagagaaatgctgctttatttgcgcagaagaccaggccaagagaggggagttttctcaccagttcccagacgagccagcgtgggtctttgcttgcctctccctcccaccgccgcttccaactcgtttcctacgcgccccctccccttctctctcccccgactccgaccccccagaccttaggagggtgacgggttagggtggagaagcgctgcgggggctcggtcgggaactgccttttatgggcaggggtccgtgtagcgtgctccgccgccccgtcggcggtctgagtttcgtggacgtgcgggctccacacctttcccgctggcattgagccgtagctcctgtgctagaggcagaacctagggacggagaaatggccctgctcgaaatcagctggcttctcggttcgtttgcgggtatagagccaggatttggggctccaccctgtcccctctgctccccccaccccgccaccatgataccctggctctttagaaacgggatgcatttgtacgcacgagtgtaatgcctttttaa

SEQ ID NO: 61082 - DNA, 1230 bp, Bovine  19866880976159
ggaggagatggaagggggcttctcccaaggcttcctccatttaggttttgcacttgcccatctttcagctccatggacctccaaagtctgctaccgtcatgtctccccagttatgcttgccagacccccaacgaggcacaggctgtgtgcgtctgagtctaacccattctttcagggtgttttctacagcagagccttcaggtccctaggggcacaaggcattctatttcacagtagtctctttcccaggacagagcagggacggccagacgtgccccactcaggcagagtctcctgatgcacaggcagccatgactccttctaatatttcaactccactacaggcatgctctctccactaacaggtgattttctcttggggagcttccgtctcttcctctaactgagtctctctggagaaacgcacaatctttcaatcagatttgcatttgcctgaaccccaaatacagtctgggttcatgtcttctaacacatactcataattccagaacttaaccaagcagctgtttcacgatcccgggctttccgtgacaagtaaggagttctcaaaacagtctatgccatctagaggctgctctgcccagagcattcaactagacctgccggaaaatgcctcactaatgccgcttgccagccttatggagtgtgatctctgacccaggccgatgccattctgcacagagtgtgataaattccataatgcaagtcttccaaaagtatgataggaatgcagagatgaaactggatttgagacggaaagaaaggtccatcagttgagtcctgtaggatgaacaccatttccagacaagcagctaaaggaagaaacagttttcaatttggaagtggcagaacaggaaaaaaaaaaaacaaaagtttagagtctggagcttaaagagtcagaaaagaatatattatataaaataaggagaagaaagaagacaagatacaaaggggaatttttacataaactgcacagccacacaatgcagatatttaaaagatagaaacagagttacaaacattaaacattatccttctagtgagttttaaacatatgtgatatactgttaagttaacatggtttaaaactgctgtgtacacaataatctcacttatagaaaaatttgaaactattcggatagaaaaaagttgaaagcagatgttaaaaattgctatctctgattgctagaaatataataaaatttaatt

SEQ ID NO: 61083 - DNA, 1093 bp, Bovine  19866881063739
cccatattataaatatctggctccttctcttaagtccaagtattgtgttgctgttgtaaaccttcttctccactctgctctcaacactcccgcccccgccccactctttggctgctctcagctgacactaaagattcagaaggtgcaaacacttggctgccctgaaacctccccttacctgccttctatgatccaaataactggcaagattaacgtgacactaaaaatcagctctttttcctaattccagggtctacctttcttcctaccttattgaactttccccctgtgacggtcaagggacttttcaaattcgcctcctttagactggcccatttgcaaacagacacctgggccaagccctttttaatgcactgcctgtggtccataacccaactgtggccacaaagaaagaaaatgccctccaggtaaatgtgagggtaaaatactaacctcaaatcaagctttattttcaaagaagggaacaagtttttatgatggatcatgttttatagaacaagattctatagggctgtttattatttaagggaaaaaaagccttatgaacatatgtcataacacaaggacatacacttaataatcttagttatctttacccttaagccttttgtagatgaaaggtgagttgattttctcttctctggatgtgtaaaacattaatgctaagagaggcttttatattcttatccgattgatagaactctgattccatttgctatacatgccgcacagaatatgactgtgtatgctatttgaacttataccctaaaaaaatgtttaagcagtccaacattttagattaagatacagtcccagaaagggatatagttacaaaaagcatcagtcacatctctgaataactgaactctttattgataggtttgaaaattgcaatatgggtgcccgctaaccactgataataaaattgattatgtataacaacactgattattattataatcaccttgatttagggccttaacaagatcattctctaggagctgaggaaggagtatatttactagctgcgatcaaaatgccaagagatctctaatgtccctttgactctaca

SEQ ID NO: 61084 - DNA, 2153 bp, Bovine  19866881134262
tcttccagcttggggtaccacatgcattccttggcttatggcaacataacttcaatctctgctctgtcttcatgtggccatcctctccctgtagacgatgtggtgtctctacattatcttccttctctgtatgtctgtgtgccttcacatggcgttcaattctttctgtgtgtctatgccgtgatttccctattcttgtaaggacatcatttatatcggactagggcccaccctaatgacatcatcttaatgtgatgactgctgcaaagaccctatttccaaataagttcacatccacaattacccaagattaatattttgacatatcttttggggggacacaattcaatccataacaatcaaatttacaatgtaaatatctatcaatgaatctactaaatttttggcacctggtacacattggctaaataaaatgttctttcttatatcctactgaaatcctcacattgtcatttaaaattatctaatttactattgattcaggaaaacttagaaataaatgattactatcatatgaaaatatttgaggtacttgaaagttgtattgtcacccttagctgtgtatttctccaattaaactattcaaatacttttccctataaatcctagtttctagctcttcaatcatctttgttactaccctctgtattccaacatgaacttataatttatccaatcagaaatacattttgggctatgtcagacactcaaaagatttactatgcaatatcatttttcctaaacccctgtttccttttctttgtaacattttgtccacattgttaacatggagacattaaatgctttataataaattttgggtttgaatttaatcatttttaatgagaaattatcaaaaatatggctagaaaattcatctgtaaacttgatgatttttttatactttaaaaagagaaaaaaatcatattgaaaattgctgaagtatgacctgacatgtttcacctaacctccaaagataacttttctgttgtgttttattaaattctgtgaggcacagcactctctgtcaattcagggctctctgctacctatgggtcttattttacatcaagagcagctgaacttcacacctatatttgccacccttctggatccttcctcctgagcttattaacaacatccagcaactacctggaagacatactgcaagaaaaaattaatgttttctgcaaggagcaaaaaagctttctattcccatatgtcagcactgcagagcaggcctattgccaaaaactaatagcatttaaacaatagttcattcaggtgagagttatgaaaatgctcctcttctgagatgattcactagatcttattattcaaaagtgagaataaaattggttgattttgcatctaaaaactgaacgcattgaaaacgaagccagagatctgatccttagtccaagatccctagtccaagtttctcacataacttgctctttgacaacgaattttcacatgacctcagcatctccattttctcacatgcaaaattaagagaaaacaacctcttacctactgattatgaggataaagagaaatcacaagcagaataactcagactgtaaggcgctgagcatatttcagatgttaatatgccaacttggaattttaaaaaagctaaaatctataaatcaagaaaacgacaaaagagcatcattgctgattaacggttactcaccactctgtgtctgcactttgggaaattatctttttatgttctctttgtgtgtggactttcaacccagaatatagtatgaaaatttcatattattattgccttacattttttctgataaatcttttctcccacagtactttgcaggagagaactatatgctgtggagttcaaggtcatagaaagtcacatatccaaccttctgggctgaggagtaataaactcagtacagcactttctcctggtttgagacttaacatctgttgccatctagaaatgaaaatgcagttttgtgtatagaattcaaacacgtggaaccagctaagactgtaataaggaaaagtaaaaacgattgttaacatggaaccctgttttagtacaaaattatcaataaagttgatgaaggtcacctgacttgagtaaatgttttgacata

SEQ ID NO: 61085 - DNA, 950 bp, Bovine  19866881651403
tagccccaagtatcagttggcattttttccctaggtttattttactcacttcgtgtggcaaatgtttgaattggaaaacaagagagaaaccccccagcgtagattcacttctctgttctcctatcaggcgggagaccctcacaggctgattagtcatagaggcaggcttctttgttgatttaagagttcatcaggcgagacgcaacaattaccttgttgcctttacttgattctctattgttgacttatatctggaatgcctccattgtacaaaattcgatccaaaaatgaaaaaaaaaaaaaaaaaggcaaaaaggtaatgatggcaatagaggtttctgttaactgacttttgtgtgtagatggtacatacctcacaaatgtatgaaaaacattacaagttataaagttttgtatatatttgtgtatgttataattatgtgctaatgatagcattatttaatattgtaattccagaaagaaatgtttgaaatgtcacttcatactacactgtaatactctccttccaagaaaataattagcaagcttcaaaatgatattcagggcgctttgtaataagaacaaaatctgaaacttcatggaccaaaatcccatcaaacataatggttcctaactaggttgctacaggtcaattctataaggagataaccttctgttttgcacaattgcattttatttcagttgtgcatttaaaatatgtattctacatatgctattctgaaatttccagtcacatcatatcagcaagaaataagtcctagataatgcctaaggatgactatgattaactttttgtggtttgacagtattgtgctcttctttatttaaatgtaaatattaatatattaatattactagatagcttcatcaccccatgatttacaagatattcatataaagtgaaagagtgaatattacgttctataatg

SEQ ID NO: 61086 - DNA, 1156 bp, Bovine  19866881658675
ttcaaataggcctgtgttaaaatttcagttctggtattttttagctaggtgatattggaaagctctctgaccttttctaaattctgatcttttaaaatagattttttatttgcaaactagaaagcgaaattctctcttacaggagtaggcgacttaatgaaatatacctaaaagtacttggtataatattgatagatttaagtgttcaataaaccatatttgtgaaatgatctttgacatgtaggaaaagttttggaaggactgctactcaatttaattcacatatagcaaacctcttataatacaattctttctgctatttcttctttcaaattctttttgaaattgtgccccatctctctccctctctccacacacacacacaattttttattttacactctggcttccattatggtgggataggtgtaacagcttcctaatgtcaccctctgcctatccagctttactgagccctttcaaatccgtcttccatgctgactcctttaaagtttcctaaaacaaaattctcatctcctattttaaaaactcactaacttctcattgtttagcaaatgaaatccacctttctcttactccttttcagtgttcccattgtaatatggtcatgccttcctactgccaagatcagctgtagtcagccatagtctttgccacctgtttcttcagcttaatttagtgatactctttcttttatgaagcttacttttcccagcttcatccatgccatgctctgctgatggcattcctataaactagtcatactgcctagaatgctctctaatattctgttattattattttctttgagtccttgcttgggttattaatcaattaatgaaagtcaacttccaagtttgtctgtttcaccctgttgtagacccaacatcaacttcaactgatcccaccgggatctctggagctaaaatgacccatcacagttgtcttgagttagggggaaatggtctggcctttataatcttgcttcagtctatcagttaatatgcccccctctctgaaaggtttgaacttggccaaggtggctttctgcagccaaagcaaggaatgaaggggcacacaggtgaaggctatttgctgacagcactctcagtagctgagactacaaattcttatt

SEQ ID NO: 61087 - DNA, 738 bp, Bovine  19866880454048
tttgaacagaatcatcaggtgattctatctacactggcatttgagcagagcttgccaagcctctctggatcagtttttcctataatttgcgtcttgagtcagatcactaccacatccccatgcaatagtccacatggatgttattactcctctttagagaaaaagggaaactgggttcagggagccgactcactggccaaaggtcacacacatttaaagcggcaggggcacccaggttccaagcctcccagtaattccttcttctgaggcgctatcaggcctgatcaatagtttccgtgggccatgcagccagagtctagggctacctgttcaccagcctcgcattattctttaagagaccacgggttttaacaacatccttgctccctttgtttgtaatcagggaaaactccttaatctaggtaatttatttaatgagtagctccaaatactggttcccaactaccaagcagtttaatacaaaaattacaggctagcttaattgcacttaaccaagtaagcttgtgaacaattttctctcattatttctcattgaagcatacactctcagcacagttctctttattaataaaagcaaagagcaactgtttgaaaaccttcatgttccctgatgtcttaaaatcctgatctacctgttaaatccagccaatgggataaaggaaaaatactatatataatagttatttcaggcgaaggctttctcacataaacttctca

SEQ ID NO: 61088 - DNA, 1765 bp, Bovine  19866880497896
ttgtgcttattttccatttctatataactttggagaagtatctttgcaagcccttcggatctcctccacacacatgtagtttccctgtcagccaggaaaatgaggaggacagattgtcttagtccttttatgatgctctcaattccagtgtctccctattacactcttggctggttggctgctcaccttaaacttggtctaaaaaagctgaaggtttttataatctatcccaaatgaaatctgccatttttagctgtgactgttcctggtgtttgccacccccacttcctccatctctgccccaaggccaatcagtctcctttgacagcaaagttgttttttcattacagcttgcccaaggtgatatggctgtaattttgcccagctgagctgggggaggcaagcataggagcagccccagagaaacgatacagactctcattattcttacccagagctctctcatttttgtgtttcagagtaaacgtttcttaattttctgcctttgggtaggtgtttacatgctgaaacaattattttttaggctgtcttgcccatttttatgcttcatgaaagggaatcatgtgatcccttcatgtagcgattactagaagatcaagtctgttttcaaaacagatttgttagagagtgctattgctgctgctaagtcacttcagtcgtgtctgactctgtgtgaccccatagacggcagcccaccaggctcccccgtccctgggattctccaggcaagaacagtggagtgggttgccatttccttctccaatgcgtgaaagtgaaaagtgaaagtgaagtcactcagtcgtgtccgactcttcgcaaccccatggactgcggcctaccaaggttcctcagtccgtgggattttccaggcaagagtactggagtgggttgccattgccttctccttttagagagtagtgttcaataaatatgtgttgagcatagttaactgaaaggcaggttttgtgctgaagagccttcagagagtgataaactctgcgtctcaggataccagatgattctggtagctccataaatgtttgttgaatgaaaaaatgatctgaagcaacaaccaatgtttcctttgcttttataagagtgagaaattggagaggactaaacctaaaattcctttgaagctttgttttgataataaatgtattgatttacctgaggccttgtattagattcagctaagataataaaaatccctttctcttcttgtggctcaactggtaaagaatccgcctgcaattcgggaaacctggcttcaatccctgggttgggaagatctcctggagaagggaaaggctacccactccagtattctggcctgtaagtttccatgaactgtatagtccatggggtcgcaaagagtcagacaggaccgagcgactttgactttcgctttcaagataataaaaatccctttctcttctatatcttaaaaaatgcttttcagaggttaatactacttttaaataaatctccataaaaaagcaagtagaaagattacaatctaggtaacatttccctgtgatatctcacgcccctttctagttcagacttctgcacaagctcattagaaggtttggtgtgttcagagaacatgttaactggatgtttaattttcaaatgtttctgggcttcccctgtggtccagtggttaagaatctacctgccaatgcagggtacactggttcgatcccttgtccaggaagatcccacagggacatcgaagcca

SEQ ID NO: 61089 - DNA, 1239 bp, Bovine  19866880505703
ccctgtgctgggcactgtggggtctactgaaatgcgcaaagtgcaggccctgctgtcaaggaatttaatgtcccaggctgggttacaaccactacacattgtattgaaagctgctcctaacatgaaaaaaagcccttcacaatggccagactctccaaagcacgacacaaacattcctcttttgtagaacacactgctccttttggaaggaaagttgttctttcatccaactgtcaatagacatagtgtttgctaagtgtagggcgccttgctgggcataacggggggcttaagatggcaagacatgggtcctgacctctaaggctttatctgtgtacatctaaagccccttaatgtcagaggaaatatatagcaactgcaatattttttgttaacataaactcttctaggatgtctgttaacccaagtaatgattcttaactacaactcatacagtttcagacttagaaaggagccttgaagtcccccaatttcacaaccatttataaagggtagatccagagacattagctagtctgcccaagaatgcacagattgttgttgttcggtcacacactcagtcgtgtccaactctttgcaaccccatggactgtagcacgccaggcttccctgtccttcactaacttctagagcttgctcaaactcatgtccgttgagtcagcgatgccatccaaccatctcatcctctgtcatcccttctcctcccaccttcaattttgcccagcatcagggtcgtttccaatgagtcggctctttgcatcaggtggtcgaaatagtggagcttcagtttcagcatcagtccttccaataaatattatgttcattttccttaggatttatttgtttgatctccttgctgtccaagggactctcaagagaatgcacagatggctggtggcaaattgagaactgggtcctatgtcatccttgttcctcatctactacttgctctgtgcagcctgtctctgatatcaacagatgcaacaatacaaacacagaatttaaagacagagaaagacccaggagcttcataggcataatgcgagaaaatccaggcatctctagtgaggcctttctttaggaaaatagatcgcaacagttacacaagggctatgtcattgccaagttcattaacaatgtgctgctgctgctaagtcacttcagtcgtgtccgactctgtgcaaccccatagacggcagcctaccaggctcctccatc

SEQ ID NO: 61090 - DNA, 924 bp, Bovine  19866880660568
tgcagcaactcaattgcccagaaaagaacaattgtgagtttatagctggaatgctgtttgcttcacctctcaaccgtgggctttcacaagttttttgttacttctgtattgatggttgatgagacactcattcccttgaattattaaaattacagattgagctggaaattactcctcttgaaagaccgcagggaaaggaggagggaagggccatgggtgagaggaaacagctgtctaaaatagtttagccaaggcttggaacctgctgtggtgaaattcctccggattcttgttctggagagattatcagtgtaaaaatggcaagaaatgacagaatggtttttttgtgtcccttgtgtggtattcttggatcagagctgggcttatgagggacagttgttgttcagtcgcccagtcgtgtttgactctttgcaaccccatgaactgcagcaagcaggatagttgaggctgagttgaaattgtgagcttctctcttgatagaagactgagttttacctcgaaacgaaacctcatcaagtatctattctgttcaagtcttaagtttatagttaaagaagcttgtaaataatgaaccaaacccaaatgaaattttcctgccctatggaaagaaagtgaaagtgttagtcgtttagttgtgtccaactctttgtgaccccatggactgtagcccaccagccttctctgtccatgggattctccaggcaagaatactggcgtgggtagtcattcccctctcctggggatcttcctgacctagggattgaactcaggttccctacattgcaggcagattctttaccagctgagctaccagggaagctctttctgccttatggtctactgaaaactaaagaaaataatagtgttttgggagagaaaaaaactttcttaccaagttcagag

SEQ ID NO: 61091 - DNA, 1865 bp, Bovine  19866880674243
ccgtacactaggcttccatgggctcaggaggtaaagaatctgcctgcaatgcgggagactggggttcagtccatggattagcaagatcccctgcagaagggactggcctcccgctctggtgtttttgcctggagaattccatggacagaggagcctggtaggctacagtccatgggatcacatagagtcggacagactgagcaactaacactttcacttcacttcaccatactgttaaaaatgattaagatggtaaatcttatgttacatgtttttcaccatcataaaaataaaataacatgaatgtgtgtgtgtgcaagaaaagattggactgtcacaattatgaatgtttaatgaatgatctgagctgtgcgacttactccgtttccatatgcctctctactctttttcactccctttatgcttttacaagcaaaagtgcattttgcaataagctgaacactgagaaatctgatttcattttattgcttttaattttctgccttcattttccccctctttctcatggctctcttccttcttgggaacaatccaggatatgtgacttctgaatgtaaatctacgtgcccacttacctatctcattttagtattttccctgatgcatacatttttattaatttttattgggtatcccaggtggctcagtggtaaagaatccacctgccaatgtgggagatgctggttcaatccctggctcaggaagatcccctggagaaggaaatggcaaccccctcccatattcttgcctgggaaatcccatggacagaggagcctggcaggctatagtccatggggtcacaaaagagtcagacataacttagtgactaaacaaccacaaaaaatagttgctttacaaggttgggttagtttctgttgtgtggcaaagtgaatcagctatatgtatacatatatcccttctttttcagatttccttcccatttaggtcaccatagagtctcttcagtgggccagtggtaaagaatccacctgcaatgcaggagacccaggttcaatccctggatcaggaagatcccctggaggagggcatggcaacccactccagtattcttgcctggacagtccccatggacagaggagcctggtgggctacagtcatagggtcacaaagagtcagactcaagtgacttagcacgcatgcatgcagagcgttgagtagagctccctgtgttatgcagtaggttctcactagttatctagttatacatagtaatgttgagtttatacataataaactagggcactaggaacagtttactatgtataaactacatactataatctgtgtagtttatacacagtaaactagggaagcctggcgtactacagtccatggggtcgcaaagtcggacacgactgagtgagtgaacagcagtatgcgtgtatgttagtcccagtctcccagtctatcccaccttccctccttgctaaccgtaagtttgttctctactcctgatgcattttcagtgtcttttgttgggttccttctggttggctgtcttgcggtccctgggactgagttcgcctctctgctttcacgtgtagggaaacttcagacatgccagcagccaggcccccgtgtcccgggaggagctgatgaccgtgctgtctagactgcaaggtgtgcacctccggggcctctacttcactgagacgcagcggctcaccctgagcggggtggggcttggaggaggcctcggaaacaggaagtggacgtcgagcacagagcgtggagatgtgtgcctgcccccctgactacacaggtgactcatgtcaggtaggagctgcccctcaaccatcgaatgccctggagggctcttgggg

SEQ ID NO: 61092 - DNA, 1523 bp, Bovine  19866880681685
aagggcaggtataagaggaagaggcagaggtctgcgcgcagccagcaggacgcccagggactacgatgcccccggcagtgaggtggtctgcccggagtgcaggatggctctggatctttggggcagccctggggcagtgtctggggtacagttcacagcagcaaagggtagtacttcctccatctccgggtcaaaaccaacagcaagcaagttatgtggagcttaagcccagccaggtaacggcccttttacgttttgctttgggtggggaagggttcccagctccctgagatttcaaggcagggtgatgagtgagaagtgggtgggctgggggaggggccgatggctcccccatctgctgactggcagtgttcatttcggtgcctgacagatcgctctcctgggctgttaaccacaaaaccctataaacatcagcccacctggaaatgccgaggcagctagagtttgaatgcctgtgggatgttcatgtctaggaaacttcgtgccctttctagacgaacccaaggcttaggataagagtctggatgcttgtaggtttccaggctctgcttgggagaaaaattgcccataaagtaaactctgagcatcagtggaatccctatttaagattaagaaaattgatgagatcaattttgtgtaatacctaacagatgtgcttcaattagccgggcattaaacattcataaattctgctttcactgtatttaaatttcctggatagtacctgtatattcacagagaaataaacgctatggctgctaaagtgacccaggaaacttgatagagacatcatttttatcatttgtactacaaaagtttattggaaaagttatcctgaaaaattgtgacttaaaaaattattagttgcaaagtctctttactgaagtaacatgttgggacacattcgttttcatttagaacaagtcttcaatacagcctgaatagttgaacagaatcgtatgttaaatgtagagtttgtgtgctttacagaggtgagaaaataattatattcccataactgacaaatgttctgagagtcacatgatacatagttcttgtggagtgtttttctatttctaagcaaaagcaaattaagatgggtgatttacctttaatcaggatagaccgtcctcacccaccaaagaatatttaattaaagcttttactgggcatgttgtcataaataaaccatatatatttattatttagataatttgttctttattaaatcggataattttataatcatgtaatggggtatatggtgataattataaggcccttgtgccttcttagtagagattttttgcagatacgatcataccaccactggctgaattaagttcaaacgtatctctcagttgtgctttcagctcaagaacattccctttcatgtttggattctccttagacaagcccattcagtaatcctaagttgttgtagtgcattcttttgcctcgacatggttcctaatagctgaagggaaaattatattggaaat

SEQ ID NO: 61093 - DNA, 3760 bp, Bovine  19866880758385
cagctctgtggcctgtgctctgtatttgcaaatccttcgtatgttcattggcaagaaagattttgatgctaacaaaaaaatcccaaaactgttgaacttgatgatacctaagatcattcctagttctaataaaggtataaggcgccaaaggggctaccaagtaatatctactaaactggttgtgaaattatgcccacactggctctgaaatttacttaacaacttggaataatgggacaatggtttctattatataagtgtaaaaaatgttttcgttctgttcctctttacaagagattctattactcaacccaagtgactaagaaactcctgattcttttgaaaaattttcaaaacttgcacattttactgcccagtttctgtttcttaatggaatccaagatgtcactttaacacactgtatttccatgatgtgtgctgtgtatttggaagagtaaaggcactgtctaaatatccttgatccatgatatatgtataagcaaagctcctataattcacccaaacaaacaactctgaacctatttcataccaaaatctgtaactctactttccctcttacagaagggacaagtgttttagctggataaggaagagagtttgcttaactgacatcgacctgtgtgaactgtatagaaatattttaaccttaatttccaaatagtccatttgctttgcacacatgcagccccttcagcttgaacttggtcaaaggaaagtacttttctctcaggcctggggacaactcgcagggtgcggtgagccccgctctgtagtccacacatctgccagcaccccacctccatccacacaccccagcccctcagcgcacctcgtcttccagtcctcctccgacttggacctgttcttgcgggccgctctctgtttctcctcgagtcgctttttttcttcactagcttgatctagaatcagcgtagcagtgaaaaaacggttattgtacaagcagaggccacccgggacagcccctgcacactcactccatggaggcaggtgtcagcaccgccgtcctttatcagaacaccagcaccacagtcacggcctgtcgacactgaacacagccccaggccgccgagaggtggcgctggcatccggggcctctcacctgcttccacagcctgtgtttacccaaggagcctgcttattctgaaggcctcagaagtcatgttaaaatgcttccctgagggtccagaggctctgcacttgcaaggcaggaggcccaggttcaatccctggtctgggaacgagatcacatatgccgcaactaaaagattccacgtgctgcaactgaggtctggcaaataagcaaacatgtgcttagtcccatcagtcacgcctggctctgtgcaaccctatggactgtagcccgccaggctcctctgtccatggggttctccaggcgagaatactggagtgggttgctatgccctcctccaggggatggatcttcctgacccaggatcaaaccccagtctcctgtgtttcctgcactggcagcaggctctttaccactagcatcacctgggaaaagtacaggttgctcagtcgtgtccgattctttatgaccccaaggactatagcccgctagtctcctctgtccatggcattctccaggcaagaatactggagtgggttgccattcccttctccaggggatcttcctgacccaaagatcgaacccaggtctcttgcattggcaggcaaattttttatcatctgagccaccggggatggcttgtgctaacacctaaaatgctaatatgtaagatgcttgtgcgaacgtataaaacgttcagccctaacagactaaaacacagacagtgactgggagtaaggcaaaccatcctcctcaaagaaatccaccttccctggagccgccaggcacgttacctatctccccgttctccatggctctgatgtcaggccgcagcctgcagtctgtcttaggaatcacgctctccatctccttgtctacttcattcaaaaccattgcaaagctagtaaaattgtacatctaaaaagaagaaaatgttcaaattaacatgtactggaggttaatgcagaatgaaaccctgaagctagaagatttgacagggatcccccactctgctccagggtgatgatggccggcctctctgcgcccacacatctcccatgttttcacccgggtctgtgccagctgtgggagtctgtctcaagcaaaccccccaggtgacattcaccaccatcagctccagggagaactacaagcaaaaccaacagtctccattccacatgaaaagtctcacttggatctggctgcgtcactacgcacttaaagagagtcaatcttactcctcagtaagtgtagaggaaacccctcaaaggcccacacccgtatgtatggaggaagccccccaaaggcccaccccaaggcatctcggccagacaccaggaggcctgggaggcagcaatgccaagtcctgggggggaaccacagagggatgactgaggagcaattcgatgacccgcctctcacccccgccctcctcctggttctgaccaggccggggaaagagcgccatcagatccaagtaaacaggaggccttacctgggctgagttcggaggccgtggggctattcgccacaggagaacgctcccggggatgacgaacacgctctcggaatccggcattggcatttcatccgactcctcagaagcgctcatctggaagaaccaacagaggaacaaaactgaaatgtttaaaaagatagtacttacaaccgtgaatattcactggaaggactgatgctgaagttgaagctccaatactttgaccacctgatgcaaaatgctgactcaccagaaaagaccctgacgctaggaaaaactgagggcaagaggagaagggggccggggggcagcagaggattagacggttggatggcatcaccgactccatggacatgagtttgagcaaactccaggagttactgaaggacaggggaagcctggcatgctgcagtccatggggtcgcagagagtcgaacatgagttagtgactgaccgacagcagcaacaaattgtaaaatcagcagttctcactgtgtggcattagaatgtaacccgtgagtgccagggcactgtatctttctcattctcgtgtcctcacctttcaatccaggccaggaagccaataaatgtgggtcgagcgaccgagtccatgctgtgagcctgcgttgtgtcacttttaggggctatgagcacgtaaggccttaccagcaccactgtcgtcatcacgccttgactgtcgtgttttaatatttttaaagctttttttaaaatccaaaataactcatttaagtggttcgtggaacactattagggcaaggaaaggttaaattcttggagcatttaactaaatttatcaatgacccaaaccagcagggatcctgaaagtattcaatcaaaagatgttaagctaaaaaagaaagcagcatttccactagctgcctgctccctccccttccccagcagagctatgccagcagctctctgtatatttagtccttacgtaactggcccataaagttttatatataaagaatttaagcctctggaaagtgaagtcatattcccaatgtcattgttaccaaatctagaactactggctgagacatggaattttacaaacagcaaccaggaggggacgacactggtgacgagcttcgcctggcatctga

SEQ ID NO: 61094 - DNA, 830 bp, Bovine  19866880840733
aaatatatgaaagcacttaacttaagcaggacatcttccttgaaagttatgattaaaaattcttaggaaggttatgcagtcattatattgactgcatccttcatattgatatttatgtagaaatcttagggtaatttgttattggattagaaatccaatgtcatcgttttctgaattgtccctgaagtatagcataaacttggccttattaaacccacagctgcacagcaacgtatgttgttctttaaaacatgcctgccttcctctttctgccgtttgcctctttatctggtcctgccctattgatcccatttactttatgggtttgagcaggtagcaagctgttggtcttttatccagaaattgttggtctgtgactatggctctatctcagtatacattgtgtttaaaattttatattcactgacctggtttatggtctcagctgagctccattttaattctgctatttacttgcatttgaaggccagtcggtcacttataaccttagtagatttcttatgtctgttggtgggcttccctcatggctcagtcggtaaagaatccgcctgcgatgtgggagacctaggtttgatcctggggtcgaaaagatcccctggagaaaggaaggataaccctcttgtggattctgccagaagaattccatgaacagaggagcctggagggctacggtccatgggcttgcaaggagttggacatgactgagcgacttccactctatgtctgttggaagcagacaacaatatatattggttctccatttatgtgttcatttattttacatcttctgcactttgtaagcaaggctt

SEQ ID NO: 61095 - DNA, 1849 bp, Bovine  19866880876667
tttttaatttaaggagaattacaatgttatgttggtttctgccatatatcaacatggatcagccataggtatatatatatatcccctcctccttggaaaatttactttttatagtgtcaagaaagatgatttgatatccagaataaaatatatgatgtatttacatattatacatagaaatatgtgtaacatatatttctataatagaaaaaaagtattacctgattctgagtcatcctatccaatgtgtgggacccaaatataccacttgacaaatacaatccacgagaacatctctatttaaccttttctcaactcacaatgataaatttctgtttcgtaatctcaccaacagtgaagaaattaactaacaaactgcctgatcttttgagtaaaattgaaagtatcaaccaacagctgttgccactgggcaacatctctgacaacgtggaccgcatacgggaactaattcagcaggccagagatgccgcaaataaggtgggtgtgtcccctcattgccaggcaccaaggctcattctttgataagttactctattagaattaatgaaactaactctgttagtttcactaattaagaagtgaaagatatccaggtacccaagaatcagttgtctttcttgcccaaattctttgggtgctccccatgtgaaagttcattttctcccatcatctttcagaagttcatatcatcttcatcccttaaatgacctggtatgccgggaacagtggtttcctttctgctggcttatgcaggcaggaagcagggttctcctccaggctctaggcagtaaagtgttattgcaagttcaagtaagggttctatgatcagaacgtgtagatatgatactgcacaaaccctatattctcacagtaactcgggaattgtggaatccatttttagtgaggatggaggagtggttcctaccactcccacatgggcagtgttctgaatatgagattacagcagttttccttcattgggaagttccatcaacctttcttctaattttaatctgacattatttacttgaatttcttctctcactatttgttttatcctaaaataatgtaaatgaaatattttgtattttgtagtcaactcccctgtgagatatttggagattagagggatggaaaccaagtcagaatatcattgtctttgaggcaccatggttgatttctaggcttatattccttactttgagcctcacaatctgccttttcttttaagaaagagaacttcccaacacaaaacctttagcagagaagcaaagagcctaaggcacagtttggcagaaaccaccctcttcgtacccatacgcgtcttataaaaagcaaatggaaaagagtatgcttctagcttttgcctctctacgttcttccactaatttaatgaacaaaatatgaagtgtataaatagcgcagaggtttagcgctgataaccaaggcagactgccttgcttctttgttttttaatgtttatttgtttatctgactgcatcaggtcttacttgctgctcgtaggatcttcactgcagcatgggtttctctctgtagcgtgtaagcttagttgctctgaggcatgtgggctcttagttctccaaccagagactgaagctgtgtcccctgcattggaaggtggattcttaactactgaaccaccatggaagtccccgcactgccttgttttgatccctgctctgtcacttacaaagctaagactagtttcagttcatagatagataatgtttcacaaaagtattaaagcacacatgagaagctgtgtgggaatccagatccagggtagaaggacctctagaagggagag

SEQ ID NO: 61096 - DNA, 1492 bp, Bovine  19866881025561
ttatatatttgaaagtactaaaaaaggagatcttaaaaattcttaatgtacagaagaaaatctgtaactgtgtgagttgatggatgttaactaactgtggcgatcatttcacaacctatacatatatcaaatcattatgttgtagactttactacaatgtagcatgtcaactatatagcaatacaactgggcaaataaatggtgaacctatgcaacctgttgcttattttgtatatgggaaaaggaataataaatagcttttatttactgagtgcttgctatttaccaggaatcatgataagggattcataagcatttttccaacaactatatgaggttagtatagttattactaacctcagtttcaccattgtacaaatgatgaaacaggcttgaagaagcaaggtcactggcatgagatcagacagatattagttggcagagactggatttgaccctaagtagccctgctggagaagggcatagcaacccactccagtattcttgcctggagaatcccatggacagaagagcctagtgggctacagcccatggggtagcacagagctggagacgactgaggcgacttagcacacacacacagccctccttccacctcctcccaccttctcccaccagcgctttcccatgtcacagtctggggttcacagatctgaagctgaaccccacaacctggaaaggaggagccactttctttactcaccatcacattcttctccgggaccactatctttgggttcctggtttatgcagtctgaaatgaggagtaaacaaagaaggcagtgctactaaacttactcttcatgtactttttaacttggcttttaggaaagctagtttcagaaaatttcagtcacccaaccacccagtatcgccagctcttcccttctccctccttcccttggggccactgttctgagagctgtcttggatcccagcagtctggctgcaggaatgtctcttgtggcctctctgatgatatattgcttcttctctccaaagggtcatgtgattcctatgaagttaacactccaacttgttactgttgccttcatttggtggcctcttatacaactgctgatgtctcttccaatatcattcgagaacattcaatagacactcactgagtgcctttgagcactccctaagttccatggcccagtgctaggggcaggaatacaaagatagaagacaaagtctctgctgtcctataggcgcgggttcaatctctggtcagagaactaatgctccttaatggtcagggaacgtaatggtcctgcaggggaggtagacacattttacagcagtgtgacagatgctataagggagatatgcacacacagtggactagctacggctaaattcttgaggttctcagctacagacaggaaagccctaacggtcatccttggacattcttcactctgctaacttctactcctttccccataccatgcatccttaatactga

SEQ ID NO: 61097 - DNA, 1917 bp, Bovine  19866881095618
ctgctaaggttaccaggatacctaccttaaattggaatttcagataaacattattgcataggtcatacttataaataaaaatattgtggtttatctaaagttccatttcagctaagtgagagtcactctagtcatgtctgactctttgtgaccccatggcctatgtagtccagggatttctccaggccaaaatactggagtgggtagcctttcccttcttaaggggatcttcccaacccaggaattgaacccaggtctcctgcattgcaggcggattctttaccaactgagctattagggaagcccaaagtgaaagttgctcagtcatgtccacctgtttgtgacccgatgggctgtacagtccatggaattctccaggcctgaatactggaatgggtagcctttcccttctccaggggatcttcccaatccagggatcgaatccagatctgcattgcaggcaggttctttgccagctgagccacaggggaagcccaggagtaatggagtgggtagcctatcccttctccagcagatcttcctggcccaggaatcgaaccagggtctcctgcattgcaagtggattctttaccaactgagctatcagggaagcccccagttaaatttaagcgttgtttatttcttcctactaaatctggtccatttgtacatgctctttcctctgaaggaatgacttcttcttgctccaccctactcttccattttgatgcagaattgtcacttacctttcaaattctggctcttgttaggtcctctctgaaccttatttcttccagggagagtttagtttcataagttttgaaacataccattagtctgcacctctcacgctggtaaattttcagagccatttctagaaatcctcatattctcatttaactttctctctacagtatgggggaaatttcttatatgcaagtaccttggacatggttactgctcagatatttcttgaaaactggtgctcaaaaattctagaactgtttttttgtaccaattagagtaattcagtttttgcccctaaaatgaggagaaaactttggaaatggctttttcaaaatgtagttgattctttaaataactgttaatttcagttcaacagtatgtttatcaatatgctttaagattttttttttagcatttacagagcaaataaaaataatatcagtttatttatattgttgctgcttttaaggtgaaaatggttcttgccaaattgtatgagaataagaaaattgctagtgccacccacaacatctatgcgtaccggtaagtgatcatcaatcactgcttcaggaatgtgcagtttgtaaaaaaaaaaaaaaaagtggggaacagatccatgatttaaaacaaacaaacaattatgtgttttttttccattgtaaaagtaataatcatgtgtgaaatatttggaaacggcaggaaaaaaaggaaaagttaaccgttctctgccattcagtgtaactgatattgtgaaatgttttctgtcttttctatgcaaagtttattttttaatgcttcattctagtatccaggtttttccttaagataacaaaagcatttttccgtgttgttatattgctttataaacattattttaatggctttatcatatttggttgaggttccataccacaatttatttaaccatttcttttttgttttagtttttcattttttaaaactattacaaagaatagtcctgtgaacatctttgtatactttttagattattttctcaggataggttctggttatttcatattcttttttgaaatgaaacagaagtacgtaaaaaggaaaaaaatgaatagattcctggaagtagaattatcaaaaaatgtgaacatttttgaaattcttaatccatattaccaaattttttctgaagtt

SEQ ID NO: 61098 - DNA, 1150 bp, Bovine  19866881102239
ttattttgaatatttttatgatgtcatgcttgaatgttttagatttaactttgaaatgtttaaaattctcctatacaaggtttatatgctcaaatatagaggtgtatgtcattttgtaaagattacattgaaaagatggcttttctttacactaatcctctcaattttgccccctcccatccctaaaaagaaaaaaaaaatgtctgagtgttcggaagagacattcctaatttgaaaattcgaagctggaaaaggtatttcatttgcttattttagtactctgaatttacttttacaattttctataattaatgtcattagaattaaaaggtgtttgaattgtatgtttgaaaatatgtataaaacctagcaattcacaaaaataccataaaaatagaggttttaggcaccatcattacataatgacaaacctttttaaatccttcaacttccagtggcaaatgccaccagagaaactcagttgtattcatgtattataaatatcaaactatataaaaggaggtcttgtgcatttcaggtttgcaaggcacctgtgtacttaagatatgtacggagacctactgtacagtagctttgcccctttaattggggcacattaatcacatggtatttatctacccaaccccagactgagattttgctcctaggggccttaggtaactgccagtaagttatttcaatggctgtctcaaagttaacaagtgttataatgaaataatctacctgatgctaataaaggctttagaatgttctaaacagtggtggtttcatttaaactttcaaatatactcataattgcaattcgcgtgatcctgaattgtcaagcatgtccttacaaagaagtcccctgtggtgcccagagtttgcgctgagtgtcttctgggtaagtacagtagaagagtaaggtgccactgtattcactcggtgtgaatgccagatagggaatgattaactggagacccttgctagcaaactgctcgagtggaaatacatattttttacagtgtgtacctaagacctggttgtgttgtttctatatcccgtaagttacaaaataagcaagatgacaaggctttatgcttgcatgaagtttattgatatagtacgcttggtggcagactccaccttg

SEQ ID NO: 61099 - DNA, 1878 bp, Bovine  19866881110033
tgatgtatggagaaattttgttgacatctctcagttaagctgagagtctgatagagggggattgttataaaagaaataataggtctcaaatggagtcacttgtgctaagccccatgtcagcaagccccatgacttgattctcaaccggaatgcagttacaatctcccccaggcatacagtcttaactggtcagtctgaaattgtctggtcagcatcagtaatctgccccctaagcccccttccgtctcctgtaggtaggttcctaagcctgaaatcatccattcttttcccccttctgctataaaaatcttctattttgtataactccttggagctcctagatggggtgcaacctattaattgattagtaaagtccatttgatctttaaatgtcttctggttgaatttctgttatttaacaggtgacatattcactcacctactaaatacaatgcactttctaggtgctgggaggaccatgacagacaggatagagaccttactctctgagggtggagactccagggatgcaggggaaatggggattaatcagtggaatagctcacaggagagaacttagcatcctcttctctggaggacagactctcatctatcttggagtgtttaatgagggaagttgtcttattttagaaaatagaaaaggagtagtgactgggaaaggtaatatttttaaagaggaaagttaaagaaaaaggctgtaaaatactcagaatgtaatgaatgcatagtcaattgtcattaagagggagactaaactggcaggggattattatttttttaatgcttctctgggaagaaagagtgtggaataactgaaaaattatgcaattagacagagcaggagttttggcatcttgcttgaagcctgctgagctgttaggcatgtgactgaaggtcgaggagggtatgcaagtagatatggattaataaacacactggagtgtcttactgagatagtaatatttggattataaagcacttttaaaaactatttgagcccatgattaattgaggctcacaaatttcaagcagtgaaatgtgttttattgcaattgctattaagaacgatcagctatccgattccttgatttccctagtgaattttataatctaaattaaacagagaatggtataaattttcccttttttgggtagctgattaaaaccaatatcatctccatatacgattacatagtagttatatctcactccatggaacaatttattatggatctgattactttcagtatttttatgaattgatcataagccaatttgaaaacttactgatctaaagtaagttcagtaataacagaatatactgcctgtaagaattattaatgaaataaatcaggatgcatggaaattagcattgctccttgtataaattatgttgtcacgaggctgtaaatcactgcctgtaacatatttctagctccagatgtaatcttatactggggctttattaccagttcataactatgcctgaataaggggaactattttctgaacagattcttctttgaaaatgttttaagaagaaagaaagaaaaaaaagaaagaaacacaagcagaaagagattatataattgtaaaaatacctaaaaacaccactattcttttaaaaatcaaaatagctttacttacttgaagaagcctatatgccattttacgtgtgatagaagtttacaaacggagagttttctcaagtttttctggaaaacaatccttgcacacaaattgctgaggcaattcatcctaacaaaatccttgagatggagaagaaaaggacagaatattttcgttccctctaactacagctgtcttcttgcattacagacagaaactaaacagagg

SEQ ID NO: 61100 - DNA, 898 bp, Bovine  19866881116138
aaactgatgccagaaaaaagatacctatctaattacttatgttggtatgtctctgtggatgaggcattgatgtcacttcagatgagggcctctccattcatcactgatgctttaaccttacctctaatcaaggaagttagagattacacatgcttttaaatgaaactacagaccagggaaggtatcactatggttgcattatttaaactctgaaatatatagtgaagtcataaagggcagtaaggcaagcaatgcatgtctcccctcctggcagcagttttcaaagagaatgacaatctgatcacagcataaacatgttaaccaaaaaatatatacgtaggcacatgcctatcattacagcctatttacagagatatttgatcattattaccataagagagacagtataagtagcagaagaatattactaaaagagtaacactatttgcattctggacagaaatctaaattcaaaacctcatattaagaaaaatattcttagtaaaacctgagtgatcgagttagctgtactggtcaagttacattttctacttacctctaaggattccttcaagtctacagcagaaactgcatcgtcttcttcatcatcagtcacttggtcttgggaacagtagtgtgtgctgtaagcagaatgctcttctattgcttccagccagtcctgagataatccaaggatttaaacaggtgaaatacacttttaactcgaaacacgtattatgacaacaacctgaaaagcataaaatttacatggaggaaaaaaaatgttagggcttcaaaaaaacaaagcagaatatacccaacaacgaagtaatgatgcacgtctctcgtttataacatgtctagataaaaaattttcccaatcctttaaaaaacatca

SEQ ID NO: 61101 - DNA, 1173 bp, Bovine  19866881119421
tattcatgggaaggactgatgctaaagctgaaactccaatactttggccacctgacacgaagagccgactcattggaaaagaccctgatgctgggaaagatttagggcagaaggagaagggggtaacagaggatgagatggctgcatggtatctctgactcaatggacatgagtttgagcaaactctgggagacagtgaaggacagggaagcctggtgtgttacagtccatggggtcacaaagaatcagacacgactgagggactgaacaatgacatgttctatgcagcatcttcaagaagagctcattgtctagagagattaagtctaggcctatctaccagcagatggtgctgacgatcactcacagagtgtcacttttggccttttctaaactaggagatgtcagaatggtctccaggaacctcagctgcttgaaaacagagaagcctccatgtcttggaaagtcaagggtcaggtagatagagatgaaatctcttacggcctgaaaagaatcagaccaagaagcaaacagcaggaggtcgaacagcttagcgttcagagaccccaggaagacttaacatttcttttaggcagaataagcaaagattattaggcaaacagtagttttcaaagaataaaactgacaacacaaacagaatgggtaagtggcaatttctcccacattctggtggcatcttaaattctggatgacttgccttaccaacgcacactcacacagccaaaaaaagtattgggttggccaaaaagtttgagtttttccgtaaaatgttatggaaatgaacttttttggccaatccaacagagtaggaccgagggaaaggatgtagctaacatttgcacattgtttttcagatacattgtttgcttataacgactcagttaccccaaaattgttcaaatgaatgaacgtatttgttaacatctggatgcttgtcataggttacctggttttctgcaaaaaacagcaaacctctgtccacagtggtctgaatcgtctgtccaaaggtggggaagggggcgtttggttgagttggaactcgagcatagcctgtaccttcaaaataatttttatctgattcttcttttctcctgtcaacaccaatcaccattaagtgagaacacagcagcaaaagactgccaagaaacaatg

SEQ ID NO: 61102 - DNA, 3883 bp, Bovine  19866881158230
agcttgagaggcatggaaaccccccccagaatacctgattacatagtataaactcaatttcttttcaaagtacattctttttccctgatatcatccttttaactcagggcctggaggctttaatcagacaataatctgaattgtggtccatcttatcatttaccctcaaaattattgtgtcttttctctctggttaactaaagaataacaacccattgagaatcaaactgcaatcagcaacaatgtagttaggatcaaattgcattaatagctttctttttctttattagttcttcagtgtccacaaaattgcccccaccagcacatgctggcttgaagcactcatatttggatcagcatgctgggcatgtttgcagttcgtgaccagcctgtgctcagttctttaacatcacctttcagtcctggctggaagagtgggccttctggccatgtctaaaccagatagccttgatttcccaacctgattggacgaatcatttataatcatcaattatacacacttgcctaatgttgagagaatcagattctttctctcaaacactaactgtgaaactctgaaatagctcaagaagtggtgatcactggaatggaaggtcttagaggttcagggccctagacagccatgacactgctctcaggagcatctgtgtgggtgagaggggagcagtggaattttataggaagaggcattatcttctcagaatgagggaggcagtaaagtcaagaatcaattaagtgagcaagtacagtataaattaaaaacatgcccttcttaggaggcaagcatgtggataaagctgttgtttctaacaatagagggtaaaaaatgacatttgactattttgaggtttaggtaccacattaaaataaactttaaacaatgtcttgtatgtagacagtagattcacaaagttaaggagtatttagcacagagatcatctggtacttcactcatggctcagctgataaggagtctgcccgccatgcaggagacctgggttcgatccccggattgggaagatccctggagaaggaaatgataacccactccaatattcttgcctggaaaatcccatggatagaggagcctggcaggctacagttcatggggtagcaaagagtcagacatgactgagtgactttacttctctcttctcatttggtgctacaaaggcctaccacttacagttagactctgtagcatggcctcataagcttctgtcactgggaccaaatctcccggcctcaccactcatgcccgctttgtgggcaatctgtactctgctcacactgggacctgccatttcttgaatatgctgtgtattttgtcctaggtcttagaagttaaatctcagcagaaatggtaacatgtgggtaatgagaaaatgtactctgagttggtctaagtcaaaagctaaaaactcaaccctatagtgggcttcactgaaagacagaagtgattagctgaataagcagatccgagtttcaaggaacgattctaggctaaaaccacaagtgtgcccctgtgaaccttaagacacttctactcagagaacggcacagacatctcattttctacatattatctgcctaacacagacacgacatgtcttgaaaaatccataagaacaatcataagtgctgctaactaaatgcttgctttgatgggacaaaattgaaatatctatcattctcttctctgtgggttctcccaggtcatttttgtcagttgtctgatcctctacaccagcttgaccttcatttcttcttgggatgctgatgttaattactactctgagcttactagatggttctaaatagcctctttccaatagctcctcccactcctgtcctgctgtgaaattgcccagctctgtagctcttcagtttcctcttttatttaagtagatctccacagacatttgaaaaggacacacagtccttttagagctgtatatccagtttctaatttactacttaagagctgtactctctgggtgaatgtgacaagctgagttctcagcccttaacaaatcatttcagtattgaaacagcgctccctaccctagggattaataagtgtgcttcctgtttctaagtaatcatttatttgtaaatatcaatgtttgtagtgttttggccagtgaattttttttttgttccagaaatatatttaaaatatctgtgtagtgtaatattgagatgcatttgaaaatgaacacatttctttttgacgagagatgaggctcaaagaaaatgatttactccagaattcactgaaaccatagttaattatgtacctccttgtgacaattctattgtttatttctttgttatttcatctgttcattcattcattcagtatctacctgttgccatctgagcattagacgtatctctggacccatggttgtaatagcaacaacaacaatagcaatgatagcaacatagtaagaagagtgttcactgagttcttaatatgtgccacacactacactaattattttagaagcactatagcaatttaaccaaaaaaccccatatcacagacaggggaagcaccattgcctgatttgagatgaagtaatggcaccccactccagtacttttgcctggagaatcccatggacagaggagcctgggaggctgcagtccatggggtcgctaggagtaggacacgactgagcgacttcactttcacttttcactttcatgcattggagaaggaaatggcaacccactccagtgtttttgcctggagaatcccagggacggggaagcctggtgggctgccctctatggggttgcacagagttggacacgactgaagtgacttagcagcagcagcagcaaagtactcttgcctggaaaatcccatggacagaagagcctggtaggctgcagtccacagggtcgcgaagagtcggacacgactgagcgacttcactttcacttttcactttcatgcattggagaaggaaatggcaacccactccagtgttcttgcctggggaatcccagggatgggggagcctggtgggctgctgtctatggggttgcaaagagtcggacacgactgaagcgacttagcagcagcagcaatgagactcaaggtcacatggttaggacatgggagagctggtgcctgctccagagctcttagcttccaccagcatacccatccggagagggccagctcttggcctgaaaccagcccgagtccagctgttggcctgaaaataagcccgagtccctttcacacggacctgactgggtctcagccatcaggctcagcagcaggttacttcctctggcacctgtgaaggtccagggtgagggtgtacatctgggtcttagtttcttctgtcttgctccctgctgtgtattttggggtcattagaccctctattccaatgctgatgctgtactcaaaaatatttgctgatttgactgcttttgtgaaaatttgcagatgaggttcattcattttctgagctccaccttttttcttatcctgcatatttaccatctgaaggtgggaactatcaggatcctgaaagagcactgggctactcactgtcgggataatttccagtgtctattaaaattctcaccttccttagttcattgagtctggagacaatgatgaagtcagtgtatcagggtgaaggatcatcaactaatattgaatctgtggctaattttccatattttgagccagatttcatcattcttttctctcctcctcaaagttaatgaagcatttctcctctttcatttcttccttaaaaaccttttatacttagaaaaaaagataatgagtcatgagtaaatgcttatacccaaaagatgcttaaaacta

SEQ ID NO: 61103 - DNA, 1373 bp, Bovine  19866881241679
caaaggtaaaaatgccccaaaatccccagtctctctttttccagtgacccttgtcctctgtgtgtactctggagcctgaattcaagaggttttgtgaaacgattgtcctggttgataatatttctggagggggaaagtcataactgaatcaggaggaagtcataactaaatcagtgagcagttgatttttaagtaaaattacacaaaaaattccgatgaaattgctcatcatgctttatagaaactcttcttgtttgagtgggaaaataactgttgatttcacaactgtgttcttaagaagtttagcagtaacttccactgagcccagcatcagactactgtcttaggaataacatgagggaaattttccaaagacagcatttaataacattcagttgacattttaaaaacagataagaatttgatgtttggggaattgaaaaaaaaaaaaagtgaatgtgaagccgttattaggcgcgtaaggagttttactgtgggaagcagacagtgcggtgtgattaataccgtagtagcaccgacagcttagctaatagtctctctctctggtcttgcaggaggatttctctggctacgactttgaaaacaggttgcatgtccgcattcatgctgctctggcctcagtgagggaactggtccctcagtgacagaccccaagttcctgctgtgtccttccccaacacaggttctgcactttaaaagcagagcacaccgctcttatgaagatcagcttttcttcgaaaaccacctggacccaggacacgtttcctcagttaggctgatgtattcaagatctcctcttttaaacacatagcttaaaaaagaaaagtgatgatgatggtagtgataataactaaccacctggggagagggttaagtgaccttgttcaaacattttagttttgtgatttattatttttaaaataaaagtaaactaaatattcaacctgcgatcttgtaggaatgcatacctgaagcacacatctgactgggtaacacaaagtacctgtaaaattattaacagtatcacaacatagtatttatattgtgttttgaaaaaatagcagtgctttccagttttactttatcctcaaactattcctgtgaataatagcacagatattctaatctccattgtccagaaaatgagactcaggcacaagaaagcgaattgacttattccaattaattattcctcttattatagagtcttgaatagaatgcaggtctcctgaccacagaccaaataattcttttattgtaaaaacaaatatgttaataacccagaattccaagttttccttattaaaaaaaaaatacttctcagctgaaagttgggtcatcaaaatatttat

SEQ ID NO: 61104 - DNA, 689 bp, Bovine  19866881293048
gagtgtgtatgggaggagcacaggctgattattttcaagattggaaacactgtcagcaaagtccgcctctctcacgggttctgtccctcctcttcagattagcgctgctctggtatcataccgtggtccgcccattttttgccttggatggaagtgataacaaagccggcctggatgaagcgaaggaaattctcctcaaaaaagaagctgcttatccaaactcttcccctctttatgtttttcaagggacgcatacaacgactagaggtactgtgccttctcccagcttttttttaaaataaagcctcttgcttgaatctataattctcatttggaagggggctagctcataaggagcccgaatgtcacagggctgacattctgtgccttgcattcgtcattgccgtgggagcctcttcaaggaacctagagtgtttattcagttaccttctgttcacagctatgggtgaagcagggtcggggtccctcagaggtgagacaagatgctgtgccctgagttgaagacacgggagcccttgcgaatgtcttagttaaaacaaaatacgaggttggctaaaacatttgttcgggttttcccagaagatgttatgtgaaaaacccgaacaagctttttgaccaacccaatagatttttttccttctctggagttaccgatatctatttccaaa

SEQ ID NO: 61105 - DNA, 1948 bp, Bovine  19866881294321
aaaagtccttgttgccttacgaaagaaacatctatgaccactgaacattgcactgacatagatgtgaggggaaataactccatttatcactagctggtaagagaattctgattttaaaaactatttacttatttgggtgtgctggatcttagctgcggctcatggacttagttgggcttccccggtggtgctagaggtaaagaaccccgctgccaatggaggagacataagagactcgggtttgatccttgggtcaggaagatcccttggaggagtgcgtgcctggagaatccactccagtattcttgcctggagaatcccatggacagaggagcctggtgggctccctagggtcgcaaagagtcagacacaacttagcacgcacacatgtgagcttagtcgctctgtggcacatgggatcttagttcctcaaccaggtattgaacctacatcccctgaattggaaggtggattcttaatcactggaccacaagggaagtttcaaagagttcttatttgggaagcttctcttggacaattggatagatatagagttacacctttaaagggacagttagaaatttgtcagcagtattaatattgctggaaggagaattagataaaaataggattttactgatacatcctaggaactgcgtgttacttcaactacacagaagctgaaagctgaccttgatgacagcatgctttgcaaccaaagatcaaacgctttccccaagcacactgtgaacatcttgcagctttttactctctccagcttctgttcaaacaagcctgggcaagtgtcaagtgatagatccctttacaaataaagccacaggaccgggcaggtttaaggagtatcaaacacacagatagcaaaccagggtggatatttcaaatatgcatctccagaaaagccacattgggcaggtggcttctgataattttaagactcggccaatttctctgctagctcagctgatatcagccagccttgcagtccacacttgctcctgaacctgggcactactggtacttgatcaccatcactctgatttttcatatcaaatcttgcttcacttggttacctgtttatattttgtctggactcacagtgaacaagtgatgatgagcaagagtaggacaaagtgccaaagccaaactgaacatgaattatcacgaaaggaaaatgacggctttctactgacagagtctactgaccttactggagcctggatgataatgcagaccacatccctctgaggctcagaactgtcctgtggcttccatcacactgaggataaaagtccttaacatccaaagtgccttactctagcctgaaaggtacaggatctgtaccctggctgtcccaccaacctcatctcccagccagctctctctcaatgcaatcaagccatccatgccttcttactgtccacaaactcatcatcacaggagttttctcatctgttttttccccccttgccatggaccctcatcatattgtcttggtactccacctcatcactcatgattccctgcccaacaactccagaaagccctgctaccaccctctgtaaagaatccactatctatcatataacccttttattagtggtgtggcccatctctgaagttatacttcagactgatttgtgcacattttactgaggaataaccccactctctcctcccattcttcaggtgaagcttaatgtccttgccagccttctttactgcagttaccccagcatctggaggagggatgatgctcaataaattgcttagacattaaatgaacagcaaaagaaaagaggaaaaggcaaaaccctgaagaacacaacttggagagtctgtttttgtttggttttgtttccattttttgtctattccttttttaaaatagaaaattgttttattgagatagacttcacatatacaaatc

SEQ ID NO: 61106 - DNA, 486 bp, Bovine  19866881301301
cgcctgccctttactctccctgccttctgggaaccaccccccccccctccaacaccctctgcattccatgcttaaagggggttgagtcagaaggctttcaggaactcttccaattcaaatgctgtgaagtactgcattattgctgccagattcattttagaaacttaccgtttaaaaatgattataaatgtgttttttttttttttgcctgagaaaatcttttaagtgtccttgaaactgcagaataaaatacaaactttttatcttggcatttaaggatgttcttaacctgattttttagctttatttacagttcttctccccatgatccctgtgaacacttttgaccaaacactgtgtctcttggtcctctgttaaagtaatgcttttgttttcatgtgtgtgttagtcattcagttgtgtctgactctctgtgacccccatggactcagcccatcaggctccttgtccagggctccaggcaag

SEQ ID NO: 61107 - DNA, 1134 bp, Bovine  19866881353874
tgattctgcggagtttaattatgttgcatgttaaagatggcttaataagcaaactaataagccaatgtggatattcagaatgaaaatgactctgagtctcttcctgtaagtcatcccaactgtggtttttataaatatactcacagtgttacaaatactctcaaggactttaaaaaaagactctcaaatctgacattacttttaattcctttacaatttctaaaaagtacatcagcagatggtaaagaatctgtctgcaatgcaggagactcaggtttgatccctggatctagaagatcccctggagaagggaatggcaacccactccagtattcttgtctgggaaatcccatggacagaggagcctggtaggctacagtccactgggttgcaaagagtcagacatgcctgactaacactttcacatcccttttaggatggggtgaagagataaaaccaaacaaattggtatcaagtccagtgaggttgggaaaagctgctttacatacatggaaggacacaagactccatttagaatgctactgctttgttggaaggagaacaatgtatccactctccctgtgtctagtccatccatatatatcacatgactatttcccttcaaaaaaaaaatcaagaagtacaattccttcttgtcctctttttcaacctatagtagtatgtgcatatttatataagcacataagcataaatacacttatttatatgtgtatgtatatacatgtcttcctagaaacactctgagaagtctgaaagcctgaagtgtcttcccccaacacaatgccactttctaaaacaatgactcagaaacagctcaccaaactcaggtttggttttggacctttctgccttcttccaatcctcattggtctgcagaaggaacacagatgacactccaaacatgctatgtattaataacatttcctaacctcgaattaaacttaacatgatctctgtgcgtgtaggttgcgggcggggaggtaggggaggtggcagagaagaccttccaagacgtcagtctttcccagggcttggtgacacgcacctgcatcctttccacaggatcagcgagcgaactggccttgtggatgaggtatgtatgctccatatatt

SEQ ID NO: 61108 - DNA, 1094 bp, Bovine  19866881447951
tgcttctaggctttagcccttgaccttggccagatgacttctgcataattctttgcagaggaggcaaagtctccttcacttctggtcataagccaactgttgagcaaacactgtaatcataataatagttgtcattctagcccctggctcataggaagtactcgtgtgtagcactaatccttcatgcttagtagttatatggatttaaaaattcattaaccaaaggaatataagaatatgattttccagtaagttttatatgaggcgacatctgtgaaatgctgcacatggcaagaatgtgtatttctctaaatacacagaatagaatggaggaaccacttagcaaggcctcccctgcaaaaggtcctggaaccttctgatgatccagccagtgactcagaatctgacttaacgcagggcgtcatctccaccaagatgctgatcagggcaaaactaaaatggttggaagatgcctccaggaaagagctgcctggacattgggtagtaggagcaaagtgttttaactcagacaaacacaactgaactaaaaacagagcttaaagagagtggctgtaactcacaccaaatattcagtagctgcagttttcatttttttattgctgagttcaattcacaaaaacaacaataaatttatttaacatctgttctgtgtcagcagtatggtagtcatctttaagactgttatgtattagaataaattacaggaggcaatgaaatcttattgccaagacttctttattatttggatatagaacatacccaatcagaattagtgtagaactttcaagagacaaagaaatggaaacaattgccagctgggatgcttccttgtctgacttttttttttttttttgaaagtttaatttgttattgaagcatatttgacttgcaatattagtttcaggtatgcaacgtacttattcaatatttgtatagtttactccattaacattttttaaattggagtataattgcttttttttatatgcaagcttttgtggttatcatgccttattaccagaaacattaatagccacaatgtcatttcctccatgtctggcccaataacttaa

SEQ ID NO: 61109 - DNA, 844 bp, Bovine  19866881476630
tgaaccttgtccctcttgttaccctgcaatccctgcgccctgtgtgatgaacgttctcatagcatgtttggatcaatgaacgattattatatgtattttgcaagtagagacaagagagaaagcaggtggtgtgcttagagtccatggacagtgactgaatggaaggactgagtctctgaccacatcttctgaccctgcagtgtgtgctttgattccacgtatcatagatgttcacatagctgcctgataagcagcaaaaggtccttttcttggggtccattttccaccagaataccatgaactcttcccttttccctcatcactgaaacagagtggctttgcaccaccagcagcccagctctttactcatttttcattctataaaacgttattaaactgcaccacacagataagtactagaaaaattgccaggttattttcctaacataaaattagccaatttgcctgtgtacggattgcaaagaatgcaaggcatcccattcaagtgattaacctcttagttaataaaagcaacagtttcatgtgtataaataatataataaaaggaacattcatattaaagttatgtagccctccccttcctcagctcatctccttaattggtaaataattcatcaaaccctgaaatgaattgtcctcccacccacatttcttcatccaattattatgaaataggaaagcagcctcctttctccctttggaaagcaggcgataatgaaatcgttcagggcttccctgagcctgtgctcggctagatagaactggcacgggccttgccagtcactgagtgatgcttctccgggatcccaagaactgagcttgt

SEQ ID NO: 61110 - DNA, 1319 bp, Bovine  19866881827794
tttgtatgtttcttggtatgtggaagatgtttaacgctttcatgttcactaggctggtgcggaagtaaatgtactgaatgacatgggagacacgccgcttcatcgggctgcctttacaggacgaaaggtgaaaaacattctgtgttcagtgtttgcaagtgaaatgttggaaatgcactcacaaatgttttctcctttatagccctaggaatagcaactgggaaaagccgcaaaaaacgtatataccagcactttgggtccaaaagaccacaggctcttagtgacagacagtgaggtcaattacgaaggtcatggggctccactctggtgtccctgatagaagctcattcagtctctgcttgtgtccccaggactggggaacgcctgcaccttctttatcattttttaaaacagttttattggggaataatttacactgcctgaaactcacctgctgtaagtatacagttcagtggtttttttgatgcgtttacacagtcgtgcagccatgaccacagtccagttttggagcatttccatttgccacagagtttcctcgtgcctgtttgtatttatttcttgtttcttgtcaagcctcagactaccactgacatgctttctgtctctagatgtttgctttttctagacatttattgtaaacggaatcatatcaacatttgtgtctaacttcttgagtataatatagttaagtttcatccatggcatagcgtgtaatttgttccttttttgggctgaataacgttctgttgtatgcatataccacgttttttagtctgtcttctgttattggagagacttttccctccgtattgcctcgacaccttttgtggaaatcagttgatcataaatgggtttgtttctggacttctgttctctttgtttgatctatattctatccttacaccaataacacactgtcttattacagtagctttgtaattaagttttgatattgagtagtgtaagtttggagaaggcaatggcatcccactccagtactcttgactagaaaatcccatggatgcaggggcctgatgggccgaagtccatggggtcactaggagtcatacacgactgagtgacttcactttatttttgcactttcatgcattggagaaggaaatggcaacccactccagtgttcttgcctggagaatccctggaacgggggagcctggtgggctgccatttacggagtcgcacagagtcagacatgactgaagcgacttagcagcagcagcagtgtaaattctccaaccttttgatcttttaaattattttttctattctcagtcaag

SEQ ID NO: 61111 - DNA, 1208 bp, Bovine  19866881850866
gtctccccttagggtagatctaccatttctatttgcacagtatccatgtattctgttttgtatatatcagacatgtatatatacttgaaaataactgctgtgacctccctaagatgactcttctccaagctaaatatctccaccttctaaaaacattccttcgtacctaagtttgaacttccttttggctccactaactaccacccaggtctatatcgtgaagtttatttactggctaactgctgcaaattgttaagtcattggcacttgttatgaatcaatttaatcaaattaatttttttttcataatgcttctgagggagaaccaggaggtaatggagaaaatgcaactagagcagactgacatttttaaaagcctgcagagaaggaagagttattgaaaacacatcttgcagatgacactgacttaccttgttgttgtgctcagctgagtttgactctttgagaccccatggactgtagccctccaggctcctccatccgtgggattctccaggcaagaatactggagtgggttgccatttccttctccagcggatcttctctactcagggatcgaacccgcatctcttgcttcacaggcagattctttacagtctgagagttacctaaatgcttaatattcatcagctttaattaaaggcttggctgctttgattattagattcttgaaatttcctattcaaatatcaggtcttcattgttaagagagaagaatgttttctctcttctacccagagcaaattgctctaaagtatatgaataaattctctgcttcccagaaccaatggcaaattcacaaagctccataaaactcatgcatgacttgctgctgcagctgcataattaaaagaaaactagtatatcgactagttctcctcagagtagcatccataagtcaccactgcttgagaaaagcttgttactaaaaggattatggccaatatcatttttatgatgaaagagagagaatggctggtttgccttgtccagtctgctcacagatagccaaaatgctccactggctgattttttcatatgtcttgaaccatcaagacaaccacagggaaatagtttttcaatgtacagatttaccaccagagctattgcttcatcctcggtacataagctctctgcctcccaaactcgatccatagaaggcttatttttagcaggactaaaggact

SEQ ID NO: 61112 - DNA, 764 bp, Bovine  19866881929987
ctttttttttttcttccctaaactgagtttattgctcgttttaccacactcagttgtttgcctctcctcagctgggatctgacatttcattgcttttcttttggttcttgttctctagctggactcgaccacactggtaacccttaccctcgtctccccgaggttttatctgaagtcaggactccgttttcagtccctgtctgcagcgctgactgctttccagacacaggaaagactggttcttagtttcctcttcatatccagccctctaacacaggacaggttttcaaaaagaggtgcttctcatgaaatgctgtggccaagagaaccgcatcttcgtttgatggtggcaaaatggttagacactcggcaccttagagccacagactagtcggaatataacccccatcaggcctcctgcccccctttaagaagagggcactgagttagaaggtggcaagaatctgggccctgtgagtcctaatccatctcactccaaaccctccttagtgtcgagtctcgtgcctcccacacatcagccgtgctgggtgagagggaccccctggccaggatgttggagcagctactagggagaaaatttactgtaaagttacctcaataacatttaaaaatgcctctttccatttttttctttttttttttttaggaagaagtaagtctaatttgggctggacacctcttcacctggcatgctattttggacatagacaggtggtccaggatctattaaaggtatttttatg

SEQ ID NO: 61113 - DNA, 1505 bp, Bovine  19866880472449
tcaaaagtgtcctttacccacccaaagcacacagcagactaccaccaatctggtgggcttcaaaggtaaagtctgctcttagtagccaattccccactaacaggaaggtgctgccacactttacataagctgttggtgctatattgtatttctttgtatatgtaagtaaagcagttactgcagattcctgggtaagtcagaggaaatgtctatcttaaggtgatatgacacaactcagaaaagtactagaaattagatccagctgatgactgagttgatcctaagcaggatttgtctttgaaataaaacccagcagagaagcagaagttcagataactctggtaatttggggcagggggactagctgaattctcatttcacatgtcaaagccaagttcaaggaggatttatgagttaaatatattttgtaaagcaaaccaaaaaatagaattgttgttcagtcactaaggcatgtccaactctttgtgatcccagggactgcagcatgccaggcttccctgtgcttcattatctcccagaatttgctcagattcatgttcattgagtctgtgatgctacctaaccattcatcctctgccacctcttctccttttgccttcaatctttcccagcatcagtgtgttttcccatgaaaatagaatactatttgttaaacctctggctagaagtatttctcaacttagaagcaataaaaggaaataatcaatggagatgactgggtaatagtttaaaacttctatgtgtcaaacattgtcttaaacaagaacatagaggacttctctggtggtccagtggctaagaatttgccttgcaatgcaagggaggctggttcgatccctgatcaggcaactaagatcctgcatgcgacagggcaacccaagtgcaataattactgagcctagatcccacatgatactacaaagatgttgcatgccacgactaagacccaacacagtcaaatagatcaatattacatagaaacctaaactgaaaaatggtgacagcaaatataaagaaaaaagtatgaatatcttagcagggctcatacagtaaaataaaatacaaaatctcagtgattgaataaaagcagaaaacagatcacatacaaagacatcaaatagtaataaatatggtgaaaattaactttacagtaattaaagaaatagatgttaactcagtggtaaagatatagagataacaagcaatggtttgctcatacattgctggtgtcattctaaactgattccatccatttggaaagcattttggttatatgtcgtaggtcaggatgctcctacattttgattcagcagtcccatttctgggaatctagacaacaaaatactccaaaatatgagaaaatttctgtgccacaagttgtacatcacagcagtgttgaaaacttggtgacaacttaaagatgctggaataggggctatacccagctccctgtgctcgggaccatggcgttgcttcgtgtttct

SEQ ID NO: 61114 - DNA, 1174 bp, Bovine  19866880544479
ccagaaagaatctatattatttatttattggttctacccaaccatcagcctttgcttaggtccactgttccctgtcgctgattttgagtcttgattggtttcttctttatcttccatgttccgcttcatcttctcagaaactgaaggcagttttgtatctcctattgatattattttcatattcaatattgatattatattcagtcatggcagggaggtggggaaccctggcattttttgatcctgggctagtcacctctagagaagttttgcaaggtttgacaaccatgtgtgcgctagtgccgcactttagctcctgttctgtctgtgactcctggtggtcagaggcgtggagacttatctggctcgggactcctcaactccagggaaacagggaacatgctctccttttgtgcatgatgcccgtgaaacatttagcagcaggctgtttctcttcatgggtgttttggctgagagtggattgaaactttgaattgtatgtgcctttttaaatgaagagacttatttctgaagggttgactcttgctaagttgcttcagtcgtgtccgactctctgcgaccctatggattgtagcccaccaggcacctctgtccatgggattctccaggcaagaatactggagtgggttgtcgtgccctcctctgggggatcttcctgactcagggattgaacccacaggaaattgtggttgatcaggttatcccaggagtttggcaggttattagaattctgcgcttctctaagaagagagagtaattgcttggctagcggattccccattacataagagccccttaatcacggggtaaaggaggtggggagggtactttgggcctcaggagaagggctgcattcctgatccagctgagaaaggatgttctaaattcctgcagtcccctctgggtgctgctagccatgtgagagcacaggaggtcagcagcagcaccctcctgtcagcaggatggcgtgggtacacgtgtgggcacggctaacagctgtctgggtctccatattcctgacacttgacagactgcagctgtcactggccttcagaatgtcaagtcttttttctgaggtgctaaaaacaatgcaagtttgcacaggtcataaaaacgcccttgggtcaagtatctggatctgtgtttgacaagg

SEQ ID NO: 61115 - DNA, 1213 bp, Bovine  19866880671782
agtcttgtcccaggtccgtcctggcactagctttggaagggtgatgcagcgttttttggtgaattagttagtgcccccacaattgaactttagccaagttgttgcttgataattggcatattttttccctgacatgctgatagtccaattattgctttaaggttgggttaaaatgtttgactctttcaaaccttaaggtttatgatgatgtcagcagagcactagactttatgaatagttctttgttttaacaacaacaaccacccccctccacaaacacacacacagaaccgaaagggagggaacatgaagacccagtaagcagtaacatgctgttattgattgttcaatgatcgtgagctatcttctctcatggaaaaatttatttaaaatatttaatatatatactatttaaaatgtggagtaaatggaacgtgaattcagttttggatctgctgcctttgcagtgcccggagcagttggatattgtaagagtgaatctgagtgggagagatgggtgaggagtcctagctggtatctctgggcaaagctgcctcatatctttgagccttggtttccacaaagggcatgaaaactcccttttaagggtcatattagagatgaaacagtcttataaagagtactaagaacatagaatatattcaggaaatattttcttttccgtttcccttcttattggattttgaggatcattgtaaaacttttgacacatttagggaacacagctttctgtaagcctcctgggctcatcctggttcattcacaaatcttgaaagttggaatctcggatgacatttggaagctcagatgacaaatggtgttgcgagatgaatccaaccactgcctcgatgatgctagggcagtaacttcccattccttacatgccttcttcctatgaatagtctcaggtcatgttagctgtattataagtcgattcattgctgattcattcatctcagcttttcggttccaggatggcatggtgtcaaagctgcagtgactgtcattttgatgaggacatgttagaatgattttcagtgtgagaatctgcttgagcattacaaaacattcatttttgtggaaagaaatcttcacaaagcccggaaatggactgaaatgactcttttgatttagtatgaaggcgagaacatttttgaagtttgggtgattggtgatggggaagagtgattat

SEQ ID NO: 61116 - DNA, 883 bp, Bovine  19866880677923
ccataaatagtctggcaatacaagaggggttggtcatagactccagcatattatctaagtgagcagacctcactcccttgaaaactcaacaacgcagcttaaaccacttcaacttatgttttccatgcccagcattcaagatactgatttcttcagacatttccctttaatttgcaggtcatcaaatctaggtttactttgacaacataatagctaagagattttgagattctaaagtaagagttcttcaaataactgactctccaaataaccagccatcaatgcaggaagcagagatggcaagaaggaacatacattttgggtaattcagcaaacctcaagtatctgtgtgtccatcaggtaggaaatcaactctccttgctttttgccatctgtgataactcattagaaaccagcatcttcgtcctgccaggttttcctgtcttttgtggtttaatctgaagtatatgagacatggtctattttcctaagttcaaatgcaggagctacaggaactgaagagttacctaacatgaaagaatcaggacaagaggaaaatgcaccagaaaagaattctgtcctgttgttatttatactcctcaaacaataaaagtgtaaagtgtgccaaggatctacaggaaaatcctgttaaaacacacactttaaaaaggcttcaaaagctttctgaaaatagcacataatccgaacactgttcaaaaagaattaaaacagaccaatcatataaagtacagataatcctcaatttcatacagattataatctaacagtcactttttaaattggttttttaaacttggaaagtaatgtgtctatagaagcaaggtaataagaagtagcaatatttacagaaacaaaacaccag

SEQ ID NO: 61117 - DNA, 2947 bp, Bovine  19866880683475
ggggatcttcctaacccggaataaatctgggcctcctgcaatgcaggcttcactgtcagcccctgggaagtccctcaatcaaatacatttttttaaaaagttgaagattactatttccttttgttcttcccccataaacaccaggaatgacaattctgtcattttttttaaatgttctttttaaagatctttatctatcagcctttggtaatgtattttaagtgcaatgtatttaatttggtttggattctgttgctttcccttttgtattataacctaagaccctcattttcaaatttcatcattgctattagctagcctcatggcttttacatttcagcattttcctcatggcttgaaccttgctccttcttcatttgcctatgggattcaactccatggaatggctgataactcatcagccaaccacagtgatcagtccctcactccaggggcctggagaagggactgaggtcagacatgactgatctgatgatcccaatggagccagtgacaacaaacattttagatgtcacaaaagataattggtgagaattaatattggtgtttatacatagacataatctaagagttttaagtaaaaaaaataaaaaatttacaaagccacacaatatttggccactctatcccaccatttaatacaatgaaatttaaatttttacatctggcttgttcagcagtcttggcaagtaactgcaagttagagaatccaaatgtcataaatgttgcttttataatgtatcccatttgtgaccacagatttacctttctcttcttgcaatacatatcttattattaaattgtatgcattttataaacacacatgagattggtggtgggaagtcagccaagagaaaatgagttcatgggaaaatctatttactttcaaaattttgctggagctaatttgcaaagagaataacccacatgtagattattgagggttagctgtgtaatccctgaatagtacaacactggataatgattcctgttgagagattttctttcagtttctgtatttcaaggattttacatatattatctcacattcttacaataaatgtatgagggtggttatgatcatacacattttctagatggggaaactgaggcccacagaagctaacctgcccaaggtcatagaaatgttatgggtggagccaagacttgacatacctgggtttatctactgcacaacattgtctcctttgtccatccattcatctgttccgtcatgattgtagtgtacgaagacctgccttgattgtgggatagtatctgtaggtaacaattaacaaaaccattcaaaggaagaataaataagaggttaacatcttgattgtcaacagtttaaatggcaaagcataaaaggaaaggattacttagcagagcccaatgtctatataagaagcaatcattttctagaatcaaagatctctagtcaatagatgacagtctgccagaacatcccagctgggtctctaagttgcagctgtgacatctctctctccatgtgtgctgagctgctttagatgttagtctaaaacagtgacttttctttgatatgtaaagttcaaaggaactttgttatactggagtttacttacaagttgaataatagcatacaggtaaaaagagttctgggttgactggtaagctgtggctccacccaaatagcaaatatttgggcttaatcaggaaaccacaaaatgacacagtagcaatgaagggaaatggaccgcccaggagtctggaaatggactttgatgccctttggttttattgtatagtcagccaagacaaataataaccaaagaagtaatattttatctccagggcttatgtgcaggctagataggaactccactcataaaaaatacagccctcagaattcttctgaagaggagagatcccaccaattactttttattattgttattatcattacaggcatacctcattttattgcaattcactttactgtgcttcacagatagagaatggaatggcaacccactccagtattcttgcctggagaatcccctggttggaggagcctggtgagctacagtccatggggtcacaaagagtcgcacacgactgaagcgactgagcacgcacgcacatgcttcgcagatattgtgttttttatggattgaaagtttgtggcaaccctgggtgaaataagtctactggtataatttttccaacagcatttgctcactgtgtgactgtcacattttggtaattcttacaatatttcaaactttttatcatcattattattatttgttatgatgatctgtgactggtgatctttgatgttcttactgtgatttactgaagactcagatgataacatttttagcaacaaaatgtttttaaaataaggtatgtgcaaaccttttttttaggcctagtgccattaggtacttaaaaactacagtatagcataaacataattttatgtgtgctgggaaaccaaaaaatttgtgtgatttgcttaattagtatttgctttgctgtggtggtctgtaactgaaccctcaatatctctcaggtactccagcattactgttatcatcatcattattaattttaaaagagaaaagctgttcacatctatcttactcttacaccactgctgtagaaaacctttcccttcagtagattaagaatgcagatattccatgagatgtttcttgcagaagagtgggaaggctgctgatcccacacccaattccacattctaggctagagaaatatggagggaagaataaagaactcccccacctcccccaccaaagatgtccatattttaatccccggaacttgtgaataagttatcttacatggcaaagggctttgcagatgtgattaaggagagacgcaggagacccaggttcagtccctgggtcaggaagat

SEQ ID NO: 61118 - DNA, 1549 bp, Bovine  19866880808664
tggtgcaattttgtagtgtgtactgaggcacatttagtgttttctgtggcttaggttgtagcaaaacctctggaattgtagagagctgcaaagaattgcagagtgcttgcatggagagttccaaaagaaagtcacattgtgtctgattttgaaggtcttcatctcttgggaggagttttatgggaagcctgaaaagagacacagtgctgtggaactaaagcatctgtcccaggcagaactgttatgtagatacctctgttacaaggacccttctctgactctgctgtttgtctacacaccttgtccctcctcactgcacctaaagccttccactcatataccccctcatacttttgctatcctgctgtctgcttcaaggttacctcataatttggggaattatttgggaattatggaatctctgagtttgcattaccccggtctctagagtgatgaggtagccatgatatttgatgacagtaatttagactaagatgttagtgactgaagagttgggactggtggcctgattctgtaaagtttcacacctctgctctctacagttgccgtcctaatcgtgactgctggattcagcagactggggcggctcttacacagttatgatgaagacattgattacagagaacatggtttcctaattttccacaccaaaactctagaaaaaaaaattaaaacattgtagacattttgagataaagttctggtaaaataaaaactgagaatttggtagccctagcactaagcgtttggttctcttagtaatgagcagtttgacttttcactactcagttaactgccctggcctcagcttcttaactgttaaaatgaagagttagtgctcactccgacagcacatataataaaattggaacagtacagagaaggttacagagaacggctcctgcacaaggatgacatgcaaattcatgaggcgctccatatatttacagccactatggagaacagtatggaggttacttaacaaactaaaatagaacaaccgtatgacccagcaatcccactcctgggcatataccttgagaaaaccataatttgaaaagatatatttgctccatgtctcttgcagcattatatccaatagtcaggacatggaagcaacctaaatgtccatcaacagaggaatggctaaagaagatgtggtacacatatgcaatggagtattattactcagccataaaaaggaatgaaattgtaccatttgcagagatgtggatcgacacagagactgtcagagagagtgaataattcagaaagacaaaaacagatattgtatattaatgcatatatgtggaatctagaaagatggtatgctgctactgctgctaagtcacttcagtcgtgtccgactctgtgtgaccccagagacggcagcccaccaggctcccctgtccctgggattctccaggcaagaacactggagtgggttgccatttccttctccaatgtatgaaagtgaacagtgaaagtgaagtttctcagtcgtgtccaactcttagtgaccccatgg

SEQ ID NO: 61119 - DNA, 1057 bp, Bovine  19866880817440
tctattactgtgtaacaaattacccccaagcttactctcttaaaacaaacaatctactttctcgatatgctgtgctgtgctcagttgctcagttgcgcccctttgtgaccccatggactgcagggctccaagctcctctgtccatggaggttctccaggcaagaatactggaggttgccatgctctcctccagggagtcttcccaacccaggggtcgaacccaggtctcccccattacaggtgaattcttgggagcataccgggcaagtgggatcactggggaccgtcagagggtaccctgtgttatttgccttgtgggaacactacccagtattgttagtgcttgattttttaagaaaagttgaaaagtcaaaattttatatgaaatcttcccattttaaaatactagcctttaattaaaaaattaaaaaacaatactattgaataaagcagatctctcaaacacggcctgtgcaatgctgttatgaaaccaccattacagagaccacagtagaaagagcggattggaagggaggggacagaggtttcctttgtccttttatttggaaagccaagtcattgttaaaatggtgggagcttgagaagtacaaatgccaatcatttgatcaagataactgtatttatataaattctccagtcatattggtaaaagtgactagttttcactaaaagcaagcctttgatccctgatctgacagctgcacatctatataaaatgagacactttgacatcctcggctctgcgctcaattggacaggtggtttcctccacgctaatggaacagaaagacaattgagtgctattagataggagaggacgttctcacacacaggaaaacagctttttcctttgaagagagaaaaaaaaagacataataaagaacagaaaatgactgacagaatcggagcttcccaaatgtcagaagagctgtttcagctacactctggcctctgttagggaagattaggatagtttttagacaagtattgaacataccttagcattagctgactcagggagcaatttgcttggtaa

SEQ ID NO: 61120 - DNA, 941 bp, Bovine  19866880905439
actgatttcctttaggatggactggttggatctccttgcagtgcaaaggactctcaagagtcttctccaacaccacagttcaaaagcatcaattctttggtgctcagcgttctttatagtccaactcagtcaccgtttatgctgttgttacaccaaaggtttgatgtctgcagtagggactagaactagaaaactttatggcgaaagattggcatgttcatagacattcaggtaagcagcctgggaccttgttacattatgagagaagggattttggaccttgcatgcacctttgcatgactagggagcacaggattatttaggggcaaaatggttgtaactacttaactagccagtatatgtggattcttgttcattcacaaaaataacttttctgtatgcttgtggaaattgtaatatcctggataggttttattacaatcatttgtggtgcagtcagcgtatctggaaatagtatgagagagtagagcatagactactgctatgtctgtaagcctgctgctttctgggcagattgtgcttatcagaattgttacattactgtaagtttttcttcacacttctttcatatagagcaattggcgtggtatttcagtgtattattttgccaggaaaatgtcaggttagtactcctctcaatagggcattgtgcatctcagtcacctgtggaatttaaaaaggggctcagccctgagctgttggactcaatctctagtcctgggcccaccactgtccttttcattctgatgtttcttctggcctccattccttctgtaaatacatattgagctgttgactgtctctgagatgggtataaaatggcaaacaaaaccaaagtgattcttaacttcttggtgtttacgtctgcaagggagtagggaataaataaataaatagtgcaggaaagaatttctccattt

SEQ ID NO: 61121 - DNA, 1796 bp, Bovine  19866881155158
tgttcttgtggaaagacctttaaacatcactgtgtattgtatcttagacacttggtcatgtccgacacttgtgaccccatggactgtagcccactaagctgtccatggaattttccaggcaagaatagcctggaaaaatggagtgagttgacattcccttctccagggaatcttcctgacccatggatcaaccctcggtcttctgcattgcaggtagattctttactgtctgagccaccagagaagcccagtttagtagtatatagattcaaagatagaattccccactgaagagcataaatggagataatcattatgaaagtcattagaagaaacttaactgtggtttttgtctgtctccagttccttaaacccattagcttcttgaggttatcaactttgaattcagagactcgcacataatggaattgctagtctctctgatagttcctgagtctcagttttcctcatttggaaaggaaggaatatttaatacctcctgaggattgttataataattctatggaattttgtgtgaaagtgtttacacagtgcctgggacatctgtgtgcccaaataaacattttatgaccaacatttagcagggatcttctgctgaccgtggatggactttctgtctgacaagagtgagtttcagttttctgtttcttttctccaccaggaagatgtcatcaacactcagtgtggctatgatgccaggcaaaaaccagtaagtggaatcccatcttgtcgcttagcacgaagggtgttggaggagcttttgaatttgcatagtgacgctgtgctctccttttccctgtgaaggaagttgatcagcagattgtaatctacacaaaaggctgtgtgccccagtttgagaagtggttgcaggacaacttaaccattgtggctggtattttcataggcattgccttgctacaggtaagatggctgtcatgggagatggtgccctgggagagccctcaccaggacagatgctttgcttagtccctgcacgtcacagttgttaagacacccttggagggctggggagcagacctcaaacctctatttggtttgtattttgttaaggctctgattttagatgctactatcctggaagactttagggaatctttcttccttttcaagatggaaacattgctggggtcactagttgcctactggctttccagcgtttccatggggttagtgatgtggcattgtgacagctgatcagacaggaatggtcagatggagagccttgcccaagtggccaggctaaggctttttggagtttctcagacactcggtgctcctttctctctctggatcatctttccaaagtgctgggaagggaagggagcacccacttttcctcctgggaagccccaagaactgggcttttctttttgtggagataagatactttcaacagagagggccacaaataaggtacaatgatcgaaagaaattaaagaagacctgaataaatggagagtcatccattgtcacagattggaatatttaatattgttaaggtggcaatactctccaaattgatctacaagattcagtgcagcctaccaaaatgacaactgacctatttgcagaaagggacaagctgatcctacaattcatatggaaattcaagggccccagaataacaaaacacactttaaaaagcacaagattggagaattcatacttcccaattcaaaagttacaacagagctacggtaatcaagatagtgtatactggtgtatggttggacatatagtttagtggaatggaa

SEQ ID NO: 61122 - DNA, 1442 bp, Bovine  19866881201132
cgttggacaggaacagcgaagaagcagacgttttcttctttcgccttcgtggtcccgcagacttcagtgcagtggactgggtctaaccacagacgcaggacagcagacgctgctcttctccacaaacctgcctccctgtccaaggtgctcttccttggcagttttgttgacttccctctgccgacatgccaagcagggacatttcttctctcgtatctaagtgtgcagcactgtcatgaagagctgacagtaaagcaaacaggagatatcttccagttttccttagaaagaaaagttgcaatgtgcataacacgttttttcatttttttctgacttactcctttttatctactcccttttgaaacaaaaaaataagaattaggtgttcaattatggctgggcacctaaagtggaaatcttttgagagaaataaaattaaaaaaaaaaaacacttttattttatgttggggtatagccagttaacaatgttgtgatagtttcgggtgagcagagaagggactgagccgtaatatacatgtatccattctctcccaaactcccctcccatccaggctaccataaacattgagcagagttccatatgctgtacagtaggtccttgttggttatccattttaaacatagctgggtggacattggcccatccccgactccctaactatcccttcctctcattctccccctgcccccacccccagcaaccataagttcgttccctaagtccgtaagtctctgaaagaaataaaattttgaattaaaatctgaatgatttctctgagatgttcaactggagcatagttatcagcactcataaacacacccagagtggtatacacattctgtggttagcactatggtattatctgtctgtacataaagaatcattaattatgaaatataaggtataatatttaagtaatgtaatcaccaacctcagtaacaaaatagcgttaggaagtggttggccaaacattttggctcttctcattgaaaaggcatagtaatgttctatagctcttccaactactatttactatttggataagtattgcaagacatagggctctttctacttgttgaatttgttttttttctaaattatacttggcacttcatcttgaatttctaaaaatctggagggaacagctggtgctctaataaatattcaggccagctattttaatgctttgtatttaattaagtcatcctaataaaagaggaatacttgacttaagcatttctcaaagtataatgttttgcttccaacaaaaatttcccccaactgttaatatttccctgaagcagccttaaaacttaattctgccaagtgagtagttctaatcacttctgaagcatttaatgccaaaactcagttttcctgttttaaggtacagtcctatcaatatagcccagccccttca

SEQ ID NO: 61123 - DNA, 879 bp, Bovine  19866881234381
tgctgtgtttttactgtgctgggggttttattcttcaatttgataattgttttgataaatctctatctcttggatactgacttagagcgaattcttttctaccaagtactttttagagtggttgaccataaaccatttgagaaatcactgcttctattaatgacttttgagatttaacttgagttggtaataatggaatgtcctttgagtagaaaactacataaaacagtgtttcactgtgcaaaccagggcagagatgagtttctgataagagaatataacttatcaataatttaggttattgtatcaagtaatgtaacgccgggccgtagtgattgtttctttttaatttttatatgatgtttatgatgtggtaagcactgttcccaagtgttccttgtatattaacttacttaatcttcctagtgaccccatgaggtgtctttgagttctttacatttgtactggtgagaacactggggacagaaagtgtgtgacttgcctgtaggcatggtcgtgtgcccatggacaattactctgggactaaagatattctgatcacgtatagaatacaactggaaaattgggaaatatttggaaagaagttaaaatattcattcttttgacaatttagggcagttgacgtttgttaaattgtttccattacagtatgtatgtatgattttttttcctttttattttctaaagtgtactaagatataattgtggtggttagttttcgaactcatgtagagggcttctaaaacaaacagcttcgcattttgatgagctgagagactttcaaaggattcctgttcccacagcaaaatggtttcaaatgataaactttgcctctgacagcgaggcttgtgacaatgt

SEQ ID NO: 61124 - DNA, 762 bp, Bovine  19866881323504
tggcagatgccacggtgtgttttgaagtgaaagttggaggagggagggctttgtaacagatggtttcttgatatctggggcctgtccagctttaagctttgagaacgatgggctggaccccgaacatgtgcatgtagtcctgactgccagaacaggaagtgagggcctagggtggtgtgttcggggcagctgctgccactcagctagtcggctggccctgcagcactggcttcccgaggtttggtgaggccgttgtgtgtggtgcagtagcaagccatgaggtgggaaacccagcctggaatccgagacggtcgtaaccacttgggagctgttggcctgttttggaaggagtgtcagctactgtgccccgtggttcttgtgccgcctttggtgcggatgcagatgtgtgagcgtgggagccgaagatacgtgtgtcctgcatccatctgcctggtgtcccggcttctgtggaacagtaagcgctgctttgtgggagggcttggctgtcctctttgacattagtctccagagactaggagcttatcccagactcttctagcatcctttgatacctttttggaatgattagatcattcttggctgggtcctagtgtttggcctgccactcactggctgggtgtccttggacaaattactttatctctctgtgtctaactttatctatataatgaagaagctgggctaggtatgagatgaccttcaatgttcaactctgattaaaccattttgtgtatatattca

SEQ ID NO: 61125 - DNA, 895 bp, Bovine  19866881397205
atatactaccccttttctggattccaagggaaattgcaggtgagccagggagcttgaggacaggatggttcgtgcagaaggagactggaatgctctctgccacaccctagagcaggtttgtctgagtggctggaatttcagtctcccttgtatggtgacagatgcacatcaagtacctttcttgtttgttgactctctaaacttctgttataatgatattgcctcagctgtgttccattaatgtatcttatttcttagacacctattggtctccttgcttagttctgcgagataccatctagtacttcggggatagtggaaatctcctattttcactggtgaatcatcacttaaaaactccagattcatacgccaagacctagttgtcttatagccaatttgtggactggctaatttgctaaaagtatttgtttcaactttttaaattgactgctgttcattttgtctttatagcagcactttgctatggtcaatttgtttttgcttctgctgcccgctgcagcaacagctatagacttggagatgactgagagtcacaagaatacagatacaggtatagatagtacgggcttccctgatagctcagttggtaaagaatctgccagcaatgcaggaaaccctggttcgattcctggatagggaagatccgctggagaagggataggctacccactccagtattcttgggcttcccttgtggctcagctggtaaagaatccgcctacaatgtgggagacctgggtttgtttgattcctgggttgggaagatcccctggagaagggaaaggctacccactccagtattctggcctggagaattccatggactgtatagtccacggggctgcaaagagtcagacacaacagagtgatg

SEQ ID NO: 61126 - DNA, 1069 bp, Bovine  19866881673262
ttggttttgtgaggactgagagacagatggtgacctgcggctaattatgcagtgggcaagactgttcaaacaaaccaccgtgactgtggcagaacgccttctcaggagttagacaatctgggctgttcattgtcacactaggtaagcacgttctaggtgaatggcgaaaaggtgctacaagagggaagtatatttgcaactccttttcatcttcttactcattttcatggcaaaagggaaaaaaggaagaaaagaggttgagagaggcagttaaaataaacctcagcttgtactactgtgacagctaactttctggagcgtgcatgctcagtcctatccgattctttgcaaccccattgactgtagcccaccaggctcctctggccatggaattctccaggcaagaatactggtgcggggtgctatttcctagtccacaactttctggagagctaagggttttaaacatcaacatttgtgttttcattgtttcgagtgtaaccttgttgaagactttgctgtgctctgaaagcactggaagcagaattaagttctgagatgggcacccctgcctcctggagcgaatgctgccccctgaggttcacggttcacttgcgtccctcctggctcaaagattgcacccccctcccagactctccctgactttagtttctttcaccacacttttcagtcatctgacacacacatatatatgtgtgtatatatatatatatttttttacttatacatgtgttcattttacagttctttctccaaatgtaggcttcatgagggcaggggtcttggactgttctgtgctgtgacctaaagccctggcacatagcagcttttaaatatttactgataaaactaattgactggttagaagtcctttactcttcaccaccgtgctacacagtaccttgttcttttgtctgtgtgctggcccgctgaccctctcaggcatgactgtttctgtgcttacgggtatcatattcactcgctgcctcgttgatgcctattctggtctgtctcgctcttggactatctcatcctcgacagtggaaat

SEQ ID NO: 61127 - DNA, 1038 bp, Bovine  19866881834836
ccttcaccatgaacatggacatggaattatttggtagctagctatatgttttccaagtctttttagaaagctagcattattctatcagaggattcttgctcaaaagtatttgtgaatctgccctttgggtccaagctgaaatgtttgttttcattgggaatttatgtatgttaacagagtttatattttctgtggtaatggaattttgagggattgttgcttcattatatttataatcttacgtaaaaagcctgcaggggcatctaactgaatttaagctagaaataacgataatgcagtaatttcaaatagtcatgtgttcaagatgaagattttaaagtgatgattccacagtgaattttaatggttattgtgtacaatggtacttacggaacatccgttcagtcactacatgaatataactagtatgttagattatggatttgtaatgtgagatgagaacttttaataagctttccctataatggtttgtgctacaaacacaaagtatgagacacaaccctaaatcatagcagggtttttgaaatcaataggctcatgtttcaaatcaagatgagtttcaaatttttaaaaacacagctaagaagttagggatttgggataagatgtttctttttataatgtaaagaaaattttacttttgaagggatcaagtataaaatggaattgaagttacactttgagaaaaacttgttgattgtaagaccctgttagcatttaacacatcactgaaaatgctttcaacattttctttgggagacttttggagaaaaactggctgatgtgtgaaatttggtttggtgtggtcttgtccaaactggtggttagttattttgaccccctgatctggtgattccaagaaactttctgaagatatccctaaaaatgtacaaatgcctatttcaccattaaaggttcttttagtaaaagcatataaataaatttttttaatgaagtgaacccattcttacgacatttgaagcagaagcatattatattttcactctgtatcattat

SEQ ID NO: 61128 - DNA, 1177 bp, Bovine  19866881912494
aaaaaaagtgtttacgtattaaatggacattagtaagaagaaaccaccttcttatactccctactgcaaacacaatactatttcatactattttaattatggtaaaacaaggttaaatccactcataagtcttgaaaatgtttaagacattagttcaaaggaattgaattttgaaacttttcaacggcattttcaaagaaatttagaaatgacaataattcaagtaatatgtcacatcaccagttttttttttaatggtcttatacctttactaagtaggttttaaaatgcataaacaattaaacattactattggtttttaagttaaaaggttagacaaagtaacacttgcattacaggaagacacagagtatatgaaaagcataagaaaaaaagcaactttaataaagactaagaagataaaaagtcttagaaccccttaaaaacgcttaataaagaatgaaaaatatataacacattaaaattattatttacttgcagcagagtgttctttgatgactgttaggaaggaaagttttaacaaggaaaaaatttggttacataaaatatttctcttttcaaagttttatttaataatagtgacaatcatcttaggaaagaaaggaagatttggcttgagaggtaaagaggtcaatatggctttgttatcattgcttgccttcattttctaagaaactaattgattttaaagttcttaataagccccagatttttcacaacagctcttcatgaacactgataatagaatacctgtaacagagttgaaggtaaataaacaaaaacgaaaaccaaaagtactacctctaagaataagcagaaagacactatgaagaaaggcactcatatgcctatgcaaaacactatcactactaacacctgcttcatctagaggaaagctttcaaaatctttttcttttccttttaaaaatcatatgccattttcaagttaataattttctccaaatttatgtatttttttatctaaagataaaaatctgtttcttacaaaacacattttcctcatagcatgcatcccttgatggagtttggggtattaatctctttaccactcttcagagttcttaggcttccctgggggctcagtggtaaagaatcagtctgccaatgcaggagatgccgggttggatccctggat

SEQ ID NO: 61129 - DNA, 1911 bp, Bovine  19866880361124
aaaagaaaatgtgaattactgagtatcaatgtctctattttctaaaaaaatgttcttctttttctcttactacttactcctctttttcttaaagtaaataaacaaaacactttaatagaagcaacttcccaagctactcacttctctgtaaataacaagtgtaacatattagcatctatgaagttacttctattaatttcagtcacattatgtcttagctattctttccacattgtggaatcctaatgatttaagtgtatcttttataaagaaatctttctaatcctttgatcattctaattgggcctctaacaactttcttctctattatagcttcacttgaagtataataaccagtcatcacgcaacccatgtttgcttctcagaaggcaaagccaggtcccaaaagtcattttgacctataagtaatagcagagttcctgccactaaccattgttcaataaatattggttcgataaataagtgcttaatttggaatagaattcctgattatgccagcccatgatggccttttagatctcattttcttatgttgggttaatgttgtcaggaaactatccagaaatatatcattatttttaccatataccaaggttgacaaacaacagtccctgagctaagtgtggccattttcctgtttttgcaaataatgttttattgaaaaattgctctaattagacatctctccatagaagacatacagatgaccaacaagcgcatgaaaagatgctcaacatcatcagagaaatgtaaataaaaactacattaaggtatcatctcgtaccagtcagaatgactattatcaaaaaagtctacaatcaaaatgctggagagagtatggagaaaaatgaaccctcctacaatgttggtgggaatataaatttgtgtggctactatggaaagtgatgtgcgagtctcttaaaaacttaaaaatagagctaccatatgatgctgtgatcctactcttgggaatatatccaaaaaagaaaaatattctaatttaaaaagatatgttcaccccagtgttcataaaagcaactatctacaatactcaatatgtggaagcaatccaaatgcccatcaatagatgaatggattaataagatgtaccacacccacacacttatacaatagagtattagtcataaaaaagaatgaaataatgtcatttgcagcaacatgaatggacttcagtttagttcatttcagtcgctcagtcgtgtttgactctttgcgaccccatgaaccgtagcaccccaggcctccctgtccatcatcaatttccagagtccacccaaacccatttccattgagtcggtgatgccatccaatcatcttatcctctgtcattcccttctctgccctcaatctttcccagcatcagggtcttttcaaatgaatcagctcttcgcatcaggtggccaaagtattggagtttcagcttcaacatcactccttccaatgaacacccaggactgatctcctttaggatggactggttggatctccttgcagtccaagggactctcaagagtcttctccaacaccacagttccaaagcatcaattctttggtgctcagctttctttatagtccaaatctcacatccatacatgaccactggaaaatccatagcctggacaagacgggcctttgttgacaaagtaatgtctctgcttttgaatatgctatctaggttggtcataactttccttccaaggagtaagcatcttttaattgaatggacttagagattatcatattaagtgaagtaagtcagagaaagacaaatatcatacaatgtcacttatatggggaataaaaaaaaaagacacaaatgaacttacaagcagaaacagacacatagacacagacatagaaaacaagcat

SEQ ID NO: 61130 - DNA, 1156 bp, Bovine  19866880393583
aagttggactctaaagaaagctgagtgccgaagaactgatggttttgaactgggatattggagaagactcttgagagtcccttggactgcaggaagatccaaccagtcaatcctaaatcttaaagtcctgaacattcactggaagaactgatggtgaagctgaaactccaatattttggccacccagtgtgaacaactgactccttggaaaagaccttgatgctgggaaagactgaaggcaggaggagaaggggacgacagaggataagatggttgaatggcatcaccagctcaatggacgtcagtttgaataagctttgggagatgcttggtgatggacagggaagcctggcgtgctgcagtccatggggttcaaagagttgggcacgactgaatcccagggatggcggagcctggtgggctgccatctatggggtcgcacagagttggacacaactgaacgcaacttagcagcagcagcagcagcagagcaactaaactgactgaaaggctttctaaagttaacctaggaaactgaaatttaaatgtaccgacagtttgttgctggtggtggtggttggttgctttttaaaactcaacccaatgtcacagtgatgcactaaaattcctgtgtagaaataacagtaacaagttgggtaaatagacctttaaattgtaagacatttgtcagccaaggtcattttagtacagattcaaccaggctgactttctaagcttcctaaggagcaataatgtatggatggatataaaacatgtgttttggtgggaagaaaatcatcttcaataatgaatttggtaagttcagatcctggagcctagaagtcaatgtttaaatttgactcagtttcattcaatcagccaggcatagctgtgctcacttttgtggaattctaacttgggttgaaaaagtaaattatgttttcattgctccagtggcaggagacatgagagaatgtttcttgtcataagtggagtgggacctgaggatgtcccttctccaaaataaaatgtgatcctatcatagatcaaggagttcctaacatgggaggaaagcaagagaactatggaaggcccctgaaattttaaagcagagaaaagtaaaatttaaatttccacaacactcttaacaatccaa

SEQ ID NO: 61131 - DNA, 1077 bp, Bovine  19866880455232
tgcatatggtgactgcagccatgaaattaaaagatgcttactccttggaaggaaagttatgaccaacctagatagcatattgaaaagcagagacattaccttgccaacaaaggtccgtctagtcaaggctatggtttttcctgtggtcatgtatggatgtgagagttggactgtgaagaaggctgagcactgaagaattgatgcttttgaactgtggcgttggagaagactcttgagagtcccttggactgcaaggagatgcaaccaggcctttctgaaggagataagccctgggatttctttggaaggaatgatgctaaagctgaaactccagtactatggccacctaacgcgaagaggtgactcattggaaaagactctgatgctgggagggattgggggcaggaggagaaggggacgacagaggatgagatggctggatggcatcaccgactcgatggatgtgagtctgagtgaactctgggagttggagatggacagggagtcctggtgtgctgtgattcatggggtcgcaaagagtcggacacgactgagcgacttaactgaacctgataaacaagacttaagtagaaaaagccctgaaccaaacaaaagaataagtagaaagtcttttctgcaggaagtcacaactatggtttattttcctgaaacccttactactcagagtatatatttttttatctttaaataaaaattctttgcttattaacagtaacctcttttcaaaaatattttttgcttgctatgtcaattctaatactgtgttatggtcatgggtcattgaaacacgtgctgggttgtgaaatatactgaataacatgttttttggttgttgttgttttttaatattaaagattcttatgtttgttataaaggaaactgatccctttcaaaagtcaatactatacaacaactcctgtcaccccagtactctaaagaactgaacagaaatagttttaaaagcactggaagcatttttctttcttcttctttttttttagtagaaatttggtctctggtgagtaaaacaaatattcactgaaaatcaaatatttt

SEQ ID NO: 61132 - DNA, 1308 bp, Bovine  19866880522162
gcataaaattatgtattaaatttaagagacagaggtatttatagtttacaaaaggatcagagatatcagttgaataataaactgtgtaagtgatgtcagagtcccaagaaacaaaacaaatgagccaaaaatcttatattaaatctaaagaagttcataaaatagagtctgataagtcagacatgacttcatgactaaacaacaataaaattcttaggtattagacagattcattctagcatgtctttacttttcccagattccttgatctctgactttcattttaattatgacagttcttttattttataacacctttttacattttactaatttttgtgcacataagtatgattttcaaagagacgttctgttttgtaagtaatcccttaaataatgttaatcaattttgtgttacaacttcaaaagaaataaaaatattttattcttattttatgtttaggtaggattgtattactagcactattttaaaatgatgtttacaagaaataaataatacattaaaagaaattttaaagcaatcaaatgaaatatttaggaagttaattcccaatgtacttttcattatatcatgacaaattttttagtggttttttctcagcagctgattaatattgattgactaaattctcatgttgtattaagttaaaaaacaaatcttacaatatatactcatctttctataaacctatatttttaaggagatgttagcatatattgtctgtaacatacagaatcctaagtcttttaatgacattgaataaacagaatacaaccttttcacataatgtggctccaaagatatctgttccatcatgatagacttaacataagaaatcaaaaatgcctcagaattaaaataatcattttccttccatcaaaaaaatacttctgattttcctttgaaaacataaacagctataaaattttatcttagcaaaatatattctaatttatttatatttgtaaatatattttaaaatatttatatgaccacaactctaagtaatgataaaattagatttaatgatcaataaccccaacatagcactaaagtgtagagaaaacaactgctccttaaccacaaaatttaataaatgctaacaacaaatatacataaataaaatgccattcaaaccttaagcataaatacttaagcagtgtcatcacagaattacctatctagtgcctttctctcttcataaggttaatatttataaatgtcagaggcaaaaattgaacatgtagaaaagtagtaaaagggtcatagtaacttcgacatttcag

SEQ ID NO: 61133 - DNA, 3083 bp, Bovine  19866880546892
ctgagtttgaagatagtaatctttcttcattcatcaaatacttagagagccacaattatgtgacaggtcctgtgtcaggcactgagaatatcatgttaagaagctaaagaataatttatgcaatagatgttatttggaaggttatcagaattttttaaaaatatgttaaagggaaattattctctaaaactttctacataatagctatttgtgaattataaacacataaagatttgatttgatctggatcaagtaatcaaaatgttaaaaagttatgaccacaaatgaaaataattttacaaaaattttaaaaagcagtattctaattccgcaataataaaaaaatattaaaatagtgtaaaaatgtgcagttatagacaatgtataaaagctttagtttttaattccatgatgattagagttattttagatgcttttctaatttctaataataaggaaaatataataatagcttaaaatataggaagcatcagatttgagatcattttcctgaaagttggcattttacatagaacattgtatgttacttttttctctcttatgttgatatttttcctcagaaatcttggatgctttcaacacaactcttggtcttgcaatccttttcagacatataaaataagagaacacacttggggaataaaggaatttctgaaaaccccctgtttcacatattgggttacagagtatgtatatgtgctctttcacttccttgtctgggaaacagggtatgaactaagtaggatgattttactctgaatttatgttacaagtatctaatcatcacagtagattgttaatgactaatagctttttaatctgccttatgtctatacagacacagaatcaggttaagtcccttgaaaatttcacggttttagcatttaatattaaagttggcagtgaaatatgaatattttgaatgccactttggactgaagaaagaacacatcataataaaacttctgtctttaatttctaattcattccacatcaccagaacgtactcatttttagtgtttctcaaatattttctgttcagagaagaaacattggggttaaaattaatgtaaaaatctcatgaaatagtgtgcttgaaggaaatcactagagattagctggatgattctgactcatgacaagggatgatcttgacaggaatatgatgacctaccctcccaaaacatctttaataagaaaaatgtgtacttaatatctagggagagactagagagcattagaacaggagttgtcaagtcagcaaatctgcttattcttttccttcttgggaccaactaagacatcttaactaccacaatttctggagcaccccaaacagtagatacacatgtattgaaactggcaggagctctaaatatagtatttcactctacaatgattctaacaatggatttcagtttcttttcctagcatttctatgtttactacttggactcagtgagtctgacccatgcagagaaggatttcagaggactgaatatctgttcagggagagcagcctggcttagtaaactaagaatcaaaagtaggagtgactaccaatcccatagtgattcaaaagtaggagtgactaccagtatcatagtgatttgattcatattagagttaactgcaaagaagagagcatacattccttctgaattcttagaagacaggttagtctagtacagagtttcccataaagttaattgtccatgaaatgtaagaaattctgtagttttattatctttataatgctgggaaatttcaaataattatttgagcattcagttaacacagactttcttatctttgtgagtcaacatttttcttttttttttaaagaaagattcctgggatttccctagcagtccagtggttaagactgcacttccaatatggggggctggattccatccatggtctaggaacttggttcccacatgtcctgtggccaaaaaaatcaaaacataagacagaagcaatattgtaacagattcagtaaagactaaaaatggcccacatcaaaaaatcttaaaaaaaaaaaaaaggataggaaaaagattcctggagacatgtcatttgtttaaatctaatatatcctttgctggttaaacattgttacaatttacttgttcatatatttaaataatgttcagacagattcctttgtgtgcactctttaattttgcttgaatactgaatcccattacaggacatctggctaaatacacagagatacagtgagttgaatggggtccagtttgcgcattgactacaaagatgcagttgctttgaatcagatgatttttacaagttgcaagtatttctgatgtctctgtgactcactaaagcttttgtgaatccagccaaatatttcttatctaaagggacagtcagtggttatagaaagataacaaaagctgaatgggtagagagatagcctttggagaactcagaagaaatttcttaatctttcagcaaaagtccctatgggttttcacccactttttgtaaaagccaacactcattcttcaacacacatacacactcacaattttacataggaatgagatgacaatgtatcattttttaatataaaatcacatttataagtgtacttttaaaaattgatttattttaattgaaggataattgctttataatatcttgataggtttgctacacattagtatgaatcggccatagggatccaagtgtcacctacatcctcctcatccccctcccatctccctccccaccccatcccttctggttgtcacaaagcattgactttgggtgccctgcatctcacatcaaatttccaatggctatctattttacatatggtaatatatatgtttcaatgctattcactcaaatcatcccatgctctccttttcccactgagtctattctttacatctgtgtcccactgcagtctgttctttacatctgtgtctcctgccgtcacatagggtcaatgataccatctttctagattccatatatatgcattaatatacaatattttgtttttctctttctgacatcactctata

SEQ ID NO: 61134 - DNA, 2915 bp, Bovine  19866880644306
gttgagaaattattttaacccctttatctttaggatctgcaacactgagtcataatatgcatttgatgtaacattgacgaatggataaataaataaaagcagaggcgactcccacaaaatctttttgcctaatcctactgaagatcatggtaagcaataagcctaacagtcctgcagatcatatgttgactcatatcttacaatatttacggataaactagatagagtaatgttcagcatgctagcttagcagctttttttccctctgttgttttagaaaaagtttccatctctaaatatgttctctctcaaaataatctttaatcttactgaatgtttatatctattgtagacgtgctagttaactcttcaaaattgttattaacataaaagaagtccatgatataattttattcactccagacttatgctctgcatcagttccctggaatctttcgtcattgtacctttcctgtgtgaactcctaaagatcctaaaatatttatgcacatatggatgatttccaattaactttggagtatcaaacaactgtgatttgaggaattcattaacgcataaactaagtaaaagaggagtaagcctatcttgtataaagtagtttaaaaataaatttttattttataaatcatttaggttatgactatataattattaaccaatgttttgacaggtgcaaaacagggcaaaataacaaaagattattttcctcagtgtagaaatgtatgtttaattatcaagagaaagttttatgaagatatttattagcatttgctaagaaagattgtggtatgtgatagaattagcacaaaatgaatttagttcaggattatacaattagccagtcgtgcaactttgggcaagccatcctgactctcagcttattgtctgtaaataagcagtttggatcaataaatgacaaacctaaagttacacagttttctatggtaacctcaggagttatcattctacttctgttattcttgtaaatttttgaatggagaattttaatacattgtaaatagtttgccatgtttaataactaagacaaagattgagaatttcagcacttttgttattttaaagaaaagacattttagttgaccttgatgagagttaagtatgtagaggctacatataaaatgtttaaagtcttagcactcaaaaatgagtcggtcatttattatactgaaaaaaatcttagtatactgaattgaatagcttgaatttttagagttagtactggttggtagtttgatactaaaatgttacttgggggaaaaaaggaataaatcattataaactgtcaaagggaaggtgggatgaagaagataagatggagagatggttaataaagaacgattaactctctgctcgtaaaagctttctggtaattgctgagaaacagagcatgtactcagtggtgacatgttctgatgtatttgcctctcccggttcctctccctcctcttttcagaggcctcctcttcctccttctgattgacaaacacctaacaagtacctacccaggagacagaatgtatatgtaaactatgatgattacaatttgcagaaagctttagtaccatcatacaggttgtacttatgtgtttgtatgtgtattatatctaaaatatacacttttatacactacaaaaataagtggtattctcataggctcagttttaccaaaagtcatatcagtagatatattttgcatttgctctgttaaagaaagttaatactcagactactccacacactcattttaattgatatattttgttgttactactattaagttgaaaagtagaccatatatagtgttgatctggggttaagtgtgactaatagggtataaagaattttgatggagataaaaagactagtagggatgtaaaagagccaaatgcccttgactatattcacttagactatattcaattagaatgttcacataagttactatattcatttagaatgttcacataagttagaggtctttgttcagacctctaacctctcaaagtccgaaataaaatttccctcttccaattaacatatctaggtatttataatgatctgtggatttcctttgctagttaaagctctgtatgtgtgagagagagaggaagatggtctttaagtgccctggcttactcactttccatgccattcttctcttctcacatttcccagtggcagtgtagggtgagatgtgatggaataggtgagaataaagggagcttatcactttctcaaggtcagctctgctgtttctccagctcagatttctaattttttgatcctgtacaaaggatatgttgaatttatattttggaaaatgccaaataagcaagtagcaaaatcaaaattaggcctaacctaaggccagataaatgaaactgcaattttgaaagacagactgttcactctactctgaggtcagtgaaagaaccaaaaatactttcatctagctcaggtggtgatgctatgactaatttattaaattattttccttcctaaagtgaatggccaatataaagacctatctttcttagttttagaacttgaagactggtaaagacgaatttcattgaggcaatccacaaattaaataatttttttaacacttaaagtaaatactgaatgttttcacaaagttaacatgatggccttaacttgtgtttttatttataaatgcaagtacctgctgcttcacaaagtcattaaaaaaaaatccttaaactttggagctagatatagggcaaaagatcattgtagttggtaggcaaaacaaaaatagtatttccaaatttccacctggatgtctactttcactgaatgtacaccttgttcaagtcctttcttaaacagaatattagtagcgtcttcac

SEQ ID NO: 61135 - DNA, 892 bp, Bovine  19866880659911
agtaatgaagcagcagcaaatttacatttgctcttgattccttgacaacataattgtgtcttacttgatgttattttaatcatagtattggagaacacccagtgaaaccaaaaacaaagaattgtgaagacatctgtgtccatgtttttcacctataatggtatttgtgtcttggtttttagaggaagttgtagtaaccaatgagaaatatgcaactaaatatatctttgcttccattttattttaaaaacatttcccatggtactattttcaatagtatcattataaaaactatgaaataaaatttaaggtgccaaaggaaccatgaacttccaagatattcaagctggttttagaaaaggcagaggaaccagagatcaaattgccaacatccactggataatggaaaaagcaagagagttccagaaaaacatctgtttctgtgttattgactatgccaaagcctttgactatgtggatcacagtaaactgtggaaaattcttcaagagatgggaatatcagaccacctggcctgcctcttgagaaacctatatgcaggtcaggaagcaacagttagaactggacatggaacaacagactagttccaaataggaaaaggagtacgtcaaggctgtatattgtcaccctgcttatttaacttatatgcagagtacatcatgagaaacgctgggctggaagaagcacaagctggaatcaagattgccgggagaaatatcaataacctcacatacgcagatgacatcacccttacggcagaaagtgaagaggaactcaaaaacctctttaggaaagtgaaagaggagagtgaaaaagttggcttaaagctcaacattcagaaaactaatttcatggcatctggtcccatcactt

SEQ ID NO: 61136 - DNA, 2260 bp, Bovine  19866880671771
acctgggtttgatccctgggttgggacaatcccctggaggagggcatggcaacccactccagtattcttgcctggagaatcccatggccagaggagcctggtaggctacagtccatggggtggcaaagagacggacagaaggatccacaattttcatcatattctcactggtgtctacaactaataagctggaatctattaaattaaataaagaaaataacaacaaaaatcaccagatctgcctgaatattgttgtacagaactattgcattctggaaatacccgtcaatgctgaggaggagagctgagaatacagcatgattcatattatatgcattgcttgccatacatcacttgcatatcatagctaaagcctggataaggaaagatagtataacataaaatatctttctgataaaatgaatacaaagtttaaacttcttcaatgttaatacagaatatattaatattctatggtaatataaaaatgaatgaatattcgcaaagtaaaaatttaaaccggtagagttcttttgcattccaagtatatttagattctgggttgcatgttgatgtacagattgagaattatattcattctcctcttctttgtattagggagtaaaatctttggattttagaggagcacatcgctgcccagagggggactccatttcccaggcttccttgcagcaaggcatgcccacgtggctaagttctggccaatggaatatgagcagaggtgatgcacctggccgctttccttctcacttctctttcctattggctagaaactggcaacttttgaaatagtttaaagtgaaagtagctcagtcgtggagtctttgttacctcatggactatacagtccatggagttctccaggccagaatactggagtggatgactgttcccttctccaaggcatcttcccaacccagggatcaaacccagggtctcccgcactgcctgcagattctttaccagctgagccacaagggaagcccaagaatactggagtgggtaacctatcccttctccagggaatcttcccgacccaggaatcgaaccagggtcttctgcgttgcaggttgtttctttaccagctgagctatcagggaagcatgataatttccttgtacccaaaggtacccttgattgtttcaggaaagaaagaaagaaagaaagtgaagttgctcagtcgtgtccgactctttgcgaccccaaagactgtagcctaccaggctcctccctccatgggattctccagggaagagtactggagtgggttgccatttccttctccaggggatcttcccaatcaagggatggaacctgggtctcctgcattccaggcagacgctttaacttctgagtcaccagggaagcccccaaagtaatcatatatgaatataaatcttaattttacaaatatatatgatatttagtgtttatagtaatgaacgaccttcaagctaaaaacaataaaaataattttgtttttgttggcaaaaattaaatatatttatttcattcattaatgtattaatgttaagcattaagtatatgatgtatacaatattagcaagggtatggggaaatatactctcttaagagcatgtactgctaatttaagtataagaagcttaaactttctggagggccattttacaatgcataaaatattttatatcctttgaccagtaattttacccaataaccagagatgttcacaatatttatatataaggtttttcatgtgtggcatcatttacaatagtaaaaactggatatatatcaaaattctaacaataggggattgatgaaataatatataaaggaatgcagtgcagctattaaaagtagtgttataaaaaggaatttaatgacatgggaaaatgctcatggcagtctgtgaagtgaaaaaaaaatgttttaagggactatgtatacaatgatttcattctgaaaaatagtaaatagataagatagaagaataaacatcaaaatgtcaccagctatctctgggtaatgttcatggggaaagaaatatttacagatgaatctatatagttttcaaactttctgcaacgaacactttgttgtacttttagatgttctttaaaacggaagataaatgtaatcagagaactttagagacggaagatcctttaactctttgcagtgtctctattgacaaggttgtgtgctctgatagttaagctgacgaacagcccaggctgcccacacgccattcatt

SEQ ID NO: 61137 - DNA, 1348 bp, Bovine  19866880722203
gcttaatttttctgagcatcagtttcatcacatgctaatttggattaaaaatagtatctacctgcagaaacttgaaatgcattaaagttcagcatattgtaaggattcaaaaaaggttattgttactattattgatgattccatttaaaaaataatcatttgtaacttacagtgcaaattcaaggcttctttgttagaaaaggcatctgtgactttgctcatttcaatttatacttggaagataggcagtacttttttttttccttcctactatttttgaaaaggcattcagacatgaaatgcttgattatttacttgaatcaggattgaaacacttggctagttgaaggcaattctgggaatgagaaaaagggcccctctttgagtgattgaagctggatttctgaatcggatctttcaaaaataatgggattctttgcccattttccatgaatttacattttttcatagaaaattgtcttggatcagataaattttaagtaacatctcttattttttcattactttaaaaaatgcagccctaaattatcttaatctttcttactctccttaatatcctttctgctggatatttgattctttctatatttagttttctatcctgtgactatttttaaagtctgctttttttcagattcggtttcttatttttcaagtttgataaatatactttaatgaatttttagaaatttagctttgttttactgttcactttctcacaagcactatgttctttgcttggcaagaattttcttactaaattatgattctgttgtgtggtgagtgatattttctacttgacacagataaggaaactgagacatagattacatagcccaagttcccacccataaagtatgaagaatgggacgtggacccaggtggtttgatttcagagctcaggctctccagagctgcacaagtatcctcgttttatcagagatgcactttcaaaagctgcctctttttttcctttcctttattctctatatattttacagtcctactcatttctttaaggaatatccccctttccttcaaaatgtagatcaacattttagaatgtaatgtgttcccttgtgtgctcctgcatttcttactgcatctctgttctcccaggtcactgactcactgctggggatgtccttggcctccttgccctgtgacattcagttactaactccattcttttacttctgtcttccaaggagtctgagcttttgaatgttattttcctttcattcagttccaagatgatgtttgtctctgctgagtgtatttcctttaagctactggaaccttctgttctgcagattgctccttggtg

SEQ ID NO: 61138 - DNA, 624 bp, Bovine  19866880730634
ggaagcgtctctatataaggaaataaactggaaaatcagggagattttttttctcttagtttttttttttttaattttctttttcataaaaggagctggctatttgaagactatacccaatctgtatgttttacacaatcagtaaagacttttgaatacatttcaagtattaaatctatttaaatgtatcattttaaagaaggtcgtggcaaatagttagtttcacttaataaaatgcttggttttacttaatagaatgcacactagttttctgcatcttttcaaggctaatgaaaatattgctaaatggataaacagtgatgctaaagtaccatccacagaattacagatttctctgcaaagaacagatttttattttctctgaaaaaaaaagaaaaatctgtgcttctttctctctaaatatcagcattacagaaatagcaccacttaccaaagtctgtttaatatatttcctatgaccagaacatcatttgttttcctttaccagaatttggtcagttttgtcagtttccactctttcacagaacataaaaaaaaaaaaaaaaattatgaggatcttgagtgttaaagcttgtgacgaaaatcaatcctaatgggaaattg

SEQ ID NO: 61139 - DNA, 939 bp, Bovine  19866880964314
tagagaaagatttagctaaggaaaattgattaagaggtaacacaagctatttaaataaaacatggaacgtgagtggatgattgtggcatcaggctggcaagggtgtgggacaggaatcatgtattaaaattgaatggcaggggaaattgctgatagtgtaatggttagtaggaaaaaaacctgaaatagagatcaaaatatatatgtgattatctacactttgtgatctcatagtcttttatatgtcactgtattttcaaaaccatttatattgcttttatgataaaagcaataaaaataaagacctacagacagaaacaaaaacatttgaaggtgtttttaaaatattttaaaaatccatggaaaaattactatcacaaatggtaaattatttattcagatctcaaaagttcaatagaagcttggggactgtcaattaacttgctggttacagcataaacaccatcaattttaagaacagctctataagaaagtcagcagacaactgactcatgaccttcccaacagcacccaactgtgaaacaactcagcaaggaaatgttctcctcctggcagagaataacctggtgacagcctctgtgccacaggggatcctgggccttccctcaggctttgttttttttttttgagtggaggaaagatttctaactgtgaccttcttggtaaagagcagagggtatcctgctgggaaaaatgcttcaaatctagtctggattttgtccctttcctcagctcaggaagcagtattgcatatcctggacaatgaataactgcctatttacaaagatagatgaaaatatcagttgaaacattacagctaaaatattttaagtataattcaataaatacactatttctgctccactgaaatttatggagctggtaccaccagactgtagatacactgttaaaatgtac

SEQ ID NO: 61140 - DNA, 1817 bp, Bovine  19866880979394
tctcagtaataactcccgtcactaatctacttctttctttcaattcctttctccttcctcttttctttcttccttccttccctccccaattaaatgttcatttgtcttctactatgttttagcctctagggctaagtgttgatgataatagaaatgaagaacatgaagcctcagatctgagaagttctgccaggatcccaaggccatggggtaagtattgctgggacagtcatataagagcacaggggaggagaatccttagtcatactgcttgccagtttcaattagcatttgcagctttctgataggattcattatcagtcagtggtggtagctccatcagtggtgatggttacttgtgggattcagtgttctcagcaggaggcttccaacaattacttctgatgctcactgaagggactcccatgacttgctaacctttctcactggactgatctgagataatcttctgtaggacagcctatggcagcattcttgctgaccctttaagtagcatacagggtcttaatcggcttttttaaagaagggttatcttaagtgttaacacagtttagcatagctttagagaagcatatcagaatgaaactttcagagttacagtctacagtggcctgaaatgcccctcattatggccattatgtagtgtgaattctcatagttccgaaggaatttttataattgtgttgcagcatatacttggttgaaaaaatagatcacagaatgtcatccatctctgtgttctggaaggaatgctgctaaatctgatactcatactgagtcattcaaaaagctgaaccgaaaagaattcaagatcctttagcactcatgtaaatctctggtagacagagatttggattgcctagagaatttggaattctttatggaaacaaattgtgactagacatttgctaaaatgctactcttcaaataaatgcatgataaaagtaatgcttactgtcagatattcctagagtactaagaaagaaattgagaatgagaaggaagagacagaaaacacaagcgacatattcaacaatagtagtaatagctactgtttatcctctgtgctacaccctgtacataaattactacattcaatcctcataaaatcttttaaggctcagcaaaatacttatgggcatttaacaatgacaagctgaggcttaaaatggaataatactactaattatcagttatgtatgtatcaaagtatataaaactacataggtattatgcctatgtatttagagtatctgacaaaaatctaaaattttctcatgttcttattttcaagagaagataaaaagaatcttttccaagatatttattggtattacattttcttaactcagtggtgttcaaattagcattaagtggtccacaaaatttttctgaactgtgacaaaataagccagactgagagcaagattttagacacattggtgaataaaaatgtaacacacccatcaaatatatgcatttgatcatttatctagtaatcaatttttattgtgcttttaaaaaatacaagttcataatagttttttttttttttttaagcaaactacctgcttcactgttcattagagaggcacagtcttgagttacccacaaaatctaagcttcaattgagactttgataactcgtgtcaaattatacctacacataagggagatttatatatatatatattttttttttttttttttcaggaagacattaaaatctggcttaaatattgttgctgtgggggtagagtcactaagtcatgtttgactctttgtgaccccaggga

SEQ ID NO: 61141 - DNA, 1739 bp, Bovine  19866881067296
tcactttaaaatgatataaaactttgatgtgtttcatgtagtttctttgtaagctattttataaatataaaatgataagctatttgataaaatcagcttatggaaattgttaattgtgtgccacatgttacaatttgtaatatctgctgaatgcttatacgtttattagtgctgttaaatataatcagtgtttgttttacctaacacagttcaatagaattcttgatgtattttataataacctaactgtggtttaccatagatttttcccttcatgttatttaaaaacaagttttacaaagtaagacaaatgacatttattgtgatatatgtattattagtaattgcttattgtcattttatatacaatctgctaagtaccaagtttatatttaccaggaaaatatctagtttggtgacttaagccatatgttcttcattttctgctcatggttggcagtaagtgtgggcgtctgtctgggccacttgcccagctggaccagtgcttccctttcacttcctttccctgactcagcagcaggcctgagtgacaggacggtcaccagtcttctagacaaaaaatagtttgacaagggtaaatgtttccactacttgagtcatctgggactcctctctgtggtcagtacctgtacagaaaaagaaggaaattgtgttttcactgataacatcccttcaaatatattatattttgtttcagagaacaccaaaccacaaggatggttccagtcagacatccaaatgtttactctgagtcatacagtagttaacacactggagtgagggattccctaagtaggtatctgggttttctctagtcactagaggctgttagatatatggatttaagtggctaagttttatttactttgctgacttctaaattttatacagtgacttttttttttggtcttttttgtgtaagaatcagagaaatgtcctataatagaaagtggaatagagaagaattcccagcacaataagatgaagcatagatacgtcagatgagtgttaagaaaatacaaaaatagttacaccaccagatagatgatgattagcatctgaaaagagggtttaggggatttagaggaaaaggggatcatatctgtccggaaatctcaagacttcacacagatagtaatgctgatatgttttgtgaaactgcagaattgtaatgctgaggaagaaggggactttttagggagaaggagcaagatgactacttgtttcagaagaagaataatccacctagattggtctactggatccatgtagggaattattaagattaacagctgaaaactaaatcaggctttgattttgagtcataatttaagaaaactgtatttagtttggtagacattatttttcagtgtaataacgtgattgaagtataatttagaaaattaacctgaagtcttaatcataataaatggcttcaggaaagactaaagaaatgagatcagtgaagaaataggagaaaaaaggacacaatatgaggtagagaaaaggaaccaggaagggagagagaaatgtgtggacaaagtagaaattatatgattaactgatcatataaaaaattttatagagggccctaaaaaattctattattttcgcattagcctaatataaccccagtatttttcacaggtagagaaatttgtgaatggatttagtttctcaccctgctgattttgaattcccaggtatttctatagtag

SEQ ID NO: 61142 - DNA, 1851 bp, Bovine  19866881163731
tcacactttctacattggtctcataagcagatcacccaagagaggaaatacaacttaaatgtccttataagattctagatttcgaaaatttataagacacctagtaggcctttttcataggtcacatatgcttctcatttggtaaatttattaagatagcctttattttaaagtaatggcttggcggaaaaggagattcttttctaaaacaaatgtttaatttctagagcagcatcaaggataaagtataccatcaataagtaatacttagcaataactccatatccatgtatttagtactattaaaatattatgtcaacatttatcatcatatatataaaatctacatgtatatataagcaggtacatgaattataatcttaagaatacattttaaactattaatacaaaatgctactgctgtctttttcccttttatccctcccttcaaatgacagtctttgatacatttgaagagccattgttaaatatgtttttaaaatgctatgatgaaaactagctttattgacagtgcacatattctgttactgttcagagtacatataatgttttaaaatgaaggcaagctaaagcagcaaaacatttgtcatggtttgaggtattaggtcatgaagtttgcatgtatatttggtggtttatatcatgccaaaatagatgttccccgtcgggaagattcttaagtgctaaaatttgcccttactgttctgtaaaaattgtaactctttcagaggggaaaaatgtgttaaagtatatattttcacatctctgaattgatatattttttaactaccaaatattttaaaaacttatatgtatcacaaagatataaagtgacttaaaggtgctaaagaaatagctaatttattccacatattctgaatcttccaacagatggcatattttcagcaaataacacctaaattattatctctcagatgatcaacacctgataattggtggctagacacatttctatttaaaacatggaattctacatctagataatgcaatatctttaaacattcacaaatttcctttttataactttattataataaatatttaatttatacattttacaaattatccctatgaatgtgatataccttcatttgtatagttatattcaatgaatttaatctctagacaaaatacttcccattattctcttctaacaccatcatttgctttgacttaaatgataaacatgatagagattgaatttaatttccttaataagtaaagtttatctaacttattgaatatttatattttaatcttgaattgatcaacattgatcaacatgtcttggatttcttcccaatgctgttatgacagttttttttttttcctgatgtagcaatctatacccaaaacttactatgatataaaatgaatatttaaaagttatcttctacatgaatgcataatagaatcaaagactttatagcatgtgaaataccatattacataatatcaaatttaattttgatgttgaaattacagaactatatagttcatctcactgttagtaagaagaattaggtcctattttgggtttggggacaaaatttcaagcctgtgaaaggtgtgtgtgtgtgtgcgtgcatgtgtggggggtggaggggttcctgcatgtacccaagcaagttctacaccagttccaacactatattctaggagataacatcaaattccataggttgagacctcagtcctataggactgtgtgcccctctcccatccccaccagaggtcagaagcaagcccaggttgttatctgtacttttgcctgactggttataaatcagagtttcccacaaccctctc

SEQ ID NO: 61143 - DNA, 1254 bp, Bovine  19866881269867
tcatttatgcccctcaagtggccaacaaaatacttgtcatcaagaagaaatgcagtaatcagcttattccacttaattaaaaaggagctgattgtgtcaaagaacaagaaataaaaataatttagaagttgatagaaacaatgtgcttcaaatgaatttgctcctttaaaaaaaggaaaacgtaaaatatttacccatttgaaaaaaatatcttattaaaagcaattttaaggctcttaaaggtatagttaagaaaatgtatacatgaaaaagttgtaattccctttatagcaatactatgtcctgttcttgattaaatggaaagaaggacaagcatgagggagtggggttggggtagctgtggtttggagactaggttactatttataagtaaagaatggaaaagaaggtgtcatgaagttaaactagggaggtccagcactaactaaatcgtgggattgtctctatggactgacttaagccctttaacaacttctctgttttattctctccatctgttttaccagactatcaggaggattatttagttaatgttgaagactatatttatcagctcacaaaatgtctgtgatttaatgatgagagagctctaaatgatgccatgggagtatcacagggaccagcaacagcgttattgtcagttgagtccttcagagacccacaggacaaaatatgatatgccatactcagagcacttggaattgcgtttcaataatcatttctcccttttactcctccaaggcaattgagttttatactttgtgagcttgagaagcaatttggtttttatgatgggagaaatttagagaggtctcaacattatcctgaaaatgattctttcaaatagaaattaaatagtgacacgatgtactacaagtgataacttttctttctaaggatctaagaacatgaattctttgcttgaaatccttgtctaagatctttctcttttcctttagtaaaagaaacagtatcatgtttagtaacctgaccctaaattacagacttggaagcctttaatatatcaaatgttattaaccgcatttattttctaaaggccatacagtacagagtaactcagaatttgaaatagtgtattttgaataagtcaaggagaaaagaatttcctttatgattcagggttttaaacagtctgcatttttaataattccataataggtatcatcctgactcagtgaggatgataacacagcccaatacgcttcagcacac

SEQ ID NO: 61144 - DNA, 1143 bp, Bovine  19866881376770
cctcttctttgttacagacacgttgctttctttgggatggaataaaaactcatcttttgctagaaagggagtatgttttggcaacccaagaatatacaaacaatgaagaaccatctgaatccccaaagttcaaattttggtaaaaccaagttttagggctgaatgtattttatcacattgcattttgaaaatcagtaatccacatatggcatatgtatccttgaattacctacagttctcaattaagcaaaccatggcattccctagccattataagtaaacataggttattgtagttttaaattatgccactttcaaacattttttgctttagtccttgaaacatcaaatctctttcattttcaatttgcctctttcaaaccagtgccccataggaggtgccgtccaaaagttgaaagtctctttatttctgccaagtctaatttagataccactaaagcttccaacaagtgtacatgggagaatgaatttgggaagaattttgaaaacagaatggtttatgtcggcagcagtttgaaaaaagagtaaatgctattgagaaatgaactttcactaaaccaaaaataaaaatgctaaaagtatataattatcttgaatggtaataagttctgcacagttatccaaaatctatagattaattgaagaactatgttcctttttgagtatgatatggccttgagttaatgaaccacagcatccgtgatatggcattttgtactgtatggtatattttaaatgaagcttaaacaaataaggactccatactgccccaagcaaataaagttttacacagcaggaggcaaacattcttgaaataattggtcacgataggatattattcttttttttttaagtcttacacaaaacatatctcatttcttctaaattggttctgtagatttgaaaaagaatcatgatcaaatttgtggcatggaaaagagccattctttataaagaatattaattatcactgtaaagtacaattaatatagaagccaaggaaattacactggatttctaatttgatgacggtgcaaacttactttgaattaatttctgatatgacttaatcagtagatattattatgtacataaaaattataaaaacatgcaaaaaataca

SEQ ID NO: 61145 - DNA, 1437 bp, Bovine  19866881566928
gttaattatctccctgactgcgtaggtcagaagcatttggtttttccacaagaaaaagatgtacttatcaggatgatgatttacaggttatcagaaaacatctaagattcattccaaaaattcgagatcttgaaaattagcccctccagagtctgggaaaagcttataaagtttttttaattttttctcttcacctctttgaattgagaatgagaagcaagtgtgaaagtgctttaatatttcaaatgtgaaaatcaggactttgatcaaaaagaaaatctaatcaagatacacagaactgaaacatggttaaaggtataacattttatttggagcaagtcttggactaaaaataaagtcttacatacaatctaagaacatgaaaaactatgaaaagtaagatatttaatctctaggcaagcaggcattcttaaatttaatagttctctaagaattctttattctgttgttctaaggaaacaatcgtttcctatcgtttttgcaatagatatattccatatttcatgaatatgtttccattgtgctgtctttaatcatgggtctggtctcggctttagtctgggatttcaggaaattgcacaagtaattgtcatcacagacacagcttaatttctagtgtagtgatgacacaacaatttgcccaaggccaaactgaaacagaaaagtcttttataaaatgatgggtggtttgttctacagcttgatagttcactatagtaagattagagaatgtaaaaaagggaaatttaagtttatgttgagcttcaaaatcttaatgaaattgattgcttgagaatgatttaacattattatgataaaataaacctatattccacccttccttacacatatgagctttattttttgaaaaaaagtagatataggcaaaaataaaggagaaaagtatacataaaaacaaggcaatgaaaattaaaatctagggactcacatacaattttattcacatttggaagtcagaagcacttgtttcaaatactgctttgccactatttagctgtaaactactgataaatgtatgaacttcgtgttctcaatatcaatcctgcaaggttctcgttattaaaaatgagattaaaaaatgagattaaaaaaaaggaaaaaataggtttgtaagatatttagtataataccagtcacctattaaggacacagtaaatgacagttattaaatgtttatcagaaagtgcttcaagtaggtttttgagctatacttagcagaatttagagccctgagaccattaaaattgcaagtgatccaatatcaacttttcaggaaaaaatacttaattttatacataatcaaaaatctaatatattttaaggataatgacaggaggagagatgaggagactaagtgtaattgtatgtgtacatataattctactgctacaggaa

SEQ ID NO: 61146 - DNA, 3089 bp, Bovine  19866881618304
aatcaatgacattcattttttaaaatttatgtacatatttgacaaaaatctatgaggtatctattatgtacaaagcactaagatctccttaccatgttgtcttgatttttgtagttttatactaagttttgaaatcagataatataagtcctccaactttttttttttccatttttaatgtgactttggctattctaggccctgtgaatttctatatacattttaggatcagtatatgcccagaagaaaagtctgctgggattttgatatataaataggtgttaaacagacttatagcatactctagggaatataaacttttgtttatacttcgtttttttttgaataggcatttacttttaattgctccttacattagtttgacaaagaattaattgaaatctaaaacctaatttagtgacatgccatagcataaacactctaataataagaaggtgacaataattcttataatatctacatgcctaagacactattatgttatataatgtaaagagcaagagatcaagtgctggagactttggttcaactcatatatttgccacttactagatgtgtgaacttaggtaagtaagttagcttcttggaaacttgacttcctcatttgtaaagtttgatattgtcattccagctccatttttgcaataaaattgctataagaataaaatcagataccatgggaaagcaatttcaaaacttgtaagaacactctgccacttattcaaatgactttgtacaagtcactgaataaattcatgcctctgctaactaatctgatcatgagagtaacagtaggtatttttcagagtttgatccacataaagaactgagcatattgggagtctggaatattgcttacactcagtaagcattagctacttctactacaaataatgataatagaaataaaaagtataataaaataattgactgggaataatactaacctacatgcaagaaaggctgaatattatgtaagtctcttaaaattagttgatgaatttgaagcaaatggtttaacctttccaggactgagcataatcctaaaatgagggtaataaacaatgtgatctcaaatactgtccttgttctgaaattcagacaatgtgttatcattatagggacttagtaaatgaatgttaagtgcatcttaataagtattatgtattaaccctctctcagcctttatatcattgccaatttcatttatatataatatatacagtattattctctgcttcaaaagaaaagattaatctagggaattatatttaaagccattccattgatttaattttcctttctattgaaattttcttggaagaataaattaataacctccttataactatataataatgtcaccttggtgtttttgtaacatgattaattcagttagaaaaattcctgaattctctattcttaaagatgttacttcagttataacagtaagacatttctctaataaaacttcaaggctgagcaaaattctcattctcacagatgaatacatttatatagaaaggtatttattgccttcacacattcttcccttatattgtaagatgaagaaagtgaaataaaaatgattgaatatttaaaggccctagtttgtgaattggaaaggctgcagaagagatatccgtaacaatggaacatgcccaatatgacagattcaatgaatcaaatatttaaaatatcactgtgctgtatgtagaggtacactacgcgaactgtcatgtacagatctacagtaaatatgaggcttgtaatatttattatttaattcttaaaaaaataaagacaggtgtctttggcagcttgaaacaacattcatgtctgtgcaactgcattctaatcacatttaacagatgacaaaagcagtcattacctggaatttttcacttgatggctctgtaccttctggggacaggagataaatgaaggaaagccgacaccttcagatgttgtcttgattagtgttgacatttttccttgggggttgacagctgctaattaatttaatttagacatgaaacagaggataagaaaatatctttttaaaaaagttttactaaaagaaatattgaggtacctccatcacaagtagtaagagcaagtctaatttgcaagatcccaaattgctactatgacacactcatgtaactgcattctttcattcttaagtgtaactgctcaaatgtagagaatatagaaaatatatgaagttaaatcaaaatatttcctctacagatatgccattcaaatggggtttctatttaaaggtgaaaagtacagcacaaaacagtttttatgcaagttgtctttattcttaaattatttttaaaaatgatgctttaataagattttttttaaaaaaacatagtttataggcagactacttaatatttttccttgtgttctaaagaacatgtgatcatactttgttttctgacacagaaatatctaaatttctggttttctttaaagaatgaaaataaaactgaaatgtatgaaagtgtcatcataattaagggagaatgttcataaaaacaacaagcatgtgtgtaaaccacattgtagcttgaaaaacacatttctcatctgggtaagatctacatggacaagttgaaacagtctcagaaaaatacaggacagtgttgtctgctgtgacgatgagaataagggcatagaaaaccagcattttaaaaaggaagttccaaagtggcttgaggtgggggagtgaatcaataaaggttacattaaaagactgatgagcagaagtattgctctattcagagtaaagttcaaatttgtggtgagccaacaagtgttggagattatgaggacatgacaggaagcagggggaaggagggagtttcatattacccaaagtatgcatttatctcttgctttccttggagtgcagaaaccagtggaatttaggatatgagtaactgaagggggtggagaaataccttatttttctcaaactgtggtacttccaaagtgaatcactgttgttttgcttctcaagaaggatttatgtgctaaaacatagatttcag

SEQ ID NO: 61147 - DNA, 763 bp, Bovine  19866881822444
tttgttttctaattttaaacctaggaagaagaaagaacatgtcagtttctgctttagccacaataaaattaataatgctttttcaattcagctttccaagctagatacaacgcaagtcaaatgtaaagaattgtggagacattgacaagatgaaagggattcctatcactttcatcaaaacttaaagcacaatttttaagttcttaagttttaagttcatagggtagtagctataggcaatcttcacttctaaataacatgtcagactgcaggtgtccctggggattgaagaaagtctatggtttatgtgcctctttgtctcaggttcctcaacacatctgtatatatgtgtgcgtgtgtatgtatatgtgtatatatggagcagatcaaagctagttccgtttttagtttatactatatgattacttttaatagtaatttttctccacacattctactcaacacttaggacccctgggcttggtataaccccctctttttttgatccattttttgaattgtgcctctcccttctgcatctgagaatccatgaacagacgctaacaaaagtccaatctcagtgtgtcatctctctgaggagctatttgtgattgtaaaggaatgttttcttacgctaattcttaggctctctccatcaactaattgggctgactttggactcatatatatttttgataagaatgtctctggtgaatggggaggttctgttaaaagcttttacacatgacattggttcaatcag

SEQ ID NO: 61148 - DNA, 937 bp, Bovine  19866881839655
tgaagacattctaaaagtcaagagtgtcatctcctgattagagcctggatagtattttgtattttgctagtgttacctctatgtcatgcagctagaccaatatattgtgattaatatatgcatgtgccctcgtatccagtaattttagtctagaaatttagctcacagagatttactcgctcctacagggaatagcatatgtacaaagttagtccccgaagtattatgtatattagcaaaggactggaaacaatggaaatgtctatacaggggactgattaaataaattgtggtggtcagtataggggatgctctgctggtgtaaagagaacagagacattttatgtattgatatctaggaaacactatataaaaaagtaaaatgaaaaaaaatgtgtatttttttatacaaaagaaaggggcaaagagaacacagaactattttcttacatacatatatcaattctctggaaagattacagcatttttttaacttacctggttgtggtaaagactccatacactacaggatttctttcatctctcgtggggagtaagtaaatgtcttctattaatgggaaaaaataacgattcactgtaatttgtatttctcaatatcacgtttgctttttccttaataatgcaatatttctgagactctaaatagtatgtaaaattaagataacagtgacagtcattaccttatgacaaaagaaattaaggggaaaggtccagttctcactagctatctggcactgtgttgaacatttaacctccgaggtgtttacttcaatcacctgtaaatgggatggttcacttgataagctccatgtctgtttcctattagctgtatgtgacttcatggagaatgaaagtaaaaatgggttatttttaccctccagtgttaaaacaaggtgttttcttataactgcaccag

SEQ ID NO: 61149 - DNA, 1070 bp, Bovine  19866881997028
ctgtttgatgggctgactaatgaagtggacaaaaattaaaactaatattttcataaaaagcatgatatccttatcctgccctgtctcatctagctcccttttatcctccgtttctactctcccacatataggcaattactcactctcactgggacacattaaagttcatcttagaaaaaaaaaaaaagaaagaaatccacaaaccaacacaagaccattaaggatataaaataaatttactgttgcttataaacaccctaagttataagaaaatgaagaaatgaaatggactgagcaccactaatcatccttaacctattttgatacatttttctcttaaattcaacagtcatctagtaattcatttataatttgcacataattaaaagctgtggtcagttatttctaagatttaaatttcattaaggaatgtgccctctaatttttaaaatttaatcaacattttacaaaatttaagttttatttataatcagatacattattatttgctatatacatatagtttatattgaaggatacaaatttatctttttgtatatttttattttattgagtctgttaattattcagtgttgttgtcacaaaataattttagggaataacttctaaaaatgtgagccagtacacaatataacaaatatgtcaccttaaagacctaaattttttactaaataatatttatatacctaagttatgagttactcaagggagctacataaagtccttaaggacatattcccttcactagtaaaactgaactcagtctcagttaaattattaataggtacacttttgaattaaatcactatgtctatcatcaaatctctatgaaatcaaattgtactgatgtttttactacagtattcattgaaacacatgttttagtaatgtatttatctgatccaaggtctggttttagtaatcttcatatgctgcatttaactgagctatattttcagtgtaaggttattatattaaagttatatgggacaaaaactatatattcacattttcctagagagtaacacacagttataagtacttcaata

SEQ ID NO: 61150 - DNA, 722 bp, Bovine  19866882054908
atgtttgttttagtgaagtccttactttgcatactctgaagaatcttggaaatattgttcagatgtcagttccttcaggctctaagaatgacatgtaccttggctgaactttaaaataaattctacatttatcactgttttactgcatccttttatttttgttggtttctcttacaagcatgaattctctttgatcttcccatactttgtagccacacagaaattatttatagagtatgagcctcaatcttttttcctataaaacagccttgacaacttagtgccacaatatttctctcctacaagaacaaaagataactaattttcagtatctgatcccagtttattctttcaaaattttcaaaatgtatctttaaaaactcccaactcaagttatttaccaagaatatgaaaaaaattgtttaatttcctatatatatccaaaaatttctggatttccaacactctgagactccccgaaagtaaaagtcactcagttgtgtctgactctttgcaactccatggactgtaccgtccaaggaattctccaggccagatactggagtaggtagcctttcccttctctaagggatctttccaacccagggatcaaacccaggtcttccgcattgcagggtgggttctttaccagctgagccaaagggaagcccatcatattcactactgaataatattttttcttcacattgacatactttttt

SEQ ID NO: 61151 - DNA, 729 bp, Bovine  19866882071967
atttgatgactgattgtgacctggagccatttatcaggaaaaagcaagatagataatgagtaatgtatctaaggaaaggatggagcttgtaaaatgttgattttgcaggatagtaaagttctgttgttatcaaatgtgttggctgagaaaacaagtaattctgatttttacactttaagagagtaacttgaaaaagactatgatatatctacctttgtcaaattataagacattaattgctcattaatcaaagaatgtgtacttaatcaaaagagatacatgccagattttaattcttttgaatcaaatggagatagagtttataggaataactaaccatggttcctcgatacttcttttaaaaataaatttgctgatctcagagggaggacacataaataaaataactaagtacatttcttaggatgaacctaaaaaaactgtatttactattaaatttcatacatttaagcagtattaaaaaaaaaaaaacaacacaagcaacagatgttttaaggtcgtagttatatattcatgtctgttaagtcactttagttgtgtccgactcttttgcgaccccatagaacatagccaccaggctcttctgtccatgggattctccagggaagaatacttgagtgggttgctgtgcttgcctctgggggatcttcctgacacagggattgaatgggcttcccaggcagcgctagtggtaaagaacccacctga

SEQ ID NO: 61152 - DNA, 1238 bp, Bovine  19866880168575
atttccgggagaattatctataaccttagatatgcagatgacaccacccttatggcagaaggtgaagaggaactaaaaagcctcttgatggaagtgaaagaggagagtgaaaaggttggcttaaagctcaacattcagaaaacaaagatcatggcatctggtcccattacttcatgggaaatagatgggaaaacagtggaaacagtgtcagactttaatttttttggttctaaaatcactacagatggtgattgcagccatgaaattaaaagacacttactccttggaaggaaagttatgaccaacctagatagcatattcaaaagcagagacattactgtgccaacaaaggtctgtctagtcaaggctatggtttttcctgtggtcatgtatggatgtgagagttggactgtgaagaaagctgagtgccaaagaattgatgcttttgaattgtggtgttgggagaagactcttgagagtcccttggatggcaaggagatccaaccagtccattcttaaggagatcagcccctgggtgttctttgggaggaatgatgctaaagctgaaactccagtactttggccacctcatgcggagagttgactcattggaaaagattctgatgctgggagggattgggggcaagaggagaaggggatgacagaggatgagatggctggatggcatcactgactcgatggacgtgagtttgagtgaactctgagagttggtgatggacagggaggcctggtgtgctgcgattcatggggtcacaaagagtcggacacgactgagcgactgaactgaactgaactgaggggaaggctgccaggctcatctttactgccgctgggagtgtgaaaggaggaatgggcagagggagagaatgtggtgccctgtgacaggtccaaggccagagggatgaaaagatcatgaatttggattcaaagaatgaactctgtgtggctagcagtaggtcaaggactaggctgtgagagcgactggagatggagaagcagctaagggctaatggaggtggagtgtgtcaaggctcgtccacctctgctatcttctgcacagcatcagataaggtgctgcgagcaagctgctttttattccttctcattctcaatgaggtgtttctgcccctataccttaaaggcacttggcttctgagagtctggggttgatgaccaaaccatctccaggggttgtttctatctccaggggttctttg

SEQ ID NO: 61153 - DNA, 1404 bp, Bovine  19866880352960
tggaaggcgagaggaacagatcattctgacagtccgagagcacagaacttcagggtcgagtagcgtggggtgtgctggagacaaggtggaagggaccccttctgctggagacagcctaactggagagagatgtttgataaggaagggacaagatggagctctaagcagtgtttgcaaagactctaaggggaaacatggagagcatggtaggttcaaggagccgccccagtctggtctgacccaagggtggcatgtctagggaggaagagatgagttgagaacagctgagatcttcacaggctgcagatgtcatgctgaagggtttgcattttattgaaaaggtgatggagagccccaggagggtttcaaagagggggaaacatcatgaccagactggagattaacaacgaccactctgggtccacaatggaggcgagatggcagatggtttatcccgggagagtgtttgggtgtgttaagaactagcccaggatgtttggaatagattaggtgagaaacagcggagggagcaggacagatagaaggggcacttaggcagtaaatcaacaactacaggccttgcaaattaattggatgtggagagttaaggagagggaggaacttccaggtttctgggagttcagaatcttctgagttgactgtcagaatatttataattgttgatttatgtatttttgcaggctttaatttcagggtacattaaaaggtaatttgattgaacaaaatatcatttagacaagacttttcagggatacatactgctgttgaaaacatagttgcatccacagaccaaaggcccatatcttatccacacgccctggaaagatgcaagggccagctcctttctagcggctctggaaagtcctcggctggcactgagatgcttcacattgaggagcagagtcaggacgctggctggctggtagagaactgctcctatatacctgccctggtggctcagaaagtaaagaatccacctgcaatgcaggagacccaggttcgatccctggctcaggaagatgccctggagaagggaatgactatccagttcattgtccttgcctggagaattccatggacagagagcctagagggttacagtccataaggccctgttgcacagagcctcaggtggctcccccaaatcgaggcaaggtttgggggtggaaagtgagagggttacaagagtacattgggttttggtcaccttcttcctgtaggtgacctttcctcctcacaaagcagaaaggaatcacgattttgtgatttgctctgatgtatctgtgaacggcatcacacacaaacgcatatacatgttagagaagagtcttggcaggattgagccgactactttccgttgtgatgcttactagggctgagcca

SEQ ID NO: 61154 - DNA, 3845 bp, Bovine  19866880450449
atctgggccttttaggagcagcaacatggaggcaagtttcccactttgagccataagcaaaacgagtcaggccgcgggtggcctgggtgtggtctcagtagtctcttgtcgctctgagcttagtcgctcagtcgtgtccagctcttttccaccccatggactgtaacccgcctggctccgctgtccacggggattctccaggcaagaatgctggagtgggttgccatgccctcctccaggggatcttcccaatccagggacaaacctgggtctcccacattgcaggcggattctttaccatatgacccaccagggaagccccaatagtctcttgaagtgaagtgaaagtctctcagtctgactctgacagtccatggcactctccaggccagaatactgaagtgggtagcctttctgttctccagggaatctacccaacccagggatcaaagccaggtctcccgcattgcaggtgaatctttaccagctgagccacaaaggaagcccaagaatactggagtgggtagcctgtcccttctctagcggatcttcccgactcaggaattgagccagggtctcctgcattgcaggtggattctttacccactgagctatgagccaagcacaacagtctcttcagtgaagttgcttcagtcgtgtccgactctttacaatcccacggactgtagcctaccaggctcctccatccatggaatttccaggcaagagcactggagtgggttgccatttctttctccaggggatcttcccgacccagggatcgaacccaggtatcctgcattggcagacgctttagggactgagctaccagggaagttaacagtctcttaggtctgatatataatatgtggttttgtgtgcaaggagagcgccccctagtgtaaatcttgaagttcaagactgaatattgttcagagagggctttctgggtggctcagtggtaaagaatctgcctgccaatgcaggagatataggagacacggattcgatacctgggttgggagggccccctggagaaggaaatagcaatctactccagtattcttgcctgggaaattccatgtttagaggagcctggagggctacagtccatgggaaggcaaagagtcagacacgactgagcgactgagcacgcatgctcttgcagaaaaggatggaggggtttggggacaagatcaaagttggtttactaagagaataaccagagaagtatgtttttgggaagccttttggactggctttgcagtcaaaggacttggattttgctgtcagacttggcttcaaatcactacttccaagattgtacgcacttgggtgagttacttccaccccattttctttttgtgaaaccgagatgattaatacccacctctcagagtgtttttggggtaaatgaaggaagcgggggttgagagagtgattgaagatgaagttggaaagattaggcttgatcatgaagagtttacgtactgtgccaaagagtttgaacttgactcaaagaacaagagagccaatggaagcttgtgagcaacagagacagggtagcacttaagagttggaaacgtcaggttggtttatttctcttcttcagttcttgtctcatggcaacagaaatttggagcgatggaccaaaaagtataggacaacaggcaagttacagctcagttcagctcaagcagacagatcttttatcagtccaacactcccagaagagtcctctttatccttcctatcaattcctactggcttccctcttttacactcccagctcttccttttggttatgcccagtgcaaagcagggcttgcacccaccaccaatcaatgaaaggaaatgcaaatgggcatagactcaaggccaagtgacaattatgctataaaacagcaagttgtcttgtttgtatcttcctgtaattcgtctgttataattagatgcagaatattcatgagccctaaatgggctcctaactggctaaggttacgtggagaagcccctgtggtcagtttgcattccctgtgtgcctagggcgcatgtgcagggctgggaaggtatctgtggttactttgtagcatatctgtgagctctcccgtgggagggagtttagagatctgcacgcatccccgccttccctcattgctcctgtgtaacgtcctacctaacagaaagataagtggtggcagtgtagacaagggggcttgagactttggtggttttgatggagctggaatatatgggaaagagattttggaagtagcattgacttgcagttgatgcaatattatggtgggtcttgagatgggaggggacagggtgcagccggaaatggcagcaagcatatgtgcagcttttgttaaaatcctttcctataagccttcttacctaattctcacaatagttttataaggagatattgtaattatccttctcattttgtatgtaaggagtctgatagggagattaagtcaaagggtatacagttagcaagcggccaaatcagaacgtttcacccaggtctttggttccgattctgtctctatttctcagatcacactgcatctcaaggtttagagtgaagtcactgcagagagagaggcagtctgggtccagggttggatgtgtgctggggccccaggttgtacaatctccctggttgctaggagtctctgatgatcagagtccccaggttgctaggcgacctgggttgctaagagtctcagtttattataggccttgggttgtcagaagccttggggtattcaggctttcagtttatgaaaagcttcatggttctcagagacatcagttattaggggccccgggcatctagggctcttggctcttaacatcaccaggttgtgagcccaccctgcttgctaggaatctcaggatgtcagaggtcccgggtgtgtgaaggccttcagctgctgaagtgctggtttactggaaacctcagttttcagcatctcagacttgtgaggttactaaagatgtggcctccgatttttaggtccatggcttcccaaagtcatgggtcaacatgcagctttctcccacccatttctcttctttctcttgtcagagtttctggagctttctctttttctcaggtgctttatcacagacagcctcattctgctcccgcagctgtgctgacctgatttcttctactcccagttcttcccacttaggtaccaattccaagacctttgagtagaaatttgttacggttcctaaataaagcagatatcgaagcacatctgggttatgtttatgttctcatcattcaccctctggccagtcagctttaataatcttaaattagactttgtggaaaagtccagggttgagtgcccctcatttccaattattttattagatgagtcagaacagtaaaacttgcctgtgcatatttttgtaaaaacatttgattatcaaatagttattctcagaaagttgcaaggatggtagagagagatccggggactcttcatccagtttcccccagtggttacatcttacatatccaagtgattcaatgctagtatagtaattctctgcttatccagagatctcgtgacttccatgagggctaacaccgtgcaaacttggatggggaaaaggcctctgattggttaaaataagctcctgctttccctttgcaatatccttacagaacacaatatataattggcctcttgtatccatgggcttccacctgcagttggttaaatatgaagatacaaaacccgtggatatagaaggccgattgtactaggccattcactatagggacttgagcatccttggattctggtatcctgggt

SEQ ID NO: 61155 - DNA, 1012 bp, Bovine  19866880473722
gaattcttactaagagaggacagaacctggcaccctaagagattcattatgaaaactgccaagtattaaatgggcccatattcagatgataaaaatccacacactccaaagccacacagacaatggataatcaatgattccacttgatcctccttcacttgtgaaaatcaccaagtgctgtctacactcaggagcacagacatcaggaagtgaactaagagaggaagaatgtggtggcaaagaagagagtcaaaaactaaaaacagatcaaatacaccaggaaatggaaaaaacaaataattttccctattttgtcttagttcctaaagcagaaaaaattctttcttttttttttttatggctagatcaaactgagaaaggaatttatgtgagtcgactggttgccaatgtaagacaaacactgtaatatttactttttctttaagtgtgcccccaccaaccaggccaacaggaatagctctagctgtcctcagaaggcagctgctcttcaagtttaaccttgctcactgaagcagcacagtttccctaagtgtctgttaatgtcacatttcaaaaaaggaaagaaaagataagtctacttacagatagcattatttccaaatgttgactgcagtaaatgcccttgtcctctgtgaatgagaactgaaaccatgtgattgaataatgaaaaatattaatcctcttattttccaatttcaagaaacattctgtctcaagtgtttgcttataattcacctaagtttaaaaagtcaagggtttggccagcacggccagtgtacttggcagggccaggatggaggactcagctggctcgttgatgtgtggtggggccaggagaagatcccaccagtgcagctggggtgtctggcagtggagaggccagggaggtggctgcaccgtggggaacttagttacatataggaggcttaagaaaataaacaaacaggctgatgatgatgggagccaggtttctcacttctgcagaaggaaa

SEQ ID NO: 61156 - DNA, 3355 bp, Bovine  19866880506947
tggagtgggttgcctttccttctccggggatcttcccgacccagggatcaaacccagttatcccgcattggaggcagatgctttaacctctgagccaccagggaagatatatatgcattaatatatgatatttgtttttctctttctgactttcttcgctctgtattataggctctaggttcatccatctcattagaactgactcaaatgcgttccttttcatgttagtgtctttagtctgagatttttctccactgaagcttaccatttgctggtttatttctttaggaaccatattatgtacgttgcatcaagcccaacgacatgaaatccccacagatctttgatgatgaacgctgccggcatcaagtagagtatcttggactcctagaaaacgtgagggtgcgtcgggcaggctttgccttccgccagacctacgagaagtttcttcacaggtgagaacagatgaaacagagaaacccgatagcacactgagacttacggagccctccctatgttaagcaacgcatcagctcgtatcaggcggtctaaatatttgttgagtgaacagaagagttgaggaaactacaaatatgatagacgttcctagaattggcaggagaccccttgagtttgtggtttatggaccatggggaaaaaacgaattcctcattgggaaaatataagcatgtagtttataggagaaaaaacaaggatttagagtcacaggtgggttggaatcctggctataccacacgtctgttgcatgacctggagctagaaatttaacttctttgtttctgcatttgcaaaatgagtatagtaatgctaccttataaggcttttgttgtgagaattaaattaaccaaagtggaaagcctaggtgcctggcacatagtagaagttcagttaatgctgcttatcattactgatattagtgactatcataataaaaagatactaagtagatcatcatggaagccctaaaattagtctacctgattgaatcctggctttgaccgggacttttgaccttgggaaaatcatataactttccagttgcctctgtttcctatgtgtagaatggagaaaattaattttttaaatgggaataataatagtaattacttgataaggctgctggggctgaaatgagataacatttataaaataaacacctagaatgggaacctggcatatagtaatcactcaatataaggtgtcattgctattgttatttattattggtaacaataatactagttgacacctgagatcttaaaaatactgttttaaatcccatcttttcatttattttaaaatatttattcaacatttcctatgttgtagactacagatttcacaaaaatatgaatgaataaacacataaaatattggttggtgaggagtctctaagtagatagtaatgaatgtaaggagtcagccatacaaaagtcaaagaaaaagagcaggtgaagcagaggaaacagtggagaaaagtctcccttgcagaaataagtgtcttgttttaggtaccaaacatcatctagtatggttggaggatgctgagcaacagggcagtggtgtgggttgagatcagagagatggacgggggccagatcatgttgcacgttgtcatccagactaaacagtttagattttggccaagggtggtaaaaaaccattggtggattttatgcaggaagccacacaatcttatggatgttttaagagatcactgtggctgctgtgtgaataggaagcaaggagacatttagagatgctattgcaggaatccaggagaggcagctcagtgagagtgccttgaacaaggaattattgtagatccaagagtagtggactgataggtccactaggataggttttgggggaaggtagacaagacttgctgatggattgactcaatgagagaggagtagagagggatgaagggtaacatgtagatttttgcttgagcatctggataagcatggtaccattttctgagataagaaagattggggaagagaagtgtgaagagggggacacggaactagggcaaagatggaatcaagatttgtctcttaactatgttaggtttgaaatggttctaaatgcctaggtagaaatactaaataatctactagacatataaatctgtagttctgtgaagacttccaggctggaaataggaagtttggggttactgatacataagtaagtaagtaagtgaagtcactcagtcgtgcccaactctttgcaaccccgtggactgtagcccaccaggctcccccgtccatgggattctccaggtaagaatactggagtgggttgccatttccttctccaggggatcttcccaacccagggatcgaacccaggtctcctgaattgcaggcagacgctttaacctctgagccaccagtgaaggtctactgatacatagattatatataaagtcttgggacttgatagaaaaagaagagaaggcccatgccaacatttaggtttgtggtctgacatgaaagaaccagcaaagaaaagagaagaagtgaccaatgagagagaagaaatatcagaagagggttaggtcacagaagccaagggaagatggcatttcaagaagagaagtacaattatattaaatattactataaaagcagaagcttaaccattagaccaggcagcacagaagtcagaggagaaagagctggtcagagccccatttgagcaggatgggaaagtgaagtgaagagttggatgtccacggacaactcaaggatgtgtgttgtgaatgagaacagagaagaatggaagcagcagccagagtggaatgtgaagtcaaggagactctagaaaatgttcaaaatgcaggtggcgatgattcagaacagagagagaacccagccacacagaagggagggtggtaactgaaataataacctccttgagaaggcaaggaatgaaatcccagcacaagtggaaggttggtcagctttagatgggagcagggatccttctcccctagcaacaggacgaaaggcaaagaatatgaaaaccaaggcaggaagcctcgaaggccgactgatagcaccaatgaaaatgctcctgtctgattgcttctatttcttcttgaagtatgaggcaaggtcatgagcctgagagtgaggatcaagagaggtggtgaggggggttgacaaggaaacagaaatactcattttagagagcgggagagctttcccactctctcccagtggttttgctaccaggaagacttgagcacccatttgaggtttgagattgtaagtgtatagtgagacccccctccccctcagcatcagcttttcttctccac

SEQ ID NO: 61157 - DNA, 1062 bp, Bovine  19866880519411
caggaggagaaggggatgacagaggatgagatggttggatggcctcactgactcgatggacatgagtttgagtaaattcccgggagttggtgatggacaggaaaggaagcgtggcgtgctgcagtccatagggtcacagagagtcggatacaactgggcaactgaaatgaattgaactgaaaccctaaccctccacaaagtccccttctccaagtaccatcaaagtaggactttgacagtgtgaatttgggggattctttcttacaataattctttgtgtaacactggtgaacctcatcagataacactcgcctagacttaaactatctagacacagctccattaacttttcttcagaatgggagaaaggggaccagacatgaagatgataaaggccgtctgcttctcagtgaagaccaccatccctggtggagagtaaaacacaaatgcaaaatgttcctttggttccccagaggaaccaacatatcaaaagccagcaagtgtttcatccaaagataccaaattgccgagaaggtttccagaagggttggcaagggcctgccacagaagcccctacttccccaggagcggtggacctgaggcatggagggcctgggaagtgctcaaagcagagaatgtctctggtacctgaatcccctctgagaatgagctggatgctttgggaagatgatggatgagcctgagtcacataactggaacgaatccagaggcaggaattagacaatatcaagtcctcttgcttcccttacttgttctgtgtgaccacagacaagtccctttacctccttgagccttcctcttttgtaaatgggagaaactccagcctgccttgtctcctccttgggctcttgtgaggatcgaatgaccatgcacaggatgacactttaattgaacattcagcatgtgctggacatgtcgcttcctttatggcacttattcctcataaaaaccctgcagtggtagagatcatcaccccaggccatagctgaggaaacagagggcagtggggccatgcaactcccccaagatcacatggctaat

SEQ ID NO: 61158 - DNA, 703 bp, Bovine  19866880662296
acctgggccttgtttctcgaagccagaggtgtggcagacaggacaaggctggaagaattgtttgcgaagagtagatttccatgtgcttttttcctttcttttttttttttagctagcaccacacctgttgtgcttttagagtgattgaaaatatctcactaatccacatgcagtatttattttttttccttccaaagaagaaaacagttttttcttgctatcacttctctctgacacagctcagcccgtgataaagctttgtagctggcaggctctgttttttcttgtctgtggctgtcagctgtccggtaaccatctatctttctttggtctctactctccatttttttcttgtaacatgaaaatctttgagaaaatacacttggcactctatttttcaagagccttacaaatgctcatttcccttgactcaaaaatcccatccttatacaaactagcatactgctgctgctaagtcacttcagtcgtgttcgactctgtgtgaccccatagatggcagcccaccaggctcccccgtccctgggattctccagcaagaacactggagtgggctgcaattaccctctccaatgcatgaaactgaaaagtgagtgaaagcgaagtcgctcagttgtattcgactcttagtgaccccatggactgcagcctaccaggctcctccatccatgggattctccaggca

SEQ ID NO: 61159 - DNA, 866 bp, Bovine  19866880727393
tggtgtgaagaactgactcctggaaaagaccctgatgctgggaaagattgaaggcagaaggagaaggggacgacagaggatgagatggttggatggcatcaccaactcgatggacatgagtttcagcaagctctgggagttggtgatggacagggaagcctggcgtgctgcagtccatggggttgcaaagagttggcacatgactgagcgactgaactgaaccaaaagggagaaaagtgtgtatgtatgcatatgcagtggggggaccaggtgatgcagtcaaacttcaactccatcgtcaggcaataagcctgcagcaatgttctaagttatttagcaaagccaggaacagcttgccttccttgaacctcacaaccaacaggactcctaatttaacaaaataaaaaactgtaaaacaatatgtttcctatttccttttgcagaggccaaaaggatttaaaacaatctttaaataatattcctcctagatctcatgattggacaaacacagacctctctctctaagaactaacagatagaaaaatcacctgagacatggaaagatccagcagtccagggggatctttttcaagaatcagaacagttacttgttaagcagatcccatagagcagaataaaaatttttttaaagtttcatattgagattcaggggcttcccaggaagtgcaagtggtaaagaatctgcctgccgatgcaagagatgcaagagacgtgggttccagccctgggttgggaagatcccctggagaaggaaatggcaactcactccagtattcttgccagcaaaatcccagggatagaggagtactcgtgggctacagtccatgcggtcataaaaagtcaga

SEQ ID NO: 61160 - DNA, 1430 bp, Bovine  19866880738483
aagattagagggtgcatgcaggcatattgggaaggttattgaaagcaaagctaaagagcttgggctttataatacaggcatcagggagtcattgagcaggcaagtgatgtgcacaaagcagtgttaatagagtagaaatcatcaggatgaactggacgtgggaccaaggaatgagccaggaggtgagttcggaggtgatggcactgggccacatgcgaggtcaggagacacatacttgagatgatggctgggaaaatggaaagtgaggaagaggtctaagaaatctaacaaaattctgcggggcttgcctgctgatgagctgtggggattaaaggaatgacatgcatcagagatgagtcattaaccatcaggtgtctgctgccaggatgggagctacaaagctgaaaagctccacagcccctgctcctataaagtatactatatagacagggatacccataggtggacataacagctcaggtgatagctgcttttgtagaggcatcctcaggcaccatttctgcatcggggcaccttgactcctatgaaaaagacccagccaatgaggacagtttcaagttcaccaagacccagacatgtgacaccagggagaaaatgatgacgtcagcagtggggtgacatggatgaaatgtactgaccatattgatgattagaagaagagccttccaggcagagaaaacaatatatacaaaggcatagagatatctcatggcatggcatgtatttttgaaaagtaatatcctttagtctttaaaggatagcctttaaaaaactaatattagttttaaaaaactaatgttaatctttttttttactgtgttgggtctttattgctgcatgggcttttctctgactcatttgaaaagaccctgatgctgggaaagattgaaggcaggaggagaaggggacaacagaggatgagatggttggatggcatcatcaactcaatggacacgagtttgagtaaggtctgggagttatggacagggaggcctggcgtgctgcagtccatggggtcgcaaagagtcggacacgactgggcgactgaactgaactgaactggacttttctctagttgcagtacacaggcttcttattgcaatggcttctcttgttgtggagcatgggctctaaagtgctcaggctttagtagctgtggctccccggctctagagcacaggttcagtagttgcagtacatgggcttagctgctccacagcatgtgacacttcccagaccagggatcaaacccacgtctcccacattggcaggcagattctttaccattgagccaccaatgaagcccacatggcaggctttaaacgccaagattttaatgctgaatacagtggagaagggaagaatagaaataggaaagtcttaagggaacggttttaggggaaacatca

SEQ ID NO: 61161 - DNA, 1890 bp, Bovine  19866880820820
agccttagcgtcccaaacagccccacacctgcttgtgttcggttagagtgagaacagaaaaatacatggttagctactcctaaaattaccctcttgttggatagttacggatgtgaagactcagaaagaactttagagacagcgtttacaatgtagattttaaagccctctttatggtggttttgggtggagcttgcagaccgtctgcccagctgctcttttcctcatccactctttgggggctgggccggcggagggagagaggaggtgtgggatgtgtcaaggtcaccaccgcacagctgcaaggtcagcaaagtggggacggggtgctgcagtggcgtctctgccaagaagtcccagggaattaccatcttcctgcatgttcactccacgctgggacccggcagggacagcaaggcccggggatccatggcggtcccaaagccacaggcccgaggggaccagagctctttggctgaagcttagatgtgtggaagctccaccgacgggaacgcctcccttttgtccgtggctgatgttgaaggccaagcttgttgctgctgtttagttgcttggtcatgtttgactctctgcgaccccatggactgtagcccgccaggctcctctgcccatgggatttcccaggcaagaacactacagtgggttgccatttccttctccaggggatcttcccgacccagggactgaacctgggtttcctgcttagcaggcagattctttaccactgagccaccctacttctaaccacgaataactagaaacagaaacttagggattcattagaaattttggtaccagagcccttacaacgccaacaggccgccggttaaactcccaccttggcgaaggcatcccttccgtagctggcttcctgctctgtgtgctgcttgtcgatgacgtcgcggcccgtagccaccgtccggtagaggagggctttctccaccatgtccgtcttggtggacagcaattccgcgatgatagatacaagcttgccgtcctcaatcagagtagtgtcaccatccactacaaactttaaattcccctgtatcagaagagaaaaaccaagacacatcatttccactgagattctgaaaaacgatgtcagggaacgatttgccagtgtgagagaattcccagggaccttgtctgtagcacctatcttcctaaatacattaatatctcaacacataaaaattgagtgcttcatccatttcgtccttctccagacactcctctatctttcaattttcagtgtatgggttttgatggatggaaattttatatttttatgttgtcaaatctatgagtcatttgcttcagggtttctctttctttggtgtcatgcttagatcattccaattctgaagattttatgaatatttaatagatttttctattccttttatagttttttccctcctatttaagccttgagtccagctagaaggtatatcagtataaagtaagaatccaactttattttttcagatgattacttgctccaacaccatcaactgaatagtctaagcttttcctcctgatttgaaatataacctttattacacattaatttccaccaattttttgagtctatttatatgttactctttccagacaataaatattagccagttaccaagtgtccagcacatgaactagtctgttgattaatctggtgctgaacttatgcagcaagttttaaagcactgcggcttttactatcattttaaacggctggaattagttgtgtctctttcccccagctccccctaccctactattctcctttaacacattttattcacttttagtatatgcttattgttctagtaagttctagaatcattatgtcaactaaaaaagaaattc

SEQ ID NO: 61162 - DNA, 2105 bp, Bovine  19866880881166
tctctgcatagaggggcagggactcagtggaggggaggggcgttgcagtaccatattatatgctcaaatgatgctatgggttcctttagcgacccatgaatataaagggaaaagtcaggtgaatctctctctagctggaggatcttggataaggacttagcctcaccaagccttgatttctcatctacaaattgggaagaataccatctacatcggtgggctctgtgagccctgaaagacagaaggtctacaggggacttccctggtgtccaatgattaaagaccccctgctcccaaagcaggggccctggtcagggaactagatcccacgtgctgcaagacgtcacacgccacaaggaagattgaagatcctgcatgctacaactaggacccagtgcagccaaaggatttaattaattggttaaattattattcagaaagatagaaggagtataaagcaatcagcacagtgcctgcctcgtggtaatgcccagtgactggacattcttctctcccttctgaaaaggaacccaaagatgaatgatattaatgacgtcctaaaagagactgtggcctcttggttgggatgcagggacaagtggtggccaaggggctgcattcccctcatctccttggttcccaaggactccacagcccacacggaggtgctttcctgggtacttggttgaagtcaccttttaaatctccctatggggtaaaagcacagtcacgcatctgtccttggaacataataggcagtcaaaaattcctgttgcaaaaaaaaaaaaaaattcctgttgcaggaagagatgagtgaataagcatttttcctaataagatgcaggcctcgccttccaggagctgaccatctatagccccctcctcatgcatgcatccctctgccatatttaattctcaaacgtgttgattgacgacaacttcagaaaacaaatggaaaccaccccccactgaaactctcatacagtgctaatgggaatacaaaactatacaaccattttggaaacaacttggccacttcttaaatagttacagacacacttacgatgatatgattcagccattcaattcctatgcacttacttaagagaaatgaaaacttatccgtacaaagactgatctatacctgctatagtagtagctttatttgtaatagccaacctaatgtctatcagtagttgaatgaataaatcctggtatagctgtgcagtggaatactacacagcaatgaaaagggttgaattactgataaccttccacccctccttccaagaaaagaaaacaaaaagcagcttcattttgtttactgaaagcctggtaacccatttaacagactgttttcctccctctgtgcaaaatgtgttaaagcagggtcctcaacctctggaatctaatgcatgatgttctaaggtggagctaatgtaataataatagaaataaagtgcacaagaaatgtaaggcacttgaatcatccagaaaccatgcactcccctggttcctggaaaagttatcttccacaaaactggtccccggtgccaaaaatgttgaggaccgctgtgttaggagattttgatagagaaagccagagcaaacaaaacagtgggctttaacatgtccattattttgaaaacagccaaacgagaaatttcagcaaatcactggaaggaaagttcattcaactcagcggaggggaaaggctgagttttagaggaggtttggagcaataggatttcacttcgttcaagcataataagcaagaagagacaaggaagccactgcctcagaaaagccctaaaggtcaggattaatgaaggcttggaaggtttgaagcttacaggcccagtcgtgtgctggtaagtggatatttctacagtccttaagggagcttatacataatttattttcttaagtaggtccatgtgtagaaatgttgtttgcactactaattgggccagaaacctgtgtcttcagggatatcttctgtccctaaccttttccattgtgcatttcctggactctgaggcaggctgccccaacaggtcacgctgggcctggatgctgggtacccaggccagcaggcattgcta

SEQ ID NO: 61163 - DNA, 1932 bp, Bovine  19866880957191
gaaaagactggtgaggggaggatgggaaatcattagacctgtgtggaagtgtctcagtctgggaatgaatgttgaatgaatgccttagtatggcagcctgggagaagacgggcactggaaggaagagcttaagaccagcttcgctctccttgcccttccatttgcagtggggcaggtcatgatgtccaaacatccagcagtctccaatagccagtggacccttagaaatggggagggactcgcaggcagagagggcttccccagtggctcagcggtaaagaatccgcctgcaatgcaggagatttgggttcaatccttgtgtggggaaaagctcctggaagaggaaatggcaacccactccagtattcttgcctggagaatccaaaggatggggaacttggtgggctatatagtccatagggtcacaaaacattgacaccactgaatggacacacgcatacacatacacacgcacatgtacacacacacatacaagtagaaaggagagaggaggagggggacaaaaataattgcaccccacatgttagctctataatagaggtctaagcattagtctcattttgctgatagagacattgaggcttaaagaattcaagtacctcatcaagtcctatgattaataagtgataggaccaagatttgaatctagggctttctataccaaagctatgcactgtttcaaccctacagggaaagtagaattcttatagtaagctccaaaaaggagatttagggagtttgaagaatctcccaatatcatggtgaaatgtaactcagatggtaaagaatgcctgcagggcaggagacccaggttcgatccatgggtcaggggagatcccctggagaagggaatcgctatctactccagtattcttctggagaattccaaggacagggtagcctggcaggctacagtccatggggttgcaaaaagttggacaccactgaacagctgacaccttcactttgtcacgtgaatgggcgttgtttctgcagggtgacgccatacaacctgatcagactcagagtgtttctgagactcgtgggaggttaggagttgctgaggtcctgagatgcagagagaagttagcaattaaggatttcatgaatctgctctctgctggctcagcaaaggtgcaagatgtagtcccagtctgtgtgagcttacagcaggacagctacacaatacattcattgaagatggtatatgtgtctgactctttatggactgtagcccaccaggcttctctgcccctgggattctccaggaaggaatactggagtgggttgccatgccctcctccaggggatctttccaacccagggatcgaaccctggtctcttatgtctcctgcattggcaggtgggttctttaccactagcaccacctgggaagcctcataactaagaattcagtgtatgttttggacagagcagctcagcaatgagggtgataaatgatgaagaggagcaaacagaacctaagaaggctcagtagagaagaaggtgggtcttcacctagactttgaagaatggatggcatttgggcaagttttcagcccactcctacttggaatactagcattctacaagctcagtgataggtttccttcactaaaatagaaaaatagacattccaattcccagaacacattagcttaacatatagaattttttctatgttgtgttttttcttaaaaaaaaaaatacacctttcttaaactttgggtgcctgctaccatttgccagctagtgagggctgaggggaacagacagaatgatcaagtggaaataaatgctaatgggaggccaggaatgtgttttcttcaaaatattttatgtgtgattattcttcttttgagttgcagagacctacgtacatacactatggtcatatttcctgctagaaaa

SEQ ID NO: 61164 - DNA, 1534 bp, Bovine  19866880998615
aaatgaatgaatgaccaaatgaattaatgaatgactatagattgttagtggagaaagtcacaccactgcatacatagcaaacctttatttcttttgggctgaggatagcagcttgaattagccaatcacgagaagatttaaagcaaaacaaaaaaagttagaaaataaaaagcaaatttccagtttataaatcaccagaactcctgactaccaaagtgtttccagatagaggtcttgccagagaggctgtcatgtatagataaggctcatttgtaattagtaagtgtccatttgcattccaatgaagtaagatgttcaagttcttacaaacaatctattctctggagaaggctaaacattactcttgtaatcttggagattagcaagtttttttcttggtaacattttttgtgcattccttcaacaaatatttattgaactcttatcctgtgccaggtactattttgagcactaagaacatagcagtgaatagggcacgtgccccgtacttatataaattatgacagtgaagggagacagtcaataaataaataaaaatggaaatggtgatagtggagaaatggtaaagctagcttaaaactcaacattcaagaaactaacatcacagcatctcatcccatcacgtcaaggcaaatagatgctgaaaaattgaatcagtgatagactttatattcttggtctccaaaatcactgtggatggtgactgcagccattaaattaaaagacactttcctcttggaagaaaagctatgacaaacctagacagggtattaaaaagcagagacatcactttgctgtacagtcaaagctatgggttttccaagagtcatgtatggatgtgagttggaccataaagaaggcagagcaccaaagaattgatgcttttgaattgtagtgctgaagaagaatcttgagagtcccttggacaacaaggagatcaaaccagtctatcctaaaggaaatcaaccctgtatattcattgaaagactgatgctgaaactccagtattttggccacctgatgcgaagagatgactcatcagaaaggatcctgatgctgagaaagattgagggcaggaggagaaaggagtgacaaaggatgagatggttggatgtcatcaccgacacagtggatattagtttgagcaaactccgagagatagtgaaggacagggaagcctggcgtgctgcagtccatagggtcacaaagagtcggacatgatgaacaatgacaaacggtggagcagagattgaaaccaggatggtgtgcttatgagctatcgggtggtcaggccagggggagaggcaattccagagagaaagaagagctggtacaaaggtgggaaagagattggcagagccaattatggacatgagggaagagagacgaaaatgaagttggagaggaaagtgaaagctgaactatgtatggtgttggaatccttgggggaaaagcgtagattctgtttcaagtgccatgcgtgggttgaagcgggagtgatgtgatctgttat

SEQ ID NO: 61165 - DNA, 2159 bp, Bovine  19866881000282
cagctactccaagtctttttgagtgggggtatctcttttctgtagttactgctctctacatacacctctaagggactgcattaacctggggtcctctcacccccatcagggatgtgattaacacacaaagggctttcataaaattgtgctggtcatttcactgcttcaggtattttctgtgtggtgatacacacacttggcctttgggatttaactattctctacttcagttctttggtttgactgcagagttataatatttatgctcttttgatctcaattaacaaattgatttggctgctcaatgatggagaacattctgttcattctgttttcctttcagaggcttgggagacagatgctctggctttttgcaggatgcctggtgactttattccttgcttttgtgtctctgctctctgttctcccagttttccttttttctctccctttacctctttctttccttccctcttccttcctttctttctcctctcttccccctctcctttgcccaactagctataaatcagagatcttaatgatactgatttgtcatggaaataacgtactatttgggataaataagagtttatcaccctatgaaagtgttagttgcttattagtgtccaattctttgcgaccccacggactgtagcctgccaggctcctctgtccatggagttctccaggcaagaatactggagtgggttttgccattttctcctccaagggatcttcctgacccagggattgaatctgggtctcctgcattgcaggcagattctttactgtctgagccatgagggaatcccaagaatagtggagtgggtagccagtcctttcaccaggggatctttcccacccagggactgaaccctggtgtcttgcactgcaggtggattttttaccatctgagtcaccagggaagctcatcttattcctctatgaacaaccatcatttggggcaacagagtgcttgtgctttgagtcattttgtaggagggctgactatcccgaggtcgctgtgctgtgaggtcaggtgctgaccttctagtcagcagctctgggatgagccctcccagcctcagcaccagatgagtgagcatatgagggtcccaaagatcctcagtcactgggtaactcccagcttttgtgacttcccaactaaagccctgcatactgtggagcaaaggtaaactggccccatggtgcccttttcaaattctggacccacggattccgtgatcagaataaaatggtcatatgctactagatttaaagtagacaaccaacaaggactgactgtatagcacagggaacttggcacaatactctacagtaatctaagtgggaaaagaatctgaaaaggaaggatacttgtatgggtataactgaatcactctgctgtacacttgaaactaacacatcactgttaattgactatactccaatataaaataaaagtgtaaaaaataattaaatggtcatatttttttttaactccactaagtcttagggtggaaggtagcacccaagcaacaggtgactgaaatccaaatttgggagctgtgaggtgctcctgtagcagaatccttaaacagttggccctggctttgggaagtgggtggtagctggaagagccttgaggagcctgctggtggaatcacgatgggctttaaggaggcggtcacgagggcctgaagggaagcaaggaaaatatgatctcaagcacgaggcaaggaggcttttatcatgaagtggtggaaaacttgataaccctgctgcctatgggaaggcagagaacagaagatgtacctaacaaactggtgctcaagatacggacttccagacaggatgccggacgtgccatctggctgcctcttgctgtctatgaaaacacgtgagaggagaagcatgctcttaatacagagctgcttggctctcatgcaaagtttagaagaaatataaaggagcttgcacttgctgggtttgaaaataaaactgtttcttattctcagcttctccagatggcaaatgattctcaaattaagaaatggtttcagggcaatgatcagatccagagtgggtctgtaaaaatcctttgtcaaaacctcagaaagatctaaggcagtacttcatagaaatctccaggcaga

SEQ ID NO: 61166 - DNA, 1155 bp, Bovine  19866881037774
cacccagatgctttggtgaccaccccccttattctcctggggaaatcaaagagtattaccttcaagatggcgatgcagtgggacatgagacccctggggagacaagaagcatttgtcagggcttatccagagaggcccacctccctccagccaccacctccatgcctcctccagctctgacccccaggcacggctggacaccacctgagagccgggacaccttcagcggtaaaatgaacaggcccaggagctaaagcaggaagccctttctttcccctgtcttcccctttcccctccagcacccaacagactcctccagctagtgccacaacctgagcttcggagactgttccctccacccagggaatccttccccgtatcctctgcctggtgaactcatcttttcaagtcctgaagagattgccctggcggtccagcgattaagacttcaagcttccactgcagggagtaggggttctatctccagtaggagccggagagaagctccccatgctgcaaatgcagccaaaaaaaaatggaaaacaaaaagacctgggacgaaaggcgcccactctgggaaagcctttagaggtccaccccgctcctctagcccagcaacttcatagacgccgcctcctccgtgtgctcactgcacctgaagagacccacccccttccctccatcatttccaaaatagtcttatttagtagaattctgtctccaccaccagtttcaaagctgcattgtctggcccagagcctgcacatcacaccgggttaacaccccacccagtgaatgaagggctgagcgacagggaagggggcaacacacacttctgaacccgcagcggggtggagggatccccgagggaccctagagacaaagactgcatccctggagcctgagggccatattcacgggcacctcaaggataacccaagcacatcacggtgactttataacacctctgccacacatctacaggcctcagtgtttgggtctgcaaaatggggaaagtgaggacagtcaccgtggtgtcacactctaggtccccccacagtgagggtaggggaacgcagcaatggacacagtgctccagggtgctcagccaagctcgggcaaaggaagccaggaaaggggacccaggagcccaat

SEQ ID NO: 61167 - DNA, 732 bp, Bovine  19866881054916
ttaactcaggcgaggatggcaagcctctgctcaccacggtcaagggggggacaggcaacgggctggagatcatgctggacattcagcaggatgagtacctgcccatctggggcgagacaggtgagccgggccaggggccagggcagggggtgagggcggaggggagcggcctctgggagacctttgcctggagcggttatcttggcccacccggtgaagggctgctctccatcaaggggtgggtgatatgctggtgagtcggaaggacgtcccagcacaaactgtgatgccctgagttttccttggatttcactaggtgggagggggctggtgatgggatactggaaagggaaggcgggtaggatgagaagaggtgcggaggaagccttgaattaacaagtccggttggagcggtgggtggcgcaatttcagaagaggaagtgatggaccagccccttccgcttccaccatcttgcatatcccaacccggctacagggcccagtggaaaagaaagcaggtttctcccgctgagggaaggtggaggggctgctggaaaatggaagggcacagactcagcctgcgtgagcccatgggggacccgggtgtacaggtcccaaagcttatttagtgcatccaattattcgtttatttattcagcaaactattcataagccacatatgctatctcgggctttacaccaaaataaggatattaattaaaaaagaccaag

SEQ ID NO: 61168 - DNA, 1059 bp, Bovine  19866881109471
ttgagtttcagacactgatgacacttgtaagtaaacatgccgtcgatcactggagtctaacattgtataaaagagcatagcattcagcacttaggataaaaatttaggagcagacacatgtataatttgaggctgaaattatcagtctagagggagaaggggcagatgattcaagaacatcatgcttaaatggtggggaaaagagattgactagaggaaatggaatgaaaaagaaatctccgctctttctgggcctccgctttctcctttctcttctaatgtgccaaatgagttctaatttctctccagttccataaggttatgaattattccaggaaggaaaagaactctggaaacactgtgtttcagaatcaagttggaaagttttcagaaataagggtaatcaataaaaacctaactactgatcccaccctttgctcctctcgttctctgctcttccttcctgcttttgcccagctgcctgtcctgtgtcagtgagcttttctggctccggggaacagattgtgattgtgggaagggggagagagattccctctgttcctctcgagtatctgtggctggactaataataaagttgacacaagacagattaacaggaggaaacccaacttagttttatgggcatcaggcagttcagtcgctcagtcatttccaactctttgcgaccccatggaagcagcatgccaggcttccctgtccatcaccaactcctggagcttactcaaactcatgtcctttgagtcagtgatgccatccaaccatctcatcctctgtcgtccccttatcctcctgcctttaatctttcccagcataagggtcttttctaatgagtcagttcttctcatcaggtggccaaagtattggagcttcagcttcagcatcagtccttccaatgaatattcagggttgatttcctttaggattgactggtttgatctccttgcagtccaagggactttcaagagtcttcaccaacacagcagtacaaaagcatcaattcttcagcattcagctttctttaggtccaactctcacatc

SEQ ID NO: 61169 - DNA, 1501 bp, Bovine  19866881157298
aacttagaaaatggtgagagacagggaggcctggagtactgcagttcacgagatcacaaaaattcgaacacagctgggcgactgagcaacataatgcattccaataaccatgcccctgagcagcagggatttggggataagcaggaatgtcaagggctccagtgaagcctgatgaagcccacaactgtcagctcctacaacaggattataaaaacagaaaaatcatactgacttcaatgggccttccctcccagcaaactcatttcgtgggagaaagagctgatagttggcagtggtggtcacccaacagaaatgcaggctggctggtgcccaaaggtcacaccgaaggccaggaagccaggtgtggagcgacagatgttttagccacaaacaggaaaagggaaattttcttaaaagcttatgattgggaaatcacaatgctaaatgtgaacttcttggtggataggtcacatggggcagttcaggaactgccttgtaaatttgttttttcagccaagagagctcgcctgattcacgagaggtcatgtcagtgtagctctgacagcaccgatgctgtggggcagggtttaagagcacaggggctggagccgggctgcctgcactgaaaggctgctctcctgcttaagctgtgtggcttagggtgagaaactcaagctctctgtggtcaggagtcctctcctttggagtagagaaaacagcaatattcatatgtgcctcatcggattattttgagggttaaacatttagaatgtttatgacacttttttttttttctgtcgttttttgggtttgctctcggtggtggtgctcagtcgtgtccgactccttgaaaccccatggacggtagcccaccaagttcctctctccatggaatttttcaggcaagaatactggagtgggttgccattccctactccaggggatcttcccggcccagggctcaaacccagatctcttgcatctcctgcattggcaggcttggtttactctttatttacttggctgtgctggcacagcaggcggtgtcttttgttgtctttgttgtggcacgcaggcggtgtctttagtggcagtatgtgaactctttccttgtgggcatgtgggatctcgtttcctgaccagggaccaaatccagatcccccacattgggagctcggagtcttagccactggaccggcagggaagtcctgacacttgtttttaacgtaagtcacttggaacatgtcctagtgattaggaagacctacatttattatacggttattatttttcatgcttttgaaagcagcaggatgggaaaggaaaagcttagactttggaatgagttagagctgagttcaactcctttcgacagttgtaaaaagagggtaaaaataccacacgccccccacccccaaggctggaatgagaaattaaatatgtgtctggttcagttgcctggcatataggaatattcaggaaatcttagttcccttctcct

SEQ ID NO: 61170 - DNA, 613 bp, Bovine  19866881221100
ttaccgtgttgcaatcagcacggtatttgatgcaggataggacagaatagaataagagtgtacatgttttgtaaaggtaagtgtttcataaattttatctccccatctatttgtcatctatctattatcatctatgtctgtctatctgtcggttttgacttggcaggtctggccctttgctaacatcttggggagaaagagtgtagggaaaaggcagagacgactcggccatgtccacaagaccagcttttaatatgaccgtgattggaagcacgaataaataaacgccagagaaaatggaaaaaccaaaccaaagctcggaacatcaaaacccagattcagaaaacgaaaggaaacatatctccgacaaacaaacaaatcaacaaacaaaaagctcgccccaccgcgaagagacagaatcagactgtacaatccgtgtcacagggagagccgacggcgggggccccgcggctgtgtccccccggccgccgcacctccgtctcgggcccctgggaggggaggagggcggccccgggcaccctgtgggccggcctggggaggcggagggcggggtaggtgggcaggttaagaaccttcacgaacgacaagagga

SEQ ID NO: 61171 - DNA, 1056 bp, Bovine  19866881285258
ctgtgctgaagaatatgtggcctgaaggcaaactgagcattacagaggtgaccaagagaccactgaccgctgccaccttatttaagaattctatgattgctctggtagacacccttgcatcaaaggtaattactttcattttaaaatacccgttttatttcatggattctctcttgacatatgttaatgagaaaggtatgtatagtatttgctttttaggtaactatagtaaatcaaattgaagaacatgtattttaaatgaatgttatagtaattcttaatactgttttgtttgttttttaccatggcctggtgaaacagttgtttgtgtcccagatgaatgatcttaaatttaggccttttatattgttgtcatcaatgggaaagtcttatatgtgatcttaaaaaaataaaaacagtatactacaggtatagtatgtgcctgataaaagaaattttagccctgtgctgaggacaaggcctggctttaaaaaaaaaaaaatcttgagttaaattgtcacgtaccatccttatgttgtatctgaatacaaattacagatagagctgtaagaggaagtttagtatttaagtgttgcccttaggctgttttaatagttgaaatgaaaagatgtactatgggcagtcgtttctgctttttattgttcctttgaggcctcatactgtttgataactttagtctgaggtttttttccccttgaagaacagatttctactcttaactgctgctgttgatgagtttgataaattaggcagcattctggggctcattatttttagttccttcatttttatctttctctcctggtgtttttccagtgtattttttcttcttcatttttatcttttttttttctttaatcaacttcctctctaaaaatttaaatctatattatttttggttacttcactgtggataaattaggcaaatgccataagaatacatctcttcagtagctttctgttcttttcgtcaggattctttgacctcaggtgacaacaaataagaacagtgtgttggcttgtataatcaaacct

SEQ ID NO: 61172 - DNA, 898 bp, Bovine  19866881345071
attagttggccttttgtgaagcccgatgggaatcttattagatccttccccttcctcccttgacacttggttcccacatctcgaccctgacacttactcatccgtgtgacgtggctgagttatttactctccctgcgcttcggtttcttcacctgttaaaatgggcatcatcccgtgttcttcagggccagtgaagggaatcaaatgaagtgatgtgtgtgaaaagcgcttggcaactataaatacacttcggagttgctgttgatggggtgagagtgaatatcaaaggtagagaaaagcaaattgcaaagcagcgtgtgtctcctctttgtgagaatgaggtctggaggggctctaatccttagagattgtgctttagggccttgggaagatggattccagagcctctgaaatgaattggaaattggaatgagaatgctaaagcactgctgcagttttatttgcatagggtcagggagcaggtgctggggaggagggcgagcctgggaggaggtgtctgttctcccaggtggaggtgagggcagcagacaggacggccgtattcctgggagcctggaaggtcccagacagtggagaaatgggagctggcaaaacatgcatgcaaagaagtctcctgcaacccacactaaccctctctgcctcctcttgaaaaataaaagtgaaagtgttagtcactcagtcatgtctgatctttgcgaccccatggactgtagccttccaggctcctcttgactatagaattctccaggcaagaatactggagtggggtgccatttccttctccaggggctcttcctgagccaggcattgaacctgggtctcctgcattgcaggcagattctttaccatctgagccacctaagccaaactagatggg

SEQ ID NO: 61173 - DNA, 1085 bp, Bovine  19866881348825
acccataggggaattcatttccctgctagtgaaagttaaaaagaaggaaactctctgtagggacagcagtgtcattgtcttgaaagatgccctctgttctccccctccacccccaccactgaccctctgctagtgacactgaagaaatttctaggccaggtgagtggctgggactgataacttctcagaatccttaagtctctttttcttcccaaaatgaaacagagggactccccatggtgatcaggaagagaacatattcctagcttcagaggacaaattcgttgttggctttgaagtatattttcagaaaatcagcctcattcatattagcattgctatggttattataactaataataagatatttggttaaacattttacagtcttcaaagcatttccacaccatctcatttcatcatttcattcatattaacagagaaatacaaaaacacatcccggagctaaatctaataatcattatgtttacatgtatataaaagagcatattcatgggaaataagactcgaaggaaataaggcaaaatacccacagtgaggggattatgaatgatttattttcttgtctgggtttgccacatattttataaggtggctctgttttatttatttgttgagcaaatatttgttgaacacctactatgggtgtgaagcgatggggatacagtggtaagaaaacagaccagtgtctgtcctcacaaaacctacatattagtggtttctttcatacagaacaaaataaccactaaataatcttaagccgagtagaatttggagactggcccctacttgtgtgttctgccgttggttctaccccatccagctgaccctggttttccaacattggttctaagatgtgtggtctttcacattttaacatttctgaaactggggcttgtttcccaatcaattgcatgtcagttacaattagcagctttttcttttttcttttgattttatctcttccccattatttgtttatttatttggcggcgtcaggtcttagccgagtcaagcaggatctttcgatgaggcccacagactctctagttgtggcgtcaatg

SEQ ID NO: 61174 - DNA, 975 bp, Bovine  19866881474078
atttgagtttgatcccctggattaggaagatcccttagagaagaaaatggcaacccactccaatagtcttgcctgggaaatcccacggacagaggagcctggcagactacagtctacggggttgcagaattggacacaactgagcgactgagcctgcacacacactaacaggaaaggaatcaaaaccaagtaaacagaaaagaaactttgaggaaatagagataatggttaatggcatgagttctagagccttggttcaaatctcagctattcagcttaccagctgcgtgacctcagacaagttacttagcctctctgagcctcagttccattatctctaaaatgagaataatattattatctattctttaaggttgttaggaaggtagatatgggttcatatttttgtgaaacacttagcaaagtgcctgaataatatcaggcactatgtacgtgtctgataaataaaaaataaatgcagaaagcagaaggaaacttcaaaacattttaattaaaattctcaagaggtaagagatgatacctgcatttgtaaacaccagctattaaaattggatgctattaaaaagtaacatccaaagaaaaaaatttttttaaacctactgaaaattaaaaatatgattgcaaacattttttaaacccacagaaggattggaattgaggaaattgcctgaaaagtaaaacaaaaaagacgaacagatggaaaatgggagagaaaaaaatgcaaaaatgagaaagcaaaccgagaaagctcaacatcctacaactaagatttctagaattacaaaagtgagagtggagaagaagatgttgccaaagaaataaaataagaaaaattcccaactgacccacatgattttccataatgaaagaattcactaagtcctatctgcaataagtggcaagagaaccagaccaagatgcatccttgcaaaattcaggctcacaaagagaaca

SEQ ID NO: 61175 - DNA, 940 bp, Bovine  19866881840525
tgggattttccgaaagagtctggcatgtgttgcctttccttttccgggtatcctcccaatccagggatggaacctacatctaatgcattggcaggtggcttctttaccattgagccgcctgggaagcccaaaagatgctttaggataacttaaacctgaaggcagccagtgggggaatctctgctgggatggggtcaagaatctgagcttgctttggggaaaccggaaagacttgtgttgagctcagcagagaaataaagacccaccaaatgtcaacaagggccttgtctgccctcataacctttttttttgagctgctgtttcttcttctccatttaaaaataaaagtcaagtgggaaataacaaagcatacagtaatataataataagctgaaagatgactcaataaaaagaagtgataaaataataaaagcaggctgatacagtaaaaaaaaaacaaaaaacccaaaactcaaccaaacagaatcaccacccagggccagacaataaaagcaatagctaagatgtactgatccaactggtgatcgtgacagtgaaggaggattattctcattttacagaggagagaaatgatgcttggggagattacgtatcatggttccagggggtggggcaggggaatgactccatgtgataggtgaggaaatggaggttaacccaacaagaataaatagccagtcaggggcagaccaagacactgagctcaggttttctagctcaagtccagggaactttcacctggacagaggccaagccttggtggtatattggcatcatcagggaagctctgaagaaatcctgatgctgaagaggtatttcttcaaagaagacatgcagatggtcaacaggcatatgaaaaaatgttccacacctctaattattagagaaatgcaagtcaaaaccacgatcacacctgtca

SEQ ID NO: 61176 - DNA, 1103 bp, Bovine  19866882007108
acatctattgaataaagaaagagataagaagtggaccagaaagaggtgctgtcagtgatggggtctggggctgtccagagggtgagcccggggtaccaggaggggtcccatctccatcatctcttgtgagcttagtgaccctccaggggctccatcttccctgtacaaagtacctctaggaagctgtcctaaataattcttgtgtttctggaatatgtctgaaactcctcataataaaaagtttgatgaatcagttaaatcgtaaatgaggggatctctgtcatttgccaagccagtcctgagcaggtgactggagccctgacccaaggcaaggccaggccgtccttctcccagtacttcgcagggaagatgaggcattggtgctctgaggcaggggcgtgcaggaaaaccagccagggccttaagccaccaatatccaggacttccctggtggtccagcagttaagaatccacatgccaatgcagaggacacaggttcgatccctggctcgtgaagatcccacatgcccagggggaaactgagtctgtgccccacaaccactgaagtccatgtgccctggagcccatgctccgcagcaagagaagccaccacactgcaactggagagtagcccctgctcacccacaactagagcatgcccgtacgcagcaatgaagaccctgcacagccaaaaataaacaaaactgagagaaaaacaccaacgtccaggggcctacaagcagactagctgatcagagcctcttggagcaaggactgaccactgcttttcagatgctcctctgacgattcatgtgctcaatcacgtgtggctctgtgggaccccagaaatgcaggcaagaagaggcagggacacttacactcaccaaacccagaggtttgatttcagctgtcaagctgatgctggtacactttaggctgaacaaagagatgactggctttagcccacttcgggttgtttcaccactgttcatagaacctctctttgccttaaaaagcccacgggtccactcctttgacagtcgtttaaaagaaatctgtaactgtctaatcagggcatgaaccatttttcagacttgcccagg

SEQ ID NO: 61177 - DNA, 3540 bp, Bovine  19866880415225
cctgctcccctctctgtctgggaaagtgggttaaaaacctttttttgcctccagtacgtgattcatgtctgctcctcactggctgccacatgcagagttggatttggctccagcagcagccctgtctctaacgatcactagcacctgcccaaagggcgagaatcactagaaagaatactaagccctgtgttttgaaaaggtgcagactcacaagaaggcacgggcctgatttgctggaggaggaggtaaggaaggaggctctcctcttccctctctccttaaatatactcctttaaagctgacatttaaatgtctgtccccctgacaaagctgccacccactaatctccaacgtggagagccccaggtgccgtggcagtgggaagaggccaggcaggctttccctaatccatttacgtcactgatctcctccacagctgagctcggagggcggatgtgcagagttgggggtggggtggggagcacgttattgccccgccatccctctatccaacatgctaatccaagctctccacttgccagctgctcagctctctacatatgcctctaagaccagcctcctgcagcctcaggaagagagatggtttcccagaagaaagtctggcttgtccatctatctatcccctggggcgagaagggcactgcagcgggacctagacgctttctgtacgtgatgttatttatcacaaggaatctgtgaagaggaactgttgatcccatttacaggcaggaaaacaatccaagggaacccaagaaaaaaatgatggaatcaaagctgaagtccaggccctctcttgtctttcttttcttttttcttcctccgacttctttcacacttttcttaggactcatggactaggcattcccactgtgccacatttttctaaatctttataaccacaatgaaaggctgcttagtaaaggaaaaccaatgggacaagatattgattctcaaataggaaacgagacctctgaatatcaaaatcaaatatctcacacaaatatcaaatatggttttttcaagttattttatgactagaagaaaattgcattaaatgtatagaaaggctccagtaattagttaataccatcttttcaatatcgtaattgaatggaggaagggcagacttttcaacaaatagtactggatccatcatgaaaaaaactcacacattatacaaaaattaacactaagtggattatagattaatgtagaacatcaaactgtatgtttttagaaaaaatacagataatatttggatctaggactaggcaatgggctcttagacttgataccaaaagcacaagcaatgaaagaagaaattgatacattggacctcatcaaaattcaaagcttttgccctcagaacagtgctgttaagagaatgaaaagacaagctaaagactgggtggaaatatttgaaatacgtgtgaggtggtgaatgtcgccatgtctgctttttcactagatatatcctgtggcaaaattctaatatcaccttttgaatagctgcaattgagcagaagaacaatattttgcccatcacaggtttttgttcagggttttaaaataaggaggctgaaagtggggaattagtgattattgcacataatgtagatgacactttccaacccacgtgaataggaggagctaaatatatatgctgtgtgtatccacatttgcaatttactacaaaccaagcagagacaaatgaaaaatgcacacactatgcaaaagagggtaagacagggactttcctggtcgtctgatagttgagaatccgccttccaatggaggggatgtgggttcagtccctggccagggaaccatgatcccatatgccacagagcaactaagctcatgctgcaactagcaaagacccagtgcagccaaaataaaagtaaatacattaaaaaaaaattaaacgggggtaggatagtgcctagcacaaataggcactatatgcataagtattaacttttaggatcattactgggtagcaccaacccaatattcatagggaattaatacactgtatggaaatattataaaagttattatagttatagatgttcttagatcctaacaattctatattaaacaaaccaacacattgaaattttccaatgtgttagctggctgtcccaatagccagctaagagggtttaggcatcgttgaatgagatttctgctcctattttaattttggagcttccctgacagctcagttggtaaagaatccacttgcaatgcaggagaccccggttcgattcctgggtcaggaagatccactggagaagggataggctacccattctggtattcttgggcttcccttgtggctcagctggtaaagaatctacctgcaatgtgggagacctgggatcaatcccctgggttagcaatatcccctggagaagggaaaggctacccactctggtattctagcctggagaattccatggacagtatagtccaagaggtcacaaagaattgggcactactggggactttcacttttcataaggtgggaggagggggagatgcagtgcctgttaagcagacacgccttaagttggccggtggtcatggtcatttgtgtgtgtgccttctcctttgccaactgaagggacagagactgggcccctcactgacttatctgccagcagcactttgcacaagatgccttgtgtgtggttgctgctcttgtgtgtggtgtagataattgatgaaatgggaatgaaggtgtagacatgaatttgaggacaaataaataagctcatttcctatttttgcttttttcctgtccttaaaaaaattatgataaatctgtgcttaggcagttgagattccttccctatttactcagtcttttcaagacagaatttgtcactcgacctcagtgggtacaggggttttggaaagtgttgatcaatgtctggactgctttttgcatgaaataatgcaatcctaacacatatcccgcaattccatgtagaagagcgcagaggaccatagtttgtttagtgctttggccagttttttgttgtcaaaggatcatttttttttaaaaataaataaccatagggaactgaataggggaaaacatttcaagagtatattttattatcagtttgccatgaaaaactcaagggtctcttgacaacctctgagtttaatcagctttcagtttacaaatagttaccaagtgaaataacattatcccagggcagagcaatacctaatgtggattgtgaagatacagatgtcacatgaccagtgagtgttcatttcaacccttacctggggtttagagattatggaaaatcaatgcagaatagctttctgggctgcattcagaaatataactgggtgttgaatcaaaaaaagagatctaaggctgcagttgatccagtgctttcagatgcccaaattaaagtgtaaatggatgctgtggctgatagagttctcccctgacagctaaaaagccctgtataatttaaagccctgagttgcgca

SEQ ID NO: 61178 - DNA, 1624 bp, Bovine  19866880593484
actctgcatttaacatctatttaatccccataacagtatgtggtagacatcatggccatgttttatagatgaagaacttagtggttggatgagctgcacttggaatctgagtctatctgattcttttttattaataaaaaaccataatgtattctcttattccgactatataggtctaatgtatactattcacatgatacaagtcatttattttctttgtatcattataaaaaatagaaaactgcctttcaacctgccatatattggaaaatatcttccttatcaaggctgaacttgatcagactgtatttttctaacttgaatgaaaaacaaatactgcttatgctgcttatatacttttttccccattaaaaaaaaatcagttgttttatctatgagaaatggatgccattcaactaattctttctcttcccctcactctaaagttcctaagagctctttcaaaagtgatactcatgcagcctgaattttctataaagtggttccatattttaaatacacctgagtgatgaacagatcactgtgtatggtagagtttttgaaggtaggccttgaattcaagtgtgtcccaacattgaatggacacagaataagtcataagtcatatatattgtatctttagcattatttttagattgttttagatgatcaggattttattaccagtgagtacatacaggtggtttagtcctaagttgtgtctgactcttggatcccatggactgtagccagctaggctcctctgtccatgggattttccaggcagcaatactggagtggtttgacatttccctccccaggggatcttcccagcccagggcttgaacccctgtctcttgcactgcaggccaattctttaccgactgtgctacccgagaagtcatacagatgcatttaaaatgttattaaattcatagcatatatttcccaaccaactacaatcactgttacgtggggtgtctgaaatttttttgatgtttaaaagttgggaaacctattagaatattttgcattatagagaaattctggagtgatttgaagaatagtgatttgactataggaaactctgtttccttagtggctgtcacctgaatcattcattaagtcgaagattttgctttattcatatttctcattgtcagcatatcttgaaaatgaggcaaaatcagatgtggccagaagataaaatgaattcatttgccataactgagctgtggtgtttgtccttaatccctgggtctctgccttattgaaaggccatatttattaactgccgtatgttgggaaaataagttatttctacttcagctgttccttttctttttttaaagtattttcattacaattcagattttcatgtgggaaatttgaaagtgcctgaatataggttaagaaattgtgattttacagcccaggaatattattacactttttgttgcgtttcattacagtctttttgcatcaactacctatataatatacataatttgaatgatactgcttgttcttgtgtatttatatatttgccagtcttttatgatatgtcaagatagtaagttatttatcgtgtttgttttgcttttttattcttggatcatctaag

SEQ ID NO: 61179 - DNA, 1373 bp, Bovine  19866880704231
caaaatgccctgtagccttggagacaccccaacccccgctcaggaagaaggttcaagttcagtctgatttggacacaccagccctgcctgggagaaggcagcctctggccacatccaaggcatatttgtgagtgggccttggcccacgtggcccaggtcccctgtgtgggcatatttggcccctgggactgacccccagatggggggatggtgcaggggctccttggggaggggtctcctggctgcagctgcagagggagggctctggtgacctcatggcagctcccattcccttctttttccgtgagtcatgtttctaaaagtggcccaggagcaagtgggagccagacggtggtggcggggcctgtgtggccaggagggagaaggagggggcagatagggagggtggggcccagaggaaatgggagagagacagcagaagggagagacagacagaggtgggaaggagacagaggtgggggctgcgaggaacacagactcaagggagagatggacatgggaagctgcggccagctaactgctgaagtccctttccagctttgcaggggatggggtggaatgttcaagatgtgagggtaaggaaaaatgtctccatctgggccctcccacccatttgctcctcttcttctttgactgtccctgaatgtccctgatcatctcttcccatgtctagggcttgcctgtcatctatggcctggtctggaggtaggtggatgcagaagcaccatccgcctccaggcctctctggcctctggggagaatgctgtgggacattctcccacatgtttaggacaagctggttcttcctcaacagatgtgggaggggccaaggcctgatgctcactgctggctatatgtgcttgagtgtggtggatgcaatgggctctgagggcactgaggatctggcctttggtgcccaggcctgggggccctgggactccaccctcaccactctgctcactgagccttgctgcccctctctcctacagctggcccctggcgtgaactcgggccagggcctgggcatcgagatcatcgggactctgcagctggtgctgtgcgtgctggccaccaccgaccggaggcgccgtgacctcgggggctctgggcccctggccattggcttctctgtggccctgggacatctgctggcggtgagctgggggaacttcccaagtaggagtgctggtggggagggtggagccaggctgctgagggtgtcctgttgagggcagggggtgggactctgacagggctcattccacgggttgggggaccagctgccctggagagggaggcacagggcctggctgaccatccttccaggtctgatggtcactgccctgtttccc

SEQ ID NO: 61180 - DNA, 1015 bp, Bovine  19866880780949
acatgaattggctgcagtccattggagatgctgaaagatttcttttctttgtgcttctgagcttggaaataaaatgtcaaccctttcactgcccgagtgaaattgctgggcagtagagctatagttcagtactagcttgtgctgatcaaattcagctgccagggatggcagatgggagaatgcagcagtcacctgtcttcagtaagcatttgttttcagaaccattcaacattatgttagtggaaattcatgagagcctgatattctactatggcttgtgtgagagcaggacccttttataaaaccccaaatccttgacttgattagaatagaaagataatcactagattatagaactggaagactccttcatctgtagtggtcataatcactatcccaaaaggttgttatcaggatcaaatcaggaattgtgcatcatgtcaggtcgcacagtgtctaggtgaaggtaagagctccaaaaatgatggtggtgatagtaatagttgttattattcctgtttcaacaggaggtagaactttaaaggccatcatggaacttccctggtggccctgtggctaagactctatgctcccaatgcttcaggcgcccaggttcaatctgtggtcagggaactagatcctgcatgctgcaactaagatctggtacagccaaataaatattaaaaagaaaaaaaaaggtcatcatgcctggagttttcctggccaaatacaccttttcttccttgggccacttgtccctgctgtcacagaggatccaatgctgcctctagggcaggtcccctccctgcagtgactgtctcgccactttcaaaaaggagaccttcacctatttccgtttccatggagaccgtggcatatcctcctgctagcctgagctctagagccagctgtgaggcttcatagctatatcccggttggaggattctggaagaattcacagggcattagggtggacctgacactttgtataggatattccccctccctccagagg

SEQ ID NO: 61181 - DNA, 868 bp, Bovine  19866880862290
tgctggtgagctgatgactgtcacggccagtctgctgcctgtgtctcctcccacctcaaactccatcttcccggtgggcctcctggagggaatgaagtcattgttccccacaactcagcccatgggtgggaaatccctgtgggcccagaagggagggtccatccgctccttccttctgccctgtgatccacagaagctcctggctctgagagtgacagcctcggccacacccgtgggcgtcttccccccacacagcccagggccaatccttggccagtgtgtgagtctctgtgcgtccacctctggaccaagcggaggtcttcccgctggatccggtggggaccgggaccagacggccctgggaacagccagctctgactggaaggcaggtctcctgggcatgtcaggaagaagaaagcacatctggaaaagcgtttgctgaggctgctgctccggcagggccagacagtgcccaggcctcaggggcgggggaggcgggcagcccccccttatgtaggctggctcaggcctgtgggttctggaggccgggcccacaccactgcccatgggagggccacggagcctgagccaggcctcacggagggggaactgggtgggggaagtgctctccttggatcccaagctccccagctggtggggctgcacgggtgactcccagcttctccacgtacactctctccttgatgctcccttccccatgcacccctgaccctaccagaattacgctgggaagttgcaggtggtcctctcacacctatctctcacccatcctattgcctgggaagctggcctccccagtccttgtacttgttcctgggctagcagaactggatttcctattaggggc

SEQ ID NO: 61182 - DNA, 1564 bp, Bovine  19866880886942
actaagcacagcatgacaagaaaagaacagctgctggggctgtggaaaatactgtggagtctaagaaagtgaaatttaccaacatagcccatttttatatgaaatttattaccttaaaatatcaggaagaaaatgtatagaaattgcaaaaaacctaagtcataaatagctaactcataatgagaaaaacataactcagcagtgccaagatgtcttcctgcacattcttggatacattgacaaagggaggttattggaatagagacaagagactgtctaaactagagtagacagaagcaagcttgctagctggactttctgtcataaaggtgccccaaatatgtggaggaataccaattggctactgaaacaccctcagcccaacaccagtaacactgtctgtcctggatgcctgggatggccctcctgccataaccctcacctccttcttcctcaccctactctcatctccaccaccacttccaggaaatgcctgcgtcgacaatcaagatcttaccatcctcaaaacagaacatgaacaaggggaaaagatcattttgcagcagctgtgaaacgtcagctattcaccctttccgttcaaaccacacagtcgctcaaagctgcccatcatcccagagactacaactgaaggtaacaaacataaaacaaacttttttggaggataaaaagaaagatataatcatgtaagaaaggacttccctggtggtacagtggataaaaatctgcctgccaatgcaggggacacgggtttgatccctggtccaggaagattccaagtggcggggaacaactaagcctgggcgctacaactcctgagcatgcaccctagagccggtgctctgccacaggagaagccgccccagtgagaagtctgtgtaccgcaacaaagagcagcccctgcttgcctcaactcgagaaagcccgtgagcagcaacgaagacccagtgcaaccaaaaataaattaaacaatgatgtaagaaagaagaaagctgtttcaaatcagcaagcctttgtttccacttcaatgcaaaagtcactcactaatttcaccagcagaacaccatgggtggtacctgactctgatcagtccagatcgaggggagatctcatttctgaaagaatttccaatctgggcagcagcaaaaggcaactttccttggttgaattccaaaagccgtttgaaattcaggaaaatcccctgtgcagtttctggtctcaaatatctataaatttaaacaaatcagtctgttacaaaggaagaaatcatgtttcccaataaatctgaaattctagatacaattcctaaaagtcctaaatatactattcacacaaagctgtatgggccctaaaaatgttttagaaatagatattttctattctcacacaggtaacagagaaggtatcaggtgattggtatggaaacaccactgttagaaatgtcattttatttcatcattccagtgaatcaaagatgacttctctcatgatgtctctaaaacttcggatattcttcggatattctcctgattctcacttactttgg

SEQ ID NO: 61183 - DNA, 1396 bp, Bovine  19866880891579
gcttgttggggaggtagggagagtaggacagtgtcagaccgctttctggaaagcaggattttctattttgacgtcttggcaactctccagcaatagaccttacttgaagctacagaaaaggatccagtgagacagtatgggaaaattgccccctgcctggtgggagggtggaggggtgggctaggctcctaggcctgaatgaggacacgggacagcccccgcccccttcacgcccttatgcccctctctgctaggactggagaagttcctccaagagggagtgatgtcacattttccccagccctgccctgcgggcgaagagggcggcatctctcattccagaaaacgctggtggtgccatttgtcccaagctgctgaccacccccttcaggagaacattggcaggatagggggctccacctggagccaacatcagcatacggggtacctggcagggaagtgggtttggagccactcctcaccctaggcacacacaaggcaccacctgctccactgggctggctgcccctgcagctcccactcgactctccaagacccacacaccctcctgccctgtaccctcgaacatctgtctttgccttgttagatcacaaagcatgaagacttgagtgggggcttctgagaacaagggatctgatgccctcattttgcacatggggaaacagagggtcagagaggccaggtgacatgcccgaggttctttggtgggtcagagttaagccaggactagagtgcaagtcttcaggttcctgccaaggcccagtctgccagcctcacccagcctcttcctcttcccttctctgctggacaagaggccacctcctccttgggctccagcaaggactcagggaagtgtctgggcatctggaaggtacctttggaggagcctgacttctatgtcctgtgccatcccagcctcacctctggtcattggctcagagggagtgtccaggtgggcactgtaagtccagcaggccaggactctaggctccctgttgtcttgttcccgcccttgcctagatgccctggtgccctctggccaccaggcctccctgccctcctgtggatcccactgcctctgctcctcctcatgacatctcccagggccctgcctcctcccgagaaccatcccggttgctggaccctgctccagctggctcttgctcccttcacacatgctggatgccatggcctcctctgggccctgctgggacccctgggcacttcctagggcccgagcctcaccggctctgtggcgtttccagccagcacgccaccactgggctctagcagtgggggcaggtgccggctggtgccacgtcgtgctcgctccaggccccacagtgtgactgcctggtcctgcaggttccagagc

SEQ ID NO: 61184 - DNA, 992 bp, Bovine  19866880895474
ccagcagaaagccccaccacccactacctcccagacagaccaaatgaagaccgctggaccctgtggggcaagcacagaggccccagggtacctaccaagctgcagcacatccagatcaccctcgagcttgttggacactgacaactgatttttcctagaggaaaaaaaaaataaagggaaatgtcagtgtaccataggagaataccagagaaatgcaaacaacagagaagaatgggaggagcactggctgggcctccaggagggagctcctctccagacccggccctgccgctctgtgtgtgccgtgtaccagcactctccctcgctgagccacaggttccatgtcagatgggatcagatcacttctggggcgcttttccattgtgtacacacacaagcacaccccagccagcgcaggattagagaccctgtagtttgacacttgccaagaactgaacgcaggctcttttgctgatgccactgtagcactgctgggaaacgcttgcacgtgcacaggcacacacgcacacacgcgaatcaggttcctgcgatcactgcacagattttcttatctcatttttttgttggtttcctttctcccagctttcttgtgaagctatcagcagccgtttctcagaaatctctagaatgcaccagacagaataccttctgtgattctgactagtagatttacggatgtgcacacagagctttctttaaacagcccacctgtacttcagctctctttagattttcttttccttcagcatgcttcatctgaactaaagtaacatcattttttttaatgtattaaaaaataacaacattacatcaccctcttgaaaactccatttactatgttaaaaatgacagctcttttgaacgtagcattgaaatgtattttcctccaacatccttgcaggataagatatgattgaagtaacaattgtaatcttgccacagtaggttctatgaatggcttcctccgaaga

SEQ ID NO: 61185 - DNA, 3711 bp, Bovine  19866880910841
catcaagcatagcatatccccgcctgtaattatcagagcgtgcaaagcccctgcctaatcttgtgagtcctggtgacaccctctgaggaaacgctcctatgttctcaccagactttatcttcaggcctgtagtcccttcagctgaatggtctagaaaagggagagttcatgaggaaggagcttgtacaacttaagtagaatggggaggacccgctgagccttgctgcaaaatgaaaagtagtcctaaattttaactggtattgtaacattgaaaaacttgtcagacttgaatttgtcttatttctcagtctctgggtttcttcatgtcttttttccttttgcttttggaaaaggaagtgtctgcaagcatgctttcagaatactgagtaagctgtctgagactgagcttgtctaaagccagtgttttggagaggatttacatcaaagagagtaaccgttggatgattataaaggaccatgaagtaaggcaaaacttggagcctatggaataaaaagtgataaacagggaaagcagtttagacaaacggtcccaggagttaatggaggaaagtccaatggggcttcctgccattttattccctggttttctggattttggttgattttgtcatgtgcctctgcaggatcctgggtggaaatccattcatccttcacaagtcagtatctccatggtttttattccatggtaagactaggacccagagaaggcaatggcaccccactccagtactcttgcctggaaaatcccatgggatggaggagtcggtaggctgcagtccatggggtcgctaagagtcagacaggattgagcgacttccctttcacttttcactttcatgcattggagaaggaaatggcaacccactccaagtgttcttgcctggagaattccagggacgggggagcctggtggactgccatctgtggggttgcacagagtctgacatgactgaagcgacttggcggcagcagcagcagcagggctacagcttgtttaatgttacagcttcttcttgacctagaattggcaggtggctaagtctttgtatagctgtgatccctttggtttaggtggggagtatcatttgttcatatgaaatttttttaaattaaatttcattttgattatctggctctgtcttctagtctgatgactattttgtctccacagttccaggtagagtctctgaactcaaagacaagagacagctgatacagtcagtgtttgtgttgatttccatctcctgtctgtgagcttggattaattgacagaacagatggaaagactttggcagctgattatttggggattctgggcagggtccttatattgatctgcccttcattttaagtgttctcttgctgctgtcctggttggaagctttgtgaggacagacatcaagcttctctgtctgtctctcatttctgtgctcgcagaagatgtttgatagcttttgaaaggcaattaaggtataggtgctgctggactgaataagagatgacattaaaaagtaaaagtaaaaaagaaatcaaaagctctttcgcaatgcatttcatgtatttttaggacccatttaagcaatttttcattacttctaaaacatctgagataatcatggaagtgccctagtaaattgtgtgtgtgtgttttaaagaagagaggtttgattttgactcataaaattaacttaaaacattcccccccaatagctactaaattgccattcagggaaatctttttgggaaaccattactatgtgcatatttatctcatcattatgcagtttgcttgatgttagcttgttcaattcatgccgtgtcctctgccttgaataacacatcatttaggaagctgttactctaaagacaccagctgtatggtgccattatcagtcatttacttgttcagagcaataaaaaggaagaaatcagactattataaaagctaaattcacttttaattcccattctttgaaaagtaagtatcaggcacttcatttagtgtacattagtaaagacttgccagtgctttaaagaaaatcattttatttggaaggcactatgcagtatctcattttgtgtgtgtgtctgacatttgctcagattctcttaattttattttttaaaaattgttttttgatgtggactatttttaaagcctttattgaatttgttacattattgtttctgttttatgttctggtttttcggccaggaggcatgtgggatcaagatcaagatcactcccaaccagggagtgaacccacatccctgcattgaaaagcagtcttaaccactggatcaccagggaagttcctgggttttcctaatttaaaaaaaaactgtatcaatctgttccttaacaactattttccgtatcattctgtgttagtgttaaatgaagtttaaaataaaggctttgtttatttttttttgagtgtgccacttttatcctttatatttttgctttcagagaattcacaatggcagaaattgagcattttgtagatcccagtgagaaagaccatcccaagttccagaatgtggcagacctctacctttatttgtattcagcgaaagcccaggtcagcggacagtctgactcggaaaatgcgcctgggagatgctgttgaacaggtaagattccataggtaacttaatttagagcatacttcttcctggagttcagcactcagcagattctgtgtactggatgataaaatattttgacagtcactttatttgatacagtatgtgggtttttttttttttttacagtatttattacacagtattattatagtgggagggaattacctgaacatgccaatgtgtgggccattgggactaacatgaaaaaaaatttagcagggcatgtggaaaaaatttgttggtttgaattgtaccgcatcagtttttgttttttttttggccacactcgtcttcattgctgcacgcagactttctctggttgcggcgtgggcttctcattgtggtggcttctctggctgtggagcacggctgtaggtcttaggcttgcgtagttgtggtgtgagggcttggtagttgcagcctgcaggctgtagagctcggactcagtagttgtggcgcgccagcttagttgccccacgatagctggagtcttcccggcctaaggattgaacgcgtgtcccctgcgttggcaggcagattcttaactactgtactaccagggaagtcccccatcaatctgacttttaacaatatggacttcttttggggagacattttgactcataggaagcaagccctttctattttaaactcttctgtattacccataacaattgggataagggcttgcatataatagaatttccctatgattatttgcctagagaaatgagtgagtaaaaacttggtaacagtagttgctgcctaataatggaatgaattgccctgggaacaatgagcttcctgtctgaaaatattcaggtggaggctgagtgataatttgtcagcccttttgcagagaagggccctgcaggtggtaggagatggggctagacagtttctaaaacccttctgtactaaagttgtaaagggatttatactatatggggtttgcaaatttcagtggataagaatacattaaagtcccctcagcatgtcttacgacttttgttaattcagaaggcaatatatgccatt

SEQ ID NO: 61186 - DNA, 1020 bp, Bovine  19866881018532
atagtatattctgctcatgaagttgctctgaaaagctaaagtaaattttacctacaccaaagttattttccctcaggatcaaagtttgagaaatgagaattcctttaagtcttttctacttattgcctaattatacacctagatatttctacagtatttcagaaattctagttctaatttttataattaaaaaaattactgttttatcctgagcacatgtttccagtaagatcttcaaaggccttgttatataagattgggtttcaacaacttcctttccccatagaaagaaattagatatttcagttttttttaaagagataaagttggtacgcgccactatccctgcccaagagctggcatatgtgggttgagttcttttattattttacccgaagggtataattacttacgtggagtgaaataaggagccgtccttttctaagtagccttcataatggaccaacatcaaatcccctcctttggtcttgcgatggcagatgaacggcttctggagaacttcaatcttcacttctggttctgggatgagagccccactcaaacaagttactaacagtgtcaggactgcattccacaagaaaagcctcatgttgccagggcaggaaagaagttgctacaaaaacacagaaagggcccccgacctcatagagttaagaaagtagttgaagacttaaagacaacagcctctggcaagtcatgactccctcccttcctagcagacgtggcacattcaccaccgacaactttcccacgctttgcgaactcacctctaaagagttaagcccaacccctgccctgactggctcttacaacgctggctcctggaaagacggcctcccattggcttgtgattctgtccctcaggagtctctcaagccaatggtgtcacaatattgcaatttgcagttccgctgaggggaggtagcgcagaagcaaaccacccggagtggtcctgaaggcccggggattacagaattccacaatttaggaatggagaga

SEQ ID NO: 61187 - DNA, 1261 bp, Bovine  19866881138963
aatagttgagacctggataaggggaggttttgaactttctctctttcctctaataatgtgagttcatcatccttcgctcctgtcattttctgggttccgaaaagaccacttgaaacgagtgaactttcagatcgtaaacgtgagaagctgtaaatgttcctgagttactcggtgaaggcagccatccttcatatggaacattttgaaatttgattttgcggaagggagggaggtttcatgggctggagagcttggtggtttaatccaggcctccttttcctagggcactgcatggacatcagaatttagagaggacagggtattctcacatccagtcaggtagaaccagaagcttggaattgaaccccaagagtagatgacctagtaggaagcacagaacgggtttctccagcaccggcgcctgatgcaataacttgccttggctacggagggtggatccctctctcggaaataattcattggggcagtgctgcagaaaattcggcaaattctgccactttatctacttctctctagtttgagcctgattgattctatcctatttaattttactgtgggcttaatttattcttttttcttggtatcagagctttatgaatgcatattctccatcttcctccacacaccctccttaaatacaattaagtgtgattcctttgtcttttctgtctcaacttttttttcccccctctttcttcatatccttcactttagaagggagaatacatctaatttgggaaaacgcacacccaagcccctccctctgccacgttaccctggaactgcagtgcacattatccatctgtagcgagactctggaactagttaactgaagtacactttgatgggggaatagccttccgctattattactgtcttgtgtattgtttgtgttggcttgattgctagatatttggcgcttcaagctattttccgaatatgtaagttagtctgtcagtttgtgttttcttttcctaatttttcaggaccacacataaatcagttaactacctgggactttgaatcacactgctttcagggtcaactggaagggaatttaaagattatctggttaaccttttttttttttttttgctttcgaagaaatgagatacaatttccactgtgaagtttgtgcatttgaaggcatccttggagtgggatttgtaaggtgcttaataacgggtttcgttagtggcatgtgttttggataaatagctagttcgtataaatttgccaa

SEQ ID NO: 61188 - DNA, 1350 bp, Bovine  19866881162823
tgtgttgcaactaagacctggtgcagtaaataaccattaaaaaaaaaaaagattgaacgccattgtgagccctgggatgtggctgaagattcactacttttagcatgatgaatagtttccaaacctatcacagtcattttatgctcctgagatccatactttcccaccagcacttccatgtgctccgcactatttacacgcaggtgtctgccccgtgccagctcctcttctaactgcttcatttacatgcgcccattcgatcctcacagcaacttgatggaggaagcactaagattaacccattttatagatgagaaaagtgaggcacaaggcaatcgagcagcttgccaaggatacacagataagaagattccaacccagaaggtctggttcagggcttatgttcctaacccctaagctactgggcagtggtacaggaacgacagcaatgtggggcaacaagactgctgctgacctggagctgcggctgcttgggaggccaccacgtgatgtctaaatgtttgagaactcgcctctgtgttcaagttggagtgtgatgtgcaaaaagacatttcagaacatctgtgtctgatacagagaagggagggctttattgaagggggatgtacaaagttcaaagaatgctcctattttctttaaatcctagcttgactgtcaagatctagctcctaagccaccctctccatgcgacagaggtagcccactgtcacctccagccaggaggaacctctcatatctgataactccaaagccctctgctgcctctgctcagcattttgctgttttctgtaccttacctcccccgcttactcagaaactctaaaccacccgttgtttagcggtaatttgtaccagggttctgctctctggctaatgggcagttgtttgtggatttttcttttgcgcttacgtttgaatcacaatacaaagctaattaaaataaatggttcacagagcacagagtcacagagctggaggggggaaccttagattgtttttggaagcaatgaattctgaaataattaagttaccataaaaatccacttccgctgagctaacagtgagttaaaagcaatgaaattatgaaagcatacttgctgaagagcagaaacaatggcggagattctattagcctaattgttttttaatttgagctcataagtttttcaaatttggggttgttagtggcctactcctgactcctgggcctgtcacctgtcagcgaggtccccggccagggtatgagtcagttaggccagtgttggtctgacaccgactctgacccagtgcaaggacaccagctccttgcccctcactgggcacccagcc

SEQ ID NO: 61189 - DNA, 1477 bp, Bovine  19866881173592
acctgagaatagctgtatcttaattgcttgcatgaatgtactgctaaaatacagaaagagaaaagaaaagtctcttttacctaatatagtaggcacactcaagtaccctgtgctccatcagagaaaaggagaaaaggaaaagaaaagagtgtctgtgtattttctctaacattcttgagctacccagttttaagcagcagaacattgggtatttagtgtccagccctatcttcacatattggaggattaaaccagaaatggaaagggaatagattaaacatttcacaaacatctctgttgtatgagacataatgctaggccactgtgagtttgttatttgtatctttcaagccctaaacgttagtcgaggggcattatacctgcttggttattcgttaatgctccatagtagaacgctagttgaggagtcagagaaacctgaggtctggtgccagctctgtcactgccaggggcaaagtcactttatcactctgagctttaatatcttcctccataagagtgatgagatttacccattaataatcgtaacaagagtaaaaagacttaaacacttctgatgttccagacactattctaaacattttgcacagattaagttacttaatctttgcagcaattgtaggaagcagttgactttattatttccagatgaagacattgaggcacagaaagatgggggaagggactggcccaaggttacggagttagtaagtgcctccagcatcagtgctccattcattacataatacttgcaaaggtccttcctgcttggtcattatataattctagctgattcataatgtacctatatttaaagtatgttggcctggaatagcagactctatttgggaatgggaggtggggaggagtctgggagcaaggaggactgtgcccagtgttgtgcatgtgttttgtcactcagaaattttcagaactgctctgagctttctgctttcagttttagttcgctttcctgcccactcagcacacaggagggctgccgtcatgagctctagccagctgcaggcttcttgggcccctccagtgcgttagggcacaagcacattgcagtcctgcattccaaaaataacagaagtttgcatcacactcgccagatgatggtctgcgaaggtgctatagtcttgcttatccccccaggtaggaggtgatgcttgtccacgtatgtttgtgctgggtagacagtactaaggagtcatctggagtgtgagtgatccagagcatgggctcacaaccacgtagtcaaccttttttgttgtaattatttttaaatatctttaccaagatagtaattaattaatctatcgtgaatttcacccatttaaagtatactcatcagtgttttttaatatattcacagagtacaaccatcaccacaatcaattttaaaacatttgccttatcctaagagaaatacccactagcgatcgttcccacc

SEQ ID NO: 61190 - DNA, 909 bp, Bovine  19866881201085
ctggagtggatagccttcccttctccgggcatcttcctaacccaggagtcaaaccccggtttcctgcatctgaggaattctttaccatctgagccaccagggaagccccctagaagaaagtgtctttgttctaatttggctgagtttagttatttataaggtgttatgattgtcccttaaacagaatcagctatttcacttgcatgttgaatagccttttctgttaccctgaagagcagcagagtctcaggatgtattgtgtcttcccaagttttttctgtcttcctggactacagcttgttgcttctagtcagttaattgctaggcaaacaaatggaagtagtcagtgatttgagacctgagaatagaaaaaacctcccagggagaagctgaggaaagtgagaaaagtgttaaatgtggtacctgtagaaaagttgtttgaaaaccaaagagctgtcagtgaatatttcctgttgctggtggggagcaggaagtttgagtaagcttagggtacataaagagccattcaacctggagtcaggcctgctccagtacccatcttggaagcaggagggtggggtgagagatttggcttgatttcacaattctgttttttaatcagtgttaaaagaaattggtaattgtcaaccctttcttccaaccctcagaattagatcatctgtgcagtgtatttataaccaagtaattggacttttttccttttaaaaaattttaggcaaatggagttaaacagttgtgaaaatggatctttaaatatggaaataaatgatgatgaagaaatcctagtgagaaacaagagctccttatgtttgaaacctgcggagacagattgcagcatatcaagtgaagaaaatacagatgataatataacaggtaaaaacaaaaaag

SEQ ID NO: 61191 - DNA, 956 bp, Bovine  19866881217725
tccatgcgtgtattatctacagaatgaactgggagcaaggcagagggaggtcagaaacccagaagagccctgtctgggtagcctccactctacccaaactcctgagctttactggggccagtcactgaggacttctttcaaaagaggatgccagccctcacaacttctcctggtttatttatctcttcctagagatctctgctgatgaagaaggaaaactctgcaattggctccaaggtctcacccaagactatggactaaaaaagaagcacttatatttcctcaggatcttttagaagcggagagaggaaaaatctctcttttggcctgtgtgtgcgtaaagcatgcttctctgcagccaaaaaggcttgatgcaaacaagtaaggatgtgctctttatctccttgggttactggaaagcaaatgaacagagtatttttactcttctaccttcctttacgtgtcatattaaaaacgttaacaactggaaagcaatcaagaacagagtacttttccttttctaccttccttcactcattatgtaaaaaatgtgacaattcccttaaagcctttaggagaagaaacaagcaagccacactctccttcaccctccaagtcctgtgcccctaattccgttctaatcggtttctgagccacaccctcccagcacatcctaagattcctaaaaccaagaagtaaaggctgcttgtaggtctgttaggtgtttgcttgtttagagtatggtcgtggtagtgagaaggtagatatgtgtcctgatttaaacacagaagtgtttgatgttacaataaaaacacaaggttagaaaattgcctcaagtgccaggtgagcaggagactgtgaaatggtactagatgtgtgattaacaaacacactgctctcactattttcactacctcttaaccaatcttctgtaaaaactgcctgcagttttaggt

SEQ ID NO: 61192 - DNA, 2030 bp, Bovine  19866881265771
ggtctctgaacctgtgaaagctggctatgttacttctgaaagtgtatctgtgagcgtgtcggtgctgcggtgtgagtgtgtctggaggtgagtgcatacatgtgtgtgcccactgctcgggcctgatctgggggcactcatgataagcagatgtgggcgactgggtggaagctgtggaaaagaattcctcccgggccgcttagcacagctaattggccgttggcaggcagctgcctgctgtcgccgacctgggcttttccagaccctcagccaagtgcaaactcagacctggcttgggccacagcagggggaaaaattggcctgagaggccgaggaaggcttggaggaggtctcagagtgcccgaggaggtgttttcacagggagggagagagaaggaaccagatcagatctgggctggcgggacctgggcagggcaggcgggtgtggggacagtgagggaggtggccagaggctccacagagagtggcgggtgattagacaagcaaccgtcctcccgcttctcagccaaagtccagattcggctgcgaaggtccgtgcagagggcagttggcatgaccctgccaagcagggattagcacgccttgtgtcaccgtgacacctcacccagtccaggactgaaggttagcccttcgggctggagtttaaactttagtcaaggaagatgtggtctccgtgggtgtaaggtcctccaggcttgtctctagtgggggcagagctgggcgacctcagggcatgcccacggagtagggtcaggatcacgtcggggctcagctgggtatgatgggcaaggggaaggatccttcctggggaggaatagagtctccccaggccttctggccccctcttgaccttccttctcaagggcgagtcaggccaggcatctgctggtgactctgttctctcacacaggcatcccaggcaggcctgaggagggcaagcatccctgtgcaatcttgatctggccacaccctgattcagtgtctttttcccttgccagcctccatttttccagtctccccaatacctgagctgggtgggttgcaagagagggagaaaagggaacccaaccctgagcagggaagcagacaagttgggttcaaggcctggctgcttacttgttgactttcttggagctgagagccctcaagtctccaagaggggacctaggtctctttgatatctcttggccacacccatactgccagcaagctcactttgtggacttgagtttatctctcttcacaggaggggctggctaagaggagcccaagaagtgccaggctgaacataagggcatgaacattgttgtgggagcccagggactgccctggccccaccatggaagtttggggtccagaaacacgtgtcttgggctgaagaactcagaaagggttcagaacactgagcctgggatctaaagggacctgggaggtggcctcagtgcctcaagaagggcagagaccagtctgcacagcaggtgacatgctctttcctccaggctctgggagaggtttcccctagccccttgagtcccgggcctctccaaacccaaaccagtcgttggcatggagattttcaaggaaaatagggaaaagaagtggcaggaagtggttggagtgagtcagggggtgtcccatggggatatgttggcgaaaactttctcctcactgagtcagggctcaggatatgccctggagcaaccgtggacctctctccatcctgccacatcctagccggttctcaaagccagaccctgagtttatttctggagtgaaagacagaggcagcggcaggtgcctggcctgccctgccctacttcagctactaatacagtgtgatttcaggcaagccacctcatctgtgtggtcccaggtcccatctgcagaatgggtatatcgcaaggcgtggctgggtgctgggaagtggaagatgctcttgaaccttgaaattctgatcactcactgcctctgttcactcttcccctctcttgcttgctcacccatgttcg

SEQ ID NO: 61193 - DNA, 1600 bp, Bovine  19866881409985
cagtagttgtggtgcaggggctcagttgctccttggcatgtggaatgttcccagaccagggatcgaactcttgtcccctgcattggcaggtggattcttatctactgtgccaccagggaaatccctcaataaagctatttttaaaaagaaagctatctacttacagaaaagagacatatttcattaagtgataatatatccttactcctgctgctaagtcgcttcagtcatgtccaactctgtgcgaccccatagacggcagcccaccagtctcccccgtccctgggattctccaggcaagaacactggagtgggttgccatttccctctccaatgcatgaaagtgaaaagtgaaagtgaagtcgctcagttgtgtccgaccctttgcaaccccatggactgaagcctaccaggcccctccatccatgggattttccagacaagagtactggagtgcggtgccattgccttctccaaatatatccttaggtagaatctattatagcaattatctgtgataagtgtatgaataaaatgtttataacatgaagaaaaatttaaaaagtcatatgaaattctgggtagattgaaaattttgtaaaaatctgtgagccaagctagaaaacacacgcaagatgaaaatacctgctttagggagggagaataccatggatttagaataccttggattttcctaataggctaaattttctgctctgatgttgttgcgttttctttggaatgaatcttctgatccttttgttttgtatgcattccattatctcggcctcttcagctcctgccctggcagtatccatcagcatctctgtctaaaatttgttcctgtgtgtgggtcactcctgacgaagggccgcttgttctgagcttcaggtgggggcagggcagtgctgcctcagaagcatgagacgcttctgggcctgtcagtcctaataacaggcttgcttcctctcccacctggaactgttacactggcttccaaaccttgacaggttctatttcatgattccttccctgttagtcattcacttcccacttccctttgctgtcacctttttcttcaacacactggcttagcaagctctgtgagtctgcatcaccgccaggctcccagctccccgactgcctgccccagctgctcccccggcactcagcagaaccgtacaaggcttcatttacctctgaagcccccaaagatgggaaaacagctactgtcggtgtcagctgcaaagcttccctcctgcccttccatctctctccatccttcctgacatattatcttgtcacaaaggagttacttggggaaacatgctattattctttccttggtgtgatgcagtcacaaaggcaattttccagggagatgggcccagcaagccagtgcccagaaatgggaagagaagggagatgggccttttactcacgtcccattggcttcaaggacctgtttcacccaccataatggtgctgactgcttaaggtcagctctgcctctcagcattatgagcatggaaagacaggcaacggcaggcggaatttaccatctcatgggccaaacagctgtctacatccccagaagaag

SEQ ID NO: 61194 - DNA, 828 bp, Bovine  19866881430290
tagtataacacattagttatagacatttatcaattaaagaatgaggaagggcgatctgctagccttaaaaagtaaacagtgactcattccaactcttcacctcctttgcaatattttgacacattttattatgaagaaataaacacataaataaattgttctgttaatcatggtaggtcattcattgctagttatgtagcttaaatcccaggcagatttcaatgtaaacatttataaattatgaattttgttactcacttcagcattgcacatctcctcagtaaagcagttacttaaaagtagagctcaacaaccattttcctgttttcctcaagcagagactcaaaagcagtaataggcacactgtttcattacaacatgaaaataataagccttgggttattgctaaaggcttttcaaatatcagcatctaacttggagatgagggaaaaagaaatagagggtgctgatctgtgctgtaacctgttcttatgtggggcacgctcctggttgcaatatttgaaaattacatgtatgtaagtaaaacatacagcttcacatgtgaaagtgaaaaatggtccagaagtcttctcttcaaaaacagatcacctttttcttcccaataacttaccagaaataaatgtacttagaagccctaaggggttcttcaaataatattcagaaaaatatataaaaataaaaaaaacaaagcatgaacagaacatagttaacaaataagactttctttcgggataattacccttgcttttaaggatggatgccatgtaaaatgggagacgtgtctataattcatcatgtttatatgta

SEQ ID NO: 61195 - DNA, 1203 bp, Bovine  19866881448743
catcatcaaaaaagactttttcaagttacaatgagataaagggacattatctaatcagcaatataacccaatacatagcataatgaactttgataacaattcattcatttctttatgtctcggcacaataggatctacttcttgtcacctctagcccttagatgaactcataatctcattgtctggtgaaggaaggaaatttctcctttgctgatctacagatcaaatgagataaattatttcatcataaaagggcattcatcttttaatagagaaaacattcaccgagcaccctttatctaaagagcatgtatgtagatgcaggtgttggaaatggctgagaaaaactggtcaacatcctgaaagatgcagagcatttttctttcaaggaccaaacactgagtggacacatgttagactacaggtaaagagaacaagaaaggaacggtgaaacgcataaaatgattggcttaaataaagtgccaaaacatctcagtttatccacagaacaaggtacagtcttgaacttatccattttcaagatgtttacttctgagttgcagaagtgatcagaaaggatatgggctctttcaaaggtttctcggctacgagtgggactttggtggccctcgcatgacaagacaggtcataacaggaacggtcagcacatccaacaatctcgatccagccctgagaagacataataaacatctgtaactcacacaaggttcattcacaaatgcatgcagattatacatactcatgaataattcaattacagaatttccactcaacttttacaaatgcttgaaatgggtacagttttatacatcaagtagtagcaatcttataataaatataatccacacatgtacacaaagtagtctttttattttctggacagaattattttgccatattgtgaatgtggggtaaactagtatttgctgggatttagctatggaaataaaatgtgaacctagacaaaacttgtagatctctatcaaatttttgaccagaagtcaaaatgaatctggtagaaactactagcacaacactctgttccataaaatgctttagcattgatggattttggcatccacaaggggtcaccgatgcaatggacatgaacttgggcaaactttgggagatggtgagggacaaggaggccctggtgtgcctgcagtccacgggatcgcaaag

SEQ ID NO: 61196 - DNA, 1089 bp, Bovine  19866881474149
cctaccatgttcagagaaacaaaaaacaagtttgaagattccaagaaagaaatagatatcaggggtttccctggtgggtcatgtgtcagtggtaaagaatccccctgccaatgcaggagacacggattcaatacctcatcagggaagatcccacaggcctcagagcaactaagcccgtgtgggattgagcctgtgctctagagctcaggaaccacaactactgaacccatgtgctgcaaatactaaagcccgtacacactagagcttgtgctccacaacaagagagaccaccacaatgcgaagcccaagctagactagttcctcccacaactagaggaatagcccctgctgactgaaactagagaaaagccagagcagcaacaaggacccagcacagccaagaataaaattataaaaaagtagatactctattaaaagatttgaaaaaaaaaaaaaaaaaaaggaaattctagagcaaataacattgaaactgtagagtgcttacagtgggcagggaactgaacttgggggaaatgtcacacaatctgactttgtcttccaataaagagagagaagtagtttataaaataggggtgagtattcatttcacatgcttttcagctagaatgaaacaaaccatcagctaaccacaaacatccagattcctaaatcctaaggaggctggggggcggggggtgaggtgggggaagcaaagctctctacaagagactttatcaaaagagaaaagaacaactatccagtttcttcgcctccatatccatccacatgagagtacatcctttataccgccttctggcaattttatattacaagagaacctccatagcacttgcaagcattttggtgttaagtctactggatgagaaccggaatactcagttgtctcataaaagactgtgtgcttcccacccaatcagagattcttaactcaagggatgctagaaataaccatcatccccgcaacaaacagctgtgtcacatcccgtttccccctccctctccgccttcagcctccctccacgaactgctatctttaagccacagggcagacaagagaaaaacaattag

SEQ ID NO: 61197 - DNA, 944 bp, Bovine  19866881487753
aacgaccccagccatggtgctgccgcaatgttttaccatatgcgttatcttggaaagaagaaatactctgtgaggaacaatttcatcaggatttgatgtgttatttgcatcatgtcctttctaatgtacatagcagcatattcctataggcattaaaaactgagggaaaaaacttaattacaagattatatactccaaaagtcctgagtaggaaaaacaagcctccagagattttttttaaaagaaaaattgaaaaaaaattttgatacttccactcttaccctgtgtcaatacagctgaacggtggcttattattatggttggaaaattcaatacatataaggaagtaaaaagggaggaaaggatattgtcatgtggagaatataatttaaaatacactataaaaatagaaaaatgcagttctttgaaatgttgtgtgaccctgagccagtcccttagccaacctctctaaccatctcttttcctctttgtaaaattttctctaagcttctcttcaattctaacattctattctgggatgtcatatgttagtcctagatgtcccataaccctggatatacagtgttaaagctagaactttgaaaactattatggaacagcttgaaattattaagctagatataaagtaaccggtgaggcttattaataaaagtcaattcatattctagactttaaagataaaaacctattttttttccccaatgagttttaggagattaaaaaacttctatatagtaattttaattacaaaaaataatctcaagaacaagatgactgcattttatgcaagggatatgttcctgaaggatttgaataattcaatatattccaaactgaaaactgatttttctacaggaataaacattctctcaggaggcacagctctatattaccacagtgcatttttatttcaatgctccatt

SEQ ID NO: 61198 - DNA, 716 bp, Bovine  19866881526002
cctcccctgctcctggcactaacctcactctgatgggtgagtccatctcccctccactcccagggctgagccccccaggcagagcccaggcccagggcaggtgggtcagaaatgtgagaagggccagaggaagtgtaacccgggcagtccctggtgctccctgggctctgttctaaggagggggtcaggagggaaccctcaagctgtcacacttcaatcctgcaggagccttatgtccctcagatggcgctctggttgtgtccaccccgtgagaccagggatccgggggtgcagtggctccccctcagactgggcccaagttctcagacccagagatcccttgtgggaacatggtgcccaaagaagaaaaccttcattccaaggagtctggatgacctatattatgtttattttcttaacatataatgaaattccaattccaaagaggcatatatgcagagcagacagatgcagggtcctgtgtgcagcagccagaacaggacaagatggagtgcccccctctcccctccaagagtcccctcacccttcctgacaccaggccattacccaagcagaaatgcaggatctgggtctaagagggcccagtctaacagtccagggacatggccctggctgctaggcctggccaaatcatcatcttgctccgggtcctggaccccagtttctttctctgttaaatggactagaagcgaaat

SEQ ID NO: 61199 - DNA, 2334 bp, Bovine  19866881551513
aatgtgatcagatggaggaggtccccaggtgatccagaccgaagtgacattgatcttttacaaagactcctgttatgatgaaagtctagtgataactggaaaattcatatacaaaatagagaggctaacctggtggttcagattgtaaagaatctgcctgcaatgcttgatccctggatcagaaagatcccttggagaagcaaatgtctacccactccagtattcttgcctggagaatcccatggacagaagagcctggtggactacagtccatggggccgaaaagagtcggacatgactgagcgactaacactttcaacacttcagagaacatctactttgattcccttcctcgtagatgtggaacctgaggctcaatgaggggtgaggtgtgctcagcctcctcagtgaagctctgctagagacagaacttgtgtccccctggatggggggctgcactgcttctccagattcacttctctgtccatgactctgaactgatcagaggtttgaaggtcaaagaattggcagattgcctttgggaaagggcaaacacaagttagcatgtttggcactgtagtggtgtcaggattcacctagggagggaccgaggccattggtttaataagacctattacccgtgtgtgtgactagttaaccagagacttctttccaagagggtctcaccatgatttctgtcctgtccattgaggtctgaacctatggggccatatgcattttctagatcattgcaaccacagtggtgacattgtagggtctagagatgcctttctgtccagctcatgggggtgggggagaaggtgacaccaagagaaatattatttgcctcttagctagttggtgataggttgaagaccagaacccagaatttctaacttcccaaccaggaatctgactgcaagaaaatagtgcttcttagcaagccccctctaagtgatagttccagtaatgatgctttaaaaaatattgcagaaaatctcccagttctggcccttatcaaagatagagtctgtagacagaggaaagaggatatgatgctcatccaggtttaaaaactatagacacagtgaggagagagaggtgactctctaggggaaggtagcattaggctgttggtcatctttgtctgactgggactggcccttagagttagacggtgtatcttagggcttctcaaagtggggagggggtccatggatgctgtcagcttgtaaactttggactatcgtcttgcagtgagtacagaaattgagagtaagcatatggaaattttttcagcaattaacagagtaattttatggttgctaaatctgataatgaaaatgtgaatgtgtattttgtgtatctttatggtttatttcattttttctcaaagtctatttttattttattttaaaaatatattatttatttatttgggtgtgccaggtctcagttgtggctctgtggggtccttcatcgcagtgcacaggctccagccatacttcgtgggcttaattgctctgcaacaagtgggatcctagttccctgaccaggaatcaaatccccatcaccagcattacaagacagactcttaaccaccttaccaccagggaaagtccccgaagtctatttttactgtacagcctttgggggcaccctccttctagctgccttccttgaccatcctggggcctagtgatctccccactcctgtgctccccctgagtttgagcctcagactgcagccctggctcttctccccagcttcgtttcttctaatttgcacccatgggtattcatagacactaattttaaaaagtgtttcataacataagaaacactcaaatatattatcattattaaaaaataaaaccaaaagagacaaacagctactttggctgtcccaggtcacgtccccagagaacacattttgtcagttttctgagttccttttcacatcttaaattctgcatttacgtttgaatttttgtactatcttttgaagttgtttacacaaaagtcgtactgcaaagatgcactctcatttaaccacgtgtcttagaggtctttcggtgtcagcactgatgtagtaaatgtcacttgtgtatgtcatatatgtgtgtaatcaatcctatggcagaaaaatggcaggaaataccattcctggtaatggtggccttgtgtgccagagtggggtacagtgccttgttaatagaggcattctccctttccggaggttcacagtttttgactacaccgcagagaacatttttgcacacgcctcttcgtgtaacatgtgctagtatttcactggggcacaaactccaacgg

SEQ ID NO: 61200 - DNA, 1461 bp, Bovine  19866881751268
tctgagtttctctatagatagaagggacacagtatgtgagaagttggttgcttggaacatctgggaaggctcattgaaagggtaatgacaggggcttccctggtggtccactggttgggaatctgcctgccaatgcagcagacatgggtttgatccctggtccgggaagatcccacatgccacagggcaactgagcccatgcaccacaactactgaagtccccatgccgtagagcccacgttctgcaacaagagaagtctctgcaatgagaagcccacacagcacaactagagaaagccagaacagcaatgaagacccagcacagccgaacgtgaactaactaataaatttaaaaaggaaaagaggagtgacagttggcctatgtccctttattctttcttcctttatcctgcttggaatgtgggtatgacaactggaactccagaaaccatcatgcaccctgaggcaactttaaggatggaagctacacccccaggagagtagggcagaaagagcctgagccccattgacaaggagtggccaaatctgcccttacctgcccacctccaggttttattcatatgaaataaagaccaattctgatcttattctagtcactttagtcaagatttttattattagctgaatgcaatttctaactgattcacctgaaatttttaaacatgtatacttaatgtaacaagatctaaacttaatcagtacctctatatacattatagaccaaggaccactactatcagaactttggatatgttgtcatttctcactttttagaaagcttcttgctgatctttgcagcatcttcccctaccacacacacactcacatatttattttctgattcttacaagttcaacaaggtatgtacccttaccccattttcacagaagaagaaattgcggttcacaggcattaggtaaccttttcaaggtcacataattaaaaagtggcaaagtctttctaacacccaaacttttcgattgtgtcagaaatcttgaaaagtaaaagtgttagtagctcagttgtgtccgactttgtgatcccacacactgtagcctgtgaggctcctctgtccatgggattctccaggcaagaaccctggagtgggtagccattcccttctccagggtatcttcccaacccagggatcaaacctgggtctcctgcattgcaggcaaattatttgccatctgagccttcagggaagtcacaaatcttagctgtattctttcattaactactttgctggcatcatagctgaggacaagcacaccctctgactgggggaaggctggagtaaagcaagctatgctattacccagatcatcatatcttactaaatggccatatataagagatcagtctgctaatttaaggacagcagcttctggtttagccaatttccaggatacaggacttttcccagagggaaatctacag

SEQ ID NO: 61201 - DNA, 1239 bp, Bovine  19866881842655
ccgactctttgcgacccctgaattgcagcatgccaggcctccctgtcctccccaactcctggagttactcagacccacgtggtgccttcttgctgcgtcctcacatggtggtggaaaagagggagagggagcattcttggacttcacttataagtcactaatcccatttgtgagggctgtgatgcataaccttatcacttaccaaaggccccatcccctagtatcctaatatctaggggttaggatttcaacatatagattctggtggggtgagggaggcaaacattcaggccacagccatctagttgcaggcaacagtttgaaccttggctgtgtcataggaaatgtcctgctaaagatgtcagagcaccgggcttggaggagcccctggtgctgctctggtgatgggaccctaccccttgaccgtttgcagttgaagtgggaaccatctggtctgctgacggaaaggagtgatgctcggaggtcatttaaagaatctgagggagaacctcggatcccttagtttctgcagagcttgtgtcccctggagaggagtgctgacttcctttcctcagagcttcaggccccttcctgaggggaagcccagggaaggctgctgtgggtcccaggagaaagagggccccagggggctctgtgccaaggatgagggtggctgatgctggagttccctcacagctggagctgatgtgtgcatgactctctctgcagattgggaaaaaacaaaataacaagcgaaggaggaaagagtctcgctctggctgtgaagaacagcaaatccatctttgaagtggggtgagtagaggcgaatgcccgtgggtgtttgtatacgacctgctctgtgtacactagtgcttgctggcctgtaactttccttttttgcgatatttttgtctggttttggtatcaaggtgatggtggcttcacagaatgagtttgggagttttccttcctctacaatattttgggacagtttcagaaggataggtgtttactattctctaaatgtttggtataatttgcctatgaagctatcaggtcctggccttttgtttgctgagagttttttagcacttgcaattggtctgttcatactttccatttcttcctggtttagtcttgggagcttatacctttctaagaatgtgtccatttcttctagattgtccattctattggcatatagttgctcatagtagtctcttataatcccttgtattt

SEQ ID NO: 61202 - DNA, 1436 bp, Bovine  19866880963889
gggagcctgatctagagtggagaccatcaggaatgaatgtatttggccacaaaccactgggagtgcagttggcccccattgcacctgagaactgtgggtctcagacttcattgaacacaagtcatcagagtgacggataagcatgcaggtgcccgggccccatcctgaatctgacttagtacgtctgcagtggggacctgaggatttgcatggttaacaagcacagttgattctgttatcagaccccactaagaaccattaccccaaattcactggggactgtgggaactcagggacctttgttagtaggagtgactcctggtgggatttcctggggcagtgctgggaggggagggcgcacctgaaggtccagctagcatccccttctgttcccagtctctccacagcagggcagcagctgccctgagcatccagttcccagggacctgcctgtgggcctgtgtttgggcatctgagaaacggcttcccacagcccccatccccccaccccctgcccgctctgcgcataatctgaatttccgaacagtcattatctgcgatatttaatccaaattcgcttctctaccctcctccgtttccccttattaaaataattttagagttttagtaacagaggtctttttcaaaggatttctgataagaagtggactctcaagaagccttttgggaattatggatgtagcatgtgtttgctgatttcatgaagataagatttttccttgaagataagtcgatctgatgatcaggacacacaagtggtggtgactattgttgatattcatacacttcacctgcagtgctgttgtgtattctgtttgtagaatccacccccatacagttggagggcttttttattatgagaattttcagcctgacacagaactagaaaatacagttcccagagttaccaagatctgtcgtactttttgacagctatttttttcctgttcttaaatatttaaaaaatttttatttttgtattttatatagttctttttaaatttatttttaattggagtataatggctttacaatgttgtgttggtgtctgctgtacaatgaagtgaatcagctctctcttgaggcctccctcccaccccccatcccacccctctaggtcatcacagaccacggagctgaacttcctgtgttacacagcagcttcccactagctctctgttttacacagagtagtatataaatgggggcttccccagtggctcagatggcaaagaatccacctgtaatgcaggagacgtgggttctatccctgggtcgggaagatcccctggaggaggaaatggcaacccactcctgtattcttgcctggagaatcccatgcacagaggagcatggcgggctgcagagtcacaaagagtcggacatgactgaagtgaccgagcacacaccctgta

SEQ ID NO: 61203 - DNA, 1959 bp, Bovine  19866881846505
ctggaaggtcgcttcctaagataagacagccctgtcgtgttaaaattaggaattaccagaagcccagcttctggctctgagcacacccggtcccgtcctttggtgtaagagcagtgggagtgaacacagtgagtcgggtcacctttcttgaaggctggtcgtagagagtttatgtgatttttatttcttaagataaaattactactggaaaaagaaaacatgaagatgatgagccagtatttgaacaaattgaaaatacagccaatccttctagatgtcctgtgaaaatgtttgaatgctacttgtctaagaggtgagtatttatgatacttgatttttttaaatggtagcaacagttaggtgctgtgaatttatcagaggtgactttttttcattgatcctttttaaaatttttctcttttcttatttcaattatgtttttagtcctgttataaagcacccagcttgtatctcttaagcatatgttaagaaattgctctctactaaggaagttattgctgttgtagagggtgagacagtaaacagtgtaaagtttgggggctgtgagtctctcttgcagccagtgaaatttttagagatcacaaattattttatgcttgttcattattttatatatgtaccctctaatttttaaaaggtaaacatgaactcagaatgtattttcttaggtaatcagttttataaactgtccccaggttagctgtcaagaaccataaaaacagtaatgtcacctctaggatgattatttttaataattagtatttcaggtggttttgggtagccctctgtggctacaccagtatttggatcttccagtcatattttattctgtctctggaactgggatgaatcttgaagtattataattggcagtgctttacttgtttaatggcagtattaaaataatgattaaaaataatgtttctatcgatgatgtcttggtttcagtgaaatacagaatttaaattatggtgggaaaatactcttattatagaaattaactttcagaatgtctcaagtgatagaatatttaatgtagttaatcatgcatgtggtctgcccatgtaatgtggtaatggtagcagaattattcttaaaataaaaaaataagttgtgaggaattttgtatacatactgtgaaattgactttcttctttcttccaaagtccacagaatcttaatcagagaatggatgttttttatttgcaaccagaatgctctagctctgcagacagccctgtctggtacacgtccgcctcactggaccgaaacaccttggaaaacatgctcgtacgggttcttttagtaaaagatatttatgataaagacaattacgaactggatgaagacacagactaaaaaaaggaaggattcagaagcagtcaggataacagcgttaggcagtcatgctgctagatcttcattatggaaacatttcaggtttactcctcctgttctgggttttgtagcagtgcacccacaccgggtactaccatgtaaataatctgtgagtgaagttgccattattctttgtagtggttttaggatacttacaaatacattcaaattcttttttttttattattatttatttgattaggtatgtttgtaactttttacattacaaaatatgaatgagaatgtgccatgtataattttttcttgtagtaagaaacatccatattgcaccactctgctgttgcaaagcttcctggaaagggggctcttctgctgggtttctgaccgaatggttgtgtgtggggagcacctactaaaagtttagaacttgcagtgtctttcagaatttttaaaataaactgtaaactaatgggctggggtttttgttttgtttttctgggggttttgtttgtttgatttatgctttagttcctaaagccttacaagcttatgtagagagataccatctttgtaccaaaa

SEQ ID NO: 61204 - DNA, 2229 bp, Bovine  19866880972028
cttcgcctctagaaaagtagcaaacgtcaaaattatgtaattggctgtcttgaaatattttaataatgccaaattctttatagtttgcaaagcaattgcaaaagtgttatcattttgtacccataataaaccctagagataactattgctatctccacttcacaaataaagataccacagctctaaaagattttctgctactaaaatatccttggttgttaagtgacagggctggatattttacatccagaccttctgacagtaagtcttgtgatggttcctgcaaggcagtgtcctctagtttcatgtatatgagggcatttaaatcctcttctgagagaagaaaagattctcagtataaaacattaaaccagcagcttttagtgtattatttggaaaatgccaagaaaaaataccttgaggtgtttgaaactcacatttgaaaatatgatagtgattgaatgaaaatgaaatacatgtggtcaaataaggtataaattgtatttttctttgtctagggcttctgaaaaaatgtgattgctggttagcagaacaagtatttctccagcagtacagcagacgttttctttccagtgacatgtgagagtgggtggcgagtatttcagatcagaacattgagttcttgtgaacaaagaatgtataatgtctggatctacttttctccctcttcttctcttagattagccatcatacagccttttagaattaaacttcagcccctcttcaaaaataaagaaaaactactagatgaactttggctatagataacctcaatacatattcgtttctttgtgatttgttttctttggagaataattccaaaacgcttaatcagacaagtattacattatggattctcctttctgaggataagataaaattaaattgtagtctttttgttgtttgtttagttgctcagtcgtgttcgactctttttgtgaccccatggactgtagcccatcaggctcttcagtccccaggatttcccaggcaagaatactggagtgggttgccatttccttctccaggggatcttcccaacccagggcttgaatccacatctcttgcattggcaggtggattcttcaccactgaactgcctgagtcttgattattattaagtacatttttcaaacctaaaataatttcttctcttggactgttcttagtggaaagtacatgtgagactaaagaaagggtatctataaaataaaatcatgaacagtttttcatcctcgcagaagactagattcaatatataagcaaaaaaaaaaaaaaaaaaaggtcatttttgtatgagtaactacacagtaaaacaagaattcattttgacagcacatgaattttaaatcagtaaaaatgtgcctttaaaaaacaacaacagcaaaaatacatggcctgcatattccagagaagtgatggtaatatttcaactaaaagggaaaaaatgttagtcactcagttgtgtctgactctttgcgactcctggaccgtagcccaccaggctgctctgtctatgaaattctccaggcaaggaatactggagtgggttgccatgcctgtctccaggagatcttccctacccagggatatatcaactcaagtttgtagaattctgagtcatttgtcagaaaaaccgaggagtctggtttcatccttgcttactaggtattaggtgtgtaattttgtgcaagttactcccatttcttgtgtgtcatattcctcttctgaaaatcaggaaaaataaattgtagagttaattttaggattaagtgataatactaagaggtttttagaatggctatttctgataattgagcctccaaactgagatgataggtgctaagagatgaacattgtttaaaaaaaaggaaagatttttacaaaggtgttagaaaaaatatacaatatttaccaaaagatatccaaaaactagacttgccacccttaggttaccactcacttctaacatttatatggagaataataaagactcaacagagagacacatggatgtttgtgactttaaaaagacttttcagaggcttctgtattttaccttcctttggatctatgagggtggtgatttttccttttgcaagactagctaagggagcctcaagagatttgatgggacagcaaggggcagttacaaggagacaagacacacatatctggctccagccagatgctttcttagctgataaa

SEQ ID NO: 61205 - DNA, 1877 bp, Bovine  19866880393521
atgcacctcatcatattagtttaaaaggtttctttttgcatttaacaatcttttcctaccaggcaaaatggcctttattaaaagactattctcagctttacttctgttatttggaagtcatttgaatctttttagctgctactgtacatcatataatttctgattaacattaaattgcatactgttttaattataatctccattcctaaatgattgagtatttagatcatttctcaaaaaggcaaaataaaaattatgtctgattgatatgaatgagtttgtgctttaaatattcaagcttagttatttaaaattcccaatttgaggtagaagagttggtgggtaataaaccaattttatttttaacattaactaaaacatactacatgttatatcataggtaaattgttattacatatggatattataataaaatttgaatagtattttataatttatttgtatatgaatgatcctttgctaaaatataaaaagtttaattcagtgattattttaaatataagacaaattcagataaatatctagctcattagttaaaaagtcttgccaatatttttattcaacttgaatgttttaaagtttctgtgtgtgtgcatgtgtgtgtgcgagtgtttgtataaaaacagcctcaggctttaaatatgttttgctactcttgaacatctgagaccaataattcaatggaactgaaacacaataacttatttattttaagtgattttgcattagagcatttaattccaacttttctttctgttaaaacctcacaaggttattgtttctctaaaagatttccaagttaaatccaaaacatttttagaaaaatccaggcagacttcatgctgagaaagatctttttaaggagcttaaaacaatttgaggaatcttggacgcaatgagataaactgaagggcattttctggtattagatgaaatttgaagattcggtgtttccgcaatagaggaagtgtgcctctttatgcgctgggaaccataacattatagtatctgatttgtagaggtatcacaaagttacaaatctaaaaaaaaattgtgactttgacaggtacggacaatgaagaaatattaggatagtagatactgaaaagcaattattgttttctaatattccatttctctattgggtttgatttttattttacaaatataataattataccatcatttaaattctcctttccaatataaagtttttggtctggcagctagagatctcagttttaattatgtccataaagagaatctaaagttcactctaccttagccacattatttacgagattagaaattaaaccttaaagatagtattatcaacataaaatatcagtgtattccagcattttaagaagtttgaataaatttacacatatatatatatatatatatgtatgtatacctgcatacaaatacatttctagactataaaacattatcttcagaaatttttatatttggcttcacccccattactaaattatagaaagttgtgactgttttaaattcatgaattacagattcatttagttcatattactctatggattataactgaagggtctcttcctttactaccaaatgatcaccctgtttaataagcacaagttagcaattttttctccacctgcctgcatgtttaagcaattaaaccaaagcataaacagtatctgcagttttactacttaaaactcatttgtgaataggaacatttccactgatatgatttctatatctctgcctatcattttgtcatccaatgcaacaaataagtgagacaaattaatttctttattatacataaaacacaaagttttaaaagtttcagttactcaaaacag

SEQ ID NO: 61206 - DNA, 1924 bp, Bovine  19866880400985
tttctttttgataatgaaaagacagagaagtcttctaagtaagggaaaataaagcagcaagttaagatgatagttgtagtaaaatgtaatatttaagtgcaaaaaaagtctgagttgacattaaattggatagtaaaacttcaatttatagttagtatgctataatgtttttgtgttcttatttatcagactatccatgaacatactataatttgctccccactagttataatcagctcatattttatgtgaaatgtatcatctttttcttcttagaacattgtgccctccagtcacatttgttatacttttcgtcctacaacaaaccctttggaatacagagtgtgttgaattgaatctccatttggatttcttccagagttattgctttgagaagaacacatgaaatgacaaaattggcaggcactggtttaactccatgtctaactctgttgttttctgttgatgacaagtgcacggaatagttgaaaatgtaatctacaatgtcattcctctatgcagacagattacattatatataatttagcatttatcttcagttacatcgtgaagcttcacatatttcagtaaacatctcttttttagcttatgatggataattgataacaatagaggattggaaatgaagaagcagaatgataaaactcccattcactcacttgtgcacaatagccaaccttgggtttttctcttttattgtgatagttttctgttctggcaaaggcagtaatgtgatctgggaatttgatattctctctttactgcaatgatatcaaatacgggtaagcatcctggccctaatgaaatttaaaggaagattgaggacattaggtgttaatcagggtattttttagaggagtgtgtgtgaatactactgtgggatccttgttctgatttcgtgtgtgcgagcaacattctggaatcactcttctaaaagaaatgtcagtattaggtaagaaaaagtaccaataaattttgatgttcaaaaacttttttgtaaccttagaggtcaacctaggttccctgtgcatccataattctattcagttgcctccatttccttctcacaccacatgtccttgaacttcaagcttctgagtattttataactacaccacacaattctccacttcttaattatgctacctgtatcatctcacttctcatcctaaaagaaaaacaacagatgtgtatgagaacctgatgaactagtggaacgtatgaagggaatggtttcagtttcaactttggcaagagatatatatttcattagtttacattttttaattatatgaacccttattagcagctactaaatgttgctttgaaataatctttaaatgtttaaaggcaataattaatgttttaaaagccaaatgtctaaaagttaaatactaataagcttcagatgatttgagagaaaagaggaatgctgtgttttattaagctagaccctcacctttttggcttcccaggtggatttgcagaatctgcctaccaattcaggatatgcaggagatgcagatttgatccctgggtcaggaagatcccatggaggaggaaatggcaagcctcttcactattcttgcctataaaatcccatggacaagggagcctggtgagctgcagtccatggggtcacagagtcagacacgactgagcatgcacacactcactttttgtgaataaactgatgttcaagtagtaaataatagctaatctcttggcttaaatgctgactctgaattctctgattctgctcaaatatcatctccctgtgataccttcaactagattccatgatgatgagtctactatgaaagtgaaagtgtttgtcactcagttgtgtcatactctttgtgacccatggactgtaatcccccaggctcctctgcccatggga

SEQ ID NO: 61207 - DNA, 1737 bp, Bovine  19866880825792
tggaaattccaggacttagtaatagcctggtttagcccatttgctctctgtgttccccactccaatattaatattaatatccaggcccagagtcctgtactatgtcatcctctaccacatgggatgaaaaggaaaaatgtaaacgtgagcaagacaaaagttaattttcattttataatcaatgcagtcctggttctactagaccttaacgtatgaattctcaaaaaatgctaacactttaattattaatgcacaaataaaggccattcacgtatgaatttgatccacttattggtccaagctcaaaaggaggtcttagtgcgttagacaattaattattgaatgtttttgaaagaaaaaaataaagtgtgtcttttaaatatgtaaaattgacataatacagttttctattttcattcagtttcttaaactaatttttcaataatattaaagatagtttaatgtacaaagctatattatcaatataatatttttgatatatatttaattatcaatatactgttaataattattattaacaaataggcatggaagagatatctcagaagaaaaaggaccacatgctaccaagtatagttctgcgagtgttttattctggctttgttaatcatatgcaaatatgtattagaaccttgatacattcatcttcataatgtgtttccagcttgttaaagtgaagtttaagaagctcctggaggagtaataggctgcatataatggactagggagtgaaaagtttggttctatatgcttaattagtttctaattttcctataatctcatcatgagtctcaaacagaaaataatattgaccattcatatagtacaagtgggtgctggcattttagatcattctcaagggggatgactaaattatttaccaagagtaatgtattacttattcaaattaaacttcacctcgagtgtagttttaaattcagtgagtaaatagcaccctgtgaacatcataggcttactgttaaatttaagtgaattaaggtccagtatcatgtctgtgaagaaataatctctgccctgccccccttacagaagaaaggttcacatcatattctatatcagggaaagagaaaaggtaaacagaaacaaagtgagtaaacaataatgacaacaacagaaaacagaaagattctgtctagttctagactcaaactgaaccaaatctggagctttcttgggaatgactctctaacaaaagtaatttcatcctgatctttctaatgtgatgctgctgatatgtgacgatctctgttaatatgataatcatgtaagaaaattactgattttctgccatgaacactcactacaaatttgataaatgcctggctgattttatatctttaaaattttactagttttgctaaaatctgcaatctgatgaaaacttttctgcaagtgaacttatttttttcccaagtactttttgtctctaagtctgtctttgatgtttgatttctagtaaatgctcaataaactgttgctattactgttgtcacctgataaacaaacattctggtggccttggcaaaaccatgattcattgagtagacagtgtatttcagtgacccttcttatatgaagcagtgatattcaccatgtttagctgagcatgtgtatttttataggaacagtgtgatcatataaaaccataccaggtgaaaatttaaggaaacattccttaaaagtccctacagcaga

SEQ ID NO: 61208 - DNA, 1002 bp, Bovine  19866880929623
ccaaagtggaaaattatgcaaagaaaattgagaaagtaggaaaagtgccaggcctggtgccttagggaaagtggagaatatgaaagtaaatacagtacagagtattttggttattgctgttggcactcttcttgattatgtaattgactttgtaaattgatatattacatgtttattacttattatcaaatcacaggaataggaaacaattttgttcttgaaagaatgatggcccattacacgagtcccatcaagaatgtatttggctatgcaattgcccatggtggtaaattgagctaatttcaacatcagctttgcaaagcaatatttatctgtgattaccaatagttagagtcaattttttattatattcacatatttcacatactatatgggcccatttcttttcatactgttagaattttgctaacaggctaaatttaattagcatgtaagtagaatctggcttcacattacaaatattgtgaaaccctggtgtcctagggacgtatcatttgttaactggaaaatcaatttaagttcatcatttaacaagtgcctaaaaactgtaattattggtcacaaatgtgtttctaattcttacaatatttgtgaagtacctactgtgtgaacttttactgaaaaatacacgatacaagtgacaatagtcactgtcttccatctgactcttaatttaaatgtttaattgatagtgtgtagtatgtggaatgaggagcccctgtcccaaaatatgcccatgcccttaaaatctgtgattgtggcattatttagaaaattctttgtagatgaaggtttttaatgagatcatcctggatttgggaggaccctaaatccaatgacaagctcttagaagaggtggagtcttgtaaaaagatactgaatctttataagagaagacacagacatgttaagtgaaataagccagacacagaaaggcaaacactatatgatttcacttatataggaatctaaaaagtcaaa

SEQ ID NO: 61209 - DNA, 873 bp, Bovine  19866880929758
actaactactcattctcaggcagtattagcatactgattggctgttacttctgtcactcttctcactatggaattatgacaggccccacagcaggaaacaaatattcattaataccctgtcctctgggacacaataaactgccattcacttgcatacaaataaaatacacaagacttgtcaggcaaggggacataaaaacaaagatgcttttgcaaaatggtttgatactaccgggggatgggaccactgtgaaagggtttagtttctcattctatctcatcatggtaggaaaattctttatatggatttgcttttaaaatatcctatctttctcctcttgagctctttgagctcttcaattaaatggcaagttcttgcttctaaggaaaggaggggaaaaaagacctttacaagcctgtaattaatcccacaacacagaaacaataagaattctaaaattccattaaaatgtaagacagagcttttttttggttcaaatacgatatgcaaaaacattctgctaaatgtatttgaaaaacctcattagaatcagtagggatgaaatatacttcaatatcacatacctgatgggatcagtaagagaaaaatgatacatgaatggtatcactgttgaaactccactgtctacttgttacactaacagattaggtcaaatttcaccctaaatattaccacatgactgagtttacaccttgttataaccagaggatacagtattgaagaataaattaggcaacacactgtatgtaattctgaatgttaattcctttgatatttattagagcaacaaatactctaataaatttttaattttcaatcacctagcctaaacttcgaagatatgcagagaa

SEQ ID NO: 61210 - DNA, 1439 bp, Bovine  19866881293170
taagaaggaaacaagtttatttttaaatttcatgtagtacaacaatactttttagtaggaaaaaaatacactatgccagaaaatcagtctctgccccttgtatagaaggtgatctgtttgtactgctgctactgctgctaagtcgctactgctgctaagtcgcttcagtcatgtccgactctgtgcgaccctttggacggcagtccaccaggcttcccccatcccctgggttttccaggcaagagtactggagtggggtgccactgccttctcctgatctgtttgtagatgacaccttaatgctgtctattttgatgcacggtgggtgaacacagttcctgggaactattctgtccactggctttcttttggtggcccagcagatagactgagacatcactggtgaagctgtgaatataatgtaatggtcatctttagcattaatataaggtcaggaaagattctgattgctaagagacattcttaaaatgttttatacacatagggccatagaatccatttacaaatgtgttttcattgtacttctagtctatgatagaattaactggatttgcactttgatatgaagttaagaagaaatctcttagcactgttgactttttttaaacacgcacaaaatatctgtatttcttattaggaaaaacagagtactttgtgtaatttagatttgcttattttaaaatagtggagaaggaaatggcaacccactccagtgttcttacctggagaatcccagggatgggggatcctggtgggctaccatctatggggtcgcacagactcggacacgactgaagcgacttagcagtagcagcatttttaaaaagacatgtgagatatatatatatatatatatatatatatatacacacacacatatatatattctcttcatgaaaacataatagccaaattaatttttcttgagtggataaggagaaagaatatagaatgtataggatgatttaagtcccaccttcttcgtaagtcctgctctttactcttatctctataaaagtataggatagaataaattgtttctgaatggaggagacaaatagaagtaaatgacaaaatgcaatgtaaattggcttttgaagagaaaaagcagtaagataaaattattgactcctataatggaaagactgatccaaggttcaagcactgtcattgggatgtttgggttcccccccccccaactctcacccagttcctcaaatagacactttcttcattgagagtaactccaaccatattctcccaagtgcaaataaagactgttaaatagcacctttctttccagcctagatcctaaattaattctgattagctgtgattgaatcatgtgctatacataaaccaattattaggcaggaaaggattactaatgggcagtgatgcttccccagaataaactc

SEQ ID NO: 61211 - DNA, 1306 bp, Bovine  19866881419296
ttgagggggcaggaaatgtatggtggcgtaatgttaaggctgctaagatgtatgctattgaattcatttcttttattcacctgagtcccacagtattatccaagctctgaaaatatattttaagggtggtttccaggatacaagtgacaatctgccctgatgcaaattagtggtctcattcattagccgttgaaagcatctccaaaaataaaaatatcctcttttaggctgattgtttggtattgtcttaatttccttctttgtgtacgagaagaatggcgggggggcggaataataatgaaagcatactgtgcacagcagttcaagtggctgcttagaaccttattctacttgtatcatcagaataatcaatttcacataacttcttttcttgtttcttttcttttttggtgggggagggagaacctcgtacttgcaacataaaccttttacatttcaggtcatttatcaggtttatcctctttggtgtgtgtgcctgaacatggcagattctgagcagaggagtataggactcctcactagtattttgagagtagcactctacagtactgtggaaaagaatagaaaggtagactgtctcaaagatactcttgctacctttggagtttggcatgacgtctggaaccaccagtgcttttgcaggagccagtcattcacctcctgctgccagaagagaagagtttgcacctgctgacagccttttcatctggtgctgggtctcccttgaagaaggcaaccagaacctagttgacaagagggtatgtgaaatgtaatttgctgtctttagcctgtcggtacaaaggagagtctagaagaaagaagaatatgatagggttgaacttgaactaatagtgtgtggtaactcccaacccttggattacttggcatccatactttctcttgccatatttaaactttgaatagcaacaacaatgcaacagcatatttctactcacatggtgcaactattctttatataaatgatgatactttcattcttttcctcctgaaagtagaaaaatagtcctaaaaatagccctagcaccataactagttttggagaatgttaattcctcttctatttcagtcacagtttcatcctcaatattctttatttaaaataatgaggaaagtaattgatcataagatggtgtttaacatttctgatttccttcttctactacattcctttaatctgtcttgtccaggattttccacagtttaagatggcctagcaacctaaatatttgtttcccaaggtctaatcactaagtaattttccctt

SEQ ID NO: 61212 - DNA, 1893 bp, Bovine  19866881433501
acagggcagatacttaggtttagagaatccctcttcttctttaccctggatcttttactttccacttcactggaatttctcaattttaataatcacagattaatccttccctggtagaaagaaatgagctagacaattaaaactatgtttctttttcatgtcaaagtgagacgttccttgaagatcaagggtataagcctcaattctctagttttataaagaaatgaatataaccatatcacctatcaaacatggtaggtatttctgtatataataaaagtagctctaaggaaagctactttatgtactcagtgtgtaagagaggggatcactatacaaatatataatggaattaaagtttttataaaatacatacttgtttgatagagtacaagatgtatttcataagttaaataggtatttaatttaaaaacatgtgttatgattaaaaaacccagaacattaaattcttaaaaagcgtatcatgtgtttaagaataaaaattaagcatgttagatcatgtatattttgtgatgactgtttaggaagcatctgagtccattttccatatataaaggacataaaaaaactatatctaattacttctagatttagaaggtgttgtccaaagctgatgggggtgttcagttgtacataaactatcacaaataaattaactatttgacttattatttgctgaggtacatatcatacttcacagagcttttaaaacctcaaatataaaaacgattgtgaagaaatttccagaaaagtttcaaatcctcatttactaataatactaataaatccaagtaaactttcaacattttattaaatatggatttaaaccttatgctgagttgagaatttaagaggtgtactccttgattcaattaacaagtatcatatttacaaagcattcacagtacatctagtattgctttgcaacttgtagtccaaccaagaatttacagggaaaatagcaagataaagttggcaagaagtagaataattttaatgaaaacacagtattaatgcaactacgtaaaaaattcattgacgcctttcacattaaactttgtaaaactatttgagcagaatcacttatcattatagttaatatcagattctggaactagcaacaaaactataaagcttagtggtcttttgatgaaaattgtaggtttttttttttaaataatagtacgctttaaaaaaaaaaaaaagtcaagaaactggaaatgctctgttccccttcccagcgcccagagtcatctaccctgttttataattcaacctgcaaacagattaagcagctaagtttgtggaaagtatgtttgctctccgctaagaaccgttgtgtgacactatggcgactcccctgatacctcaaagtgaactacagactgctctcactcatcagcagggaaaccaggctgagaattcacaacttctttgtaacttcaacttcttcatagaaatcagtatttggccaacggcaggaaagacttttattagctttacacgctcttttctttttttttttaaaatagcattcaaaagccacaggatgccctatatttcagaaagaaatgttttatgctgatttttgaaattttaattatgcaattaaaaattagaatgcctgcaaatgttaagtaactgatttttttaaagtacagaaagaaaattctaaatagttgatacatttttcttcttgaagatatattaaaagtttacaattttagtccaacctattcattatatagttatagtttatgaggaaataaacatcagtgtaaatttggcccacagtaaagatggtacgtgatgaaagttatttcattttaaaacctagatctttggagaggttttctaaccacatcagtctgg

SEQ ID NO: 61213 - DNA, 977 bp, Bovine  19866881905839
atatttctctctgaatttcaaaatatattgaataaaattatttaaaattttttgtgaacaataatgttgagacattaacaatagagcaaagagaatacactttatagattatctgataatattttgtcatttcctttttctatggtaaaaaaaatattaaaaccacacttagactcatataaaggtatgatatttgacagaaaaaaattagaactgctgataataaatcaattactttaaatatcctaaatgtaagtatgaatgtatataagtattgttatgtgctttaaatttagtttgattaatccagtccacatatgtttattttctactgtaatagataaatcacttattcgtgtgtcaatgttttgatcttctggaaggtatgtaccaaatgcattgatatattaattcttaaatatgtaatttgttttgctgtagatctactgatacctataaattaaaggtcttcttttgtctgaggaaaactaaaccttgaaatatacggagattgtatagaagatcttgagatgatacaaacatgaatatgatcatagtcttctcatgggaagggaggcagaaagatattggctccagattataactgaaaattctagtctgcattagtcttacaaaaagcgggtccatttcctgaaagcattcacccatcctgaattccttaagataggtatttgagagaagcaatgatttcaaattcttcaggagttctgaaaagaaacaggatgcaagtaaagtaatggggagtccaatccactccttagtctgagaaattaaaccgtcctttagaattcagctgttaacctttatctcaacttagtaccaagatacattgctaagtataaaaagcagttacacagtagtgcatattgtagtttgtgagtgtgtgtgtgtgtgtgtgtgtgtgtataaaatacatttagtctttgcatatgtttaagatttctctaggagaatgc

SEQ ID NO: 61214 - DNA, 1643 bp, Bovine  19866880452375
gtggcctagtggtaaagaacctgcctgccattgcaggagatgtaagagacatgggtttgatccttgggtctggaagatcccctggaggagggcatggcagcccactccagtattcttgcctgggaaatcccatggatagaggagcctgatgggttaccatccacagagttgcaaagagtcagacatgactgaagggatttggcatggcacgtgggagggcaggttttctaagagatgtgtatccttccctctttactgctggtgatgcaggacaagagcagaaggaagcctccatgtggtgatcggtacaatagcaaatgacgaggtgctgacaccaggcaaatgctaactagtacccagggtcacaatttacacatgaaacatgtaaaaacttctttgaatgcacattcaatcagagattttactttagaaataccaaatggaccataattcacctatattttaaaaaatcttccatatcaggtactgcttatctcctgtgaggtattgaaatccttacatttatatgccaggataaaatattaatagtaagtaacaacaaccacggccaccccctcaaaatccacaacaaatggaaaggtaaacagaccctttataattaaatctgtaatgataaaaaatcaacgttagataataagtgtctttataaaaaacagtctcccaaatcacctaaccattaaggcatttattttagtttatcagttgacagtgacttttattcctcaatgagactcgtacttctcattctttaaaaggcagtctttacagggataatacaaattaacaagacaagtcattcttggaagaaagggttgggattttgtcaattgatctttaacagataaatcagcactatgacttacaattagggttaaagatcctagacaatatttgcatatgaattcctggaagaatgtatgaggaacaaaaataaagcagaatctagtgtatactaacatatttttcaaaatgatagctcttataatcaaatatatttgagacatcattttatttatcatactgacaaacatttttaattttttaaaattaaaatcaattctattagaagtttattattttttttaagaaaattaccatcacaaatcaagattttgaaagctacgcaaccaagagatcagatgtaatattgcaattaaatgaacaggctggatgaaggttactggtcacacatattacataatattgaataatctaaatcttgtattgtttcataagatgtcaatgaaattactattaagaatataaaatgcttgaattaaaacaaaaccaaacaggaacatgaaaataagaatatattatttcaatatcacttacaaaagaaaaaacattcttatgaagggcagtaaaggaactcgaaacttaacgagtttagtttgtttttaataaattccacttctgaaataacatattaaggaaatgatctagaagtagaggagaaaactacatgatgaaaatttaaacggggactttcctagtggtccaatggttaagaatccacctcccagtgcaggggggacactggttcaatccctgttcaaagaactaagatcccagatgccacagggtaactaagcccaagagctgcaaaaaaagaggccacg

SEQ ID NO: 61215 - DNA, 1580 bp, Bovine  19866880871181
ttgtgaaaaccctcctcccccctgccctggcgcctggcaccatcctagactgacagtcagtggccaacaaattgttgttactcaaagtaattaaagtaattaagcacattgggttattgcatgagagtaataacttacttaatggcccacttaaatactttttaatgtcagtctgtggtctgctttagagcgcctgcattttaaagtgagtgagattctggatcttccactagctccaagtcttgattcattcgtttattcattcatgtatttgtattttcttgagctacctctttggctagtccctgtgttagcaacagacacgcagtccactggacttcactggcctgtggttaagactccatgctccccatgcagagggcatggtttcgatccctgatcaaggaactaagatcccacatcatgtggcccaaaaatttttaaataaaaatttgtcatttagttgataagtcgtgtccgactgcttgtgaccccgtggactgcagcacaccaggctcacctggcctctccactgtctcccagggtttgctcagattcaactccattgaatcagtgatgccatccaaccatctcatcctctgttgtccccttctcctcctgccttcaatctttcccagaaacagggtcttttccaaagataaataaataaatctttttccaaaaagaaatacatagaaatccagtacatgccttcacacaactcacaatctgcagaaccatcttgacagctttaaatacagatataataaaggtatctattcattgcattggagaaggaaatggcaacccactccagtgttcttgcctggagagtcccagggatgggggagcctggtgagcttccatctatggggtcgcacagagtcggacacgactgtagtgacttagcagcagcattcattatacaaatgaagaagacagattagcttaatacatggacactaagggtgaattccattggaaacacatagccatagacatggaatctctccccacttcctggccctcctaactggtggctcagagacaaacagttattccctaaaggaactgaggaaggctgaatgattcctgcactgcaagctggcattgtaggaacacagatctggaagaggctttggtgggcccttggctccatccaggaagaaattaatgacctttgaaagcagcatttcatgaccttccatctgtctttggcctcaaggactcctgagtataaacacagatactacctagcaatgattcaagccattaggtcccattggggaagtccagagaaagtttgttttggtgaattcaggcttgctctggtaagaaatgataaagggagtccctcatgctgaaataaaaggatgctggagagccacttaaagttggataaataaagatcctcgataaaagtaaatacatgggccagtagaaaagccagtattatttttattttatatatgttttaaaagacagacacataaaaatcaaatcatatgatgctggacacagtgtacagatgtaatcttttgtaacaatataacattaaagaggtggataaggaattgtat

SEQ ID NO: 61216 - DNA, 2228 bp, Bovine  19866880974007
gcacatgctttagcttatacatttgtttcaccctctacgggggaaggtggccctaatagtaaagagcctgcctgccaatacaggagatacaagagacacaggttcaattcctgggttgggaggatcccctggagaaggaaatggcaacccactccagtagttttacctggtgaatcccatggacggaggagcctggtgggctacagtccctggggtcacaaagtgtcagatgcaactgagcatgtgaacacacactaagggggcagtggtctggtggcaccccatcttctccagacaaactgctttccgattgttttcaagtaagaacgtgcaaatggaaaatgagtggaaagcgggctgtaacagatgtctaatatcattaaagctggctccaaaagaatccagatctcagattggtatattaatgctctatttatctttaagcacagatggatatttttattagtattactttgtttatctggtttcaggaaaggttagcccagggggcagatgcctcattacgagagcacattcctgccgagagtcagaggagaggggttgccttttcactggaactttaattagaaaagccaaagttataaatgttggcagctctcgcccaatctaataaggccagttgcaacaacaaacagaaagacgaatagggcattggcaagccagtgcctccccgcctctcttcctcagcaacccaagagaaaaacaacataccaccacctcattcccagatgtaaaacagatcaggacagagtccaagttctcagaaaacagatacttcataagcagctgttatcagtgaggacaaccaagagcaacaaggctgttatggatgcatggaccttccagaagcttctggatgaagcagtttctattatggactctgtgacttttattattcatcagcatgggatcctggggagaatacccagtgttcctgcatgatcattacctctcagtttgtttttctctagagctgatttctcattagtctctctttttagaggacttagtgggattatggatccactttcacaggaaatttctcactgggttggattgttgttgttgttcagtcgctgttatgtctgctatcccatggactgtagcatgccaggctcctctgtcttccactgtcccccagaatttgctcaaattcatgtccatagagtcagtgatgccatccaaccttcttgtcctctgtcatcccttctcctccggccttcagtctttctcagcatcaggggcttttccaatgagtcagctctttgcatcaggtggccagagaattggagcttcagcatcagtccttccaataaatattcaggactgatttcctttaggatggactggttggatgtccttgcaagtccaaggaactctcaagagtcttcttcaataccacaattcaaaagcatcaattcttcagcactcagccttctttatgatccaattctcacatccacacatgactactaggtaaaacatagctttgtctaggttggtcatagcttttcttccaaggagcaagcatcttttaattccatggctgcagtcactatctgcagtggttttggagtccaagaaaataaaatctgtcactgtttccattgtttccccatctatttgccataaagtgatgggaccggatgccatgatctttgttttttgaaagttaagttttaagccagctgtttcactctcctttttcatcctcagcaagaggctctttagttctcttcactttctgccatgagggtggtgtcatgtgtatatctgaggttactgatagttctcgcagtagtcttgattccagcttgtgcttcatccagcctggcatttcacatgatgtactctgcatataagttcaataagcaaggtgacagtatatagccttgacgtactcttttcccagtttggaaccagtctgttgttccatgtccaattctaactgttgcttcttgacctacatacagatttcttaggaggcatgtcaggtgatctgtattcccatctctttaagaattttccacagtttgctgtgatccccacaaagattttagtatagtcaatgaagcagattttttttttcaattctcttgctttgtctatgatccaacggatgttggcaatttgatctctggtttctctgccttttctaaaaccagcttgaacatctggatgttcttgattcgcgtactgcggaagcc

SEQ ID NO: 61217 - DNA, 2895 bp, Bovine  19866881172792
gaagccttagccacaaagtgaaccttgtttcccccagtaaagaaccacagggtgaaaagtggatcctaaatatttccagggacacccatttccccatcctctgtgccacttctttcactcaggcaactattttatcatttggcctagattacaacacctcccaacacttcctgtctgcagtactgaccactcccccaacccccatcaatttcaaacacaatagtcaacaccatcttttcaggtacagacctgatcattctagttcccagaacaaaactctccatggctccctcctgcccagggagtcaagtccagcgctagcacatggcatggaaagcccttcacagaagctccggcccctttacctcccccaaccttctcttctcttcccctgacaggctctgctctcagggtctgaactgcttgttgggtcctcagtttgctgtcagttcttccacagtctcccacgtttctctgcagggacccatagttgttgccaggctgcatccgtcatcagtgcaggacttggggcaggggtctgcccttcattctggtgttctgtgtgacctcagctgtggagtctgcccaacaaccacccacaggaccataaggattcactacaagttcacagtcaccagcgtcaaaggggcttggaccactcactcctggaccaccccctttgacctctctagcccactggatctgctcctctccacagagttggtttttaatctggttcgctcttaaccctccccatggacagaggagactcgttggccgcagtccagaggattgaatagagtcggacacgactgaagcgacttggcaggatgcattctcaacccacatgcaacctccaccttccctccacctgggctggcgaccccatgccctcccacctcccagaacacccattccacgcgtcagccctctccctacagcacatccggtctgcatcttttggctgcgttgttcctatccatatctcaatgtgcttcatttcctccaaccccgcacatctcctgacattatcagctgatgtgaacacaaggtgagcatttggaaacgaaaggaaatggtctctaagacgacgtgaagtctggggccctcatcttagccagcatgattagtagcaggaggtgtctgtggcaaggttatgaaccctccagaaatctcccagtaagctccaaggaatttctattctaacagctgccaaggactataatcctatctttgcagaaaccatttttaaaatagttaattctgatggccagttttggagaacaggaaacaaataaatgcatgaatgcccactaaagaagacttatgtgaacagactaaatcgcaaatattttctttaagcccacctttgaactcagatttcacaaattaaaaaaaattaacctttcctcaactagtgatacttcatcctaatctaagaggacataagactagcaagttaataaattcctgcggattcctccacaactattaaaaaaacaggcatgttcactgaaaccattaatggtgataatacaacattctgacctctgaaatagtcccctaaaatactatacagagtttaaatgccacccagagcatagaagatgaacattttaaaaggcaagaaataagtaagatcacctttgtctatagaggaatccacagcagaagaatgatgatactcgacaagaaaaggtggtataacaagttgagcaataaaactggccaatctgcaaaggctcagatgctgccgtaataacatctggtcccagcggggttggggggtgggagccagagaaatcattaagccatctgagacgctccaaacaaagaaactgtaaaattctgaactataaagtgaaggaaatacacttaatcccggaggggttgcagtatgtatttcaactgggtgatcccttctccagtgaggacacggtgatatgccgaaacctggagtgacacagaatctcaaccgactggatgtggcccggagccagcccgcgccagcacccaggcacctgttggtttaatcctagcattactccagacacccaaggcgggtgggggtgcagagaggaggaggccaggggaatggggaaaaatacatctcattcattctgccgatcagagaatgcataccttaaaaaaaatagttacatgtgctttctgtaaatgttcaataacgtgttagaagattaacacatttcttctaagattacggtttattttttgaacttcagatcctagagggtgcaaagggagatgtttgtgagtaagcaactactttacttactatattatcttaagcaaagtgactcgaaactctcttgaatgaccctgtttccttctgtcactgagattctacgatgggggtacaattatagttgcgtttcaacttcaataaaatttctctgctgcccattttcccagatcattctcaaatagtcttctgccaattagctaaagttatttttaaataagcttttgaaagtctttgttgaaagcaggtgtattacaaaatgtgcttctttaggaacttatgtgaaagagaaaaaaaaaaaaactgaaatggtaaataaaaacaatgactattacatcaaaatagtaagagataaaatacttgtatcaaaaaataaaatagcacataaaatatactggggcattttcaaagctttaagatgggaacacaggtgttatatgtgtaagtcgtcactaagtggaacactttagacagcttttcacaatcttttctgttcctctattcccactgcttttctttcagtctaatgactggacatgcctcaatttctgtgtctcatatattcagaatatatatctcagcacagacgtgggccctatggttcctttgctgaaagacaggaaacggctgaa

SEQ ID NO: 61218 - DNA, 731 bp, Bovine  19866881400715
ctctgcacatacacgcagggcacctgctgttcgcaggctggtgcccctcctttggccccctgagcatgagaactctgctctctgcatagaacgccctggctcccaccgtcttcacattgcttaacttggaggagagcggatttcttcctcaacttcacagtttctttgggatccacgatttgcattagcatgtcataccaaatagaccacagaaataacattcacattctctattgaatgcctttccttataaactgccttcctagttttatgattggtataaaatttttctttttaatcagacaaattagtttcatatgtctccatccttttccgggctacttcatccgctccgggaaaaaaaagccctgagttctgagaaaagctttcattttcacagcttgtgcatcaataatatgacctatgtgagtccatttctagactccaatagtcttaagaaaattactgcgttgaggctgctgaaaagagagttacgattggggaaattcagattcatgatgaaagattttgagtctgcaacttagagaaaagctctgaaactgtcgcctccccagaccaaacgttcactgcatgcactgtgaacaggcggacaggtgctgtgacaggagaaatgaaggccaaatttgggcctctggtgcccccggcacaatgagttcaactctgaatctcaggatcccgagctgtgctcctgctcagcctctttctctgca

SEQ ID NO: 61219 - DNA, 2058 bp, Bovine  19866880462523
taatgctcaaaattctcccccctgccaggcttcaacagtacatgaaccatgaacttccaagacgttcaagctggatttagaaaaggcagaggaaccagaggtcaaattgccaacatccgctggatcatcgaaaaagctagagagttccagaaaaacatctacttctgctttattgactacatcaaagcttttgactgtgtggatcacaacaaactgtgaaaaattcttcaagagatgggaataccagaccaccttacctgcctcctgagaaatctgtttgcaggtcaagaagcaacagttagaactggacatggaacaacagactggttccaaatcgggaaaggagtacgtcaaggctgtatattgtcaccctgcttatttaacttatatgcagagtacatcatgcgaatgccgggctggatccaagcacaagctggaatcaagattgcctggagaaatatcaataacatcagatacgcagatgacaccacccttagggaagaaagcgaagaactaaaaagcctcttgatgaaaatgaaagaggagagtgaaaaagttggcttaaaactcaacattaagaaaacttagatcatggcatctggtcccatcatttcatggcaaatagatggggaaacaatggaatcagtgagagaatttttcgggggctccaaaatcactgcagatggtgactgcagccatgaaattaaaagacgcttgttccttggaagaaaagctatgaccaacctagacagcatattaaaaagcagagatgttactttgccaacaaaggtccatctagtcaaagctatggtttttccagtagtcatgtatggatgtgagagttaggctatagaaaaagctgagtgccaaagaattgatgcttttgaactgtgttgttggagaagactcttgagagtcccttggactgcaagatcaaaccagtcaatcctaaaggaaatcagtcctgaatattcactggaagaactgatgctgaaactaaaactccaatactttggccacctgatgggaagaactgactcatttgaaaagaccctgatgctgggaaagattgaaggagggagaagaaggggacgacagaggatgagatggttggatggcatcaccgactcaatggacatgagtttgagtaagttctggaagttggtgctggacagggaggcctggtgtgctgcagtccgtgaggttgcaaagagtcagacacgactaagtgactgaactgaacttgttgtacactggtatctaatacaacattgtaaatcaactatactttaatttttaaaaattatttattatttatttatttatttggttgaactgggtcctagtgtgggatcctggcatgtgggatctagttccctgaccagggatcaaacccaggccccctgcactgggagtgtagagtcttagccactgaaccaccaggcaaatccctatacttcagttttttaaaaaaaattcctttaaaacatcaaagagcctgagaagatagtaagaaagtcctagggaaatcagaaactgagagaaatatgcagaatactgaggccacacttggccacgaagggaattgatttattactgccctaaatccctacagataggggtgttccagtggactgggaatttgatggcataatttatcttcacccaacttatgcaataatgaccaaaagaacaggctccatttccacaatgaatccgttatttagtattagttgtgttcaaagattaggatgttcagtctggaatgaaaattggcattatataagagggtactggctgagcttttagatcatcaactacttgacatgatctcaagttcttatttcacagtcagttcttaaaccatattccctagtccttctacagatactagaaaagatgtcaaatttcgaagggcaggtcctccccctcattctgctgctaacttttttggttgcttttcatttcttccaccagagagatgtgttgtgaaattgagtttcaataccattcttttccaaactgccagctcagatacgatcagaaaacaggtcaatg

SEQ ID NO: 61220 - DNA, 1544 bp, Bovine  19866880541223
ctgggccctttgctttgggagctcagagtcttagtcactggaccccctgggaagtccctgaaaactattacaattaaaatgggtaaacaacaaggtcctaccgtacagcacagtaaaccgtactcgataccctgtgatcaaccagaaaggaaaagaatataaaaaaggaatgtacatacccgtataactgggtcactttgctggacagcagagatcggcacaacaatgcttatcactatacttcaaaaaaaaagtcctggggtgcttactttataatcacccctattttaaggatgagcaaactaaggctcaaagaaccctgcctcactcaggatccacagctgaggtggagggagtctcagaactcagtcctctggggtcactggaagctgcctaggggtggcacttttcagagcaggggtcaaccctggggctggaagtggggcctgtgtgacttcaggctctctttcccctactcagggctgtggggtccctcctccacctctcccacccctcagccagcaaagggctcaaagcatggcatgatggggactgcaggactgaggtttcgagaagctgtttactctaggtcttgaattttaaagagtttaaagtccaacttggaccctcagctcccgggatgcctgtaaccatggcagcagctcatgaacaatagcaaatatttgctgattgagagagagagagagagagaggtagggagggaaacaggaaacagggctttgtcctgggtgtctgcagatggcctgggggctgtccccagggggcacacggatgcttccagtaataactcctctactgaggggggcacattccccatctctggcccaggccctgggtttctgcctgaaacatgccttcaggacagcacgtccagggccagattctgggtggacctctgcactaataagttccttctttttctcgagcctcagtttttttcatctgtaaaatgggaataacagacttgtctgcctttttagggaaagtcaggtagcttaactaaaggtcagctgccctggagcatcatcatgaggaactgttgtaaagaccaccccctcaattggattccagattgaagagatgtcaggagctccaggccaccgtccaggtggcccagagacgagcagtggcttgctcaaggacacacagcaagagcagctggatccagaagccagccacccaggcctgctgtcatcaggccaggaggccctccccgaccagctgtcaccagctgagaggttgtgaacaatggctgtcgggtgcttctgtgaggacatgcttggggcttaactggaatctgggtcagggcctggacagtgtctcagcagagagaagccagggaagcagactctgagctgctgagaaggggttcagcgttccctgcagaagcctgaggaaggaatcagggctctcgccacaggccagccccctcacctgggctttccaggtcagccgcttcatgtacacaccttgatttgtaaataggccaatattttaaattacattctagtaaaaaaaaaaaa

SEQ ID NO: 61221 - DNA, 2071 bp, Bovine  19866880566517
agaatgcctggactcactgatggccatgggggtcacctttcagggaggggggtcacctgaccagcatcttgcctgcagcaggtgagggggttgggtttgatgctcctgctgtaggagtttgctaggcctgcggtgaaaagtcccgcaaactcagggagctcagctcatgctctgcgatgacctagaggggtgggacggggcggggagggagggctcaggatggaggggatatttgtattcatatagctgatatgtgtgtatatgattgtgtggcagaaatgaacactgtaaagcaagtatagtccaataaaaagtaaattaaaaaaacactgcaaactgggaggcttaaccaccagaaacacactgttcctcagttctggaggttggacgtccaagatcaaggtggtcagcagcgctgtgctcctccctgtgggcacccgttccaggcttctctcagcttcagatagcttcttggcttgtggcagcatcattctagtcttcatcctgcattctctctgtgtttgtgtccatgttcaaatttcccctttttatagggacgccggtcgtattggattgcagcccacccaccctcgtccagggtgacctcatcttgactaatgatggctgtaatgaccctccttcccagtaaggtcacacacagaagaactcggggttacgacgtcaacacgtgactgcggggaggggagacatcagtcaactcatgacacccaccaggacagagttcaggaggcaaggtggcccctcaagatgaaacgagagagccatccccagaaaagaggggaatggatgctgagctgtttgaccacagttgccctgggggctgtgagattcactaggtcatgagctgtcagagagccagggtgtaaatgaacaacttgccttctccgcaacagaaccttgacttccatcaggtctacacgatgcacctgctgaagaggtgttgcctgagcacctactggcagccaagctctgctcaaggcacctggactttggaagtgaagacagagaaaaatctatgccctcctgggacttccattctagtgataactgccctccccaacaccctgaccatctgttgattccctccagagggaggcagggcctcatttttcccactgtggtccttcctgtggtttcagccacacgatcccagcaacacttttcctggggggggatacttgcctccagaggtgtcagcccccatcccccaaccccatccatctgtcttctccgcccccaccccggccccccaccccgtctttctttgtctcaggaactaaaacaggaggtgagtttatcagacgcaaattgctcaaggacctcattcattttgtgcagtaattaaatagaagctgtttggaaatataattatagattggcccatcaaagcaaattaaatctttgaagagtaatggcctaattagctgctagattctgccattaaaaaaaaatccaaatgccctgttgtcccgaaccaggaaatatcagggcccagctgtgaaaggcatcaaagggacattaatatcaggtggctgtggattctgagcagatgaggggcctcagggtgtagactcatttatcaagattaacctggctggctagactaggggtcctcgtttatttatttgcttcacagagtcttaacagatgtgtatacactatccactctgggcttcttggctgcgtcccccttggacccccttcctctccaagccctttctcttccttgttaatgctgactctgcatatctcttctgtatcctcaggaccaaccccgtctctgccacagcctctcctatcccaactctcctcacgatcccagttttccattgatctgggaggtaggtgaggctccggaaagttctggaacatgccaggacgtctcaggtccttgcccctatctgagccttgactctatgtaatgggtgcctgtggggcctggggctcccccagcggggctgacaatgctgccacccttcaggtcctcttgtagcaccagcatcctgactttccccataggtaactgcactccacccgtggtccacgtgga

SEQ ID NO: 61222 - DNA, 1352 bp, Bovine  19866880692685
acccgctcctttgagcccaggatgatgcttgccacgtcaaagatgacggcgagggccacctcccccaatcttgcagagctccttctcctcgtacgccatgcagatggcgatggcgtcgatgagcaccagggggtccatccctttggagccgttctcctcgctgtggaacatggcggtgctgggctggctgcccacctggtagcaagggagcaggaaggggcctgggaggagaggcgggcggcaggcgggaaagccgggcttagcgccacagacacactcgtccctccaactgcaaaactacccgtttccctggagattaggaatttaataaaagccaaccctggtacctgaccaacttctgttaaaccgcaatcatttacaaactaagcaggtataacgtaactgactccattacacagtgttaactttcagattttctcaatcacagctcacagacagacttgtttaaagggagaaccgtaatcaggtctcttcgttgaaaaaactcattaaccaggccacgaggcacaatgtgcgagtgacgatgggttatgcttcggacattcctgacacacacagaggaaagagcaagagcacccagctctaaaacccaatccgcgcaggaggggttggagcaactaacaactcacacccggcaggcaccggcccgaggcgaggcggcagtgactgagacgcgtgcgggtctgccgggaacactgggagacaagctccatgttaaatgcacggcgctgactgttcggacaggaagactttaaaaaggggggagttctgcgttctgcagtgctgggagaaaactacttgtcgcccaggataagaggtttcgaggacacaaagtgctactcaagaggtcatgcccacgaccggcgccggtctgggagcagctgcaaaactgaggctgagtgttcaggaacagcagcgggtggtgctgtgacatcttcactgtctcgtacaaaaccaccagtctgcaacagattggaaacactaacagaataggtccttcggcacccagagccggggaaggcctgaagcagaggggaggagcggccaggcaggggaaaaggcacagatgagggtccaggagcagactgaggagccgggggaccggggcaagcggtgatgggggctgggcctggcaaccaccaccggggacagggggccagcaggggcaggaccgcacagtcaccgctctacacgcagaggtccaaaagtactcggcccccgaaacgaaaacaaagggccaaaacgctaaacccaccgtgttaatattttatacgtaaaaccaggtgacaattttccagtgaatacagcacctactgctaaacaccaactct

SEQ ID NO: 61223 - DNA, 1121 bp, Bovine  19866880698809
ctgcatcctgcttattgaggtagcagtgtaacgtggcacacctttcctcttcctcagcctggaaacactagtagagagggctgtgggcaagtctgttctctgttgttggaggtggagaacgtgccgtgttatcttcatggtcctgaagaaaggggcctcctagtactgtggggctgatgttgcatacgtgggcaggatattgagcgtccctgccccacgtcaggcgtgttttattaagaggaatgttgtgtttgactttaggaaaaatgacttctctgctttttctgtagaaccgctactttgagaaccctcaggtgatccctgagaacaccgtccctcccccagagatggtcggaatgatcacgacgatcgctgtgaaggtgaaccccgagcgtgaggacagcgagacaagaacagtacgtgtctcggttgttctgctcctagctttgcttttatccacatcttctcccccggtggaggaagcccgaggtcttgactttttagaccctaagctttttggtttttcataaaaattaaactcatggaggcatttaaaataagcaaataaatgtgtgtgcgcacaagagagcctcactgattgtgctctgcaggtgtgcgcgtgaactgtcgctcactactgatgcagacatgcagaatcatggtggaatgagagcagctaaccctgcagggggccccggcctgttcttagcttcaacagtagtgaagtccctttaaactacgtataaacctgtagttcagtgcctgcccgtgtgggctccggggacagaagttctagaatgttacagctccaccacttgcgttttctcactgtaggaaagttcatgaaccatgagttttgtgacggtaacagtgttattttctgcagctcatgtgttaaatctatagcactggccacatagggaacatgtattgaatatgtactatgattgtgttttatgattaaatcaagacaatcatctgtgtttgttctactgcgatggttttgcagactgtttcaatatgagcataggaaactacatttttagtttatagggaacaaagctgtcatttctttgctcttcctgaattacaaacttttttcacttcccttttcctatcca

SEQ ID NO: 61224 - DNA, 1795 bp, Bovine  19866880740702
tttgtaagatggggaggcagggggcattccaaagtggggactgaggtggggagagggtaggtctcagagaatctggctcttgtgatagccctgtggagcagggcatgtttccttccagaagagactgggtgtggcagggacctccctggggactccagaacatcttggggtcaccctagggaaggcactagagacagagacaggagcctgggaaccccacagtccccagccgcaagctctgagctggggcaggaggcagaagatggacccgcctccatcctgtgggagaagcaagagctgcagagatggaccgtgaaggcttccacccagctgatatatggggctgcttcattctctcgaagaagaagcacgtccccatcagcgaggggctcattggggagggaggctttgattcctcagtaaacaaaccacctcattgaatggagcatcgtggcacgctgggcaccccccacaggcctcctcattaactctcacaatcctcaggtaggccgtttgtctctgtctttaaaaagtggggaataagctcagagaggtagagtgactacccaaaagccacgcagcatggggatgactgagttggtattcaaacacaggtttctccggctcctagtggattctaccaacccactgtttgatatctgctcctgaatcctgatctcaagaaataaagttttgaggttggagaaaatattccattttcaccttgaaaggatgagtctcctgtccccagagttcaaaagggcttcagttactcttcctactgtcatatttcccaggaggaatcaaaggcgctaaatttatggtgtctgaagtgagatttatggtgtttaaagcgacttctcgagcatcccaataaaggctctgatttataactaacgcattgttttaaacgcattataaatgataaaaatcgggcctgccgatgcacctcatgagaagtcatattaagggaggaaaagaaacggtgagattagatgttgcattaaaagatagagtgatggattaaggcccagagtgtgaatttagtgtgacttgccagaaaaagttggggagctgtaaatctaaagtgacaatctgtgtacagtggaccaatatttgtcacttttattatactttgttcagaattggtgatgggtcattatttagacacacacaccaacaatgctcaataaagctcagaagtggaagcttcttctggtaaggatacaggctaacagacttccctggcagtccagtggttaaaactccatgcttccactgcagggggtacgggttcaacccctggtcaggaaactaagatcctacatgccctgcagtgcagctccgccccccacaaaaggggagggggatacagggtaaaacctcaactccaaaccacaatgtcagctcagaggccattgcataatggaagattctccccgtcgtattcagaaaacattccaaacccataaaatgtgggaaaggctctcagagggtccccaaccattctcaggaagcgaggggagggtgacacccacatcttccgagtggcggaggcccacccccgccccatgtcagcatcctcatcaatagcaatagcagtgacgatgatcagagggcctgacattgctcctggtcacttgttcaaagagcttctgagagcaaaggtggctggaaccaagggcatgctggctcttcaccttgggaggtcgcaagtccctgtcttgatcagagatactaggctagattggattgttgttcccaactctctcctctctctgtacctggataacag

SEQ ID NO: 61225 - DNA, 1406 bp, Bovine  19866880824548
ctttgaactggcgatcttgacattggaaacatcaggctgtgaggctgctggagaagggacttggggaaggtggatttctgagacgacattcgttacttcatttaaccagccagccaaccgatcaaccccagggctgactgaatgtatcctgtgtgtacagatatctgcaaggcaaagctcaaggcccccacagcaaagaacaaccagtcaacgagaaatggggcctcctggtccacccactcatgaagagctgccccctgcctaacattgctgagctgagcttagagtctgatcccctaccagctgagtcttcacaaggaaccatagtcctatctgacacccatttccagccttgagagaggccctgagcctggagaacccagctcagccacatccgtattcctgacccacagaaactgagatagtaaatgtcctttcagggtgctaagccttagagcaacctgttatagagcaatagatcacatacacagggtgatctaacagccatttgggacttactcttctaattgcagctgccattagcactatcctagccctctatgggccatgcccaataaattttgatcaagcaaagatcacaggctttcaaccagagctgagcattgtcatcacctggggaaattgaaacaataacactgcaaagactgatgcctggcttcaaccgcagagattcttcattatttggctgggagtgtggtctatccattaagggttttaaaagatccccaggagattctaactggagtaaacttgggtaaccactgttatagacaatagtttttccccttagttcctcttgtgtgctgtgctcagttgctcagttgtatccaactctttgtgaccccattgactgtagcctgccaggctcctctgtccacggcattctccaagcaagaatactggagtgggttgctatttcttactccaggaaatcttcctaacctaggactcgaacctttgtctcttgtgtctccctgcattggcaggtgggttctttaccactagttccacctaatcagtacagtgggtcctcgtgacacatgattctgtatttgtgaattcacctacttgctaaaatctattagtaaccttatcaatacttgcagcactttgcagtcctttgtctgataccaagtgagcaataaaggacatacatggagagaatccaaaacacataaatcagctgacaaagtccgagagaagctagcctatgtctgcttttccctggcctgtgtccacttacttacacatgcatctccctgtgcatctcctcacaggttttttgacacttcgcaggtgtgcggtctgggccctttctccttgcttctagcctcttccacaggtcagggttggggggtggtattttggcacctctgtggtcgaag

SEQ ID NO: 61226 - DNA, 2147 bp, Bovine  19866880930906
ttttcctctcttctgctttcctgtgggctggggcagggatggcagagaaagggctgcctgtcgcctttatttgttcgaggtgcgccgggagaggccggcggcctcctggtgtgccagttggcctgtgccagcaccaggccctgcgctgagaaggggcggctcgcggttgacgctctgccttcatcatgttgaaattctccatttctgaataaggggttctgcattttcattttgcactgggccccacaaattcagtagtagttttgagaaggtatttgaaccaagggcgcatgaagtgtcatgcagatgacctctccagagtcgtgctcttatgtgacctttgatcgggtgggtcctgagcgcagcctgtgagtcactgattcagcttcctcctgtgggacgggtctcctgagaacctggagaaacacacacctgtctgccctgccggtcagcttcctaacactggtgttctctgctgccccctgcaggaccacttgtcttacttccatttcgtgggtcggatcatgggtctggctgtgttccacggacactacatcaatgggggtttcacggtgcctttctacaagcagctactggggaagcccatccagctttctgatttggaatcggtggaccctgaactccataagagcctagtgtggattctgtaagtaccgactcagggaactgaaaattcacctgtcacctgtcttagggtgcaccagatccatgggtgtgaaactggagaaaccaaccaccagaatcataaaaactgatctgacgaaaatatttaattgacttactatctcatatactgtttgaccagcttctcttcatggactagtttcctttgttgtctccttgaatattaggttacgattgtggctgttaatccccaggcctggtggtttttttttttaacactctgaggtgtctcctggtctctagagggaccaagtgaagtgaaagtcgctcagtcgtgtctgactctttgcgaccccatgggctgtatagtccatggaattctccaggccagaatactggatggggtagcctttcccttctccaggggatcttcccaatccaggggtcaaacccaggtctcctgcattgcaggcggattctttaccagctgagccaccagggaagcccctagagggaccaggaagatatcaaaaaagtcctgatattcagtcacctttaagattatcctaaaactcttaaaagcaacaggcacacagctacatggtcaccgtggatgtcgggggtcctcgtgaatgggctgatttcacaggaatgggaggtccacatcctcccacatgtcctagctgctaaggctggggtgcgggggtcaggcctgcatcctgtggagaaccaccccagctgtgtttccagaaatgtggcggacaaaggagccagtcctaactttcaagggcttctctgcactgaagccttggaaaggctgcctggaggcagggcggtgatatcttcttggtgtggctgccccttgactcagtttccccgtcacgcttccctcttgtctgctcggagacttggatgccatgtctccggaggtcccagcagcgtcgctcccgtcaccctcctcttgaggccagcctgacccccgcctgtgctcccccgcagagagaatgacatcacccccgtgctcgatcacacgttctgcgtggagcacaatgcgttcgggcggattcttcagcacgaactgaagcccaacggcaggaacgtccccgtcacagaggagaataagaaggaatatgtccggtaggcagtgttccggggcacccggggcggggcttgccaggcagcgggcacgttgagatggtcgaggctcctctgctgcgtgagcctcccttcccatacttggaccagagtcacagtagagacttcccgaaagcagtggtgtcagcagtgggagctctgagtggagggctgacctgttaaagggggattcacgaccccagagaccaaggcggggactcgcaagggagcactcggtgctgctgtgacggtgatgaccacaggagagcgcgggggaggagccgaagcttcctgagctcagtctaagggcatcttccctccggtctgtcctccccgctctgaaggcaaatagctgactagcaactcca

SEQ ID NO: 61227 - DNA, 1046 bp, Bovine  19866881025866
ctggaccgcctgccggagatgggctccaacgtcgagctctccaacctgtatctcaagctgttcaagttggtcttcggctctgtctcgctcttcgcagctgaaaacgaacaaatgctgaaggtagagtcaggcccagcccgcgcgttgtgttgggggttttttttgttgtcgtttctcaatacttcattttgagcagaaaccggagtggctctttatattttcaaacacaataatattaaatgaataaaggtgtacaaccagttggagccaagtgtggaaaacactgcagttttaaagcagagctgttcctggttgcctgctgacccaggatgaacacgtgagcagtctcactcgcagggcttgtcagtagtctcggcaccactgattcttcatttttgaagtcatttcttacatgaaccacacaagtagggtaggagcacatcatgttcttttaaaagaaaaaaaatcgggtgacaccaaagaatagaagaggaaggaacatctgacctctcagagccgacgagaagcagttggctgttgagcagctcccatcacatccccttctttcccgggtgctgtgtctgtgttcgtaccttcttgcgtttggtgcacagacgccctgtttcaggcctgtttgctcattcccctctgaatcaagggctgcagccagcttgtgtccctgtattaaggccgtccaggagggtgtgtttgctgacgcgctcctccatgcgactgaccctgtacgtgtcgtggtgtctcatcagttacttgactccagcaaatggcagaagccagtgcatgcttatggcagccactgaaggcagcgcgtgggacaaaaaaccttatcaaaattctcttctactgaccgcaggatattttagtttctagaatgctgagtattatcagttctgtctgaagagagatgctttcctgtagggagaaggtttgagaatgtaaaggagacccgttttctgctgaagtaagtgtgacgtaaagcaccagtagtctgtgcttgtgtgagacagtttcctccacttcttcagtta

SEQ ID NO: 61228 - DNA, 1747 bp, Bovine  19866881085704
ttaaacccgaggagtagacagatgaaggagtttcagctattaacttcattttgcattctgtaaataaacatttataaataatttgttaactttacgattttgcagtacgttactgcaaacatgcatgtttttatgcagcttctaagcttcacttgctcgtttcttcatgtctgtagataccaaagaaatgaaccatggcccaaatacctaactgggaattgactggtcctaaaatttttaagtgatgccctaatagtagagtgtaatgtaagtgaattctccaaattgcaaggccccttccctttaagcttccatatatgatacagatatgtacctaccggtctacacgcatacgacctggaacgctcttccctatgcttccggcctggccgcctctgtggggccctcctgtagctggttcctgctcctgtcacgtggcggatgcctgagttttacctcgtttcccctgctgtaaaccggagctccacaggctaggggtgccgtctgcttggtcatgtctctgccctgatgcctagcctggctgctggctccaggcagactcgggggaccgccacggcacagagtaacaggaatacaggtcctcttgttggaatgaccagttgtaggacatctcctgctgtatcagggtaaattcagccttcctgtttatagaacataagaaaacatgttactctcatcactcatttggctgcactatttcagtaattagaaacattgccattctcatgttgagtaggttgggaaatgatcatatataggttttcacctattttggaattgagatgctcccgttgtcaagaaaaaaatgtctaaggatgtattttttttttaacagcaacatctgcgaaagtggatggaagtggtggtcctcacccacaaagggggccagaggagtgacggaaaatgtgagtgactcgtttgtttccgggggcagccccgccgccgggcactgccgttagtgatgcgaacgtcggagccatgctcttaattaaatcccggtcagaggtttagttgtgtgtgactctagtccatgtaacctgttacacatattttgttagcgttacattttcgcttttatttctcttaatcattgaacgttcctttttgtgtttctttaaaaaaatctcccttttgttcactttaacacgatgtttttgttgatgagaatcctgggaagcttgacatgttagtatttcacttttactagcttttctttaaagtgaataaagcgtgctttctggacggttcttggcagctgtcgtttgcacgggggtgcagtgctcagctgctgttcccactgctttccgccctcattgcctcataagctgagcagaggtcttaggccttcaccacgccccgaggacaacgtgatgaagcatcacgtgagtcctggcacgcgtgttctcgaggtctgaatcccccacccccgttgtttgcccaaaggccagatggcccgtacttcaaaacataattttttacaatttcgagggaaaaccactctagttaaatctgtaggctacagtccatggggtctcgaagagtcagacatgactgagcgacttcactttcactttaaatcttttaaaggatccgacgtgggtcgctaaatgaatgcttcttgctgatttgactctaatcttattcacagatgttaatactcttttaaaatatcttttaagttgatgtctgtctcctcggtgggctgtgttgccacaagctcctgttc

SEQ ID NO: 61229 - DNA, 514 bp, Bovine  19866881098087
ccggcgaaggagaaaaccccgcccagcctgctacgttggaggtggcctcttcccgggcccgtccgccgcctgctaagggtgcccccaccgccctcgctgcagcggcaagcgtccctcctccccagcttcctggctccggagaagacattcaggacagaaagagcccagagacgccggtcacctgcctgcctctccctcccgggccggcagccccgccccagcggacgcaggcttaaaagcgccgggccgagcccacccgggcgtgacgcccctccccgctcccgctgcccgcccaggccgcacccactggagggcggtgcgcccgggcctagtcctcgggcggccggcgcagcggctttaagcgggggcgggactgcgcgccgtgcagcgcgacggagactgggactcggccgggggcctctgcgggcggccggccgccgaggtgggggtaagtacggggaccagggcggggctgcgccagagggcagcggaactgccccgggaggcgcgcgcg

SEQ ID NO: 61230 - DNA, 945 bp, Bovine  19866881121113
caaagggggaggtcttgattctggttgtgcagcttcctggctccacagacctgggcttctctgcatctgcctctgcactcacacaccttcctccagaggctgcccaggatgtttgggagttggcggaggagggggagtgtggggtggggaggcgggtggtggtctgcatgtgcaatgactccacgggctgtaggggactctaccagccaggatatttgcaaacaccatgcacaggccagcccgctttctggggaagcatgagaagtggagaaggaagaggagggtggccttgggggcctgggctgtatatggaaagcccagctgggatccaggttgcatctgaaagtgttttgaaggtagacagcaatggcaacccactccagtattcttgcctgggaaatcccatagacagaggagcctggggcgggggcggcgccagggttgggggtttggggagttacagtccatagggtcgcaaagagtcaaacacggctaaagtgacttagcatgcacacatgccatggaacattctaggtctgttggaacacttcctgcaggctggaattgaaggaatgaagaaggaggggcattctatccctgtctcataaaaaagcagcacaagccatcctcaactactcctggccccatgaaaggcctaatttccatccacctataactttattaggctcctccgagctattcatcagacaagcctgtcttgaaaagcggtgtgtagtgacttttattaaaatgtcttccccgtggctcacacattaggttttatggtcctgcacacagatcagatcagccttcacaatggtaaagagccagctcccttgcgctgggacccgcagaggttacagtgagaccctgggagaccagatgtccggtcgcaccgtttccccggaacatgggcctcagcatcggaagggtccttgctgcaac

SEQ ID NO: 61231 - DNA, 523 bp, Bovine  19866881153052
ccccacgaggcccgtgcccccgccccctggacctggttccctttcgggggtggcccaggccccgcccttcctccgtggcagctgtgcttgtgtgtgtgttgggggtgccctggtgcccagcacgggcagccctggggcgggccgaggccaggccacgctcctgaacacgctgtcccgcatctgcaggtgtttgggcggagccagtctctgccgggcgccgactcgctgctcgccaagcccattgacaagcagcacacggacaccgtggtgaacttcctcatccgagtggcctgtcaggtgtgcatccccgcgtccccgttagggtccttccgcacaagggctgcccgtagactgagtgcattcagccgtctgaccgttcggtcagaaaaaaaacagacaaaccaggtctgggagcttgtcttcagtagcttgtccctttcttaccagatctcgtttggtgacatgctgatgttcctgaaacccgactgtgttttataataggattttttaaactttttcatca

SEQ ID NO: 61232 - DNA, 904 bp, Bovine  19866881246242
tcttttttagtgccatgtgttttgcatttttgtgctgttatgggcctgaccaagaaaatacatgtgttagacaaccttcgctcaattatgagttatatagagctgtttgccattcaatgttaatgaatcaacaatatgtagtgaattaagtatctttaatcagaaacacacataaaacaaagttatatatttctcatctgttaaaaatgttgtaaccagaagttggaggaggaatctaaccctatctttcctctagaagtaatggtttagtattcattaattcagggtttgctgcatctttatacaccataattaccatgaataacaagaattgactgtacttcctccttttccctggcgatacttcactacatcaaaactgagaagcctaacgtgaaacctgataaaagcagaaaggtggacaaatgctatctattatagagatggcaggactcatgtggacaaaggcagtcctctgttgttcttgctacactgaggcagtgggttgtaatccaaggttggaagaattaatgcacttttcttatgctgtggcatgtattattatgcttatactcagtgcgttttgtgtatctatattttttgaaccaattacaaaggtaaaatgcaaagatgattcaaaacaagttgaaaagtaactaatcttccgcactttcaacagaccaagaatttttccccttctttgatgcaaaaagtatttgacatgccctcattgattcataagaagcaaaaagttaggaggttactttcaatatctcataaggacatgcaggacccaaggcagaatatagtcaataattgtcatagttcctttaagacaattttttttttttcattttacttaacaattttataatttggcatacatttaatatacgctttccca

SEQ ID NO: 61233 - DNA, 721 bp, Bovine  19866881318197
aaaaaaagctggaatctcttttgcacaccaaataacagacgccaaaaacgtaaagtcgtgagtttattgcatatgtaacaaaatgaacctgaccgccggggtccagcctgctgttcaaccactgttttgtgtttccagctggttctataaccacattaaatagaactagtattctttaaatacttttgattttgacataaaacattagtgtacaactttcacaaaataaatcagcaataaaaaccgtgggaaggataacaaggatagcagcagtacttaaaaacaaaataaataaaaatacattataaagtggttgagagacaaaaataaaccaactttaaaaatccatactatgtgttgggaaggctgccgtgcagcaacacctggctgcagccggggcgtcttctcggatagcttggcctggacgaccgcccgacctggactgggaccctgggctgggcgagccccgggcctcattcccaggcgcttctcccgggaggagtcggcggacggctggcagccgccccgcagcccctccggtcttcctaaagcactgaggagcggtggttggctacatccctgagggtcggctgatggccgctggtgaggcaagccttggaggtcgggccctgaagcttccgggcagaggcggggggacggggttcgtctgcggctcccgggaagggcagggggcggggggctcacccgggaccacccaggg

SEQ ID NO: 61234 - DNA, 1885 bp, Bovine  19866881377973
gttgtgggaatcatcaccagctccgaggcacggtgtctgtcagcctgcctgcaccccaacgaaggttttctctgctactttgtagagagaaaatcttgtgacgaacggacttccctggtggtccaatggctgagaatccgcactcccaacgcaggggcccaggttcgacccctggtcaggtaactgtatcccacaagaccaaactaagagttcacacgccacgatggaagatcaaagatcccgtgtgcagaaacaaagacccacacagccaaataaatgttttaatttttaaaagccccaagttaaaaccaaaccaaaaaagcactctaaacagaaaacgtgactcaactgccgtggtcaggtttggtaagcccagtatgcagtcttatacaaacacttgcgtaaccttgtcttctttctactcaaaacttgaaatggacgaatcttattaagttctaaaattcttactctttgaaatagaaaacatagaattgagaaaatatggaaggataagcacaaatgcagataatctgtcggagaagcttgtgaaaagacccgcaaaatgatcacaccgacaaagtgacatatcaaactccaacaggaaggaactgtcagagataagacgccgggtcttaggaagcctctttattaggaaggcaggatttcccaactctggtgctttgttcagccccaagtttcagagttggatttacaaagaattattttcataaacgccaaggacctgcaactgtctagacaggaagtgattaaaatacaagcaaacattccgactgagctgtggacaaggtatagaacatgagaaaagttctagaagtggtcaaggaagagctatccccagagtcagaagagagagaaaggataaaggttcagagccggaggcaggggagaggagcagacatacacgcgtgtgtaacacacaggtcactggcatctcggccttccacaacaggtatggaccgttcagacacggggaagactcgagagctgaaacaacgggaaatgagactggcagcagaaaagcagggctgctcagctctttcccctgcagcaccgtgttcatcaaggcagctacacgagactcacctccacctggaaggtttcacaaccatggaaaacgggagaggaagcaaactccttccaaatcaaacttcacccagctgttcacatgcttgcctagggaccaaaaccccagctacgcacagaacaatgtaaagtgaaaccattcaaagatactgactcttgagacatcctgagactagaaagaaaaaggcagaggagagagaatggaagtagtttgatatgaatttcggacaaacatgaatgaggaaacagaggagtctccctgaagagagggacagaaagcctaaagcccttgtcttgttgggaatgggatttatgttttcagagcaaacgtaagttacatttgccagaagaaagatgctttctagaatcaatatggagaagatcgaagaagaaacctgggacaatctggaaagaaaaagcacttctcggggagaggcagttgcagtgtgagcatgtggtcaggaaggcctgggctcaacctgtatcccagacggaggggcaggaggggagagaggcggacgagatggcaagaggcttggaggaacgattctgttcccggccccatttacttacttacttttggcggctggaaaagatcccaacttcacccagagacgtagtgagacccccatatcacttctcagaacctaattttgctggtgctgactgctgcagggctgccaatctgcttgtgtattctaaactgtgagggtgggaggctctcctgtcccgtgacccccaagatgggaccactgtcacacacgactgcacattaacgagg

SEQ ID NO: 61235 - DNA, 1642 bp, Bovine  19866881450903
tgacttcctttcctcttgagtcttaggctggtcaccaaccgcagggggcgttcctccctgtcagcgggcctggcgggcagggcttagctgatgtcagccccgactaacggaggaaagaactgtgctgctgcttccaacgtgtgacttgccttctcaggttgtatgtaaattggaggttcatgaggggaatcgaggcccagttcctggctcttcagaaggggtttaacgagctcatccctcaacacttattgaagccttttgaccagaaggagctggaggtgggctgtgcggggctggggtgcgaggggctgttgtgtcgggggcggtccctgcctcctggccaggctgcgggcgaggctgcatggtccccacaggcgtgggggtcgctgtggctgcaggagcagggacagggtggggggacaggggtgtcggggagccccgagcagggctgacgaggcctggtgtctatgtggtggcagggagtccagctcatccgtgggacatcagtcagggtattccgaggcttcccctgacttagagacctccagtgtagagcttccccagtgcctcctcctgaggggtcaccttacggttactgagcatgtgaccgtaaccagctgctcccatcctagccagctgctcgattttgattccagctgttatcaggcccaggacggggtgttactgtcctttcttgtccatcttcatgggacgcagtgattcactcacgtcttgtccacctctggcaccaagtagcttgggcctttcaaagtgtccccaaccttctgccctggtatgccggagtgcacgtgatcccctgggggggagtcacactttacaccccacacgtccccaggtgtccccgctgggcaggtgaccctgtgcagcctttctggctcctcagggcacacacacacatgcgctcagctgtagggaaacatcacgtcagcggccgcccccgcaccctgggggtggcagccagcctggaagtgcagacacagacgggggccttgggccggctgtgtgtgtgttgggtatccccttgtctgaacatcgcccggttgactggggcgtggttggtcggtctctccatgacccgggagcctggggcggcccgtcgtgttgtgtgtctgggaagtgacccaccttcatgccccgcagctgatcattggcggcctagacaagatcgacctggacgactggaagtctaacacgcggctgaagcactgtggggccgacagcaacgtggtccggtggttctggcaggcggtagagaccttcgatgaggagcggcgggcccggctgctgcagttcgtgacaggctccacgcgggtccccctccagggcttcaaggcgctgcaaggtgactgcagtggcggccgggccaggccgggtgggggcctgggacgtctcctggcatcgggtctttcatgatggacgccgggcacggcagtgtcgcttgtccagagacctcttctctccccactgctgctcccggggtgaaagaaacgtctgtaaacagtgggagcccgtgtcagccacacaagtcttccacaccacctgctcggggtgtctcagcctgtgggcccacagcggcggatgcggccggcggcctggtgtccccgtaggctagaccaggaat

SEQ ID NO: 61236 - DNA, 939 bp, Bovine  19866881908738
tgctgatgctaaatctggaggttttgtcacttgataaccctggcagaagtaaggttgagaatatgagtaccttaaaacttagtaactggacttcacatgttcttagtgagagcaggcagttttcacgcgaacgttccctgtagcctcgtccttcgcctgaggccctcctggactgagaagtcccctcctgtcctggggcttgggtcctggtgtttgtgtctgtcttttttcccaccgcctctgcacagggggtttcctgactccagaacctgcttttcttgtgatgctaccatccactgcaaacagggggtctgcttgctagaaattcctggttttttttttaaaaaacaaattcctggtgacttaaggattctgctttcagacacctgccctggggcaggctcatgtcctctcagctgtgagaggacagctcggtctttgctcttcctgcacccatgaattttctagaatgtctgatgttagtcactccgtagccattgtgtgcatatcccgagactgcacagagctcctagggttacgtgaaccctgacaccatctgggaggatgggcgtggggccccgggtggtggcagggggcccgggccccacctctgaagcatgttaactagactgttgtctcgtaaggctctacaggcgccgcagggccccggctcttcaccatccacctgatcgacgccaacacggacaacctgcccaaggcccacacctggtaaggaccggcgccccacccggcggtccgtgtgcgggacagcccgcacgtcagggtcagcacgaggctctttcaggagcgcagttaagtcctgagacgtggctgttcttggagctactcccctggctcctgctgcgtgtgtgtgtgtccatgggtgcgtgttaacctgttgcccacacaggtgccgtcaggagggagcactgcaggttt

SEQ ID NO: 61237 - DNA, 763 bp, Bovine  19866881918759
ttgtgacctgagggaaaccagcccaaggaataagccaacaagcggagaagggaagacaggagaacagcagagaaactgggtcagagcctgctcagacggcctgcggcagaaccctgccgtttcataagaggacaaatcttgcttagctcaagcgtgtttgtactggattttccaccatctgcaaaatataccctcaagtgatttactaaggacagtccctaaacctctttaccttcctcatcttttctcctaatggattctactctgcatttcattttcatttctctcttagatacacagctgattatttcacttctaagaaagaaaacccggtgcttatcttgtttaagtaaccactttcatttcaggcctttataatcacgtttatccttaccccagagtctggcaccatcttccattaatgtgtcagcattgagttccctgaaataaagtaccagagcacaattgttgtgttgggctaattaaagatgtgtatcatgggtggaattgtctctttggaaccaagaaattaattatgtttctttggcctggtgaccagatttggaaaacaaaccagtagatacacataatcgtttgctatctacagtcgtcccaataaattatctccggtcctcatttactttctcagattctatgggtacccgaggatgacagtctgatgggatctaagaagactgacttcagatgggaacttctcggaaacactctctttcctcccgggacagggaccagggaggaggag

SEQ ID NO: 61238 - DNA, 865 bp, Bovine  19866880479215
tgacagggccgttccatgctgcagctcagggcccaggcctgccagcctgtgcttggggcccctggtccagccgagtggcctgaggtgagccacctctgccctcacggcctccagcctttcatgtgaggattgagggacagtagccactccccctggggacctgggtgcagaggcctcaagactgagctgccacccctacctgtgccttccctgtacccatcctggcagctcagaggatccctctcaagcctcctgggtcatgggctggcacttctaaaccaaaacacattgtcctggaccagccgtctgtgccagagactgttgtacagaaacatccacaccatgaggctctacctgggtgaaagtagatgcaacctctgtcgtgggaggcagttcactcaaggctggtacagcctacagctgtgagctagttctgatcagaagcgtaaggattcccaggttcatcagattatagaggcaagggtaggactacacgcacaagatacttttgtgtaagaaataaagagcacaagaaaaagggagacagagagaaggagagagacacacacagtgacatggagagacagagacagggaaccttggagacagagatatctgtgttgtctgaaataatctctctacactctctgagggtcacacaagacgcaaccagagggttgtctctggtgaagggctgaacaaggagatgccaaggccagggggttgggacacgcacttacgcagggcgtgccggctaggcaagcagctgtgcaggggctgggcgtggatgtacagggcccggtagaactcctggcaatcccgctcaccgctccgctgcaggtgcccaagaggtcgcagagacgca

SEQ ID NO: 61239 - DNA, 1721 bp, Bovine  19866880538756
cgtctggacacatcccacaattttactgatttcctcctgttgaaacacaaacccatcactgtgcccatgaagcagaggtggggccacctacctggatgctttggacagtgtctttaaatacaggtgagcgctgggtccaggtgctcaccagctccatagcccggtcaaagttcttgacatattcaccatacatcttgaggaacggggccaacttctgcaggatgtctccaagtcgagggttcacatcccttcaccaggaaatgagatcatcacacacatagttccagtgaagggccagggtgggacagggacttcacagggagccatgggacaatggcctgactcccaagtctgtgtgatggtgggcaaactggtcaccctctctaagccttattttcctctcctgtatcacatgggatggaaaatagtgtattgcctagaggatcatgtgaagtacttcaacagtgcagtcacagaaccattgctcaaaaccaggagctgttagtaataatggaaccacctgatgagccacagttatcgaagagaaccaagaaaaccccattatacttctatatgagcaacaattaggaacaataggatgatctaattctggcaatatcgtgggaaagcagcactgtgtaataatgagtggtttggacagggatttagaaataaatttaaaggaaccaaaaatatatgaatatattagactttagaactgtggggggatttatcctaaagaaataatccaaaagaagaaaaaaaggcacaggcaaaaagtcatcctctgcagcattactaggaatgggctttcaaaggcagaggggaagcccctggactcctgcaccattattacacaaggagtgtctgtgtactgacagtcttttcagggccttgaggggcaaagtcatttctagcaggtgtgcgctgcattagccagaaaggcaatccagccctgagctttaacctcatggccttgcacacagtataacctgctctgcaagtggagcgtgtccttctaaatatttacaaattgacctggatgcttgctgagccttgcaggtgcagggacaccccccaatcaagcccctggcccttggcctctgtgttctctctggcctggctctagcttagagagtggactcttggggacaccacaggccttgcagcttgagctgtccctctcctacaaataaatggaagcagcagagggacagagggacagccctctggggacactcacgagagagaaaaacatctcagtttttaaagtagaggtgcagtatatactaggaaggaaaataaacccataagcatggtatattcactggtgtttgcagacgtcaaacctcatttaaattctgcaaagctctggtttggtggttttagttgttaagtcatgtctgactcttgcgaccccatggactgtagcccaccaggtttctctgtccatgggatttcccagacaagaatactggagtgttttgccagttccttctccaggggctctttctgaactatcagtcaaatccacatctcatgcactgcagtctcctgaattgcaggcagatttttcactgactgagccaccagggaagcccaaacaattctatttacagtagcacctgctcaaggtgctcggtcacatctgactcttttgcgaccctgtggactctagcctgccacgctcccctgtccatggaattctcaaggcaagtata

SEQ ID NO: 61240 - DNA, 2569 bp, Bovine  19866880544026
tcttgcctgaaaaatccctggacagaggagcctggtgggctacagtccatggggtcgcaagttggacatgactccggactaaacccccccaccaacaatttgcagatgaagaagctaagacactgagaggccatggggtcagggttggcccaggaccctgcaaaagagagcctaggaccctaggagacaggtttcccaggtagcccctggtttgggggcatgcaaaccccagatttaaaggctgcttggcagggaatatacaacaaaacactgcaacaggatcaccatgaccttcaatctccaaaggcataggaatcaaactcccagggaaatgtcggcccctccactttcccaggcaccctgagttgcacttaccactcattcgtgatccgcgcctgcagctcaggcaggaggaactgcccgtggaagcgatagatggaggagatgttagagaagatgcctgtggtgacttctgaagggatccctgcttctgtcagcccagtgcagaaaacctaggcatggagaaacccttgcagtggtcactaaatgtgggtcactgcaaatggttacaatcatgcttctgctacaaacatgggagctcaggagagggctgccattgccttatgttttcttaatgaaacttctgcttcaacaaactgccttaaagaaccttatggtcttaaagcgagcttactgatggccaagaattaggagtgaggcagcgacagtcccctctagactgagacagaccatctttctcccatctgcctttcatgggaaatggatgatcctgatttcctttctctgctttgtgagctacaaacagaagcagcacctgtcaaaacctggtttctattggagttttacttcctgtgctcataaaccccatgttgccaggtaaagagggagagtgccactcactgtcatagggctttacatgctcagataatttaactgccatgaagaaaaacccccaaggtgactagacaagacctttgccccagagccacaagttgtgaaagcaaaaactaaaaatttctggaggagacttaaatatatccaagttttagtattcgtgtcagtcatattccaactgcaaggcctagccaatgctaagatagaaagcttgcctctgaaactgcccactgaaactctggaagtagacaaaggcaggctccaagccaggagggttacctggtctagcaggtacagccgcttcacataggtctcctccgtgtgcaggagctcctgggcgatgtggagcaacttctgaggctcagagcactgtgaagagaagagctataactcacctagggatggtgagtttgggggaggcagcatatgacactgcataccagggatgaccacaggcccccaaagatcagaggaagctgctggaactgggatgtgaggctcagttctcacagatggaatttccagggaggtttctgggggagacagaataatttttaccaatcccctcaaatcttctgcagccaagagaaaactctatcctcccagggctttgactgcagaacagctacaatagccacatcaaaatatactgtggaatgacatcatcaagatggcaaatcaaagctacaagcccacccaatagacacatgaaaagatgctcaacatcattaattgttacagaaaagcaaatcaaaactataatgagggtatcacctcacactggtcagagtggtcatcagtcattaaaaagtctacaaataagaatattagagagagtgtggagaaaagggaactctcctatactattggtggggatataaattgatgtagccaatatggagatttctcaaaaaactaaaatagagttgccatatgatcttataatcccactcctgggcatatgcccagagaaaactataattaaaaaaggtacatgtaccccagtgtttattgcagcactgtttaaaatagccaagacacagaaacaacctaaatgttcatcaacagataaatgaataaagaagatgtggcgcatatatacaagggaatactgctcaaccatcaaaaagagtgacataatgccatttgcagcaacatgggctagatattatcatactaagtgaagtaagtcggacagagaaaggctatgcgatatcacttatgtgcttagttgctcagtcgtgtccgactctttgcagccttatgacccaccagggccactgtccatgaggattctccaggcaagaacaccgggagtgggttgccatgccctcctccagggatatcgcttatatgtggaatataaaatacgacacaaatgaacttatctatgaaacaaaacagactcacagaattagtgaacagccttgtgattgccaaggagaagagtgaggtgtaggagcgatgaacctggagtttgggattagcaaatgcaaactactatatatagaatggataaacaacaaggttccggtgtgtagggaactatatccaatagcctgtgataaaccataatggaaaacatattaaaaagaatgtgtgtgtgtatatatatacttatatataaatgcataactaatcactttactataca

SEQ ID NO: 61241 - DNA, 1873 bp, Bovine  19866880586806
acgtaattgtaaaggagcttcaaatagccaaacaatcttgaaaaagaaaaacaaagctagaagactaatacttcctgatttcaacaagagtggcataaggacagaccgatagaaaggtcagaattgagacctcacgtataaggccaataaatccaccaacaccaatcaatggagaaatgacagtcttttcacaagtggtgctggaaaaactggatatcacatgtaaaagaatgaagctggacccttatctaacaccaaatataaaaactaactcaaaacagatcaaagaccaaaacataagagctaaaactataaaactcgtagaagaaaacatatcagaaaagcatatgcccttagtttaggtaacaatttcttgaatatgaaagcaaaggcataggcaacaagagtgaaaaaagacaaatcagactttatcaaaatgtaaaacttctgtgcaacactgtcaacagagcaaaaaggcaactaacagaatgggagaaaagatttgcaaatcacatatctgataaagagattaatatctaaaatatacaaagaaccccgaaaacaactaaaaaaatcacaactcatttcaaaaatgggtgaggaatttgaagagacagctctccaaagaagacatacaaatggccaataagcaaacgaacagatgttcaacatcactaacctttggagaaatgcaaatgaaaatcacttgagatactactttgtatccattaggatgactacaatcacaaacaggggtaagaattagtgctggtgaagccaggatgtggagaaaccggagccctcatgcatttgtggctgctgttgttcagttgctaagttatgtccaattctttgcagccctatgagctacagcatgccaggcttccctgtccttcactatctcccaaaatttgcatttatggtctttctttattatccgctctcacatccgttcactgctggggggaatacagaattgtgctatagctatgcaaaacagtctgccatttcctcaaaactttaaacataatttcccccaagatccagcaattccactcctaggaatatacccaagaaaactgaaaaaaagtgactcaaacatgtacatgtacacatacgtttacagcaacattattcacagtagccaaaatgaaaaagccgtatgtccatcaatagatgaatgggtaaacaagatgttcccatacaatggaggattattattcagtcataaaaagaatgcggtgctgataaatgccacagcatgtattaacctcaaaagtattatgttaactaaaagaagacagtcacacaaagccataatttgtgtgactccgcttgcatgaaatgtccagaataagcagatccacagattcggtagttgccaagggttggcaggacaatgggtgactgctaatgggcacaggacttctttttgaggtgatgaaatgttctggaattccatagtggtgatggttgtacaatcttacgaatagactaaaatctgctggattatacactttaaaagggtaaaccttaggatatgtataactatctcaattaagaagaaaaagatgaactacttttgaaataaaaggtaaacagtatctccattttattttactcctctgaaaactctagatgacccagccattcaccccaggctctgtgcagtgagcgcccggaggccagctcctaccttgaggtgctggtgcatgcagtaacgacacaccctgtgcttcagctcgtgtgtaacatcactggaggagggaataaacccgcatttgggctgcaaaacagataaggaagaaaaaacgcttagggagaaaacatataccttcaggcagacatataactacaggatgatgaagtgcaa

SEQ ID NO: 61242 - DNA, 891 bp, Bovine  19866880594973
cagaggatatgctcagtgaggacacggatgtggaccgtgcctccgaccctggggtgagcccgccacacctcagcacctgtggcctgggtgctggggaggtaagtccctgttatgaggtcctgggaggggctgggcctacttataccccagctccaggctctgcaagtacagtgctgtgatgtggcctgctagaggaacctgtatgccatgcagtgtcgggtgaggtggccgggagggtaggcgccttctgtccagttagaaatgtccaagctcttgaggcctcttagaggatttgagacagtgttgtgttctgaaggaagttcttgttccatgcagtcggctgagttctgatccttcacctctttcaggagaatcgccaatcccaagcaaacgccccggtgtaccagcaaaatggtatgtctcccttcacggctgtccctgccaatcagacatgcctttggaggagtcatgtctgccattgtcctttctctgcttccagtaggcatttgataagggcctcccactgagcatattgtatgggttttggccatcacactggggggttgctggagtgtatggtgagcgtgtccccatctggggacagctgccctgtctgaagagccatgtctggtctgggtggggactgagcatgatgtggactcactgccctgctggtcccccagccagcgttaccacttcactgatgtacttccggtgaccttggaaataagcccgtgctggggggacttatgagagcctctaatgccagtgaggagccccctgagcgggctgcacatcctccccactggtgtgagatgaattcctcaaatccccattatcaggtctgatattggcggcgaggggtcacctactcactctcaccagctgctt

SEQ ID NO: 61243 - DNA, 1588 bp, Bovine  19866880596117
ctggcaggcctccagtccctgtggttgtggagctgcctgagccccgtgtctctcttaggagaaaatgcacaagcttttggaggtgtacgagagactgggtggggaggaggacatcgtcaaccctgcgaacgagctgatcaaggagggccacatccagaagctgtcggccaagaatggcaccacccaggaccgccacctcttcctggtgagcccccatccaatcacaccagccctgcccactcctgcccaacccagctgcagagccacaaccctgccgggcctcacccagcccagacgcagagtcctggcccaccgggtcactcagccacaccctcacccagcccagacccaaccagcggcaaagccacgcccagcggctaagccacaccctcagcccaccccctagcatgccctcgccacgcccacattcagcccagccccacctagccctgtccaccaccgccagggccacggccccacctcctccctagggtgctcctctctggggtcagacacccctcatcgcgtgcctgcccgtccctatcgcagttcaacagcatgatcctttactgtgtgcccaaactgcggcttatgggccagaagttcagtgtccgggagaagatggacatttccggcctccaggtgggtgagcccctcccacgcaatctgttcccctgggaaagcacagagcaggtggagggacacagggcactcactgctgtgcgactggtcatgtgcctgcttctctgagccttgcttatgtcctgatccaggcgtgcaggaacatctcttgagtcctggcatcctggactgagtgggcaggatccctgcccctcagcttggcctaccttccagcacgtgtaggcttcatgttggcaggctgaagggccatggcaggaccaagctgtctcctgtacccagcactcagggttccctttacagactctaagggaagcttgaggtgaatacagatggggtgcccatgcttgggcactttgctctttgggcatccttgttctttggtccttggtcctatgctccctccactcctgcaccaatctggaacccggatgaggttctgctgacatctgtaccccaaatccagacggcttgttgttcttgccgtccctcttccttgagtccatcgatgtcttatgctgtgcggctactggagctggaatcagtgccccttctcctgtgggggagtactttgaattaacaggcactccaaaaatgctggctaaatcaaagtacttagttattctgaaaagtaaagatttgctagtgataccaaaaaaaaaaaaaatcccttctgatagtggcctgcctgtgggccacatccagctgagggaatgaggagtgtaggggatgaaggatggctccttgttgcagatgcccctggatccaaggcaccagcccatggggcctcagaaactcctgcagagaagtggggatcctcctggctcttctcagattttcatcctgtgtgtcaggagtgtctggggggtaccttgtggggaaaggcactggcactgacttcctgggaaactccaagaacagacacatttggctggcacagttctaagaa

SEQ ID NO: 61244 - DNA, 1238 bp, Bovine  19866880599759
tgtcagtacctccctggcttccccatggaacagggctccctgagggcaggctgggcccaagagctggtcttgtctccctcacagctgtgcccccctacgaaacctttggcttcaaggtggccgtgatctcctcaatcatcagctgcgccatcatcatgctcatgtccatggccttcctcacctgctgcttcgtgaagtgtttgaagaggagtgagcagcggcgatctgacaggtacagtgacctgtcactgctgcgggcacttgctagtcacggcgggacccctggggtgtcagggagtggggctgctgggatcctggcgtcttgccgttcacagaacatctaggctgtgcagggcgcatggctcacttgtttggtcttttgtaagacaggtgacaggtacacgcgggattttctccttctgcagactgtgcacacccccagcgtgtgctctgctgtgtgtggacgtgcagggctgaccacacgatggttaactagggcctgcaggtggagtctggctcacctctacttttcttcacagaaatttatcctgtttttgtatgtgtgtgtggcgggtgggggcgggtatttttgttttaaacagtggtaaaatatttacaacataataaaagttaccatgcgagccatctttcagtgcacaattcgggggcattagttatattcacagtgttgtgccatcactggcttgattctttgcaagaactttccaccacctgtctttgtaagtagtttttctggcacgtactcatcatccacgactgccttctccctacagcagcagaacggtacagccctaaaatactcactcttggccttgcagaggcttgcggtagtgtcctggacacgctcacacctgactgtctttcccccatctctccccagggcaaaccaactgtggctccagctgagaagcgaggatttggagacggtacaggctccctacctcggccttaagggcctcaacagtgacagcagcatcagtggagtgtccaggatccagcctgtccaagtgcacgacaatcacagcttcaccacgtgggcacgggcagggcaaggagggcggtggggcagtggtaagggcagggggagtgcctggcttggccagcgaacctggacaccaagggcactcacggtctgcgcatgctgtgagtccaggcccaccaaggccccagctcccatctgtaggacaagctgatggtccttctgcagcctgtgcctg

SEQ ID NO: 61245 - DNA, 1253 bp, Bovine  19866880860747
ccccacccctacaacaaggctgggaagtcaagaaggattgagataggaattggtgtttaaaatcttctaagagaactacttcagggaaggactgcctagttttaccactgcaagatttcttggtagcccagtggtccaacctgttcatcccagagtaaaaatatcacaggagagataaggcttcacctgtgacaaaaatccacagacgtgtccctcaactttgggaaagggcctggatgggcatctagggcaggaagtggacagaacactgtatcccagagaagtaaccagcggggtggtcagagagcagagcatggggaaggcctgtgggatagataccccggccagctgtgatcgccacatgcaaggcaagtccccaacttgaccctttcctggtgtcccggcgctcacaaaagacgctgaaaccgctgaaggcagctgcgcccagagacaggagatgatatacatagaaatgatggatacacacgcctggtgtttcccagccggccacctgcatccatcccacgtccaaatccccgctactcaaaaagtgaaacaccgcaaaggacaccacccccaccgtgcccgagacctgccatcaagagcagaaaggctaaccaccaggctccaccgcagcccttgacgcggaggccagggcttctagaacccaaatcgcccacagcacctaaggcccgtcatccactgcagggccgcctccgggacggccaaccacactgaccccgggtgctccagtgctggtctggtcggcgcggagtcagcagtcggctggtggtcgacctaactcgggctaaggggtcagttcggcctgggtcggcggctgcctcgggggtcgccttcttggctcgggtcaagggccgattctggggtcggcgcggaggtcaattcggagggatgagggatccgggtccggagtcggaaacggccgggggacacggagggcgtggcgccagccacccttgttccttacctccttgagctgctccatctcgccgcggatggcctcgtagtccacctcaagctcttcgaactgcagtttgagttggtgcttctcctcgaggactgccagcccgtactcggccgcctggatcttctcacgcgtggtctcggccagctcgtgcgacagccgcttcacctccgcgcgcagccactctggctgcgcctccatcacgagccgcgcgtactcttcttcctcggacggcgcggacatggtggccacggcccgagtcgcacca

SEQ ID NO: 61246 - DNA, 926 bp, Bovine  19866880881132
ccctactgcaagacgttttccctttgctggaaggatattggcagctgctaagcattctgcccaaagtattgttgagtctcctctgaatagtcatgttagaacttagagtgcagaagctggaggactttgcccttagtttgtgtccagctgtaccggcagttttctgaactccctcacacggaggtctggtggttctgggcggtgtgggcacagaagggatgctgcataaagctgccagcagctgggatcctgtcccctgactgttgagatgggtgatggctgcctggcaaagccctgtagcctgaaatcactccactgtgtctaaaactgcatggacccccaaatgcagaccatctcctgaagcaaggtgttgcctggcttaagcaagaccattgtttaaatgactgcagccggccagtggtgctggtgggcggtgtcaccaaccctggcctgtgtgtgctccccagggtcctccaccagcagcctggtcccgggccctgagccgggcccccaacctgccctgcacatccaggcgcaggtgaacaacagcaacaacaagaaaggcaccttcacggacgatctgcacaagctggtggacgagtggacaagcaagacggtcggggccacaccactaaagccgtcactcaaccagttgaagcagacgcagaaattgcatgacatggaggccacagcaggctggcccctggcctctggcgaggcacgggctgtaagtggggcatggtcggggggtgaaggggggtggatttgcccagagtccaggggacggaatgggagtgaagccatgactccagatctcagcggagcagtaggccccaacccggtgttgggcagtgcctaggtgggactggccagcagcttgcaggtatggccttgtcctggggccccaccttcacttcttccatcag

SEQ ID NO: 61247 - DNA, 1614 bp, Bovine  19866880887688
acggaacccagatctctcgcattgcaggcagattcttcaccatctgagccatcagggaaggcctgtccctcagcttcagagccctgctaagggacacttaggtcctctcccctttccctcccctaattcttccctcccttcactcgtttttggttttgttttttttttttttactaggacagtggtgctgtgagtagattccagttctctctagctatcttctcccagagctgccagcatatcagtgccctgaaaggaagccctctaaataagcagagctgttgcgttctgaactgcctttggttgatcaggagcaaagatgaaggaactgaacaggaaagaaagagtccaagtgactgtgcaaatgccaccaggccaactctgatgtgggtggagcctgagcatgcagaggagaccctaatctccctgggctcagccatgttctgcttgaggctgtgcagttgccagaacaatgttggaatcactctgtatccagacacctggacctgaagagtggggcaaggccactcttatttccttactccttcatgtagctctttatttacacaatgacatttttttttcttacagggttaaaaaaaaaaaaagcatcccagacacagcactttcctttcagtgtctatcatcagagctctttgttaaagataagaggttgcttccacttcaggcttgaatgtcactgcagcctatgccagggcctctctgtaattatcctgtcctgtctggaaagctcttaaatgccacttcatctaagggcttgaggccgagattgcttctccagtgcgatgccaaaggctcctcttggctgagatgactaaactgtcaaatatttttagagcaagtcttcttttaaaaaataaataagaaaagtaaagtgagtgatgattaatcagctcctcactgcctccaccttggcatctgacatacaattttcccagggagtccctgtagcctcgcgttggggtgaaggggctcccccactgtcatctggccaggatgtggcctctcaggacctgtgttcaccctcctagctgcctgattgatggtgcaaatgggtgaagttcctcaagtttaggaaaaattttctgcctttgagcaaaacatactttcagtttagagcaatctagaaagctttttgcaaaaacatgttctcggaaagcagaattacattcagagtcctttcttttggaattgcttgaccacatttttcctcagagagatttaggacagctaagtagaaattaaaatttccatacgtaaacagacatggagacagctggctctgactctgtaatgacgtggaagttttgaatcttgaaagagcatggagattttattagcttatttttaaataggttggcttttctcccaattgcaaatataatacatgttcttcatagaaatttagatattactgagaagcgttgagaagaggaaacccagaagctcaccacctgaaagtggcaagatttatgtgggcctggaaagatttccctcttcctttcctgggtcttgtctactgataagtggaatattcatcagaatttgtcattggggcctgaaagctgacaaagttgccccccctatccaaag

SEQ ID NO: 61248 - DNA, 1283 bp, Bovine  19866880939855
catgcccctaccttggtatgaatctaagggcagaggcggcaccatctcaaaggctggccctcctcctaccatccaccactgaaggactcctggagggcttaccagtgcagcctcattcttttacattcctcagacaccccaggggagccacaccaccctcctcacctcctggctctagaagcagcactggaggctttcacagcacctctcagcagcaagtcctccgacattcactcttcatggtctttcacaaaaaagtagagtggttaacattaacaaatgcagtaagacagcaaacacggcattgtcccttcacacagggccttagccccccggcccctctgcacagaagaaacagtgtcttcattaaagtcccccagagtcctaagtgctgcactgacctgagtcgccagtttaaagtagaatgggtgaaaacactgtttccatcaaatgaaagcctcagggaaggggctgaggtggagtgtgagaagtgcaaagggttgagtcaagaccctctagcaagacatactcatctttaatttttttccctcaaatagagggtgattgttttcagactgttcactccagtcagaataggcaacaggaggctgcccagcctacctccttgaggggctggggtttcagagctccacacacaagagattcaggatcccctgcataccctggtgctgggcaagaccatcctcaccccaggccagcaacaaggaacaacctcaggccaaaacaactctggcagctacctacttccatacactctggagcctgcaacttgaccatgagaacagggctccatgcacacccctatgtgtggaatctccaaagccctgtacccagcatcccacatgaatgagaggcatgtgttatttgagtatctttttgaacctctgagtgaagaagtaagaagtaaatggtaggacaggactgaagaataaattctagaagagctggcttgattcaaataagcataattctcaatttatcacaaaattccccacaaaaattataatcagcaaaatattctcattttttgtatagtattttcatacaatctcatggtttcactattatattacaataagccttcattagtccctcaaaatgatgatataaataatctatacaacctaccatagaataaaaaactgaagccaagattcccaacagttttcatagcagctgggcacgccttttgtgaccccaacaagaaccctcttggtgccagccaggcgtcgctcgtcatgcagaagcagggctgtgggcag

SEQ ID NO: 61249 - DNA, 1122 bp, Bovine  19866881151115
tttgtgacacctgagacattagcctctgtttagagaggcagaacatcgtctacactgaacatccggagtgtgaatgctcagggccaatagcatgacccagaagtcaccaccagagatttggagaaaggaaacaatgagatacctgggaggcttcctgagggagactcaggtggccatgctggacagggagtcacagagttgaagcaggggagtgacccttctccagtaatcactgacctccactagacaagcaacatcctttgtagcccctacctcaaggtggggaaagtgcactccaggcagatgacccatggatttacaatttctcctttttccccaataccatttccctttaacaaatatgcaccttgatctccacacacagaatcggccggcgctctgcaaactggtaggtctgcagtctggctaggttggggaggcacagggcatagccactgagcgtgtccaggtccttgtcacagcgagattctggagaacagagagaggaagataactgagggtcagcgagagcagcaagacaactccatggcagcctgggctcctgctgggggcaggaccaactcagcctctgctttggggaggtcacctctaaagcttgggttatcctgcctgaggagtctctgtaaggacctagagtcacacaaggataacactgtgattcctggtaggagtttggaccttgtagtaccagctccacctctggaggggctggaggttgagggcagccacacaggtggccagctgtgtctacatgccctgctgctgctgctgctaagtcgcttcagtcgtgtccgactctgtgcgatcccatagacggcagcccaccaggctccccaggccctgggattctccaggcaagaacactgggagtggttgccatttccttctccaatgcatgaaagtgaaaagtgaaagtgaagtcgctcagtcgtgtccaactcttcacgaccccatggactgtggcctaccaggctcctccgtccatgggattttccaggcaacagtactagagtgaggtgtcattgccttctccagtctacatgaccaagccccagcaaaaaccttgacccctcttctctcagctggttttaatctgtgtcc

SEQ ID NO: 61250 - DNA, 1405 bp, Bovine  19866881212263
tgcttttttgaattttaaaaatggttttatgattttgagtccttgaaagttatggaactttttatttgggtttggcattgaattttttaactgaaagtgttttcctaagttaatcataagttgcaggtctttgtattcattttgatgctttttgtgttcccaaacttcatattcagtttcatgtattttgagttttatccctgtcagtcattcatgacccccaagtatttcctgccccagagtccttttgtcatttccctttacaagttttgtgctcacctttcctctccttagatctcctacaagtgttgttctcctgtatagctcttcaggttctattttgatctctctataccacttccccagttgtggcaagtgggcagaggagaccttcccctggacacaactgcccacgccaccatcaccaccccactgccccagcccagctctgcccattagccacaggccaggcaggtgctggtttctcttgaactcctccctgtgtgcgtccagttaaaatgtctccttgaaaacttcttgcttgcttctggctcttctcaaaatctgagtcctagctcttgtgcatgtctctttctcatttaaacagtctttagtgcttatacctctgcctttggatttactttttagtcaccttcctttcccagcagtatctttccctgaggcagctgtataccacggcactctagcaggtcacctcaggaacgttttgttttcaatttacttagaattttactaaaagttatctctatatgtttacatcttactgtctgccacccaaagtcactgagtaatcctttttacaaatgtctttagggacaagatgtggcgtttgacccctggggaggagggagtctggttctgggagagtagcatgtcagggtccccaggaatgtggaggtggacagaagagccgtcatgtctcatcgtgcaggccacacatccccagcattctccaagtcatggcaaatgacacggcttgcagtgggccctcagaatgaagccaggacttgaaggatctcttctctcttggtttcccggaaggggctctgtgggtagcacctgctgaccagtgtccagccaagcagtgattttcatctccactccgcatggcccctctctgggtttcacatcatggagccagcttccagagagaagagcagcatgatttcaggccttttgaagttttatggtatatctaacatactgtgcaactttactagagtgaggttggtgatcggactttctggaatcttttttgaaagaaagttgaatataaattgtgcatgaagagaaagatgggcttcatttattttaagagttctaccttttaaggcattgcaagaggggcagcatgggcactataggacattctaaagaaggaatt

SEQ ID NO: 61251 - DNA, 506 bp, Bovine  19866881299500
tgcctggaatgccacagggtaagccgggtgtggcagccccttttggccagctcaacggccctccaggtgggcactaattgtcaatgccaaacactaaagtcactgcccatctgtcttagcacaggtagccgctgggagtacagggtctgggagctcttagtgatggtgtggtaaggaggcctctcaccctgccccatggacagggaatacccaatgaggcagccatgttactgagaatgagggtcagcttccctccagcctctgtagacagggctcctcatatttccacctccacgctcaccactggcctgttcagggcagcccaagatctgggattggcctcaaatctgcaaaacaatgtatctttttgcacttggaaaactgcccatgagccttatgccaggcagggccaggctgtgctccattgagagctctcctggctgacttttagtgggcatcctgcctcaaccagcaggactccccaaaaccttacatttaaagccaag

SEQ ID NO: 61252 - DNA, 2473 bp, Bovine  19866881686247
tctgtaatctttggttgatttccagagcccttgttaagttattgtttccagtttctagttgtgtgtttagtgtttctgtaggtaaacaaaggtttgttcttcctaggctgtcatcttgctgacattcctgctctacccttttaaagtcagtcctccaggcctagacaggcatcagcttcctttctgacaccatagacatcatttcatttgttctataattccgtttaaatggaataatcctatattacacagtatgtctaatatgtgattttttcccttcagtttaatgtatttgagatatatacatgtcactccttgtagttcattccctttgccctatagtattccagtttatgggtatatcacaattttttcccccatttacctgttgaaggattaatattgtttctagtttttgggtttttttaattaaggtgcaatgagtatttgagtataaatcttgataagggaatatattttcattaaaaaaaaatgcctaggaatagaaccattgaatcatacgatatgtgtcagtttacctttaatgaaatagacagaccattttccaatgttataccaatttacatccccactgatgtctcagagctccagctgctccacagttccaacatttgtcattgtaggtccttttaggtttttggttttttaaaaataattttgtagacttttagtgggtatatgaagtagtgtatgattgtgaaattttagtttgcatttctggggattaataacattcagtctctttttatgcatttttcacagtggccagtctaatatcttcccacaggcaatggatgatggatgtgtttatccatccatttatttcagcaaatgtttactgggcactatatgccatgtgctattttccagagattgagtatggactaacttgagaagtaagtccagatggcacagctttggaaattgggggtcatacttttgtgagttttacctccaggagccccagcaggttctcagcgtgaaaatatgagaactggcaggaggaggtaccattttgacatacactagagcattcttctctctgtaacaaaacctgccctcaaactatttcaccagattcaaacctcagtgggtttcactggagcctaaactgcccggaaaagtgaaatacccagctctaccctccttcagctaaaaaagcacaaaacatagcttgaagagaaagtgagcattaaaactacactcagatatagcagggatgttggaattatcagaccagaaatttaaaataactaggattcacatgttaagtgatttaatggacaaaatggacaacatgccagaacagatgggtaatgtaacatagaaatagaaactctaagagaaaatacagaaagaaatgctacaaaaattgttgcagaagtgaagaatgactttgatgggtttattagtagcctggacacagctaagaaaagaatcagtgagctggatgatacgtcaatgcaaacttcctaagctgaataggcaaagagaaaaaagactaggaaaagaaaaggacaggatattcaagaactatgggaaactcataaatggtgtaatgtacatataatggaaatagcataaggaagagagggaaaggaacagaaaaaacaattgaagcaatgatgatggaatttctcaagattaatgtcagacagcaaaccatagatccagaagcttcagagattatcaagaagaaaaatgcccaaacaagtacacctatggatatgatattaaaatgaggaaatccaaaggcagagatggttgaaagcagctggggtgggttgaggggtacattgcttatagagaagcaaggataagaattatgtagactttagatatcttacaagcaagagaagaatggaatgaaatattgactccatccaccattatttacaggtattgctggctctttggtaatcatattatttgttcattattttgctctctctatttttcacacacatgcacagagtttttttttttttttttggcttcagttggatattaatttcttgagagaagaaatagaatgtcaatgtaattgtctcaagtacctcctatgacactttccaaacagagcaagctaattaattctgcttcacaagaggcaggtagattgcatctttctctgtgtctgcatgtccttcctgagtgtagacacaatcagacatttatttatttgtgatcataacagaggtgacaataataatgaacacaggcaacttttatttgtgtagtgatttgcactttgctctttctcctcctgagacgttcttttccaacctctttgtacatctggtaggtcttctgtatcttctaggccccattcaaatgctgcttcttttgtcaatatttcctagttttccttggtcccctttatcttaataatctccaatctccccaccctggctggggattgtagtcatagtgacctgggaacatttttttt

SEQ ID NO: 61253 - DNA, 755 bp, Bovine  19866881909941
cttccaggggcccggcgtgtcctgggcttctcccctgtcatcattgacaggcacgtcagccgcttcctgctggcctttctcacagatgacctggggggcctctgaccgaccccaagccctgcctgcccgcgtgttgctctccaggggcttgcttctttcctaagtgtttatttcttgctatttataatttctgtaataagcactttactttcattgtacagagatgttcaacaatattaaatgtttgagtctcatcccttctctcaggagtgttttctagatgattccaattcaagacacgacagcgtctctaactaaggttgatcctgtgggttcttcacttcctgagtccaacccaagacccaggtcctgcccaggctgccttcccagactcctctgagcctgggtctcacccctctgtgtggacttcccaaccccaaatgtccccggctgtcccccagtgccctcttccagatgtaaccctgccgcatgtcctgcccctcccctggggcctccttccactgcttctgtccagaactccctgccttgagccctgcttgccatcccccacctggagcactgttgctccccacacctgccccccatctgctctctgtcccagtcctcagccccaggcccggagggtggacaggcaggccctctggactgctctggtaccctcccttggctcacagggccgccagggccaaaggcggagcaccgagccctcttggatgtgcacagggacgtttctg

SEQ ID NO: 61254 - DNA, 776 bp, Bovine  19866881268556
aaaagtaatatatcatccaagggctaaccattctagaacaagtttcttaactcaagttcttcccaaaccaaaaataataaggtccaagtaaaaacatacaatcggatactttaagactcattagccaccaattcttttcaggagatgacattaatagaaatgtaacttaaagttcaattaaattaattctcatatatattataactcccttaattttctttcctatggaaaattgagctaagctagaaacaaattttacgtaaaaacagaaagaattttcacataagacttagctctaaaccttcaatatacatcttgggttttcatcttatttttttttttaagttgaatgttcatctgatattgaggacatacttattttctacagaaagcccaggctttcaaataatcaaacaccgagaaatgtgattaaatcacagcagaaagtagtaacagcaaggtaatataatgaggtcacaactcgagcagccaatcaaaagcataaaagcatttcctgcaatattaatagtcaaaagagaaaaccaatcacagaaaccttgggccttcttttgacagtcacagaagcaagagaaccaatccacacacactcggagttgacaataaggcgggaccacaggttcattgaagaaattcttgagggtgcagttactatgaacttcgcacgcaagtaacaccactccaagagtcaccaacactgtcaagccaggtgaaattcaaccgtatccaaaatgtagaccatcggggggaaagcattt

SEQ ID NO: 61255 - DNA, 1324 bp, Bovine  19866881913326
ttgcctgtagcaattgtttgttttaattgtgtgaattgtgtagatacaccataatatatctatccactctcctgttgaggacatgtggattttctctttttcttggctataataaataaagctgctataaatatttgtgttatgggtctttttctgggcatttattttttatttctctttgataaacaccttgaagtaaaatttctgggatagaatgttagatatttgtttaaattttattacagacagctttccagagttaatgtgcaattttacacttctatcagcaatataagaaagttctagtttctctacaaccttaccagcgtttgctgtcatttcatttaagttattctagtgagtatgaaatggtttggcttttatttccatttccctagtgtctaatggttgagcatcattagtgtctattggccattcatactacttcccttgtgaaatgtttgcttaactgcctgtttgaaaagttcttttttgtcttttcattatttgcagacattttccttatatatgttctgaatataagtatcatatatatatatatatgtgttgagaatttctgcagtctgtggcttgccttttcatttcataatggtgtatttttgagaacggaaaatttttaaatcgaagtatagtggattgaattgggggcttcccaggtggcgctagtggtaaagaatatgcctgccaatgcaggagatgcaagagatggagtttgatccctgggatgggaagatccccttcagtaggaaatggcaataccattccagaattcttgcctggagaattccatggacagaggagcctgtcaggcttagtgtgttaagctttctataacaaaaaacacttttgtgctatgatgatctgatagtagctaataatcactctgcccagagagaattctctacacattctccctgcacactcattgtaccaggtacgcacagtcaaagtgagtggttttacaggtattggtttggaacttttggttaaaatgcaaaccacaataatagtttagtttcctacattgggggaaaaaaaaacataggttaagctaaaattcctttcctcagtaggatcatgaaaataaaccttcaaaattcatcctgaaaggctatttagtggataatgaaaaattaagaagagaagaggatatacttttaacaagtagcaacttacctgatatgccattcttgctggtgttcaataaagctacagatgctacagaaactcttctattgttcacagtctgccctggttttcttgaggtacattcttcactatcactgtcctgtaaatttagtag

SEQ ID NO: 61256 - DNA, 1607 bp, Bovine  19866880395168
ctcccctcggccttcccatcccccatcctcctttagcctgtctccaccgtcctgcgtgagtcaggagtcttagggttagcaatacgtgataagccaggtgaaactgagacatcaataatgagggccctatggttcctactgttggaaacttaaaagttcttctattaatttctagaaatgtggcactgattttatctgattatactataaatgtatgttaaaaaaaaaaaaaggaagacaaaagacaggaaaaaaaaactcacctaccattcgaagatagcctctgttaacattttggtggatgttcttcaatacattttttttctgtatatacttattacttaatgttttaacattgactagactttcctttttacgataagcagaaaaagaatttgaccagttaacatctcagggagctgattaaatttttttcacataaaattaagaaatatttatcttatagtgtatttttaagtgtttataatcttagctgtccttttctcacattattttcttaaaagccaagatgcatctgaaaagtctcaggattgtgatgtgcagtttaaagcaaagcgtgacttcctcatgagcggtttgccagatttgttgaaacgacaaattgcaaagaaagctgctgtgttagatgtgtacaatgcagtgagctccagtttccagagagtcgttcatgttcagcaaaaagaccatggtgagtttattattacgagatatttttaaacgttaaaagcagcaatatgaaactatgtaagtgggttttaggtgagacaaaggttcaggtataattcttatgtgaatttaaagtagctttttatcctctctcttcctgggaaatcccatcaacagaggagcctggtgggctacagtccatggagtcacgaagagtcggacacgactgagcaactaaaccagcactaccgcatcctctctgctgcagccttgggctgagaaagggggtggggcaggaaagctgaagcccttagccctgatgccaggggagggcaggcacgtgtgtagagctgaagtgaatgctgtccagagaggcgctgtgttcttgaaacctgagcctgtctgtgcacagatcatcttgtaagagtttctgagaggaactccatccctgtctgtccagtctgcagctcactgtttaagagaaatctgtctgcctccttgctgtaacagcttgttctgtttggtaccacacaagtatcttgtgaaccatctggagtggtaacagggagccgtgctccactgttctagctctctctaccttcacatgtaccgcactctagagcaagatgtttacacaagccataggatggtgttaacttgatcttggtctaattctctgtggattcacgtgttctggtaaccacagtcttactttacctatttagtttttataagtactgatgatatacaaagccttctatctttgctttgttgttgttcctgaaaagtgttagtcacttcagtcgtgtctgactgtttgtgatcccatggactctgtccatggaattcagaggcaagaatactggaatgggtagccattccttctgcagatcttcccagcccagggatcaccggggtct

SEQ ID NO: 61257 - DNA, 832 bp, Bovine  19866880433266
ctcccaagtacgggaataatgagtgacctctagggtccctgctggtggatgaacactctgtgctcctggcggctacgagcattcggcactggctgcctctggtcctcgagcggttttgtacattttgctctctgggacagtgtccatttggactcacagcagaggggtagaatgtgccacaggtccaaggccaccgatgagatcatgccctgcacaaaggcaggaagggaggcaaaatccagcccattccccttctcaaggcttgtgccacaccagggttcccttagccagaagcagattgtctatttctacctggtctgtccagggggtgaatctttttgcaatttatactaagagtctgtacaccctgtggtcctgcaaggacctgaaacgagtgagcttctcggccaagaagaccataaaaccccaccagccgatgtgttgctatttcagaagcagaggaacccacaccttggtctctggggccagagcgagggcggctgaccttgttcctaatactcaggcactttgttttctagaatgcatcagaatcagccctcaagagataatgaaaataaccttacctgggggtgagatggttttcccatcggccataaattcctgtctctcatacttagctcgaatccactgttcttttaagaccctaaaaagagagaaacttgagtcagctgtgtctgatgcatcctcttttcatggcaattttatgagaccctgtagctgaggatgggagcttctcagcaaggcctggctgcctgcccagcctggtcaagtttctccatctgcatactattaacacttgggaccaagtaat

SEQ ID NO: 61258 - DNA, 1624 bp, Bovine  19866880540168
cttctgttgttaagccggggtccccaacccccaggtacagactggtacccattgctcacatgaccgcctgagttccccacccccaccctatcccctgtccacagaaaagttgtcttccacgaaaccagtcccagatgccccaaaggttggggaccgctggtttaagctgtccagtctgtggtcatttgttacagcagccacaggaaactaataagtttgaagatccagaaaaagtgcccagcgtgatccctggcatggctaagtgctttagaaaagttagccactgttatcatgcctgtgcatgctcagtcacttcaatcgtgcctgactctttatgaccctatgtactataagcggccaggctcctctgtccatgaaattttccaggcaagagtactggagtgggttaccatttccttctccaggggatctttctgacccagggattaaacctaggtctcccgcaatgcaggcagccgctttaccgtctgagccaccagggaagcccttctcactactaacccacataaaatactgtacatttataaaatgagttttgatttacactcttccttgattatcttcagtttcccttctatattaccttctggattactctgctacttgactccactggcatggaaaatcaaaacctgatgaaaattatgtaatgatgggaggagaagcccacttacctatagctagggtcaccatgatgaatgggatatgtatccataggaacattttccattgaaatatcagtaagaagcagagactttctatgttttaggctacagcgacttcgaacttcctcagacactgtaagtaaagctaaaaggaacaagaaggaagatttaacaatttaataaatcataaatacgacttaaaataggatatacttcttacaagctcctaaagagaataacagctgctaaacacgcatgtaaagagtcttggagagtatgaagtttaagggtataaacccttaggacagatttgtttatcttaaagggtttgccatctgttttggaaggctgcatgtaaacactgaacagagacttaaacagtatctatagagtctagcgctttaatgtatatttgacctcaacaaacataaaaggtcagcaggccaggactataatgtccatttcttaggtgaagaaaaatactttgaaatgttaaatgatttgctcaaggtcaaatgactcaaaaaagttgctacaaactgaagtctgctaaactgggaatcagcactttccatcaaatgactatgtttatactcaataccccataatgacctatatgggaacagaatcctaaaaagagtgaatatatatatatatatatgtatgtgattcactttgctgtacagtggaaactaatacaacactgtaaatcaactatactccaatttaaaaaaaagactgttcaaaaactgtgttacatataagtgctaagtgttgatgagaagagaaacacaaattgggcaacagcaagcgaggatggtataatggaaggaggggagggcagacagtctaggcaaaacaaatggcatcaggaatgaatattaaagagacataaaggcacttctagtaaaggcaagcagactagacttaaaatagcc

SEQ ID NO: 61259 - DNA, 2972 bp, Bovine  19866880559371
agctggcctctgtggtcccagtcccataaacagaccagttcccatgtggtaactctctgctttgctggagcatactcaggaaaagattataaaatatctcaacacaacgaatgaggtaaaaaaactatcaccattttacaaaatattttatatttcactagcatctatcaatctttaacttttggtaaacattatatcctatttcagggattttgagatttggggcatttaataaatactacatgtcttttctcaagttatctttttatttacaggttttttcccattgtccaattttcagaagagcttattcaaattattacctgaatttctctaaactccccagcttacatatgtgccaaaaatgaatgtatttatttatggtaagggtaatttagatttcagttgttatgttttagagatccagcctaaacacacagcacttttatcctcattgatgcctttataaatcagcattataagctaacaactgatatgacccataatctcttgatcagaagttgctaccttaaaaaaaaaaaaaaaaaaagttgctaccctttgtgctggcttttaggacaatttcctaaatgaaggaggccattccatacttgactcttcttcatctgactgactttatttctgagttctgagaaaacattcatactggattcttactggttacaatttgtactacttcaaatataatcatccaatttcttaagtacagattccagcctgtactgagataaatgttccctggttgtcctttgtcaacagtctcctcgttgctacagttccctggttggagtgtcataagcttactttaagaaacattttgtgacctggggacccatctgtcatctggagatactgttttcattttaattacaatttataatcttaaacaaactgaaagcctattaccactaatgatttgctactatgttgccatgttaagattaatcaaaacctacaattacagtaaaaaaaaaaataaattttacaaaggaaaacatagctcaagccatatgcaaagtgcttagttaagtaaatggattggtaagcagcgcggcacagtggtatttggaggctgatccctaaaccgtttttttaagtctttattgaattttttacaatattgcctctgttttatgttttggttctttggcagcaagatacaagggatcttagctttcccactggggatcgaacccaactcccctgcattggagggtgaagtctaaacctctggactgccaggaagtcccatgatccctaaaagttttatggactatatatgacctgaagttttcttcccaactttcttactttttcagaacatgtttttgaggcttaagaaagcacttgttaaaccacattttcttaaacacacgtacacacgcaacttccaagtaaaatctctggaatggttcaggaatgttgcccattacaaacagaaatttgtttttaacatgaaaactaacagatacttggctctgtccaggtttgttttacccaaaaagtactgaatgcaaatcgtatatgtaaatctgagatctattgccaacttttaaaaataggcttttaaagggttcttttaaaaaatcaagtgttaaaaaagtgagaccacttttgctaaagttaatatatacctatacacacagaaaaaaatttgtaaaaaaaaaaattccaaatattaatgccaaatagctctggggtttatgagcctggaggacatggtcttttttacacctttctgtagcacctaaacttttatagtgattctatattgctcttataatcaggaggaaaaaaaatcaataatccattttttattttcaaaaatgataaaggaggggaaatggctaatgaaggtgagagttgcccacaggcctgggagctggaaggaaccagaaggactaattgggaaacggcacgggctgacccagacagtcatggctcctcaaacagtctctgaggagaagagccaggcacacaagcaaccttggagtcacatggctccagaaagagccagacatgtgcctcagggaccagcggtcctaggaggagggccctgccctacatacaaagatcacttggatccagtccttggagaagaatccagtgtagaagagccaaagaaaagcatggtgacatcagtgaagaacaaaccactagtataattcgcaacatctcctagaaattagagggaaaaaacaatgagacagtgtcattgccctccacctgagaaaagaacaaagaattttagaaggctggtgagggtgtgtggagactaacagtcactcacggctggtgggaattattatatgactatgtgctcctgaaaagcaactgtaccaatcgttgaaagatactcacatccttttgtaattccctttctagaaatctaccctaagacacacgtaaaatgctttattgacagagatagtcattgcagtatgatttataattttttaaaaaggaaataacctgaatactgtcccacaatagttagaatggtgattttcaatataactttcaatgggcattatggagccattaaaaacaaggtttatggagcctttataataaacacataggggaatggtttatgttgccatgttaaatgatacagtaggatataatactgtatatagaatactattttaactacataaaagttcacataaaccaggaagaaatgctctaaaactttacacagttccctgtagattggttgggttatgaatgggtttatcttttaaaaaatattttgaaataatttcaggcttacagaaaatctgtaagaaaaataaaagctgtcatattccttttactcaggtttccagtgtcaccatttttctacacttgcttcactgcctgcatgtgtgcacacaatcttttttttttttttttttagccacaccgcacagcttgggggatcttagtcccccaaccaggaactgaac

SEQ ID NO: 61260 - DNA, 814 bp, Bovine  19866880659160
tttgccttcttagcatgagggagtgctcaaaatgtgttcagaccctgagaacagagtatagtatgggaatacatgctttgaggcctacccctgcttttattggtttacctgttttatttgattggcttccatggattttcattataaattcttttttttttttttttggttgcacagcatgaaggatcttagttacctgaccaggaactgaacccgtgccccctacagtggaagcgtggagtcctaaccactggactgctaagggaaatcctaatgatttattttagaaaaagttctatggctgaaaaacttgaaaagtgccaagttacggtctttccaagcccccttccagctcagagaggccgattaagcaggattagtgggatggctggatacagagaatggtagaatatctgtggatcttgatattagagcaagaacattaaaaacctgtgtggagttccgaattggtcatgtttgccttaaggcttgatggcaaaggtgaggagaagtcactccactgactgtaggcatcctgagtacccgattcctctcttttagggtaaagaccccaaagctgtcatcagcatcaaggacttgaatgccaccttccagacagagaagattgggaacccccacgggctgcagatcacctaccggagagatggccgcgttcggaacctgtttgtgtaccacgagaatgggaaggtgagagggtggcgttgccgctcagcctccagctcagcagccccgaacctcgcaggcccagctccctactccctggcgctgcagcctcttagacacgatgctgctg

SEQ ID NO: 61261 - DNA, 2778 bp, Bovine  19866880930143
ctttcctgtaacttcttttttttccctccgtctctggattaagaatggagttacaaacttgaatggtgattttatactggaacaagggcacattcattaaactctccaaattctgaaatggtccaaacttttttctgtgttctacaatattgaaggacttttttccacgaagcaatttgaaagcttcaagttctttattagatgctgtattcaacacatgcaagatggaagcctgctgttctgaagaaaagagcttgtcaagtgtctttccagactcctttgcagtctcatcagaaaaatcaatatggggaatgattttctttggtgcagtggattctttccgacagcaggaattatgtagggcctggaataaggatgacgctaatggaagtggaaaacatctccatctccctaaaagaaaattttagcaaaatttaagttagacatagttccttttagtgttgtggcctaacgagggcctttgcaaagtgatacggactttcccataatttaagaactatccataagagatataggctgatttttgtgggtaacagacttaaattttactacatacaaatcttatgtccaacaagaagcatgtatttaaaacgattatttccaactttttaacgttttttaaaattttaaccttagagaaatctttttgcaattaactgatattttaaacaatatttatcttcactagtttctttctcatccagtggaatcaaataaaactaaattttagagaattccctgacgctggagtggttggcgctgtcactgccagaggccaggcggggaactaagatcccgaaagccgcacagagcggataaaataaaactaaaatttacccgtttacaagaaatattttagctgagtgataaatttaagagcggtttttattttctttcgtacgcttttcacgatttctaccataagtctacaaagaagaaaacccatacaaagagcaactctgtaaaaccaagggaacgttttacattgcggccacaggacaataacgcatccagaagtaagcaaggcagctgtcagacaccgaaccctctgccctctgccctcagcccagtccgaggagtcgctcgtggacccttaacccagggaaaggaatcccaatagttccgaggctcggcgatcagaaccgccccctcttctcggcagggtctccaagagggagaccaggacacgggacctgagagggtaaatacgccaggcgctaaaagcatacggcagattcatccagtattccaggcaccctacctccagccaagaggagactagggacggtcatcctccacgctaaagcactaggttcccacggttcagtcttcccccacggaattccggtttctgcgtgcttcgcccaaaagcgcccggcctgtcaaaggttccggcggaagcggcgttccggcccgccactaggggcttccagctgggctgtgggcagtcgtttcgtagagcctcgatgcagactccgccggcgtagtagtgccaggatccgcagctccgagctgcgccgtaggttcgttcctctgcatccggaaaacggccttgcccactgtggcccctgaaagcagcagagccgaatctctgggaagagaacgcctgggccggttttagcttgtagttggcaagatccctcctttggggagcctccctgggtttggatccaggcatctagattggtgaactcctatctgggaccctgtctggggcgcaaggaggagagtctggcgggggaacgtaggcaggaacacacataaccaataccccaggtagaatggactaactgggacaggtgcgaggtggtgtttcaggagcccagcaagctgaagacaagctccaggaagggagccttaggaggaagtggctttagcgctgggcctcaaaagtatcccctgtggaagggatggatgcagatcaggctggcaccaaaaatggttggtcctgttccaccagctaactggaaaccacctggacttttgtagagtcagacttgaggtgtgtttctgaaaaactgaccatacgttgaagtatgaggctggattagaggtaacaaagtgtatctggaagctagtgtatcctgaaggcataagcaaccgtcaggaattgaaccggggcagttgtgtgatcgggtaaggctggatggctgttccttgctctttgtacactcactgctagaacagtccccgcttcacctacaccaccctcacatgactgatcatccctcctagtcatagaacctaacgagtaaatgccaatgtacttgcccccagccccagctagtgattttcctaatctatagctcaaaacatctctactaggatagtttatcaaaggggtgttgaggggcatcccccttccctggtttctgggcaacctggggtcatttccctcacatccagtgaagacaggctgtcttgtcctgcctgccaccatgcagtgcctctccagaacccttttgcttcagacgtgtaagattccttatccgcgaaaccactgatatctctgttgccgattctgggctctttcacgaaagatgggcatggtatggcatgtgtcctcagttgtgtctgactctttgcagcctcatggactgtttgcaatccaccaggctcctctgtcgggattttccaggaaagaatactgaagtgggttgccatgccctcctccaggggatcttccccacccaggggtcaaccccacgcctcttgcatctcctgcactggcaggcagattctttaccactagagcca

SEQ ID NO: 61262 - DNA, 6484 bp, Bovine  19866880931034
actccatttcttctgagggattcctgcccgcagtagtagatataatggtcatctgagttaaattcaccccattccagtccattttagtttgctgattcctagaatgtcgacattcactcttgccatctcttgtagatagggagttaattgatgaacatgaagctaatgtatcaagagggttgatttagggagcactgttaggtaatttgatatgatattcaaattttataaattcataataaaatatgtgacactagaatttaaaaaaaaaaattgtatctttaaagtctttacttgttccttttgtcttttatagaagagaccaagcaagttttgagactcagcttgacagagttctcattaccgaaattttacctgctatttggcattagcaaagtcaagtcagctgctgtcattgccttccgctccagctaccgggacaggtcattctctcctggctcctatgagagggagacttttgctttgacatccttggagacagtcacagaggctttgttggagatcatggaggtatagaaggcaaaatgataagaagctaaactcatttttaaaaatccactggtactgtatagaagaaatactgttttattctgttttgcacttaatgcttaaataaaaacattcccatagactgtgtttagaattttctagaaatatttatgtacataaatatatttagagtatcttttttttaggcatgtatgagagatattccaacatgcaagtggctggaccaatggacagaactagcacaaaggtatgtcccacatttaagttgcaaaagtatgtgtactgttgaaaagatagatattactgcataattgatattctaagtaattattctatgtatttatatgtatgtatataaacacaaaggttttcataagctctttgaattttttaattgtagatttgcattccagtataacccgtccctgcaaccgagagctcttgttgtctttggctgtattagcaaacgagtatctcatgggcagataaagcagattatccgtatcctcagcaaggtacttccccctctcttcccaaatatttgtggttcccaagttgtaaattatatcttgaatttttctaagggacatttaaatttgaatttaataaagtatcttatatgttgtttattgaacctttaaaaatgggttttgattattataattctttgaagtaaagcctctctagagaagatatcttaaaaaaattaagtatttcttttggcagaaggtactcttactgttttattataagcattttactagatggtaagacgagccttacctttctaaggtggctcagtggtaaagaatctacctgcaatgcaggagaggcgggtttgatccctggatggggcagattgcctcgagaaggatatggcaactcactccagtattcttgtctgggaaatcccgtggactgaggagcctagtgggctacagtccatggggttgcaacgagtcggacacgacttagcgactgaacaacaaccacaaagactagccttgtataaaattatgtaatttgtaactgctataacaatgcctgacttcctatattagcatataatatagaaatacttcttaaaaagattccaaatgtgcttactagctaccaagatcaccacagcattggaaataatcctcgcacttattaaataaagaattgttctgaaataattctgaaattcagtttaggagtaaatgttttgtttcaatgaaagtaacataaaaattctgtttctctaaaaggctcttgagagttgcttaaaaggacctgatacttacaacagtcaagttctgatagaagctacagtaatagcactaaccaaattacaaccacttcttaataaggtaattactgtgtagaaaatgagtgcatttattttgggtgttagtgttaaatgttattttctttcaaagagttcagaaaataagatggatagagaaattataaagaaaaagctatagttaaagtagaacgtcttaccttaaaattcagttgttttatttacattagaggaagagtaaggatggagaatatgttcttaagtgcttaggtattgtcttatcagtgcttaaaggaaagatggatatatatgcttaattctttcatccagttgagcatctgctatgtgccaagtactgttttaggtgctagagatataatactgaacaaagccaataaaattatctgccttcagggaactttaattctggaatgaatgtgaaagttgaggagtggctagataataaagtgattaaaatacatgatacgttagttggtgatcattgttgtggagaaatgtaaagctggggtaaagcacacctgataatcaaaggagtttgggtgctaagtgaagataatgtttaaaggaaataagataatagcagccactgttttaggatggtctgagctcatctcagctttgtgacctcaggcaggtcatctgtataacatctggacattatgtttctacattaataaattgactaagtaatggcatagtattatcttccaactctaaagttgtattctgtgaattgagtacaaagatacgccaaattgagagagattacatagaaataaagacctgtatgttcttggtcttgagctatatgttctacaaacattataaaatggccaaattggggttcttttgctattccaaaattgatatttttgtgtgcacagttagaaaaagacgctgtgcaatgctaactgtaaggtcaaactgaatggaatgcgtctggcccagatggtttttaaaaaagtcttccagctcttctgcctcctgcttctcacctttccccagcaaaggaggataaaaaaaattcagaagtgattatagctcccttaaggagaaacctattacagggagaaattaatcatcctcgatgcttacctatacaccctggatccgaacagaatttaggggtttagctaaggaatttcccaatcccagctaggatccgttgggatttgttaaggaattttaattgaccatctggacctaagagcccaggttttcagatctgtatcaactaatgcagatgttagtttctgaaaacagaacaagggaatgactagagaaagcaaggtgaaaataccacttaaaggactgtgaatcacatagtccagaagcttgcaccaaatacaaggaattagctcagaaattactcaaacccatctcagagctttctccaaaaaccataaatggacaaagattcaacagtgcaagcaaagatcagatgaatcaatccaaactattaaggaagattggggggaaaaggttttaagcaatattctggcttgacatttgagtcattctaacaactaaaatgatccttttgcttaactccacctttaaagaaggcttagatgaggatttagctacttttgtcaaagacagtctaggttggtctgagtgacacacaaaacactcttgttacacgggctgaccaacttttcaaaacccttaaaaaaaaagaaaagggggtatctgtgaaaattatgaaacttcaattgcaccactttattaccccaatgccagtagaaaattaactgacccccaaccaatttaattcccaaaacagtagagaaagcttgaaggaaaaaaaaaaatctctctttagaattcttgtcctgagggcagaaactcctactaggagaacctgattttctctccctgtgccttgagacccagagctctctggatcacttatctagactgtctcttaattgctgaaactgagttgggggggaggaaagaagccttttaaatttttttattccaacttattcacattttgttttatattgtcatatttgattcatgactaagtttagaaaatgaaggtatatctctgactgtgtctgtttggatatatgtacgtctcagtatgtttctttggataatattgctgcggttaatttgtaaaatgagctctaacctaaccagcctaaagaaaaataagcacttgcaaatcaagcagttctaaatacaagagaaattaacctaagtgaatttcaggttcacatgaattaagaaatattcagtattaagtacctggtattaatatttgttgatctaattaatatagacatgcttaaaatattaagcataatattttcattgtgcctaggtttaatatgttaaataaagtgttgttatatctgttgcaaatttgtaagcaaggaaagtaactcaactaaagaaacttttaaggaaagaaagcgtaaatgagataggaacttttagataaactctattaaggggctaccccaatggctcagctgtaaagaagcacctgccagtgcaggagatacaggttcggtccctgggtcgggaaaattccctggagtagaaaatggcagcccactccagtattcttgtctggaaaataccatggacagagaagcctggtgggctacagtccacgggatcagagagtcagacacgactgagcgcacacgcatgatttcttgtataccacagtgtgttctgatgagacggtggtgtatcttactaacctggagtgcgtctcccctgcctaggactcccctctgcacaaagccctcttttgggttgctgtagccgtgctacagctcgatgaggtcaacttgtattcagcaggcactgcacttctggaacaaaacctgcacaccttagacagtctcaggatattcaacgacaaggtaaacaagctttcggttggtgtttctaaattatgcatgttagagtgtctcctttttttgttgttgttttcttttaaaattagaagagatccatctttaaatatgaatttccgtgtaactggttgtgaatatattccttactagctcataaaatggtttaaactttgcatacttttttatataaaaatagcaaaaacacagtacttgcccaatattggtaaacagaataaggataaaaatattgagtaataataatagctaccttgctaggctctatgctgtcttatgcactgtacattcattaattgtaatttcataatccaagggtaaaggttagcattccccacccttacttcacttcatgaagaaataatctaaaaataagctcacttttattgaattatggtacttaatgagaaataggtataattagaagcagataaggagtttggaggtgtctaaaggaaacttttggatatttaattatgctagtcttttgtttgcttaatcccactttaaaacatattaataccatcaccacccctcttaaaaccttttagttttgattgagattgggttttggtttgcagagtatagtaaaagaaatacaatagtaagaaattatattcattttgtctttggaggaaaaaaagagaagcgtctaggagaaaagagaggaattttaagatagataggtgtatataataagagatttgcttaaagcaaaattaacagaccttgtgagaagaaagaaacagaccagagcctggttttatgtgtgaagatgcctggtctaagcattgtttgttttgtcttccaaatagtagtgtagtgtagacccacaatagctggggctctgggaaatgtggaagcagaattttagatgtagaagttaccttgaagtttaatcatccattttataggatagaaaagaacaaagaagtcaggtaacttgttcatgtttgtgcatctgatttggaactagaatctctctttcctaattccattgctcttttctggagtggtcttaggacagtggtggtcagagagatggctagcttttggccttttgtatgaatataggatatttgtgagtgaagtgtttgtctaggaatatctgccttggcattttcattgccaaaatagacccattagcagaagttaatattgactccaaatgcctcaggatactaggaatccattaataaagcttgttaaaagttaccagaatgaaagatgaataaggtctgaggatctattatttaacctaatgactatagttgataacactgtattataattgaaatttgctaagagaggagaacttaaatgttctcccccaaaagaggggatgggatataaatatgtgaagtgatagtttattaacttaatgggagaaatgtatatgtgaaaggatatacattcattcttcaaatcatcacattgtacactttaaataccttacaattttgtcagttatacctcagtaaagctgaaaatatatatatacattgaacttatagtaagttagtactttaatatttatgtaatattctgcaacttgcttttttttaacaatatgaacatctttctaaagcatatatatatatacacacacaaaatttcatgtgtgtgtgtgtataattcttgctcatgactgcagagtattttacagaatgcatgagccacaacgtatttaaccttgcccattaatggacatttggttgtgtctgttatctttttttattatagaaaa

SEQ ID NO: 61263 - DNA, 1880 bp, Bovine  19866880934887
ccaatgagctctgggaggggagggaccatgcctttgtctcggtagactggcaaggggcctttcttgaattgctgatgcggaaaggactatagggaatgtgagaccttagcgtgtctcaaggcctggaggaggtggtgagctgatgggtctgggggtgcagtccctgcagaggtgtcctggagagcaggttggaaagggaggtcttcaaactgtgcttcctgatgatatttcaggccgattcctgggcttttccctgagaagacttaggggtattttttttccttttggtaccagcattaacatgcaagagcatgcttctcactgaccacaggccctttgcatctgaccttgagctagagaatcttggaatgaattagctgaaagcagaatgcctcccatttcccaggagctcgtctcatctcctgggatcgcagagacacatcaagcttgctccatgatctctgtgactctgaaagggggcacgtctacgggagtgcaaggagaagaggcctggatgcaggaggcttagggtcctgccctgattctccactgaccaagtgagtggctttgagctggtctctgcctttctgggggcccagtttcctttttgggtatggatgacctgccagctctgacaatctaactcttgtccccttgggactccttatcctggctaccagaatacggggccccgaggctgtgggtggaggcggccctcttacttgggagctcctgaacatctgtctcccaggatggtgaagaggctggaagtgctaataatagctggcatttactgaatgtagacattgtgcaaggggaccttgcatgcatcctctcactgaagtgccacacaagccctgtgaataatagagctcctggccgtctggacatgtaaaggcaaggtgttatttgtagtatcatgagttgaatatcgccccacgtcttgctaggtcagatgactttacagcgatggaggaataaaggtctggctttagtaaaggaaataaaggaataagaagcaaggtggtcagaaggaggatgagttcaaatggagggaggagccctgagaaagtggggatagaaaggtggtgtgggtggagctggcgtcggggtggggctggaggggagttctgaaattgctatgtctctggggtcagggcatggtacccagggttcctcccactctgggcccccagtgaaatgaccaagggccatgagcaccagttcaggtttgagttgcccggggctttgctggggaaaccactagattctgaaatcagcctttaggactgattttgggtctagcttgtgggtgagctataattatgtccattatacctgtcttgaatgattcacagatggcaggagcttacgtaggagcaatgttcctcttaattttttttttaaacttaaattttccgatgactcactggagttgagaatacagtctcattgatgggagagaagaaaaagtggggagacagaaaaaaggaaaatgtcatcgggtctactggagacaaatgaaattgtccaaaccatgtccaggtgattctgtcctataggttcaaacctatcacccactctcccatctgttgactctcccctttctagaagcggcagagagccctggagtcccaggaaggcagtggaggtacagctgatgctgggaaggttgtgttttgaaccagaagcatctggcttcaaatctctgctcttgccttaatgcttgctgtgtgaccctgagtcacttttttaatctctctgagcctctgtttgtctctcctgcaaattgggaaaagaacagctttgcagattgctgggaggatgacatgaggttatatatgttaagaacttacatatagtaacgttagtcactcagt

SEQ ID NO: 61264 - DNA, 2057 bp, Bovine  19866880950402
ttacaagggaaattttttaaactagagattggagaaataggacaacattaaaatcactaaggaggagcagacagacattgtatgcctcttgttgtcacactgagaaggaaacaataacatttatgcagtcttccagccaggaattcttaacccatgtgtaaccatggagaaacagtagacaacgctcaaatgaggaacattctattaaaggggaagactgcattttcccaccatgtcaatgtcataaaagacaaggcttggaggtgggagggagggtcaagagggcggggacattaatgatacctatggctgcttcatgttgttgtatggcagaaacacacacaatattgtaaagcaattatccttcaattaaaaattaattaattaaaaaagaatttttaaagataaaaaaagaccaaggctactattccagattaaaggagactaaagagaaatgacagtttaatacaatacatcgtttctaacctggattctggactacaggggaaaatactacatcaaggacattattgagacaatcaacaaagtggatggtaaatgagataccatattgcatcgatgtgaaatttagtgaaatggataacttgactgcatggaggcaggaaacactaagtatttaagggtaaaggagggctttcctggtggttcagaggtaaagaatccacctgcaatgcaggaaacttgggttccatgccctgggttgggaagatgcccctggagaaggaaatggcaacccactccagtattcttgcctggagaatcccatggacagagaagcctggtgggctacagtccacggggtcacaaagagtcctgcacgactgagcgaccttacttactttaaatcttatagtcataagacgttatggtggttagcttttaaggggaacagttttgatgagaagaattttcaatgtaatgttaggtttttaaaattgccttttttggcagtttataaatataaacatttctacaaatacttattgttacatgaaacaataatgtaaatgtataagaatatatgtttatgtcaaggagcaaaatacttcaatacatatttttttctctagattctggaattgaagacatgctttggacggaaaagtatcaacctcagaactccagtgaactcataggcaatgaactagctataaaaaagttacataggttggtaaaatttataaaggaattgagaaatagtttatgaatctagttttactatttatttatactgaaatctagaaattatgggcttctctggtggctcaagtggtaaagaatctgcctacaatggaggagactcgggtttgatccctgggtcagggaagatcccctggagaaagggagtggctacccactccagtattcttccctggagaattccatggacagaggagcctgacaggctacagtccatggagttgcaaagagtcacttttcatatttcacaaatgcttgtgataagtttgcttgtgacaagtttttttgtaacaatatccatcacatcacacttttacacttcttttcttcatgaaacattcacagtatactcccttagcaaatttcaagtgtatgacagattattgtttactatagtcaacattctggcatattagattcctaacacatttatcttataactgaaatctcatatctgtttagcaacatctcatcatatcccccactctccatcctctagtcttactcccagtttctgtggtctggttgtttttttttttttaatatttcatatataagtgagatcatataccatttatctttctctgatttattttacttagtgtaatcacctcaaggtacatccatctatgtttccacagatagcagagtttccttctttctcatggatgaataatacccttttaaaatatatatcacatttcttgattcacttttgagtgggcactaagattgttctcatgtcttgcctatagtgaataatgctacaacaatcacaggtgtgcaaatctcattgagatttttatttcatatccttcagatgcatacctaaaggt

SEQ ID NO: 61265 - DNA, 1442 bp, Bovine  19866880958693
gtgagtagtaagtacccaaagaaaatccatccttactattttatttcatcccttttaggactaaaagattcataaggagctccaggcaggtcaggatttggagatgcaaatgccttacctcttctaaatagacagatgataggtatgatcctttcatcaattggcaatattcggtttgctgccaatccagcactgccaatttacgatcgaggtgagcccaggcaattcttcgagtaccagaaacaatggatacaatactattaactgcctgaaacaaaaaagcctggtttaattataagtgtgaacattttaaaagacaagatttaagatacaaactcagaaatccaaattagtttatgtgatagaaataatatttagtttatgaactaagaattattaaagagtagttattattaaaaggtaaccagcagtagtcagtttatagacagaacttttacttgttctcagcacctagctcaacgcaggtgttcagatattcacatgttgctggggaatgtgctagatactgggaaacgagggacatgaccctacattataagaaacaccaccatacaagttacactgtagagaggagaaatggtcaggaagacttgctggaggactaggagactgagtaaaatggtaaacaggaagttatttcacccagatgtctgcagatataggctgacacctctcagacagtgtcctaaagaatgcaagtggtgaaagggcagagggatgggcagatttctgcagaaagtaacttcctttatcctgagagctactgggagtcaccaaagcatacacattcaggtgtaacagatgtacatttcagaaaggacagggacagctgtgagaaaagtgggtgggagatggctagactagggagaaagatctgtattaggtacctgttacactacaaagttttaagaatcttagtcacagtgagaagcacaaacagattaaaagcaataggagtataattgatatgtggaataaaggaggaaacgaaaacagccaggtaactcaacattcctacataagtcctgcacagacctacttctctacatcaactatcctatcttcctaaaatgcctttctcttcctactagcatagctctctctccaggatccaggctgagttctagtaaacattccccaacacacagttctctccactaaattgccaatttactacctgtacatttcatgtctttgagaataactataaatagattgtctatgtgtgtatccctgggtccacaggagtaaactataattgccagaagaaccctgtcttggtgcccagaatagtactctgcaaagtaggttgtcaaatatttaggcagtaaaagagatgttaagaaaaagagtgtaccttaactctctctcttcctatttctgggtttgatgagctttctcaagagccgactttcctgtaa

SEQ ID NO: 61266 - DNA, 2035 bp, Bovine  19866880987158
atatatattttaaagaaaggatgctgagagatggccaatttatttatgaacctggctaatatcctacaggatagtaaaaccaaacctttctccttctgctcagctttaaaaagacaggatgtaagtggtcactctctcaagtctgctcaaactctaactcagtgaatctaagttctaaaagcaggcgtaaacttgagcattaaaacctgagtaggcaggaggtggaggcttccctggtggctcagatggtaaagaatctgcctgcaaagtgggagacccaggtttgatccttgggtcaggaagatcccctggagaagggaatagctacccacttcagtattcttgcctggagaattccatggacacaggagcctggagggctacagcccatggagtcgcaaagagtcagacaccactgagtgacggagcatgcgtacatgcaggcagaagatggagttgatgtcctggaaggcggacttacaagcctggcttagcccagcctttctagggtagggatggttggggcagaagacgggggacagacggtccagggcagaccagggaacgaacagcagaggtcatcaacatcgcctcttctttcgccccagctgcctttgggttaatcagaatttagtttcttctcaaagatatgactcaaggatctttttattcttaaagaaattctcgggcttgggataagtaaattattctttcctttggaaggaggaaggtgttgaaacagaaagcacacacacgcactggggccgtatataagcagagaggatcaaacaaggcccctccctgagctaggaagcagccgcccccctctccttaccagtgtgagctcggtgccgccacccacaccttcaccagcaccgctgagtcacagcgctgtttgtcaggaaaagtatttttagaatttaaaagtaccgttgttgccagtggttttagaaatgcttgcttcagaagggatggaattaagcaatggcggacttggaccttcgagcctgacacacccccagtttagaagagaagctcagggcagatacataaaaactgtgcgggcaagactgaagtctggggacttccttggtggtccagtggctcagactccatgctcccaacgccaggggccttggtttgatccctggtgggggaactagatccccatgctgcaaataagacctggcacggccaaataaataaatattaaaaaaagaaaaaagatgagttgggcaaagctccctctaattatgagccagtttgggctcaggctgaagacctgattcccagcaaaccccagtctgttttgccctccagggaccccttaagtataactctgtaaagaacttcttgcctgtgaggtgaagagggcaggagaggggctgagattaaaaaggaaaattggatgctgatcttaccatagacatcaacgttcactctgtgaatcaaagctttaaatataaaaaccaaacacataaaaaaaataaaacagaagagtgtcacagccttgggcaggaaagctaagtattacaccaaaggcagaagccacaacggaaaagattaatgacttggctataaaaatcttttaaatttgctgtcataaacaaagttaaaaataaatgacaagctgaaaaaatacttgtgatgtatgtctaaaagttaatatttctagttcttttaaagcactggaaatgaatacatccacagaagcaagggtgaagaatgtgggctgccagttaatgaagaaaagaactcctggtgactgataaaggcaatataagaagttcaaccatattatgattcaaaagagcaatcctaattttagcctctcaaatgagaaagatctgagaaagcagaacagccagtatccaagggtaggaggaatctgacacaattctgaagaacgattaattgacacaacttttctggaaaggaatttgacagatgtatgagaaattctaagaactgcatcatttggatcaaacagtttccacctatcagaatttattttaaagattggtgaacgggctcc

SEQ ID NO: 61267 - DNA, 1208 bp, Bovine  19866881011661
tcctcatactagccattagatctctggggatcctgtatttccttttttttggaattgactagaaaaatctgtaagatttctttctagtttaaatatttgatgaccttaatacttttaacagcatcctccctgtgccacaatggtctgtggggagctgaccccacttaatttacctaacattttctcgttttgtctcagtgtgcacctatgtcgcaggcaagctggctcagtctcttctgtgtatgtcaagcttattgctgcttgtctgcctctgtttataccagcccctgcctaaatgctttaattcctcttttatctttttctaattcctgtccacacttaaatgggtagctcgagcttcatttttcccatgaagtctttatagactaaactcactgcgtcctcacttcttcatgtgcttgtcacctcaggttctacagaaacaccctttaaggtgtctccccttggaagggttgattgaacatagcttagcattattttcttttctcttctcttttttatcaaatggagtgtaaactttctgaaaagcaagaactctctgtgagaattctactaatagtcaccccagggcccagcagagttataagcacacactgagtcattgatggaatgtttttcatatgattcttggttcaaaggtagactggctaacaggagtggtaatttggctttattttaaatgcaaataactgaattttattaataatttagtgtttatggtggcctccatcttataagtgatactttaactgggaataagtttttaacaaaagaaagctttaaggaggaacttgtacctatttatatttcctccaacagagctagcatttttgaatcaagtttcagatctgattgactacctttgtgatcttgaatttgtcacttacttttagtgtcaagtctgcataaggaaaattttttgcagtgatctgataggataaattaaaagacacttgctccttgaaagaaaagctatgaccaacctagacagcatattagaaagcagagacattactttgctgacaaaggtccgtctagtaaaagctatggttattccagtagtcatgtatgaatatgagagttggaccataaagaaagctgagtgctgaagaattgatgcttttgaactgtggtgttggagaagactcttgagagtccctgaactgcaaggagatcaaaacagtcca

SEQ ID NO: 61268 - DNA, 1645 bp, Bovine  19866881011989
acttatattgtagttgaaatattaatagatggacaatagtccagtcagcaaagcgctaagtaaggtcactgcagacagtaatagattctcaaacaagtagaggtagtgttagtggtggctcctaatttggttagtagtgagagactcttgctatttcttggatatgctaccttcattcccacatcaaggctttttctacttgctgttccccctctggaaacgtctcctgcactttcccaggtggcttccttcagctcatttttggtctcaactcaaaagtcagtgcctccagaagggcccctctgagtaccctaacctacccttatttatgcctttcattgtttgtgacctgactctgcccactagaagtataagttctcctgaggacaggttctttgatttgtgggctgttgtttttcagctatggtttggtcaggaaaatagacactactctatggattccacttttgaagggttttaatccgtggaattggagactcacaattattggaagggtgatgggagttaagatggggtggggagccacaggtggggagaggaaaagtggatggttttcaagagcgctccaagaggccactgtgaattttgagaaatactggaattggttgccaatgatttcagtctgttgcaacaaggaaagtagttttcaagagtctgcccagaagctgctgtgaatcttaaagaacttccaggaagccactgctggctagcacacttgcctgcaagtaggctttcttggtggctcagatggtaaagaatctgcctgcaatgcaggagacctgggttcaatccctgggtcaggaagatccactggataagggaatggcaacctactccagtatttttacttggagaattccatgcacagaggagcctgatgggctaaagtccctgggtcccagagaattggaaaggactgagtgactaacatctggaagttgctacaagcttcccatccaccactttgaatctgtctcattgacagcctcgaacccagaaacatacaggggaggagattctgggaaatatggttcttgtctttccctttgtagagcagactacagaaggagatggcaattatgccaagttgaaaacatacgatccaacatgccgttgtatcgccaatatctagaacagctcttgacgtatagcaagtgctttggtggtagttaaatgactgcaagaatcattcctggtccttggtggtgtcaaaatttgaaccctcaactatctgactccaaagcccatgcaatttcattccaataccagctgaacaagctatgaccttgaccctggagctcaggctggaactgctgactaataagtcccagacagggtctgtgccccatgtatgcccacagtgctgtgcatattagggacaggagcagtgagggaggttggagagcccagggaggttttgagggggataggctgagaaacagatctctaaccctctgtgatcagtgctcagaaacttctggaggtggtggcattgtagagtgcactgggttgagggggaaatactggggctgctctggggtgggcatccctgacagccaaggagatagctcagcccttgagagcctgagcattggccaggagtaaccttcctaggacttcccca

SEQ ID NO: 61269 - DNA, 1770 bp, Bovine  19866881045214
cactgtcatctcgagggctctgaggttagcttgcttaggagcccgactcccataggtgtgtggatggtgggggtgggggaaatgggaggagccacagggcagacgtggagggagggtcagagcagaggtgtgtgaaccaccagagactgggcgcttctgagatactttcctggaagctgctggtggggagtgcagtagaccggtgtggagagggactgctctccgtctgcacttactggccgactgaccctggaaagtaatttcacctgtaaaatgtgggcaataataatacctctgacctagagtcattgtgagagtgtatggagaaactcttagcacggggtcttggcactgaaaattttcttatcaactgagagctgcaatcattatcatcatggcctgttctctaaggcaggctttttcaaactgtaggaggtaacctgtaagtggatcatgaagtaaattgaatagcttgcaagcagccatttttttttttttaaacatagaacagaatggattaacatcaagtaattggagtgcataagaatggttttataacacattttataaacgtatatatatttcctcccatgaggcaaggctgaatgtttgaaagccacgcttccaaggcaatgcttctctaaagatggttggaaggagcgttttttaaattagtaatttgcaagcaactgtcatcactttttggcttccctggtggctcagatagtaaagaatccgcctgcaatgcaggagacccaggttcgatccttgggtagggaagatccctggagaaggaaatggcaacccactccagtattcttgcctggagaattccacggacagaggagcctggtgggttacagtccatggatccaaaacaactggacccgactgagccactaacacactcatcacttttgccagagcagaataccacttgtgcgtgtgtgctcactgtcctatttgctaaatactggtctttgagttagcttatttgaacctcatcatgataacaatattcatgaaatttattttttaaaatatctattacttttttttttattaacctaaaaccatctcacatatatatgtacaccaggctttggggacatggtggtaaaaggagcatcttctgaaagcattttctgaaagctgggagccaccagaactgtgagacacagatgagtccagcgctctcagggtcccattctgtccttggaggcaggcctggccctactgcccagtttctgaattcttgtggttgatcttcccacaatgggcacctaaggaagcaaagagcaggccctgtctgcttgtggactgattcaggacctttcctgggacgtaaccccctagtggaggaggccagggccctgctgtatcttatcttttcttttgtgagccatgtcctgacgctgcacaagtttgcagaatttcctttcttgtccagctttgattccattgatgggattaggcgccccccacagccatgtcctttgatgtggtcagggggtagcagggagatttcaagctctgggagcaaatcttaatcttctgcgggtttctctgggatcagcgctggggtaaacccattacatccctgccctttcatccccccaggacactggctcctccagacttctcgagtctcagagatccaaagggtctgtcagatttagagagagcaataaaagaggaagagaaagcagagcacgaacctcagacccccgccagcacccgcagcatcaccagcaatgtcagggcatcttc

SEQ ID NO: 61270 - DNA, 1227 bp, Bovine  19866881085951
cattttaaggcacttgaaaaatctgactaaccccataccttaaaatctcacattttataaagtgatttctctatatttcagtgccgagtctaaaggaaaacaatgtgtatatttacaaagtgaatgaatattagaaagaaatccctcaactgacactgcagcaaatttctggtgcatgcacttgctattgaatatatattcaatcctaacgttgactttctcttaaaaaaagaaaaaaattctgaagtcgatttttttactgatttaaataacagcttaccatagtgtcgtcttcaacatcagcatctcattttctccgggaaacttaagcttaaaggtcgccttgttctggaaagtaggaaccgcttctggctgtgggctgtgcttgcctgctcagctgcattgtgttgctgtgagctgaagctctgcaaccacctgatcagtaccacataggaggactgcagagctgtcattggtgcggactcaaatttattgcaggaggtgcacacgcgacagaatgaaccccgaaaaaatcttttttttaatttacagcattgagtgtacccatatagctcagatttgccataggaaggaaaacctcgtggactttagacctggccctactcatttctgtgtatttgtctgagctttggctttacattttaacatttacctcgtggagaattcgtggttctttataatgctcctacttttcatgctttttatacattgaaaaatgctgaaaatgaacttgaccttccttgtggatggttttctaagatattagtttaactgtttttgaactctgccttctcaattttttttttcctaaaatggtacaattgtcatgtcacttttaaaaataacatctaattttttatgtgctcccccagtgtggtgattattatgtacaaatcaccttttcaatttatcagccacttaactgttcatcttttggggaagtacaaaagtacttaaatatgattattttattttatctttttgatacaaaggattattttacccaggctatacaaatgagggaggctgtgtttttaaatgaacgtctcatttttctaaattatcagttcatgtggtaacgtaaatgtgttttattttatgtcttttggattaaggattttttttcttcatgaagttactttgatgagtgaatatgaatattattttctccagagacatctttggtaatatatgaataactattta

SEQ ID NO: 61271 - DNA, 777 bp, Bovine  19866881184074
gagtgctcgaggacagcaagaaaaatgagggactttcaggggcagctgtgttttctgactcagtcataatgcccctaaaaatccttattgttcttgcagtgtgcatcaggcggcggccccagcccagcccttgcccacctggcctctctgggatggggagaactacctggggttcagctggcgtgccctcccacgttttcctgaaatgagactgtagggggatttgctgatgagttaatgttttgttggttgatgcattgattggcatgtacttttataatttcttttttggtggaggatggggtaggctgggcactgagacactcgcgcacagattggagcccaggagaatgcaaggtctccctggtttgtgcgcagtgaggggtccctagaacttagctgcacattacagcctgaggaaggggagcttcaagggcaggtgtacccagggctaggtcatgtcctactcttgatgaccccatggactgtagcctgcccagttcctttgtccatggagtttttcaggcaggaatactggagtgggttgccatttccttctccaggggatcatcccgacccagggattgaacctgcgtctcccacattggcaggcagattctttaccactgagccacctgggaagccccatttaggggcactgtgttttaaaacgggaggagcctcagtgtgcaccgctgagctggccgttttgcaaatctgcctgcagtggaccgaggtcttcccgcagctgttgcccctagagcctgctttctcttg

SEQ ID NO: 61272 - DNA, 1604 bp, Bovine  19866881238096
tattctatgagttttattttccatatctattttatactgcttactaaagactcagataatgtgtgacataaatatgtagtgatgagtatatgcccacacattttaccatagcagtttttttcttagctttaaatattagtgataatattttcatgtcatcatcattactaaaattctatttgtgtaaaaaagcatatttaataataatcattgagtgtctcatctaatcacctttgtttatttttaaatgaaggtgaccattctctctatgaaaactgaaggggattaaaaaataaaaataatttaaacctatggattgtgttatatataggaaattttcatataaagaaaataaaattttttaacagttggtattttggggttgtagatttagccatcactcatgaattctagttttatttccaacccttagctttatctgccatgggtgtagttttatttcttttaattacagaactgaggtcaacaaacataatgattgaataaactttaaagggtttatattacataaacctaggtgaaaatttttctgaaggcaagctcaacactgaatttttaaaattccatgcaacaaaaccacaatacctgttatatagatacctttagacaatcagactttaagtttaaaacaataataacattttagttttaaaaattggagcgggaaatggcagcccactccagtattcttgcctggaaaatcctatggacagaggagcctgactggctacagtccatggggtcacgaggagtcagacaaaagtaaattttatataaaacaaagatcaaaccagattgcctgtgtgaaattgtcttaccttggctgttaacttcttttgcagaaggctaaattcttgttctaactggacattttggtgctttggctaagaaagcaaaaagtggttccgaacgttcagattaaaaatgatcctctagcacattgaaataggttctgtagagaaagaggaagtttatcaatagttggttccggaagtgcaataagccacaaaatgactaagaaagtactactttaacagagcttaatttgaaacacaatttggagctacatgatttgagtgcttttaattaacatttgtaagtaaacatttgagactctctagtaatgtgattcagtcagttcggttgctcagtcgtgtctgactctctgagaccccatggactgcaaacacacagtaatgtgattatatagtttaaatacttaaaatagaaccttggagagaaagttatataaggaaaaactgccaggcaggttactacccatagtgagatttcttttcataacaaatgaatgatgtgtcctgtttacttgtgtgaccgtaggcaagtcgttgtacttctggatcaccgtttcctcctctggaggaatacttctgttactaggttttgagaggattcaataagataaaatatataaatgccttacacacagtcggtagccagaaatgttatttcctcttacataatttaggctaaacccaggtaaaagtatgattaattttttccaaatagtttcctaaagatttttaagttcaagtccacaactcttaatacccacaaagtag

SEQ ID NO: 61273 - DNA, 1232 bp, Bovine  19866881245310
ataagtgctagatcatataatttgtttcctctgctgaccaaggttttgttgttgaccaaggcttaacagatcatagatgaatacagctgtttaatataatgatttataatatgtatgaaccgggcactagatttgccaagttctttagaaccttcaaaactatgtatgtctaaatattcaggcaaaaccaggattataaactggaaattctagttatggatcttgaacaatacaaagtagttataatatattccttggctttttaaaagaaaatccacttaatacttaactacatctaataacttttccttatagcatgaagtgtttcataagtaaacttttcagatgatggaaatttaaacacaaaaccttttaaattttaaccactttagaaagatatctttctgagtataaacaagaccacaatggaagactcccttcattattactgtcactataatacacacaatggtgtcagttgagtaacccctccagggttgaccagagtcataaggaatcatctgctttgacaatgaatgagcccaaggttctgtacagttgctgtttctgccatcttgcttatcttagccccactcgagctattagctatttctcaatgtatccacctgttagttgcatgctgaattggtatactttccacacttggacctaagagtgacttcagagtaaggaatatgcttatgggctttaagatgttatgtttttggtgtggcttttttgtctgggtgcttgtttactcctagattttcaggttgttgctggcagtagggaatagggacgctactatactttgcagattttttggattgagtaggctgtgtcagagacacagaaacactagggcaagattagtatatctagtaagggaattataattctgttcacttacagggattacctgtccctgaggctacttttcctgcctcaactcctaaaaatgtttcaaccttggaatactttatgtaaacactctataaacatgtcagtatttttgttgaactctttgaaagtagaaagttttacagaaaccaaaattcaaatcagctacaaggtaaagaagaaatgtaagatgaatttcataataaaaaggagcaaaatctgctgtaaactgataacaagggaattcctaatgttgctatagtaatattattgctcaaatttatataaagagtacatttactgacctggggaatgcgggaagtgcaagtgag

SEQ ID NO: 61274 - DNA, 1204 bp, Bovine  19866881350705
aaataattttcatttcattcttacttctgtgttctactttctctctctccttgctgttcctttttctacagaagccaggcatgagggtgatattattcctataaattcttcagatggattacataataatctagactggagacttaaaaaaagaaagacaactgcctggtaaatggacacaagtctttgcaactgtttagagccaaagcccaggccactccttagctcctgccactcaggagctgactggcctcattctcggggttcccaaagatagtcatggttgcacatgcttagagctgcatggtccaacttccccaggtgatcagaatcacctgggatgcttataaaaatgcagattcctgggccctatgccagatctgaatcagattctcctggagggagacctgcatatttacaaatacacagtatacatttaacaagtagccacaggcacttcttaacatcaggaaaatatgaccagcactgttatagatggagaaaacttgagtaattttcaaacttggctgcaaattaagagtctcctggggacctttaaaagcccccaatgctcggttaaatcagaagcgtcatcaccttgaatcatgtgcaggagtcatggggaagacctctgactatgtgcatgtgggccaagactgcagggttctaacactggctttgccacgaacccattgagcagcatctctagtcctgagcttcacacatgcaaaatgagggacatggactagcccacagagaaaacacttcctgtcacatgtatcagtctgactgattggaggtggctgcttgcaatattgaggaggattccagggttcagactgggctaaacagaaaacagtggctcagttagtgatgtctgccacaggtgcagattagagggcgatggcttgtgtgtcaagaatttgctatctctggactagatcatctataaggttccctctgagcctcaacgacataataataatgccaatagcaccacactgattgtgaagaataactgagatagtctatgcaaatatcttgtagcctataaagtgctatacagatgttagtcattatgataatagttattattttagttctaggatgctattcctttgacactttttaaggcagagtaatgaacaacaagtggcctgtctgggtggcagtgagatactggattaggaatcacatggggtta

SEQ ID NO: 61275 - DNA, 1127 bp, Bovine  19866881394709
gggatgctgttgcattgtatgattatgtcttagcctcaaactacgagctcctccaagggcaaagacgatataacttttttatctagcacatgggttgaatgaattcaatattgcgttttctctgaagttagttcttcatttacaatgtccttggcatgaaaattgagaatcacaaaacactaagtaatcagaaaactcctagaacattatttgtggcaaagtataaacagaaagaaactcaaacaaaagagaacagtcttatgtgactagtcatagtgattaacattcatggtttcattgaaaccatggtttattggcaagttccttattttatacttccttagccaaagctgtgtaagagcacctttgtattcaacctgtggtgaggcgggatcagtgggttctctcattattcacttcagcttttgaaaagggaaagggtctcacagcattttaggtatatttctcatgggcaaatgttgatataaaagagcagttttaattttcaagaattctatcttcttagagtaataaaaaaatacagtaatcaaaaactcttacctttttgtttttttaagaaaagatggcaaatagtattattatacttcatagcatagtgatatattctacccacagatgataattttggaaaatatactgttaaaggccctgcatctgaatgctgtgagactcttccttttctgtgagtacctaatgtctctcctactctcgtttacctgctgcctggacaaataagacagaataaaacaagtacagccacaatatttagtctaagaatcccccacaaaactgttctgagatctcattctcattcttctgtcttaactgatatggcttaactgatctatcaaactctcttatcattgacatcaaaaactttgctgcatcaaaaacagaacattttgataatctttaagagcttcaaataattttccaagagtgaaagtatctgaccatttttaaaaacaactctaaacatttctacataatttagataaactaaccaagcaatttcttcgtgttggcctgagaaggctgccccatgtccaagctcatagatttcctggctcggggactggtctggcccgcaggtggatagctggctg

SEQ ID NO: 61276 - DNA, 838 bp, Bovine  19866881871893
tgctcatatctgtgtcacttggctttctagtcataccaacttaatctacttactagaaatgacatgacaaacttttttgctctaaggtactttggtaaagtctttatggcaaatataatactgaaggtatccaagcattctgccactaaagtaaaactgtggttgcctccccatgaatggtaacgtcacatcattattttacacacaagccataattgttttaaatctaaatgatgtcctgcttctgaggaactcttggctactttacagattatataatggacaaaagctcttcaaaaagctagaggacactaggctttgcattttaataaggcaagtttgatggctttgtttttttgcactgtataaaagtattaaaaatgcaataaaaatttaaacttaaaagacatataaagaaggaacagttttagtgaatatttaacaaactgttcattagtagaaaactaaaataattatacagttaaaagtcttctatgagcaggaaagagaaatttatcttttgtacatcagaagttagaatctgacttagctaagtcaaaatcaacattagtttcaggataaaatcatgggggtctaacgcacaccagcagtactaacagagggagaggaaaagaaaaggagaaaagccaaagaaggctggaattcatttggcgctacaaccaggtgatgagtccaataaaacagacagcaggactagagcgggcgtgagatacatccaggtactccaagtcaaactgcactggggcttcaactagaagaaaactgagaactgtctactaatacaaaggaagccattgtttgaattaagagacaaaca

SEQ ID NO: 61277 - DNA, 750 bp, Bovine  19866882080055
gttaatgctccgcagtcctatcttgaaattccaataaaaatttaaacgaagggtcttacgtttccacccgcactggccccacaaattacagagctgacccggagcccgcagctcctgactcctcggggcgcttcctacaaggtgcgctgccccacccacctgtggtccagtcagcaagtctgactgactccgtgggactgcccttcccagggagcagagcaggcttccggagactgggggtggtccccagcggagccaggggtgcaggacctgacggaccccttgggaatccctccctcgtctccagctggcttggcctgacttccctcctctccgctccctgctgagaattaacagagagggctggtggctgcccccacccccaacgtctgtgccccgtgtcctttgggctgggggtgggggctccagaatacagggccccattgtgtgccctgatggcaggcagctgggctgctgggaaagtggataaacaacaagcagtcctgagcgcgtgcccctgaggcccgatggaaggccaggatcccctggggtggtgggaataagattggggtgacccagctctgtctctcgggaggactggaagcagcgagatgtgtgaaatgctcaaaataacccccgacacctaggcagtgctcttcagctgggggctttgggacttgtgactgtcactgctaggtctgtgacactggggataaagtaccgcctcctgggcgtggcttccaagccctt

SEQ ID NO: 61278 - DNA, 1860 bp, Bovine  19866880407543
caattttttaatcctataaacaatttattaatattgggatcaaaaaaataagtctagaaattttcacattttattgttttttctctaaaatataattaataattgtttaaaaattagacatttcaagagacttggtctctgcttttaaggtacaaaattcatatagattatataggtattagtgtcatgagtaattaagttgttcgatcctttctgctgttaaacaagttttgcctgtctgattcaacacagtaaacccttccacaataactgttttttcctaagaaaaatttcctgcagtcctggcaacttccactttttgtaccaataacattaggattaaaattgggctcattgtaaataactagtaagtttgctcttcagatattctcattttgtctccttgcatttgtattatatattttataatagtttctatttgccttgatatttcaaggtggttcagaagtctccaaccacgttatattttactgctacttatttgtaagactttaaaacatatactattcatcctggttttctaatcataaacaataacttgtgcctctttcaatggatgataaggaatttcatttatgcagtaaacatttattgagctcctactgggctctaagcactattctagggcatttatccatggggtgtatattgcagcagcagaagtcagtgagcaaggatacatgataaatagacaatttatatattaccttagaaagtattaagtgtcataggaaaggggaaaagtgccccagaagtgccaaaagttatatttgctgctgctaagtcacttcagtcgtgtccgactctgtgcgaccccatagacagcagcccaccaggctcccccgtccctgggattctccaggcgagagcactggagtgggttgccatttccttctccaatgcatggaagtgaaaagtgaaagtgaagtcgctcagtcatatttaggaagtgccaaaagtaaacttgaaaacagagcgctacaggtagttctaattagttagggtaactgtactgaaccctccatacttgctttttgaaacattttgtggaattataaaccaggctagtgttagtcaattatgttgtatttgcattctgagaatattcttagcttttacataattgcatagtcacgtacacagcaagtacctggaagagttctctgtgttatttatccctgatctcagtcatttgttccatagaaaaatcctgttgttgttcagttctcaactttgattcacctcttgttcagctagaatacaggttttacacattacatgtaaaaagttattttttataaccttacataaatgtgtgtttgactggtacttaagtcttgtgctaccttcagttttccttaaaattcttgcatacggaccagttgtgggggctgtgctgtaatgaagaccatataaggcaatcctaaattttgttcctttgtgggaatatttctctcttgccagatagtagtaagattatttctttaattcttgagattcaaaatacttgtaaaattcacctgggagtagatttctttcctataagtaatataaaaataatggctaatatattttcctcatcagatttatatcctttttattaagaatgttttcttatagtgtatctctgaacatttttctatcttttttatgtgctctagtttcttgttgggatacattgttaatttgtactttgaatttcttgcttgattctcgctctcctcatcgccttacccaccatttttatctttcattctctctttctgcattcagttagaacttctaaagttttcctctatcatttgttcaatatcttgccaagtcatttctttttcaatg

SEQ ID NO: 61279 - DNA, 1606 bp, Bovine  19866880518795
ccctgtccatcaccaattcccagagttcactcaaactcatgtccatcgagtcggtgatgccatccaaccatctcatcctctgtcatcaacttctcctcccaccttcaatctttcccagcatccagggtcttttccaatgagtcagttcttcacatcaggtggccaaagtattgcagtttcagcttcagcatcagtccttttgtctagattggtctatcattttcaaactgctaactgtggctaccatccaaacatggctcatcatctcatatttagtgagcaccaactccatgcagagcccagggaaccaaacacaggagatgataagctacaactgagaagcaacggtttatgttaaatgtagcctggaaggagcagcaaaatatttctgaatcatttctttgacagataaggacagtgcaatgagtgctatggaatgactgttggcaataaaatggagcagagatcgctggattactgggctcccagagagttgggtctgcacgctaacatcttcagaaatgaatcacattaggaaaatttaacattctttcgcatcgtctcctgttctgcaaacgaggaacataagcaggcgaagactgtgcaagagtctttccctgtgggtatggcatgaattctcttagccaatttccaggacttcagcatccgtatgtactcttacctaaactgatgtgccagagaaagcatctattgcaccttgtcacaattgcccttcgttcccttttcaaaagcaacatgtacttttcacctcttctaaatcttttttatattgccccaaggcaataaatccccaccacaattcaacatcttgtatctggagacccttcagattaaggcacaataagcaggtcctctaggaaacatttttttacttcgtctttttttttaaaaagcatttatttatttggctgcactgcgttttagttgccatgtggggatcttcgatcttcctggaagcatctggaatcttcagttgcagcatgtaacctcttagttgaggcatgtgggatctagttccctgaccagtgatcaaacccggaccctctgcattgggcgcgtggagtcatagccattggatcacagcacaagtcgtaaagaaacttttctagtctttcacatatttcagttaagtatctttcagtaacatttcctgacaccggaaatggggcattttggtccattcctgggattttcgaattcatgtatgttgcagggcggggaagtggagtaaaagcgctgttcattcgtcatttttccttttcaaacccctgctactgtcaaagcgtatgtcactttttaagaaaaatcccacaagggcaaaacaaaggggaaaataacctgaaataatgaaggtggcggcagcttatttcatccagctgacaaattcagggcagtatctctgcctcgtttgtcaatcatagaattctaaagtaatatgactgccggtggaatgttcattagcttatttagccttttttctcagaaaggaaatctgattcggaggataggtttgactgttagaaatattttaacaaatagatatggtagatattgttcagaaattaaaccagctaaatctaggctc

SEQ ID NO: 61280 - DNA, 1021 bp, Bovine  19866880580044
ggtatagttgacttacaacattgtgttagtttcaggtgtacaggaaagtgatctgttatacatattcataggtccattttttccagattctttccataaaggttattacaggatattgagtagagtttcctgtgctctatagtagatctttgttagtgaaataaaattttggactctccccaggttttaatactaagcaacaatgagaaaaaaagctgaagagctcaaacctctgccagttagtatgttttatgctctgaggatattttgtttataagtataatcccttcgcagtttatacatgtgaaatctgtagaacagttaccttcctcctttgcaactttgtttcttcttttaagaagtagatctgtactgccgatgcctaggagacaactcagaaatgagtactcccctaaatgctggctaaacctgcactattttcatgttcacacctaagaaagtcactcctcaaggtcaccgaaaacattcttgggaggaaagcgaaatgagttttaagccgcctgacccccgtcctcctggacaccatccaggtgctgacatagtccagcgggtagaccatcaagttccaaggctcactgcctgatgatgatgtggttcctaagtacttttcctcctgtttccagaggcctggcttgattccatttgtgactcatgcacagcaggccttgttagtcatcatttgaatttgtttttctttcttcatggagcaatctgaccaacagtttagtatttttgatgacctaaaattcggaacacccctttgccctgcattttggtcatttggcctttcagatttaaaagctcaaaaggatgagttcagattatgcctgggagctttaagcaaggtgtgctgaggcaaagtggaggacttcattgagatgactttatctggtattacaataaatatatgttttttctccaagtcacccaggcatactgacctgaaagctctggataaacagttctctgttgtgtgtgtaagggtgagactgtgacctca

SEQ ID NO: 61281 - DNA, 2151 bp, Bovine  19866880595289
cccccaaatcttccaatgctattcctggatctcgtatcggtggcaatgtaaaacaaggattgctcagcttcaacatcacactctcaggcactgctcttgctttaagggattgaagtcatttaaggaaaagaatgaggtcacttacacttcttgaaaactctttcccacttcaccccactcatatttctctgaagtcagtgagccactacttcttcttggcaacaaagagctgccctctcttatttcccaacgtcccccttctctgccaagataatctttcccagacaggggcattcaggaggaatagaagtctccagaaatgggagggagggggggaatcccacagaaaaggccctggcagggcttagttaaatgaattccacatttggataggaaccagcagctgacgcacatatgagaagcttaggagagaatgtctaccaaatagttcaccaaaaccaaaaaacaaaattttaattttcaggtcatggagaagaagtcttattgaaagaatgcaccagttgactttctataccaaatgtctgttaactgcaaagggcaagttaactactaactaaaataatcaacattataaaacgtcacttttttggttgaaaaaagaagaaaacctgttcaagccaatttttaaagagagtgatggttaatttctctaaatgctcttttactcaacagacaaggataactactaacagtctcttggaaaatctatcaaaaatgaatgagagacatttttaatgacttcaaattgttacatcccattgcttcaagcatgcataaagatagattatcatcactgtatgaaatgtcctgtttcttagaaatatcattccctatacatgtgaacatttgaaacatcaggcccacacaataatacaatgattaaaaccataaataggttggacgttaactaatgaacttttcctttttttagaaaaccagcagcattatttgagaaatggataaaagagttgcaagtacagagtttttaatcctacctcctgctgcgaaggggctgttaaatatttgtaaacagaaagcaaccctagaagaaaagcttctgattaatgggagcaagtctttcaggaaacaccctacttgaaagatattcttttcccccgcctaaagtcagagaagtcactaaaccctccccatcaaagcttcaggaatttttttaatagcttgttttttcttcccagaatcattaacagtatggaacagacagaattccagcatccctacatttcatagataacaaaaggaactcacaaagagtcaaagtaatgggaaaagttgatgaaaatcatgtagtcacagcagaaattttcttaaagactaaactttggtctgttaccaactttgggctgtgaaatcgttttgtctcatctgaaatcaagaggtaactaacatggtacgtcccatgcgacatggtgtccagggaagaccagcctagagtaatgacactaggttcagggtttaatcaataacttaacgacaagaattgataacaacagagacatacagatattcctgtggagagaaagtgggtagggagtaggctgtgatgattatggttgttaaacaaaggtgttatactttatttcatagttcgggatgactcattgttttataaaatcccaggctgagtcacttcattattataagccaagaaagatgaaatgagagactcagctggcttgcatccttactagcctggggcagaggctggcaaccccaaacctgaatgatgcttgaactggttccatttccctttcaagtagactccacatcaaaactggtacaaaatctgttaacactttttcactaattacagaaggggccagtaatttattttgaggatcgatgtatagtagggaagagaagttataaaatatcacttatccccatgttgaaatagtagttttaggcactttagtgataaaatgtcagatatagctaattgctaaaccagttggaacaaagcttgcaaccaaggtcagacacctgggagattaatagaatggcaatatgtaaatattgagcaaaagctgaagacagaccgaagtaaaaaatgaagagctcagaacaccaagtgtcatagagggaagtctagacaccatggtcaaagtggga

SEQ ID NO: 61282 - DNA, 1835 bp, Bovine  19866880689257
gttttactggaaaaaaccgtttcagttggttagtgttttcaaacacaaatttaatttctgtggaattaaactggtattttcatcccgacatggtttgcaggattgttataaaaacaaaagttgatagttaaggaatgtttccaggcattaatcgatcataataaaccaccagccaagcagccgtgtacccagttacctggtgacatatttgctttcatatattattctttaccttccaattatatgacaaagtgaacatttaagggagaaagagatacaaacatttttttcattatattcctgggaatctttgaaaaattctagttgcaaagatattatataagtttataatacatatgtttatattatattttcaatcaatagacactaaaaaatttctgaatggtatgtgaaattatatttcttaaaagtgtaatttcacagagataaacttttccttggatcagaaatttagaagttaagactcagcaagaagtctcaaaatattcacagtctcctaacaatatcaacattaaaatcctacggtctaaatctttgatagaggtaagtaatatcacttatatttaccaaatttaggaacaatacagctcaagtaagtgggttttactttgtaagacactggcatttaaacttcatctatagtaggggaccaaagattcactccagagattattattattattttaattctttgtcagtttatttattttttaaaaatttatttattttaatacacaagatgaagacattggattatttttagaataatacacaagattacagaatacctctaaatcacttctaaaaaagagtatgactgatccgactgcatcatgctcttactttaaatataagttcttctccagacatcagactatacttgagttcaagttcacagctcaagaatgacatgctgactcttctgacaattctggtgaataataatgaaggggacaagatggttttcccataaactgagtcttatcctacagcaatccaatcagcaataagattctgggctaatattttaaattgagggatggacatttctcctatctataaacacttcaaattcatggcactattttctacttaccaaatctgaaccctgtagtaaggcaattttcctctttaatgttaagaaatttacacatataggtagtcaaacacatattcacacatactaaagaagcccagaaaaatttagaacttactagcacagtctggccattcagtggaatatggtggtttccagataccatcttcataagcacaataatacttgtcagtagatccttctgtgaaatcatagccctctaagcaacttaatgagcagttaacaccagtactatcttgagtacatacaaaatccccatttacaggtgtaaatggaacttcacagggggaacctgtgtaaaaaaattgaattattcatatacagtggtattaaaatataaattaaaatctaagtgtctaagctgaattttgaaaaggattcctcctgtccacccctactcctagaaaaacttccacactaaatccatagtgtgaggctgctgcaatttctgcttttcgattcctagggtgggtacagctaaaaagctgtaccaatgtgcaattaattacatgtgcataactgtgcatatgttatgaaaagctaaaagtacttctgacgtgcaactgttattttcggcattttttaataaaaaggaaaaccaaataacattacatagcaacaaattttcggaatctgtctcctcaagcattcaaaataggatcatgacaacaatactttgaactttagagaaaatatt

SEQ ID NO: 61283 - DNA, 1314 bp, Bovine  19866880704685
ccaaaactatttattgacattttctatgtgtccaacacatgctaggtcataatagaaggaactggaaatgagcctataacttattagtatacagaagtatgaagaatctaaaagataatgtgtctgcctggagttctttgtgaccctcattttatcctaaatgaacaaaaatatggaaaaccctattgtacacagcactactttcgtacagttgatgtcattattattaaccatattacatttttcattttagctcagtgtaaacaaggcacctactcatcaaatgggcttgaaacatgcgaatcgtgtccgctgggcagctatcagccagcatttggttcccgggggtgcctctcatgtccagaaaacacttcaactgtgaagagaggagccgtggacatttctgcttgtggaggttaagtcttacacgttgcttttttttcccccaagcctgtgctaggttctctgcatggaagagtggaatcttgttagcagaggcatatgtctgccatatgcaaagaatgtaaataactgtctcttcatagagtgtttccttctattcagccagttggtacttaagtgtaaacacccataatataaacaccatcctggtactgttagggactcacaagaagcacatgactgggtcccagccctcaacactagtaaccatgtgaccacatggtatgagagaaatacttgtcaaccaggaacgtagatttttcatgtataaaatgaggtcttgtcttatgttccttgaaactcgaaaaatacatcctttggattgtgacctttgttccctgcagtttgaagattttcacgagtggttatccactctgactgcctactagaattgttgcacattcatttcagtattgtagccacttattgactagagacatgttagtacatcttttgttacctgaatattattgaccagaatgtttcgatatcacttacataacagatcactgggccacaggtgttaatttctgcaaaaattggcccagtgagtaacatgttaaaactactgaaacccatctccacccccccagagaattctggtgtaagtttactattttcttctgaagatcgcccctctccccatgttgttgtttagttgctaagttatgtctgactctactgtgaccccatggactgtagcccaccagcgtcctctgtccatgggattctccaggcaagaatactggagggggtagccatttccttctccgtgggatcttccctactgagggatagaacccgtgtctccctcaggcaggcggattctttaccacgagccacgagggaaac

SEQ ID NO: 61284 - DNA, 987 bp, Bovine  19866880736997
gggagggattgggggcaggaggagaaggtggtaacagaggatgagatggctgggtggcatcaccgactcaatggacgtgagtttgaactccgggagttggtgatggacagggaggcctggcgtgctgtgattcatggggtcgcaaagagtcggacctgactgagtgactgaactgaactgaatgattcaggcatgatatatttatggctttagattttcatatctttagctttaactaaaggcaagtgttatcccaaggaaataatcagagttatataaaaaaatttgtatagaaaatttcatgtcagcattgtttataatattagaaacaaatagaagtagtagaaataactaattgttcagtagtagagtaaatatgagaacaattatggtctgccagtgagatgtaatatgtttcatttattaaacatcatgttatttaatgatttggggaatggtttacttgtgatatgaagtgaaaaaatcagagtacaatattatatgaccaattctgatttttattaagttaatgtgtattgttaaagatgggaaggaagcaacaaaatatttacttaagtggtctgagtattacttaatgatctgggtattaaatacgtgcaagagaaaatatcaccaatgtgatagctttcttataaccaaaggttaatgcacttcttttagaacgtagggtatactgctttataagcacaaatgattttttctttcttttgcagtgccttgtccagtgggagaattctctcgttctgggttaatgccctgttatccatgtccccaagactactaccaacccaatccagggaagtccttctgtttatcgtgtcccttttatggaactacaaccatcacgggtgccagatccatcacagattgttccagtaagatgatactacttcgttcttcacgttatcctgtatgggagagtttatttctgcagtaactttaattgtgactgttatatgttcagtg

SEQ ID NO: 61285 - DNA, 1843 bp, Bovine  19866880749924
gggtcgcaaagagtcgacatgacgagaaacttaacagtgacaacgacacttaaatgtcttacatattctgcagcatgactcagatctctgcccgttggtcttccatgcagcatctgtcagcccttcagttaagaggaggatcattcaagagatccctgtgaaagcattgccttggtcatttcatgccttctcattatctgggaatgtttacttcacttctgggtggatcagctcaactgccactggcgaaactcacaaattaaatgctcccaaatttaccgtttctgctgctgtgttcatggtggttttagcaatctggtatttcttcaacaagtagagtgaagcatagcaagaatcagctttttcttgtgatgttgagatcagggatgaaacatgcatgagtgctcagttgtgtggaactgtttgcaaccccaaggactatagcccaccaggctcctctgtccatgggattatcctggcaagaatattggcgttggttgccatttcctcctccaggggtcttcctgacctagggattgaacccacatctcttacagttcctgcactggcaggtggattctttaccatgtcatcatcaaagggatcccagggccagccttgtgtcaaggttctccgcctgcacaagtagacttctattctctcttgcaaccctcctcatcagttttgaacatcagttgtgacttcatcctctgatttcatgttttttagatgtagagccacctagcatagactggtgcaggtccccgcctccagtccaggtctctgagaaggagcatgctgtgacctgggatgagcctcagttttcagacaactcaggtgagaatgcgggtatcttctcatcaacatgttaccaccaaatacaaagcttgtaaaaagataaaagagaaataaaaagcaaattacatctaaatatagtagcatggataattacataagatgttttaatgctaggataattctatatattttaacattgttaatcttacctgtccatggcttttcattcattattcagtggggatttattaaacttgtacagtgtattttatttgaaagtgtgctagtaaattcactgagcctctaagcttcctttatcctagagacataagctatgcatcctattggcaagtctaatgcagttctatgtattcatactcagttcttaaacatttgccaaaaatgttataaaagcgcatgggaaaacagaaaaaagtgagcaaatatagctgaagttcactttaaagttttcacaaacaccctgaaaacaagaatgcaagtgaaatagatttcttaattaaatttccagtattcacagagactgacctagtaaaggaaaataatctatttagcaagaatgccttcatttaatgaggcttttgagtcaactatttctatagtttagtgtaagattttatagtttattttctgttagcagcccagttagtaccaatagaatgttcagctggtttgtataaagagtaaatgaaaattcaaatcacataaagtgactgcacacaataacccccagattggagtcctcctttctccttctctcctttttaggggccatgttgaccatcaccagaagccatacaccaggagacctgttccctcaaggggagacgatagtgcggtatacagccactgacccctcaggcaataacagaacatgtgacatccacattgtcgtaaaaggtatactctgcataagcctccgaaatccagctgacacttgagatgtgtaatcattattgcactctcctttgtgatagaaaataggctatgaacccagctgtttaaagttagaatacgacggattata

SEQ ID NO: 61286 - DNA, 1711 bp, Bovine  19866880892072
ctcctctgtcctggggtttcccagcaagaacactggagtgggttgccatttccttctcttggggatctttctgactcagggatcgaacccacggctcctgcattggcaggtgggttctttaccactgagctaccagggaagcctgtcaagcccttactatatgtgccaaacaatacctcaatcttatatgcaggattttgttccattctgccaaagctccactatgcagttctatttgtttatctttaatagatttgaaaactgaagcacagagagatgggataacatgttcaaaatcatcagagtgagttcatggtgaaactggaacttgaacccaggccattggactgtaggctggctttaaccactagcccatctgttactctgtatgtgtgatcttgtgccagccctaaatttctgcttcttgagtcagagggattggaaatattcttctctatgattctttctagttctgaaatcacaagattttatgaaacagtcatgtccaataaaattataaaacatcaccaagacactataaataacatctgcctagcttagtctactatcatagcatcaaatgatactgctgggtaagttctgaaaactacagcggtggcatagatgtggtagcagtaggctgtgcacgttcgtactggtttgtacctttgcatgtcattactgtcatacactgaaaatggaattgacctgctgtggagacaggacatagtcccagaggttgagctggcttatggagcccacaaaagactcagccgggttgaatccctctccttttttgtcttgttcttgcccaataaccaatgcaccaccacctagaaaaggaaagaaaaaaggaagaagagtggcccggctgttctttctaaaatgctaacttaatgaaggcacagcctatacaaacgggaaattatagagaagctaaattatctacattcactgcatgatttaacagtaagatgagttcgacattttatatagcaactgaaaaaacagtcaaagaggatttggaacacaagattagatttatacatatttaactataaaactacatatatacatatataatatttatatgtcaacaaagtagttaagtcctactttgcctctttagctctaggaaattaccctccgtgacagattaccagtagctgctcttcatcgtattattctttagcctataatgcttaaagttctattaccaattccaaggaacattcattccagtggctgcttaacgacccaatccaatggaaactcttcaatattcacctctggtgacttctctgtatcacttgtttcttggaagcatttcattctattaaactgcccttcctggcactcaaaaaggtctgtacccctcgagagctacccttcccctttctccactctgctttgtggccgcaaggttcatgcccatggactacaccacctggtttcttcagtcctctggcctctgtttgtctggccaatggagaccagcccaagataagaaagtgggatgagaaacaagtttaacttcctggataccttctcccaggcaacagatggaaggggctggaaggggccgctttcctctgccttgcatcattgctcccactgggtgatttctccccatcactacaggttcacctacattctggtgacaactcccactctctgtcacttcatgtacatctcttgtgcctttccatcg

SEQ ID NO: 61287 - DNA, 1104 bp, Bovine  19866880896874
aatatctgttagggctgagtttcagaatgaaggcagcttgggtattggtcacgaagaaccactgaaagcatggtcgagtacagaggacttacataaagtcaaattcagtctattgtctgaaatttaagaaaatggaaaaaggaaagcttgctaagaaggaatggttcacagtagccctctctgtataatgaatcctaaaccttaagaagcaaaggcacacacgacggccataatgaacaagatttcccctaacaacagtttcaaccttggaaatcctaccccagagagatccataaccaggttttattagtccaactttctctcttttagagaaagaggcggttttgaaatcattttcctttgtctccatattaaataaagcaaacaacctgatttacctcattcaggcttacacatgtttgttttagcactggactaaatttgagagtctgccctgttattacatcactttttaaaaatagtaccacagaaataaaattataacgtaaatccatgtagtagtaaaacagtcctcttatttctggaagaaatttgaatgttacatgaacttcaaagttaaagtttctatagtgctgataagataacaggagccaacatccaagtactgagataattttctttgccccaccccacccccaagtcaataacggcattacttgtaaatcacactaacctgctgggggggaaaaaaggccaagaaatttaaataaaatcaccatcagcagcacttcccttctccctcccccgccaaaacaaaaaactttagattccttcaatttatcaccttaattaagttaattgattaaacttacaaacccaagttcccttgtggaagataaaacacacagttgggaggatcattcattcaaactgtattcagaagatggtacaaagcaattggccgaatctttcatcatctttctccttattggcccagcacctccagatttgaaggcaattagaagaataacggagaaggcaatggcaccccactctagtactctggcctggaaaattccatggaaagaggagcctgatgggcctgcagtccatgggggtcgctaagagtaggacacgactgag

SEQ ID NO: 61288 - DNA, 921 bp, Bovine  19866881070050
gttggaagacaaatacagaatattgtccttcccttatttaacatgtgcacacatgtatgtgtgtgtatgtttcaatttttataagaatttttgtcccaacacttcataagaaataataatcttgtcctataattttataaatgagaggtggttgagaaaagcatagtataggacagtgattctcaaattttgatgttcattagaatcatctggaggatttcctaaaacacagactgtggcatttctgtcacattcccaggggattactgatgctattggtcaccattctgtgagacctccttgtgtagaagaacatggatttcagcagaattagtccatagaaggactgtgtgtaccctatgagaaaataaaccctattctaggacacctggcatatgagttgagatctggcaggatttagcaccacccccatttctcagccaagtggccttggtaacaagtacatgtgactttctacttttgactttggaatcacactaattcctggctccattttatgcttccagatttccctctttcccctctacttctgactttggatcttttgctgtcttttatgtatccttgtaaggatagcttaaatctatttagaaagaggtaatacctttatgaaatgcttaattagatggtaattcctaacatacttcctttttcttcatcactgccactccctataaattcaggttattgtgataattacctttaaaggacagttctgtttctgttcatcctctctttgattgaccttcagtgtttgcattttaggcttaaaatgtgagatagacattgatgaatgcagctcactgccctgccacaacaatggaatttgtaaagaccgagttggagaattcatttgtgaatgcccatctggttatacaggtaaggaaagagtgtctcatt

SEQ ID NO: 61289 - DNA, 946 bp, Bovine  19866881121602
caggaatcgaaccggggtctcctgcattgcatgcagattctttactaactgagccatcagggaagccctttgcaagtatgtgcatctataaatgcatactttttacaaaattataaatactagagtatatagttgctttgtaggttttttatggttaaaaaaaacttagaatgtataaaacttttcttttggtaataatggcactattaagtttgttttggtttgatcttgctgtttcttatatctgaggattcatatctaccaccagttctgggacatttttgttcattagttcttagagtaatacttctgacagttttgtggttttgactctccatttagatgattctgagaccttttcagtatcattcctgcctctgaacctcactttcaaattctcatctctgaggctctgtctgttctgtgtgatttttttgggtagtaacagtctcatttactaattttctcaccagttgcacttaatcagatatttatctcatgcactcatttgaaatactatggttttcattgctacaaactccatttgaatctttttcaaatttgcatggtcttaaaaaaattgctattcttttactacatcctcttgttaaacatattaaacatttttattttatagtctgtatctgataattccattttctgtagactttataggtctgattctgctatttgttgtgtctctggtatgttctggcttcttcatgcgtactgtgaattttttttttttttcctttttgtacatgagctcatgtttctaggaacttttcttctagtaattctttgggaacttaaggtgaaatataaaaaacttgtatttgcttctgctgctgctgcttagtcgcttcagtcgtgtcccactctgtgtgaccccatagacggcagcccatcatgctccactgtccctgggattctccaggcaaaaaca

SEQ ID NO: 61290 - DNA, 835 bp, Bovine  19866881205418
ttctactgactcctgtgtgctacaggggaaagagctttaataaagagtgagagaaccgacccccgccacaggggtatgagctggtataatcagaggagggaaaagaccatatttatttaggataaacaagaaggggagagcaatttaattggttcctgatgtcccacataacacaggctagagctcttaaaactgagtggcttatttttatttgtgaatagatttgattttttttttttttttaatgggttttccatctgtgttggtcgaattccagttaagaaacttccatcctggctgctttgatcttgtgctcacctttcaaaggcataaaaaggtcttcttttccctttatataaaagtacttccagccaatatttaatatgaaagagatgtttatcagacttgggatgggcatattgaagctattcaggggttggggctttctttgctcatttcttctttttctcatacacactctgtttttttcctatcagcctaggtcccttgcctatacttcctgttgtgagtttgcacacagagggaggtagaggtggcaatcaataaagttgttagtgtatggataccaagcgggaaaggagggggtgggaggaattgagagattgggatggacacgtgtacactattgatactacatataaaacacagaactaatgaggatataccgtatagcccaaggaactccacttaatgcatcgtgatgacctgaatgggaaaagaagtccaaaaggaacgggatgtatgtatatgtatggctgattcattttgctgtgcggtagacactaacacagcattgtgaagcaactatactcca

SEQ ID NO: 61291 - DNA, 805 bp, Bovine  19866881221961
tagggatatctgtgaatatgaaaatgatgtaaccaataacaaatatcatagaatattatacctttatgacattttctagctcaatgttaaagcattagttgctcagtcatgtccgactctttgtcaccccatggactgtagcccgccaggctcctatatccatggaattctccaggcaagaatactggagtgggttgccattcccttctcccagaggatcttcctgacccagggatcaaacccaggtctccttcattgcaggtggattccttaccatctgagccaccagggaagtcccatgtataatgttgtatcagccatcagagatttacagggtaagaattttgtccagttaattaccttgtagtctggacaaaagctagcttttgcctttactcctgtacatgacaacttcctcttttgaaaacttcccctgtttgcagacaaacagaatttccccatttatttatttgttaattttacctgcaaatgggcataggagtaggtaccaccccaggattgcattcttggaagatgtggttacacagcaaagcttcagcagctggccggcagaatgggctcactgctttcagttcattccaggcagcatgaaccagtagttcttgggcctcctcagggtctgcgtaggagttgttgaagaaaacaagagcgtcttttgccaggacagcattgcacacctcccctctgtactggccgcagtagcctttgttatctttctgtggcttgctgaaagaagcagtgaacaacattccggatcacatgctgtttctgagcattcaatctg

SEQ ID NO: 61292 - DNA, 1054 bp, Bovine  19866881331571
ccaaccctcttagagcttttatgtaatttgtaatggaaatttgaaacgataatgaatgaaaagcattctgcttattttgtgaagagaaagcaaagcgcttagcaggcatcaatttcagtgtgtcctctcggaaagagtgcacttggctttggagtcgttacacgaggctaagggtccagattgactttctggattgtgttttctcaataatactgattaataaacacagcatatacgggaaggttatttagtgggtcatctaaggttttactccccctggaaaatatctttggaacacgcgatcatgtctgagtgtgtgggttttgatccagtcctttttgatctcctttctagcgatctgcattcttccctgtctgaacggcggtcgctgtgtggccccttatcaatgtgactgctcacctggctggacagggtcccgctgtcatacaggtaggcatcctggcatagttggttttattggtgcctgggctccatgaaaccctagagaacaactgatgagtgtgactcagattcagaggtggcagtaaaacagaagggtatcagggtttctcacgaattcctcaagatggtctcttgaatggtggtctcagtgctcaacctatttctacctcagagacacctctcagggtggtatgacaaataagagcatctgagttaactcattggtcagccttcttcatgtcatttgctctgtgttgcacaatggagagaaaacataatgcagaagttcagaagaatatttatttaaatctctatgaagctaaatcactaaatttgcagtaactatttggaaagaacggactctaaataaatacaattgaagttaaagtgaaataactcaacaagagatggttccttatcatggaagacagtaacaaactattgttgatttgtggtaaacatgtcctcatagcgacccatgttcaaatacctgcctatccactatactttgctgtctgttgaattgcttgattttgatctttccctgccctcactagattgtatgccactggtaggcagggatatttgtgat

SEQ ID NO: 61293 - DNA, 765 bp, Bovine  19866881365080
atgcccttttgggaatctgttcatgcgtgtgtcagagggttcacgcagggtgaaagtggtgcattggtcagaaacgtcccctccaaacagctggcttctggggcctgtaatgaggaattatgacaggaaggagaggagttactgaagttattttaaggtaacgttagttggattcactgcttaccgcatgggaaaggtcatcgttattacatttaccatttcgggtttggagtttaacctctttattgtggatttgttggtcctgggcactttagttttgtggtaggatgttttgtctgcagtttgcatctgtatttggaatgagaatgaagtatcgtttttaaaaccaggacccaaaacaatggaaacaattgtgagggcacatcttatgttcagtggtagaatttctcatggatactggagaagataaatttgattctcatcctggcatataaaaatgactcatagttgttgcagcaaaggcagatgtcaacagctttgattttgagtttgctcatttggggaaaaacattttctaaatcacatcaagcttagtatcaatacagaaacccaagagtgaaactccagaactttcacaaggctatgggctgaatccaactggtgtgtcctgtacagtcacagaaatccccctcatctgttgcctggggtttaattctttctctcttctcattccttaccttccttttcttccttcttctagcaaggtcctccacatgaatagtttctcagctttttaccacccac

SEQ ID NO: 61294 - DNA, 1526 bp, Bovine  19866881409308
ttagctcctcataagtctccacaaaggaacatcaaaaagctctaaaagtgacatcacttcaaaatggaattcacttctttgacatctgtaattttacctctaggtttccttaccataatatctttgtaattttaatattttgttagaaaaacaacttaggattcttgtgttttaaattatattttaggaaatatcgactatttagaagtagtgtgtggtttttctgtgacagcatcttatttgttctactttacttaaaaagcagcatggtttttagaggttttttttgtttctttttaaacaactcttccgtggtttgctgcttgggaaaaatgtattcccatggaaattaacacccaccaggagaatttccgggcagtaggcttactttatactgtccggtgcgtctgttcactgcttgtttcgtgtgaatgttgtttcattttgacatttggaaggtaggtaggtctgctctgtaacacagaaacgtggctcttccagggttgaacttcccagttttgacctgatctgtttttctctcttttcttctcctcgtggaacatttctttttgctttttctacttgctgttatttgttttttaaaattgaagtgtagttgatttacaatgttgttcgtttctgctgtacagcaaagtgattcagttatacatgtatacattctctttttaatcctcttttccattgtggtttctcacaggacattgagtatagattcctgtgctgtacagtagaaccttattgatccttgctgtatataagtggtggcatctgctggtcccaatctctgatactgactttcattctcattgcccctcatctcccttccctcagtttcttctcctcctcccctcccccatcccactggccctgatcccatctggcggacacccttcctgggtgcaagcatccacgcttgcccagcagaatcactcctttcttggccccgttcccattccacccagcaggatttctcatttaagcggggaaaaaggggggttgtagagagtcagcccaactgcctctgagttggcaaaacgcctccccttgagtcttcccacacttccatgaacagcacagcttggcagcctccctgacgccccctccttccctccaccctttcaagcccaccaaacacagtcagaagctctcgttttctttgctgcatgctgtagtcagcacgtctgtttccgtgtggtccgagactgagctgttccctgccaataagccgctgctgagtggctgcccagcagcctcagccatgctgtgcccagcccctaccattcctgggcactgtaatcttgcatcccaggggacaggctgcatgaagagagggaggcggttcacaaacccactgcccccagttacccaagtccctgtggctgccaccagttgtgcattccaggctgaaaggcacagctgtctttaagatgtatgcagtgggtgggcccatcagtgcagcctcagcagaggggacagaagcgctttggctgctggttctagccagg

SEQ ID NO: 61295 - DNA, 1712 bp, Bovine  19866881409901
ttagacataaccaccaatacaggaatggttaaactgagttgcatccattaaatggaatattatatagccagtaaagtcatgtttttgtaaaatttttaatgccataggaaaatgtggcaattctgcagtggaaaaaaacaaactggttataaaattgtttacagtatgactgcaattatatataaaggtatacaatacacatagcatacacaggggaaaagctgttaactgtggttacttctgggttgtgatatcagtattttttctgttttatacatttctgcatttttcaagttttctacaatgactgtgtattataatacagaaaaacacaggttattaaaaaaaattcctctgatgaactgataattagaatgtactcgggtaccataaatatgtgggaccataccactgtgctcatcttctataacttttatagagtacatattcttctgataataaacttacatttcctgttttatacatgttacaacactttaataaaaaaaaggtaatattgtgattagatcattgtttgtttcataacctaaacaaatactggctttgacatctaggtttttctacttcctagaacatttaaaattaacactcttttgtctttttaagtatggcatactgcacacacagattttcatgcatgctttctaaaaacgtaattctaatttacaattttcctaacataaggaaaaaaatggagttataaatcatttaaaaacagtctacagtcttatccatcacaagcatgctgataggcataaacatgtttattaaatgaaatgtatcctttaagaagagaaaaagggaagcctgcatgtaaatgaagttgtggattcaattagtcagaatttattctgacttgcaccaaatcatacaaaaacttttgaagactagtgtagtgtacacggacgctccagagtctgtgtatgaattccattgcaagatctccactttctactttcaaaaggaatgggagcaggatgaggggtatcacataagctaattttttcaatatatgtcaagtcttggtgggtcaaggaacaaatactgccatgggttagtgtttaagtacatgaatgtagttttcctctctttctcacaccccaccctgccctggcctttggggagggggaggctgttcatccctcaatagatgctggccgcctctcatcttagtttctttcctaaaccacggagtggtcattgctgtgaactccagccaggatggtgtggttgagggaggaagccgagcggtccgagccttccgtcgggccgctggtgttctcactgcgctggcagcagaggatctgcctgaaggtggcgctcatctccttgtcgcggtaggagtagatgatggggttcatggcagagttgaactcggcaagcagaaggaaaaacttctcataggccagaacgtcacactgggggcagcacacgtcgagaagtaacaagaccagtccaggagtccagcagatgataaaggcacctgtagggtcggggagcgggaacgggaaggtttaaagagagaacagaaaaatagaatgatgaagggagcacccatatggtgaaatgatttcagctcaaggtcaaaataatgagctccaaaggcatcagatcatcatttgaaataaaatgttcatgttctgaaataatcagaacagattctgacaataaaatgagcaattgaataaaat

SEQ ID NO: 61296 - DNA, 1186 bp, Bovine  19866881413161
tgtgggcctatggggtggtcctttgggagatcttctcctacggcctgcagccctactacgggatggcccacgaggaggtcatctactacgtgcgggatggcaacatcctctcctgccctgagaactgccccctggaactgtacaatctcatgcgtctgtgttggagcaaggtgcctgcagatagacccagtttcagcagcatccaccgaatcctggaacgcatgtgtgagcgggcagagggccgtgggggtgtctgaggtccaagatgggcgaagagaaatcgccagcatcttctcagactctgggagccagaggagtgcaacgcccgagcccccaggagacccagatagcaaagaatagtagcagacatgggtaccatgctgcttgtttctcagaaataaaaaaaaaaaagactgggcagaactcctggagtgggtggaaattgggtgaagggaaaggcaggcgagaaaacgtgtcaaataaccggaggtaactactcttcctcacagggaaagtttgtattacatattgtaccggaaagaatgccatcctgttcagttcctgaattagctggcagcagaataaggctctgctgtattaaaaattaatatgaactgtggttgagagcttcatttttaatagagttcattcctgtccattaggaaagtagtgtattttcctgtaagaaatttagctcaagcatagaaaactccaaagaaggaaaaaccattcattgtctcctcacccaaagatgggtgttggttttttattcaatttctttcttgagtttaatgcacacttttatatttgtttgtattcgacagagttgtggtttactttattgatagagagtttccaaggaataaagtgataatcagcaagattatatttttattgtgaattttagttctctttttctttgtttctttagaagttttcctttgtgtacacgtgtcatgaatttaatctgcttgctttattcttacggtttttttttttttctgaaaatgtctttgtgtctatttaccttttctttttgaaaattttattggtacctttttctttgtctcatctttctttatttaggacttggttcctttttggtatttggctattttttccttttatttcacctatacaacaaacaccttggcagaaataataactttctaagtaacattatgga

SEQ ID NO: 61297 - DNA, 780 bp, Bovine  19866881573870
ctcttagtgaatgacaatgaagaaaaatcttttgatgaaacagaattctacagccaagattcactgggttcataatttcatcatttcaataacaaggtaaactgttctgaaaagtgagggaattacatggcatttgcttttaaaacaaatctgttccaaatgtgccccaagtataacaaaatttattattattagaagctgtaaactttagggagttggaaaattggattctggtgtagaagtctttttaccagtggtgaggagtaaaaccacatacttgttcatgtacgtacccatcatatatctatatacatatggatgtgtatttatacatatgtgtatatacatatggatgtatatttatactcgtatatatatagatagatgtgtatttatattcgtatctgtatacatatgcatgtgtatttatactcgtatatctgtatacatatgcatgtgtatttatactcgtcattctatgtacacacgcatgtgtttatgctcatcttgagtataaatgtatatctatatacgtatatgatacttgagggagctcgaggtgttcaggatggatgtgtatttacactcaccatgagccagtttttggttccagtttttagttcacagaaaacaggagaaaccagagaactacagaaatgacccatccaaggcaccatgccctaagaacttacccacacaccggggctctggaccatcccattgggcgttcacttgacaggtaagcctagcacttccttctagtctgtagccttcatcaca

SEQ ID NO: 61298 - DNA, 1020 bp, Bovine  19866881672103
gaaggaagtggtgttccactgtcaggatgggtatgcgttacacggggcccccaaactcacctgtcagtcaaatggtaactgggatgcccaggttcctttctgtaaaccagtcaactgcagccctcctgaagatcttgaccgtggcttccctaatggcttttccctttatcgtggggggcagatagagtaccagtgctttcctggttataagctccatggaagtccttcaagaaagtgtctctctaatagctcctggagtggcagccccccttcctgcttgccttgcaagtgctccccaccaaccattcagagtggggctgttaatgggacagatttcagttgtggaaaggcagctcagattcggtgcttcaaaggcttccaactcctgggactgtctgagatcacctgtgaagccgatggccagtggagctctgacttcccacgctgtgaacacccttcttgtggttctcctccaacgataccaaatgcgttcattgttgagaggggttcattggaggaaaatgtaataacttacacctgcaagcctgggtatgtcatccaaggcagttcagatctgatttgtacagagaaagggacgtggagccagccttacccagtctgtgagcccctgtcctgtggacctccaccatctgtctccaatgcagtggcaactggagaagcacacacctatgaaagtcaagtgaggctcaggtaagaccatgcgtggttccagagtctccaaggggcacagacagaagggttgtaaaatgaaaagcgataaatcagaaattaagctagttgggaagaaaacatcttctttgggctgttctctgaaaactgaagcttttaacactgggccttattctgcccataattatccatagattggcttgtaaaagtaaatttccacattttcagattatagcttctaatacaggtatcataattaacggattctgttgagcttcttggaccatcaagatcctctaactagctttaatacctattaactcataggct

SEQ ID NO: 61299 - DNA, 1372 bp, Bovine  19866881738355
tccttgattcggcaatactgcacagagttcccgaccttctggaagcctggatcacagaacagactgattttggagcctggctttacgtctcttgatgcagttcgcagatgaggtactgatccttctaaagacgggcaatctgagggcaaagaacactggttcagagcatgtcagaaacacacaagcaacatcaccaggttaagggtttcaaatcatatattgtaccagtatttgagagccactctattgatactaaaacaagataacatgtaaccagatctctggcatgcaaaatttctagaaaaaaactattggagtcaacaaacaatttttcttctttcagcagaagtctgctgaatatttttaaggaaaatggtatttttgaattacaaatagtatttcagaattaataaaatgttcttatgagttaacaaaagccatgaattctaggataccttcagaaacttctttaaatattatatattgaattttaggaggcagctgggaccattcagagtttgaccactcggtatgtatattattacatctatttctttcccctctgtgctacctgcacatggatgatagctagtaattacagagccaagagagtaccccatctcaaactggaggacaggacttcgatgggcatttaaaaaaaattaaccatatccctctgctcatcctatttcccttattttacctttgttcaagtttcctgcacaattattttgtactgtgttatacagaaggtatttaagtatgtatataaaaaataacagaccctttagataaggtaggctaaacatgaattattaggtaaacagtagactgacaagcacatgctatttgaccagtagagaatcacatgtctccttttgctagaaaatcccggagtaatcaagagacagcagagtctaaagaagaaggaagctataacctgaacagaatatgctcttcggattgatcttcactctccccacaattcctgacaggaaatcaggccaggctagcacgtttcctttactgagttcctctgggcatgaggtggccagcgatttcacctgaaagtttacaaatccatcttttagacaaacctcacttgtttctggaagacagagctattatatcttaatctggtcctgctgaaaacattcacaggcttgtgaggggtgggggcaggaagcagagttttggatatagggagtgatttcaggggcaaaggaaaggtctcttccttttctctctctcccctccacccccaccattccttttaccaaatatttcatagtcgctggaaattctacatatagaatttcttggctaaaactgtgcagtttgttaaggtgttgaggggcacttcctctctggg

SEQ ID NO: 61300 - DNA, 1277 bp, Bovine  19866881823821
tcactatcaaataataaatatatgttttatatattgattgacttgtatatagtatatgctatatatttcatattatatattgtatatgtaaaatatacaatatcctatatgttatatactatatataatactataactatatataacattataattgtatataacattatgctataaatgtgttgttcagtcactaagctgtgtctgactctataattaatagatgtaacacatagtatattctatatttttacttgaatataattttgtaattaatgaaaatcaattgtcaggtaggtcactgaggggtcagggaattactatgcttactttaacttattctgaaaagacctctaatgaaggttgacatttcaagagctcttagcatacagaacttggcaaatgggtcagaacttggcaaatggtattggaggggaacacataacttgacaggaaatcaaaaatgagaatgtggaaacattggaatgaaagggtagcaagaagtttagcttgaaagaaatgaaaatgttttaaggaagggtagtcaggtgagaattaaaagtgggggattcagtagatactgccttgataaatgtgcagtgagctatatgatttgcataaatgaatgggtctgaagcttggcatttacaatagaatttgtattttaaagctagaaggaaatatggaaggaaaaagaacctttcgcaagcataatgagcataatgcttttacatggatttttaggggagtcagcagctctaaagccagacaaagattcaaatctctgctctgctacttttttcctttgtgaccctgggcaaattaacgttctgagctctggtttcctcatgtataacatggggagagaaaaccttcctatgcaagggctttttgtgaaatataaaagaaattctcagaagtccatggaatattgcatcgactatgtgaatgttaatttctgtatccctttaataattgacaacattgaggctagagattaggtgctatctttgaaagtgagatttggccaaatttaggtgtccttttacctgtctgattcccacctccttcctccccacttacactttgttgccactggagtttgactggacctctgctaggcctggacgcaaatggtcatgccaggtcactaggcagtttctgggaaggcaactactcctttctgtttcctagaaaagcccccaaactagcacttgtgtggaggcagcaaggcaaaaagacaataaactattcctgatgatacagactttagtcca

SEQ ID NO: 61301 - DNA, 1555 bp, Bovine  19866881875609
gtttaagaagaaaggctggaaacaatatcacaaaattccttttagaagttgagagactcatggaataaatgagaaagatgatgaacaatggagcataatgcaatggttaactgggaaagaacatgagaaaaccagtaagactcactaattgtataatgttagctgaggtttcgaatccaggaaattatgttttcactggaaaaaaaacaaaacaaaacaaacagcaacaaaacatggttaattagtgaataagagctttgaggcatttgatttctaacagtcttacaactacctaaatttaaatgtttagaatcctattttaaatactcactgagacattcatttgaataaaccccttgttatctgcctccaacatcttagcaatatatggaaaagaatatatttagcatatatctgggaggtacctatcacttttatcttcttagttattaaaaacataaagataacccgtaagtttataaactcctggtgagagtttaccataaagtcatcataaagtttttataaaattagtttttccaaaagaaactcactcacatagttacactgctggggatgaagtattatcctaagatgttatctctcctttcagacaacataaaccaccatctctcggacactgaagagacttatgactatgaaaaacgaaaagcaattctgagctggggaagcatatgggtgggttcccctctgagtttagaagcccctgtggcaggaacagagaagaggtcacagaaggcagacgccatgcagtgcaaagatgactcttgcacaagagaagcagcactgaccagaaccatacattgtcaaacactggttgagaatgatttattaaagtccaagtagcatgtttttaaatttcaaatagtccacatcttcaaagtgtgcatgaataaaagtccaagttcatttctttccttcctctacaaaaggctctatattgtgcataaaatctgtgcagatgccttctgctacctggttccccatactccttctggtttgggcacttgttaagtgtgctctctgctcaaatggtgaccatacactgacttcctccttcctgaacagacattcttctcctggacatctctctcttaaacgtactcctaactttcccacacctgcttcatgactgtgactttactggttacttattactacaaaccggtgcaataattagttgggctggacggttaaataggtatcacctaacacagtggggtggccctcaagaacacacagtaattatctagtcacatacagacacattcaacccatttgctacagaagctgtttaatatgaaggtggtcctttattcattcgacatgttcgatttctttgcattttcttccattccacattaaagttgtggttaccaagagccgggtcattgttgctcaaatgaaatctggaattgctaagcatattaagtagggtatcctggctgtttgtgacaacagactgtttctagtccattttgttatataaaaaagtcactctcaactaaagtaaccactgcatttcctttgtaaa

SEQ ID NO: 61302 - DNA, 1192 bp, Bovine  19866881887444
tctgagaattcctgattatacttagagccagaggagctgctgacacaaacagtcattagcagacgacccttttggaacaaactatgctttaaaatgtaaacggtggaggcattttccttgcgttgtccagaaagaactttctgctgcctgagcctggattaatcatgagagagttcgtcaacattccactggtacatattcttactttggttgccttcagcgggactgagaaacttcccaaaaggttggtttcagcgctcttgtctcctgttgcctgtgacagttctaaagtgcatgcgtgtgttccgatcatgactgattcatgagggcaggcttgggttttacttggtgaagtgggggtgtagtatatggagagagagaaagctatataaataagcaattgatggatggtctccattctactgctatccgtcccctgcttaagctctacaataaaaagtttagccattcagtgcatacagagtcctcactcgtaagggaaacattaacaggtagactgcaagttattgaggtcagtttgtttatgtttatgtcaaacttcagggtggtctaaagggatgatgaaaacctttttacatcaggtttgccaggaatgtatcaatcccactcccagacatccagagtgtttgcttctgaacaaaaatcacttccattttcagtttcagctttgcaaaactcttaatcaatatttgagttctgcccaaataaaaattagagaaagacgcacacaagttgcctataaaagtctgaagaacaacgggttctccataggaggctggagtcatgatttggtttggcaagagaatgggaaaggtttttttttcagaggctttggaatgtaccggaaataacaccacctcaggggaaaggaaagcaacttaagaaactgacaaacacctgttgcagtagcaagaatgtccacagtttctggccagcatattatgaaactgagactagtgtatttcaaatcaggaagaaagacaggaaaataggtgatttgcaaagtgactgagcacttcactgaagtctttttacaaagacatgagaaagcaaatggaataacattaaaaagattctgattaaatggacccgttgtttagtagctcaggcatgtccaactcttttgtgaaccagtcaggcttcctctgtccatgggcttctccaggcaaaa

SEQ ID NO: 61303 - DNA, 844 bp, Bovine  19866881896542
aggctcttcccctggaaacgttaacccatctctcaggtacctctgtgacaacgggctttaggacagacctcgtggcaggatagatgagggccagagaaatatgaaacatatcatgtttcatagaaagttccatttgctaagtgctcattttaaaatattttaccatatttggagtgaattcccagccattggtttcttacaagcattggctaatttcttgtttctttatcatgcatttcaatatatcaggaattgggatttgtcttacccagcttaaaggcaatcctacctcatttgtggcttctgccctttagctaagaaggttccttagctgtctccaaatatgagaatgaatatacaattatagaacaaagataaatcaatcatatttcccagaaagacttccttatatttaatttcaaatattgcttctgttgcgatcacttcttttaattagttcctcacagaggtaaaaatatctttttcaccagcataattccatgtagcctcacccccacttgccacctctgaacaaagattcttactgcattagttttgtttgattgaaaatggacaaagtaacttctcagggccctgtagaaagaattaccttctaagtcaagagacagtcttgtctctctttccaatctacttcatgttctatcttaggcatgtgagcatccgaagaatgattcatatcatttctcctatgtgtctttaactacaacagttttcccctgagtactcccaagtacccagtatgcccgagtactccagagcactcagtactcctgagtactcagtggcagagcgataccacccttgaggtatgatgatttgagtg

SEQ ID NO: 61304 - DNA, 1214 bp, Bovine  19866881999712
ttttgaaaaatttgctttagtcattctctgagggtagatgtgccggtggagaatcctctcccctttcctctcatttggggtctctacccccccttccctcctgaaggacagtgtcacgagctacagcatgtgcagggtacattcctcactgccagcacttggaactgctgtgttgggtcctctggtctccacggcttcaggagaaacgctctgtcctttgaattggtctctcccatagggaacatgctgcttctttctcattgctttcaagacatttttcccccttagattttagaagcttagtgatcatgtgtcttggcatgagtttctctgggtttatttcattggattttctctcaacttcttgactctataatctgatgtctttggtcaagtgtggaagttatttcctcatctactctttcagcccctctctctcctatccttccagggcatcagtatgaatgctgggtctgtttttattatcctgcaggtccttgaggctctgtttatttatttttagtccatttatctctgcttttcaggttgagtaaattttgttgatttgtcctcaagttcaatttactccttattttgagttcttaatctttgttattatatttttcagttctctaatttttatttattttttaaatgacttgtgtttcttgctgtaatttttgtgtcttgtttttagtttctttctatcatttattttaagaacatctatcattcctggttgatgacgtttgtgatgctgcttaggtaattggaatatctaattcatcttggtactggcatcgactgattgtcttttctcattcaccttgaaatcactacatgtcaggctattttctataatcttgaatattttggctattatttagagacatgcagggtcctatttaaatcttttattttagtaggcagtcactttgtttacgctttgacttatttttgtgggctgtgaatccaatgacagttgcattttcagagactttgtgatgctctcttggtctgactgggtacttctggggctcttaatgattgcttctgatatgtcccaagaggccagaggtgctcacatggcccagggagctcagtgcctgtaggtgctgaaagagaggacaaagtacttcctggacagggccctggggtgggactctcatcagtgtcagctgctgtcgaagggttctccagcccagagaaggcta

SEQ ID NO: 61305 - DNA, 1700 bp, Bovine  19866880362492
ctcttgcctggaaaatccctggatggaggaacctggtaggctgcagtccatggggtcgctaagagtcagacacgactgagctacttcactttcactttttactttcactgagcgacttcactttaactttttactttcacgcatcggagaaggaaatggcaacccactccagtgttcttgcctggagaatcccagggacaggggagcctgatgggctgccgtctatggagtctcacagagtcagacatgactgaagcgacttagcagcagcagcagcagcagagttgtttctatgtcttggttattgtaaatgatgctgctatggacattggggtacatgcgtcgttagtgttttctttcttttttttttttttgacatgaacctggaagtggaattactagatcatgtagaagttctttctttagctttttgaagactctccataatgttttccatagtgattgcaacaacttacatttccaccaacagtgtacaagggctctcttttctccttgttctcaccaacatttgttatttgtagataggcattgcaaaagtgtgagataatgtctcatcgtggttatgatttgcacttgtctaatgattagcaatgttgaatattttttcatatcttctgactatctgtatgtcttctatgaaatatgtctgtttaggtctcccattcattttctaatcagatttttttttgcattgagctgtatgagctataaatatatattttggatattaaccccttattggtgatctcattttcaatatttaccattccctagactgtattttcattttaagacattatattctgcagtactatacacaaatcccttcaagttctttaatgggttataatattaatagaaaacacatcattcctcagttattatttcagaaagcaaataatttttaaagtaatactttttcaaatacttgactaaaaaataggctgactacatttatattaaaaatttacttatctcttaactatgattttgtgtaataaatatatattttaaagtcaggtgaaagaggttaagtcttggtttatttaaaattacttttttctggtgctaaataggtttagtcagcaatactctctgtgtgggtagataaaataatgaatatttcattcaaatataatgctgaaattttcactggctttcaaaaagcatcaaattttggcttaaagcccagatgtttcttaagattctagccagtaaaatctgtttgaaatagtgaggcaggatggagggtaaggaagtaaccaaagtgcttgatattataaactttgtaatttggctgataaatccattacttgtagttatgtgtagcacctatgaaggttttcaaattatttaattatgacaattaataataaaaagtacataatctctaagagaaaaatgttttaaaaacaggttcgatgaagtaggtaagtagataatttgcaaaattttaagtccttcatctcagtctcattaatagtcacagaaagacctctggtaaataatagactcttgagataatgaggttctttacttcaggacaatagagcaccattggggttactcttttaagccttattttctatttggattagtttatctctgataatttcaagtctcccttgggatcaggagaggaagcttaactgaggataataactgtagaatagaatatg

SEQ ID NO: 61306 - DNA, 1357 bp, Bovine  19866880405039
ttttggcctttgagctattctttatgaactgtttaagatttttcttacatagttttgtcaatataatgttatagcagaaagagtgacaatgttaaaaataggaaattatttctatgcctgtatagtcatgcacaaatctttgttctacacctttgaactaaaactgtgttcttggcttacctaaattttgtagttacaaaaaaaataaagtcttctctgcaatttccccttttatatgtgtatgttttcccaatgtatcaatggatgacagatattctttagatttcaataatttaaccatattttctattaaatcaacattccagatatactatttcattatcattttctttctataatattatacagtgattttacatctatataattaacttctaaattctctgattcccaatactatgaatttcatgattatacattgaactaaactatctttgattgtactcaatacaaagctttgtaagtaatagtgatatcactatattaattatataacatttaatgttgcattttaagtagtaagattattgcattacacacatactggttagtcattcttaaaagctgatatttgatattttaatcatccatggtttctaaagtgcttttttgtagtacctttaaaatgtcagggtgaagagcatactgaagaaacacttcctttatatagctaagatttctgttcatgcaaatcgtgctggcaaccatatttgtacctatatggaagcaaatgttaagagaatacgatgccaagaagcagagatgggaaactgggccatggaaacttttaattttctgtgtccagttatctcttgttccagatgcattcggtctttgctatgagtagcctacattttccccatatgttttctgctacatgtatgtatttgacaataacataaagaacatttgctatgggccaggtaccaacaaaagcaattattgacccaagacaaagttatgaggtagatactgttatatctccaatattacagataaggaaccctcagagaatttaagaaatctgcccttttcagttatctgttgctgcataacagaccacccaaaacttaaaaggacagctgtttatttgcctatgattctgaagggtcagtactttagtctgggctcaactaggtagttctttgatcagtttcacctgggatcactcttgcagcttcgaacacctggtggctgtactgggcagcacggtctcaaatgggtgtgtatatataattgtcagtcaaatctggctatcagctccagacctttgttttcctctgcacgacagccacccctagggggctagacctagttttttgtttgtttgcttgtt

SEQ ID NO: 61307 - DNA, 1597 bp, Bovine  19866880489732
atttttttaatcccccttcttaatttatatcattatgccaatatttcttttcatttagaacaattttacggagaagacaatggcaccccactccagtacttttgcctggaaaatcccatggatggaggagcctggtaggctgcagtccatggggtcgctaagagtcagacacgactgagcgacttcactttcactttccactttcatacattggagaaggaaatggcaacccactccagcgttcttgcctggagaatcccatggacggagaagccaggtaggctgcagtccatggggtcgcacagagtcggacacgactgaagtgacctagcagcagcagcagaacaattttatcatatttttctgcattattgtgtatttactttttgcaagtaccctgggatgtgtgggtagaatggagtaaagaaatggggaaaaatattggcttaagtcttttttgttgaaaaacaatttttggtaggctgagttaggactataatccaacttcctttacacattctctgttttattcctttaagcttgaaatagtttgaaaaacagaagcaataaactaaatgtattacaatgcaatacagataaatatttaaatcatttaagaataatttgaatacttctaattaaaatagtaaacatctatttaaaatacaaaacccagcaaattatatgcaataataatattaacaaaataatcttcactaccattcagcctcttctgtgtactgatacacaaatagaattttaagaatgactgacaagttgtttttcctgggacctccaaccatgaatctgtcatgtttattcttgttcaaagatagtgacagcagacgagaagaaattgaatggccttttaaaaaaataaaacacacatgacagatgccatatggcttttcaccaaataactgggttggatacatttagaaagaatttcaaaaaagaagtggaaaattattgcacaaatgctcttgcatttcaaacaaatatacaataaatattgtagcattcagtgacctgacataatcctgaacaataaagtataaactagctaaaggaaatgatacaagcttaatgataaaactttatattaagaaatcaaatatgttaaaaagtacagagacaggcgtaatgaccacagtatgtccctcacccaaatttaaaatttttcaactatggtcaacatccacttgcccatgttgtcccaaacctaaattaccctgagacaagtccaagaaagcatacatttacattattctatcatgtggttttaaaatgtatgtatgatatttaaagtaaaataaaaatatcataaagtatttaattttaaaaaagcctctataaaaattctatagagttggtgatggaccaggaattctagtgtgctgcagttcatggaatagcatagagtcagacatgactgagtaactgaactgactgatgagattaaatatgaaaatatcaatttaaataatggagattttacatatttaataattcatattataagaaatatatttgataaaatataatgcattatccttgtaaatcactttgtaaagacaaatcattacttttttttaaa

SEQ ID NO: 61308 - DNA, 1261 bp, Bovine  19866880530370
cactatgtcataaatctattcatctcttcaaaaagttttcttccttctctttattattcttattaaaaataattaacaaactatatagtgtttatatgcattaccagtttctttgatcttacctcacatggaaagaattggtcagaaatttccgtcctgcatctacacattgaggaccttggctccttcagaattcctcttaaatcatgtttaggatttagacatgtagagggtgttttacaggtgtttgaatatgtttcccctgagtgtgtcttggcaattgctattgtggcaacttttcctactgtgtgtgtttgtaattctatgtcagcaaggccagtgtcactttttcactgagtacctcagtgtagccagactctgctctgcttgacaagtccacttgctctcctccactctttcctctgttctgcatgatcactctcccactctgctgtgtagctgactgtcccttaaagagcagtgtgaggggttgagattaatagcactttaccttttcctttggttttattacaggattcccaaagtagggcaatttatgccccagtcttcatgaatacttataacactctctcataataggaccctcctggacacccagggtcctgatcctttgaaacaactggtgtgacaaacaataggatctatgacaaattcttacttccagtaataagtaaagtttcacattgggttaagcctattgtgcctgggattcttccctcagaatgatgtatatactcagtttttatacaaaaggatcaaagtctcagtctcccagatacagcaagaaacgtgtctgaatctcaaagtttgatgtgtgtgtgtgtgtatagtatagtcagttgtcttgtgatacactcagtgtgaatcaagagatgtctttatgtagtaaaattatagagattttacactactataagaatttatcagtcaaaaaccatttaaattccccctggattcagaataaagattacaattagcagcacattttgggtaatgacatctataatgccacagccacagacagcctgccagaatgtgagtagcttgattggagccattcattgcctggctccttctataccctgcagagcaatttgcctccttaaataaccatcccctactgctaaaagcaacaatgtgctatgcaaagtaaatcaatatataaatcatttgcttatatcaacaaatctttaatttccctcatcaaaagaaatttctaataaattttaattgagatctt

SEQ ID NO: 61309 - DNA, 1061 bp, Bovine  19866880572139
aattatctaccttgcatattcgaaattactctttacaaagctgccttttacagtgctttttccatttgaattatttgacaagataatccatattcatgctgaaaactgtgtgaaaagtacagaaaaaaaatgaacaagtaattaatttagaggaactaactttcaccaaataattgatatataaatttgtgattattgcttgataattttttatccattcctagtgtgtttagatatgtactatacagaataaattacaacttttgtaacttttataacttgtaaaatactctctttatattaaaatgtgattgtaggacttccagttttagctccaacctgtataaaacttggaagttatcatgccatcattatagaaaaataactgagcaatgtgaaaagcagtgacttttgttagactcatcagagattggaagtcagtggaaaaattataatcagtactttggggaggcaggcaaatatagttattagcagtatttatcaatttacctggaacagaagcctctgaagtcttaaactgggaggaacacatagtcatttcaacaaaccaagactgagtgtgaactagcttgagaaagagaaactcctggagccatatagtccaagtttttgtagatgttaacctccaggaatcctaccagtttctcatgttgataatccaataaaaatgtccctcatgttttgggcagagggaaaggaaaataaaatattcctggtgtattctccacaacaaagactaccactacaggggaaactatattactagagagttttaacaggggaagaagcaattatgtagcttcagccacatcccccatacctctcagccttcctttcctattttatgtaagaataatgggaaaaaagctgaaagatacttgtgaaagtcacagtctggggacccaggcccaccaaaagacagaagtgatcagaagattggagaacagtttccctctgcacaccctgccatcattcatttcaacagggctggaatataacagagaatcacaactaaagatctgcaagacacaatctttatt

SEQ ID NO: 61310 - DNA, 874 bp, Bovine  19866880922462
tatgggattctccaggcaagaatactcgagtgaattgttgctttgcaggcaaattcttcccccatttgagcaacctgcactaacccagtccatgcaagcacagataacgctttctgtttggatttgcttgtatgtcatatcctctaatattgttttaaccaaaagtgaatcacatagccaaatgccacgttcacagggtgggaaaataaaaatattcccctaaaagggggtgaggatgattaatattttctgaataacagcataatataccacattatgtaagtatgactccaaaagttggccacattttccttgtgaaaaatacctacaatgttcagatcatgttgttcatagaaaaaattaggaaacgttttatttcaaaaacatttgtttatgttttccccaaacttaggctcttttgatttcaggattctaataagattttgaacagctttttataacttctttgcattgctctagcttgtgacaaagaatattaaacaagttgtttgttagagatttcaacacataccacagttaggtctactactaattagcattatagaagcagaagtgctgaagttccatagaagtgttatttatggagaatctaagtttcttgccagggaacttgtttactattaactgttctttacaggaaaaaaaaaatattgctatagctatatttaatgagaagcataaatcacacctaatggaccatgactcatatccccatcaatttatgatgctaaaatgtggacttagggaatctgtctttctataactagttcagatggggagaatagctttcattttttaaaaaactgcagcaatggaacattatatggtctttgttctatttgatttataaata

SEQ ID NO: 61311 - DNA, 1447 bp, Bovine  19866881228640
ttcagcttttaattttatattggagtatatttgattagctgtgttgtgttagtttcaggtgtgattcagcaaagtgattcagttacatacatgtatctgttctttttcaaattcttttcccattcaagttgtaacataatattgagcagagttccctgtgctatacagtaggtccttgttggttatccattttaaatatagcagtgtgtacatgtcagtcccaaactccctaactgttcctcctccccaccttacccccagtagtttagtattttaatgtaaccatctatcaactaaagataacaaagtaccaaaataaccttaagtgttgcataaaacaaatttgacatttcttcttactacttatgatactttttgtctctctcagttagacaaatcatggcacttccatcttaatcctcctatttaactgtaaatataaggagcccaacagctcagccaggttctatgaagagccctcactctgtgctatgtgagtcacatattataggaaattgaagacctatattaaagaccatctgggcctgtgggtataacttttcctgggtccaaaatgggagataacatggacttgtcctttgatgccactgccttctttcctgcaacatctttaaaagcctatatttaaagtatttggtttaaaaattgattcaattgaattaaacatcaagggggagacagaagaaagaagatagggtaaagtataaaatcctcaaactaacctgagatatattctgcaacaaagatgtcatgctgacgggctggttgattagaacagacattttgagttcagtgatccagcagcccttaggaatcctgggagagagctgccaattctgagaaatacatttttttttttctgtttggttttactgattagttgaaacagtattgccgaggcccaaatttcagtcatatctttattgttgctgtgccattataacgcttctaaggtgtgtctcttcccagtcttatcactgatgcttacctcctcatagtgtcatgtgaggagggaccacagaagcaccagatttccgctttaagaaaaccctggggcttcctgaacagctgcttctcaaagctgttgatttgcagtataaaaattgatccaaatggtttgttctccatctgtctcgtggcctgctcttgctcctccaattaggaggtgctagttagctctgctggtagctcttcttttgctgttttctcaataagcggaattgcatgttgaaggtattgcctctgatcagtctagcccctctgcatttgaccaggggaacacataatcaacaataataacaacataaatttctaatctatacaatgtacatcatccttattctcatttttggacataagagtatctagaagctttaaaaaaaaatttcagtgcacatgtggatggagcataaaacagatccctgag

SEQ ID NO: 61312 - DNA, 1459 bp, Bovine  19866881366965
tctttgctactagcacaaactgggaagccctgaaacactcataaattctctcaagcatcgaccaagaggaagcattttgagcagaatttgaggagtgagtttaaggtccaatctgactttagccaaactaagttagcatgcaattatttagtctgatccaataggtgatgattttaaaagataatgttttatgttcttaagcaagaactcaaatccagcatttattaatactttggtaatgaagttgggaattgggagttggtgatggacagggaggcctggcgtgctgcagtccatggggtcgcaaagagtcagacacgactgagtgattgaactgaactgaattgaatgaaaataatatttacttcatatgatttctatgtacaatcataggaataatatgtttaaaacagaacaatgtcaagcatatagtaaatattaaataattagtaaatgtttaaactgtaattcatagatgacataaatgctataggtagtaagtattctgatgtgtgctagataacaatagagagatttaaaaaattaaaaacttctccaagagtgaacatttcagaagtctagtgactgatccattttgtagataatttgtattgacttacagaaagctagtcattagataataagtctgatttgtatgtaaaataattgtatgtttctatacaaatttgccacctatactgtagagaacaagagaactcaaagtttattttgaaataaaagaattagcgcctcaattctctcacctttcaatattcacatatacagggaaagtgatttgatctttagagtagactatatcttatatatatatatacatatatatatacacacggagagagacatacacacatatatatatgtacagtaacatctctttaagttttttaagcacaattaaatttcatacatagatacacatttacatggggtccgcatgaaaattgtttaaatgacattatacatttttaaaaaatgctatacttagggcttccttcacagctcagtcagtaaagaatccacctgcaatgcaagaatctgcctgcaatgtaggagacctgggtttgattcctgggtcaggaagatcccctgagaaggaaatggcaacccactccagtattcttgcctgagaaatcccatggacagaggagcctggtgggctacagcccagtgggtcacaagagtcagacatgacttagcaagtaaaccaccaccatgcttatcactatggtttaggcttgactgctacctaaaggagacaccagctgagatacctatcttcaaataaaaaactgaaattaagaaatatagatgtactctcttgcactgtggtgggaaaacattcgtttctttccagtggtgtggaacaagagctgtgtacatccaaatttcacatttagcaacattattatggttggcttcaacccagcaacaaaataat

SEQ ID NO: 61313 - DNA, 1578 bp, Bovine  19866881383589
gtacagatatacttttaatatattttatcttttctcagttaaaagatatttgggcccttccattttttggttatcatgaataatgctgccataaatattcaagtacaagtttttatatgaaaatgttttcaattttgagggtatgtacataggagttgaattgtcaaatcatatgctaactctgtgtttaacttattgaccaatctacaaattcagtgatttttctcttctgtctgctcaaatctgctgtttctttagtaattttttaaaaaaaaattagcaattaaactttacaaattcagaatttctatttggttccctgttatctctttgttgattttctccatttgttgagacactattctcattctttaattatttgggcatattttctttagttctttatcatattctaaaaatttgattttaaaaatttgtctagtaattcttatgcctcaacatgctcaaggacagtttcagttgactgtcttttttctcctatgtataagcctatatatttgtttgtttgctggtttggatatttttcttaatttttcattgaaaactgtacatgtaaataatataaagtggcaacactggaaattatattatttgtcctgtccagagttgctgtttgttgtttgtttctggatatgattctgtgttttttgtcattcatggacactgatgtgtttgattggttagcttaggggtcagctagtgtttccacagaaattttcttaaatgcctgaaatcagtaattcaaccaatctttgtcaaggggttctgtacgtgtacttgggtgtgtctttacacttcaccaggaattttctttactttagcctttacttcttaattgagcagaacctcaagattttatctacagataaaagtttaaagcttcttaggtctttcataagcttgtgctctcctactatgcacatagtcctatgactgcaagtggaccttccagattctcaggaatattacagtgcacttctaagcccttataaatatctcattctccacctctccctttcaagtttgtctataatttgctatagaagctatccactgctctaggaagccacagaattaaataattgacttcaatcgttattgataattatctcatggaatatgtttttgaactgggtaaattctgagtcaggtcaaataaatcagctgaaaaatcagcaagtggtttttcccaggaaatttaaaataatgacaactatctgagaatgaggcctagaaaaaactttcaatcacattctgaaccctcaggtagctgccaggctacagtcttttatcttgggactaataaaactatcttgttagtttttaaagctactgcacaacctggtaaaaatgagaatagagtcattaaaacgctacaaactgtgctgttcttacagagattcaaccattttcttgaactaaaagcttcccattgctgcatgccttttgccaatttttcagaagtctggaaaaagttaattctgaaatttctgtgcaggtagtgtcatagattttatggagagaatttccagtggtcttcactctgccatttcccag

SEQ ID NO: 61314 - DNA, 827 bp, Bovine  19866881885775
gtgttaagagaataaattattaagcgataacccctggccactcaaatatttttacacattttgtacttccctagctagtctccatactttgattcttgatttttaagagcttcaaatttcacagaaatagcatccaagggaagggaggaaaaaaggtgagatatttatgtcaaaatcagtgtaatcttaaaccaagaagatatttaggtcttcccagtggctgctttacttgtgataggatcctctccatttaagtcagctcaagctgttcatgaatgcatcctctgcaatagcaaatggtttctccttttaccagctgtggctacccactaacttctgctttataaaaaatgctttgaatctgaaataaaacacacaattagaagtttatgtacatagagtacttttattcattgcatgaactttctgaagtattatatacaaaatggtatcttttctgaattcaagaaaatgtaaacatatgagggttagttaattactaacagggtaattaagtagctgtatatacccctttgcagatattcatgtaactcacagttgaaaattcaagcctgtatttccattaaacttaagagaattgttaaaaacttgattttccccttaacttcttttgcaaggaatatgcaatatacagcatgagcatatttaagtttatttgaactgtttcactttatgtgatgatttccactatagtatcttttctaggatgttcattgtttggtcacaagactttaaaccatttggagaaaaaatggtttaaagtaaaatatgttttgtgatgcagataagtttcagtcattctacta

SEQ ID NO: 61315 - DNA, 2787 bp, Bovine  19866881142520
tttgctttccgaagactatggcacaggggtccttgggaacaagtagatatttggccaggaaaaaaggtcagaccaaatagggctgctccaggcttacagggatttagcagccagagttgggctcaggctgccccaggctcttgctctaatttagtatagactttagagaacttgtctcatgttggggtgtgggggctgaagcattcacatgcaaagtagtctgagcttccccaaacacgtttacacaccctacaacaagctttccaaagtctcccatcttgcagcagctgagctgtagttaaagctgcaaggctcacaggatcaaagaagccaggaagagacaaagcaagtaagaaatcccagaagctaatctcaatctagctttctccaatgtatctggttggccaaagagttcattcaagttttcccataagatgttatggaacaacccaaacaaaatttttggtcaacccaataggagaaacactcatataactgatatgggatgtagaaagctatgctgaaacaagctgggtcttctgctggatttttcatcaaataccaaaggaaaacaaggggcggggtccactttatttatttatttatttttaatcctcagttattctattgtaaagggatatagctgaacagataggagacagattccccattgtgaattttcctgatggcttctgcaaggaccatggagatagggattgcctgtattttgaagcaatgcttcatcttatcctcctgaggtacagttttggtgactactactgcttcaaagcatgcattgttaatgtgagaaatggctggaacagaaaagattccatgagtcagcacagcataaacacaactccaggggagagaagtttgtcagctgcatggcagattgaaccacaggtgtcagccatgtgatccactaggagagccacccaggccttcacgtcgcccaccagcaccatgcagtccacttcatcagccttcctccattctccacattcaaccagtctgagacaggaggcgctctcttagctcctccggcatcaggtgagatagtcatggagttcctccacttagacatcttctctcttatccacttaaggacggctgactctgcaaataaattttccactggaaaatcaaaagtttgaggagcatgcaggtccctggtggtactatgacccttgtctactacagagatcattttgccacaagcttggctaatattggagcccagctcttatccttcttattcttccagacataagtaggaagcacaggcttaccgcagtaacccaactggctgaagcaatctttgcaggcattattcataaccaaaatttccattcaattaacttgatttcaccacagccactctgaacaatgtagacatcctttccacgcactttttcaccgatttccacataggtctgattgctgaatttcacagtcaccgccttgactagccacaggcccagggagggcagcagtcttctgggataggtcctggtgggagctgctgaagattttgatattcggcatcttggccaactaccctaagccctctttgcttagtgatcgctcctgctgccgagacccaaatcaagttggcccagagactcagtactaggcacttgaagttgctactctgtcatcttccattcctgccttgtgtgcaactctaaactgtcccaggattagacaaattaagactgtccagtctgcttcctaaacacctctcagaaacattccctcttctggactctcaaaatctcttccttagttcaagtctcaccattttccatcagcatcatgatgacatcccctcaaccgattggctgtctgggtcttactctgctctgctgaaattattctttcttaaaagtaaatatgatcacattacttttgctaaaatctccatcagtttcccaattgtctccgaggaacattccaacagcactgcaccatgctcaggcttctcctggcctggcccagtctcctcggcccacttgtcttactcctgccttcttgccctgaaaactcatcccgctcctctctgctccatccacctacccagctcccccagcctccaggcccttcctccctgggctcctcacccctcccatccttccccctccccctgtgctacctgaaaaccttctagatgagcccgtctcccaagttctgctctttggtaagactcgcatgtggttatatcctcttggaaaggcaacctgtaaaattaacatgcatatatacttagagtctacttctggaaattgttctgtattacctatgcactcctcacgtaagtgctcaaagatattcattaaattatttgttatagcagcaaaaaacaaaatataaataaataaaaagggggataaccattctgtcaataggcagctgattatgtataagcaattaatcataacaataaaggagatcaacacatcctgatataacatggtcctcaagctacttacctaagtaaaacagtataatatgctgtggggatgttattatgtgacacctgtactgatattcacaggtagaccctaccaacggcttccctggtggctcagctgctaaagaatcagcctgcaacgtgggagacatgggttcaatccctgagttaggaagatcccctggagaaggaaacagctacccactccagaccctacaaaaggtggggcctctgagagggaaactcaaggattggaaagaagacttacttttactctaaactattttggagctgtttctatttttttctgtttg

SEQ ID NO: 61316 - DNA, 814 bp, Bovine  19866881232508
cttgaaaaatgtgtccatgcagaggaacaacatcacatgttctatgtacagtcaggaatctgatgacttccaagctccgtctgctctgctgcctgccttttaatattagggtgtctggaacagatctgtgggggctgcccacatgtccagttctgagacttccccatctacctgctgtgactttggcatacaccgacctctaacacgtgtgttttagagtcagcgtggctcaagcctccaagggccagagagaagcagacttgggaatgcaaagctcccttctagccagggttgccaaacaagcccctcagtgaacactgaaagccgatttgctattcaaatgccaggctggaaactggcgggtacttgagagtatctctttgtattatgcaagtagtcacagaggccccagtgttgctggagtgctggcacagacaaatgaggttgtctttgcctttcaactgcagtgggactgtgggtggccaagctggtgattgccaaattgtattacaagtgtaatggcccctgtgccaggctgtcaattcacccaggtacctctccaggacaagtggcttggcaacctgtccaagttccaatgaagcagccagtgcaccctgaagtcagggtatggtcaccaaccaggggctgccattgttttggaaagctggggctacctggaagcaccaatggtggtgacattgtgaggggagagaatgcttagagaagctactcaggcaaaagagagtggtaaatgctccagtgtgggaacagatcaacatggccataccagtccatgatgtaacacacaggaaga

SEQ ID NO: 61317 - DNA, 836 bp, Bovine  19866881516268
attatgtgctcctaaaagagaaggatgaagagggataaaagagacataaatgggataggaggttgaggagaaaagaaaaggcagtatatacaaaggaaagatggttaagaggccaatgggaaggaagacacagaaaaagcacaagtcacagaaaaggtagagaagagagattaagatatagaaagtgcctgtgtggatggccattgaagcagggtgtgagggacagaagggtttattttgttcaaaagtattaaataaactactgtttccacactctgctttttcttggtaatcagctttggagcctcagcaactttttagcgttgttatctaaaacaccagtgagtgaatttgccattactcaaaactgtttatttttaacatttatgagtgccttctctgaatagaacagtccaccacagtaaaaaaattcactttttgagctgcctcagcagtattgaaggcaacaagtaaattgtccaatgtcacacaaatagaacatagatggggtttaaattatttttgtatgttctgtgctttcctataacacagaattccatcacatatatttaatctgaaagagcagataatccaaaacttattatatatcatatattaacattttcaataacagatattgcttctcaattaaatttggcaggatagtattaaattagtttctattccccaagcacacaccaatggcaagtgcagcccacaagtgtgctggaaaccaaaaagtaagtaactggggtttgaaatctgctgtggagaatttacagagtggataattgaagttgattctaacttgaagttgatgctccctgattccctgt

SEQ ID NO: 61318 - DNA, 868 bp, Bovine  19866881888121
taaatgaactaatgagcatgaatcagtttcaggaacaatactgaagcacaccaggcagtagtatctttcaagatacaaaatcctcagaaattcagaaaaaaaataagtactagaattatcaagataggtttcaaggagaaaaatgtcccaaagattagtgatgggagtggatataaattgagatgggagaaataattctcttcttcagcctcacaaagttggaaaactttttattatataataggctagagaggactcagaacagtgttctatttctcagatatggaagaaagtgattgtgaggttaaactcaccatagaagatgaactttcagcctgaaaaaaatagtcctccataaataaactccagtagaatctaggccaagggtagaaaaagcaaagcactatggggaaaaggagaaaagtggatgacatggatattgtcctagaacttagtatctagtactaaagttactggtttgtcactccttcccgcagtctatatctccctgtatcagttctgtgaaatcagtgcgcctagaaaaacgtaatgacaaacttcaattccaaaatttaaactgacaagctgctgattcagtgacatttctcagggcactaaaacattaggaaacaaccttacaaagtgcctttccagtaccatcatcattttatttagttattacctggtcagggtgcagatttatattccagccctttctatgcttaaatataaaaattcttcctgccaatgttgccaatttctatttaccagccattgatttttccagtgtgtttctaaatggagcttgaaattaacatgtcttttctttttattcactttcctctatcctggcagcgttaataaccag

SEQ ID NO: 61319 - DNA, 2971 bp, Bovine  19866880640178
aacagagatgcccgcgttactctccccacatcaccctttatggtcacatagcgacactgctgtaaaagcactggcatttatgaagaataactttcatcaggcttagaatgtgtgtaataactgctgcttttaggactctggaagagttcagtagagctaaacttagaatcattgggattttgcgttttaagcattttagaattcaaggagaactcacatggctattaagcagacgtcgtagaagggagccaatgggtatttggtaatggaagacaaccaaaatgagacagagtgagtgatgtgtcatgttttttaggcttgtagataccttgagtgctgtactgttcctttgttaactaacttgattgtgttttcatatcagagacatattttagaacaaaacactaaagctacagttgcgacagaacaaccctctcactcttttacctgtacattttcctcttcacttctgaggaatatcaagttttgtgtacgaaaattttcttttgactttgaaaggaacaccctatctagaatcttttgatgcattaaataagctgcttctgtgataggaaattattaaaggaagaattaccttatacttgataacagtagcttttacacttgatcttagccaaaaggccaagaagcaataataacagtagctttgaaaattaatattttatccagtctagtgagtcatacctaccttttttggaattgtcatattctttggtatccattccctcatttctctctcaaaagtactgtactggttaccatggttaccatgcgatggacatgaacttgggcaatggacatgaacttgggagatggtgagggacagggaggcctgttgtgctgcagtccatggggtcacaaagagtcagacacaattgggtgactgaacacaattgggtgatttttaaaaatacagtgtcacttaaaaataattgacaattctttatgaaagggatgagtaaattattcaccaaatattggatgtggtcttgagctaaatttgataggaaaactttatttttgttattaatataatattctaagaatttctccccctggatatctgtcatcctctgcttttttcctgcttttccaatttgaaataaatcttgtctaaataacagttaaagaacttaaaactgtggttaatcaaaattgaccattcaagtgcaaaactaataatctcttggtccatgagttaaggctatcatgagcctccttttatgaatgctttgggacttgctcccttctcctttgatacttcagaatcttttccatctacttgttttcctctctctcatatttttctctgagtgagtatgatatgaaatctaagaatatctaaaatttttcttctctttattttaccacattttaaacatctgaaaaaaattgtaggtaggaaaacatagtttgacctttttcattttactgctttagtttttgcttccccaggtctccaattttgttttttaacaaagttgttggtaagaggtaattttaaagtatcttcagtgcttcatcttacaggaaaactgggactgggaaaatgttttgtaaaaagatggaagcatgtataaatggatgatgtcagagtatataaattcttttttgtataataggatacataatatcttgactttaatcttaattctattttatattttaagactgggtagtgatttttattagagtcaatgtaacccaacatcttttttttaaatgtgttttttagtgttctgaacatctatatttaagcatttaaggccaaagaaattactgatgatgatacctatagagaggaaggatggatcagttttttctgtactattttttgagtccatatgataacaatatcatctagtttccatgcttggttttataaatacgttagagtctttaactttaaaagactgtcagttttgattgacgtgtttgagggcacataccccttgtaaaaagcagtctcagtgaaagtccaagttctgctttcagactactacttgtattaaagggggaaatttttatgtagttacttgctatttgagaagcaagaaaaagtcaagaaataggaactgaattaaaggacatacttgacaacttttaatactatggaatctatcaggtttttgtggtgtgatttttaaatttttgatgatacaaaaattttgttataattttatggtcatgtttgattttggagatttctggttgctctcttataaaaaatttgaactacctaagaaatattctggcttttcaaacatgaataaagcatttttcaaaaggacacatattgttttatttgagaataatattaacacctcttggtagttaacatcttgtgagccttaaggaagaatttgaaatacatatggagtggtataaggaagttgtggattgaggcctttttggtgcttttcagctatgaaaggtgtctgcagtcaaccttaccattgatagtggtagcaatgaattcttcatcagaaaacactttttgtattatttctgttatatactgattatttctatttttattaaaccaagtactgtcttgattaagtcaagtaagtacagacagtttagtaagttaaaaaatattaaactactactgtctgcctagcatttagcccctaggtatgttttggcacagaacagcatgatatggtcattgcagtaaaggaaatcataattttgtgggggaaaaaggttatgtgtatgaccatctcacctttccatatgtatcatgcttttatatcactacatagtgtgtacataattttttatctttaacattatcataggtattttccttattgtataatctttaatcattatttttaaaaatttgttttaaatgaaacgaatatttttaatggcaaaaggtacaattcacaaagaagatagacatcataaaccattagacacctaacaagaaagatacataaag

SEQ ID NO: 61320 - DNA, 2191 bp, Bovine  19866880652561
ccccccccccccccgccaccgattcctgggttccctgcgtgtcgtccgtctgtaaaaccctttccctgggcaggggtcgttcttgcagtgtctattcccctatcttactctctcttccaactgtgccgccttcatttctctatcaagctccctccgtcgttactgtgtgttgcttttagagcctgcgttgtagcgggaagctgcagtgaagtttggtaccgaaattcactagttttgtgcaactgtgggcaggtcagctgtcttctctgtgccttgttggagccatacatttcgtcattcagtaagtggttctgttttgtgccaggcacccttttaagtgaaaacaaacaaaaacagtccttgcttaaactgtagttggagaggtgacggtaaatacatagatacttgtatatctatgtatatacttgtatatcttgtatatacaagaatagatacttgtcagctaatgataaatgttaataaaaataataaaacattgaaaataggggttggagagtgtgtatgtgaggggaggagttttttagagtgacaagggaaggtttctcagagaaggtgctgttttagtagagacctgagtgagatgaaggaacaaggtatacaggcccgagggaagagcattttggaagagtagagtaagtgcaatggccctgaagcagaaatgatttggattatttcatgaacagtcttgtatagaaatttctgcagtcatttcataggtgtcttgggagaatgaaatgtgcacagagatgatagctctttggaaataaaaagaatttgcatatgaaagtttctgtgataatttacattttcttattagtagtggagctattatttctctattttatccacagtcagcactcaacaaggggcactgaaggaggtggagggattaccctcatggaataaatagcagtatctcaaaattgaacgttctggtcagttaacatttatccggtgcctacttatgtgaagtggtgtcttgggcattggcacatgggcacaaggagcacagggttcctgtattcaagaatggccaaaaaagttttttaactaagaaatacaaataaaacagacaaaagaatggctaaaaaataatgccagctaacattgactgatcctggaattgtgatgaattctttacacagcctattttgtttaattctcataatgctttatatgatgaaaattaatcactttattttccagttgaagaaacaggcttggagaggtgaatagcttacttaaagtgacatagttatcatagttattaagtgacaaattttggattcaaatctaggtctaccagttccagagccctgaccagtaatccatgctctggtctgttgtctattacttgtaagctgtagagttgttgttgagggtaattagtgcagttaactaccgttgatgacagaagtaaatgctgataaagacacaaaaggctgtagcatcataggtgagtgagaaattgaggctctaggaagacttgaaggaaatggtctttgaacagctttttgaatagaatttcaatacttgaagtggagacagcccacaagatatttattaactgcagagaaaaaacaagtatctttatacagtggaaaggcctggtagacaccaccataatcaagtggttaagttaacatcaccactgatggaagagattaaaatcacatgccacttgttaggagttgcactaaaaagagcacagcctcactactgtgatagtcttaccaaaaaaaaaaaaaaaagcataacgactctaatcatgaggaaatatcagacaaacttaaattcaggaacattctacaaactcactagcctataatcttcaaaagtgtcaagtcatagaaatcaaggaaagaccaaggattgttccagattgaaagagactaaagacatgatagccaggtgcaaacatggagtcctttgctgtgcaggacatgagtggaacaatttctgaaacttgtatgggggcctgtggattaggtgtagtaatgtgtcagtattttctgattttgatggttgtattgtggttatatagaagaatgtccttgtttgtagaaatcacacacactaagagcaggggttggcaaactttgtctattaagggccagatagtaaatattttaggctctgagggccatatagtctcagagacagctcttca

SEQ ID NO: 61321 - DNA, 1314 bp, Bovine  19866880694405
tggtcattttgtaggcattccagtcttttgtaggtgttgatgtacatttacagaaagacgattttcttttagtattatgattgtttccaaaaaggttagttggattaaccaaatacccttggtcaaggtatcaaatgggttgcaatcaaaagtacaaaccaaagataatggaaaaataaaaccagagggtaaatcattccctgccaacactgaaagtttctaccttgatactaattacgaaactttcaaagaaaaccaggggggaaaatggcttaaatttttatatatatatagagagagagagacatgcctatatctatatctatatagatatacatataaagatatttattacatttatacttatttagaaaaaaagacaaacaattcatagtttactttgaatagtatgccttctctatttataacagctgctcaaattttatagaatggacaaactctagggctcacatatttcttaaaaatgtggggtataaaatactaacaggctggttaggtaaaggtggagtgtagtgaaacacaatcaaatgacagacaaacagtgaaagtcatagaaataacagataaaagaacaagaaggtttctgtaccgttacctgaagtctggccaaaatgcttgccttcttggagtttgacgagtaacttcttgaacatgaaacactgcagaaacgctttgttttagagtaaaaagcatctcgcacaccaaccattccacacatttcacaggtagctaattaacaaataaaaacactggtgttatgatcataaaactgattttcgtctaacagtttaataattcctccaattatctaaaggttttaatttttaaaacattccttcaggcagatagaaaatttcttctgttacatgtgatagaaaaatctaaataaaaggtaggggaaagactagaatgatgccatggctataggctccagaaggactgacaataaagtctgaaaaggctttaaaaaggatcaaaatacacaaacctaagttagattcaactaacatttccttagtgctcaccttgtgccagacattataagctctaatgtttgaaaggattataaacaaaagatgaaaagtagttgcagtacaactgaagattcatacaaagtgcagcacaggtctttaaaatattgtgaagactgaaacataagggtaacaaaaagtgaatctcaaaagacatacaaattgtgggactgctgaattataaagtagttctattttcaaatttttgaggaatcaccataggggttttcaataatggctgtaccagtttatattaccacca

SEQ ID NO: 61322 - DNA, 788 bp, Bovine  19866880822516
taaaagatgtcaatgaaaatccccaggagaccattttaggtaagatttttgtttaaactttaaaatgtatagaaagctaaagagtagcattttacatatctaaaatagcgccctagtttgggtacaactgcactggtaatattcattttgtgtaagagacattaacaagttaaacttactactagaaataaaatgtatgcttctatcagagtatatgggggcatatgtctctttggagattatttggagacataaacataggtaaaatcatcacaagttatttttcatgtttcaaatatatgttatttcaggtgagaagttattagacacatatctgaaacctgtggttctcaaagttttgtccttgtattaactgtgtgctgctgctgctaagtcacctcagttgtgtccaactctgtgcatccccatagacggcagcccaccaggctcccccatccctgggattctccaggcaagaacactggagtgggttgccatttccttctccaatgcatgaaagtgaaaagtgaaagtgaagtcgctcagtcatatccgactcttagtgatcccatggactgcagcctatcaggctcttccgtccatgggattttccaggcaagagtactggagtactggagtactggattggggtgccattgccttctccggtattaactgtataacttgttacaaaagcaaatttacaaagccccgccccagatctactaattagactaaaactccctggatctggggcagtaatctggactttaaccagctctccaagt

SEQ ID NO: 61323 - DNA, 1468 bp, Bovine  19866881351112
ttccttcccatgtctatatccatttgtgttatttatgtcagactttatatttaatagcattacatattggaaaagaatttttttgctatgttaagcaaaatgttggctacttttccagactctagcaccttaaatgtaagcatttgcatatccctttgagaataaaataaaatttcatccttaatattcttttatatagaacatgagtagtccgataaataagaaatttatattaaaaggtttcccttgttaaaatgttatactttttttccaggtattagtcttaaaattttgtgtattcttttgtttcttcaaaatagatgatccataattatatggaacacttagaaagaacaaaacttcatcagatctcagggagtgatcaactagaatccacagctcatagtagaattaggtaagcttttttatatacatttttgccttgggaaaaaggaaaataaaataatctgtttctgtttctctctgttctttaatcctcagacaatagtagctctctccctcctgtagttggaatgctataggagggggtagcatagaaaacaaaacaactttcactaatgaaaaggtaaattaatagccattgttttctgatacttaacaaagattgtataggtttaaaatttttgtcagaatgctgtaaatttttcatttcacctgtataattggtttaaaagtcatttttgctacagagagacatgtttgaaagggttagctagacttctgtttgatgtaggagtgtgaataaattatgtagatctccaagcattgtagccaatgagctaagccaggcctcttagtggggaggaaaatagttaataggctggcctctgctctggattgctgcataaatgctaggagcagcagctctatggttatgaggcggtgagagcaggatgacgtcagcgcttcggagctgcagcaggatggagtggaaagctgctgctgatggcattgtttttgtggcagcagctgaatgacagatcctcactacaaagatacccctctggcccctgtgtaggcctcctggttcgggtgtttcaccatgccagcacagcgccatgagtcctggatgcatgctgctgtttgtgtttggctttgttggcggggcggtggtcattaattctgctatcttagtatctctctccgtcttgctgcttgtgcacttctctatttctaccggagtgccagctttgacgcagaacctaccaaggatactcaggtacttcagtctctcttagaagtccttttttagttggtttttcttttatttttagctttatgggtgttctttgtaatcattcatgttgcagattgaaacaatggaaaatggcctgaagctaagacttctattcttatatatagtaatttatagactatcgcttagggatatgctttgtgtttggaaaccacccacttaaaaggattttcagattgtacttatacacaa

SEQ ID NO: 61324 - DNA, 771 bp, Bovine  19866881505860
acttaaggaaaacaaaacatttgacctcgtacaatggtgttaagtaaaataagtttacatggtggtactatttagtgtcaggcaatgagctgcacattgttaaaacttttcaagtatttctgaaagacagtatgtcattccttcaatatttagttatttagcttccttctatcaccatatatttagccagatgctcaggaaacaaacatgaacaggacacttcacctgcatcagataaattccccagaaataatgccaacacatcctgaaagctagaatccttgaccgcctcaagaagttaaagacccatcacttgcaacccagagctccaaaaggctcaaagtcaaggttggggcaccgaggtaactcaagttaaaagctgaggtattataaagttaaaagctggccaagtgcagtctctgaaaagagttgccaactgtcacccacatctccttaacccgccccctaccacttccccgtcctttttataaatagtttttaaagggaactgtccaaggttaccacctgacaaggaagaatgcattgatgtggtataccaataaaataaaattgtatactctccatatttacagagtattcccatacgacatctaagtgtcgacaaagtaccaaccaaggcacataacacataaaataaaacttcctcagtagggttaaaatatcaagaaactgaccgaaagaggaagatatctaacttcccaaagcagcaacccccaggaaagggactggaaccagcggaagtaacatatc

SEQ ID NO: 61325 - DNA, 1889 bp, Bovine  19866881552242
tgagttctggcctggtgtacagtgcattgtgtccaaagtaaccccaaaatgaaaactttagttgtttttttttttagtttccgtattgactgttaattgaatatatgacctattgtctgtctaaccttgtgcttctcagctctctaaaaatttttatgatcaaatgatgtatttacaaccatagaaacaatgttcatatcgggctgtatgtgttaaatgcgttatttttgatatcttgtccttttctaaggttctgctgaaaatgaagagaagtcagaagttcaggcaatcattgaatccactcctgagttggatatggacaaagatctcagtggatataaaggctcaaggtattgttcaagtctaattgggatatcttacttctttccttttcccatctcccctaagcacattgctgttcccccgtctctgaccagataaagtgcgttcagatgttttgctgaagaaatgttgatgttctatttaagttttctctttttgaagccagaccttttacataatttacatgttctgtgaactgttacctttgtagcatcagggactagaagcatgaagaaggatggggaaaaaagacagtgaaggagtattccataaaggaatagtccatggtttgtggaacttgggaaaacataaaagcaaaagtggggaaagtataatttgaaaaaacctattctttcctccaaatcaggaagaagagaatgtattcccttcaaaactgtaatggtttcattactgcaagaaattagtctcattttagtatcattttacatggggaggctgtttagtgattagaggagaatggttgtgtatcatcttaatgaaggtcgtctgaattggaattctccaggccagaatactggagtgggcagctgttcccttctccagggaatcttcccaacccagggatcacacccaggtctccctcattgcaggcgggttttttttaccatctgagctatcagggaaaccctaggataagactatatgcattctaatcctgacctggatttgaatctgaggtaagtttctacatccatgaaagaaaattatgataataccttagatgattgtaaggagtaaatgaatcaatatatgataaagcattggcagagtgcccagttcaataaaggttagctaacatttatatatgttaccatctgagcaaccagggaagtattttgttattaccatttaaccttaataccatttaaccttaaaaaccatttaaattaatacttaacttaatgtaccatatatgttacattatatgttaccatcatataattttatcttaattataaccttacgagacagatgtccttcccttcacatataaagaaactcagagttgtatactattttgtccagactaacaagaggtggaactagcattcagtctaagactttgatttcaaaggctgtgccctattgaaatatttttttattgtttatttaagaaattaaacaatgcagtgtataaaaagtgaaatttgcttttccatcctctcctaaacctacttattaacacttgtgcccacttatcattttgaacctctttttaaaaatcaaaaacatatttttattagagtaaagcatgtatacagtattacggttaaatggtaataaaaaaatacttccctggttgcttagatggtaaataatctttctgcagtgcaggagacctgggttcagaccctgggtcaggaagatcccctggagaagggaatggctacccattccagttttcttgcctggagaattccatggacagcgtagcctgacaggctatagtccattggatttcaaagaattgaacactactaagcaacttaacacatttttttttcaatgtatgtatgcagtattaa

SEQ ID NO: 61326 - DNA, 1554 bp, Bovine  19866881894218
cagcaaaatatatttgaagtgaaaggatttaaaccttttagggcaaggaattcatttttttctcccaattatttatgcatcaaagttggaaagctttacaaagcctattcactattgttttgtcagatgttgccttttctttgtagacttgggtaacagatatccatgcctgcttgtggggatatcattaatctctgtagcgtttctgctggtcactgtacttgcatgctctaagaaccattttctatattttagaggtttaatgttgtggtttcttttgttttctaactcaccaagataaaaatttgatttgttgagatttctgcttcgtgtgtggtttttaaatggaggttcataatgtatagcttttattatgtaaatgtttacttaaaactcaactcctaattgtggacttaaaaagaaattaaagtagtaaatttcctcatcctcatgttcaacattaaagtccagaaattaaatttcatctgtggtcttaaaacttggtcatttatttatttttttcctgattttataaaaactgggagcaatctttttgctttgtgtacattttagtacataaaggatttgtgtgtatgtatatataggcttaggaaattgaaactcaagaacataagattaattttaaagggctgtcctaggtttcagttccatttatgaagccagtactatgctgtggataagaggttcagagttggactaccaggctacaaatgctctgccacacatgagctatgggacttttggcaaattacttaatctctgtacccgagtttcctcctttgaacttcttaccccattgagtcattttaaaaattcgtgagatgattatttgtatttaaacagttaaagatatattgtaaattaaacaagtaaataattttcataatcatttatatttactccatttttagtaaaactatatcagctctagctattttattcataaaataacatgattaaattcaaagagtttcttgacataaaagttgctgttgatctgactgaaggaagataccgaagtctttaatattaagattggcttcccaggtggtgctagtggtaaagcacccatctgccggtgcaggagacttagagagatgggtttgatccctgggtcagaaatacccctggaggagggtgtggcagtccagatctccagtgttttggctggggaatcccatggatggaggacactgataggctacagtccatagagttgcaaagattcaaacatgactgaagcgcagttggcaagaagcagtagttccaggaaatgtgcatgggtcttggagtcaaaaaaggcctgacttcgaatcccgtttcttccaagaactagtgcccgaagtctctgagcatcacttttcctaatctgaaaacaggaaaaataattcttatttccttgtgaggattaaatgagaatatgtcaataaatcatccatttcagtgcttgccacattggtgggtgttgaacaaatgtaatctttttactgctctttatatatatgtatagtagattttattaatgattattta

SEQ ID NO: 61327 - DNA, 699 bp, Bovine  19866881923256
tgttagatggcatgcgcttttgggtggtttgcaatacctgtggaaattgcatggtcactgcactgggcctttggtattttttaaatatgatgagaaatggcctggttcaatttgcttttcatccaatgctgagaccacctccctctaagattttagttgaggattgtttgggaatggaaattcattgtattgttagttttcctgtctaaaatgccatggctggattcagttctaatgttctgtgattttatactgatcagtcaagggcaataggggaaagctggtgcaaagctgaagcacttagagtccctgtctttccttccttttggtaagttgagggaattagattgtaatagaacaagtgagctgagagcacacgttttaaatggccggatgggtgagtggaaaataactaaattgctggttcttaaatagtttggggatgaaatttctttctctatctcatgggctaggcttctgaagaccttctcaaggagcactatattgacctgaaggaccgtccattctttgctggcctggtgaaatacatgcactcagggccagtggttgccatggtgagtgtacatggtttgggatgttgataccaaatggctcagttgggagcaaagagtgaatggttgtgattcctgctcctaatggcaggtcttcattgatgcaaggatgctgagcctggggcat

SEQ ID NO: 61328 - DNA, 925 bp, Bovine  19866881758197
atggagaagagagccagagtagatattattttttattaaatatatgttaatggaaaatcctattaaataaaaaaaaggaaagaaagaaaaaactcatggaaaaagagattagctttgagggtaccagaaatgaggattaaggaaagggggaattaggtgaagataatcaaaatatatatgaacttccatttataaggtaataccaggattgtaatgtacaacatgataaatataattaacactgatttaagttatttatgaaaattgttaaaagagtaaatcctaagagttctcatctcaagaaaaaacttttttatatttttttacaattttgtgtctataggtgataatggatatgcaccaaacttattgtgctaatcatttcatgatgtatgtaagtcaaatcattatgctgtttacattaaatttatccagttctctttgtcaattacatcttgatagaattggaagaataaaatagtatcacttttgtgagaagttattcttagcaaaactaaggtagtaactcattatgggtatacagataaaaattataaaataaaattgtttttattatggtttaaaaataaagtaaaataaaaataaaatagattcctaagaaagctttagttttgctttagttttaacaccaggcctttagtaatgatttctcttttaaaagatgtatatttggaaatcatctgttagttactactcctgtggtgatttagattattaaaaacttgttcaacattactttttcctgttttgcaaactctcaaaaagagacttaactgcaggtgatttgagacaattaaatgctaaatatctttttatctccatagaaagagatgtttttagcactaaagatagtaaaacacagccattgccagataacagataaaacattttgcatctgatttct

SEQ ID NO: 61329 - DNA, 1513 bp, Bovine  19866880367270
cggtgacacagcctgcacttctttactagaaaggggtagagtcgttttcaccaagtcacctttgtctcactgtctctggacacacacagctttgactctgggctgtttgcttggcagcacgcctgcttgggatgccccttccatgtcaagtggccaagcctggaggcaggtgacagcacacaggtaggacgtcacactcttgggagacacagtgacaatagagggaccaccagaccatgggggcaaagacaggggtggggtcggacccagacagatcttctgtccactgtcctcccacacacggccctgaaacacagacatgcttctctctagctttcttctccttagggtcagtccctcatgcttggctgaagcctgaacacctgctggtacatgttggctcaacccctgctggctgcctcccggtcagtgtagacccctggtcacaagtgggccccacaccatgcctgcatccaccactctggtcccacggcctctttgctgccctctggttaattgttaggctgaagggactcccccaaaaaacttcccatcaccccaacgagagtctgagactttctgtttaactgcctcactgtgggctggcccaccctctgaccctgggatccatcccactgatacccagaacccaaggactagagtttcaaatgtcctttctagataggtgtagttcattctctaaagaggtgaggctttgtatctggaaacaaagctttcaacataactgaaggtcatgccccctgagggctcctactagcccgatacttcttttcaacaaatgcctccaccctctcctacctgtccccatgcaggacatggagtatggcagaattgctctctgctgcctgggagcttacagtacatgggggagacagacaaggagcagagtaatcacgtgatcaaagcacttgatgaaagaaggcctgggagctaggggagcagagacagaacacagcatgcacaatcgagtttgagctggaacgtaaacaggggagtcacaaagcaggaaaggatgactgaggacagaaactggctctgagaggccaggctgagggtttctgctttcttccatagggtaagaggagaagacacaggagcctagatagagatgccagtgaggagtctccaacaggcagggtggggactggccaaaaggtgggaaaccagcaaagatactgtgcagtggttgagagtgaccccaacgataagaacctgaaaatggatgacagactgactctgggggtaaatgaaggggaagatgtgaccactgaggaaagggaccagggacgtggtgacgattcaaatgcatcatagtgtcagtacttgcctgcttcggagggtccttgagagcattttccacagtgtcttctggagagactggatctggtgaaatagggtccacctgaaacacctttgttacaatggcactctctctgcagtctctgaaaattattccaaacaggaaaagtcttgtgtgtcacacaaaggttca

SEQ ID NO: 61330 - DNA, 1529 bp, Bovine  19866880486157
agctctgtagccaggggtgaccttttcattctccacgagcaggtctttcttttccctgggactttgcacatgtgaatttcctttgtggaacatgtgtgtctttgcagcctctatcctcccctacacccccagcacctttttacacctgtcaattctaagcatccttcaggccccagtgcccccactttttccagctctcctgtcttcctagtgtagattggcatctcttttatgtgccctcatgttgccctactgagcacatcacattccactccaggggtcttcatgtctcccagagcttcagcatctcctggggaacttcagaaaatgccctacatctagaggttgattaactgtgtgtgggacaagcccagggatattaaaacaaacagcttcttgggtggttctgatacacaggatggagagcagctgtggtgctgttacctgcttgcccgccctatgcccctcgcagcagctataagcctctgagggcgctcagcgcatctgccctgggcatcctgttcccagttcctagccaaatggcacagtgggagctcagatatttcttaaagggtatgtaaggagacctcttgtaggagtcaggaatgttaacagttggaacagccagtgaggataaccgtacctgtcttctcaatgtcttctgaaagtcagggaaccacggatctatcttactgggcatgcacttgatagtagaagaataaccttccgacttgggttggctgaaagaaaaatggaagacggcctgggaaacttggaaaatggttggtaaactgattaaacctttggttactttgttctaatgatgtatctttttgttttcctcctaggtcagctgagggaacagctcagttaccttaagggcgataatttttttaggtttacctgttctgattgctcagaagatggcaaggagcagtatgagaggctgaagctgacatggcagcaagtgagtaaaacctctagagtttgtgaggttggtctgccccagatttattggagtaagtgtctagagaatgaggaacttaacgtatgagcttttgagttgttttgagggtcactttttcacaatgaaaatcatacagaatatgtggagaaaagagttcttagtaaaattactcactgccaacttagcacactgggtttgagattcttgaaaatctcacccacacagtttcatttatatataataccaaatttctgattttaatcaaagaggttcacatttttctggcagctgtttttagaaaaaaccattctaaaaaatgtgaagatggtgaatcactacactacagctgaaaacaatacaattctgaaagcaactgtgcttcaatttaaaaaaagtgaagttggccaacctaaccctgcccaactattgcctgaatagtatcttataactgatctccaggttgtgttaattttggggggtttgtttttatattaatatgtttatagcaaggcatcaatggtatatgcagccttttaagttctaaaaattagaattaacatca

SEQ ID NO: 61331 - DNA, 1192 bp, Bovine  19866880556171
aaacttgacttgaagtgtgtgtgaagtattgatgaaagagacagcattcaatgtgtgtgttgatggagaacagcttagtgaaatcttttttactcactgtccttttaaacttgatcagaaaaaggacaatggctcatatattctaaataatgtctttagagccccttgtgtctgcgtagaggtgtccaaggattggagttgttcctgagaaccctgaccctgtgagccgggagggatggagggtagcatccacctgagcggtttgattagtcggcacgacgatgaagccacgagaacatcaacctcggagggactggaggagggggaggtggagggggagaccctgttgatcgtggagtcggaggaccaggcatctgtggacttgtctcacgaccatagcggggactccctcaacagtgacgaaggggatgtgtcgtggatggaggagcagctgtcctacttctgcgacaagtgccagaagtggatcccagccagtaaggagcttctcctttcctttgctctgtcagttcctgtgggaagatgtgttttcctaacctgtgaaagaaacaggaatgtgaagtagatctaaataaaaagataactctttgatttattactagtttagttgcttaactgcaggcttatataaaacatagacacatttgtcctaataaatatgactgccaacctctgtcactttgttaaattaacgttcttgattgccacccagtaaaaattagaaattctgtgtgacttaaagaatcagctgcatttttctatcagggtcacattattgtggatttgcaaccaaattctaggcccagcatagagctgaagttcagacttacaactcaggtaatatttaacctacatggaaaacagctgcgatagtttgctgatataaggaattagcagattagaaatgtgttgtgcctgtttctagtgttttcttcttgctggcttccttgatctgctggtagatctgctagtagatgcacacacacaccccaggaggtcctttgccaggcatcagggcagttaccgaagcagggctttcccgttagatggagactggtaaagacacatgtattggaggagtactctgtgtactggaacctgtaaccaagtcagagaaatttagatatatgtgtgtatgtgtatttttttgttgtgaactgggtcattttctggt

SEQ ID NO: 61332 - DNA, 1191 bp, Bovine  19866880596619
tctttgaaggccctgtctcagaatacagtagcattctctactgatggaataattctagaatgtagatgtatacacagttggttttcaaaagttcagttcatcagtgaatgcaagtgttcaggcagatgcagtgaggtctggacctggttcctcagactatgatgtgatcctgcattccgccagctgagtagaaccagcggtgctgaagcaagttgttcagtgttgacatctccttacgagaggtactatgagaagaaaacttttatattgattcctggtgccatttttattttggttaattatggaaattaacaagactcaaactgatccgtggcaccagtcattgggggacctagaccgtgtgtgtgctgtctactgctgaaagcctcccgaaagtgaaagtgaaagaaagtgttagtcactcagttgtgtccagctcttctgcaggttcctctgtccatggatattctccagacaagaatgctagagtgggttgccatttcttcctccaggggctcttcccgacccaggggtcaaacctgtgtatgctgcattggcaggcagattcttccctgtctgagccaccagggaagccctgccttgtgggaattctggtccagagtaggcctctaataagtatttgtgcgtgagtcgggaccctccaggttcaggtgtctcacatgtggtatctaaccactccactgtgttgcctcctacaccagggtcttccaggctcagggacagctctcttcttccaccccatcctcccagggagacagggaaagagaaagacgtttccatgtgggtcctctggttagagctctcttggtcacagacaatccctttggaccctgtttgtgtcactgggtggctgtgcattaggaggtcgttgtagtgggtcctctgcaggaagtcttgctgggtggccctgaagatgtaaacattttgaagaacagggactggagtcttaaccatcagaccaggcagaactgctttggcggctccacgtctcagttctgactcagactcttctctctgccacagaaccaaagccagaactccacctctgtcctttctgccctccggatctctgcagtcagaaattccacatgcagcaggtgctgtgtagtcccccaccctggatcttcacgtgcctgtatgccgaagatcccgtccagccaggagacctgt

SEQ ID NO: 61333 - DNA, 2975 bp, Bovine  19866880617309
tggattgaaaatagccctcatttgccatatattttcacaagatggtaacagagcttcttctttctattccagtttctttcaacctggagtcagatgtcacgtggctacccgctccccgcccgccgccaaccctccacctcacttgtacaccccctatctactctttccttggtgaagccatatccaaaagagaagtctaatcttttctttcatctacttggatattaaggtcagacatttccaggctccagtttccctgggtcttttccaagatgtttcctcctgttctgagtctttccttagacaccctgttctctccagggctgcagagggaagaaggagatgaggggggaggggattcatcctgctctttgggccccacccagctctgtccacctctcaacactgtcccttcaattctcaaaacaagggtccagagatcttaggcaagtttttacattaatcatggactggcccaactggactaggagcaaccgtaaccttcactgaactagctactgtacttgggaaaacagggtccacatttttgcttctggtccaaattcaacatttacctgtcactgtccagagcaaaaatccagcatctgcgtctcaaccaaagacaaagccaagttcacagaattctgctgagctctttggagctagtgaggtggttcacatgagctacaaggtcagaggacccccaagtctttgctctttttaccgattatccctttggcgtagagctcagagtttacagggcaggcctctcgagccaggaggccagggtctgtccctccagctcctgctcagcagcatcactgcagctggtgaccttttgttgatctgccagcagctaatttgtcaacaagcccgtgactcctctctctggttcatcattacctggaggcaagtctccatcagaaaataaatcagagcagggaaaacaggttccagacatttccttaatactctttgttaaagtattaaggaatatgttaaagcaccataaagaatctacctgcagtgcaggagatgtgtgttcgatcccctgggtcgggaagatctggaggcagaaatagcaacccactccagtattcttacctgggaaatcccacggacagagaagcctggtgggctacagtctatggggtcgaaaagagttggacacggctgagcatcagaagaccagaggtctagaactggctctgggccccttaagaagcttaaggaggagtcactttaagagttaaaattatgattaaaaaaattaaaatcattatctatagattcaatgatctaagaactgtccaatagagactcaaatgcaaatcacttggactttcccagaagtcctgtggttatgattctgttcttccactgcagggggtgagggttcaacccctggtcagggaactaagatcccacatgctgcatggtacagaaaaaaaaaaaaattcaagtcactttgtagttttatagttcacgattttttttggtgggagggctgtaccgcctagcttgcgggatcccagggattttcggcctctcctttagcagtcactagaggtctataaaaatcttgctcctctttcaggactcaaccaagaggacacctcctccgagaagcctccctgatgccactttctcttctgtctggcacacccgctggctttcttggggagtccagggtttgggttctttctctctatgtgggctgaggtctctggaagcacagaggtaagtcttcaggcctcaggaaaactctgccaactatttcaacatttaccacctctaatagctcatatttactaaatgcttacagagtgcaaagcactttatacaccattactgccctgaaatctcacagccatcacttaggtgatatgtattaaaaccccatgcgtactttagagatggacaaactaaagcaaaaaaaaaagtaatttggacaagcctgcacagacagctagctcagatctggatttcttaaccactatgtgactgattcaacttgcaaactcttccctgagagtggtcagtccctcatatttccactaacggagaattaactcagtcacagatgaggcagctccatgtttactccaactgaccataccagcagcccacaatgctccccgagcccccttcactttgtctaaaaggccaggatccaggatcagggagtggccagagaacccaccaggcaaggagctgcagaagaaataggccatgccctcaacgacatgctcagaaaaagatgcaaagctgaggaactctcccggacagccaacgacaaatgattgggcaaccagtccccagtttcttaacctcttggggtagttgcgtgttagaccagctttgtagccacttgttgggcccactgatagctggggctgccccatcaaccacagaatccctccaactttcataggaccacctaccacctacaggacccttcaccctatttaggaccctccacaattacacaggactcccaccacctataggacccttcaccctatttaggaccctccacaattaccctcggagaaggcaatagcaccctactccagtactcttgcctggaaaatcccatgggcagaggaccctgatgggccgcagtccatggggtggctgagagtcagacacgactgagcgacttcactttcacttctcacttttatgcactggagaaagaaatggtaacccactccagtgttcttgcctggagaatcccagggacgggggagcgtggtgggctgccgtctatggggtcgcacagagtcggacacgactgaagcgacttagcagcagcagcagcaacaattaccctaccaccggccactccctaagtattcttcctgcctcaacccaaggtgtcagcctggccacacagaggtcaaacttttacaggttctctcgtgttcaggactgaaatgaaagtattaaagccaaaccccagagaacatcct

SEQ ID NO: 61334 - DNA, 821 bp, Bovine  19866880785846
ccaaaaggtaaggccagaaagcaagagggctgctccaagttgccagcagccaggacccgggtcctaagagatgcaggcttacccagtgagaccaggttgctgtagttctccagcatcacctccccggacagggacctctgagcagggctcagcagcacccactcatcctgggtgaaatccacagccaacatctctgaatgccatgtgtgcctgtaacacaaaacagccctgttcacccgggagccagccctgcccaggcctcagggtaaggggcaagggggaggcggcccaggggaggcagatgagatcctgcctttcaccctggtgctctgtattccaagatctttaaagccctgtcaccacctgggcagtggcacttgtcaacacgttcaaggtcctagctgggctgatgtggagaatacatacaaaaatagcctgtaactttcaggagctttatgttgagggaaagcgccagactttttaagaatttaaaagaatagtctgaaccacggtattagtgttgaagcatccgaatgactgaggttcacacaattcagttatggcaaagaccaaacacaactcagtccctccctgaatcccacagcccctccggccctccttccctgagaggcaccaaccagcagggaatggtcaagagcacgaatttgaaccctactgccctggtttggagcccatcccagccatcagctagcaactccgctttttcaactgtgggtagcagtccactaaacgtcctgtcccacactgtggtgctcagggtggacgtcccctgccattcagtccagaattcatctcacatg

SEQ ID NO: 61335 - DNA, 1076 bp, Bovine  19866880792400
ttatccattcatttgttgaggggcacttaggttgtttccacgtcttggctgttgtgaataaagctacagtgaacacgggtgtggagatagcttcctgagatcctgttttcattttctttggataaatacggatagtgggattcctggatcatacggaaggtctgtctttaagttttcaaggaacctccaccttgttctccacagtggctgcaccaatctacattcccaccaacagtgcatgagggtgcccttttctccacaccttctccatcatttgttacctcttgtcttgttgataatagacattctgacaggtgtgaggtgatttctcctaccttgttcaattgctaggtcatgtctgactctttgtgaccccaaggactgcagcatgccagcctcatctgtcctccactatctcctagagttagttcaaactcatatcctttgagttggtgatgctatctaaccatctaatcctctgctacccacttctccttttgccttcaatctttcccagcatcagggtcttttccaatgagttggctctcctaacctgtgtggtggcaatttgcacttttctgatgattggtggtgctgggcatcttcccttgtgtctctcagcccttcgtatgtcttctttggaaaaatgcctattcagttcctttgcatgttttttgaatcatttgggggtttttttgccattgggttgtatgggatgacttttaatggcctcataggtgggaggctctggcttggccttgacccacagttctgtgtctgcccctcgcccctgcaggcattcgcccctataagtgtgacgtctgccacaaagccttcacccagcgctgctccttggagtcccacctgaagaagatccacggggtgcagcagcagtacgcctataagcagcgccgggataagctgtatgtctgcgaggactgcggctacacgggccccacccaggaggacctgtacctgcacgtgaacggtgcccacccgggcagcgcgttcctcaaaaagacatccaagaaactggcagctctcttgcaaaacaagatgacgtcctcgctccaggg

SEQ ID NO: 61336 - DNA, 1438 bp, Bovine  19866880829018
tcttgaaattcttggtcctggtgactttctcctcggtgtcaggagcgccctggctgtagtcgctcactggaatgacaggagtccaggaccaagtgacgccccctgcaacctcccttgtggaacagccactctccctccccgcgtgcccccttggaagtcaggaggaggaaaaggcttttatagaaatttctatttgatgaaacctggcagaaaggactcttggggctggccctctgagtccagaactagaggatggatgagaaggaggggaaaaaaagaagctacagttttcagaccccaaactgtaccccctgccccaatctatctgcaaaggtctcacacttgacttctgggaggccagaggaggtaacacggcctgaaggtgaaagcgctggccgggtgtggctggccagcaaatggtaagcatttctctgccatccttgtggagtcactgtgtgtgtttggtccactgtccttttttattttcattaaaaaaattttttttgatgggcaccgtttttaaagtctttgttgaatttgttacaacactgtggcctctgttctatgctttggttttctggcttcgaggcacataggatcttagcttctcgaccagggatcgaacccttaccgcctgcactggaagaagtcgtaaccaccgggaccaccagggaagtctcctggtttttctttttttaattattatttttcttccagttttgttgagatgtaattgacatccagcactgcctaactttcaggtgtgcagcatgatgacttacgccatgaaatagtgatcacaagaagcttggtggacagtgtcatctcgtacagaaacaaaactaaagaggtaggcaaaatactgttcctcgtgatgagaactcataggatttgtcctcttaacaatgtccatatttaatgggtcaatgttttaacggtcccagaaaggggacaactcacccaagctggacccgctgccgaatagcccgttcccgccctcaagtgatgctgctcaggaagtggtcactgaaattcatcgccttgttcaggtaaaagttctggccaatgaaaaaattcacgcacagtgaacaacgccacgtcccagcacaaagaacggtctccctgctcacctgcccctgtctctgttaatgacggatggtcaagcctgaagcctggccgtcctggacatctccctgacctcacggtgttgctttgtccattctgcctcttaaacgccgccttggtctggcccctgctctctcacgaggaacatggcaacagcctccaaatgggttcctgccagcccactttccctcagctgccccagcccctctatacaacgtgtatgtaactgtgccctcccaagtcttggaattaggtcggcctgacgggcaggctcaggctgcagagcttgaatcctggtgctgtcacttactac

SEQ ID NO: 61337 - DNA, 1933 bp, Bovine  19866880830702
ctcgagatttctgtaccacccctgattccctacctttataggtgggtgaatgagagaggcagttgaggccacagatttgtaaagcagcagagttttattagaacaaaaggccccaaacacgacaacttgaggtagaggaagtaaactgagttcaaatgaccagttaaggaatgtgttttcaagaagagcgtaaaatgttttgatttagtctgtgctcttggatggagaacgcaatggcaccccactccagtactcttgcctggaaaatcccatggacagaggagcctggtaggctgcagaccatggggtcgtgaaaagtcggacatgactgagcgacttcactttcacttttccctttcatgcactgaagaaggaaatggcaacctactccagtgttcttgtctggggaatcccagggacgggggagcctggtgggccgccgtctatggggtcgcacagagttggacacgactgaagtgacttagcagcagcagcgctcttggagcgggtgagggggtcagtaaggatgctccggcggggcctcgggtcagactgaaatggtgttctgtggccggcacacattcctcctatgtctgttgaggtgggacttctggatgaagccttgcccgcaccccttgcacatgtgcggcgtcctcccctggtgtgtcatctggtggaggatgaggtgtttcttgtgggaaaagccttggccacactctgtgcacagaaaggagttctcttccaagtgtgaccacttgtgcatgagcagggcggacttgttgccgaagcctcgcccgcaccgccggcagttgaagggctgctcccttgtgtgcgtgctgcagtgccggatgagagccgactggtggcggaagccccgcccacactccctgcacacatacggcttctccccagagtgcgtcctctggtgttccacgaggttggacttctggctgaagcctcgcccacattccacacacaccaggggcttctcccccgagtgcgtcctctggtgtcggatgaggttggactgctggctgaagacacgcccgcagtccttgcacacgatgggcttgtgcccggagtgcgtgttctggtgcctattgagatgggactttagactgaagccccgcccacacaccccacacacgtaaggcttctccccagtgtgtgtgcgcctgtgcgagatgagggttgaattctggctgaatctgtgtccgcacacgccacacacgtaaggcttctccttcgagtgtgtcctctggtggttgacgagtgtggacctctgccggaagcagcgcccacactccttgcaggcatacggcttctcccctgagtgtgtcctctggtgcgagatgaggttcgacctgtcgctgaagcccagcccgcagtcgccgcacacgatggtcttctcctccaggtgtgtccttcggtgcctgacgacggctgacttctggctgaagcctttcccgcactcctggcacacgtagggcttctccccagagtgtgtcctctggtggatgatgaggttcgacttctggctgaagcctcgcccgcactcaccgcacatgtacggcttctcgccggagtgtgtcctctcgtgtatgatgagcgtcgacttccggttaaagccccgcccacactccccgcacacgaggggcttctccccggagtgcgctttctggtgtctggccaggctcttctttagactgaagcccttcccacacaccccacacacgtagggcttctccccggagtggatcctctggtgactgagcaggttcgtcatcttgctgaaacccagtccacactctccacagttgacagtcccaaaccccaggacttcgatcctcttcaacagcctgtctgtttcctcaggggtccccatttgtgcagggccggcctctatctccatacctgggaccccacccccaga

SEQ ID NO: 61338 - DNA, 2348 bp, Bovine  19866880859354
gtgacgggagcgggtggtctgtgtcctactgcagaaccttgcctctcacatgatgctccactctgtgctgttactcgtttgcattgtgtcacatctgtttcccccccagcaggtctgggccttcttgctgtttctggccctgttccctcaaacagtgcccagcaagcagacgctcagctgacggtgtaggtagttcccttactgagcagagactgggaaggggctcctgcctttaaagaaggcacatggttattagcagcggcctgagaaaaattcagctggccttgagttggtacagatttcggcgtaaagtgatttcttcattttccagacaacccattgcagcttgtgaacactacgcctaccacgattctgcaggtccacatcagaaagcattcttgtagcttcaacaggtgtggcttacaggttatgggacctggcaagatttctctgacaaacaattcatgtgacatcctgagagactgagtaggacaagaggccacacaaaacaataatcctttgtcatccagcctcacaaatgaggaaacccaaccctaacaggctattcagccagctctgtccttactctaggccttagaagcctgcagggtgacgttctaatagggcagcagggatgtgcctgtgaaccctgaggactgggggtggggctggttgacagcttccaccttcccatagggatttactgagcacctaccatatgccagacactcccccaggctggggattcggtgtcagaataacaaagtcccacctaatggagtttacatttgagtggcaggagacagacaagaaatgaataggatgtcagatgataaaaagtgctatagataataaggggcatcacagatataaagggagtaagattcagtgaggtgaggtgaggtttgctgtttcacagggagtgattccagaaggcctcactggaaggtgacgtggagcagagacttaagagagaagaaggccacacaggttgtctcgggactaagtccaggtaggacgatggccagcacgggcctgaggaaggcgtgtgctcagagtgttcaaggactgcggtgaggtctataagccaggcagggggcagctatggggagatggcagagatgacatgggtggtgggtggtgttcaaggccgagatattcttctgggggggtcaggagctgctggggtttggaggcactcttgttttaaaaggatcactgtatccgtgtctgagtgaattacatttctttaatccactaaccaaaccaggaaggaattaggacagatcatattaccacttctgagggcagcactgtttcctctgcagtggaaacttaagacatgcaccagctatttcccaggcaagcacggctgcagcctctggcaggggcgggggaaggggtgacattcaacagggaccgaacctcatggctgcgatggccccagagctgtggccaatgatgatggtctcctcgtcacagtgcagctccatctccatgaagggcagccagatgctctctcgggctgtgactgcggttcaggggaaaggaagagtctgtcactcaacaggggcagtcttagctcagtcctgcccacccttctaacacaggattgctcagtaaactacaggaccccaacaggggatggggcttttttcatggagccaaagtttcctgtgttgctgttggaaagactcaaatctgtagtttgggtaaataattttgtttttatttttttaccatgttcttgtaaggaaatactaaagaaaaaatacaactctgaagttttaatgtaaacttttcaactgaaaaacagaaatcctgttgacaacattgtctctcaagttgacgtccacatatactctttctttccaagaaggaaattcctgagacaagtcacagacatgctcagaacaaaagtggcaaagttacattttctattattaggatctcatagagatgctataacttttgtcatatctctgcctgaaatgaaaaacccatgaattctgcctgaaaatatttgattatagaagggaaaatcaagttgcttacaaagttgaaaattaagttttaccaaccctgggtgctcttcttgctcctcctagaactttctatcacatcttttggtttgtagcctcctcccctcaaatacttgccatcattcatcctgaggtatgtatccccttcggcttctctaccagaaaatggcaagattgaaacccaacaagagtgggctttttaaagatacatttaaaaaacttacttgggtcaggcatgtttttagacaaacactggaaaccaggtatctacaatatgagggggaaagaaaaaactattataaggca

SEQ ID NO: 61339 - DNA, 1432 bp, Bovine  19866881116427
ctgatcgtccggcaggcaaaaagggaccgggggctaccactctttgacctggatcaggtcgtgaacgctgcgctcctgttagtggacggaatttacggggccaaagatggaggagtttccaggcttccagctggacaggccacatacaggacgacctgtcaggactttagaatccttgaccggtaccaggtgggtgttgtctcactcttcaactcctgggactgcggctccctggtgcgttctggagagtggaagaacagtgaagggagaagtgcaaagacgactgggctgtgtttattttaattgtccagcgtgaacattcctgaatacatctgagtttgggtttctgttttccttttgggtattctagacagaacctagacattctctgcatatctcttagtctccgagggtggctactcatgttctgggttgtagctttgactggcaggtttgtggaggatgtacagtgtgccagtgtaccagacgctgagctgagcaggagtgaaggtgtggtttcatttgtgtagttaggagacaccctgcaggaagagcagcgagtcggcatggtgtccgcctggccggaggacactagtgtgtgagcgctccagggacaggtgattgcaccacaagtgccagaactccaccctcccatggcaggagccagccagtctctccctgtgtcttgctggcattgctgctaaccattccttaactaattttgctattctgatggctataaaatgaagtcgtgtttttttgtttgttttttggatgcatttctttgattacaggtgaagttagaacattctcctgtttcctggttgtttgtgctttgcttgtctggactgtttgcatgtttcctgtcttcttctgtggtgggctggtcttctacctgtcttctctggacactggtggggtgtggactttgctgctggtattttggttacccagcactgcgctgcatgtggggctgttcttcccggtgctgggcctttccctatgggcctttctatttgaaatgctctttcttgagttctggaatttcctggcatctatttctgtctgttcggagcactcctgttatttggctgttggaccctcttaaccagaggtgtgcaagccttttctctgaggggtcagagagtaagtagctgtaacttcgctacccagctctgctgtgtggtgtgagggcagcatacacgactgatgaaaggcgtcactgtgcgccagaaacagcatgtacgaaagcaggctggattcggtctctgggttctgtagtttccaaagaccttcactccagctggatccctgtaattcttttcctgtttctccttcctgggaagccgtaacctgcctgcctgcatcttaggaaccttgtgaggagagccaggggctgaccatgcagttgttaaacttcccctgagtctcc

SEQ ID NO: 61340 - DNA, 1512 bp, Bovine  19866881193039
gagccctgttgccagaaacgagaaatgaggcccaagctgatcagtgcaaactccgcccacgcaggctcccactgggtccctgactcacctctattcagttgttcctccagtgtcaacgtcccgcagcttcctctcctatttgtctctcttcctacaatcttggcaatcggcacatactctcctgaattcactgactcattttactaacactttctagttttactaactgataacttgctctcttctaaaatgggagattcatcctttctgtcaggcggcagccatcagggtgagccgacatgggcgcctacaagtacatccaggagctgtggaggaagcagtcggacgtgctgcgggtgcgctgctggcagtaccgtcagctctcagcgctgcaccgcgccccgcgccccgcgccccacacccaacccggcccgacaaggcgtgcaggctaggctacaaggccaagtaaggctatgtcatatactggatccgtgtacaccgcggtggccgcaaacgcccagttcctaagggtgccacctacggcaagcctgtccaccatggtgtcaaccctctcaagtttgcccgaagcttgccgtcagttgcggaggggcgcgctggctgccactgtggggccctgagggtcctgaattcctactgggttggtgaagagtctacatacaaattcttagagtttatcctcattgatccattccataaagctatcagaagaaaccctgacactcagtggatcaccaaaccagtccacaagcacagggagatgcgggggctgaggtctgcaggcagaaagagccacggcctgggcaagggccacaagtccaccacactattggtggctctcgccctgcagcttggagaaggcgcgatactctccagctccaccgctaccactaatgtaagtaatgttggtaaagttcttacctaataaacaatttaggacgttcttgtctgcttaaaagtgttttttgtttttttttaaatttgtctgttaaaactagttgccttcagattgcttcattgaatgcattgtcaaattatgaaagttaaagtgcaataatgtttgaacttattgaagttacttatacttacacatataagtgtatatgaagtgatggtatatcttgtttttaataagggaaatgcctttgtttttgctttattagggaattgatatgtctgtgtttaaaatgctgtttagtacaagaggtgtaaaattctgtaaaaaaggagtacataaacttacccctgtagatttgttgatgcatgtggtgagacctgcagctttactggggtgatgcaacgctttgcagttttatggagtttggcagggacaatgttttcagttggattttccttggaaatgtgaatggtgtcctgatcctttctcatgatcatatgcagaaaaataatgaagtttttgactagggcccacatttaggcttaatctaatattacatttgtgtaactgctgcttcgaaaggcaaaaagtattaa

SEQ ID NO: 61341 - DNA, 1926 bp, Bovine  19866881564954
tttttgctgtatggaggagtggggtggcactcgtctgtgacctgaatcgggcagcctggaagaactggcctgcttattcactcactgtgggtgggccacagggaccaacctctagggcagagggacagtgtgccctgcatctgccactcacctgtgcccacactgctcagctctcctggttctggaccagcatccacttcagtgtgtcatgaggaattagaatcacgaacacaggtgctctcacttcttgcaggaaaccaaaagccatggagtgtaggggggcagatttgcttttggaatgatactctgagtaggcagggcgagcagatggcagttcacttagagaagcacacagagccctgaggttggagtggttggaagattagtttcgcatgatgactggcagcacaacccctggagccaaagcctgaatacctgtctatgcctcgaatccctgaattcagtatgacctcaaagaccagggggacagaatatgtgggaaggtttagcagcctacttggcctgaaggatacttaatgctggtactcaatgaacctgctttctattattacaatcataatagatctgcccctttgttctgatatgggcttcccttgtggtcacctggtaaagagtctgcctgcaatgcgggagatctgggtttgatccctgggttgggaagatccctggagaagggaaaggctacccactccagtattctggcctggagaattccatggacgtacagtccacggggtcacagagagtcagacatgactgagcgactttcaatttcacctttgttctgatgtgccatgggccccttaaggatttctggggccagcccacatttgcagaatgaccagaccccactatgggtagcttgaggatctttttgctaaagctttcattgattcaggctgcacctaatcaacttaggtaggcactcggagtttttaaatagccaaacagacctttaataacacttttgtagatcacatccagggtcatgtgccactgtgacacaaacctccatttgctctcctgtgaaatgggtgcacatcctccaggttctaggaaggagaagcctgtggttaacaggaatagatccttgcataagggtaagacttagaggtcccaggaagatggccccgggtgattcctctcctctctgggtttgccccagactctcctgctcctgacttcctcggtgaatcagccgggcgattcaccaggttcagtctgggagcaggcgtgaagggtcctgcccgtcttctcagacacacaagatcgcagattttcttctctcggtcttggtgtctgccacagatcccgggtacaggctgtagactgtgggagagtggattcccgccatccccgccttctccccatggggcacagggcaggcattcatcaccgagaacaccctctgcgcgtttgttcagtgggtgtagcggtagacacgtttcgccccagcaacttctttagtattgtcactctcatctcaagaaagtctcatcaagctgttccatttactccaaagcagcgaaacgaaacgctgctgtgaccagggctcggcctgctcttgatttcaaaaggcctcgggcggcccctcccgatatcgtctgggctcaggatgtccctccatggtcatgcccagattcttgatggatttattaagtttcatgggagaaagcttttctctgttgtttgtttagcaaatcctcctgttgggagatgattgtaagaagcacagggagaagaaatccagtcacctgtggttccagaggccccaggggccaggtggggaaaacacggactggactggggtgagacgtttgcctaaaggtctgcactccttgagggcaacgctgaccacccctcagggagtctcaggcacccgtgccgccaggtcaggcagcaggg

SEQ ID NO: 61342 - DNA, 989 bp, Bovine  19866881899721
attgtttcaggacgagactagacacagagcagaggcctggtccttgccaacgccagttcacagatgtggggaggctggggctggctcagaacccaagctccactgctcgtgccacaccccagtgtcacagctgtcctctgtgtacctgatgtagggtttcaggatccgagacgtgtatgggctgacgatgctctggtccacagccgtatcttccgatcccaccaaacggtacagaaactttgtgctctggtgccggaatcctttcctggatggcaaggcagtctgtgagaaagacaggccagttatacaaaaataaaattactcaaagggctggtttcatttctacagatgagtagtacttaggacatttttatgtggcagaaagtaggtctttctgcaggacttaactggaaaatttaaggttcataaaaacttcataagtacctttgcataaaactggatatgaaaacctaattgcagtttaatagtttaaaggcaaaataattaaaaagttttaagttatgtatagcttctccaagtttcatgttgtctataaggcaccttgaatccgttcatcaaatatcagtcagcccaagcatcaggtgggtcacacacacatgcacacacacatacacggctcctgtctcatgaagggtctctgttaccatggcagaaatcactgttgcatgtgtatatggatttattacaatatgtctctactgagtaaatctcacaaaagtaggactgacatagattattatccctacacctcagtgtgagcagagaggactgaccagagggtagaggggacatggtccctgctccccacaggcctgcagacgcctgctctccacacagggctgctcaagggccctcagtcatgtcgtaatagaacacggacaattaggtttcatagcaaacagctcagacggaagattaaaaagtacatttacaaagcggtttgccaggggttggatgaagtttagaaa

SEQ ID NO: 61343 - DNA, 1544 bp, Bovine  19866880745462
acgtgtctctttcattctggtttcctcagtgtgtatgcccagcagtgggattgctgggtcttatgaaaactgcccattttagattgttgcttcacctttatctttccacagtccccaccactccataatgtattacaatctagccccttgcactcgacagtcttattgtctgatctcattaggcctctgaatttgcaactcctactataaactgatataagagaaatgttgctaaggagctggaggtggtacatttccatactgttgaaaagacatacatgtttccactataatgcagaaagtgaaaaagttcatttcatccagtcttgacgacatgtttcctcagcattcaaatgggtcacttcacatatactatcattggttgagtctaccaagtagagtcaatgcctgcacctcaagtggaccacactgatgtccatcactggcagttactaccagaaaacgttcaccatagttggaaaccatcaagaagtggtaccaacgagagcagttaagcttagcatggtatttccagagtcgcacaaaacatgtctaaacagatattcttggtaattatagttttataatacaattcttctggaaataatagttttcttgagtaccagagaaaaaaagcagacatttggatccaactgtagggacatctttagaagttagacgtttgagtacttgggtatcaagtcgtcatttctggaattggaagcagaaaggctgaagaagtgatgagctgaactttggtatttccatgagtacagggaatatatttcaaatcttatgtgtagttgtgtttactcccaccaacctataactctggccctggcatttccttttgaaatcagtcatgaaataaaagggtgtttctattgttcaaattacagttgttcagaaggaaatgttctataatttagatcaatcagaggcccagaggtatgtgacaagtgtgccttgatggaagatatatttttcagaagtaggtcacgttcagtcagtattggattgaaactgtgtctcctttgcttgccaacatgggagaggattcagtaactccatgtgtcctcaaggctttctggaccaagcagaagaccatccttgtcagagtgtacaattcagccttgcatcacacactgcaaattgtaagacatgcttctttatcagcggaactgtatgttaatatagctgtcacattaaatatttgctgctgtgactcagttaatgactgtcataaaagtgtggcagtatctggcattttcagtgtttgtggtgcctaatgtacggcctgctattgtaaataggccgcacatttagaactaattacatgccagctatgatagcaggtttattttttacaactatctgagctgtgatcagcacttgtaatcacaaagcaaggaaaaaataggcagtgacagcaacaccttcatgttgaaagcaaattcttgttctgaagtgttatgaaatattacgtgttttccaatagaaagtgaatacaattagtcagaagcagatataattaaaaaacaccc

SEQ ID NO: 61344 - DNA, 1952 bp, Bovine  19866880823791
aagctgccttgttaaccttctgtccagtgtgccaaaaaagcaattatagcaattaatttttccaagtgtgtactgttctctttaatagctgacacaaaatatggcaggagacataagatgcctgaccaattgtgtcaggggcccacagagctgatttgatccatttatcagcaatgagtaggagtgaaatgccatgtacagtagttccatgctacccttgaccctctaattatgatgggccttgcaaattaatgcctgagaaggaacaagaaaatgaaagatttcctagaattttaatgagccctcaaatgaaggcttttgaagttatttcatatcttaaaattagcaagaagaaaaatgaacacaacagtgaaaaaaaaaaaaaccctgaagattcagattaagtagctggattcaagtgctgagttacaaagaccatcagggtttggggtttctgttggctctgaggagacaactttctctcctctgagctgaacaaatatcatccagacttcagggagttggagccagttgtgtgatcactagaagaaccctagcatggcaaccttaccacacaggtgggcaagtaggtgcatgcaatccaagtggcaatactccacactgatgtggcccagagcccctgaggtttatgggaactcgcttcccacttactgtccatgaaatgtggttttcataaaattttggcagcttgctaaaagacgatgatctgaaattctgcaaaaagcatcttcttggttaagtcagattgatcagtggtttatcaaaataaaataaaaattattttgaagaactattggttgatccttctaggaatctagaagcaaatcttccctatgtagccttgatattaaaatgttgccatgcctacatagtggcaatcatactctgttctggataaaaggagtaagaaacaaacaagtagaaatacaagaaacccattttttccaactgtacttgcaaaatactagtccctgtaagatgctcaaaggaaaagacttttgtaaaccaataatttgagtcagtgctatataatttaagtttctgttgggatttagatttcacagttgaatataaaaggcttcaagaaaacctacagtaaagaaagttgtggactttgttaaactcagtatttttaaaactaactgttcatggatctatttatccatccattcatccatttatccacccatccaccaaccatccatctattgttactaaaaataattacatctcatggaactagtgtgccatgaagcacaatttggaaagcatagtaccctagacaggctttcactgcttattctcacctctgtggagctttcatcagtgctccagccacaatgacctacatgtttttgttctgttgttccatagaaatttccgcaaaccacttagaggatgtataatgagattaaacaaaagttagagacataaaaatttgatgattataactgctaatagtattatctgtgtctgctccgactatagactcctccaggcataaggtattttcttattcatcttaatattctcagcacatagtggagagattattgttaaatatttgtacaatcatctagttatatcatctcttacctttgtttttctctgtattcctgccccattttcttgatgactgattttctctgcagggtacttgctttctgcttccccataatttcacactttgacttaaactagagtccactttgggcctgactctgtgtgactcttgaaatatagaggacaccactctttgattactaactctgtgtctcctgagtcaaattataaagaaaaatctggtttaaccaaccaatgttttggcctatttttaatcatctgtctgctgctgcagctgctaagtcgcttcagttgtgtccgactctgcgtgaccccatagacagcaggctcctccgtccatggggatt

SEQ ID NO: 61345 - DNA, 1724 bp, Bovine  19866880846571
tcctgggcgattctgatatattcttttctgcatccactccaatccttccccgatgggaattaacaggttcaaagccaaatactgacatggtcagaaaagattgcttgttctaagtagagtgatgtgtttccaggcaaaataacctcaggagtcttctcagtggttttccttaatggacatcattgaccagacacaccaaaacccttcttttccccaggtgcagaataggaggagaatatactgctggatttttggtgaagattaaatgagatattatgcaaatgaataactgtacatggagagtcctcaataaacgtcacttcccatcctcatagcatcagttggcaatgaattatttcttttgtttcctaacacttatttatgttttcatgcatttatttacatattagagaacttataacctaatggaggcccatggtctcagctacaggtattttgtttgcttactcttggttattgagtgccccttggtaaatggcaggatggcagagtggagagaatatggcactggaatgagaatgactgggtttgaatttgggcttcatacttttaaactgcatcatcctgagcacatctttgtgcctctatttccttattataaagttgaggagggaagacataataattagtagtatctatctcatggggttgttctgaggattaaaaaatatatatatatatggagagagaggcagagagaggcagagagagatgcataccatagtctggcatcaagtaaaacctgtaaaagtgattgttgtaactgatttttggtcaatacatataaggcatttataatggtgttcaataaatattagctgttgtttttagtattactggcctataaaacatggtcaaacagcctcttgaaaataatttcagatttagggtgattcttactaccagaactaagaattattagcagtagttaaggtggcaacaaaagccagtctttgggtggtggcacggctcactaggactttaaggctttatcccaggctacatgaatagtatcaggttacttgtttcttattttgcttttggttgttctatgtctttattgtaccacatgagctttgttgccctgtagcgcgtaggatcttaattccttgaccagggatcaaactcacattcgctgcattggtaggtggattctttaccactgtaccgccaggaaaactccaagttatctgtttcttaaataccatacattacatttgcacactgatgagcaatggactcaactgtgtccacagacacaagtaaaaattaatttattgtcaaaattttaaatatggactatttcacataaaattctggacattctgcctcttaaacaattagagtatctacaactctgggcttgctgtcatacatggcaacatctgcttcagctgtgtaaaactgcccattttattttacattttatttttatttatttattttttaatataaatttgtttattttaattggaggctaattactttacaatattgtattggttttgccatacattgacatgaatccgtcacgggtgtacacgtgttcctcattctgaacccccctcccacttccttccccataccatccctctgggtcatcccagtgcaccagccctgagaatcctgtatccttcatcaaacctggactggtgattcatttcacatatgataatatacatgtttcaatgccattctcccaa

SEQ ID NO: 61346 - DNA, 806 bp, Bovine  19866880906405
tggaatgtcagggagataatagagtcaaggagaccatagatcctagtaaccaatcaggtgagaaaggatagaaggagggacacatgtgcacaacacacacacacacacaagtgttatctgttatatgtagaagatgggttcatttctactaaaggaaacattcatggactacaaaagtcccataaaaaagtcggtttccagagtcatcagaaacaaaaggagagactaagcttttaagatcataatacacagtctaatatatatataatatacagtctaagggatattttggtgattatggaagtccttccagtcaccatacatgtgggaaagactcaaaaacacttagacatgacttttggtgccaagagactggctttccctgaggatttctaaggtaaagtatggttactgagcatatcctgcagaaataccctgatgctttgtgcccatgatagctcagaattggggtgggttccagctgtctggatgggtagcactattgactcatgtctgagatctgctgggtatttatgctgagagccctaaagtgaaagaggtcagcattattgtctggaccctttcagctggagcatatgtaagactaatacccttgcttttctgtgatccaaggtaatcagccagggttggggaatatcagtctgtgaggcagcattgccttctgggtgagaacttggaggtgaacagaaatttctaagtgagcagctctgatcacagggaattaacctaaagtgtaggcagaacagaacacagacaaggaaagattcaaaggctctaggaggcct

SEQ ID NO: 61347 - DNA, 1071 bp, Bovine  19866880967322
actgccccccttaatcccaaaggaaagggattgatggattcaatgtatctccctgtaagagtggtcatggcgagcagatgaaagctgataccaagaaggtttggggtgaagaggaacagttattttctgtcttctctgagattggggtcatggataggatgggaaagaaccatgaactgggcaccagaaagtaaaaattttcattttttctttgctcttagatagctgtctgatcttagaagcaaaaatctctctgacatcagttttatctcttgcaaaatggcgatacttctttactttccagttgtgtgtgataattaaactaagtagaaaattggaatgtcctgtgagaagcacaatattttctaaagatgcaaccagtctgaacctttgaaaagttgatagtgaatccagtattcaagaaaacaaaaggtgcacatccacacattgactaaacaaaacctgatgaggaatgaccagcgttggagactgctctaggaactggaagcagaaaggtgattgagagagacacgctccctgaccgaggctttccaggtggcactaatggtgaagaatctgcctgccagtgcaggagatgtaagggactcagcttcgatccctgggttgagaagatcccctggaggagggcatggcagcccactctagtattcttgcctggaaaatcccacagactgaggagcctggtgggctggagtccgtagcgttacaaagagtcagacacaattgaagcatctgagcatgcacccatgctccctgacctcaggttgtttactggactaagaaataaagaaattacacagagcagtcagcctttgctggtttatcttgtagtaacaaacccttgatttcaggtgacttacaacaacacaactgcatttttttattatgtaacttggtgttatattatgttggtgggtgactttgcccacatgtcttttcattctgagacccaggctgaaagagaagacctcgcatgggatactctgttcccatgaccatggaaaagcagttgagctggtgcacacatcccaaggctcataaagcttccat

SEQ ID NO: 61348 - DNA, 1219 bp, Bovine  19866881044122
tttttgttttttcaccctgttttaactatttgaggtaaatagtcatctttcttctccccacccccaatcacacagcttacaaatatatttcctgagactgtgtactctccccagtttttacaacctaagaagaagtttagctagttggtagttggaagacagatctgaagggagtaagtagtgttagtaatcagtaggccacatccccttccagaatgttccagctacttttgaacctaggcctgggaaaaaatatatttaagtttcccttggagacactgttaaattatattttattaattagtgtccacttaaatttgaatccatacccagggaaactacttttgctcttaagtttcacccatgcatgattatactaataaaacaatattttaatatgtaagatgtttactgtcaaaaacacatttattgagatatatatatatacacacactttccaaagtacttcattaatcaattttttataacaacatggagctccatcattttcataatattctgaaatgatgatgcaaacattcatattcaaaagtatgtaccaactactgataatatcactaagactgaattcacttgccttaagtgaaaagccacaaaagaagtttctattttcagtgtagtttatctgtccgacgttttccactttgtgttcaaaagagagtggccaaggccatttgggtgtccgtgtgtagctggaggatacagattccacttgtggaattggtcaagatcagagaacgtcttcctttcctgtggcttagaaactgagttgttaatatagttattctgtctggcatttagatcatgaattttgcccagatccacatcaaggagaagaggccctttctatgttagatttgcagaatgacttcagatgttttgactggagagctgcagaacagaatgaaaacagtacaagccatgatctcctttgctgctttccagaatgcaccgggttctgttcttgttagctttgtattagtattataatagcatgctccttatacagcatgatttggctttattattccctttaagatattctaattatttgtgtgtgtgtgctcagtcgctcagtcatttccactctttgcaaccccatggactatagcccccaggctcctttgtccatggaatttttcaagaaaactaagtgggttgccatttcctcctccagggggtcttcctgacccaggga

SEQ ID NO: 61349 - DNA, 929 bp, Bovine  19866881390827
aattcatcaatacctgacacagggctgcccctgtccccattaggcaccccatcattgactagttggttaatttcagaatttggtttagagtcctaggaatgattgcaaaattttttttgacatcagggctccttgagcctatcagtttattcaggatccaggaacaactcttaatattaaatacaggcagtccctgcaaattcctaggtgaatagcattcacgtgggaatgagctgtaaaagtggccgctgcttttcctaaccagcctgcctaatccctcttcacagggtcaggtacagtatgtgtacgggctcctcaagactgtgcctcctctttctttgctgcaaatgtttgtccctttactccaaaccagaacaaaccactgctagagggacccacatctgtcccagcctccttccctttctcttcccatgggaagccacagagttcagaaggttacaagtgggacccaaggccccagtgatggccacctcctcattactggcagagcgtacacctcaggtctgcacattgcccagccctttgtattccacaggggctctgtgtctggaatctccaacactcctatcatgctactacctctggacccctcccccactcccgcacggggccctccaccccacacccccagcgctacctgaagaagcctttacaccaggtgcagcccgccttcctgggcccttccaagcaagaatccctggatgagtttgcttgtgggatgagaaagccttatttttacagcaccaatataagcagcgaattggccctgcactcccagttcaaattcagtgtgtctctcacagaggcaatgtttccaaagtgtgggatgttctttaacgggaggaatgcaattcacccatattatggtgtctgtggaatagtctcggtggcaacccctcagggggcta

SEQ ID NO: 61350 - DNA, 1570 bp, Bovine  19866881468769
gtaaattgaactttattatgtattcatgaaatgcagtttagtacaattgttatttctggcatttgtggtttaaagatattcccttatgggtagatgttatttttaatgtgcaaattcagaaataatgacctccagttccactggtgaattagggctgatatatacacatggacaataagggggaaatggtctctaattccttgctttatgaacatttctagtgcaatctgtgatcctttaaaaactgacattaaacaaattattttaggttacaactgtattgccagtgaagagaaaagtaataaagtaaatattttccaaggtttttaaaagaatgatatttgacaaggacatacctgaagggggaaaactcacttactaagaacaggttattgaaaaatctcagcacaatttaaaaaaaaaacagattaaaattctcatgaaatgatgccttaccggcaagttcagaatgtaaaattggaaacccaaaaggaatggataaacagataaacaacacacaccaaataatttctacaagcctctcagaaggaaactgttcaagaaaaaggatggcacgttgtctttttatttagcttaattcttttcagctctaggaagtttgttggatagataaaccaataggtagaacagtgttaaaaaaaaaaaaagaagaaaaaaaaaaaaggacttcaggaggcccctgtgcatgcatgccaagtcttaccagtcatgtctgactctttttgatcccccaggatcttctgtccatgggattctccaggcaagaatattggagtgggttgccatgccctcttctaggggatctttccaacccagggatccaactcacgtctcctgcatctcctactttggcagttgtgttctttaccccttttgttgttgttttgctcagttatgtctgactctttgtgaccccatgggctgcagcatgccaggctttcctgtacttcaccatctcctggagcttgttcaaacccatgtccattgaatcagtgaagccatccacccatctcatcctctgtcgcccccttctcctcctgccttcaatctttcccagcttcagggtcttttctaatgagatggctcttcacatcaggtggccaaagaagtggagcttcagcttcagcatcagtccttccaaagaatgttcagggttgatttccttcaggactgactggcttgatctccttgcagtccaagggactcttaagagtcttctccaacatcacagttcaaaagcattagttctttggccctcagccttctttttggtccaactctcacatccatacatgactactgaaaaaaccatagctttgattatatggacctttgttggcaagtaatgtctctgcttttccatacgtctaggtgtgccacagcttcttttccaaggagcaagcgtcttttaatttcatggctgcagtcactatccacagtgattttggagcccaagtttttaccactagtgccacctgtgaagcccagaaagttcatactaaatggtgtatggtgtgaattcccatcaattttttcttatcagaccaag

SEQ ID NO: 61351 - DNA, 1385 bp, Bovine  19866881602906
acatgactctagcagatgtagaaatgtgcctgcagagtttgacttggacatccgtgcgtctgctgaagccaagagaagcacgtgccctggctagccaccaccctgcccacctgtgtgcaggagctgcacacatggggtaaagccaaacccccaatgacccacagacccatgagcaagaaagataagcatttttgtctaagccactaagctttttgaggttgtgtttaatgcaccattattgcgacaccagcttagtgatatacactgctgacatgctttcacaccaaagggttcctgtgagtatcccatgaacattagtttgctgcatatatcaatggcagaaggcatctacattcttattggttcagccacctctttccacctaagaggctcccacacaggacattctagagccaagggtcctccagctctctggccccatcacaggcttcattcaggtttaatgaactgctcatctatttgtctaatgtcactattttccccaactcggctgtacggtacctggactgtctaggaaaacccattacctctattagcttgccaatagcaaatcagtagaattgcttgttccttaattgatagaatacactcccctcctcctgatagattaccctggtctaacagctccaagaccgattccccagtgtccgactaccatgcaatccggagcaatcagtttatactttcagtaataaatcctaacctatcaatatataatagctcttcataatcaacatccacagattccgtctgggttcagaagcaaccaccagccattttttaacatgcctataattagcagtggccagatgatatttgtgcatctgagcacgatcctctttccttgtccaataatgataatacattttacataaattcaaactgatttaattcccttgtcggggtatggagatataaatatatttatgcatgtgtaatgttctgtaaattaaaatagttcagctgacctcagtgctgcggtgagagaatccagcccaacctctccaagaggctgactgtgggctggcgcaaaggaactgctcatgcagatcagcaaagatggccaactaggggaagtgatacatatcatttgttcaatacccattgacctaagtgtgccctgcaagcttgtgaagagctcatctccatctaagagcaaccagtcttagaccaaaatgcatagcctattgctgtttaacactaaaagggtactgacatagcggacaacctttaggggaaagaaaagcaatttactaacggccagaggagggcagtgggatgggcatcacgtgctaaagacacatcccttcaatgcctcttgctggagagtttgccagccacaaggacaagagtgtcccctgctt

SEQ ID NO: 61352 - DNA, 937 bp, Bovine  19866881917953
ctttttataaattaatgaattgatgtaagaatgtactgttttggtatttcaagatggtgtacagtggggaagaacaaaaggtttgtagtcagagagacttgggttaggatcaaccccatgcacgagcacttgctggccaagttatttgacctttctgaaggaatgtaataatatttattacatataattttacgaaggttaaatgaaatagctgatatactactcttggcacaaagtagatattcaacaaataaaacttattgtcataataatatggtagatttgagtgaaacatgtgatatacatgtttgcttgaaagctagggagaccagaatctactttttgctctaattttgaattacatagcacttggcatattggtacttgataaatggcagcaattaacatgtagtttttatttagctctgttaccctgggaaaattatagtctcactttacctcaatttgtgcataagttaggattaacctatatttcttcaagcattttctgtgttctgagcattattggagcacatctgattcctgaaggaacttaagagtttagttgcacaggtaaaaccaatgtataggaacaaatagagataaaaatgagtgtaaattctcataagtgcataggggttcagaaaacagataaggtaaaccattgtagcaacaaaaggaatgacaagggaaaacaatggtacttactctaggcattgaaggttacttaagatttggatgaatgaggaaatggtggagaggcaaaagggctttttgagtggcagggggacagcctgagccagggtgtgaaggtaaaaatgaatgcatctggtgattgcatttctgagacatggagcttatgatctggtgtaacgtctgaggattgcacataagtatttgaaattggggccattgtctttgaagacgattgagtgga

SEQ ID NO: 61353 - DNA, 1254 bp, Bovine  19866880388187
gagtaggaaacaagaaccaactccagtattcttgcctgggaaatcctatggacagaggagcctggagggctacagtccgtggggttgcaaaagagtccgaacaacaaacaacagctgcctctaccaggagtcacttaactcctctgaactcagtctcaggatcactgaaacgggaagattcaatacctgctggcagcttggagcatcacacatgaaatgaggatatatgttcactttgtaaacttcaaaaattaaccagtgtgagaaattattatccttccccatcacttcaatgtagtttgtttcttgctctcaattgttttgagagcaaaaaattaaaaaagcaaagaaattaagatggaatctgtgttcctcttccctccctcaacatataactgtgtttagtttttctgtgtgacgagggacatggagaggctataaggtacagagccccagcattcagagccgtaaatcaaatttcaaattcacaacctttccctcaaggatcacttccctcctcttgtgatgcatctaattcactctgtgtgtattgatcgggtcacgtgggatctagaccctggttcaacgggccccgtgggagggaagtgaggctaccctcgaagtcatgaatgtgtgggaggtggaagaaaagaaatgaatgagttctggcacttcgggaccacaaagatatgtgtctttaaaaatgctgacccacaggaaccttaaaataacataactttctgctgcagaaagtcctcggggggcttggccggattgaggactcgtcatgtcatgtatagaggggagacaagcacatgcatgcctgtgtgcaagctacatgagcatcaggccgtgacccagaggagtgacaccctggaaatctacgaacactcacaactcaactcttagacgctgtcacttggcctgaacataaaactgtcattaggctttgcgctgtagctaagtcttggttggccaaaaatttcgttcggctttttctctcgtagcttacggaaaaacccgaatgaactttatggccaacccaacactttgggaatcagtatttgttttcaaaaatttcttctctggctcggccttcttgggcagtatgtcgaacatgacatttttataggctggagcccaggaagaatgcataatcccgtgaatagatatcattgcctaaggtgtcaccttttcttgccaccacagggttttgatactttggcctttatgggattacaggatgtcagtaaa

SEQ ID NO: 61354 - DNA, 2268 bp, Bovine  19866880528830
atggtctggagtgaatccctgtaaccttggctctgggttctgttcagtgggattgttaatacctgttgtaaagaatgaagacaagaaatgatccaagaaaggtttaagaagacataacgtggctttaataatttcagtgattttaatgatgcttatttttgagagcaaggccaaataatgtttattcacctacaagatctcaatgcaataaaaggccagttaaaagctttcactgtgattcaatacccatgcacttttgaatattaaattatgaaatgaaaaacttccaaggcattaatggaatgaaatgaaagacagagacatttcaaatgattcattggcaaaaatgtcctttctgttataaaatgacttttccaggaacacgacaaaatttttattactaggacaaataaataaaagatctttagacttgtcctgcatcacttgtaatttcatatttttcaattaagttcaatttcctgaatattaattaggctcttactatgtataaagggatcttgctaggtgctagagatagtgagataaatgtgaaatggacaaagatggaacatgagagctgccatgaaggcagctaacaggattgataaaaatcaatctgtatcatggtaactgaatagaatatgatgtactaaccaataaaatgcaatttgtttctaaaatgaacatttgtttgtcaaaaccaaaataattccttttctctgtgcttgaaaatgttgcttcaaactcataacttcaaaattcatgtttcataaaatagaacaaatcaagtcattgagtattcatggtaaatgtaagaattcaaaatttaacaattcaacataagttgtattgctgtttattggggtaaataaagcttgcaaacaaagaaatctaattaatatttatattaatcttattaagaaatactgctaccttattccctttttggccagatacctaaccaatggcctcaggccattaggtaaaaaaccaagccaatcattggagtagactaatgatttcttcatgcatccacccatactcattgtattaattagattatcatttagctgctgaagaaataaatcctaaaattttagtagcctgacacagtacaatttcatttctcgctcactttccagtccaacgttagtgttcctggttagtggttgccttcagtatggtcattcagagaaccaggttcttttcattctgtggcttgccctcctctgtcatcttggactctcccacatttagcaggcaatgtgaaaagagagaggctggaaaaggcacatgtgctttgttagcccttttggctgagaagcgacttctcacattccactggaaagctctcagttggccatacctaactgcaaagcacgttgggaaatacagtctaacccagagcccaggagggggaggaaagaatgggcctggttcacagttacgcacactccatcctttgggtcctcctgcaaagagaacaccttcagtccttccacaagggagacaaagtcacattcacagtcactgatcccagggctaagttcagagtcttcaagtgacaaagtaccctcaccatcagacctgtatgtgccatccagtgatctttctgactaaaaagacattgtctgccactccacgctcccactcccaatacacaatgactgagcagggacaggaggaaaaactcctatacagaaaaattaagcatgggaaacacacaacagcctctggtccacagcaacgatgacattcttcagacattttgaggttttttgtgacttgtgtaacggggattcccttgatttgatgcagattccacattctggaaggaactcccttcccactattcttcctggcccctgaatcttccctctaggaagttcttccttttctatcatcctccatagccacatctgagacaggcactgagcactatgccccctagaaatccatccagcccaactgaagccagggcaagcttagagacccaaagcttgctttaaaactgtaacagccaaaaggtttctattctgagctcagaggtttttttggcaatacaatttccacaaaacctcagtaggcatttgattatttactttataccactaagttctgggttgttacattgcctggttaactggaacactatcagagacttactaaagatgggcacaataaaggacagaaatggtatggacctaatagaagcagaagatattaagaagaggtggcaagactacacaaaagaactgtacaaaaaag

SEQ ID NO: 61355 - DNA, 1473 bp, Bovine  19866880757797
catcctctgccaccctcttctccttttgccttcaatctttcccagcatcagggtgttttccaatgagtgagctctcatgttagtaaatcagagaaatccccccactaacaaaacgtgttggtatttttacatatatacgtaccgctatttcttcctccagagcagttttaaaaagcttgaggagtagatattcttctcgctgattggaagcataattgtacagggtgaaaataactgtatccataaatttagttgacttgttctgtggcatctggaaaatcagcttagccaggtatgaaggattggtctaaagagagaagacgaaacgccccccacaagactgtatgttaatatactattaaagcagagaggacccccagttctttattctttaatgaattcttatgtatgaggcacacagaagagtatctggctcatattaagacaggtagcagctaacaacactactatgctataggaagttataatagaaagttatggtaggatttaaattttatatactctatcatgtcatattttatggactataattacattatgaatattttatactgttcaccatttgaaggcacatattaatatttatcgtagagacaaagaagagaggggggtggctgagctatctgaagagactggcaagaatggatcaagggttgagctatagagattgtcttagaaggactgatgaatgaatcaacacagtctatattctgagactagaaagcaaaagcaaagggtatgagacagacaatgggatggccgtaatggtttaaaaaatattttatgttttctaaatgacttttctttatcttaaggatcattctatttgtggctgtgtgtgggccttctccagttgcagtaagcagcgggggcgactgttagatccagggcacgggcttctgagtgtggtggcttctctccttgcagagcacgggctccagagtgatggctcagtagttgtggcatatgggcttagttgctccgtggcttgtaggatcttcatggactagggatgtgtctcctgcattagcaggcaaattctttaccactgagccaccggggaagcccggccatgatgttttacaaagcatgagaaaggaagagcaagacaaggaggctgaacggtaaagttcagggtaggtcatggggaaaatgccagaagaaactgataagaaaaaaaaagattgacaagttttaaagattgacaagaattaaaaaaaaaaaattgacaaggagctcaggtgaggatggagttcaagagatatagccccagactttgtgctggtgtggtttttctgaaggaattacactaatcagaggttagaagaaaaaaaaaaaaaaattaaagtgacagagaaatgcaaaagtcttactcttcatcttccttgcagtgagaaaagaaaactgtccttttcttttgtatttcacataaaagaaacacatgggaaacca

SEQ ID NO: 61356 - DNA, 1084 bp, Bovine  19866880856625
cagccccatggcaggattcagtgctgggtgtccctgccacttagaaggcactgccaaggctctgagaagcggggcctggaacactctctgtcctctggagcttagagagttgacttagaaggctctatcttaacctgttactaaatcctggtttcagtaacagaggaaatggggtttttacaaagttgatcgcacttagaccacccgatacacaccagaatctctcaaaatagagacaattttcatcattcagagttttgtggtttgcctcttggaatgttgaggagtaccacaaactcctacttgaccacagcctgaggtgtaaaaactacatcatgaataacacctccagttggtgcctgaccacacacagacacaccaacatgtatctcgtgacataagggagatgtgtgttaaaaatcaaaattgagtaaatttgaagatctgatgggctttattcagagattcaagaatcagacagtagctcctgtagcaactagaggggaactccagagggttcttataggctggaggagggtgggacaaggaggtattagcaaaagaaaagaggatttcaagccaggctgtgttcttctgggggaagggaactgcaggggtcttaaccatgcagattagctccagagtcttgatccaaaaattaaggttgattgttttatgggtcacatttatgggcagggttaaaactgcagtcaaggtcttgctttgctgtgaccctgggagtagggagaaaaaaatcaattcatttggggtttgtcattttttttttaaacatatgtcatgtcagacaatgttttcactgacttggtctctttcttcatcacaaacctccagaatattaaagtatgcaaaggctttccctcttgtggagttcactagagcacattctttgagagtagctagaatcctgtgatgttctttctaagttctaggtgctgaagagtggagttcagggcttctctggtggctcagcggtaaagaatctgcccgccaatgcaggagatgggttcaatccctgatccacgaagaccccacatgcctcagagcataagcccaaaggccacaa

SEQ ID NO: 61357 - DNA, 1049 bp, Bovine  19866880935542
tgttgcaaatcatgcgtgtagaaattaatagggccagggtcttgatacagagaataaaggcttggatttttttcccccaaaacacagaattttaccagacatgatatttcagggagtgttttcctaatacaaccattctcttacagggaaggcatttccaatgtgctatgatgcttaaagtgttaggcagagcttctaaaagccctgtttccttctgccatgaataaacagcccagcagtttgtaaaaaggccttatgccatctgaacatattagtctcctggctgtctttatcagactatgcatgcacttccttgctgagtattcactggcataattcccagccaggaaagcctcacagccatctgctctatctctggtaccctgcctatgtgccagggggatagaaatcttcccctaagtactacttaggtgtttggactactgttaaaaaaaaaggaatgtagaaaaattatgtgctcaacacatgtgggctgtttctgtgttatgatattttattactctttgctttcctgcattttcaaattaattctactagctataaacatgcacagatgcagggtggagggatgaaggaagaagaggtgcctgaaggcaatgatgggtaagggaaagccctgggtaaggagatggctgtgtcttatctctgttctacctttaactgaaggtgcaaccttgagcaagtcacttctacttttcatattaaaaaggaaaggcttcctacaagcttgaacttataacactggtaaaacaaaaaaaaattagagcatgaaaaacaaatccacagcttccctggtggtccagtggctgagaatctgccttgcaatgcaggggacaccagttcaatccccggtccaggaagatcccacatgccgcagagcaactaagcccatgcaccgcaactgctgaagccctagaaccaatgctctgcaacaagaggagccacctcaacgagacgcccttgcaccccaagaggagcacccactcgccacaacctagggaaagcctgtgtgcagcaccgaagaccca

SEQ ID NO: 61358 - DNA, 1331 bp, Bovine  19866881045191
ccccgaacacatacaatttcagtcagctatacctcaacaaagctgaaaaaaaatttaaccccctccattattcttgcctggaaaaccccatggacagaggagccaggcaaggatcgaaaagtcattccatgtaagaaatacaggaaaacattagaaaaagtacaggtgaacaacagaatgaaaattagtacattcagtgtatgtctaaaccatgcaaatgctatttttatttatatgtaaaacagaatcattatccaggctagaaaacaataaacaggtgatttttttggtctacataaccgtctggcagtacagtccatcctttagccctacccactacatgccacgtgcgcccccaaacagaaggggaaaaaaaaaacaggccctgcaaatttctaacctgtcccaagggggcagcactaccctcactgagaatccagcgagaggaaaggcggggcagggactgacgcttgccttcgtccgccttcaccaccaagccttggaggcaggagaacataaaaagcacgaggagacatcttcttacttctttatagttagttttatttgacagtgttcttgcacacgaggcaaagggctgagttcagtttcactactcaacaactaatgacacagttggctcttgaacagcacgggttcgaacttctcaggtcccttacacaagggttgttttcagtagtagatactgcagagctacaccaccctgggttgattgaacccgaggatgtggaacctccgatctggaggaactgtggatgtggaggagagatgataaattatatgcagattttcatctgtggggagggtccttggccctagcgtgcaggttgttcatgggtcagctgtatattataatgaaaatgaaaacaaagccgtttcacctgatggtagatggcttggtttgagttcgtgagaggaagctacaacttgctttcgccctgtttgaatgatcttgtggatagaaatggcttggctctgtggtttctaacctgctgggaaacttactttttccgtgaattatagcccagatgaaagttggctgtgaccacacggtgctgcgcatggtctccagtggaaaacatataaatcgcgtgacttttgagtatcgtcagctggaaccatatgagctggaaaacccgaacggaaacagtatccaggaattctgtctgtctactctttgaataaacaagtcaatgatttccatgctgctagctaagggagtttttaatggctattatatatgattttgatgagcagctagttaagaacctttcataccagtcagtattcccaacgtgaacacatatcacaca

SEQ ID NO: 61359 - DNA, 752 bp, Bovine  19866881166419
tgccagctcccgtggccgtgggagtgcctcgctcctgtctacccacctcacagtgatcccagcaaaacaccgcagagaaagtaaggaaacgagaacaattcaaaaggcaagaaatgaccatctttcctaaatattaaggaataaaactacacatttaaattttctgcatttaactctattttcattattttatccagaaaaacaatagtactttggtctttagaaacagtatatgtttgtattgttcaacacacatgaaaacttttaagtataatatattccagaaggtccctcagagaatgccttttatagccttaaactgctattttatcctattcccataaagtcgtaaacaggaaatgtcttgccttttaaaataaaggcttacttgcaaaagaataaatagttgaaatacgtagcttgtggaaatgcaagcgtggcagattttcagatctttatgagtgtttaacatgtttttaaagcattactaactttttttccttggaagtcaagatttttatttgcaaataaaaaaagctgaccatgattagcttagagaggaaaagaattcacaaataccagaatcaataaagcattactacttgatagcattgtgaaacaaacttagttcttcaacttatattcttcaacaccaaatatttatcaagcactgattaaactagtgataagtacatactctttcatcttatcattgatagtaggatttttcatggataataagaatagtacag

SEQ ID NO: 61360 - DNA, 844 bp, Bovine  19866881281825
aaccaaggaagcgacgaatggggactcactagatgccatcaatcattgtcaccagaggaaaatgaaaagaatccaacatatgttttcacaaatgctccctctctctactcccactgctcctcctcctcaccgagacacaatcttaatgagcagccagtcacttgttcacaggcctccagtggaaatggataagaagcagttggtagaagcttccgaggcatccctgtttctcctgtgtgtgtctgtattcatgcactcccagggagatggaagcagggcttcataccaactggctacagacaaccccgaccacagagaggtgaacaaccgatgacggtcgcagcaagactgcacccccgtgccaggagggatggtgggatagaaagaatgtgcaatacaggtagcagatggcactctcctcaacgcattctcaagtcagggaacccagagttccttatttctctgctgaccacgatggtacttaagaaatcaattcctatggcaacagctctaagtaagatactctgaaaataaaaggatgttttaaatgaaggacagacacttgcattcattcctgggcatagagaggcagagcgtggtaacttgtgtcctaagtcgcaggacaatcacgttgccaatttttctctttgatgccataaccccctatagcacatctatcgtggctaaataatataagagaacagaagcaacaataaaagaccagctgtatacatgaagatttgcaatgataataaaaaatacacaactaaaaaacatttcatagaaaagatcatgaagttctggtatataatacagatgaaatacatagcaagtaaaatttatt

SEQ ID NO: 61361 - DNA, 2164 bp, Bovine  19866881283561
tgagatgattggatggcataactgactcaatggacatgaatttgagtaagctctgggaattggtgatggacatgcaagcctggtgtgcttgtagtccatggggtcgcaaagagttggagtgactgagcaactgaactgacagtctaatctgttataaggagattagatgcttgctccatggaaggaaaggtttcatttctttttacatcactggagatgttcaggattggggaagagagttgggtagcgataatcagaagttatacctatcgcttactgaattgtgtgattacacaattgttcctcaactggaaaacagactgttgtaagggttaaattgaaagcttctagtttattgtagacattaatcactaaaatgttagtgctgcacacgtgggagaaaggacataactaaggagagttttgcattttgacttagacatccattcacctgctgattcttagtattctttgggcagaggtgatttgcccaaactcatcttgaatttgttagctacctaccaaaaaatattagtggagttgatggaaccccagaagaaattcacttagaatatctccatctgattctcagtttttaggagaaaaataaaagttctttgggagagttttaaaattttgcacttgaatatagttaaccagaatgacacttggatccaatgtgaatttagtaaattaaaataattgagtttcaagtttttgatttacacatgtctaaacctttgtaaagcaggaaattcctattaggaatttattattttacttaggatctactcacataccagaggacataagatattgtctattagcccaataaacctgtttattatctctaatttatatacattaaaattcacttttttagtgtaaagttctataagttttagcagttgtgtatatttgtgtaatcaccaccacgataaggatacagaacggttatatcaccccccaaaagtctcccttgtactgctcctttgtaatcaagccttctccctactcgtaactgttgacaagcactgacccatacttttgctttttccaggacaccatgtgaatggaatcataaagtagtaactttcagagactggcttttactttgagattcactgatgttgttgtgtgtaatgatggctcatgccttttgttgctgagaagtactcccaccgtagggaggtaccacagtctggggaacacgtgagatcctttggttgttggcattatgaatagcgctgttataaacactccatgtacagagttttgtgtgaatgtaagctttttatttctctattattataatagcatgtaagagtgagattgctgggtcatatgggaagcagctgctacagaattttccagggtgtaccattttgcatccctaccagcaatgtatgacaatattagttcttctgcctcttccttagcacttgatattgtcattttcttgttgttttgttgtgcttttgttttagccattcaaatggctgagtggcagtaagttgatgtggtttattattttgtgttttcctgacggctaatcttattccatgctctttggttcagtatcttttgcccatgttaaccattaggcttcttcttgttgagttttgtgacttctttatacattttgatacagtccttttttgcacatagatcaacaaatttttttgagtcagtagcttatctttccaccctgtttaacagagtcataaggtttttaattttgatgaggtccagtttattaatttttctcgtgttatgtttgtgtttcagcgtcctacctaaaaaccctttgcctaacccaaggtcacagagatgctctttgtggtttttttttcctaatagttttatactttgatgttttaagtctgtgaaacattttgagttaatctttgtataaaattaaagttcatgttgaggttcgtttgtttggttgtggatttccagttgttctaccaccatttgttggaaaggctacccttttcccattgaattgcctttgtgcttctgtcaaaactcagttgatcctattgtcatgcctttgcttctgaattatactcagttccattgatctgtgtgtctgtccttgtgctaatattacagaaagtcttgacactgggtaatctgagtcccctagctttcttttttt

SEQ ID NO: 61362 - DNA, 1236 bp, Bovine  19866881404246
atttgactctaaattttttttttcctttttttaggaaatatttcaaagaagcatgtaatgtccctgaaccagaagaaaagtttaatatggataaatacacagatgtggtgacagtcagcaagccagtcatttatatttcaattgaagaaatcatcaacacacattcagtaagtgaggctggaggagggtcttagcagtggacccagggttcagacatcagtcttgagaatgtttagtttcttcagagagttactgtgagcttgtgctcctgctcatgttcttaatcctaaaaaaaacacactgtttattcccggccccttatacactgatgaacctccttttcctgaaaaagaaaagttcacttttgacatgatatgtttattctctgattcttaagtgttaggaagacgccttctcccaaaaaggagcgtttacttcttccatgatccatctacagtcagatggtgaagggtttaagccccgagcaggggcagtcctggtattttctccacccaccaaggccatactgcctgaaccccatggtcagtctctccccatttcgggaattctctttgctattccagcagttttctgggaaaataagaatgttccctctcttctaaggtttggacataaagagagagggaataaacaggctgctctaggttggggaaaagaagattcccatcccccgcctccaacaacagccatctacaaagaatctcttgtgttgttctagaaaaccccatttcttagaagcaagcaatttcagtcagtgctgtgtcatagtacctccctgttgttcacacgcagacatcaccgtcaaccattagcctgtattaggtgcgttttaggggcagggcagttttctcagcattgtgagattctttgtttaagaccaagcagaacttattctgaaacagctaggttctcaaaacataatctttccaagaacagttctggacgtggctacgctaagctaatactagaaatccttgcaagacctacaaaatcagaacctgtgttctaaccagaccccaggtgattcagacccagactaaaggtcaggaagccccagaaggtggttaagcatacacccagcttccgattatacacacaactggggaaaacaaagacacgcctctcaaaggtctcgcccctgcccccgccaaaccaaatatactaacgagcggcaaaaactggctgcccccaaatttcactctttattataaaact

SEQ ID NO: 61363 - DNA, 878 bp, Bovine  19866881460764
acttgaattctgcttgtggcaagtcatagaaacaaaggaacattccatagattcttctgttcaccctgaaaacggctcccaggattgaaagtcatgaaagaagaaagaaaaagtaaagaagtttagagagaatgatttacagttccacctgcctccactatttgcttctccatggcaactctgtgcccatcctgcccatttagcctgaatcaatagcatttcaaagcacctgctgggcatccagattgacccatttaggggctcccattgttatctggtcaacagaccgagggagtggtgggtcagcggccagtccagttaaaaccctaaaagtgctattcagtgttctgatcttttctccttgggtcagaaaaaatctgcttccttaggatcagggaaggtctgaaccagagggacctaagggtgcattagttcaactcctcactttacagatgagagactgagttccaaagtctcttttccaaagcacctgcagtgcgtgaggccatacacggagttaggaagtgaactggatggtgatttggaacattttcagtttcagggcttttatttgtctgggttttgttttattcggccacgtggtggatttacatcatgcataatagtttgtaatgtgttgctggttgctttacttttctgaattcctgcatttggggcagtttctctctggttaaaatgttactatcctcctctatgctttgtcattttggttttgttgtattttctgttttaccctccagcatacaattagtgttaatatagcatcgatagtggaggtgtaatccgtgtgctgggatcccttaggaacaaggagttttcagtattcaaacaattaaagaagaatattccttaaagat

SEQ ID NO: 61364 - DNA, 1058 bp, Bovine  19866881646318
aaaaaaaaaaaaagtataaaagtaattgaatgggaaaaacattgaaaatgtgacagtaaaatttaactaggagtctcccatcaaatctcttctaataaattttatacataaagtaatttcatatttaatgtgtatatttatgtatattataataatattgttagttttaacatacttgaaatttatattcttgcatcaaaggctaagctaacgaatatcagttatccttaatatatttccacttctatctcccctcctatgtaatgttgagataatctggaattttagatgcatttttaaattttcagattatgcaataaaagtttaggtaaatacattttattagtttactttctaatttaatctgtatccagttttcttctttcttagttttatctttggttttgctatttatcagcatatttactaagtagacgaaatgaattactcactacgtgcacgtatttgactattttcatttgttccctgggtgttggttctgtttgttgaatgtaattcctctttcagagctgttgtttccttcaaatgtctggcatttcctgatttggggctcatcttgaggtctgagacttgcaactgtttgtcactgttggctgcaggtccccgtgacagaggcttccctggtagccctgttggtaaagaaactgcctgcaatgcaggagacctgagttcgattcttgggttgggaagatcccctgcaggaagaaatgacaacccactccagtattcttgcctggagaatcccatggtcagaggagcctggtgggctacagtccatggggccacaagagtcggacaggacttagcaactaaaccacaagcatcccgtgacagaagccagccttagggagatgggagaggaacaaggaggctgatgcccagagggtgctcactgtcttatcctcttagactggggttccctgtgtcttcttgggcactggtgtgctaccctgccatcagcatctacacttgtcttggggaaggatgagtaggttcagcaggtctaactaatccaaattatgcggcttagggctcgc

SEQ ID NO: 61365 - DNA, 827 bp, Bovine  19866881918823
atctgagttgtaagcactgacacaaaaggaatcacacccgtgttttgtttcctttccgggcacacacaaaactgtcccagactcgctaatacaaagaacagcttagctcacagaaagagctctttgaagataatatttctaaacaagcccatcacagaggcaaggcttttttgctttgtttattttcagaggtaagacagaaaaagtaagcacggcaaaagatttgtatgcatttttctcttttccctaaaaaaggaatattatatttcaggaacttttcttgggaaacagaatagcagccccattcataattacttgctcaactgcaatttgcaaactccctttccatttcttgccaagattccctctctgtttcctgaccttcataacagctccagctgaatttccttcctcaatccccaaagagaatccaccatcttaaatttttgcacagttgtcctaaaaaactgaagaactgaagtttgtaaaatagacttattttcaaaaatattcaaatgtattttgcagagattaatatgaaatctactcagcagtattcttttggaaaagcaactcctttaaacagtgagatgttccagcaccagagagaatttttcaaagcctgtgcatgtctgcacaaccccatgccagcaaaattcacatagcaaagaagctattaagttagcttttagggcttacctaaaaatccatatagtattatttaatatggtagaggaatgtacaatttagtttaagatggctcacaattcccaaaaatcaaagcataaatcaccttggtaccgtaatcatttagaccaaatcatcat

SEQ ID NO: 61366 - DNA, 1447 bp, Bovine  19866880352244
attctgcctctccctgctctctccctgatctgtctccagctcttctattgacctcctgcaaccccaggcggacctgcagagcagagccttccagtggcttctccacacatcctcccgtgctgttctgcttcctctggacgtacttcataggactttgatttccctgttccctttgcagacctttatttccccagcttctctcctaattgtgtcaggcctgatttctataacacacccatgttccacactcctgagtgattctgcttccttaactgaatctcagtggaaaaaaataaagcaggtaaagggcagatagagtgcacgtggggagtgagctgcaattttaagtaatatagtcagggaagtcctcaccaagaaagagatactggagcccagacctgaggagataaagaaaataattgtaaaattttgctaaatcacatgaagaccattcaaaggataatcagaataataaaagacttggcccagaaacacctacaactaaatatcttataatacagcataaatatagtaatcacagaaatactctatgattttctttacagcctccttttgaggttgtattttcttaaaccttatggcaacttgctgaggcggaatcaaggccagaattgttctttgagcttttagaaggaaaatagctctgtaggtatgaaaccataagaataaagtacccttgttaaatcacattgctccactgactactggagctcagccatctctttttctgaagccctcttctagcagtatcttgtgtttgcaagggcaacaatgacaaggaaatgtgaagagtgtagggaagtcaggggcggtggccctggagaaagagaaagtgacataggaaagtttctccactgggactcgctgagacgaacttggctggagcgctggagcagggtctgcccccagctggtgttctagagagagatgcaactgcttaaccaaattctgtgcagaaagaagactgtctgtttctgcattttcctgtctccagcatcagggggttggtttcctggcaacgggccacctgctttctctctgcggagcctggctgcccctagggggagcccttcgtctgtcagcctccaaggagcactgtgtttgaactctctcctcttgggacagcaggctggctctcttgcaaagcacaattagagcatctgccagcaaaagattgttttgaggcccgtaagcatttaataaattggtgttgtgggcctcctgtgccaaggcctcgctgactgcccatggacaatcgtggactttcttttgactctaaaatttaaatggaaggtggatgtctgtaaacaattctctttagatcatggtaaatcaaacacttacctatctgataatcataagagctgccaaaattctgttttgcagtgaaaatgtttgtttcattcttagtggaattttaaaaaag

SEQ ID NO: 61367 - DNA, 2439 bp, Bovine  19866880399860
tcggcagtgagatgtcactatgttaggaaattttaaccatttaaagcctaagaaagtcaacatgctttgtctaaggtgacagttgtatattaaaaagaaaattcttgaatactttgtttgccgacatgtttcttctccttttttgcatggagtattgaagcaatggaaaatcttcatgtcaggctaattgtgtggctgaaacaaaaatttacaaaagtagtgaaagcaaggatttacgcttcaaatttacagggtaatctcatgagctcagattggcagaatcaaaagtcaacatcattgtcagtcatctggaagtttccaaatattcagatttctggcaataagtaaacaaaagatctagatgagttattgatatatatatttttttaactttgggggaaattctcttggtccatgggatagcaaaaagtcaaacaagattgaatgtctaagtatgcatacacacacacacactgttataatgttaattgagaccatgtatttcacatagcattataattatgtaacagtgtagtagctgcctctatatcaaaaccatctgggattgctttgataagagggatattcagagtaggtgcatgtgtgtgtgctaagccacttcagttgtgtccaactctttgcaaccccatacactgtagcttgtcaggctcctctgttcatgggattctccaggcaagaatactggagtgggttgccacgccacgggatcttcctgacccagggatcaaacccgtgtctcttacgtctcctgcattggcagataggttctttaccattaatgccatttaggaagctcattcaggtacactttacatattttgttgtccgagagattctgcccacacatttataaaatatcttctccagagatatgactggaataattttcctgaaagatttcctcttaaagttttagtgctttccagtatattctgaatatacttatgctataaagaaacataaggacttgagtttttgagactgatcttaaaagagcacaatggacaaacattagtgaagggtagggtgacagagttcccactgcaatagaatgagatcagggaggaatcactggtggaaatgtacatcacagaatgttccatttaggtgagagtttaatttaccttgagaatgaagcttctaggtattgtgcttttgtgccattttcagcagatttttcagttcataacgttcctctggccgtgtttgtaagatatttatgctcgactgtgttcattgttttttgtgaacttataaaaattgcttttttattagtctataaaagccatgtttggagacagactaaaataaaaattaatgcaacttatcaccctacagcagagaacaagtgcctgtttcagtctcgtatttaagtaccgcagatgcgttagaacctcataaaaatggttccctggcccatcaaccctaaccagggagcaagaagctgaaatctgtgaattgcccacaaccaaaagggaagtctttggagagctgcattgtaaaacctctgagaactgatatgttctgattggaagcgtaaagtctgggattcattatgaaaaagcactccccgtaataagcatcttcttcctctatctatcacctttactttaaaaaaaaaaagtccttttgattgtgatatgcctcattttggctttaaaatctatcttattttttatttcttttttaaaaatctatctcatcgaacaaaaatggaggctgcattctctctggtccttaagtaaaaattgcaagcaatgagatatgagatttgctaattcaaagcatgttcaacagctatattttccatgtctatgaaggctttacagcatattaggaaatatatcaaataggccagtttgacaaaatcatagctacaatgatgaggattattattactattacattacaaaatcaaaactgaacaaaaacatagctcacagccctgccaatgggattctttcccaggaggtagcttgggctgtttcagcctccagttgacttccgccgggtgtctgggggtgcacttgctgaatgagtcaggccactggcacacagaaagctgaaggatgagatggatagagcaaagcacaatccattttattccaagttttcctatgttgtcttctcatgaggtagaaaggccaagagaagagccttcagcaggttggtacttcctaggcattctcacctctctcggtctcctgcccccgatctgggccaggaatcttactgtgggcaccgtggccttgttctctgggtgtggaggcagggcactgaaggaactgatagggaaatacagccccaatactctctcctttggattgcttttcagatgtattctcagtgacatatccatcgttgaatgagtgttttcattcctagaccccattcttttcagctggccttcccacccat

SEQ ID NO: 61368 - DNA, 941 bp, Bovine  19866880402360
atgagaaacttttctcccccaaccccccctcgcccttttcctcagggcttgaaatcagcaagccaaaaaacattttatcctaatatagaaaagaattagacagcagatgcttcttcacagcagcctgcgtgctggggagaaggggggaaaaatggcgtagccctccctctggcaagagtgaggactgaatcatcacgggagtgtttgtggtaaaatcacatttttcttttagatagtgaaacgattatcacggggctatggacagctcatccagagtgactttggtgaatctactctttttcatcacggaaagagtgtgtcttgggctccaagggaacaagacgtacaagactattatcgtgggaggagagcagatagaaggagaccctggagaaagttggctgagatcaagaagtgaggagagccaacaaaataatgaagaggatgtgttttctttttgaactcagggtggggatttgggtcatatctcgataattatgtggaaacaaaaggtcaccccaatgaatgattttcccagaggcccccatgagacaagctacaaaatcagttcgatggttcaaacccatcccaccaaagaccaccactaggggctgggagcatttctttggcttggtgagtgaaagcataattttatctatattacctcatgacccagaggcttattcagatcaagaagggaaagaggaaagaaggaaagagagttagtgatggagcttcttcaatatcagagtttttccatttttaatgctttaggtcttcacctgttcaggacaagtcccatagacatctatcttgactctcgctacctgtcttttgcctcaatcagttcttccaattggcccttgcttgatctttctaaaagatgaagttgtctcccataatcctttcccattgctagtccacataactattaggaaaag

SEQ ID NO: 61369 - DNA, 1709 bp, Bovine  19866880553666
caacccactccagtattcttgcctgggatattccatggacagaaaaacctggagggctatagtccatgggattgtaaaaagtcaggtacaactgaagcgacttagcacgcaaacatgggcaaagtgccttgcctacaacagaagatctggctcaatcaaagggttagtgaaataaatatgtgattctacccccattgcatttatggtggaagagggagtttttaaggtgttaaatcacaggacttcgctggtagtccagtggttgggaatctgccttgcactgcaggggatggaggttcaatctctggttggggaactgagttcctgtgtgccatgaaacagctaagcctgtgtcccaaaactacggaacccacatgccacaatgatctggcatgcctcaactaagacccaacagagccaaataaataaatatttgaaaaataaaactaagaaagtactttataaaaaaaataataaaataaactgttacatcataaccccctatagatgaatctataatagaatcacagattcactgaccagacagtggacatttttgagaaaagcctcttttttttaaggctgtttgaaccatagcatttatttgaccacgtgcttcaccttgtactaaaccaacctaggtggcaaaagcgttcataattttaataaaaggcctgagtgctggagacaggtgttgggaaacccacccttcacgttagcacgaacaccatccagcattcaaatcgctgctcacacgtctctgccggggcctggcagccggcccttcccactctgtgccgcctcgtgtctacacagtgaaaatgaaactgttgccagtgttaatacagcataatttataagctgagaagagaactcagcatgcattcccttttcaagtgaaacagactattttcagaaccaactgaagggtggagacatttcttagaaaccaaggcaactaactgctgattccccagaccctctctgcctcagagaatccacctctcttcaggcagactggaccaacttggaaaagctccatctgacacacctcctgcctgaattatagaaggcagatttttctgacaaggtcaatctttctaggcttcataaagtcctttagacctacagtccagagaaggtgctcaggggacggaagatcagaaacctggcttataagagaaggcccgtagcagagaatccatgtcctatcactgagtatgttttcaggaataccacaaagccagactatctcagaagctggacacaggggacagaaaaggaaaagtgcaagtgttagttgctcagttgtgtctgactccttgtgacctcatggactgtagcccaccaggttcctctgtccatagggttttccaggcatggatactggagagggttgccattcccttctccaggggatcttcctgacccaggggattgaacccagctctcctgcattgcaggcagattctttaacgtttgagccgcatgggcacggaagcctaaccccaaaatggatgccttgggatccagaaaaagttggccccatccctatcatatccattgtcccttgtttttaacagagaaactgagattatttaactgaccccacccctcccacaaacacacacacttccaaattctagtaccaccaatcttaaggagatgaagaagagggggcgacagaggacaagatggttggacggcat

SEQ ID NO: 61370 - DNA, 1809 bp, Bovine  19866880668529
ccagtaccagattaagtactacccaaagacccccaagatgacaaacattgcccatctctgttgaaattgaattgtcctctgcagtgtgccttgtgactaagctttggttgcatcacaaaattcagaatttacattgccatatacaagctacgagtatatactgttatttctacttataacatttaggggactggaaatgctttctatcagtgttaacaggtactatacatctttctagatcagatatttatgttaagaaactagacaatggtttgcattaatacaaactgagaagatattagaatatgtgttttaataataacaatgatttcttcaggctgcatagtttaagctactttctaagattatatcatttaaatccttataaaatttataatatttttccacaatgacaaagcaagactctacaaatccattgtctataaagctaaaatagtaataaaaatgtcttaaagagaagaaatagaagcaaacttcacgctacattaaaagcaagcaattttctgtgattttaagcatatgcaaagaaattctgagtaacctacacattcaacttgtgatttcgaagaaataaagatctggggtctacttatgttccatagaattccttttttacctcttctcctaaggctgttatctcttttcttgttattatggatgaaattggtttagaacataaagaacagaatttgatatttcatccttgaataatgcagatgataatatatgcaggaaagtttttccaaagcatgtctgggtatatacttttgaattttactggaaaacatgtcattccattcagaactctgaattaagatgcacaattttttgctgaaggctattttaaattaggctaataaattgctactctctgccttgcgtgataatgcattacattatctactgatgtacatgtattgtttgactctaatggtgtggaaattaaatgttagacatgggccagatgttcctatagatgaatatgaagtatgactctggcatagttatgtctcattgggacagagaggaagaatgtgataaccaacaacaataacagccacttcaaaaaatatcctctgatacgggtccgttaagaactaacattgtgtaagcctagatcctctcctagtccttgtctttgaaaagcgttatgtatgtcagcagtacttgcacctgttcgtgaggaaagaaaatctgtttcctaaaatacaaaataaaacaaaatcatgaatataaaaccacctggaggggtgtccagagatggtaaatatttgtcatctttatttgacagtcaggagctggcttggaatgtttccctggactgagcaacctcaacgtggcagtgagatttccatgggtcattcctttgcaactgcaaagagttcacagcagggtaggagggatgtgtgagttgggggggaagggaaatggcaaacaaatgggccttatggtgaattttaatgaagattccctgctttagctccatcagaaaaaaggaggaagaaagatacccataacatcctattcgaggctaacttaatggaatcataacttgaatagtagaaacatgtcataagaacgagaagggggtgcaggagtacacaggatgtttgctgctattgcttcttcagatgctaatcagactactaaccggtcagtatatttttaaaaatagagaagtggcacaggagataaatacgttacattgtctcaccgtgaatcagtcatccacccactcagtgagaaatgtctcggcaggtctgtgctaatggatgtaagaatgggctt

SEQ ID NO: 61371 - DNA, 1475 bp, Bovine  19866880700850
cccatagggtccatagggttgcaaaaagtcagacgtgactgaagcaacttagcagacatgcactccaaggattgactgtctattcctcttggaacatgattcacaatatatattttttaaccaagagaaagcctgaaatattgctccatgagtaataactattactaatattattggttgcataccatgtaccaaatattcaggaaacctgtgatatggtattttacacatattatcatatttatttctccccaaagagcccatttttgtcataagatgaaattttggttcagagatgagccagtgtcacctagctaaaaagtatgtaattcatacttgaacccaagtctgcctgactttaggccctatgctttttccagtatttttataccatcctacatagtataatgggaacacagtatactattgaaaaagctggtttggctaagctaaagatagaattcagttttaggaagagaaattgacctttggttagaaagccactttaatggggtatgtttggtgaggaaggttaaattagttaggatatgacaacagtattaaaatttagtgatttaaggaatattgaaattatttctcacatgattatctagagtggtatctgttcagaacatggctctcctccacttgactaatcatgaaccccagctaaggtcatctctgccatctgcaagatatggcttccgatatagttctggttgtagccgtttctaccctagggaaggaaaagacacagaggagcacacatctgagtgtctctaggacacgcttagaagaggcatctgccaagccacccaccttctgtcggtgagagcccagttacttatctgtacctccagaaaggggacatgagttgaagaagcacagtacagagcagagattcacgaggcagtagaaacaaaaaaattggagctagagctaaatgggaaggccttcatcagtcttggagatattctagcatgctaaggtgcccagagtttgggatttagggcatccagccattttattgaaaaattcactgatggtagtctcagaaaaattttgagactatatcagttacaaatggaatatctattatggtagagaagaaagatcactgggcttagaaacagaaatcgagggatcttaatccagaccttgctactaactagttctttgatacagggtaaacctctcccatcatgccaacccttgactttctttttcttttttgaagtacagaaatagaggaaaacaacagaatgggaaagactagggatctcttcaagaaaaatcagagataccaaaggaacatttcatgcaaagatgggctcgataaaggacaaatggtatggacctaacagaagcagaagatattaagaagaggtggcaagaatacacagaagaactgtacaaaaaagatcttcacgacccagataatcacgatggtgtgatcactgacctagagccagaca

SEQ ID NO: 61372 - DNA, 2133 bp, Bovine  19866880700894
ctgtatgattgggtctaagagtgtgagttgaaagcatttaagtatagctacaatttcccactgtctacgataatccattaaaaactcacaaaataaggaaaaggtgatcttcaccaaggaaaatatttttattctaattgaaagtgtctctatttcatcatctgtaattctgcaccaactgataagacttgaagggtagaagagagtgatggataggtttttcacatggggtttaagtggaagtggtttgatataaaaagaactatttcattttctgatgaggtttataaaatttggccaccatgcccatttccctaaaagtactgcctttggattacacaacctggaggtcaagaataatgaatgcttcagagtccttttccttctttgtccaacttccgttcaaatttgtcctcttgaaaaaaaggccctacaaagtctcatccaggcctaagaaagctctatattaggttggagggaaaacaaggcaaaataatatacacagcaaccctgacagcagagctgagagcccgtctctctatgctttccctggctgccctgtcaagatcttgatgcctggtgaagaatagattgcatgcatgctgcagaagataaaaattatctctcttggccctttaccagccacagatgtcatggccttgaccttaaatatcttattctagccccagttggctgaaatgctcaaagacaaaatactccgtgtcactctgcctcagtgtggcgagaggcgcccagggcctgggactgtgttcatatttggtgatgccttcctgcatcactaaagcaatcagatggatccagcctgagaagacaatcagggctggacagaagccgagagggcaaacagatgggtaataatcccctcttttatcattcgtgcctacggagaattattcagtggaattgaattctctgatgaacagagccccacacggctttatgcagttaaaattatgggatttttttttcctttctatttgcttctgtgctttgagagagatggtaagatgatattcttattcataatactagtgagtatttgcagaataaaaagggatccactgatgtttgtggcattcaatagtgtgatgccagagagtaggaactccattcagccagagccccccaacatgggtcaggcatacatgcaggacacctgtcaacaccctctgtgagttcccagggcctggggtgaacagggcctgggaaaagagaggggatatctgctatttagaattgattctggatatcagagtgatccaaagggccaagcagataacagtcccctatctcataaattttgaaataattcagtaatctgtgacttagaagggcttcgctggtggctcaaatggtaatgaatccaaagcttcagtcaattgccttgggaaaaagaagccccctgtaacccaggattgggcaggtagagaggcatttgctgcagtggaaaggccgctggtacttttcctgttgtacgtgccctcccacactctcagtccactccaaggctccatgagtttcctgtgggccagcagggatgaggggtaaactcccgggctactcaccactgcagggcaccccaaccagctgctgctctcatcttgttgactgtagctttcatgggctggtgttccccagaaatgtagcaggaaaggtgttcggagctcaggctctgaaactgactagatgtggaagaaattctttcagactcgattacctttgttttcttttggggctgccgaacaacaggggttagaaaattactgggctaatatcttatgttattgcatacctgggtggaaaatctatttctcaaagattatttttatacaaaaaagaaaaacaaataacagtaacagttactatttattgagttaaaagagcttcacgacccacacaatcacaatggtgtgatcactcacctagagccagacatcctggaatgtgaagtcaagtgggccttagaaagcatcattatgaacaaagctagtggaggtgatggaattccagttgagctattccaaatcctgaaagatgatgctgtgaaagtgctgcactcaacatgccagcaaattggaaaactcagcagggccacaggacggaaaatgtcag

SEQ ID NO: 61373 - DNA, 1228 bp, Bovine  19866880705417
aaaaaaaatgatattctttggagacctcaatagcgtgagttctgcatgtattatttgctggaagagattaatgagataacagaggcaatttctaatggagtcccttggttttcatctcccccctacccacccctgccttcaaactcagttgccagttcagcattatgaatctactaagtgttcttggcatgtctgatggggaaagggagagatagtataaactataggctaaaaacgttacaaaaaaaaaaaacctttcttccctaccttcagtctgcatccgttagctgcaatgcaataactttctcatcttatatataacatgtatattcatatttagcttgaaaccttcagtcttccaatacttcataatcaggggttttggatatttccagggtctgagttgagtcccatctctctgtagaatacctaaaccgccagactatgaaaagtcaccactattgccaatcttgatagtgttacctttagtatattacagtattttgttactaagacatgatgcttgaaatatcatgatacttgaaagaaaaataaaaggtagttcaaagcacagacataagagttttgtgtgttatttatgaatgtttgaagggaaagttaaagataagtctgctaataatgaactacctgcatgtgggctaagttgctttactcgtgtctgattcttttccaccccatagactatagccctccaggctcctctgtccatgggattttccaggcaagaatactggagtgggttgccatttccttctgcaggggatcttcccgatccagggattgaacccacctggggagcctgataatgaactacaggactccctatttccactacagagagtacccagtgaatgccccgctggctaatagcactagagctctgtagaataagtgacagtcaggtgataagagccaagagaattttttgacaaaagcagcatttctcataacagctgcagaaaggctgccacaaaagaaaatttaggaattcaaaactttctctgactggcattgcagatttaaatggttactgtggcataatgtaaattgggccctagaaatgttccttgggtagaaaaatgtttactacacgatattcagtgaataagagaaaaatatgaaactgaatggtatgaactcaaacttagaaaagagcagagacaaggacaaaacaaaactgtgtgtgtgtgtgtgtgtgtgtgttgaa

SEQ ID NO: 61374 - DNA, 2092 bp, Bovine  19866880710653
aaaagatcaagtgtttaggaaagtgtttagaaagtgtgtgatgtgtttcagaaattttcatctacaactaataaaatatatatttaactttttaattatgtttttgaacatatacaaaaatagaaaaaaaaaaaactttttatactcaatactcagcttcaacaattatccatgtgtccagtcttgtttcaaatacagccctctgtctgtatccctacccttccctgtactagtttggtgcaaatcccagaaatgttatcatttcactggtatcaaaagagactgtagcccaccacgttcctatgctcatggaattttccaggcaagaatactggacaattttccttaatatcccttaatatcatcaaatatcctgttaatatttaaatttctataatcatctcataattgttggttagaatcaatgtgcatctttgtctcttttaatttgtagtttattgctaatcctattttatccattgtaatttatttgttaaagaaaccgagttttcatctgatagaatcgtttcaacattctgagtcttactgattgtacccttgcaccatccttcaacagctattctgtactttctgtagttagaatcagaaggtcataaggtcaaggaaaaattgtctttattctttagggatgcataccagtgaaatgataaaatttctgggatttgtactaaatgaatacagggaagggtagggatatagacggacgggctctatttgaaacgtatggttgtgttaagtcacttcaatcatgtctgactctttgcaaccccatggactggagcttgctagcctcctctgtccatgggattctctaggcaagaatactggagtgggttgccatgccctcctccaggggctcttcctgacctgggaactgaaccctcatctcttatgtctcctgcattggctgctgctgctgctgctgctgggtcgctttagtcgtgttcaactctgtgcgaccccatagacggcagcccaccaggctcccctgtccctgggattcttcaggcaagaacactgaagtgggttgccatttccttctccaattcatgaaagtgaaaaatgaaagtgaagtcactcagtcgtgtccgactctagggaccccacggtctgcagtctaccaggctcctccatccatgggattttctaggcaaaagtactggagtggggtgccattgccttctccgtcctgcattggcaggcggcttctctaccactagcgccacctgggaagcctggtgttatggttatgggaaggaaaaaaaaaaattaatactctgccataaaacaagcgtcaattcttatctgtttggacaacctgataaccctgaatgactcatattttaagagttctgagtaactcctttctttctgtggtaattatttttattttgagtaacaaaaagagaaaactgttcaaaaatgaaataaaagaaccaaattctgaattctaagataaacctaccaactccagattccttctgttttgagaggccaagagctgttgtctatttaagagcaataaatagcagagcaaggaaaccattattgtctaagtgctgcttttcttttaaatgaaagatatctagaaaacaaccctgagtttggcagtacctttcagcttttgggattttcgccttgttaaaagcagaaggagtcattattttatgaatccagttcaaacactctcctctatccggcaggggtgatgtaggccactggaaaaagtacagagaagattccttgaacttttttttccccagacttttcacaccatgccatatatttaaataacgggcagaaatgggaaatgatgagtctctcaaggaaataaatacagcactctcattagaaggctcattaagaataaagtacaggaaggggcctctgagaacagactcttattctggtatttattaggacaaagcactttttttaatggagcacccgaaaagctctctgctgcagtcattattaggcatgagtgcttttagtaacttcttgggttcagcttggcccttctctctgccttggtaaacagttgacagcaacatccttgtgtcccaggctc

SEQ ID NO: 61375 - DNA, 1782 bp, Bovine  19866880810226
ttcttctttgttcttttctctcttcttttctgataattccatttcacatgcattacatcttctgtagttgtcctgcagtcgttttctttcagcctttgttctctttgcttcagtttttgagttttcagagatttctcccttagccatatgcaatctagtaatgagcctatcaaagatgtttttcatttctgctacaattaaaaaaaaatcatgtctagcaagatagggtctttcttaagatttccctttttctgcttacattgcctgtccttgcatgctgtcttctttatccattagaactcttgatttattaattctcagttttttccctctcccctttagtggaacaatagagctagaatgggcttggagttggatatcccacccccactctccctgtcagttaggctctgataaccttcaaaacaggttaggatctggttagttagtttcccctgagttcaggccttgttgagtgctctggcatacttaaacagggttcctttccccattctcctgtcatgagagaatgagaggttttttccctctgttgtttactttgaaagcctagtggagctcgtggagttaagtctcacaatactgtgagagttctgcttgtgactgtgtcccccttgaagttttaaaatctcagactttttctcactgagcctccagcagttcattaattaatagttcaggctctcctcccccagcactggttccccttgtggtttctgcttgtgagtctctgctccagaaagctgtgacttcctgaatttgccagcctctctccaattttgggggtggcaatttgacctgtgtcctcctctctcttatggatccaagaagagttgttgaatttttagcatgttttgctttttacatgatgttagcaccaagtggtatcttcaaattccttatatgtgaaaccagaactctactagagttgttttttttttttaaagccaattagaacagtatggatttgagaagctgccctatggttgtgatagtcttgtgactatattgagctgtgaaggtggtcaaggaagacatagttcttaatttgtattctgcttctgtgcagttctcaggaagcctggtcaaaaaaataccaccagagaactctagaggcagttctgtgtctccctggaatcaatacctaaggtgggataaatgtgaacatgatgccagcacatctgctgtccacggctggttagtttcattatccttcagtcacagtgggagaagtttctagcaaaaactaagtgttaaggtaaattttcttaagaacagcgttcagagtatattcttgctgagtcctcgttctgggtagatgattaggatggaggcacactttgaaacagagcccctgtgattatgaaacaggacaggctccattgggtggacatagaggaacatgatctgcaccagtgccaggcaaactttgggtggtcttctagcaaacctaagtctactcatcctcaataatctgcactgtctttttatactgagtaacttaagggtaatgaggcatgatagtcttggttcaggtggctcttgactgcaatttagtcaacttagttttggtaattttcagaagctacagaacattattatcaagtgagttacacttgacagcagctagtctgagggttgcaactgaggtttaagatggaactaggggcacttccagcccttctgatagtaagatctggtaccagcctcctacctttctcatttcatcttgtatgatatcttcccacctcactctgctccagc

SEQ ID NO: 61376 - DNA, 1180 bp, Bovine  19866880814542
ctagcaagaagcaaaagctgtagggagtggcatgaagaaatgtaaaagaattttatgtctttcagcctgggcagaagttgacagagaaaaggagctagcagtcaggaaaaaaaaaaaaaaagatatgaggggaaaaaaggcaaactccaactgaaattctctttttggttttctgtctttgtatatagctttctcactagccttgttaaaaagtaaatatctctgcaaatttaatttaattttccttcggcaaatacaaataaggcttattaaaatgtctttcccttctgcaaggtgcaaactccacgttagcagatttgaaagctctcacataattcagatggcaatggaggctttaactaggccaacatcaacatacaaaccaagaatccttcacgtgtggaacacttgcttagaatgaaattgagtacgtttgccaaacctgactacgaatggtttatttagaagtaaagaatatgaaaaatacaaaatgattttcaaagatagtaccttgatgattatcgacttttactcctaaattcctgattcatttaaatagcaagatgatgctacataattcaaagtttctgtatcttggaagggtatattgtctaaactaaagttcagtctcatttctaagaagaaaactaggagatagggcttgcatgtgtatgaaggtgtagtaatgtgtttttagtgatatactactacacggggccaagtctagggttgcgttgtctagaaaacatcccatctgaaccttaaggttgagaatataatatttaggtaactagttttggtccaggtgctcttctgcctgtggtaagccttgcatgtgaactcgcttatataccttctcagttctagagaaggaaggaagtcgacgggggtacagatgcatgcatgcatgctaagttgctttgctcatgtccaactctttgcaaccctatgtaccgaaccctgtcaggctcctctgtccatgggattctccaggcaagaatattggagtggattgctatgccctcctccaggggatcttcctccaggggatccctgaccagggatcaaacccatgtctcttgtatctcttgcactggtaggcgggttttttaccactagcgccatctgggaagcccaggggtatagagcggatgataaaggcaaaatacgaggcagggta

SEQ ID NO: 61377 - DNA, 1572 bp, Bovine  19866880820681
ttgttacacgtgtctttgcaacctgtaactgttcctttttcagatgaggacactgaagctcagagaggtaggacgctcatgctcacataggcaacaagtgacagtcataatgcattactttcagtttcataaacacatctcaagtggttctttccttctccacctctttgtctgactatccctttcttacacttctgtcaggactcaacttaaaataaacttcctccaatatctctggtctttcaagcttggtctgaatttctctcccgtctccatcacctatatctcttcccctatgtttatccttattgtattaatctttgtctaattgcctgcatccaccattatattatatataaaggtgagattattttccttgccataaaatccctagccataccatgtagcaggcattaaataattgcttaaagaatggaagaatgttgggagaataagaaacacaaattctgttcacttctgaattatagtcttggactggccctttcaaattttcctttctctagaatgattccttgtcttcagagctcttccatcttagttttcatgtgttaaactcattgccagattctgcagtttgctcaatcgcagagagcaaatacaagtattcaacttgtttatttaacaaaataaatacttaggtattgctgttttatcatataagcttgcagaggacatggttttcttgtttatccttccttccttcttggtgccatttcataggcttatggggtgtcagtgttcagagggaacttagaagactatttaatgaaatcccgcagaggaaatgcaatcccagaagcacaaggacatttacccattctcctgctgctaacaagcagtagcctccttttgttttatttactctgtgtctctccaccattttcctatttttggagtcagattaacctcccatgtgggaaggtggcacttctaatagtccaaggggtaccaacctgcctttggacacttaaaaggactttccttctttggggtttgccaaaggctgacttcagtattaaaagaaggtctcctattatctggtgttacaaccttggaacagccagcagactgaacagtcacacactaggaagcaaaatgctgaacagaaacacagccaattctgtcagccatccaagggtgtgtagctcagccatgtcagctggcaacagtgtttgcagcaaccagtcctgaactcactggagccatggcctcacatctggagtctagactgagtggctctcacttgggcccacggcctcttcacacctccagacctctctctagtgctctcactttactttttcactttgccaactttttttttccctccggtctcttgtgattttttttttcttctttcgtttatcctttcattgttcttttctcaaatgaattctagcttagagacttactttccagatactcctgacaaacatcatagagaaaaggttttcccaacaatgaggagtccatcaggacacgatgtcaaatgtcaaagtgtacagtgtctgagaaaggttccggttcaagattttccactcaccagtgcat

SEQ ID NO: 61378 - DNA, 782 bp, Bovine  19866881104441
atgccctgattcctagtatcctgctatttctagtgttacggctacaagtttgcacgataaagtatctaccagactcaccaaacctggtgacccaaactgtatcctgtgaatacacgtaagaatgaataacaggcccaaataaaattgcaacgtgtaaatttttaaaagttaaattcaagagtggataatatattgaaagccttgaaaagggaggaaacaagaaaggaaggaagagaagcatttttttgtttgtttttctagttgaaatataacgacctttaaaataatatttcagaaaagaatggttgactctatatatgttatcaaaacttgggattcattcttctggcttatgaaaatggaatgataaattgccaaagaatgaaatacagctatgcagatgagaaaagagatttttcacacacaaaaaattataaatctgatatctctggagagaaaggcagttaagttccaaaaccaagtatcatgactgataacagatatatttaaaaataatagatttaaagtaaacatagtctagaggcgttaagaaacaatccattagaagtagaaatcgtgttagagcatcataataatagtaaataacattcatttggtacttcatacgcacaaacactattctaagggctttaaatacatgaactcattggtctcctacaacatgtctgtaaagtatttatgtttattcctctcattttatagatatgaaatgaaagtactgctggattacattgcttatctaagattgtaacactactaat

SEQ ID NO: 61379 - DNA, 1421 bp, Bovine  19866881465688
acacagctacatcttgtgcagtaatacttttttaaatgtagggcctgagatcattattactttttgccagtgacctggccatataatggggcttccctgatggctcatcaggtaaagaatctgcctgcagtgcaggagacacaggaaacacaggtttgaacccctgggttgggaagatcccgtggagaaggaaaatggcaacccactccagtatccttgcctgaaaaatcccttggacagaggagcctggtgggctactccatgtggttgcaaagagtcagacacgactgagtgattgagcatgcacagccatataatgaaaggttttataactggtaatgatgaagttttttctccaatgacaatttttaagttaatgccacaaaactgaagtacttttgtttttacagctggaaggaatctttgtgactctttagtcccacaccttcatttaataaaagcagcaccctgaagcccagcgaggcaaagctctcatctctgtggggtagtgacaagcatcaggaggcctcttcccacggccccatcgggcctctctgaacctgacagccaactgaggaaccctgtgctgaatcactggggaggaatactgaagttccctgttcttatccacgtttgaccatgatatggtgataactatggggaagtcacttcaactctccatgtctcattctttgcatttgaaaaaatgcataaaacttttatttcttgccagtccatttagagagacaaatgaacacatacacaaagaagtcctttcaaaacaagtagaacttttgaaggcatcatttagaaattgagttttcctcaactagcaatagcatgatcaagagaggaaataaattgccttcagtcttgaaagcatcaagaagactctatctcatatccgccaagagcatcatttaattacctacaggtgataccaactccgtggaccacctatcccaattaagcagcagcacatgctaattatcattagacttaattggtttcccaattcagcaacttccctgatcaagtctgtcccagttaagtggtgtttattgaaccacctgaatctcgcttaaaagaaacaaaagaaaatttctcgtctccagttcagcaaatataacctactctcaccaagtcacactatccagtttctaattaaatttgcaaagcatacgctggggttgggtccaatgtgcgtatcttctccaattagtaaatctcctccaatttcagtgaaatcaagtaagattaagcaagacattccaaacaacaatcagtaaatgtgtgaaaattagcaaatatttactaacatttccccttcttgtacacatttttggactaagatgctatgattgtgtcatactttaagattttccaaacttgaaatgtgctttttcagcaataacacttat

SEQ ID NO: 61380 - DNA, 855 bp, Bovine  19866881572446
ttatagtgatctctgggaccctgatcttttcgaacctcctcttttctcatttttgccacaaggacttactgaaaggctgtcttgagacagcagacaggatttgaccccaaacagtttttcttctccccccataaaaaggtttcactactaccattctctgcatggcatgtagtactgggagacaatacgtaagagacaggatgaaactattctgttgaatcaagaatgaactaaatgccagagactcggtgttctagatcagcaatttccaggattgatacatcttaatcaagtaatgaggtgactttttcggtggtgtttcccacaccggagagaggaacagatttgccgctttgctccgatggctgctagcagcagtgttggttgttaacagagacatttacacggaaccaccagttggcaggggctaacactatgttacttgctattcccacatgctgaggattgtgggaaggctgccaagctctctgtctcatgtagctcttcagtataataacagcaacagccacaaaaaaagcctggggaaaaaaataaagaggaaaaagaagaggaaaggaaacaatggaagtaagtccctggtttcctattaaacacgagtggaatgagaacattttagtggcactttcctttccctctcttctttctctgtctctcctttgctttctctctttctccctccctttaaaaggcatttaaaattgaggtggatgcttctcaaactttaaagttttttttcaaatcacctcagggtcctattaaaatgcagatcctgattctgccagttggagggaaagctaagggtcttcatttctaacagcaccggagatgcagagg

SEQ ID NO: 61381 - DNA, 1362 bp, Bovine  19866881919082
aatttccctggagttcaaattttctcccatgaatatttttcagcagtccactagccttatgaacactttgattcttaatgaaatggttagcagaaggacagttgcatgttcagatgttgtatagctccttggaagccagtttcccacagcatttcaagttcttagaattccattgatgatgttctcacactatgaatgctcaaaaattcactggcaacacacatctgtgtttacccttttaatcaggacaatgtccacaataattttcatattcctaaaggattgagtaatacctttagaatcttagaaggcaaacatgacttatgctggacctgaaatcatcctaccatccataatatgaagagtccaaaattggaagtcacttacaaaccagaagcagaagattgtctgaactgcctatttctggcaaattactataatgaaagaatctgtaaagttgtgaaagactttggtcttgttataagggtctttggctttctttttctcttcatcaacattccaaatcacttatatttgaattagggattttttttcccaatatatagtgtatactgttgtgcatcttgccagttttatttatttattttttttttttacaacaatgaatacagatgggagcaatcacaggatgaggcaggatcatcagtccttccatgttttatagagagaaaaaaatgtttgactcctaattagcctttcttaaagggtcttaggaaagaaatagagatcccatgaaataaatttcctacaactctggggtataatcagaatcaaagaaccagaaagcaactgaaaccacacatgttcaataacagtcactaccactctgcttcccactctcttggccaacattgttaattgatcacattagcccaatggacccagatatgagtgaagaattgttctcaacataaagctttaggtatctatttccaactgacagttgatttaagttgttgaatcctgttatagcaactttggtggggggttagtcactaagttgcatccaactcttgtgaccccatggactgtagcctgccaagctcctctatccatggaatttttcaggcaagaatgttggaatagatttccatttccttctccaggggatcttcctgacccagggattgaacttgggtctcctgcattgcaggcatattttttaccatttgacctacttcagttcagttcagttcagtcgcttagtcgtgtttgactctttgtgaccccatgaattgcagcacatcaggcctccctgtccatctccaactcccggagttcactcagactcacgtccatcgagtcagtgatgccatccagccatctcatcccccgtcgtcc

SEQ ID NO: 61382 - DNA, 773 bp, Bovine  19866880476908
gtgttggtgaaggtggtcgtgtgacagcatttgcagaattaacaaaagcaggttgtactggggagttttatgcgggaagccggtaaggaattgcggggagacgctcactggctgccttgtgccggcttcaaggatgtgggaggcggcgcccgcggtgcagagagctggccagagagccagttctgggagacaggtctcgccgcccctggatggacctggcctctgcccgcccctgccgcccgtgggacccaagctcccgaacttccggggtatgccctcggcagtgctgaaggggagagacgctgccgagggtgccaagcagctctggctggccacctctgtctgtcacccgatctctcttgcccccttccacggccatcccctcaactgacgtgcaacagttagccagaccctcatgatgccctgttctgccttaaaattttccaggaattcctctgggtttggcggcagtgtgggtgaagaaaagagcacacggggtccaaattgcagcctggaggaatggagcacgggagacccagaccagtttagaaatcaactgcgttatagagcctccagctgctgtgtatgtgtcagagacagacagacagagacagagaagagagaaaggatacccgtggagcaaagtcgtcagaactcaggctctggtagctatttagggccagcagaagagctgcagctatgctcagctcccacccccgcagccaggtaggggctcaggtggcacctgaggggtagtggaagaaaagcacatt

SEQ ID NO: 61383 - DNA, 1804 bp, Bovine  19866881249379
cagtaagagccaatgatggctgcagggtaaaaagagaatggattttctaaagaatgtcatgcataccatcgatcaatacttgagattatttcaagtgcttcagagatatatacatgctttttactagttgtgtgtttattttaatatatattataaaaatatatacgggcttctcaggtggggctagtggtaaagaacccgcctgccaatgactggagaatatgcatggacagaggagcctggagggctacagttcacggggtctcaaagacttgaacaccactgaattgacttagcacacacgcacagaaaaatatataagtagcatatcaagcctgtgattacccagataggattgtttaagatgaaacttaggatggttaagacacttgaattttaaaaagaaagtgaattaaaattattaaacaaggagtggtacttgtggcattgtatttagagagcacttggtggggagctaggcggcagagttagctgggtgtaccacatggcccggggtcagccccgccagtaacagtcctgtcctgcctccccttcccccacctcctggactctctcttcgcaatgtttgccccaggtcttgccctcctttgtcttgttcctgctatttctctctctgctcctgtgtgaagagctttctctcaccatctccttatcattgggttttacaaccctctaattcagactgttaatatgagtttctccttttttatataaaaaattttacccctttatcttaaagttttatagatgtgtttatataaatacagcggtaaacaattgtctggtagtttccacaactcctcccaccacccccgactcctgttctcaagcccacctgtacctcccagtccttccagcatcattgtgaattctcatcccaggatgtgctatcgacaccttagcagaattagacctcagttccagcagtgataacctactgcattcagatggagcacagctgagcaggatgactgggtctgtgaataaggttcagtgtttgaacacactctttgcccactgctgctgggacaaagcattcatccaaatgccacaactccatactccaacaaggatgtagaagaggggctgtgacacaagcatgacatgcaacagggaatacttaacatgcaagagacaggcgacacacatagagtcacactccagtgaccacaaagataaccttctgtgtggaaccaggatctatctcacggctctagcctcaagcccggggaaatgtgcaatgcctggttcaggttcaacatcaggcaagggagacaagtgtgtcattgccatggtctggagcaagcaggtctgagtcccagaaacacgcttccctttctcctttctcccttctccctgtgacccacaggcagctctgggaataaccagttgtggcccctaggcacatggtttaaaggacagccagagatttattcggagatatcatggtgactattttggaacaaagaaggaaatgggaaagcagagggctggtagcaatatccctggacactgaccacccactctcagccacactccttatggtggaggccacattcctgggatgtcccaggttccacttcaaccttgaaccaatgctgttttgctaatatcagaggatacagtggtaggacttagaggggtgatatggaggtttccaagagcaatagaaatcactgggaaagagtccatgagtaaattctgttacaatccctttttaaaaatttatttagtttttaattgaaggataattgctttactaattttttttttgtcacacctc

SEQ ID NO: 61384 - DNA, 1482 bp, Bovine  19866881366811
cttggctattgtaaatagtgctgcagtgaacattggggtatatgtatcttttccaagaatggtttcctctagatatattaccaagcgtgggattgctggatcttacggtagtaaagcgtcatgttttagacttcctgatacatgattaaacacttcccttccctcttaccctgtaagttgacaaaattctgacaaacatataagatctgattccatgacatttcgtatttagttagcaagtaaatagagatgaagaatttcaccttcgtttagttctttattgatgtttgagaaattatgtagaggtggaatcttaagtaagttgaaaacccggactttcatttttctgacccttgctgccaaattccttccatagggaagaagcagaaacctggctcagaacagtgaagtgagacagagaagagcagcgtctctcccttccagcctatgtccgtggttccccgtgcgcaagcgggtatatctctgtcaggcaggaagccacagccttccagccgttctcagcttttgtgtcccccttcaggtaacaaagcacggatcccagttctgccctgaactctaaatctaagttaaagaagacacacaagagcaatgatcataagtttcaaaagaacagcttggtgagcttagggaaaggaaggaaaagagacttagcttctttgttgcccgtaggatgggatggtgagagcaatttacttcctctgagtcccctggtttatgtaattaagtacctggggattccagagcattacctcatagcaaagattaacaagtaccaggggcactgatccccagagggcctgggggaggggtgtgaaagaggcgtcagcagagagagggagggttaagggccaggcatcgctgggggtggcctctccctccttctcttggctgtcatggggactagcaacaccacaggcttaataattagcttagtatctgcgctgtgggtcgtgttcagaggtttctccgggcaggcagattcctgctcggttgttccacctgtgcacctgcctggcctccacgcagcccagcccctcctgcctgcccggcagagccacagtctgcttccagcactaattctcctgctgtcactggtgccaccatcatcgccacaactccaggagagccaggctgtgaggagcgggctctgcagtctctccaggtgcccacagagagccagggccgcctgcacacagctctccgcagccagggaaaagcaggggagggctggccctgcatccctgactaatgatcacgccttcgagacggatgcagcctgtgactcaaactgtggaggcactgcaaatggaaaagagtgggagggagtagagggacacagaggaaaacacagatggggggagggaagaaggagagaaaaaaacaaaggaaccaagctctctgaactttgagtctagaaagggctttcatgcccatggcctctgcagtcattaaagtacaaca

SEQ ID NO: 61385 - DNA, 2305 bp, Bovine  19866880544198
atcagatcagatcagatcagtcgctcagtcgtgtccaactctttgcgaccccatgaatcgcagcacgccaggccttccctgtccatccccccaacctataattgattacatagagttcaaaagccagaaagcctatagtattgaggataaggacatggaggagggaaccaggtgagaaatagaagggaccaggaaggggctttctgagctggtggcaacaatgtttcttgaccccaacagtagtgatgcaggctttccactgatgaagatttgctgagctgcacatgtgttttgtgccctttcctttagtgtgataacttcacatacaatgagattgaagttttgtaataatagccttaatttttttccatgaattttgtttgtaggtagatacaatgcataagcatattaacaatcaggttcaaccattatgaaggcagaaaacggaaaacagcttaaatgtccatgagtagatgacaagttcaataaattaagacacatccagaaacactgaggacacttgaaaaagaatagtatggatatgggactgtcttcaacacagatttaagcgaacattaagcaagagatgtagaaccatgcacatcatttcatttgcatgtaaaactgaagaggaggatacatgtatgtgtgttttatatgcatataatgtttctggaagaacaggtgaaaaataaagcccagcagcagtggttgtctctgaagtgaggacaccagaggtcatggatgagaaggaaactcttttcagtgtacctcttggcatcatgtgaacacaatcccaactatgctacctttcaaagtaatatgtaaaaaggtaagatatatttttaataagctgaaataatcttgagagcccacttccctattgttgttgcatctggatggatcaaaatgccctttcttggggaaattactccacagcctggagtagagactgggaacgagtgtctgtgaagagtaacaagggaagctgagagacaggggccaagcagagacaggtctgagaagccagggcacgtggagaagttaacctgtctgaacagagcctgcagcaggaatgagccaggcaaggacaaagaagccaggatgctcaggccagggaaattagacaacagcaaacacgtgagacgcacagggcccacagaaaggagacgtgcctgggcagggaaatgcctgtgaagtccactgctcactctcatgagccaggtattgctggcagaatgaaacgagcccaggaaaagaaaaaaccattctctcaccttcttacttgtattgatccaaaatacgaccacccctgaacgaagtctgtgtctactccacagtacctgtgtgtagggttatgcacacagcggtcttgaaaagaaactgttgactcaccccatttcctaaagtacaaaaaataaactttcctcccagtggctcagcaggttttcagaccatcagcctggcagtgagcctgagctactgactgatgggcaaaccagttcataaaaaaataccaggctttgattatctttgccttgttacccctgacctgatcattccacactctctgttaaacagattcatcctgttaacaaccatcatgtccacttccacctttaatatttgttgaagggatgtaggttttgaagaatacattccagaggatcagatgccatactaagggctctgatgcattcatctccaggaccctacagactcccacgagcgcagaaaagcctgtaagggaagcaaactgaacggagggatagtgccaaggccacaacaggcaggagatccattttccaagttatattctagccaacagggtccttttgccatttaacacatctatagcttttgtatagcgatgccaagtttattctcggtgcagttttttgtaaatcacatccaaaataagatttggaaaaaaatgcaccttcttatgagcccactgtgtacttgaaagacccagcgcacaaatcatttgcacctgtaccattttcatccagttctaagctaattttaaaaaggctctgaaagcctgccaacagcacatgtgcagagaagataaaatgtaatagcaattaatccaatcatctctgatttaacgttaatttaacccagtggattatgccttgttttgtgtgcaactgtgttgatcctgctacatttcagagagcccccaaatcaatcaagtcacaatccctaattgcagtcaaaatggggaattccactcagcagagcccttctctagagtatctgttcctccccaggaagaaagggaagtcaaagaaagaggcat

SEQ ID NO: 61386 - DNA, 1292 bp, Bovine  19866880693533
aggggagcacatgaagaattttggacaggggacaggtatgatcagaactatgctgatatgctgataggttgggtgagaggagagaaaagaccaaagttgcagagacccatgaactagtaggttaaacaatgttgaaagggtgagagcatggtaaagtttcaggttaaaatttccttttgtgcactcaactcaggatacacaagtcaatacagagctctaaatccttaatctaagacacaccaagtaaatttcagtctgatgtttaaaactagctcatcatgctggtgttacagtttatgctctgaccctcactgctgtctgaaacctgatcccaagaacacggggcgtgtgagatgaatgtatagtgaaagcaacgagctaatgtatctgaactctgtccagtttctatcacacttacattgcctaagaagtgactgtgggcctagggccttttcagtagtagtgtgtcgcttaattttacttcagtcctgttaatgctaagctactctaacgctttatcatccagatagctaaatttgatgccctccccttccttttcagttcatatcaatttaggaaggaagcattaacaaatgcactgaatatagtacttttcgaatcaattcttgccctgctttatctattggcattcgaatttatttaaacagtaggctctcatttcacttaaccaaaaagccaggattcagagcaagcatcaggtgacactaatgtcagcttaattagtcaatctgtgttaattatcaggtaacttggctaaataataaagccattcatgtcagggacaaagtgattttaaaagtctctctttaacaaggccttacttccctaggacagtctagcagccgtcagagccacaactgttatttacagtggctctcttttagagattctattttcagacagaggatgagacttaaggatcaggatttaaggtcaggagatacaaatcagagttagtggaagcctcacacaggagggggatcgctttaagggtttggatgatatttagaaaggaagcagcatcatatgtttcactcttaaataattaattaaaactttgaaaagtatgagaacaatctagataaaattcaaaccaccttcaaaattaatcaaccaaaggttgagaacctattgtgtatatgggtgctgttttctgatctttttacttatataatgtgagcacttttcccccatagtgctaattattcctcaaaaacatgtgtctaattttacaattaaactggatacatcctcagtgacattttaacctt

SEQ ID NO: 61387 - DNA, 1601 bp, Bovine  19866880780029
atccttttatttttttgagaatctgttcagatggaatacttattagatttatgcctgtttattcacttggtatgtgcttattgagtgcttactatatgctgggttctgctaggtcctcaaaatacagtgatggacatgatagcccctgtcttcatgaaatttacagcttaaaagggaagaaaggttgtcattgaacaaataaatgacatatagtgatttaattacagatgtgttaacagacaaagcatacagtgtgcaatggaagtcattaatatgggaactgccttgtctcaggggttagaggtgattttccttaggaaatgatattttagctggcattcatagaattagtaggctttagatcacatgtgctgtaatagtacattttaatcaaatcattgaaatcagatatttacttgtagaagaaccaattctatgtgatcaaatgtctagaaggtttatgtgaaatttaatttaggaaatcagtatctctgtgtattcatagaaaccaaaggttaacaggcaaagtggcaggaatgactcagaaggtcatatccattcactcaacaaacatttgcacaggggaagcagacaaaaacctttgcccttctggaagctgtgctgtagtagagcagacagtcaccaataaggtaagtcagaaacacagggaacatggtcagtggttggtaactgcagtgggggaaaatagagcagccaggggcttagggagtgttgggggttgtaaagttactgacgcctactttatacataatgtcttcagtctctggtttgatgcatggaccagctacttggatcgaagttggctggaattggttccatatttgaaagttcgctgacattccttagagctgtcatccctaagttgtgtaattttttacaaggtgaatattattatcattcccattgtacaaatgtcatttttcgcaccattgtgattggcagacttcagagagggaaaggtgctggtgtagacgtttttgactgtggtaaagtcagagcctcatatgttgtctgagggcccttgtatgtgcagaagaatcaagacattgattctggttctaccatgcatttcatctggaaaatgaatcaacctctttgatccacagtttccttattgtaaaatacactcttgcctccgaatccatggaagattgttcccaggactccctacagataccctaaagcatagtccgttgaccctccctacctgcaggctcagtatcctcggattcaaccaattgaggaccgattttctcagattttctgaagcattcccaaaattcttgatcggttgactccttggatgctgaatctatggagaggaaaggttggctgtgaatggcttggaccagattctgtaaaactcctttaaacctagagactttcttctctgaaaggctttttagtttttctagggggattttcattttcaggaacatctaccccagcctttgaaagcactcagtaatatgggactttgcctgtggtggcatgtgggccttctgtcaggcaagtgtagaagacactgcacttgcactggcatcatttgaataataataacacatatttgcacattccta

SEQ ID NO: 61388 - DNA, 1117 bp, Bovine  19866881123081
atgctgtccgattaattcctcccaaagacttttctacaagactattcatcctaaaacttctggcttgaaacttttcaaggtctttggggtgaccattagagaatatgtttaagaaactatcaccttcttttcttctttcatcctggtaggaagctgtgctcttctcaaaggttaacgaggttgcagaacctcagggagtgcggccaggacacctatttcaattgctctcacgtgcttctcttgtttaattcttgcaagcacagtctggagcctgcgtttagagttgcctgctgctcagcccaccagggcttccttcagaagctggctggacccagaaacagccagacactctgagaatctttaaacgcttttctgacagaaggtttggccatttcttctcccagtgctcattttaaagttaagcacgtgaacacacactttttgaatcccaaagaagacttttaattgattccctgaatattttaaggtctattaattccattgatgttgcaaacactgcaattcattccagctgctgttctaatcacattaattaacaggcttatttttacctgccagctaatattttacattgcatcaataaatcttcagctttctagccaaactgtgtacaaaataaaatgaatcacacagcctcctggttgttccacacgggttgagtcagccaggatccttccttctgaggggggctaatcaggcatgaagataaagatgatagtctaaagaatgaatatgattatccatttcaagtaaatgaattatttcaagtaaagatttttcttgtatagtctattcatttaattcatattttatatcatataaagtgtaaagggaacataacaggtcactcaaatgtagctgaaagatcatataatctgttaaaatgactcatataccaatgtcctttatgggacacaattttttttcaatggtgatgtttaatctgtatataaacacctatagtatcttcttccatccttatggattggcaataggcacttctggaggggggggggggggaaacagcccacaatttaagtgtgtagcatgtgtcagtaaaacagagaacaaaaatacccacatataaccaaccaag

SEQ ID NO: 61389 - DNA, 1595 bp, Bovine  19866881135035
tttactcaaactcatgtccatcgagtcggtgatgccatccaaccatctcatcctgtcgtccccttctcctcctgccttttcccagcttcagggtcttttccaatgagttgattcttggcatcaggtggccaaagtactggagttttagcttcagcatcagtccttccagtgagcactcaggactgatttccacaagtgaccataaaatgagaacattcggccctcagctgagaaataaagatagtcagagggccatcaggcccagagttgccacctgtgtcctcccctctccagctggctcgtgggcagggggaggcccagagggaaccgaatggctctgcccccagtaaggatgtcccttctgctatcagctggcatgtcccacttttctcattcattttgtcccctcctgacagtggcccagctatgagcgagaaggacgctcacgccgtattaacaccacatattcattcattcctcccaagggttagaaaagaaaagtaacaattctaagaacttcccttccaatcgacattcttagcaaatacattttaataagataatgcaaatcctgctatgtaccaaattggtattttcctttgccagccagccaccaggcccatttcatacgaggcatcagagactccatctcccagtgtttgggggactcatggtgaagtctaagtgtattaataatataaaatattgccactaaaaatatagatactgttctacagaaatagacagatgtttcctagtgagtaatgagtaccattttcctccagctttcctaacagtctgaagctaaaaacaaacacacatttttatgtaaactagacccatctcaatattaagaatgtaactgacagtccagaaaatttagagaaagaaatgacaacccactccagttttcttgcttggagaatttcatggacagaggagcctggcgggctacaatccagaggatcgaaaagaatcagacacaactgagtgacaaccaccactgacagtccaaaaaatttagaagtcaagaatcagatttttttctctttattgtcacatgtatatgtgtatgtatgtacatgtttacatgtacatatgcatacacacatgtaatgttcttgagaaaaatccattcatttcattaattaacctgctcaagacaggtaaattgaaggaaagggggcaagttgggacattttgatcctgcctgacattcttacttcatgcttgaaatgggacctcaaagaagcatggagtgttggggccagaagttccttcaagatcaaagggcaagctcttctcactagtgaggaaaccagggtccagaaaagtcaagcgacttccccagagcacacagccagctggcaggagagctgaaaaaacctacatagattctagtaagacaactcctcagagaactgggttatgagatatgggagagacaccagtcagcctcttgcctgaaagaagttccttccttaaaatctttaagacggaaatttccaaactcagtagtcctctggacctgatcatgacatagcaaggacataccagcagtgatgctggcaagggtcaatgagcagtgtgtgtgt

SEQ ID NO: 61390 - DNA, 877 bp, Bovine  19866881269676
atgagtcatttattatcttagtggttagttttctaattagaaaaaaatgagcccaataatacccacttttgtccccatattggataatcagggataatgtctatacagtgtctgacctttgtaggcactcagtgaatgatagctatgaaggttactttgaaaacatacctcaagtccctttggtgcagatgttcacaagcacaatatatccacaccccctcctcagtctgtatcaaatattcagcgtggcctccaacacatttactgctttgagaaacaaagcgatgctaaagctgaggctgtttttcgcttgcacatgtggtttctcatagttcaacatgtgtggcttggttcttggattcctctcagttcattatgcaacatcctgatgttcccaagatgctgtgttggagagagaggtacatttaaaacagacagaaggaacagaggctggctcagtggtggcggcaggagatgaacttgaccagatgttccccaacctcccacaggctgtgacttacaggtggcccctggtgctgtgtgcaggaacttgggagataacctgttctcccagctgagtcctccatcgtggttaggtcagagcccagatttatgagctcctggagaggtagagtacagatggagaaaatgtcaactttagcttttgtgggaggatcaggaaggaccttgaggaattgccaccgccatgacttattggagacattatactcctgaaccctgtctcttgtgcggctcccctccactgctgacttcttccccttctgcctctgcacaataactgattatgcctatggattcaatccttacccttgacatccttctctattgatatttgtggaagcttcttttatcttcc

SEQ ID NO: 61391 - DNA, 1162 bp, Bovine  19866881322298
ttgatagattttttttgataacccaaatacatgatctcctctcatagcctcttctgttatgtgatgacatagtcctgttatcattctgagaatggtctcaaagagccactaagctttgggggcaattactaccatgaggaacagatcaatatcaattagaccaactctaggactgctgcttttcataaacacgcttcagcattttgcttctagatacagagcaactctatgaaaagattaactcatttcattatttaacagagaattttgcaattaactcatccaaaccgagtcattggaatacagccctacacaaaaccaaatattctataagttatactatgccagaaacgaatatcatcaaaactggagtttggctccacggccaggctaaggaggatgctggtgatagaactatgccaaaggtgaggtcattgatccacctagaccacatcagaccgctcctaccatccctgaatgtccctgtactaggttctatgtgctttggctaccaacgaccagcactcatgtgtattctttggaggaaaaccctcatggtactagagcagctttgccctgcatgggcagagagctgtaagggtctggatgtttacatcacatctcacagccccaccgcagggaatcactgacaatcaatctgaataatgggtgcaggatacaaaagcccaactcttctgcctcgggtaggaaaattctggtgtataaattacagcccagagttcttctgtggctcaggtgatgctacccatgttagtcagaattctccagagaaacagaactaggttacatagatgagagatgatagcttagccagataatgagaacttgaatcatttgattatgacggctgagaagtgccccaatctaccctctgccctaggagacctaggaaatccagtgggataatccaatctgctgctgaagacctgagaaccagggggaatcgtgatgcaaatgccacgtgagggcagagcagatgagatgagatgccccggatcaggcagggacgcagggagaaaggaacggattccttctcctgctgcctttggctccattcaggccctcaggggactggccaatacccaagccacatgatcttggggagggcaagtccttaactgagtccaggtgctaacctcat

SEQ ID NO: 61392 - DNA, 1627 bp, Bovine  19866880285419
tgcagtaagggccatttgacattttattcagtgacccttaccactcctaaaatacagtttaatccatcttaaaagttggagctaaataactgattacagcaatgagcaacactgtgaaagttttgataaaccaaagcaaatcctcctctctctgaggaactcatataatagatcgatagtttgcatccaagtaagtatgctgctgctgctgctaagtcgcttcagtcgtgtccgactctgtgcgaccccatagacggcaggcccaccaaggctcccccgtccctgggattctccaggcaagaacactggagtgggttgccatttccttctccaatgcatgaaagtgaaaaatgaaagtgaagttgctcagtcgtgtccgactctcagcgaccccatggactgcagcccaccaggctcctctgtccatgggattttccaggcaagagtactggagtggggtgccattgccttctccgccaagtaagtatgggaagtgtttaattccatctgataaatagtgaggcaaattagaattgattagaagataaatggcatattatagactcactttgtcttcatgtttagtctcaaacttaactttcttattactctattaggacttaatttcgactcagttattgctttgaaaactggtcttagagatctactctacaagtctacatttagcatttggtatattgtcttatgtgctcagtcacatctgactgcttgtatcctcgtggactgtagcctgctgggctcctctctccgtggaatttccctggtgacaattcttgagtgggtttcaatttcctttccaggggggtcttcccaacccagggattgaacctgtgtctcctgcatggaaagcagattctttaccactgagccacctgggaagcccattaaatagaatcgttacaacaatcttacaaagggaatgtaattacccacttaataaaatccaaaaatgaggtcagacaagttgactgacttttcctaaggtaatgatatctctgattatacactaataatcaattttctgaaaaagaaatagatcaatcaatcccatttgcaataacatcaaaaagaataaaacaggaataaatttaactaaggagatgaaagatctctattctgaaagttacaaaataccaatgaaagatatcaaagaagatacaaataaacagaaaagcatcttgtgttcatggactggaagaattattattgttaaaatgtcaatattatactgtattggtgtttttccttctggcttacttcactctgtataataggctccagtttcatccacctcattaggactgagtcaaatgtattctttttaatggctgagtaatcctccattgtgtatacataccacagcatgaaacgagtagccagtccaggttcgatacacgatactggatgcttggggctggtgcactgggacgacccagagggatggtatggggagggaggagggaggagggttcaggatgggaacacgtgtatacctgtggtggattcatgttgatatatagcaaaaccaatacaatattgtaaagttaaaaaataaagttaaaaaaatgtcaatattactaaaagcaatctacaaattcaattcaat

SEQ ID NO: 61393 - DNA, 921 bp, Bovine  19866880718878
agttgatgatattggacagtgtttaattacaagagagacaaaaaacagtggcaagctcaggtggaatttgatgtatataggagttaaaatttagcaattaagctttggtttaagataagcattcaagagtacatacaatttgtaataattttctctcaactattcaagacaaaaaatcaatagaaactaagttgagggagaaggctaatgagaaaaagctgcaattttttaattacaccataatgataaatggctttcattgtaaattaccatctgtgatttttttctttcactctataaattgcaattaaagttactaaaaatagctagtttataagtgaaaagttttaggcaaaagattacttggcattacagcctaccgaaacaaaatggataagcttgtgattaagctcaattgcattacttaatattaatttggtcttccccaaatcacggaaaatcatagttaattgatacagattaggtcatgaccacttgcctaagtccacatgaggaaactatatttaacatgcttcttgtcctcttgaaaactatttacttgcaaaaataatgaaacatataaaagtaataaaatggttaaataatatactgctcaccttaatttatagaagatgccaatgaatagtgccacaaatatgaatggaagacaacctgtgcaaagttcaacaagaagcaaactttgaaataataaagaataagtttcaatttatagctcttccacctatttttgtctgttaaacagtacctgagcttgcatttcccaaacataaaataatggtgctaattaaaatttcaattaagagatagattgcaataaagtatttataagtatctatcagacagatgtgttctaaatgttttttatgccaaccagaaaaaaaaaagttttttcttactagg

SEQ ID NO: 61394 - DNA, 905 bp, Bovine  19866881063909
tggaagggaacatgatggattcaatcctcagagaatgtggttacatgaaaatgagtcatgtgtgatttatattcaatattggatataaaaactgtctgcatatattttgaaccaggtacttaatttgagaaaccttagagagctaaggaatagtcaacattttgaagttatctaacaactcttggcaaaaataagaccacattaaatgagaactggggtgattttattaagttgaaaagataaacaggaactttgacacagaattgaaataaaaacaagatcgaaggaatttggatttctgaaagttaaaaattatattatcaaactagtatttatgttctttctactgatgccgtgagctatgtaaacaaagtctttggatcttatttagcaaaatagcattaatagtcagaaagaaattcagatggtctgaaaatagtcacattgaaatggaaagaaaattacctgaaagaaggtataacacagatgaaatggaggaagatatttcagatatttggagtatttggggagaattgggaacaaaatgcttttcgaggcagaagacacatgcgcattatggcctttcatctgatgctcacttcagtagtcagtctataatacaattttatgcatagtctaaatgtcttttacatatttcttgttaagacataacattgcagaatgaaaatcacctcttacaggcaaaatgcccccaaagttatcatctaatgttaaaagggaatgtgatttttcaacatctgaatctgttaaaatagctagaatgtaaaattgtgtgaataataccagttttttaatagtagaatatcattcaacatgttaagatatttcaacaaaatgaaaggcgaaaatcactcatgatagatattcataatcaagtcgaatta

SEQ ID NO: 61395 - DNA, 1632 bp, Bovine  19866881098064
ttatttctgataagttcattttgcaacatacatttaatttttttaaatgtgtggttaaaattgagatacctagcttcttattctcaagcatctattattgctatttcaaaggacttaaacttttctgtgttgcttttgctgaaataaaacaggtggggaaattatttcacacattgactttgttaaaaaatgtgattttgtggatttttcaaattagtcttccactatcaataataataccccttgaatcctgtcccaggtctcaattattagcaccatttgctttagtgtccataagtcacacatgactaatattcagcatcatgtcttgaggtgttattatggagcaatgatcaaatttattgttctgttttcctgatacactcaatacaacacaatctgtctgacagaaattgcattactgatgctttaaaaaatatgtctcaactcatttcagataagattgaaaatttattcttgcttctgaacatatttaatatacttaccatgtctatgattttttcttagaaggatataaaaacagcttttcaactctagtataaaaggtttaaggtcatgcttgactctcttcatccttggaagaactataaacattctacgtaaaacatttaagaatattttatttaaagcagacttgcgaaaaagcttaggacattttagaaaatatcctttgaattgtccactcacccttctaatatcaacactccaattgtgcattgctaaattactgctccctgggataacatacctagattcatggtttgctacatttatgtatgcatcagtacataaaccttagtatacccaaagtgaggttaatatcattattcagcacgcgtgtggataatgcttaataatttatgtctttcagattttcaaacttgtaatgtttctaagtacaaaagagttgacaaatattctgccttttatacatggatgtgtacacttatacacccatgcttcatacacttcttcatcttttttttgaactaaaaacaaatcgagcacagttaaccactctacttttgaactattttcttcacttagctcgcaaggaaccaatgaatctgattggaaatctctcctacccaagactggtcttgtcagcctccttcctttaccctttcctcttgctgacttttcagcactgaaatctcctagagtccgttttgtccctccttcattttgctgtctatatccacttcttcgatcatcccatccagtgtcatcggttttaaatactatctaactgtagacgactcctgagttaatacctcccatcagactgcttattcaatatctccatttgggtatctcaacacggtcagaccacaaacaccaatcagactctcaccttctgcatgtcagtcttccctgtctcagtagaaggcagctctctccccccagtcatttagattagaaatgttggagtccttctaactgctctctttccttcatattccgtatctaatctgtcagtgaatgctgcctggtctaccctcaaaatacataatgaatctccccacttcccattgcttcttctcgaccacactgtttgaaacccccatcacctctgggcttattaggttgcagtagcctcttaactgattc

SEQ ID NO: 61396 - DNA, 2076 bp, Bovine  19866881235999
atatggaatactattcagcattataaaggaataaactattattatacttatcaacataaataaatctcaaaaatatgagtgaaatcccataaacaagaaaaagcaaatatcttataattatgattctgcacaattctaaacacacagaaaaatgtatagtgacagaaatcagattggtggctgctgaagtatatgacagaacggtgaagggagggagggttttctaaagaccataaggaattttggaagatgatagatccatcattaactggattgtggcattgactttgtatgtgaaaatatcaaattttaccctttaaatatgtgtagtgaattatgtgtcaattatgtaccaataaaatgttaacaaaaataatttgtaaaatttctaggatgtacagatcaaattaaggcaggtcaatctgacatgtaacagataatacaagcctttcaacacagagcgaaaagttactgtcaatggatcagcatcactatattaaagtagaagggtcggtggaatgccagggagattcaggtatggcagatagctacagtaagtctcagcaagaacagctgaggcccctgaggctgttaatgccagggtgtccaatttcaagtgaaaagcttgagttggtttcacatcagtgttgtcattatccagcatgaaagtgcccaaactcacctcccactaacccatttcactctcctatccaactattaaatcttttatatgaagaagttatttttattactgttgaggctaaagattttttaacacatgatctttaattaacatgcttatatttttgaaaactaatattttaactgataattgttagttccaagttgaacaaaatttgaaccttttgtataacaaccttctttcaaataaaaattaggcttttttgtttgtttgtttgctatgttttttacagatattactttaggcagttatgctgacaaagagcttcacaaatgggaaatgatgtaatggtatttgcagtcaaatgattttaaagtgataaggccttaaccccgttaaaaattgattcttttaaagacagctgctttgagaatatgtaagcgcctttgaatgatagaactgctgtcttaaaacacttcccttccatctgtgtataatagaaatgtattgattgttccttgccatctgtatttttgatgacctctttgcaaccgacaggatgacacagtgtcactttcaacactgttcctatcatgatcattaaatcagcttgcagaatgagctggctcctgggagaatggataacttcattgaaaaagacaagggcaactcagagacaagactttaacgttctgacatgtctgttataatgacagagcaacaaatatcttagagaaatatacttttaatatcatatataatatcactattatacagaggaccctggcaggctacagcccatggggtcacaaagagtcggacatgactgagcgattaagcataatatcattaacatgtttagaaactataatcacatatttcaatttctcttcctgggttctgagaaatttctcttaaaattgaagtgcaagctaagtcataggtataatagagaaatttttaagaaaaattgcaacaaaaaggaaaaataataaagcatcaacctaagtggaagaaagtgggatggtcaaattaaagactagactcctaggagctcagtgtggtcatagcaccctccacttggagttctactttgtgttccttcagcttcccatctaaggaatggtaaatgtgtgtatataatgcattatgcttttatgcagatcaaaataaatgtgaagtataagtgctattaagttttataaataagatattgttgtgtcataaatattgaaaattcatagtctcacatatcaacaatcttgatatagtacaatgtaactatttttttaaacttctctttattaataatgaaaagttcaattgttatcttcctactcaaatggtattatacgacaaacttctcttttcctgaaaataagtgaacagcagcagtagcagttccaaaattcctatacaggacacccttggta

SEQ ID NO: 61397 - DNA, 702 bp, Bovine  19866881931865
tttttagctataccatactgcttcctccaagctaaaatgatcaagttttgaaaaggatattgcatgaataatgtactaattatcattttaaactgtgaaatttaattacctaatgtaattaaaggcatacattaatttggccaattcttattcttgtaattaatggcaaattagatatttaatgtataattatctgaaaattattaacctcattcttcaatgtcttttcttttaggaaaatctctgaatattgattaaccaaacatatcagtaaaacctgcaacagaaaataaaaatacaataatattccttttataaaaaaccttttataataaatataaaatttatgtttagagatcttgaagctgctaaaaaggaatgcattcatcaggatagattaatatctataatatacaattgtaacttcacagttgcttcactaatgttacaaggaagtttacaaagaatctcagcttattgcagtcaaggacaatatacatctttgggtgccatcagcttttacacagcctctaagtttaactataaagtggaagagacaatagcagaatcccatggacacaggagcctggcagggtgcagtccataggatttgcaaagagtaagacacaaatgaagcgacttagcattcatgcatacagcagtccaggaatcagaggaagaaatggggttcatcaagcccca

SEQ ID NO: 61398 - DNA, 1032 bp, Bovine  19866882035411
ggtaagtttttcttgaagagggcatagaagagaatgatgttgggtctttatgtgggggagattagaacaggtcacaaggtcataagagaaagaaggtagtaatgtatgacaatggtattgaattgcttgaatttgcaagaagtaaagctcaaaattctaacttcgtaaatttcctaaacttcactcttcacttcctgatagaaaatagatgaaggtaataaagcctgcatatgctgttattaagggaaattgtgtactgaaaataataacattctaaaaatacgtgagtatttgtgtgtttgtgtgaatgtatgtgtgtttcccctgaaaagtttttaaatataatttatggtgacttcataataatcttggatattgtaatgtaaaatattagaatactatcaaatttcatacatctttaatttagggaagcttttttttttttttttcaaagtacaacatgagccatcatattggaactattaatgattttctgtgaaatgctcttatttcttaaaagaaatgttttattttcacttagtaaaggttcttcaaatgagacatatatatgctttttaaaaaatcagttcacctttcctcaaagagaatggaagtaatgttcagattccactttatggcaggacgtttttcacacactggttgatgattgacttctaacaaatggtaagcacagcttgaattgatatttcctaacatgagctgactgaaagctattaaaaaaacagctgagtgaatgttgtctccccatgccacctgtttatgtcaaaaagtatttttataatagttgatgtgcactgaaaatgtaaacttaatgcttgtgttctttcacaaagtgaagtctgttaaactgcttcagtaatcacaatcttcatcaactttatatgagtttaaaatatgataaactcttcatttgtaactgagcttttacttgtgattgatgtgtttgctattcaacttaatgaaatcttacctatactgaaagggggaaaaaaaaaagttaatagcattatc

SEQ ID NO: 61399 - DNA, 4226 bp, Bovine  19866880458238
acgtttggactaaattgtagtttattgtgtgcaatagcatgatgtctataaaaagtacataattaaaaaatactttattgctgaagacagctagttatcatctgagcattcagggagttgtagtagtcagattaaagatcactgatcatagaccatgctaacaaatataatgaaaaagtttgaaatattgttaacaccactaaaatgtaacacagatgtgaaatgaacaaatgctcctggaaaaactgaaagacttgctcaatgccgggttgccacaaacattcaatttgtttaaaaaaaaaaaaaaaaggcagtatctgggaagcacaattaagtggagcactgtagaatgaggtctgccttcgtagacagtggtggtactgggttaggtcaaagtggaattatgagctagattctcttagtggctgtagtgatgaaaatctttttcatcaagattttcctgaagctttctcatgttcctgcaagcggaaatgcctgactattctctggtctctttctgatgacgctcatgtgtttcctggacaaaccttcccactctgcataaatggctgcctagtttccactgaagtctcatgtcccatttgtaaggggtttttgaactgactggagtgcttgctgatgagagtttctcaaaactgctttgttatgttttcatgtagaccacaggatggagtcttttgtgaggtggctctgagctgcctctgacttcttaaactatccaaatattggtttcagtcagaattgccactttgctgtcctttaaagtccatcaaaactgtagaggttgttttttccacagtcttcacaaggcaaattgtgtactgctgcaattttgtttgatttgtttttagcattaaaaaaagtggatactgttgaacgttgacaagggtagaaagaaggggctcatttcagagactcgtggcacagtgaattccctggcagtccagtatctaggacaccatgcttccactgcaggggggcacaggtttgaccccttgtcggggaactaagatcccaaaagccacacagtgtggcaaaaaaaaaaattgtgtcataaatggaaaatttacagccacttaggaggcaatccattaagtatatttttgtacgaaaagggtgaacgtaagtattcaggacaatgaattttacagattgaacactcctgtgtagccacctccagatcaagaaactcccataacctccctctttctctcttccagtcccttctcccaaaggctcccctgagttccagcaccgtggattagttttgttcatctttgaacctctctttaatggaatcatgcaggaggttctcttttgtgcccggtttcttcttattttttattttgatttttttttttgatcatggtaaaatatacataatataaaatttatcatttcaagtgtttcaatagcaatatgtatcctcctgttgtgtaaccatcaccaccctccacccctagaatgttttcatcatcctaagcagaagcgctgtaccccttaaatgacatgtatatagtttatttattggctatgctgggtctttgtcgtcgcgcgtgggctctctctagctgcggtgcttgagtttctcattgccatggcttctctcatttcagagcatgggctctaaggcacgtgggtgtcagtagttgctgctctcagagtctaagcatgggctctgggctcagtagctgtggcacacaggcttagttgctccatgacacgtgtgatcttcccagatcagggattgaaccggtgtcccctgcattgcaaggtggagtcacactctctggaccaccagggaagcccaggattagttattctgaaaacgtgaaatcacggggcaatgaaaccatgtgatactataatgacagacacatgtcatcatacgtttgtctaaacccatagaatgtacgacaccaaggaaccctcatttttattaggggctttgggtgatggttatgtattagtatagggtcagcagttgtgactaatgtcccactctggtgggggatgttgataatgcagaagtcagggggtacatgggaaatttctataccttcctctcagtattgctatgaacctaaaactgctctaataataataataataataaaagtgaaatcagtcagcttagggatgcagggtttttaaaaattgttttgtttttggctgttctagttctttgttgctgcctgggcttctctttagttggaactaaagggctacggtctagttgccgtgtgcaggcttctcatttcagtggcttctcttgttgcgaagcacgggctcgaggtgctcgggcttcagtagttgctgctcccgggctctagagcacaggctcaatagttgtggtgcacaggcttagttgctccgtagcatatggaatcttcctgacctagggatcaaacccacatctcctgcattggcaggcggattctctagcgctaagccaccagggaagcccgggatgcaggttttacgggtgattttatttttcatctttagagagtccatcttctttagcaataagtacacacatgtgtgaaaccatggtgatctggggacatccgagtcttttattcatgatgacaaagcactttttgtttgctttgcaatcctagcttactttcgtttatactgtgtagccatatgaatctctcactcaaacttccagggccttttggggaaaaatgagaagctaatggggcttccctggtagctcagctggtaaagaatctgcctgcaatgcaggacacccaggttcgagccctgggttgggaagattccctgaagaaagggataggctacccgctccagtattcttgggcttccctggtggcttagctggtaaagaatccacctgcaatgcggaagaagctaatgagagctttctgtacagtgagtggggagcagaggggcctgactgtttaaattatttaccctggagatattcaacgtctaccacctcacattagaaccttctgctcaatgggcagatctccctgcctacccctccctcaccagcatgaatcaagaggaggcccaaaactactttagctgggggagggggcgctggtgtggtcctggaatatcccaggagaggtcaccaactcagtgcatcctgcttcagctccagcacttccagctgacatccatcctggggtccaaggtggaagttctgaagcagtcggagagtctgaggtaagacgctgggccttgctccccatggggctcccttttccaatggccactgggtgcaccagattgtattgaaagaatccagttagggtaacccccttacatcagaaaaaggccattttggattgaagttcaaagaggattccatctttgttttgaccttgtaaacacccagaccattgatgaggaccattgggggttgttgtgatgtgggagccttgaggggctccaaagagcttcagatggccttcccttatctggaggaaggaactctcgccccatattttcctggatgtcactctcagcatgtccagattttatgtctgcccagcaccctctgggcttcatctttaagaacattctggaagacactgggcacacattgaggcctgcccttctcctcctcctccctgctgagatgggggttttccctggagacccatagcttctttctccctccccaagccaagctccccttggtgacccagccaagcctggaattctcccttggcgtgtttcccagggactcctgaagtggcttccgggccacaaagctcagtccagccgccagtctgaagacaagcccatctccgcagattcctcttcctttttaattgcaaattcatttgtttaaaaaaaaataataaagcctttgtgcagggatacagggatgggggagctgtcaggggcaaacggatccccactgaaaagcttaggggggtcctcttcgaggggccagtcagggctattgtccctggggagtctcatcagaaatgctaagtcagtgcgcagggctgtcagctcctggagagaccagactgacactagttattccagaagggtcgggagccattagcatttctcttgaggcctgaggccctgggggctgccacggtgggtgggggagggggcgggggcagactccacgtggagctggagagggggcagtgacctcccccggggaagttcagtagggactcttgtgtcccccgaggttctgcttg

SEQ ID NO: 61400 - DNA, 3454 bp, Bovine  19866880602865
gctgttccctctgcctggaatgctcttccccacatgactccttgtgggagaaacaaggaagcagtcggtcaaaacctgcttctcaaatgtcatctcctcattgaggccttgcctctccccctatttatttgcacccccacctccctccagctctccccacctctctcccagactttgtctttctaacaaactgtgtaacccacttcttaaatattcttatttctcacttcccaccttccatccaccccacactccactctttgtttgcagagtggcagatagtaggtgatcagttaatcatctgttgagtgaatgggtatcagggagtggtgagtagcaccatccccattctgcagggggggaacagaagctcagagagattgagtcacttgtcccatgccacacaggtggctcatgatgaatccaggcagcgtgactccagagccaccctctgatccacccccgcccccgccatcccgtgtagatggcagagatcaggatccctgcatggccccaagtctcctggatggtcctcttctggcctcaaactcttccatccttggttctcagcctcctgcagggtgagcaggcgcctggatcagacaggggactgtctcacagactgctctgaggaagggtttgtcagggctgtggtgggtcagtgatggggacaggtgtcccaggaatgattccgcacggccccagttcctgggccaggaggcctggggtggggtcttcagccatggtggcctctcaccgcccccactgctgtctctcagggggcgtgttctgcccgtcaacattcttggtgtccccacaatcaggaacctccccaggcataaggggactgagtccccttggatgtgtattcgctccccactcacgccccacacatagtaggtgcacatgggtgaatactgcataatgaaggaaggagacagacccttcatgagacctactatgtgcccagtacgcagatgtgttatcttagttaatcttggcgatgtctctcgaggtgggtagcctatgcccactctgtaggtgaggaaattgaggctcagagttgccagcttgtccttgtctgccaaggagggccccccaggtgatggggctgagcgagatcccagaatctttcgtggaggagtttcttctgtctgctgagctgagttgtggcctaactcagaggcaggggactggaagagatgcccgcacatgctgggggagggtgcagacccttgcctgggccaggcaagctgcaggtcagtatcatttgatattgatttgatattgtattaaccctggagaaaagcatcattgatttgttcactccctcattaggttctgggcacttgtgatgtgtctggggtggtactaagtgctggggtcacagcagggaaggaaatatataaaggtccagtcctcatggagctgaccttctggcgagggaggaagcaggacgggctgggaggtactttagaggggcagtcaggggaggctgctcggaggaggtgtcatagcggcagtgattccaatgagaaggagctggccaagccaagactgagggagcctcacgacagatgctgtcacagggactcagaggtgaaaggctcgcccaggtcagtctcactggtatccacagggtgcgaccctaaactggaaagggaaatgaaccccacttcccagcagcctttgccactctctgtctctagagacccagacgcaggcccgtgtggtcctccaagctggggacgatgggatcagcatggacgcggtagccctggtggcccggccagtgaatggccccctggagctggtggtgaatgtcagccacacggcacctcttctccggaggctgggcctgccctttgccagccaggtgaggcgtgggtggccagcccaggcaggggcagactcccctgctaattctgtcaactcccatcctgttcccaggggcagaggaccactgtgcacagttgatgcgaatggtcttgccttgtgtctgtccagcactttacagtttgcaaaggctttattaataatgatgataattgtaaccagcggcctctgtgctccccgccgtggggccggtgtggatgggctcctgcacctgcgttccagctcctggtcctgtgtcttttccacgcttctgccttttaatcagaatcaaagcccagcttgcatttgcacagcacctactgcgcgcttggcactgttctgagggtcctacatgcactggctcatctcctaacacccccagtaagaggcagagcagcacagttgctatacatgccgtgtctggaggccagtcccagctctgtcatttgctggctggctgtccttgggcagattccttagcccctctgtgccctcagtctcttcatctgtgaaatggggtaatagcggtactgttaatgtgagggttgtgaggatggagtgagtcagtaccagtgatggccctgggatggtgtgtggctcgagccgacgcttcagaagcctttgctgctctgatgctgctggtgatgctggccgctgtagtcatcagcatccttgggtcacaggtccatctctcggtgacctgcccaaggtcatgtagcaagtaggcatcaaaacaggggctcagacttggtagtgggtccttcctgagatgcaccccacaccctctaagacaggaactgtgctgagtccccatgcagcgggccagtggcgcttggtgtgaactcagcttgcttagtggggccctccctctccctcacgagccatggaacatgtatccaagtcttttccagccttctgtttggggctatccagcaatcttcctgcccctcactcccctctgccgtgggaggaggggcagttcccggagtccaggggcccaggatgtcactcttcccgaagagggtctgagtcaccgtgacccaccgctgagcagcacttcatctgaatcccctttccctgcccttagcctgggtggtggggaggtctgtaggatgccggctctttgcggcaagagagccggccagggtgggcagatggggccaagtctgatgggcatctgccctgccaggctggtgggcggacagggatgtgagggtcctcaggcccctcctgcctccaagcctgtctccccaaccctcaccccgtcctgttccctcttcagctcatgttccgggagctctggggaaaggaagagatgcattcttccctgcagctgacgtgcgattctcaaaccagcctggtcctcaacatccaaggccacaaccaggcactcaggtgagggctttgccacactctgggagccccaggggaagaggactgagtgagggagaggcctcagctgagcacctgacccacagcactgcttcaaaccctccccacagccccattgcacagaggtggcaagggaggctcagagaggccaaatgacttgcccgaggtcacacaactaataaaacat

SEQ ID NO: 61401 - DNA, 1827 bp, Bovine  19866880660143
gcctggcgtgctgcagtccatggggtcacaaagagtcggacacgactgagcgactgaactgaactaaatccagtgagcccactcctagtattcttgcctgaagaatcccacagacagaggagcctggtgggctacagtccatggggtcacaagagccggacatgaccaaagggacttaacatgcacatgcaggcactacaggctgggcttcggatggaggggccctaacacgtgatcacgtttcactcaccctcatcctgggagccgggcacctctgcagctccagatgggtgcctgaggcatctgggcaccaggattcatcccagctctgccagcccgcaaagctctgggcactcaaccgctgagctgtgccgtcactggtgaacccccatttcctgccagctgcagccgttggagagtttcttccccgaaagcagatgggtggtcccgagaaggaaggaaggggctgtccagatcctctggggtgccagctgctgtgagcgttggcggccagtgactcacagccgtcacccccgccctgctacccgctgctccacacacagcccggagggactgacaccgccccccttctgacaacctccccctcaaaaagccacgttcacccaaatccccatctcaggctctgtttctagggaacctaacctaaaatgaggttgtgtctgatttccccaacttagaatcttcccatactccctcagtccttccagaaagagtcttgcctcttcagctcagccagagagtccttctctacccccttgctgaccccgcttcttgattctcaaaagtgaaagtgttagtcgttcacactttgcgaccccatggactgtagcctgccaggctcctctgtccttggaattctccaggcaagaatactggagtgggttgccacgccctcctccaggggatcttcccgacccagtattgaacctgcatctcttgtgtctcctgcataggcagatgtgttctttaccagctaagctgacccagcgcttggtaagaagaggcaagaacagcttctctggacacttttatagaggcgagatttccaaggtcctcttgtgcattgccagtatttattgggtgttgatttggctgggcatttggtaagatgttttcttggtgtgctagaaaagtccaactcccaggactctgagctggaggtgaaaggtgcagtgacacagtcttttcagaggaacatggaaaacctagggagcctttagaggtctctgcagccacaccaacctcaaggctggttagggctgggatgagtaatgattgtcaggcaggataacctgcttgagaaatgaaccagagcttattttagctattgagtcatcacagaagaatgagaaatattttccctcccttcagcccctctcaaggatcctcaaagtctttgctttctaaagggtggtgtttaccatggacggaggagcctggtgggccgcagttcatggggttgctaagagtcggacacgactgagcaacttcactttcacgcattgggagaaggaaatggcaacccactccagtgttcttgcctggagaatcccagggatgggggaacctggtgggctgccgtctatggggtcgcacagagtcggacacgactgaagcgacttagcaacagcagcagcagtagagaatcaaaaagccatgttttgtttttgtttttttaagtctagtacatagtcaggcttcatctagctgcaaattacagactctgactgaaattaacttacactgaagcagaacatattattttgtctccctggaaattcaggagagcaacagcttcaggcatgg

SEQ ID NO: 61402 - DNA, 956 bp, Bovine  19866880684856
tcccctggctcctgggggtctcatgggccccggtgggggctgcaaggctggcccaggaatgtaaacccgggcctgtttgggaaacctggagccaggggttcccgagggtggcccagcggggcctgctgcaggccgggggacacatgtgatgtgttaacactccgcagcggcggggccggcctgcgcggcccccaacccgcctcgggcagggcatctggaaccagttaggggctcaggggtggccgggacacggttaccttggctgaggcggaggctctgctggggcagcggccaaggaggacagggaggtgatgctggccggagagccgcagctctttgctggaagcaaagaaggcgtgagaggcctggcttgagggcgccctgtgcaggccgggtcaggaccaagccaaccaccccagcagagggctggagacccagaacatggcagcaacccaatgaagggctattaacatgcccggaggcctgacggccgtgggctgcaacgatcagggctgcagcgatgcacgtttgcattccagcttggcctccgcctggtcctggcacggtgggcaagtgcctccgtctcccctccagcacaggggctgggtggtactcagcggcaggtcttctgtgggcccgcccatggggccctctcgctttggacagctaactttaagcctggccccctcctgcagccctgggctcacagctcccctccctcggctcctcaagccaggcactcatggctccccactgccgcctgccctgggggctgccctgtccgggcgtgtccctacaccacgtgtgccaacctcagcacggctgacaccgtgggccacaccagtcatcgctgtggcctgacctgcgcattacaggacgtctggcagtagctgtggcccccgcctgcgaggagccagtagaccccccttcctggctgtaacaaccggacctttccc

SEQ ID NO: 61403 - DNA, 1005 bp, Bovine  19866880915558
ctgaggtatatttgttcgtgtatgtgtgtgggtgtgcatgtataaatatatgtgtgtgtgtatatatcagggggtcaggagaaagtaagactagaacaagacaaagcaaaataaaaatttcagacacaaatgcatgccacaaagttctacacaggagctagtatctgcagcatgaccatatgtcaaattaagtagttttctgcatttgtatgtttcactataataacggaactgaggataatgggcattgagaatattttgaaaaataatcaattgactcaaagtttttttcttggtcttttgctgtttaaaatgctgattttgaaagttatactttcaaaatcaacacatgatactgctggtatcatgtactgtgtggaccaaaattgcctataataaactttttatttaaaaaatgcatattgatccacatactgtacaatgccatgtagtatagacttgttcatacactagaacttcaactctaatctcttagtgacaaataaaaagaagagaatacattgagtgacctgatttgcattgtcgatgttttctaaaaactcatactctctgttaaagagaagcaagacattttttagcaataagctatgagaggaatgtttctcttgaggcctcttaagggagacattgcctgatatagtggacaagacctcaataacatccttagagcaaatgcaacagaaaatttcatattaaagatgctatctcttttacaagctgaaaacataaccccaaaatacaattaaaatacaattttacagtggatttaaacaattcagaccaagtccgtggtctgggatggcctttttgattcagggccagaggaagaagggggggaaatctagattattttggaggattatatgaaaggcaaaagctttaggaaacactttataaacattagtttatacaattgatttcttgttaaaacttgggcttatgctaaaagaaaatttaaaaaattactatattccatgtgcaagt

SEQ ID NO: 61404 - DNA, 1201 bp, Bovine  19866881091613
aggcactgccaaggagcactttgctacagcatcataagcctctctgaatcttcctaaatcacttagagccttggatttccgatacagagctttgtagttactggcatttaaactgaggactgtatcacagtcttctaaaactttatcatggaaaccctggtgagtgagaccaaataaagttagcaatcaattcatgtcttgcaatgatgcaaacacaaacaaattcagattctcctctcaaatggattggtaatggtttttatttgtcttttaaaaattattttcattatgaaatttcaaatacagaaaagtagaaagaatatcatggctacctatgtacccaccacccagacctttggccatacaagaccccagatcttcaagaaagaaagctgtccaggtatagctgaggtcctaagtgtgaatgtctatatgaaaactttaacaacatcaaaatactactttttaagtttagataagtgaaggttgcgttaattcttttgaaggctcactactccttttttttaaattaaaaaataacaataactcctaagagaaacataaggagcaaactgtcagttgagatacctgatacccccatctgtgaatacctgtatcttcccaggctgactttttttttttttgtaagagcagattacccctgcccccccaaagccatactcaaaagggtatctccaaggaccagtatctaaaaaaccaattatttttaaaaattcctaagtatttggccaaaactgatttttcaaagcttgaagcctctctaaagcagctaatacatctttcctataaattgaaattagaaagctgacttttgctaatgtactatgttattgaaaaatctttttttctctccagaaacactgctttacaagtcacaactcaccatattggaatagcaagcaatacgatttatatatagtttttcaatgatttctttagggattaaaatttcttcagactttgcataatcagctatactcaaagcttctgaatactgacttatagagtggttccaatcacgttcgcgataaacatcatttccttcattaaaaagatttctcacaagagcatgtaaatatacctttaaaaaaaataaaaagaatgttaccccttgaaactttttaaggaacaagtcagagtgcaagcaaattttaatttctgtatctaaaacttcagagga

SEQ ID NO: 61405 - DNA, 3137 bp, Bovine  19866881240321
tggtttagtaaaataccgagaataccccgtaacttttgaagtctgtaaagaagggcatttttttagtatattttttgcatttccctttttacgtatgtttatatgtgtgtatttttggctgcgctgggtcttcatggctgcacgcaggcttttgtcagctgcggtgagtggggactactgtctcctgtggcgcatgggcttctcactgtggcggcttctcttgtagcggagggcgggccccggggcagaggctcggcagttgcagcacatggggtcagtagctgtggcattcgggcttagttgccccatggcacgtgggatcttcctgacccagggatcaaacctgtgtccaccgcattggcaggtggattcttgaccactggactaccaggaaagtcctgaacttcatattttaatagcaagaaaactctttgatgataacatcaggtcaaaggcaacaaaattgaggaggaagagaaggaggtagatcagttgcagatcttgcaatcatttggggggtaaagttgggggaggagcctacttaagttacttctttaggctaaaccgtgtcctgaacactcactgagctgtaaatcctcccagctacagcatggggctggatctattatcagtccccatggacagatgagaaacaccaaagcacagagatgttaggtaacttgcccaaagtcacacagctgggcgatggcagaatgggaatgcggatccaggctttcttgctccagggtctgtgtcctacatcgtactgccggatattctgatagtctacacgaggggtcctgaaccaggggtgattttgaccctacccttccccggggacagttggcaatgtctgttgacattgctggttgtcatactggtgtgggaggtgctaaaggcgtctagtgggtcgagcccagggcggtcccccacaatgaggaattatcaaggtcacgggttgagagtgccaaagctaagaaaccctggtctacacagcaccacctgctatgattaatgactaaatgatactgtttctccgaagaatgtggaggtgctctttctttgctgatgggagcatctgtggccccgcccggagccctcagatctctcctgacttggcggtgcctgctccctttcccacagcagcccacacctggggatggcagctctgcactgaggtgcgctggccggcacccgaccagccctccctgctctcggtgcctgtgttcacagccgtgacgctgaagaagcaggactgggggctccaacagtatctgctggaagctgcctacaccttccacccccaggtaggccctaggaaaccttcttctttctcaaccggattcagggcctccctaggtcttctactcaggggtcagtgttgagcatcactcataaagacgggggcctcctccccggagctgttgggctgggcttgtcctgctgtagttcccctcctgcctcaggacccttgcacatgcggctcctctgtctctggctgttggcttgttaacgctgaatcaaccttcgtagctccattcaagaggtcacctcctcagggaagcctgccctgattgccctgaagtggccatgttcgtttgttatatgctctaagggcactgtgttccttccctttcagtcacatttgtgttcattactgaagctggttaactaagatctgtcttcccccctagtcgctcagttcctgggaacagatccagtgcctttctcactcctgggtccccagcacctggcacagaacagacactcaacagcctcctatctgacctccccattcccactcttgtctccttcctgtgtgttttctaccagcagccagacagaccttccaaaatccctaaaggattgtgtccatcctctgctcaggactctgcagtggctcctttctctctgacctacaggctttcaatgatccagccgtgccggcctctcctccccatctccccactttttgaccaggttcaccgctctccagacacactgatctccttttaattaaataccaagcacattgctgcccagggcctttgcattggcgatttcctctgcccggaacactctttcctagacacccacttgactctgtgccttgctgcctcctggtctcatcaaatgccccttcttcagaaacaactttcccctcccctgaccacccggtccagaacaatgacccctgactccgagtttgtcagcagagcactcacagccaccagctgccgtctcacttccttctgtgtctggaggtcctgtgagtgtggagtggctgccaggagggcaggactttgtgtataacactcggctgcaccccctgtgcctgtaacggtgcctcgcacacagcagtgaatgttacttggttctgggtgaatgtacgatggtgcaggatacacttacttacagaaacagactcacaggctgagaacgagcttatggttgccaacgggaaggatggggcaagggatagttagggagttagggatggacatgtacaaacagccgtatttaacatggacacccaacagggatctgccgtacagcacggggaactctgctcaatgtcatgtggcagcctggatgggaggggagtctgggggaggatggatacatgtatgtgtatggggctgagccccttcattctccacctgatactgtcacaacattgttaatcagttacaccccaatacaaaataaaacatttgtgtttttttttaaaaaaggcaaagcacacaaaagctgggagatgagcacgctgagctggtgaaggggcccaggggggtccaggcaggtgtgtgttgcagctgctcctgagttgtcctgtaggactctcctccaggatgtatagccccagactcctggttttagggttcttgtcttttgaggacaagaatgaccataagaactcaggtttggggttttttttggaaacacatttatttacttttgggtcttcattgcttttctctagttgcggctattgggagagcttgggctcctcactgcagtggcttctcttgtttcggatcatgggctctagagtgtttgggcttcagtaatttctgcatgtagcctcaggagctgcagttcccaggccccagagcacaggctcagtagttgaggcg

SEQ ID NO: 61406 - DNA, 1474 bp, Bovine  19866881589494
cagggatcgaactcacgtctcttgcttggcagacagattcgttaccactaagccacctggggagcctgggtgtgtctgtactgggttgcaactggtgttctggctgaaaaagagcccagggaagatggaggcactgggagaaggtggtgggggaaggaaacagagctgggaggtggatttagggaccgggggctctaagtcccttggctgcaggccctgggagtcttcagggaaggaagccactgggctctctcagcccctcctacctgcctcactcaaagcgctgatgttgtgactcaggctgccagagagctggccgtgcccagggccccaggtgcagaccccgaccagagccaggctggccgtgtcagcacggaggctggcctggcccccgaaggctccccgtctgggcctgcagccgcccgctcagccggagctctcctggcaaggtctggctgctgttctgggcaaggatgcaggtcacactgcgcatgctggtgctgttccctgccttctcgtgcttgtcccgcaagaggaatcccagcacggctgagtcggcagtgaccttgatagtacctgcaaaggatgggaaatagtccgaaaaaagaagggcgtcagcccagggcactgggctgctctgggaaagaaggaatagaacccaggggcaggaagttcctagatccatgatgtaatgttaactcatgtcagagagagcatatctgagaacaggagcaaatgaaatcagcttcccctacccccaggatgctccgaggaccaaacaacctaattcacaaataaagcagctttggataaaagcagtaagcctgataaggcatgtctgttaacaccagcgctgctgaatcctgctcacgagagtcacatatcaccatgatggaatggccccattttataggcaataaaactgagacctgggaattttggaattttaggaagaaaaaaattgctcagaggtgtcttccaccctggagaaaaagattccatacccttgacccaggccatacataagtcatgcattagggatattctcgctcttatcaaaaccatttaggtttcctgacccccaccagtctccactagggccttaatgtggtccaactgcccaagttccctcctctcattcaagtgactcaggggtcactacctccaggaagccttccttgacccttctgcagccacagccctggttagacaccctcgttctatgcttccagacaccgagcgcatgctaaactctgtcacagagtactttccatacagatagaactttctcacagaatcttgcaatcatcttttttacagattctttacattgtagggccctgtgtctccatgttctctagaaggttaaccctgtgtccttatctggaaaacatggataatcaagagtaaaacttcacttgattactgtgaagaaaattgaaatagtgtctatgggaatagtatagaattcaag

SEQ ID NO: 61407 - DNA, 1013 bp, Bovine  19866881717697
tgaaaaattttctaactatacttaaaagagtgatactattaatactacttccatctgacctgagaaagttccagattgacacttggaatataattcaaaggcagtttcaaaagtgatgaccatctactacgaaaagatggttgtgaagagtcagagaatcctcactgccagctcagagatcatctgggcaagcctgaatgaacttccttctctgtttggttatcttaagatgtctcactccagtacaggcaaactagtaaatcttttcaggtaactcaggtgagtgaaggaaatgttcaaggagcaactaaaactctgagctcagatgccaacatccaggattagaagactttgccacccaggtaccatgtctactgcatcccaggtagctctcagtggcaaagaacctgcctgccagtgcaggagaggtgagtgatgtgggttcaattcctgggtcagaagatcccctggagaaggaaatggcaacccactccagtgttcttgcctggagaatcccatggacagaggaacctggagggctacagtccatggggtcgcacagagtctgacaacagaagtgatttagcctgcaccctgtctactgatacaatgactgtggaattcaagccagaccagcagagttcacgtgggaagctacagagacccacgtacctatcacaaatactaaaataccccgttggaaagcggtgctgccagcagtactggtcatcctcagtgtggaagaccttctctttgtgcttctcggaggagatgtggccctgccactgcttctcactgtttgcagttcttcccgcacatccagcagtgaaagtccacctgcagtgcatggaagacaggagtcgcgtcagcagctgctgtccggggggggcccctgatgggtcacccgtgttcaggccccagattgactaaaaacaactccacctaaggcccacattctattcctggggagccctgccagcaggggtagcttgggagagatgggcttgagggtg

SEQ ID NO: 61408 - DNA, 1787 bp, Bovine  19866881936295
aagggttaagaagagttgaccagtaagaactttactttttaggctttattgctatgctatgctatgtcacttcagtcatgtccgactctgtgcgaccccagagacggcagcccaccaggctcccccgtccctgggattctccaggtgcgaacactggagtgggttgccatttccttctccaatgcatgaaagtgaaaagtgaaagtgaagtcactcagtcgtgtccaactcttagtgaccccatggactgcagcctaccaggctcctccgtccatgggattttccaggcaagagtattggagtggggtgccattgccttcttcgttaggctttattacctccctctaaaattcttgggccttaatcagtgcagatttattatagatatcaccagactgtcatgtgtggattatctgtccccttccagcacattcctgtgtctctaacataaaacttgtgtggctcagagtgttgtttctcaggagctattaaatagtatttgggcaaaaacacacattccttccccatctccaccctcaaatttccctctgggtataaacacagtttctctgagtaactttctgatggtcacttctgtttttttaaggtaagtatgtggtgttatattaatatttgaaagatctaaacctcggtaatgtgtaatgggcgatgagcttgccctgaagagatccctgtgtgtctttttttggaaatagggtgcagatggctagcagggagtgtaggccttgaaacagtgtgtacccaagcccgctgcccagaggtagacttagctcgatgtgacattaaaatcacaagagttcccttgaattgagtacaaatgtcgtttcaggttatgtgggtgtgcagcactgtcttacactactggttttcttagttttatagaaagattgaaaggacatgaaaggaacgtcagaaatacttagtccagccctcttagtttacagatggggaatctgaggctgctataccttaaagtgcctgcccctcctcttggcctgttaaacctttacttgtttgagttggttcagaaccattaatactcatttcaacatctaccattcccgttgtaccagaaaataaagtgctacggcagagacacccaaaaggtagcctttttgtactctgtgctgtttgtgtaacagcttaactagtagtagctacctatagaaattaacaggctttcctgttttgtgagagcagactccgtttttttgtcttgttttactgccagtcacaaaggcagtttaggaaaggctctgaagcaggaagtagttttcccaaaacactctgtgcagaattcagctcccctcagtcagcttgtccgaaagcagtggccatggtgtgctggcaaaacgtgctctacgacctgcatctggggatcttctcattacacctgatccctgggacccttgtaacacgggacctgggaacctcagcagagcctgatttgcgtgagtggatgaggtttccaggtccctggcccactttctgctaagcaaaataagttatcagatgatttttttgatttcttcctttaaattaaaaattggtggtggatgatggggttggtggtggtagtaatttaaaaacaaaattagttagcaaatgaattgtactaagtcttgaatccatagagtcactgacccagtgtctccactgtgtgtagaatgctatttttacctctttctgctgatgttcctctgtctgctgtcatattctgcagtgcacacgaagattgtttatgtcatcacattatatgtatgtgt

SEQ ID NO: 61409 - DNA, 2023 bp, Bovine  19866880216466
gactgatgctgaagctgaaactccaatactttggccacctcatgcgaagagctgactcattggaaaagaccttgatgctgggagggattgggggcaggaggagaaggggatgacagaggatgagatggctggaggccatcaccgaactccatggacgtgagtttgggtgaactacgggagttggtgatggacagggaggcctggcgtgctgtgattcgtgggttcgcaaagagtcggacatgactaagtgaccgaactgaactgaactgaactctgctttgttagataaaactgttttatcattacctgacacattgcacacttggcgcacctgtaattctttccttgctgttgatctgtcttcccaactagaagggaagctctgtgagaaaggcctccgtctactttgctcactgttgcctccccactgcctggtccacattatcagagctaaacacaaatatttttggaatttatgggtaaatgaatgaatgaatatctgcagcattgtgggtattagaaaactttcctcagggaaggattcatacattccttttcatctaggagagcaaattctattgcatggctgatttgtttgcctccgtcaatgatgtagccaaaaagaaaaaagcttccagctcccacttttacaagtaaatggcacaaaagtcttccccttcttaaacatatctagtttctggagatgtatgaacaacaaagccagctacttctaattgttaaaattattgttttttaagattgttctttatgaaagaattctgcatcatcagaggtgaaagggctgtaaaatcccttcatccatccttctctttctagagggaaccatgagcccagagagaggagaggacctcaaggtcacagagtaggagggcaaaggctctgactaacatccttatggggaatcaagggtacataactttgcactccaagataatacattctcagaagctattaaatgtggagttttaatatctaatggattcttccctgactcgcagttattaataatcagagaatgaatatgtttcccacacctttgaaaaaaaaagggcccagttgcatgggaaattatttttatctttcaaacaaagattctgacttattctgactttggagcttaattagctaatctttggtatctcacatcaaaattagttgtctttccaatgtaggtgtgtgatcattgaagtgtttatcagggagtgtctttcatccattttcaaaccacttttctcttattttgagaatctgaaatagaaagagcttcttaatccttccactgcttctttctccagcccctgctgagagtagagaaggaaatcaaatttactgagaaccaactatctattctgttgtgggcattcatttaatcctcatccccaccatttgagggatttatttttgttttacagacaaaagaacaggctggaagagttaacgttagttttttcaaggtcaggaaaggaaagtgaatagaggattcagaatcagacagactttcttccaaatttcagccccagatctatccattccatgactctggacaaatcactctgcttctctcagcccccagaccagcactgtccagtagaacttcctgtgataaaggaaaggactcgtatctgtgatgttcagtgtgatagccaggagccatatggagttcttgaaatgcagccaatgcaactgaggaactaaatataaatgttatttaattttaatgaatttaaacatacacagccacatgtggtccgcattaccatattggttagcgtaattctaagtcttattatcttaagcccagacaagctgggcccctactgtggcccaatatgactctcctctgcagcactccacagggggtgcggtgagtccacagtccccctagcccacccctactcctacttgagctctgaaactgtgatctggaattcctgcccaaacaagcccagtgtgcttccaggctgcctgggcctcttccttggtgccatgttccaagagcaat

SEQ ID NO: 61410 - DNA, 1708 bp, Bovine  19866880430558
tactcttgcctggaaaatcccatggactgaggagcctggtggcctgtagtccatgggatcttgaagagtcagacacgactgagtgacttcactttcacctttcactttcatgcattggagaaggaaatggcaacccactccagtgttcttgcctggagaatcccagggacggggggagcctggtgggctgccgtctatggggtcgcgcagagtcagacacgactgaagcgacttagcagcagcagcagcaagctagatgaggattagctcactgatactttcaccctcacattttctttctctatcacccaaatatgcttccatcactatcttttgatagaaaacaacattactatgactgtactaaattttcttgcttcagtgccaactagtatactatgattattttttgtacagttttatactgttccaatagtttctaagtatcattattttctgcttgcaatttgttataagcaataagtcaaaaatttttaaagtttcatcacattaagtattctaataagcccctgtctttcacatttttagggtccctctcttccttttcctgtctagactgttccttttctagccctttacacaaacaaccttctggaatttcccataatttctttcctgggttcgacccattgttttctaaataccatgtcttacttattgagggtttgttccctttggctctgaatcccttagaaagcattgggttcctacgtctctcctgaatcttatggcaaatttggctgtgtaagggacataatttgtgttaactataatgatccctttcaattagaactgattcaaaacaactctggtcttccctgttggctcagcggtaaagaatctgctggacaatgcaggagacatgggttcaattccagggtcaggaagatcccctgaagaaggaaaaggcaacccactccagtgttcttacctgggaaatcctacagactgaaggacctggggggctacagtccatggggtagtcaaagacttagcaactgaacaacaacaaaacaacttcataaagtatattttatcctcattttatagagaagtatactggggttaaaaaagttaagtaacttgccccaagtctcacacataggaagtagcagagctgggatttgactttctagccccaaagtctgatgagctaccttctgctgagggcttaccatacatcagactaccgtcctgagctcttgtattattatgatgatacatcatccttaccacatccagacgttgttgaaatgaatgctgttatcaaatattgactctcacaattaataaagaattagacttcctcaaataactacagagagcataacttggatcagtgagaaaaagtcacaaggagatagatattagcttaaaataaggagagaatgtctaaccatctgagccattccaggatgagtcactttgtaagatagtgagctttctacccctggagatacacaagaagaatcttccaggtaaaggtgactgtaaaatcaacttctttgttttatgtgctgatgacctaaggaggagaaaggaaccatcaggttgaactcctgctatggccaggcacagggctttgcatacaggaactcattaaaaaatgtacatcttattcatttaacaagtaaggtaactaagctcagaaaaatcaaattgttaacccaaggtcacacagttcatg

SEQ ID NO: 61411 - DNA, 959 bp, Bovine  19866880472013
caccaaagctcactgatcacctaacaaatataaattatgaaaaactttgaaatgttataagaattgccaaaatgtgacagaaacacacaaagcgatcaagcactgttggaaaaagggcactgacagatttgctcagagttgccacagaccctcaatttgtaaaacacacaatatctgtgaaacacagtaaagccgttatgtctgtaactacatcttacacatcgtctcatgtatatgatgtgaaccctaaagcatgaaaatagcacgaaaatatcaaaacaaaggattatagacaataaggcaatgaaggagataaaaagaaatcataaaaacgactcagagaagcctacagaagtcagacaacaaagagcaaaggcaaccaagaaagacccaacagtaacacacacacagtatgtgagatggactacctcgcaaactccacccaacgtggtacttgtggatttaaaatttttaatagtgttgatttttgaatcatataataagctataggagaagaaatttcaacatgggatcaggaattttcagagaagttgtatttatgatgtaaaacaagcattctagctatttagtcaaggtcagccaacctttatctcttctcaccaacattataagcaatcactttagggtattaaattagctaatatcctattagctaatttaagttaaattaaatataaattaaatattaaatttaaattaaattaaatataatttaaatttatatcctattagctaatttaaattaattaaattagctaatatcctattagctaatatcctaaagcctcccaaatatttcatttgttatacttgacagatcagttgttttatttcgtcttttatgagcttaagctcccctatgatagcgtgccttctgcattcatttacttttacaaatgccaaataaaaatttattgaaaagcaacattttaacttcc

SEQ ID NO: 61412 - DNA, 1816 bp, Bovine  19866880546920
agaaggtttaagacaagaggccatcaggacgatctattaacacattaagtcaaaaggcataccgctagagttacctgtcggagaaggcaacggcacccactgcagtcctcctgcctggaaaatcccatggacggaggagcctggtgggctgcagtccatggggtcgctagactcggacacgactgagtgacttcactttcacttttcactttcatgcattggaggaggaaatggcaccccactccagtgttcttgcctagagaatcccagggacaggaagcctggtgggctgctgtctattgggtcgcacagagtcagacacgactaaagcgacgtagcaacagcagcagcagcagcagtattacctgtaatcatggactactttccttgccgcctccagctgttcgttggttaacagaatgttcctgggatcagttacagtgaagaaatgtttggctcgtccaatgaaagtgctttgatcccatcgaggttccttgatgttaatgtttggtggaagttctccagacatcttcctggactggagaggatcagaaagacaagctgatttaagatttataatgttaccatacaattggaaactttgtaatcacactaaagagttacagacacttcagtttgcgaaaataactttgtaataaatggcagagaacaatttaagtccaaagctaaatttgtttgcaaatctcagttgatcctaaacaaatttcaataatttcccacacaattgtttttaaaaggacatagtatttcatcatcccttacttttaaaaagctatcctttaggaaaaaattaaaatatgaaaagttagaaataacatcaacagtaatcaactgaagcttgaaattctttttctgggtgaaagaaacatcaaactactactgcattctggtttactaaatctgttattcctacaagtagaagtgactaatgcaaaaaaagggtcaatgctaaaaattctacaattaaaaaaagattcagattcattcagccttattcagcataaaaaccaccaatcaaaaatgaaaaagtatgctcttcaatctaacagggtcataatgggaaaaacacattttaccaaccccatgaatagtcataacatgggagcatataatttttctcataaagtatgtattttctggctaagaacccttacttttttctaaagtaactaatttctttctctgagtaatatatgtttattgttagaactgctctgtattgttgtaatatatgcttattgtactattttgaataatataagtttatgttagaaaataaagaatacagaaacaaaatttactataatttagccattctgaaataactattgttgctctctttgtatatttctttgcagatattttctatacatattatcatctaattaaaacaaataacaaagttgatttcatacttggtattttaataccctgactatttcttgcacttacttcataagcaccccctatggcactaaatattcatttggggtatttagcaacaccttcaaagtttatgttattttaaagtaacgctgtatcactgtctactaattttttccctcgtcgctagtgacttccttaaactatatctctctgtacaatattagaaggtccaaggatttggtcactattatggcttcaaaccactgctttctcatactggtttcctcctcttccatttctaatattggttcttctagtagctttcttttccaggtcattttttcattaagttaattttcagtgcttcactagatggcaggtgttttaagatgtcagtcctgccatttaa

SEQ ID NO: 61413 - DNA, 1865 bp, Bovine  19866880599794
atctctctggggcctggggaggataatcagcaattagtgtgcaaaacattttccgacaaatgttaagtattattagtatttaaatttagtttcatcttcccctgcatccagacaaaagggaacagatggccctggctccaggtggagagggggagggcggggccgcgccacaccaagcaggaagtttcagcgctctgccttacaattagcccctgcctgatgtgggagcccagggtgtcgcgctgcagttgcagggagatcttaataaaagccacgtgaaggtcatgggatagcagggtttggggtctgaatttcccttcctagctgcctgatcttggccaggtcagtgctcctctgcaagcctcagaacaatgatatgtgctttgcaggtttggagtcgggggtgaatgagacccagtgtgagaaaacgctggctgtggcccccgagccgtgaaccagggtctccttctcatccacgccttcaggatgccaagcttggatctgctttcctctggagaggctttctgggaactgaaaaaccctgggacgtggaatcctggagatgtgaacgcaagctctggctccaccacttttgggttctcttctagccgtgaccacgagccttacctgtaaaatgggcgtgatgctggtacctgctctgttgccttgcagcatagagattggctgagacgctggctttgtaaactttaaaggaaggtatagacggcagtgtttgcttcctgttttttgctccaggcctctgtccttcgggctgtggaggacagtagtagcaggtaggaggcttggacaaaagctgcatgtatctcactctggctgaactccacttctgggccccatctctccacctgccctcttcagttaggagaccagaacccagaacacaagtgttcacaagtgggctctggattccagagttgcagggaatgacctgagcaggaaaaccagggtagccaagatggctatgccgttcacgttttccttggggccagaaaatatgcctgaagtatatgggcagcagagggactgtgggcagcctgatatgcaagaaaaatgggctgcagagacatcagagctcaaatctagaatctgccccttctaatatctgggcccctgggtatgcagttttatctctccaagccttcattttctgatctgtaaagtgggaatgctaacaccctcagaagggccactgctgctgctgctgctggtaagccacttcagtcgtgcctgactctgtgcgaccccatagacagcagcccaccaggcttccccgtccctgggattctccaggcaagaatcctggattgggttgccatttccttctccaagcattcactaccccagctcaaaccccttagccttgtcaattcttcaccaatgtatcatttccgtgtccaaaaggtataaaagtttcctgctgtggtcacttttccaggtcttgattctcttgcgaagacttctaatatttatatatatatataaagatgcaataaagcttgtatgcttttctcttgttaacctagctttgtcaatttaattttcagtcccagccagggcctctaagaaggttgaggaaaatgttgtttttcttccctacagctctatggaattcctgccagaaaatggatggaaagattaccctcacaatgtatcatttctgaatttaaaaattcagtgaaacactgttgtaataatatgatacttgcatatttagatacattttttttacatttagacaaatatgcacagataatctattaagcttgttatacttttattttctgttttcatatgaacatgtcttgttactggagacagactagaactaagacataataggtttt

SEQ ID NO: 61414 - DNA, 1761 bp, Bovine  19866880618415
tgagcctcatcaaaatcctcacagggaggtatcttaatccccattttgcagatgagcaagttgaggctcagagagggcaagccacctgcccaaagacacaaagccagtaaatgctagcaccctttcctttccctcacctcagggattggcgggcttccctggtagctcagctggtacagaatctgcctgcaatgtaggagaccccgggtttattcaggggtcaggaagatcccccagagaagggacaggctacccactccagtattcctgggcttccctggtggctcagatggtaaagaatccacctgtaatgtgggagacctgggttcaatccttgggttgggaagatcccctggaggagggcatggcaacccactccagtattcttccctggagaatccccatggacagaggagcctggcgagctgcagtccatggggttgcaaagagtcggacatgactgaggtactaaatagcacagtatgcaggggttggcagacactagcctgaaatggttgacagaagtgaatagaagacttatattttgtgactagtgaaaatgatatgaaattcctattttggcgcccataaataaagttttattggaaggcagccagcaccgttcatttctgtattgtcaggggctgctttcctgctatgccagcagggttgagcagtggttaccacagaacacaggcaccggaaagctaacttacttatcctgtctgccctttgaagaagaggcttgctgagccctgccctccaccctgccttttcccaggggtctggaaggcgtgtaggacctctctgtgactctgttctctgcacgagggtatcagggctgaaatccagacctccttctgctcgccaagccatgtactttcaagctgggtgccctggagaaaaggccttctcctaatttgttcaccctttccttgtcggtgcaaagctgctagcggtgggcccaacggcacggttccccctccctccgcgttgcagcccccgagaaggaagccccatagcagtcctgtcagacctgcgacagaaggagccagaagggagggtcaggaaagggcaggcgccagggtctgtgccaagccagcaggagggagggagggtagccaggcaccgctggggcctccagcctgcttcaaaggcgctgtccccagagggcgggaaatgagcggttctctacctttcaagtgactcctggggggccacggtttattctccttgacttgtgaggctgtaaaaggcttcccacctcctttccctctgctctccttcccctgactccagggctggggagggggtctcactccccaaactctctgaagagacagaagatgaaaaggattaatgccttggtgtagcccgtgtgctccgctgtgcagcaggacagatccccccaggcctgagtaggaccttcccagctcacccaggcaggagaggggacaaaggccttcacgcggtccaggaggtagcctcacagctggacccccacacccagggctgtgaacgacccggagcggccaggaagcccgagcactcggtgaaagagagatgggaccttggacacagagggagcgggggactggagggaaagacaacacagagaagaatgggaaaaggaaaggaaataagaaaagacagaaaatgcagaaagcacctcaacagcacacgccaagtgaggcagccaggcacggaagaccatggatcatctgaaatgcccagaacaggcacgtccatggagacaggaaa

SEQ ID NO: 61415 - DNA, 1168 bp, Bovine  19866880675505
gcagtcagctctgctgaatgattcttagttttcttccaagttcaggattccatagctttttcagaaccagaatgtaaagggaaagattgaaagtctttccttctcccatctgtgttctctcctgtaatgcctgtgagtataatgatgtgtgatggaaatgaaaacaaaagtgggaaaagcaggtagtcgaagcctcaaattttactggaacctgaaacacaagtagcgggcgattatgacctagttcctcctttctttgtggtctttgcttgccttcttttcaatccccctgtctcctgtagacaaggcgggagccatgtggctaacacagtcatggaaaagggtctagaggtgtcaggtctcacctgaaaacctaaagggaagactggaagtctccagaggctgttttgatgttgccttccagccagaggatagctgttattggcagaactttatcaacgtttgcttagtgctgttattaaggcagccagcttgccccaagctgatgaattttaaaagaagcataaaataaaaaaaaaaacaaaaaaaacctgaagctgaaaaagtaatgaatgtttaaaagcttgcctcgtttgaagcttctcactggagcagattaacccattcactgatgagggattcaaaaaaagtgattattagcagattccaaaaagtatgttagacattaaaatatctccaaccatttaatccttcgaagaaccctatgatgcaggaatttttgtcaccattccctccaacccagtcgtgaatacaggagatggatgtatacatgggcctgtgagacagccatgcacgccttggtatccatcctaggcacggccgtgatctggtccttcacgcaggtccactctgggattcagccaggacagatggcccatttagccttcccaaagacaatcttctgtacttgcctgtcagctcacaaaccttccagcttggccaacaaggtcagaaagagctttgggggtgaggagggaagagaagggggtgccatgggcatgggcttgggccgtctcctccatgctggttcctatcagctcagaggagcaggctgccgagccctgagagagtggagggaaagctggtcttggtggccccaagggcagatctagagaccccagagaagacacctgtgctaagtgctaag

SEQ ID NO: 61416 - DNA, 2128 bp, Bovine  19866880760825
actgcagggcatgcatcctgtgggtgctgtctgtgtccctgtttctcacgggagctcctggaggcacagaatggatccttttctacactctccttccagtgcccagcgtagcctggcacacagacgtacccaagtggatatatttttaaatgagtggttcagttcagttcagtcacccagtcgtgttcgactgtttgtgaccccacggactgcagcactccaggcttccctgtccatcaccaactcccggagcttactcaaactcatgtccatcaagtcagtgataccatccaaccatctcatcctctgtcgtccccttctcctcctgccttcaatctttcagggtcttttccaatgagtcagctgttcgcatccggtggccaaagtatcagagtttcagcttcagcatcagtccttccaatgagtattcaggactgatttcctttaggatggactggttggatctccttgctgtccaagggtgaattaatcattttatgaaaatgaatactgcttacacacataccttaattttcaccgtggggttgactctgctgaagttgcaaaggctgatctctgctaagttcagtttctccagtactgatacaatcgcaggaaagtaattggaaggggatttaaatggcaagctagggctgtctctcttatcgctggtgagtgatcgaccctttcacacgagagagagaggaaatgtcaaccaaatgtcaccagcccattctgagattatctagccgcatgcatgctgttttgaggctgagtttttaggtcagatgtatttagcattataaacatgttgactgtaattaagataatgtccaaccccatttgtaagatgctggtttaacacactctgctgttggttgctaaactagggggaaggagggagctccattctaattctgcccaaagagctgctggttttttccttatttgatgggtgtggttgccataaaacagcgtgttcctgactgttttaagagaggattaaaggcggtccactctgagaggggatccagggcaagaaggcaacagtctgtttaaatagcctcgttgtaatactttcaaggcaaaagtaaattgtcatgccatttttagacagcatccattgcacccgtgttgaaattaaagctcatttgcttctcatgggatcatgtaacttagaatgtcatgcttggatgtggccgtgtcaaagaatagcagcagaacctctaggttaggggagggaaatagccagtctcctgccctgctcacaggaatgtaactgacatgacattgaagagaaatttgatagaaacagccagctttaaatggtacatacagtttgacccagcagttccacttctaggaatctggcttatgtatatcctcacctgtgttctcagagatgcctgtgtaaaggctgcagccttgctttaaaagccagctaagtgaaacgagtaactcaagtgtaggaggtccatgggaggtggtagtgaaaaagaaaggtgagcccgtgtgcactattatgaaaagatattcatgaagtcaaaaggcaagttaaaaaaatcatatggaccacatgatctcttttgtttaaaacagtttaaggagtatatatttacatttaaaaaaagatgtagaaaaatgcctacctacctggaaacagcagtgtctctggggagagcaagggggaggagggtttcactctttccttttttatgtttcttggtttttacaagaagcttgtgcttatgtatatcacatatataagtaaaatatatattttttttaaaagcatgctgaaccaggggtgaggaaagtagaattttagttgcagccgctgggtgtgtccttgggagaaggagccgtcattgaatactgtgctcacgttccactgatggtcagtcgaagcctggtctggttggcgctgacaggtcagtgggtgtgcctcccacagagcccctctccttccctcagggcaggcccttcctccaccctataggggtcttagtttcgcacaacaagggtcctttcagagtccatgcttgaaataattttgttggccaaaatcatgccatttagagaatcatagcctgtgtggtcttttgatgtctcaagcactttctctgtt

SEQ ID NO: 61417 - DNA, 1474 bp, Bovine  19866880846302
tgagaaattgtggatgagtcagaagtcttctagctgcaagtaacatatccaactcaaaatggcttaaaggagaatttactggttcatagaaataaataggagtagattttactggttcagacataattagttctagggttaaaatgatgccaccaagattctgttctccccatcttttacctctgttttgatttctccggcttattcctcccatagtttcaacaggtcataacatggggtctcaccgtactattttgtcgttttcccattcctgaacaaagcacagaggcctcgggatgtctagtacaaagggagtgtgttaccatctcttattttcaggtaagaaaagagactcactgcagcagtgcagagtgaccagaatgacatgctgccctgggatttaaatgcaagagcgagactccaaagtcccctagacctgatcctgaccaggccctcctgcctcccacctgacaacggcccagctgaagatgtgcactgcatccagctcatgtttgcttattccctatctcagatcaggaggtttgggcatcactttgtgctgtttctaccttagaatgttctctcgttggaggagaatgggcagaaatactagtctagcccctggccaacagtccatgacagggacagatgtttttgttattttttctgtcatcgtcattatgatcactaacattttggtctatctgtttccaacttatatctatagctacggagccatattgattacattctcagaaatgggaacaaactataatattgctttatgatccacttttctcatagatgatagtgtgaccgtccatgtagcttgtctcacccagaatgtttaatggacacatatttgcccactgaattgaaataacaaaatttcttcataggttttttttttttctctgtgtgattaaaatccttatattctcctttcattcattgtctcattacttccttagggtatgatcttagaagcaaaatttctagatcaaaggtatttgcaaggtaatatatatgatacaaatcactaaatcaccttctagaaagatgactccaaattatacactcatcaacaatatatgaaaagtacccatttttcagcaccttattttaaagtatcttgtttttaagaggctgatataagccctgaaatttgaggatatttttacaattgattctagaaactagggaaaacaaatcagagattaatttatttcccccaagttatcatatatacatagctgctttgctataaattaattcaaacttgcctgccttaaacatttagcatgaggattttatgctttattttgacaagtgcatttaagagaacccttgtagcttctaaccatttcagcttgtttttcttcttgttttatataaacaccacattcagctccatgctacagataaaattgccacacagttctcacaaaatgtatatccctgctactgtcctccc

SEQ ID NO: 61418 - DNA, 2974 bp, Bovine  19866880864094
tgagtgacctggaaagcccttctgtgtatataccagcttacagcactgagcaaggcccagaccaggcattgagcaaatgtttcttatatgaaggaatgaaacaaaggaatctttcaaaaatatgtttatgtttagtcttcctggttggaatatatattctttgaacatgggtactgttgcctagctcatatagtccatataatttaagcttagcaaatagatcaagagtttggcttaatatgttatttattttcaattattataattattatgcttaatatgctatgcaggattttttgttgtaaatggcagaaacccaggtcagatgagttccagcaaaaaagggagctgattatacctgggaagtcccggggcagcacaggcatcagccacgggtcctcagtgtcatcagtacctgaaagcccccatctcttgactctgctgtccatgaagtctcagacaggctccttttaggtggtgacagaggtgaccactagctgttctaggtttaataaccacagccaatggagagcagcactttcctgaaagctccagcaaattcccaagcttggctcctattcttccagcttggcgctctgttctcatctagaacagtgggatgcaggatcaccttggtcaggcctgggtcacgcggccacactggtgtcagggcactgaatgcctcctgccccgcccctactgcaaccacatggcctgagactaggtcagaggtggttttgcatggagacactgagctgccaaaaatctctatctagatttgcttacactctaggagatgcaaaagagtatgactctttagatggcaaaatcaaaggctcaaaataaacttttacataaacagacaaagaaaagcctttctactatgattgcagagtagagtttcatgttctataaaagatctaaaaatgaaaactgagttagattgctacattttataacctgccattttcagacaatggataagtactaattatttctcccacaaccccttgaaaggcaaatagtgctattaaaataaacctctcacagattaaacaacggagaggttgtgacaacatctgtaccagagataagacccgtgtgtgtgctctgtcactccagtcatgtccgactcctagtgaccccatggactgtagcccaccaggctcctctgtccttggtattctccaggcaaaaatactgcagagggttgccatgccctcctccaggggatcttcccaagccagggattgaacctgtgtctcctgcattgcaagtggattctttaaccactgagccacctgggaagctcaaattaagactggtattaatggcttaagagctctggggtcataaattctgggttaaaccatccctctgtctctaagaggcataaataaacctcttcatcttcctgggccatgatgatatagcccccagaggcctctaaagagggccaaaacatattcttttttttttttttttttttgaaaaattttatttatttttttctttgcttctttttttttaaattttatttcatttttaaactttacataattgtattagttttgccaaatatcaaaatgaatccgccacaggtatacatgtgttccccatcctgaaacatattcttaaatgtaaaactgatggtcatgccatttcttcagccagccaatcagtgtatatttgccctggcactagagataagagtcttgtgcttgagatacacgagccaaaaccagctgtgtaaataaaagattgtgaagagatgtgtagttattgtgataaaagcccattcctaggcatctgaggagggagaaactgattcccctagtaggtgtagaggctagttcacaaagccaggggctaaggcttgaaggatgtgtggacgctcacagggtgaaaagtgagagaggcaggtgacaaacgctgggacacgtgcctgcccagctcagctcacaacccctcccctctagactggccctctgcagccatgattcccagtgcttggcctgtctctgcctggctgcagctggctggaccaaggtggatagctgacccaggacacagtctattggctgaatggagccaattagattttctttcttgggaatttgaagttgaaaacttgggtcagagaaaagaaaatgttggaccttcaaggccatgtcagcttgggccacggctgccatgcagaggctgtccattgggattttctacaatgatgtataaatagaaggtttgcagaaaaatctggagaatgagagtgaatagaagagcagagtgagagaccctagggcccagacacacacacacacgcgcacacacacacacacacacgcaagcacaaacatgtgaagagagtagctgcacctagcttcagggcctgtcttataatgaatcatttttaattaaagctcaagatttttatttgtttataacaaacaaacctcgacgcaaatggttttctggacactagcacaagcaaagtcctagagatgcaatctcttaattcatgctatttttctcccctcctcttattgtatatactttaagttctttcctcctcctccttctctcacagagctaatcttttctgatgtttgctcacattttttgaggcttttttggaaaatgaacaatagcttcacattatctgtcccaccattaccattatcatcatgttagtacacaaaattacaaaaaaaaaaaaagtcacatttgaaaattttctttaagtcacgttcagtctaacttggaacttctgtccacctggttgctgggaattttcacctcagctactgtcactacaaacaaagctagtggaggtgatggaattccagttgagctatttcaaatcctgaaagatgatgctgtgaaagtgctgcactcaaatgccagcaaatttggaaaactcagcagtggccacaggacggaaaaggtcagttttcattccaatccctaagaaagg

SEQ ID NO: 61419 - DNA, 1056 bp, Bovine  19866880946968
ctgctgctgctctgctaagttgcttagtctgtccactctgtgcgaccccatagacggcagcccaccaggctcccctatccctgggattctccagacaagaatactggagtgggttgccatttccttctccaatataggagaccctggttcaattcctgggaagggaagatccattggaggagggataggctacccactccagtattcttgggcttcccttgtggtttgatgaatttctaaagcttccataccaaccttgcactccaacttctttgactattttatgtagtaaagtcaatccttgtgtatttaagcccctgtttctttgggatttctgttacaaacagctgcacctaatcctatctgatacatatctaattacaaattctttgttctttatcaagaggccgatgtctgcaaatacataaaaacgtgactgaaataattttcagatacataaaagacctaagatttaatatgatatttattgacactcagattctccaaagaaacttagagctgttgggagggtgaaaatggatcatttatattataaatgtaactcagaatccagtccacacaaagcgcccaaacaatgacctgcgtgtgcactcaattagtcatgtccgactgactctttgtgaccccaaagacagcagccagccaggttccctgtccatgggatttcgcaggcaagaatactggggtggttgccatttccttctccagggcatcttcccaacccagggatcgaacctacacctcctgcattggcaggcagattctttaccactgagccacctgggaagcccaagcaaagacgacttctagattattattgttatcagatagtccagccctctgatttgatctgtgaggaaatggagatccagagaggaatcaacttgtccaaatcatgtagctcagcagtgcaggcaagactagaatccatatttcaacactcttgcttcagaggtctttcccctctcctgagcattttgcaaggttggaagctccatcacagaggaagtgtacaaggggccttggatgcccaca

SEQ ID NO: 61420 - DNA, 808 bp, Bovine  19866881222629
gtgtggatttgaaactcaagttcttaattcctgtggccctggggagggaagagaagaaagggggttctggaggattcaccccgtctccaagcattttgagaaggatgctgaacattttacctctaaattggttactacaactggttggcagggaggcattcagaagccatcagtggggatgttcaggaggcctcaggctgtgttcttgggcctctggctgtcccccaaactgaaaagtactggagtttgtgggagctataaaagaagaaacagtagcagttaaatgcaagcatcaataataagaaccatcaaggccaggtctaccattgcttaaattacccaaagatttgaaagatgcttgctagaaacatcactgtctcagttaaggatgcagggcaaatgttttcagatacactgcttttggcaacagaacactattttctaaacacatccacagagaacactgtatatgtatatgtgttgggtgtggcagggattcctctgtattttttccgattcctttcttttggcacttgggagggtcaccaagcatcccaggttacttagctcagtctggcttctgcctgttgtcttggcttagttatgaagacacccctttcattccccccaaataattccagtttggaggataaattatatgctcgtctcaggtcacactgagaagggtagacccatgttctaggtgagactcaagttcacttggacagaagcatggggtccagggctgagaccagggagggggaagtactttttggatgttattctgtaaaatgtatgcttggagcca

SEQ ID NO: 61421 - DNA, 965 bp, Bovine  19866881325641
tctgaaatgcctggagttttggttttgtgggtggttgggagattctcagcatgtttttcttagcagggaagtggcagagcagttcagtcagttgagtagaggaaatggatgaaggaacgggagaaatcagagggtaggagaccctgaggcccttgatggatccaggtgaaagatgatgcatgcggtggccatcgtgagtaggagaggcatttaggaggcagaatggaaagggctcagtgagcagtggagagagggagcaggaggcagtaaggtcgactttggcctcatagcttgggtaatacagtgataggaacatcacttacaaaacaagccattttccctcctgcactcattccaaacagtccaccccatgaaaggccacctgcctcctcctgctggttttcttacttcctcttagagcattgctatttttagcacctcttccccatcactgtgaagctcacccctttgcttttttctttcttctctcccctcctttcaaagctccatttccttcaaagagttgtcatttcaaccagcttctcttccccgggccttctgcctacgggtagccctcccaccacacctcttcccacaaatgaggcttttaacgctaattactgagatttttggatccagcacagaagccatgcacttaaagaagtgagaccaggtgactggagcttatttttagtggttgcaatttgtcaattgtgccatctattgtcacagtggcacccagagaccagagctcaactccagagcccaatgcctgaggatttgtaaactctgcagttagttagttagctagctaagtagctaacagaagggttagcctagtgataaagtcatatcctgtgctgtgcgggaaccctgccccttccagtcctccctgatgaggataagaaattatcagggacaggaatgcaaatagagaagaagaaaaggagagaaagacgagggaa

SEQ ID NO: 61422 - DNA, 1652 bp, Bovine  19866881415441
aagtcgtgggggctgtgcctggaagtttctgaagggggactccagaacagttttggtcactttctgaagcagcatccccctgagctggccagccctctggggttaggcagtgtgctttctaacaattcttgaaaagcctaagaacgtaggtggcttggggaatgagaagaaggattctaatgtgatgggatcatcctttttttttcctgtatctttatcaacaagctctgagaggtaggtatcagcattcctgtttgcagatgagaaaaccaaggtttagagaagtgaagcctcttgtccaatgtcacacagcttgtaagtttggggctatttctctgcaaagccctatttccccccttgcctacactgcattctaccagtgctgagtcaggctagccacactcgaatgtgctcatgtttttctaggggaaagaacatgcagtattgaaaacagttctttatgacaagggtatctgaggtacaagcacaagttctccaccttaattacaggtcctccagaatccccaacaggctacagtgaagtgaaagtcgctcagttgtgtccagctctttgtgagcccatggactttacggttcatggaattctccaggccagaatactggagtgggtagcctttccattctccaggggaatcgcctcaacccagcaatcaaacccaggtctcccgcattgcaggcagattcttcaccagctgagccaccagggaagctataagcagtcactaaattttgaacagataaagaattagaatagctgctagtattaattgagagtttgctttatacacacttcatgctcaatccattgaaatctcacaataacacatagtgttaagtgctgttattctcaccatgttacaaatggagaaataggcacggggcagtgaagtaacttgcccaagacagcacagctaagaagtggcagctttgtctacggagggtatgttctgaatcccgttgttctggagcctgctcctaattgaggagatgatggagagatggagggctgtcaggaaaaagtgagaagggaaccatcatttatcaagtatctggtcctccccagctcctgtgcccagctgtctgcctgttataccgcatataacacaagcctatggggttaatggcatccccagtttacacacaaggaaactgggctcagaaagtcgagatgacttggaagagtcccacagcggcagaactgaaatttgaagcaaaattgtctcccgtcaaagctgaagaattttccagtcctgcaggcaccccttgggggtcaagaggaagaagagtgtggagggtgagaaggctgcagggcaattcgctctttgcgagaagctcatctcgggacccagcgtccccgtgacacacggacgactggcagctttcttccgtgtgaactgtgctcgtggcaggttttcgtttcctgtgatgctcctgacagcttttgtgggatgattgcagggtagaagacagcaacctttaaaggtttggtaaaaactctgcaagtgggaggtctgtcgtcttcctagggcgtgttgtcagctgctgcttagaaatgtttctttacaaacctgggtgcctgagctctccaggtggggaaagcctgagctcagacaaaagctagggtgaggaag

SEQ ID NO: 61423 - DNA, 1159 bp, Bovine  19866881461379
gtgcctgtgaggacacagcatgctaaccgaggactgtcctcacgcaggaacgctacactattggatggatcccttagcgtgtagaaaaccggtgacaaatgcccattacaacctccagcagggtctctgacccaccgtgcaagtgcaattgtcaacgatgtctccctcttatccagcacctattttcagaaatcaatctaaggagactctctgcccttgaaaagacaagtgtaacttctaagacttaagtgcccttcacagaagagggcagtgagttcaaaactgtgggatgtcattcaagaaaagctgtataaacagtctagccctatttcctgacctcagcttttccgagtccaaagtgggcagggagattttaagaaaaaaacagttttcaaggacaaaaagtggaagtgcctttttgattaagaatacaggtacccgtgggctgcttctgcagtggaaaaaaaaagacatctcttttaatgacatagattacacaaactttcttgaactctaaatttgaaatagcatatttcaaggcaggtgggtggatgggtgttggaggagggaaaaagcaaaaagacaataggaagtggggtgggcctgagggagctcttgggagctcatttgcagaactctctctgaaattttcaagttgagaaatgatgttatgttaatctatgtcctaattgctcagcaataaacaacacccacttgctgcataaatgtcaggaccaagactatttctgtttctgctttgaagcaatgtcagtcatggtgaagagcacaaagggatggaacgcttgggttagcgtacaaaacgttacgtgttagcataccaaaagaccgaggggcattggttcccgagagaaagagctctcagatgcctcgggactggtggagctgggttgaggtgggactgtttgcctgctgactgctgatgtgggagggataggcatgatgtctacccactcatcacctcttgctgaaagtgttaagaacaggtcactgccaagcttggatggcactgggaggagggagataacttttcaaacaaaaatgaaggccagtgagacaactttgaagactccagtcctccaagtgggtgaagatgtcaagaagtagagtgaaaaagataataataaaataaccagacttc

SEQ ID NO: 61424 - DNA, 1349 bp, Bovine  19866881643785
atatatataagaaaaaaaatcgaatatctgatttcacttataaaaaataaatccagtctttcttaatattttaagtgttgataactaattcaaacatttaagaagcatgatggttcaattagaacatgtttgtggcttaccacctgcccatggtaagtttttgtgacttttgaagatatgatcaagtaatgcctgcatatgttaaagatagataggtaggtataggaatcacacagatagtgatcacccattttatggatgaaacattgaggctcagagaagagaagttgcatatagggacttactccaagtacgtgtccttttcacacactttcacctcagtgcctctccgtgctaaaggttgttgtcatatagtagatgtttgttatttttttccacctaatatctaaaccccttcctctgtctgaagactctcattttggggcagaatacacctttcactacaaagaaatgaaagtgccagatccttttctaggctctccatggtactggatttgtccttcaagtggaccacaccctagactttgaattataagctagagaaaaaaaataaaaataaaaaagacaggagcatgccaaatcattggtggtgatgggttgtagtaatggtggcttcatcccagttccagttctaatatcatgacccataatattgccagtgtaagctgtagtctgttcttagtagtggggctgctaagaattgacgtatctactgggtcaacagtgtacagtgacttggagaaattgtccttgtctatacagcaactatatccagttctccagccatctttgggaagcaagatggctgattcaatccccttacaataaatctttgtgtgtgtgtgtgtgctgaaattggagccagtatcttatacaggttcctgatcctgggctcccagaaaacatacaagagatagctgggagcttttcataatgatttttcttctttcaacacttcactcaccaaagttccatttaaaattactgacaacagttttctgattgcccgtgataatatattctggctatttacaactccatctgtggggagaaaaaaatcctcctgaattccttgagtgatggcctttgcataattctgctttgcccccttattcctatgattgctgctcctctaaatagccatggaatactagattgtctttctttccaaatcacaagagctgaagtttcttcttcaaaatctcctcattttcagaggatgtgaaggtttgcataggtatttgtgtcttcttcatttttcccaaatccttgtttgggaacagtgtatcagccaagacagactagaattgtatcaggtaagaagtcat

SEQ ID NO: 61425 - DNA, 619 bp, Bovine  19866881948044
ttgggtgaagcaccagcttttaagcagtgaacttccggtttactgcaaagatttcagtgagtcacctgcccacagctgatgctttttgctagcactccgtttggaaaaagacagggcgtggggggaaggatgagtcatgccaaatgctccccaagctcacgggttaaaaaagccaagaacattcaattcctttcatgtttgcagaggagtttggtcacatccaaggtgaaagccccgagaagcacatccttgcagggaggcacatctggctgctggagctgtgggaacagagggccgaccgacccaggcagacgtggccgcccacacagacctgatgcacagctgaagaaatgatctctgggcctttgtaaacagggctcagaaaagcctccctttcaaaatagtgtgtgaatgtgctttgcagatggaaatgtatggatacaaatataagctgcctccacctccgctttcacaatggccatactatcggtgaagtcctacagtccttgccacgtgggcaaaaatgcaatattctgatgtaacaacaaccctgaatgtaggggtgggatgtacgtctgaggagctcaacatttaaccatagctttttcaaaacatcatc

SEQ ID NO: 61426 - DNA, 996 bp, Bovine  19866881985670
tcctaacttctatccttctatcttcccctaagacctacaattacaatgcccaaccctggctttcaaggctgcgtcttcctgatgcagccaagcctctttctccttccacttgagcaccccacaaagtaagagctggtgcataacaggtgctcaagactgggctgaatggggtctctgattcaagtccccggggccgcagcactagcgcatggctatatgagggctgttggcggatttaagtgaacacctatgaccactaactaagtgggcagagttgagcacacttaggccccccgattgtaaggatgaggtagctagaagagagggcccaccagttctgagtcagatgccagctctgtgaggggccctggcaaccttgtctgggatctgacttgctcctttcgaaaacggaggtcaaaagttctacctgaggggacgttcgggaggatggagcaacacagggcttgcaaagtgctcatgaaggcttcccagcacgcagcatccgaggcagcacctggggaacggctgttaccctgagggagaccctccccctcaccacgctccgtcccgcacgcaaactgccgggggagttacctgtctgtggctccctggggggccgtgagctcagtcccactccacacctggagcctcaggggcctctcttccggccacctgggtccctggcccggatgcctcaccagctgagagctgttggaccccagagaagtcctgcgcgcgtcctggccggcggggctgcagcggaagagctgctggtaggccgtgcggaagtctctgttgagcgcggcgtacagcacggggttcagggccgagttggcatagcccagccacaggaccacgtcttccacggtcttgtcgacagcgctgtcccctcgcagcccccggtaaacgaacacggtgaagtaggggagccagcagacgatgaaggcccccatgacggcagccagcgtcaccgtggctttgtgctccctgagcgtg

SEQ ID NO: 61427 - DNA, 1243 bp, Bovine  19866880447462
cctttttaagcaagacagctgctacttgctgtagccacttgtgttatgtggaaaatcagacctaggggatgtcatattgtctacgttttcccccatgaaatgaaattctaatatttatgtgaaatcttttgatttttagtatttgtaacagattcaaaatatttttaaaaccctatagagactagtcattacacatcttagggccatattccccctctgttgtcccttcacttatggatagtatgtgaatattttttgttcttccaacaaccatattttgggggtacttgcgagtgagtatctagtttcctggtgagtaagtagatctactttcaggggcaaagtgatttaactctgaaatatcggattagcaatataaattattggtttgatggatgcatgaagcgagggtaattcacctcttggaagaaagtcagaaatgtcaaacccattattttaagatctgtaagtattagggtagaagaggtagaagttaaatgtacagtcattttgattagaaatgagtcatttttctattagggcaggctaaataaacatggatagacctaataaaaagaagatgagtagcaatagctcgcttttgtttaatgatgtttataatttataagcacttaaatctgtgctttcttacttgttcccagcagaaatgccatgaactatagcacaggtattgtcctatttatatataagaaaactaaagtgcaatgaggttagtatatgacttgcctgttgtgattcagcttgaaatgggagagtttaattctcagtccagttcttctgaccaggctagttttattaacaaacccctaagtcctttcctgttgtgtatttgaggttcagtaacttaagctaaagggttccattggtgattttgtaggttgcttgaaaatccttttgattcaaactgtattataactgattcttaagggtcattctggaatctgaatgtagtcgtatctagatatttaaagatgcgtttttctccccacttaagtaaactgtgaagttgttcagttgaggatagtattttaaattttccagtataaatattagaggaaccatgactgaagcttttcttcttggttttaaaattgcagataaccatttctgatgaaccggacacattatataagcgcctgtcagttttagtaaaaggccatgataaggctgtattggacagttacgaatattttgcagtgcttgctgctaaagaacttggtat

SEQ ID NO: 61428 - DNA, 1610 bp, Bovine  19866880545561
caggagatccagtttcaatccctgggttgggaagatcccctgcagaagaaaatggcaacccactgcagtattcttgcctagagaatccccacggacagaggagcccagcaggctgcagtccacggggtcagagggagttggacacaactgaagcaagtaacactttgacacttcaggtcacttctagagcttctttcccaatcagtccttctgaaggcagcctgagtggggggcacacatccctgaacccacagggtggccaagagtgtgtgctaaatcacttcagtcgtgtccaactctacaaccctatggactatagcctgccaggttcttttgtccataggattttccaggcgagaatactggagtgggttgctatttcttcctgcagggatcttcccgacccagggatatagaacccgtgtcttttacgtctcctgcgttggcaggcgagttctttaccactagcaccacctgggaagtcccataggtggccaaggggcagtcatatgtggtgaggatgagggtgtatgctgggctttgggggttcaggctgaggccctccctgtggaagaagagccaggtgggcagaggcagggtggcttcggcggggaaagggtgctccatctgttcactggctgcaggcttccgacacccactcccacaggaacacctggagctcccctacccgagagccctgccagctaacatcagccaagagaatcactcaaaagccaatcatgaccgactgcactccccagctcacccaaaggagcgccaaccccaaagggagcctgggccttggcttccaagacagctcctggggacggggatagagaggaagggtggaaaggagaaatccagctgactcgggctgcatctctgctgagtagagggtgggcctccaaacagtcaggcttcctgcccggagcccagcctgacatctccccaggccctgccagccctgcctgactcagagggtggggtgacccagggagctctcaccgcccgaggcaccctgggggacctgtccagccagtttccccatatttgcctcattggcatttctttttcaattcctcatatgcactgccctggagatggtcgggttcagactggggtagggccagaggcagccccagagacaagtttgcccttcccaccaccagccgtcctaccgtctcagctctgagaagctagggacagactctggcttgaattctgggccgagcttccccttggagggagaaggaagtggggagaaaggccccttcccagacttagcccaggcccatccatgggtggtgtagatgggaattggggagaagacctgggcttggggtctgtctctgcctaggagctgagggagttgcatgcatcccccctccctgggcttcagttttcttattccaatgctcaccaaggtccgtgcccaccccccacccccagttttgaagtttgccatgctaatccagctccttggagttctcagagcaggaaagttgggggcagggtggggtcggggaagccctggtggctagagggcctccttttcagagggcctggcatctctgggggcctccagagacctgaccccacttcctgcccct

SEQ ID NO: 61429 - DNA, 2275 bp, Bovine  19866880595799
ctaaaaagaattccgcaggaggtctccttgtgtgaggctgtatcatcagctctccattctgtgtctctcttgggaatggagtctgtccatgcacagaggggtggacgggaaggacaggaaaggaggtgagggactgagtcccagtgggcttgtgactggcggggcatcctcaggggtgtggccccaagcccagaagcatcgagggaaagaagactggaagtttcaggtgcggaagggcaagggtatgagtagctatgagcccggtcaccatgaggcagagagagggaagaatcctagaagggcaggccctggtattcccactgctcaaggacccctcctgtcagaaacatgtttttttttttcttctttcttctggtgtcctgcattgctcaaaattagatgcacctacctgatggccgagcccagccagggtctcctgagtcaaggtaggatggatgcgtggaggcttgttggcgtgcggggggactgggaggttttcctggattgtctcatgattcatttccaaattcaaagtcagttcctcaaagaaatttataaggacaataatagcagctattgtggttgagccacttaccattactccatatcatgtctaataaaagtaactcagtgagggtaggtgtgattaccatgtgcctagcatgtagtaagcactcaaccactgttaactgttattatcattatgattttacaaatgagaaagctgagtctcagagagcttaagtttgcacatcaagaaagcgggggtgctggcatagactccaaagcccatgttctgccctcttatccatttggtgagtgtttgttgagtacctactgtgtgccagacatagaactaagctttgagtgaaatagtacagtcttgctttctcccctcgtgggtcttgtaaatcattaaagacttagccagaacctgacaaacttaagacgtgtaatctgaagacttaatcagtggactgagactcatatctctaagggaaggcttctagaagaggaggacccaagcaccctgcttctagaagggtagtaagccagaggtggggaaaaaagacagcacgtgaaggcctggaatgaagaaggatgtttggttcatcttttgcatgatcttaagcataccctttcttacttttgagcctccgttttccatctgcaaattgggctcagttctctgaagggaattggtgaggggccatggccgtgggagctctgggtgaatgaaacgggttcattgtggggtatgtggccttgtgatgagtcattgtttcccttcgttgatgtgcgtgtcctctccacttggccctacccttgagcagtggccaacccaaaggagtgtttggggagcagtttgatgccaagaacaagctgacatgctccatctgcctgaaggagttcaagagcctgcccgccctgaatggccacatgcggtcccatggggggatgagggcctcccccagcctcaaacaggtgagcaggaatccaccccctatcctttccaggccatgtgctgcttgctttgctttgctgccgtcagatggagtaatatgagccccacccgggggacctggagaggcgtagtctttccctaacagaagtgctcaagctttgacgctgggagccagccaggtcacacagtccccacttccactggcaccatgaacaaaaatccagaactgaggtggtagaaatccttttaggggatcccagcctctctgcgtcctggagaagacagcaaagaaaacatggagatgcaatattgtttttaacttctgttgcatgaagcactcaagaccagggtcccttaggccttccagatcagtagtcagtggccagggagagctagtgtgaccaccaggctcccagccattattttctattcactggggcaccagtgttagactctagcatttagagtctagagacctttaaatgccctcgggattatccaggcaggatatgcttgtggtgaactatccacgcagttttagagttaggttaaaactcaaaagaattttcttgattctttgaatattttgcatcttaatttaagtctatgagattaacttgctgttcaccaaaaactttgatgtgatccaggtcactccgtctcttgacgatgccagttaaaagatctttgtctttgacagatgagtcaactgcagcccaaagaattaaaaggtcctacatgagagcttatgtgggggtttttccttctttttttttttttgcctgattctaagtccagatccttttcgtt

SEQ ID NO: 61430 - DNA, 950 bp, Bovine  19866880814311
ctttcccttagtaaatacatgattcttataccagagctagcctcctgctttgtaagtttatgaaaatgcataagcaaacaaatgtcccagtactaccttctcacaagattattgatacccttcagagattctctagaacactggaaaacttcccttgaccttttaagatcagtgctgcagagctgtgcttctcaaacttctaccacgcacacgaatcccctggagaggcttgttaaaatacagcagttcaggaggttggggtccaaggtgctacatttgtaacctgctcccagaggatgctcgggctgctggcccatggactgcacttggagtagcaagattccagaccttgctctgccccctaaaccatccactactcaactccacttgtgccatttttaaagaaccccaacaaggctgaaggaggcagatttgaataggttatttagtgaggctccctggaaggacaatgtgcagtacagttattactaatacagctgtttgtgttcagttatagtgaaacatgtaattttttttttctgcaaaaacagttccaagtcacccactcatttcctcagaacccttccccagagactcagcctccattcataggaggcccccccgtatctctgacaccagggccctcaccaaggaaggcgtggcatttgggctgccacctgtgtttctgtgacatgactagctagctgcaggcatgggcaagggaggtattagaatgatgagtcctgttgggtgctgactggaagaaggaccccaaataggggagtctccccttttttcccttccagcacccccaccttgggccctgccatgctggctgatcttccttgtgggatagttggtcttccgaggatgcacagccccatgaatgactctcgccttttctctcccgtgggtctgcaggctgctctggaaatgctgctgttgcggaa

SEQ ID NO: 61431 - DNA, 3539 bp, Bovine  19866881000569
taagaaacaccagaggcttggattggtcagaaggtaaactccaccagcaagttgtttaggactccccaaatgagcctgtgaatgccaagtttctgctggagacgaaactgctcagggttttaaaaaactgtttcagccccatgtcctattcgtcccacgtgctgtatacaagttctctgaatcagctgatcattcaactccctatgccttccacaccgctactccaagactgaaatgcaaacaaagctgaaatgaagccacaagaaagtaggaaggcgcccaaaatcatgtgaaaagagcccacaccacacagcccttccaccaagccttgaacttaggcactcagagcaggccttactaaaatctgatcgtggcaaagataaaatgccataacatggagtagaactgttgttgagtccctaagactcttgcaaccccatggactgtagcccaccaggtccatggaatttcccaggcatgaatactggagtgggttgtcatttccttctccaggggatctttccaacccagagggtgaacttgcatttctgcattggcaggtggattctttaccactgaaccgctaaggatgcccagaaatagggacagaggtaccttaaaaaaattcaatttttctttggaataatcctcactctggtgcatttccaatggaatgcagctgacacacgaatctacaaagctgcaaagggtatcaagttgcatctgtatccatggcaagcctgcctaaccatcggtaaagctagtggaatcagggtgagggcatcccctggacctgcaaggttcccccaaagagacattctagggccaggccacgccctaagcccagccatctcagaaaccaatgtcagtgaccacagagggcaatacgggagacacaagctgtgactcaagtgaacttcgggacaggacacccacttcatctcaggttactgaactcactgctccctggcgcagtggcctccactggctatctgtacagtggagttccttcagcaataaataagatgatgcctcggacctagtattcccaaatgtgcctagtaagagctggcttaccattgctatctcattatttcattattattattactattatccagccatcactgagcaccagtaataacttccctcccaacctcccaagcttgggaggagattaatttgtgaaaaggcaggtgaagcttcgacaaacacacggctcttatcacacagcaccgttattgctggctgcaccccactcacagccctgacgtagctaactgaacctgagttaactgggctccgatatccaaagagggagcacccactggtagcttgcatcctcaggactgtatctgctcttcaaatgaaaagcagtttataacaaacattccctcttggtgcggccagccagcgatgcatccccgagttgtcccccatgtgtgaagtgtgtcctctccagtgggaggcacctcagggatcgaccacttaacagggtcttgttccagtcaatggacgggccgctccggataccggaaacaggtgactgaatttgccttctctcctttttgcagtcattggcagaaaataagaaactgagacagaagcacaaaaagaaaaaccctgggggcagaatgccactttccccactgtcttcagtcagggtcatgcagagtcctatgagggaaggtctaaaagaagagaaaatttaaataactttccccagccctcagtacagaaaagtggagtgagaggatgaaagggcctgagaacaccaacccgatgtgaaatttgcatacttttgccaagcacggcggcgtgtgtgtgttggggggcgggggttggaggggcagtttgcatcgtccctaaaggttatttcactccaccacgtgctctctccacgggcctctccagaggctgaacttttaaaataaacaagaacttctatctcaaccatttaagagaactctatgatttttaaaaggggaggggaaaaaaaaggtcgccattctgagcacacatcgcaagctttgttctgctcccttccccacttcctgttgctgcctcacctcgtcacattttagttctgaagcctgtgtgtttgctctggtatcactgtcaagtttcggtgggaggccgccggcgggaccaggatgaggacagtacggttctgagacacaaaatcccaaccgcctgaccgtgaggaaagtacagccagcctctcacccgcccggaggccagcagcgcacccactgctaggaaagcgtttgtgggcgagttttactttgtggggaactatctgtgtgggcaagggccacctaaccaccagccaataccaggtggcttaaaactgggaaccacggggggaaaatactgggcacccacagaccaagaaatgccccggaggcgccccagccccccaaacctgcgctccagggagccgtcgccacctgggacaggaactgagagactgaaatgctttggaagcgggtccctgtttaatctccggcttagaataaaggttagagcggaaaaagagacgttaaaccgtttggccaggcccctccggttacagggaaggaaaccagaccaagacctgcctcacacagctgacttactaaccacagagtggacactggatcccagctctccatctcccaggatggggattttcagtatcttatcaaatgaacgtggagccaatggtgaataaatgttggctcagccatactggacactggctggtccataacacaatggggtccaggtgggaagggcagcctaaaatactttttggctcttacacaccaggagggcccatcttctagcagcatgtcttgtgggtaagagtagcccgtcctcgtaacttactccaactcctgggtgcctggggttggggttgcccttaaactagcttactgcagccttaactgttcctaaactagcttactgcagccatgtcccattattccccagccagaaatttaaaaaaaaaaaaaattaaagctgggagacggtggtgctgcacaggctcaggactgggaatgcaacactgggcttcacccgtcggtgaacacaagggtggcctcgggagagctatcctgcccttctcatcttcctgggtccacatggaccatgagaacatcagcctccaagaagctgccaaccccacgggtctctgattctaaacctgtgtatcctctctcaggccctgagccccacggagcttgctctcctcctgcattcaccgctcagccctctggctcatgccacttgcccagcacatcctgggagtcctcagtggggtatgctggagggcgcagcgccctgtgcgcctgactcgagctcaccatgagctccccatctgccttcctgtatcatcaccacggagggaggctttgctcccaggcacccaaccaacaacaaggtgaggaggggctgcagcgcacagggtgcccactagcttcagggtgggctctatttcacgggcagtgagacaccccccccccagccctgcctcatcagcctgtgtctcctcc

SEQ ID NO: 61432 - DNA, 1695 bp, Bovine  19866881004488
tctaaatatagatccaactactgttccgaagccccaatggagtcacaattttttttttttaatgggaaagagaacacttaagacctcatattagaaaattaacctggccggcacacttcaacaggtaacagaggagcatttcgggtaagaattgtttaaaatagtgtgcaagaagggcgggcttcgtgtatatgcagcttgtgtagtcacattagaccccgcacttagaaggtcccagcactgttcaatcaagatggcgatggtggtcgccatcttgaaattcattgtggtttttgaacgaaaagttctgcgttttcattttgctctggacccggtggtttagatggtaaaatcttctgcttgcaatgctggagacccgggttcaatcctcgggtcaggaaaatcccctggagaaggaaatggcaacgtactccagtattcttgcctggaaaattccatggatggaggaacctcgtaggctacagtccatggggtcgcaaagactcggacacgactgagcgacttcgcttgtgcagagctgagggaaaccaggagcagacaacatagcaccagaggactaaaagcagtgtggaaccttaaacaaacccataagtcagaaagggcaagaaagagaaatatctggaatacagggaaggatgttgctgaagtcatatgtgagagggttacacaacattagtgactgtcttctgtaagaacacaacacagaacacacccacagtcaaccggcagcatgcaaagagcactctctgcccctgccctctgacctccagcacgtgcctcccattggctgaaccctacaggaagtcagagactctggagcctattgaaatccgtataggtcagcctgccggggtaccggatatgctaggagaaggtaagagtgagtttggagagggcagaaaatagccagctcaggacttctatctgaaattttcaggatcatgggttaagagtaaataacacggaaatggaaaattcaaacagtgagtttcagtaaatgactttgtgttgattttttttttttaaaggatagtcatttgctaggcatcatgaagagggtcttacgtactttcaaaggaaaaacgaggtagtccaagaatttttttaaaaaaatcagatgtttgaaagaaccatcgttaagtgaagagagaagcctaagatttcaaaatttttagaaacattccaggccccaaagtcgaattttgtaggtaacacctcacctttacttctctcacgcttaaaccaacatcacaacaaaaaggtacctttgacaggcactggatcccaagaattgcaaggaccgttagggttcaagagattcttttcacacatgaatagcctatacaaagggagttcattatgctgatttgtaaccattccgactactcaattcctctgaacatttttagactattcagatcactttcaaaaaagtgcatatcactgattaattctcatgccactcagagttcttaactattcagatacgggctaaactaaatttatcctttataatttccttgaaaaacaaagatttttgctgcaaatgtgaagaagactgcagggacacacttcatctcttttttaaaaattgaggtaagagtcacagaacacagaattaagcattttaaagaacatagttcagtgacacatctatgtagttccaaacatttt

SEQ ID NO: 61433 - DNA, 1471 bp, Bovine  19866881050741
gtgacacgagaacaaagcagcgtactaaggccaacacaagctaggatacgatgcatgacagaagaaaatggatgtcctcttccaccagaccttattgtcttagtagaaagaaagtggtcctcagctaagactggaatgggagagaaggtgttggaagtttaagcagagaggaaaggtcatgggtgcaaatgcaaatagttagggaaataattaccgtgattgactgaggattggattaggtttagtgatcaaaaaattattgtgtgactatcttttgtcttacttcccaccatactcagctgtttgggtgcattcaaacaattgacagcggagaaggcaatggcaccccactccagtactcttgcctggaaaatcccatgggcggaggagccttgaaggctacagtccatggggtcacaaagagtcggacacaactgagcgacttcactttcacttttcactttcatgcattggagaaggaaatggcaacccactccagtgttcttgcctggagaatcccagggacgggggagcctggtgggctgccgtctatggggtcgcacagagttggacacgactgaagcgacttagcagcagcagcagtagcaaacaattgacagaaagttaaacttaactttaaatgttcaagggacttaaaatatttactgtacttttattttcagttgcaccatcatttgaaagtggcaaggagatccaaccagtccattctaaaggagatcagccctaggtgttctttggaaggaatgatgctaaaactgaaactccaggattttggccacctcatgaaaagagttgactcattggaaaacactctgatgctgggagggactgggggcaggaggagaaggggatgacagaggatgagatggctggatggcatcaccgacttgatggacatgagtttgagtgaactccaggagttggtgatggacagggaagcctggtgtgttacgattcatggggttgcaaggagtcggacacgactgagtgactgaactgatatgaaatgttcttaacgaacattaatttcatcttgataaaatgtacttggtgagttattgcagttctgtaagttttttaggctatagttggatttgcctaagtaaactgatttaaattgtttcataatgtagtatgtcttaaaaccagggctggcaactttttttctgtaaagggctagataataatattttaggctttgtaggccatgtggcctttgtcaaaatcagcaagccataaggttactgtaacagttactcaactctgctgttgagtaaagtctaaagctgctatggacaacatgcacatgaatgggtgtggctatgttctaataaagctttatttaccaaaaaggtggcaggcaaaaaagtacagccctgaggttgccaacctctcttttaaactattgtaatatagctcacttaaatcttctatgaaagcagttgaaatg

SEQ ID NO: 61434 - DNA, 716 bp, Bovine  19866881071551
cggcgaggcccggttgggaactgggagagggggaacagaggaagaggaaagagtaggggttgaagggaccatccccaagtcctcagatccaggcaaggcttcagactcaacagaactgctgggggaagggtgagggagggtaccgcaaaccccgggagccctttctagcaacaataaaacaaacataacttcctcggaggagggaaaacaaacacctcgggagagggacaaggatcagatgcggcctccccctcaaagatctctgaccttgcggtggggaggggcccctccttccctttcccagagacctccctttgccgaaggctcctgcccggccagctcacaggttcaaacgcgttgctccccctccgccctggcaagtctcccgccctcgccgccgcggatcatccagagcccggggagagggccgcccttggggttgggggaccacgcgcaggcccccgcgcgctcccgctcccgggcgcactcaccgaagccccgggtcccctcctccggggcctcctgggtgaagatccagggagggttggtggcgtagagggaagtggcgggcgggttggcatgcttcttgccgaagagtttgctgaaagtgccctgcaccgtcgggttctttttcatgctgccgccggcccgcgcgggcgccgagggaggaccgtccctccctcgcctgccctgctcgggactggactccgcaccgt

SEQ ID NO: 61435 - DNA, 766 bp, Bovine  19866881081240
ttagggggaaaaggaggccaacccttgagatttggggaacacttctagacctgttgtttttctgtgagttttgagctaaactgtggaagctccaaaggaggaaaagagttccaaaagatcgcacgtggcaggaagaagccaacctgagggagaaagagcggaggcctctagtcgttggccaaagaagccctcagaaccacacacgaccaacaagagcctccgcatgactcgagtgtgccccaagacataaacaagaaggcatcatggaagtgcagaggaacaaaccccggttatttctactccaccgatgagagcagcacggcctctctgtctctcccgccagtcctcctccttgtccctccactctccgtcttctggaccggaaccaagcctcccccctcctctggatcatgtgcacacagattatctgcctcttcatgggacactcacaggaaatttaaacattctcagaaggggttcttctaagcccacttcccctgccctctgccccaccccccacccagctgctgtgtattcaggaaatgcaaacccaatataaagataacccgggccaaacagaaaaggagactggccctgtgaccttgttgggcaaatgacttcccctccctgcatctcagactcagcttctgcagaatgaagaggctggacctgacgggctgcaagaagctcccactgcctgcaaccagcaagggctcagctgggggaacccttccagaccctgcctgtctcgggggacacccagcaa

SEQ ID NO: 61436 - DNA, 1900 bp, Bovine  19866881125410
ccgatgactctgccccccatggactgtggcccgccaggctcctctgtctagggaattttccaggcaagaatactggagtggattgccattcccttctccaggggatcttcccaacccagggatcaaactcaggtctcctgcactgtcggcagattctttaccatctgagccaccagctcaatagatggtaaatattgttattaaatgctcataaccggtagctcataacaatggccttcaaacttttccacctcacccccaataagatattataccatgactcggtacataaaatatcaacatatacatataaatatataaaactgaacaaatatttcataaataaaactgacccatacacatctgatccactcaagtctttttctccaattctatttcaacctttctattctatttcattttttaaaaactgctggtttagtcactagattgattgcacaacccactaatgggatgccaacagcaacttgagaaagactgatatatacactaagcccaaatacctcctcctgtagtttccacccctttccattctagctttaccttctggaaccacatggaactactgtgctcttcacgtgcttgttaaatgtccaagcacgagaaacatttcccattctcttgagcagccactgtgtgtgatctggcttcccaatccctcttcgtacccatctgctcctcctctggactccttcctccctctgcaagttttcctccttcagttaccactgcccaggatgccctgctcttttggcagcccttctgctcttctggtggcttctatgttgcctcaagtcaagcagcctgataagagcatcattttgaaccttcccaacagatgcactattcatcccagaggaactcagctctccttcagcccatccccaactcctctctgtaagctggttcgttcatacaaaggtgttccctccacctcctcttctgcctttccacaaacgagataaggatgcctcaaggcccaccgaccagaagagggaaagtgaggaagagtttcaatatgcacagttgagcttgaatctacaaacagaaagtgcccccttcttactcatttctgaactagctctgcctgcaaaccctggcaccaaactgagaaggcctcatcacccagtcacatctgtcccttcatggtgacagcagccttgtgacaaggaatctcacacctggctgcaaacacagcccttcgtgctgacatctcccagcaccaccttgcatatgcaggaaatgatacatatcagatacagccagtttcccatatcctatctgcatttgtagtcatcaaaaacatacacttctaatgataaaaaaaaaaaaaaaaaagaaatgcacacacttgcacctaatgtcactactttgatgggtaacatttcataatctggtctttaaaaagtttccaaagcaaaacctaaaaaaagcctactgtgccttcaaactgagagctggcttctcctggctcccctatctatcctgcaggtggggatctcatcacaaaaacatccacatgtctttcccacagaagagaacccatcaactcatatttatgggtttataatttaagtttgggcttccctaatggctcagacagtaaagaatctgcttgcaaggcagaagacctgggttggatccctgggttaggaagatcccctggaggagaatatagcaacacactccagtattcttgcctggagaatcccatggacagaggagcctggcgggctacagttcatggggtcacaaagagtcggacatgactgactgactatcacttatatatatctgtacccctaaataatgtattttaaatatttgttgagtttttaaaatatattccaaaagtatcataggtaggaatactcagggt

SEQ ID NO: 61437 - DNA, 1663 bp, Bovine  19866881205312
ttgtttgctgatgtgttgtcccacccagaagttacaaaggaaataaatgatttcaccttagtaggtcctgggcatgtagctgacttatttagaatgaaggctcggcatgtagctgacttatttagaatgaaggctccggaggccagaatcctgctttgagcccatgtggggattatgacagcatcttgactggttgtccagacttgactcctacttctgaccttagatggcccgccaagcccttgccagctgtctctcactgtagctctatgggtgactcggtgtgatccgtcttcaaggcttttctcctattgaggatgtcaggggtccctcccttccttttttgtaatgtaaaaggggatatttccaaaacaaaaaaaacatatctcgcatttgctaggcgttggtggctattcccctctgtggctcagtgctaaagaatctgcctgcaatgcaggagccacaagaggggtttgattcttgggtcagcaagacgccttggagggggcaaggcaacccactccagtatacttgcctggagaatcccacggtcagaggagcctggtaggctgcagtccatggggtcgcaaagagtctgaactgacaggactgaagtgacttagcattcaggcattggttatcgtgtgccctgggtcaataagatcttcattcttatgtattagctcgacttagtctaattggcaatgatgaattcaataaaaatgattgaatcctcactatatgcagaatactgggctaagcattagatcaagaattggcagtttttcttttttacttttatttttttttattttttaactttacaatattgtattggttttgccatatatcaacatgaatctgccacggtatacatgtgttccctatcctgaaccgtcctccctcctccctcctccctccccgtaccatccctctgggtcgtcccagtgcaccagccccaagcatccagtatcgtgcatcgaacctggactggcgactcgtttcatatatgatattatacatattttattgaagaattggcagtttttctataaaaagccagagagttaatatttcggctcggtgggccatgtctctgtccccagtactctactccacactgtagcataaaggcagccacagacaacacatagatgggtgagtgactgtgctccctgcggactgtactttcagaaccaggtggtgggacttagcagcagaccacagttgctgacccctggtctgacccttttgacccctttgttggagacacagctatgaacaaacctgacatcattataaccctcatggcgctttcattcccttgggaataattctttgctattgttaatagcattgctttggaaacacacctgttataaatagttgacaagtagctttggggggagcattggaagcctaagtaactttactgaagaaagtttccagtgaacactcagttctatttatattatctatgggtgtgtagtggggtctgggtgggggtgggggggtactgtgtgtccttaatttggtagacactatttttgagttgttcttttccccacttaacataattttgcatgcatatttctatgtattggtctagagtgtataattttagggctacatagtatttctgctaattaaggcgagtcatgtg

SEQ ID NO: 61438 - DNA, 632 bp, Bovine  19866881284213
cgggctgaaaggcgagccagggttaaacctcggcggcgccaggggggcgagagccggacagccccctggtccctcaaaggcgcagccggcctttcggtccatcctgggacgccagcctttccaggaggcttcacgagttcagggaaacgtgaaccaaagatggttgggtggcacagaccacctcgagccgggtagggggcatctctctcgttgaggtcccacaaaacagcgagtgctttttgctccggagaaagttaaaccatgcgtttttcactatgggaaaatcgttgcgcccgttcccccaaatcttcgggcagcacaaataaggtgctcccgctccccggaccttcgccactgtcccccacccccacccccactcgggcgccgggtgtggacagggcgggggaaggctatatgggagcttaaagcatgaggtcatgggcagagaaggctgctgccaaaagcggccgaggtttttgtatattttgaggggtaacggttctccatcttcagcagtgttgagttctcccgcataaccctataaattctggggcacctgggccagagagcccccgaaagaagagggggctctgcgctcttttcattctatgagcttttggccggtgccctac

SEQ ID NO: 61439 - DNA, 708 bp, Bovine  19866881949137
cattgttgacagtgggcagggcacagcccgtcctagcccaggcactttctgctcctccgggaggaagcagcccttccccttggggacccagcattgtgggggtgagggtgcagggtagggggcttctgactggcacaggcctacgagcgccacaagaccaggttggcaggaggcacgtcgaagcgcttgcgggtgtggtcggtgtcccggcggtacaggtagccgcaggtgggcttctgcaaggtgtagaaggggttcagggagttggagtactgggaggtgtagaaattgaacctgagcttttccgggttctgccctctggggtccaccaccacgggcacgtaggctgccgccagagtctgctcacggtcctgcttccacgacagggacaggggacggtgtggagccttcaccttttggcctgagggtgtcttcggcccatgactgggtactgaggatttctgtgagtcctgggaggaggaaagaaggggagagctggggactttgcgagggccaagggcaggaaggagggggcaggggcactgctgagaggcccacagagctacgcctggagcccagccctgctggccctggagctagacacttgcaggcaggagaaagccttcaaggtccccccaccggacctgcttctacagacttggtttgcttcttggagacctcgaccagctcagaggctggggaacccgg

SEQ ID NO: 61440 - DNA, 798 bp, Bovine  19866880350093
ttgggaagatcccctggagtaggaaatggcaactcactccagtattcttgactgggaaatcccatggacagtggaagttggctggttacagtccatggggttgcaaagagttgaacacgactgaacacacatgcatgcatgcatatatgtatacacacatatatgtatacacacacacatatatgttctccaagcttttttctcctctgcttctacactttaattttcttcccactttttgtgagaatttaaaaaatgccatggttggaagagagttttaactgcaaccccctcattccacagatgaccaagttgaggaggagggaagtattatgcagtgccttgcctagagacacagcgattcagcagaggtccagggacctgaatttttggctcgtggttcccaactcacctttccgttgggccacagatgtctttcaggggttgatttacatggtggtgtcaacctgtacactggaaaagttatttctaaatggatgctaattgcttcttggcctctctgttaattaatgaatgtttgggtttccaggcaaagaaaagcctctttgcacaattaacagaaataacctgattagagagacttctccaaatcgtgtgctaagtaagttaatcagaccatagaagaaataaagtcaaggacgcttggaagcatctgataatgtgccaaatttcagtgagaaaacaaaattaccaaattgtgttaggttatctacggacagtagttttttccagctcttaggttggtaaagactaagtgatcaggaaaacattcttatt

SEQ ID NO: 61441 - DNA, 2005 bp, Bovine  19866880401165
taggaggaaaaaaaaaaaaacaggaaaaggagaaaaaaggaagtctagttggcaggttttatgaacagatgtaattccttcaggcaaatctggtgaaagggaccagggcttcttcagggcctcccaaggagccccagggtctctgggtgcctcatccacatcaggcagtgatgccaagtcattcagataaagtgtctccccaagccaacagaagtttctgtgtttgagcctagactttgcatttttgccttgcaagaattctccctgtttatttcttttgacttggaagtgctttctccttaggctgaggcaaaaagaaaaaaaaaattactttttagtagtcaggagagacaggaagaggtttccctgtgcctttgtaactgagtggtttgaaaaaatctgtctcaaattgctttgatattcctcctgttgtgaggtggagtctctgtctgacccccttgacactgggaggtcttcacgactgatttggtaaatagaacagaattatgctgtgtgacttccaagcctaggttagacaatgccatgtggcttctctgatttctctttgggacagttgcttggggagtcttcagttattttgagacaacatggagagacattgtgtgttaaaggattaactctgcaagtccagttttccaaacactgaacactggaaagaaaggttgtatgtatgtatactcagccatgtctgctctttgtgaccccatggactgtagcccagcaggcttctctgtctataggagttcccaggcaagaatactgaagtaggttgccatttccttctccaggggaatcttccctacccagggactgaacctatggctcttgcatcttctgctttggtaggaggattcttagcaccaagccacctggaaaactcagaaagaaaggctgacatttgctaacctcctgggaggtaacctttaagcctttgggctttcctgcctgttaagaatatctttgctcactggagccttggactatgccagatagttaactctggtgatgtgatatatgctgcggaccttgggctgaagtatcaacttgaactctggagaggtaaggttagctatgcagatggtcacccatgctgacatgactgacccttaagaaaaataccagacatcgaggcttaggtgagctccccagattgacaatattgcatgtgtattgccaaacatcattgctggaattaagtgttgtttacatgactctgctgggaaaggacaactggaagcttatccctagtaccttctggagtctttcctatacacctttttccattgctaattttaatctgtagccttctgctgtaatagaccataattatgggtataacaattctgctaagttctgtgagtctttctaatggatccttgaatattacaaaatatagaagttggccaaacctctgaaattatttggtccaaacatctcccagacttctctggtggctcagtggtgaagaatctgcctgcaaagcatgagacacaggacacatggggtttgatccctgggttgggaagattccctggagtaggaagtgccaacccacttcagtattcttgcttgggaaatcccatgggcaaaagagcctggtgggctacagtccccaatggacgggaagagtcagacatgacttagtgactaaaacaacacatctcccagggaattaagctcaataatacatttgatagatgaggaaactgaaacttgaagacattaggtgacattttcgaactcataccaattattgcctcctcgtaagattgtattcaagcctctttagaaagtcttgcacaacacttttccaatggggcttttatagatttgtcatttcctttgacactttgttcaagtgatttggccaacggtgaagccaaatatacttgcagagtatcagtgtagctttgaggctagcacttcctcttattttgtggctcatgatgtcagcagatacaacagtgacatgctttttttttta

SEQ ID NO: 61442 - DNA, 1582 bp, Bovine  19866880404697
actagttatgtctgtatttgaagatactgcttttgggaaacaaggtttttttccctcaggcctgaatcatccatcattactggctctatactctgctaatctgaaaataaaacaaaacaactggtgtagagacaaaccagagtaggaaagggcgcacaatcagatggcaaagaaaaggtgaggcacactcaggcagagtcacacactggtcagtttttggtgccattgcattctgataacaaagatctacttccaaagaaaccactcttgatgataaaagagctccagtctgtggaaaagaaaaacactcttcaaacacttacaatggcttccttattatttggaaaatatatttctgcagtggccgagttctagcatcagcaaagaaagaatttattcagaagtacaaaaggatttagaattccttcaaggctcctttcattctgtttaagatgtgggtcatgtctttgaagcattgttgtctgtgggttgtcatggggtggttgacagaaatataagagcaattgctaccatatcgagggacccatacatcataaagatttggtttggatggatgtagcaataggatatgtatacaaaatattttgctgatgctagaccaaagatatcaatgaacaatttaaaaattcagctgcagtacaaagggcagtcaccttgccatgtgagcagcagtgcgtgagggccaggaaattaaaaggcttaaccacacacttgaaactgtccaagctactttattgcttaagtgaaatgaaatacaaacacaaatagccaagagggcaaaatttaaattaaacttcaaaatcattttgtgttttaaccatctacaatgttctcagtgctacaacgaagtctactttctttggaagcctagaaaaataatccaagacagaaagctcccctgacttcatcgtcttcctttacatgctctgtgcatgttcactttgaaataaaagtttaccaagatccaaaggaatgtgatggaactacctaggaagagtttagtttctaaaccatgatgaccattgccaatgatggccttctctaaaatgagaccttgtctgtagcaaggtttcaggccaagattgcctgaaatgctttcccttgttaggtgactgcattgagaattgccctgcaagacagatatctgcaagggaatcgttaggaatcttcttcactgtactctggctttcagttcagttcagtcactcagtcatgtctgactctttgtgaccacatggactgcagcacgccaggcatccctgtccatcaccaactcctggagttcacccaaactcatgtccattgagttggggatgccatcccaccatctcatcctctgtcgttcccttctgctcctgccctcaatctttcccagaatcagggtcttttccaatgagtcagttctttggatcaggtggccaaagtattggagtttcagcttcagcatcagtccttccaatgaacacccaggactgatttcctttaggatgggactggttggatctccttgcagtccaagggactctcaagagtcttttccaacaccacagttcaaaagcat

SEQ ID NO: 61443 - DNA, 2032 bp, Bovine  19866880506038
aatggtgtttcattaagaactatctgcccacttccttgtgcctgattcaaagtgtgccctgcttcttgctgtaaataacgtattcaccttaacaccaccatgtgtcagcaacctgctattgtttactgctgaaacctatggctggagagcattccatatgttcacatcgactttactctaacactcttgcttgcattaaaaggattcagtggcaaatggcatagctttcggtgttaaggactactgcattttaaatcatttccagatcacttcgcagcacatctgctaatgtcttttttagaaaaataagtgccccttggaaagatagtcttaaaaaagaaccacagagcagggagctccttgggcttgtagaggtcagacagatttttagaaaatagaagaagaacccaaaatcacttcagccccttaaatttttattttaacacaacttagagatatctggattttttcatctttaaaaataaggaaactgaagccagagagtttaaattacttattcaaggtcgacttcctaaccagctagggctggcaatcaagtggccacagttcacagttgtagaaacaattcagaatgaatcttagaggaaagtctgaacctaaaactgttcatccagacatgctctgaccttaacataaaatgaactctgatgcctgggacagggtacttctaaatttgaactttatctcttcatttacagattgggatttttatctccacatactctcataaaagtatcaaatacaccccaatccagaccctctttttgttcactaatcgtttgaaacttgcgactcctttgatgcattattgaatcactagactacatagactcctttgatctatgagtcaataagccttgaagtccagtcacccctctatttcgtgtcttcctcagcgcctagtgacacagaatcttgatattacagttggtatgcaactgtgtccatgtcactgtcgttgctactctgtggggtgaatacttgggatgagtgaacctccctctgcagtccatcaagttgttcaataaaatggaaatgagtgaaaactcaggtgatctgaggaatatggttccagtcacccagtgggctttgcctgggaatcagaagactggtaaataaaatgtctagagtctcctttgcactttgcccaccaaagctgtaagtttatgaacacggcctactgcttggtttgacgcgtccctcattcgctgttgggtgttgtgcctggttcagtgggtttttgctggtgccgcatgtatctacctcatgttcacagactgtttctgttaactaccacaggtttacaccctacgagtggtataacccccacccatgcaaccctgactcagacgtggtggaaaacaattttactttactaaatagtttctggtttggagttggagctctcatgcaacaaggtacaaggttgcccatctttgtcacacgcatcccacggtctgctgacaggcttttatgctggtaaactccaccaagaacatagcgggtaggctaaaaaccaactcagaagttaaaaaagatagaacctggcttcttagacatttctaaaaataaaaaagacaaaaatatgacagcaacagaactcctttgctacagatctaaaataaacttctatcaagcaacaaatataaattttcctagagggaaggaaaggataaattgccttagaaattgtttaccaactggcatagatggagatatctatcttttcctttttagtcataacctcacaagttacaatttgaaagggctaaaatttgaatcctttgaaaattaggttgatttacatccttccaatagatgacagtccctaaaactgtcacctaattaccactctgacaaaccctactgggattcatcttagcttcccagtaactttttacaatctccctctatgctatggttggtaaccatagcaacagtaaactggagatgttggaggaaataaaattcaaaccacagaaaatgtaatatattttgtacattttctatg

SEQ ID NO: 61444 - DNA, 1896 bp, Bovine  19866880663019
aaaaacagttttgttttgtttttttaatctgcccgtgcactttggaaagtattaggatatgactgcagaattctgagccacaaggaagaggtatgttcattttgaaaaaaatctaagcgtacatgtgactcattttgaccctactcaaatctgtgtgattcttctgaagtcaagaatgtctattttttttttaatagaatgaatttcattctaaggaaagattgtcctaccaggatacagctgagattgtgcttaggtcaaccacagaatgatttatgtccacactgtggataatcatcctccatcgaattatcagtcatacttgatgtgatactaaatatttggaatccattcaccatctgataggtattgcacagtccagtattggatttgaaatcttaagcacacatatgaagttttatctgcatctgatatgctgatagatgtaacttttaactggggttgggatctattttgactatccttactttgattcttctgggccttttgctcatatcacttatattcttctctttaaagaatgcacatggataatataactaatgcttttcatgcatctcttttgcttctgcaggagggatctttgaaactgtggaaaatgaacctgttaacgttgaagaattagcgttcaagtttgcagtcaccagcattaacagaaatcgaaccctgatgcctaacaccacattaacctacgatatccagaaaattaacctttttgatagtttcgaagcctcacggagaggtaactattttcacacttgtaaaagcttctttgggtgatgtttctgctcaagtcaccttctctttgctacctgcccttttgcacagcagacatctctgtgccaagggtttgctggcgatctcagcccagcatcatctgaaccctcctaatggacgttgcctagttctgttttctgggcctttctgatcagcttgcccttcagtgccctccactctatggttaactggttcagctgtgaatggaaaatgtcaagcttgatctgtttttccttcctgaggctgagataccaccatgaaattgtacagtgcagtcaaataaaactttgtggaaggtcatacctactgagcatgtggaaatgcccacaacacacagacttcacaacctgaattctaagcggccatgagccactgggtttacctagcatcctctcaaatattaccttattccctttccgcaagatcagagaaatgtgaagattatgaatattgaatcattatgttttacacctgaaactattataatattttatgtcaattatacctcaattttttaaaaagggaaaaataggaaaaaaaataatggaactgtgtaataaataaataaagcagggaaatttatgggatcaaagaaaatcttttgtgtctgaacagaagacaatttcctagaaaataatctaagttgcatgtaggctgcaaggtttgtctcatggaaagagtctttgatgtgggacttattacaaatcctccaaacacttccaagatgaccctttcaagccgcatttgacgtacttgaagatagactctaactagagagttgttgggtttccctacaggtgttcgtctgggaatatcaccccagaatacgaggggctctttctcttttagagaaagaaaattaacctttttgatagtttcgaagcctcacggagaggtaaatattttcacacttgtaaactagtgaaagacacagaatggggacttccctggcggtacagtgctgaagactttgccttccagtgcaaggagttcaggtttcatccttagttggggagctaagatttcacaagcctcacagtcaaaaagccaaaacacaaaacagaagcaatactggaacaaattcaataaagactaaaa

SEQ ID NO: 61445 - DNA, 1232 bp, Bovine  19866880708732
tggccccctggtagcccagggacatgtctccactcaagtgacggcttcatctgagagtctgggccagaaagtgggcacaatttccccgtattctgaatcccccaccacctatcaggctgtttgctttctcctaccccttgggagttttatcccagcgctgacaagtgagggacccttctcaggtatcccttggggtttaggctttcccatacctggttggatgtttctccttgaaagcagataccgaacactccaatcttccccacttggcccagtcatgtatactggatccagaaggctctgaacatttacaactccaagtaccttcttttttctcctttcaaacacctgactattgtaattaataacttcaaagacagcaatggcttctatagatccatacaagttcatttaagaactcaaagctgcaactttgactagtttttcccctgtgtcagccctaccctaagggcaatgcatatgaaagctctcgctttagaagtagaaaaaaagaggctgagatatagaagaactggaaaaagcacatagattagtatcaaaatgttctgcctcagtgctaacttcatatttcaaaactttctatgaaatcatcactaatgttaaagggaaataaacttccctatatcctgagacaggggtccccagtccctgggccacacagccgcatgtgagttgggggcaagcaagcgaaacttcgtctgtctcccgtatagcaggcggattctttaccagctgagccacaaggggagcccgtctgtatttacagccactccctaccttttgcattgccgcctgagcttcacctcctgtcagatcagcagtggtattagattagcatgaaccctactgtgaactacgcttgtgagggctctaggttgtgtgccctagaatcagtcctcgcccaatttttcttggaaaaaattgttttccatgaaaccagtctctggtgcaaaaatggctgagaatagctgccctaagagcttggggattgtggacagtcacaccaagtaaaaagagagaaagaagaaatgacatcacacactatacttacatttaatttaatggaaggaaaaaaaaattctaaataaaatccttaaataaaagtgaacccaagaaagatgatccgtgtgtgtttggtgccaagtaaccccgtgtcccccatggatgtatatattttagtttaaaggccctggataagaaacaaggagttc

SEQ ID NO: 61446 - DNA, 1726 bp, Bovine  19866880732553
actgtctaaacttcctgtaaggttctctattagaatttcttttgatgagtttctgtaaggcccagtcagccatactgcatctaaattcctttgaaatgccagaaacagtgtagaagtgttattcagtgacctcatataaccaacacatagtagcacatgttctgtaaagtaagtttactttttacagtgttctttgcttttttcaaacctctatggtataaaaattgacttgcttagtttatatgtcaagaagcatattttcagttgcattttaagtatcttttttttgttctctgctgctaaaatacatgtattttaagtcatccattcaacacatcattcagcgctagtgaaacaagttaacctgtcttagggattttctgagctgtgaaaaaatactaaaaatctagtccagggattgacagacttcctatagagcacttcctataattagtaaatgtctcagaggccttgcaagccacttcctctctgtcttaagtctccaactctgcctttcccttgtagaaagcagtcatagacaggatgtaaatacctgatcacatctgtgttccaataaaacttacgtaaaaagacaaagagcaggccagatttattctgcaaacagacccccctgataacttgggtgacttcccttaagtgccacagtttttcattaacaagtttgagacaaaacaggtcatcaagatccaagaacagtggtcctcagacaaagaggcttcgatagtaatatgtttattgcatcatccatttaagggtgcaagatacaaacacaaaacacttcttaatttaaggagaatatgaaaacatcaggcaattcctatagtactactacaaatacaaccttcacctacagtaaaatgaaaccatttagtcattttggtcttcatcccagtctttcttcccacttggaggcttgggcccacccgctggttttgccatgatgatctgcaaaacaaaattcacacgagtacacttacaaactcaagctttagaatgaagagaaagaatatttttctgagcctgctttgttattaagcaatcatcaccaatgagcaatctgttattacatcgcatatggaacactagagtaatgttggttatcatccagcaggtgagctttctgttttgtggacattaacagcaacaaaattcacattcattagcgggaggccttctaagacatgcatttcaacgacccaatgtgcggaatgtgagaaacatttgcatgcatcactgtcatcaatcagtttggcacctgatttgctatttatatatgagattcatcttgccaaccatctttatcccaatttccttgtggtttaggagctttaggtccacctgccagttttgccattataatctaaagtggttgataggtaaaatatatatacatattaaagttcaacaatggtatttcctagtaccctataagtacaagaattgtgttcataaacaaaagtcctagcacctagctgcctataaacttacacgccagaaggctcatttatctagaatgcactaacccaccatttcataagtatgaccatctagcgtttttaaaggatttatgtttgggcagaaaaaaggtgggtggttgcaggtttgggctcaaatgaatttggggagaagttaaagttagttggctttccacagagtagaacttctaaaaccctgagagagagagagatatatataaatgaattta

SEQ ID NO: 61447 - DNA, 1401 bp, Bovine  19866880747136
tctgcctgctctgcagagatattttagattctttctttctgggattctgagtgactcggagagtgtgtggagtgaggaatattaaatagtgatttgatgctgtgctgtagcactctgacttttcataatgcaatagatctacctgttgcctggatgcagatatttcagcttgaaattcctaatgtctgcttaaagatagccagtgtgacagcaatgtcatcaccaggaagcctcgtagaaagattaattcatggcctgtaccaatgatatgctgaagctgctctcctcacctgattccaattttagtaaaatgacagagaaaggggcaaatgtgcttagaatttatgtcaaaacttgcatctcgaagaattatactgaaatacagaggctcattttggttttatgttcatatacgccaagcttttacttgaatggaagatatagaatgattctcatactaaagacttctaattaagggattctttttatgactgagaacggatatcaggctacatcaacaagagggagatcttttaatggagaaagccctcaatcttgtaatgtaactggttgggtttatagtataactgtagagctacagtcaaaggttttcttgatttttctttgccagaagccaaattaaaaaaatgtccattttaagaagataaacataaattgtaagatgtaagcagacattatttctggatattcagtctatctaaattgtatgtatttgatggacataattccttgggattaaatactttgcaaaaagtaatttagaaaatgtcaaccacaaagcaaaaacactgacatgcacatttgtaacaagtcatagtaactaaaaatttttgtatggtttttccttagtttgtctaactttataaatcaattcagttcagcaaatggtttgtaagcttctgtctagtgagaacataagcccaaaagcagtgatgagctttatttttccctctaaaaggacaagaaagtgtatacttcaaaacacaaattcaaaagcctctctagagctaacagtgattaggagattaactgtttttcatttctatctcactaactttgaatgcaaaccactaaggtgataacagaaagtcattttccatcttagctcactgacgtagagtgaccaagttcatggtctcaggctatgaggatgggaagtcaaagcgaatcggcacacttatttaaccaagatttgtcttggggaatcacatccaagatgtatttagtggctttatgaattggaagcagaaatggattcaaaggtatggggaagatgaatatagttgagaatgcaatccccgtgacagtgcacctgtgcactgcagggagttattttttaaatttttttaatgttttaccaccatgctgtgtaaaagattg

SEQ ID NO: 61448 - DNA, 1145 bp, Bovine  19866880819977
aagatccaaataggtttttccaaaaggatttgttttaatgaacatccttttgaactcaagtaattgaagaatgatttgttttcgcttacctgctgaactcctggcttatggtcactgatgtgatagctttctgttctgggcttgcactggtgtggactgtgactctgtaacttctcatggccaccacagacactgattgtccttcattgttggtttcttggggggggtctgatagacactgttgtaagtaattgaaattgcaggtgtttttcacatctcgtacttaaatccacaaatatataaaaaaatgaaaattaagagaacacgtccagagctgccatggttgggttaaatctttctctgagtatcatgctcttttcatgaaatgaaatatctgtatttcagaaatacctgacctgaaataggtctcctgcattctgaaatagaaacagcacttaatttcaaattatgaatgttggatgaaatcccctattcgattgtgtgtcattcacgagaggagggtggaggtgtcacttacctttatttttatttgtctttttgctcaggtaaactgttatctgatagggtatttaatgtttaccccgggtgttcagattggttgtagcataactacagcagttaagttccttgctttattttcagtcttcaggtgcttttgtctgctgttgatgatttgctaaatgcgcttctagagagtaaagatgctaatctcctaggaacttatattggaagcgtaatgccagacaacagtgaatgggaaaaaatgagacagtctcttcccgtacaggtatgtttgatattggagagtgctcatatcattcctgaagtttgtatttcatgcaggcttaaatattttaattttattctgggaaagagaaaatgtaaatgaaatgtgtatcttactttccctttctgcctttgaatgctcatatattggatatttgatctttacaagacagcagttgacacgacagttgacagcgaataggatatagttctgtcctgaaggtaccctaaaatacacatgttgataatttctgctagtagaaactgaatttctaggcttctgtgcttttactagtaaactacccacagcttcctttttgaaattattctaagaacat

SEQ ID NO: 61449 - DNA, 2971 bp, Bovine  19866880852350
tcatctatcacagctgcttctaaacggttccctcaacatcaagtcagaacttgagagaaaaggtctacattcatcttggtttagaaacttgggtttctaaagctcaaaatgttttaagatttgtagccctttacttgaaatgctttcaactcgcaaacacattattattcaattaataaagcctgggcacttacactatgaaggtcagagccagagaatcccaacaaaacatttgagcagtaggctattacctggcaaatgtgttttttctttgctctcagcacataactgaaagagagttaataataaatcttcagatgatggcattagcaagcatcctttcgctgagctgaaatagttataggccacatcacagataaaagacactgatgagtcattattttcagcttctgacaatttctttgctttggataaagtttcatgaagtttaacaataattctttcaacataaacttctccaatcaagtaatctagagaaaaaaattcagacagacaaaataaataatatgaacagtgaattttctttttttcaactttcgtttttcatttttcaatcggtgtattttaatactttactttgggttaacattccaccttgtctttccatgtgttttttaaaaaacacatcgttgttttaaaaaacaaggtgtttatgtattagatagaataaaagtacatcaataaatcaatctgttccatcacacataaaagccttcacataaaagttttaaattaaggcaaaaagacaaaattagagtgaacggttaaattcaaatccctttaaaatataaaagtaaaagcattaaacatctcaaatcatgttacaaaggagaaagggacgtcagaggacagatggttggatggcatccctgactcaacggacatgagcttgagcaaactcctgcagatggggaaggacagggaagcctggcgtgctgcagtccacagggtgcaaagagccgggcacaactgagcgactgaacaacaacagggtgtttacaagattaaggtatctgaatgaactaaatcctgctgttctcaactaatactatgctaactaaaaacatggaatcccccaaaaaaggtgaaaaagaatgactcccttcctactgaaaaaacaagccatactttacctaccgtttttaacatgttgggataacaccatgcttaaaagagtccatctttctgagaagtaaggttcagaagatactgtggattccaagtctttgttacaaagatgctctgccaaggttaccaatttctctccaaggatatctcctttgagccaaggtgttactaaagcatgattatctgaactagagcatgcctaaaaccataaaaattgtaccaaagattaggataaagattaaaaaaacaaagtgtacctgcccaaaatattacctgcaacttagtacctcccttcatcagcatggccccaactttatcccccactcctcctcctcaagtgcttaacaaagctggtatcttccctactccccactaagtctcgcttatgtacacttccatgctttgttcatgctagcttctcaaccataaatattccctctctcttttatttatcaaaattacatccattactatattcagtataaatcccacctgctttgtgaagtctcccataacagcccatactcatcattgcttttctctgaatttctagagcaaataatgtttcatgtgtgtatgtcttgtttccaatgaaactgtaagttccttgagagcagagactgtcttaaacttctttgatacctgctatcaacactgtagatatgttcaacgaatagtgaatggatgaactttaaagacagattttaaaatgctttacaaatattaaactgttgttcattaattttgttaaaattaaagaataattaacatataatagcggcaaattacttcaatatgaacaatgggacttattatttgcccaaattttatgaaatagttactgaggccagatatctgacagcaactggtttattttcagggggtgaggaaggcaaggaaaaaaactgtaaatccacccccaaaagcatggtgatccatgttcccagagcttcttttggtataagggctgagaagaaaggaatttgcaacctggttcatttcaaagcaatctggaaaaaaaaaatccaaatgcagattgggtagtgtctgaaaaattattttatctccttatttaaaatattgtaggtaacaagagcttttattttagcccaagctttatcactattctggctttatgaccttatacaaagctcttgacctatttcttaatttaaagccggacctatttcttaatttaaaaaataaacattaacttagaaaatctctaaggtcctttccagttacaaaattcaggtttgtttttaaagaagctggctttaggattctgctcataacgtatgagattgcataaaaacataagaaaaactagaatttagatgggtattaatattggctttcctaagatagcttaccaaataaaaccaatctatagaattctatagaatccagaaagtaaaatcctgaataaaaagtctctcaggttatcaagacatgaagtccaacttctcaatgttttaacactttcacagaaagaatctgaccagaggatagggaagctagtcaggcatggaagtacagaggctaacactggctatgaactcccaaaccctgcccaagccttccaaacagagacatctgaactatgtggcaggtacctccctaatgttggaaacaagatgtatcaatcttctcttatcaaattattaactacttttgctctgattttagacttatccagaagctttatcataatttggtttttcatgtcgcctacctatagggaaagagataatggataaagtaattcaaatggtgtgcctaataaattagatttctcattgaaaaagagtaaatcaacact

SEQ ID NO: 61450 - DNA, 743 bp, Bovine  19866880967779
aaatctaaaggcaaaatttctctttgtcattttcgttttttcattcatttgacaattcccgcccccccaatcttatttacattgcttatcatctatataacacagaatcatttaagagttttctctcttcaaatatatttgcaatgttcttgtgattagcagtaatgaaaagtttatagcgcattaaaaatgagcacagaggttctgttagtattaaaatgaaggtacttgaatgcaagaaaaatgtaacccacattatactctgtaattactctgctaaagactttgctgtttgtgagccatccagtttgtgtagacatgagaagaatgtggttacgggtgactgaaggtccaatctctagtcaccggtgttggtatctcggtcactctggtgcctgagttgggatgtgttattaactcggtacaaacaaggaactaagagggatctgaaattcagttccacagaagtttactatttatttaccaagtgcaaggcagagtagccacaataggaaccccaaagtgaatgactcaatgccagccttccaccccttgaggagcggctgtcttcccagagggtatatcgagggcgttagtgagaaatgaaattgggaagttccactgggccctgtttgtggggagggtttcgacaaaacaaacactttcaaaagggagtgaatgatcagggctggatttgaagataatgaatatgggtgcagggcacagactgcgtggaactagag

SEQ ID NO: 61451 - DNA, 1310 bp, Bovine  19866881050965
acagtggtaaagaatccatctgccaattcgggagacacaggagacgcagttttaatccctgggtggggaagatcccctggaagaggaaatggcaacctgctccagtattcttgtctggaaaatctcatggacagaggaagcctggtgggctacagtgcatggggtggcaaacagtcagatactactgagcacctgagtgcaaggaacacccacgaactccttttagtctaaggcccttgcactgatcacaatctacacagcacaggaggcagtcctgaagcgcaacctctggtggggagtctggaatcgcgagacttggagtcggatctcgcctgccactagttcgccttcagactcagctctgagcaggattttgctctacggttgagggtaactggatgacccagttctggggaagtctgaggacttctagggagaatttcctgccctcaccactctcacctaactttggtagttgtcatatggggatgtgatctatagagttgtagcagccatcttgagactatgaggaaataaagttataaaaacaataaggggacatccctggcagtccagtggttaagactttgcatttccactgcaacaggcatgggtttgatccctggttgaggagctaagactctgtatactgaaagacactgccaaaaaataaaaacaataggaaagctaatagaaagccctgactttactgagaagctaaactaattctgcttctggacttcttgttatttgagagaataaatgtccattggttaagccatttttgttgagtgttctattaacggctaatgaaaatgtctgataaggaaactatggcttgccaagcactgtactaggccttcataatattcataacaagttaagcggtatggactgctcttttcgttctttttgaatttgaattccagaacacaatgtgtttgcccaacaacattggatttctgttgccccttagtcgatggtattttgttatggcagcttcagctaagacatttatttatttactcctttcggccatgatgagtggcttgcaggatcttggttcctggaccagggacagaacccgggcttcatcagagaaagctcccagttccaaccactggaccaccagggaattccccaagacacctattttaaggcctttgataccaactgccaaattatcctccagaaacattgtagtagtaggcacccccatcagtagcatataaaaatatacattccttgttcttataccaatagacatagccatacgtgcatgtttgctgctggctgctgctaagtcgctt

SEQ ID NO: 61452 - DNA, 1601 bp, Bovine  19866881300728
ccctttgcaaggtgctctgccacctctcgctccacgctgctcagatcacttgcagcaaggccactctccttcctggggccggagtctgatttcacatctggactctcaccgaaagccttctcttctcgcacatcggaacccgacgaaggcttttccgttaacactgtcgtgttctgcgtgccagcaaaattcaagtcaccgtactggtcgtacgtgtgtaagacagacagagagtagaacctgtgggggtctgcagaattgggggggcaggggagttgtttctgtttttccagatgagccctgggaagcgagatctttcttcttggcttcttcatgttccatcgctgactttctttcttcacattttaaaatcacctgcaagtctgcacagtcctggattcctcctagacactcattttccgacggctcgtgaggctgaacagaagcagcctgaatgtctttgacgctggactccacagttcggactctgtcagttccaaacgctttctggaattttcggtatttggggcataaagacggcagagccagggcagcatccttttctaagcacatggattcacatgtttggctggcactgtcctgcagaggaggagtcgcttttgcactgccttgatacctacgcagtttacagtgaggggtttggacatttttgttgtccagaaattcctcctcctcatcaatttctaaatccttctggtccaaaagagaaaacttaaaatctggtttctggcaaggcgaggagaagcatttttttctggggcattcctgctggtctgcagtggagtccagaaacttgtatttgagaaactgaaagcaggattcctcaatatcaggtacacctaaaaattccacacacttgtacacctcatccacattgtccttactgagtatcagtttagcagtgtaggcaaactgaattaaaggttcaaatcctttaactgtcacctgttaatatacaaaacaaaaacaaacacatcacataaaaagctgtctagcagataaggacgagagaagtagcagggtggcaagatgaaaacctcttagtgatacttataaaacagggattttaatttggtgagaaaaaaatattcctctcagaaatgtaaagctaagggaatctagcaaagcttgcttctcacatcctgttcactgggaccacaccctccactttatagatatccactcatgatgatccgtggagtatgatttactcatatgagataaagatataaacattaccacaactttctgcattagtggaaagaaggcatctatggaataaagcaacatggataaacgttcaacaccctgtttcgagtgctggggtctgctgccatcctagatctgcgtggttaccatattccaaacaactcctcaaccgtgataaactcctaaagtggaatattcaatgctggagaacagtatagctaaagcaatgaaagtattcctaaccacggtggacagtaaatggctacctatcaattatcttagagtttctaataaaatttttaaagattcagatttacaaagtgatcctacgtgaagacctaaaacttgtgcctagtacagtctcagcaaag

SEQ ID NO: 61453 - DNA, 770 bp, Bovine  19866881389605
tggatactgcaataccttacctgttgacttgactgctttcatttctcctaccaggtggtaacttctttgagggcagtcacctgtctttaaattcccggtatctctcatgatgcctggaagaagtgggtatttcataaatatagatgagtgaataaataaaaggaggagacaacacagaaattcatctgaggctcttttcccctttattcatgtgacttgataagaatctaatattgtcagtggcaggagacacagaaagggggtggattcaagaaacatttaagtaagaacaatgacaagtcttggagttagagatttaattggaagcaagaagagcttgtctagaatgacctttagatttagaattcggttaactcagtggatgatggtaatattcactgagtgaacatccaggagtaggttagaagcagaagataaagaatttacattcagatggatcaaatttaaggatcctgtggatcaaatgaagggatctctaggaggcaggtggatggagcgattttggtgtcttttaagtcagaacccactgcaccttcctctatggaatgctttaaaaaaaagccaaaccaaccaactactaactagaatgtcagctaccagctattagaatgttaacacaatttatatatatatttgacgttttagtggttataaagtcaattcttgaccatttgtctgaaatgttcataaacccatctttgtttcgggaaatgatactcatccatgagggcccaggttgaacagcagcc

SEQ ID NO: 61454 - DNA, 903 bp, Bovine  19866881475620
accaagatggaggtggagaatgggataaaaatattacagagataagagaattctcccagaggcagaataagatgagagttaacaaagatttaggcaaagagaaaggtgtgtgtgtgtgtgtgtgtgttttcttttcttatgagttttgatgaggcagaaattccctcctctattcttttgttcagcatccttctggggatgatcagagcattctacttcatttctctatgtcatcaaagagcagatttaaattttatctttgggagagacagctattggttatataactggctatgcattgtaactttaacctcataatattcttatttttcctactactgaaaagggttactggaaaggtattattgcacacacccagccaaacaaaaagcagtggtaaaagaactaagttgtcacactgctttccaaccttgcacttccccatatgctgtccccctgctcagaatatttttttcctcatcaacacttctcatatagatttaaactctctctctctgtatacatataattattttcttttactctggggaaattctggaccttcttacaccttgtcagtttctcccattaaatgatctcataaaccatgaccctctccttcataatttttccactttacaattaaatatttacttctgtgatcagtgtatttgtgtccatatgccttttctacactgcaagccccatgaagactgatcgtctattgtagtcattaatgtctatacccagtggtctgccttggagagtcactgagtcgggggaacaatggagattgagatgatcagatggtgtcactgaatctttggacatgaatttgagcaaactctgggagacagtgaaggacagggaagcctggtgggttgcagtccatgggggttgcgg

SEQ ID NO: 61455 - DNA, 724 bp, Bovine  19866881604132
aaatctttactgccttaaataccttttctttagtctcttttgttggaaagatggaaaatagtcaccttctgctctctaaatgatagcatttatgatttcagtgactagagaaattttggccaattttgtcttattgtacacaaagcaaaaatagtggacatgtgggaaaaacattttgatttattggctgttggatctcaacttatatagtaaggatcatctttactttctatcagcaactgtttgcatggacatcttaagtgaagtagctcagtcgtgtccgactctttgcaaccctatggactgtagcctaccaggctcctccgtccatgggattttccaggcaagagtactggagtgggttgctatttccttctccaggggatcctcctgacccaggaatcgaacctgggtctctcctaattaggactgggttaggcaaatttcctccaagggtaaggttgtatcaatgaacctctttgcagggcagcagtgggaatgcagacataaacagacttgtggacacagtgaaggaaggagcgggtggggcgaattgagaaagtagcattgaaacatatccattaccatgtataaaatagacagccagtgagaatttgctgtatgatgcagggagctcagacttggtgctctgtaataacctagagtggatgggatggcgtgggaggtgggaagaaggttcaagagggaggggacatatgtatac

SEQ ID NO: 61456 - DNA, 863 bp, Bovine  19866881956440
gtacagttttgtcatatcctcgtaagcatttggtattatcactattttttatttgagtacttctgttaaaggtatagtggcatctcatcatggtcttataaatattcttttaaaatatgatttttagtagttggggttgtcttcctgcagcatatatttgagatcttaatagatgattgtttttctatatcatcgtaaccaataacaattattgtctattcaatgatatttcctcaaaaattctattctcactgttttattgagctattacctggccagataaaacaggttgtctctttctttagatcaaatatttatacattgcctttgtgttaactactgtctcataggcttgcagggagagagagagagagagaaagaaagacagagaaagagagaggcagagaatcaatgtatctgatttaaaatgaatacatttgatgctgtggcttgaacccaggttgtgagttgtgttgatttttggcctggtgtatatcatcaggaggcatttgaagtccctgttatctgatcaacataaaccttcctcactgccttgcgcaatgaatttctgtaatcaccagaacttggctgaggagttgcctttgtccttcaagaggccacagtttcttgtctgaacttccttttgttgccaattggggagggcttcagagaggaggaacatgaaggcaggggtgcatgaggaggtgggtttatgtgggtgatgaatgcagtttcataaaatgagttttgctaggagaacaaagtgctcctgcctttgtgggaagacaagattgaagaagaagctctccttaatgcattaggcaagagcaggtcgatggatgtacctgccaaactcctttcct

SEQ ID NO: 61457 - DNA, 1503 bp, Bovine  19866880166042
acccttgcctggaaaatcccatggatggaggagcctggtaggctgcagtccatggtgttgctaagagtcagacatgactgagtgacttcactttcacttttcactttcatgcattggagaaggaaatggcaacccactccagtgttcttgcctggagaatcccagggatgggggagcctagtgggctgctgtctatggggtcacacagagtcggatacgactgaagcgacttagagcagcagcagcagcagtcagttgattaaaatagattattatcatggtgatagtatctataattaggtataatcagaatccctgtagtcaagtgagatattttctatagagatgcaacaaatccaaaattttctccttggtcaaaagtttcattatcctatctgaaactaatataaatcccagagttgtgacttaattcaacagatattccctgggcacctactctgggccagacacagcaggggtgcagcaatgagcaagaccctcctcccctgactccagctctcagggagcttgtgactagtacatcctgggtgaacccacagcagatgacatgggacacttcattgttccatcactcagggtcctaccatgcccacggtgaaaaatgtaaggccagtgacacatggtacttttattagaaaagaaatagatggcaagattatttatttgcactcaagggagaattttcatgaagaattcatggtaagagatgaaagaggtaagatttaaatagaagaaatgactaaggcgcttagagaagaaggagattagagggaaaaaaggcagagcaagaattaggtacttatattttttcctccttgtcatacaggagagtatctgggagccacacttttaaaagttttcatttgaaaaatgggagggaggatcagaataaagcagatggggaggtttccagagaaatgaggtcaaggataaaagttgaaataagacattaaatgtctaaagctaatgtgggagtaaaaaaatagatcatctatattcccatgtacctagaatgcaggtatagacagctgtcaatactcatgtttctttatgattcttttccactttttctaaacaaattttcttcttaacttcatcagtgggccacagcacatttaaacagttcttcatgacttttcccctattgtttcccaagacagcagtgaacaaaacagtattgtaatatggcctcaaaacttcctcagatcaacatctaccaacctaatgcaagcattccatctcagatagctccttagtttcctgaactgcattatgtagcttggctttcatttcatttcattggcacagaatgctgtgtaagatcaattctgtaattaacatacggtagtaactctaagaataataatcgtcagaagaacactgacatgtgtcacagttttcagatgggaaggcttgagatactttttgagactccaggttcctgctgttagcctgaatttattcatgaggaggcttaataga

SEQ ID NO: 61458 - DNA, 1082 bp, Bovine  19866880452704
taatttaaattctattatgtataataatatatgaactttaagttcaaaaatattttaatttgttttattcaagctcctaatccataagccacaacagcttcctcaacatacagtttgaagagttttaccaaagattgcatttgatcactgagacccatttactcttccttcaactgtcttttcaggaaaaaaaaaaaaagtacatcaagtactaggaaatcttaggaatttgctaagatctaagttgcttccagagatttccaacagaaatgagccactaaagcataatagttaacagattcctactcttttcggggaatggggatggggaaaagaggcataggattaaaatcacattttaattaaatcatttgatttcatttcctgttaacaaccaaaaaagaaatacttattgcatgtttatctctgtgctagaagccacggagataaaatgaaaagtacagttctcttttgcaaggtatttatagtccagagagaggaacgtgcaccctacttaacaaaaggactaacaatcttaatacatctgtgagactttctctgattaacctattttattttagcgctgattttattcattctacaaactccacaaactccctggggctcctaatgaagcaatgtaagtctaaataagtagactactgtgctcaaataggatgggagatgctctgaatcttgccagagcccaagtactcactgcagagcggagtatgaccagaaagaggtctgaacataatcccttctagatctgttgtcttctgggactactgtgtcttctaagagctgttgaagtcaagaggttaaacattttattctctaatttgcactgaggaagcaaaatcctgagcacaccttagtttcttatttacaggtatcagaaggtaggggaaaaacttctctggtgtccagtggcttagactctcagcttccactgcagggggcacagggtccatccctgttcaggggattaaagtcccacaaggaagcacacagccaaaaaaaaattagataagaaggaaagggaaatgcagcattagactgtcagaatttctagcaataca

SEQ ID NO: 61459 - DNA, 1108 bp, Bovine  19866880484070
ccccccacccccaccctgttattcttttgggcacagaccggccactccagatggtgtgttagttaatgctggacatagctttggagaaacttccaacagacgaagccggtgatgtcaggattttgctgtgcgtcgtcccccttcccccctgcggttcccagggtaggaaggtgctgagatggaagccgagggacgcccggcccacctgccaccacctgttccctccttcagccttctgctataaattctcctccttcaaagattgatccagcactctcccacagctactgcggaagaagcgctcctttcctatctgagcttcggaaaagattttgtcttccagaagtctccggttttcccagagacctttctcgaaccagccacaccaattctgctgcaggaaagttcccttctcttttgcaacttaacactgggaaaatgactttctcttttacctctcaatttcctctaaattttggcaagtgaagagacatctatctggttatccaataggacacaaggcggaaccccggactccccactgcaaacttccattccacgtagttgctttgtgtatgacttatttgctaggaagagccaaactgcagagcgggttcatacagcagccacgcacaactcgtgaaaggacccgagagctcggcgcctccctcctgccggcggggaatgaagtcctgcaagccctgcaacacggcggcgggagcgcgtgccgcgcccccttgcgcgggtggagccgagtgcgcgggcacgtgctccggggccgggcgactggagagcgcggcgcgcaggcgcctagcggcaaacgcgcgcgagcgccgccgcatgcaggggctcaacacggccttcgaccgcttgcgcagggtggtgccccagtggggccaggataaaaagttgtccaagtacgagaccctgcagatggcgctaagctacatcatggctctgacccgcatcctggccgaggctgaacgattcggctcggagcgggactgggtcaatctccactgtgagcacttcggccgagaccactaccttccgtttgcgggcgcgaagctgccggcagagaccgagccctacgtgccaaaggctcttc

SEQ ID NO: 61460 - DNA, 1871 bp, Bovine  19866880891956
cgcagattctttgctcagcgctcaacttttgcacacaagatgccctacataagtgcttgatgactcctggtgtatggttgtcattccaatcactctgattcctaggcctttgtaccctgaccagggcttttcatgagtgacttaggggtgaattaattttacaggccatcccagggactaatgaagaaaaatacaaagtcttcccacccagtgagtgatgattacatccgtgaaaccaagaatgcggtgattctagacttgggaaaaaagatgaatttcagtgatgtcagatcaaaccagcaggtaagactgttgggttcagatgatttattggaatttcattgtaaggaatgtaagtttgcttaattcagtccttaggtcacctgacctcagtgaaactgacactgcagctttggaaggcagagtccagactgaccatggtttgtgcaggaaacttgtccacatggacccacagttcttgattagcccaatagctaattcagtttacttgtttacatgcgtttacctagaatagagtcggttgagagggactagatagtctgctttccattccagcaatcctctgctcagtattggcaaacaccatcacatctttgagacatttcaatatctgagccttgaggtgatctggacttgaaggaactctggagttccaagctgtctcttatctgattccttcaaccctaatgtgcctggggattgctcaccagttcctctcaatctttacattaggttaaagtttgtgtgaaacagccattagccaatatcctgtggttcaacctgtacaaccccctgctttctagtttacactgaaggagaaaaaggaaagtcatatgcaagcattataggaaagaaacactattttatttgaactagtttttctttttcgtctgtgccacatagcatgcaggatcttagttccctgatcgaggatcaaacccatgccccctacagtggaagcatggagtttaaaccactagatcaccagggaagtcctgagccatttacctttgctttctgtacggtggttattttttaaatgcagatatatattttaataatttaactcttggtttatttcctcaggtaggaactgattaaaattgattttcaaatagaacataaaattttagtgaaaactgtatgtcaaatattgtgcagtctgtgatataagtgaccctggaaacaagatctgacactcccctgaccatatgctgctttccttcatgtttttaaatcttacttccagtggagccactgatatacagtattttactagtgtgttatatgttgggaaattcttactgagtggattcttttgaatatagtgtctacagtactcaaaattggaacttccctggtggtccaatggttaagactttgccttccaatgcagggggtgtgagttcaatccctggtaggggagattcacatgcctcagggccaagaaaccaaaacatgaaacaggcaatattgcaacaaattcaataaagactttaaaaatggttcacatcaagtaataccttttttaaaatgctcaaaataatgctttaaaatgttttttaaaattgactttaaattattgacttgaagcaattggaaatattgaagcttgccataatcaagtacacttttcatatatcatttcatcaaattcatacatatctgggaggcaaataccaaggcaactatgcttcttttccatcttctagatagagaaactgaggcccagttgtcaacctgtcaggtcagtggtagaacaggaaccagaggcctggtttccaagacattcacacattttccctgaacctctgcagtcttctgcagtttacaacaattacctccaaacc

SEQ ID NO: 61461 - DNA, 766 bp, Bovine  19866880917222
aaaaatagataatgtaaaaatgaattccagcacagaaaatgggaacttacagaaaatatgatgagtgatagataaatactataattgggaataattcacatgacataaagtaaatcactgatctagttctttgtgaaacaacaacacagaaaatcttggcctcctccaggattctgttgtctgtctttgaccagttcaacaactctgtacttcacctatgatcaaagaacactgttgcccaccgagtcctattttggtatctctaatctttcctttttggctctgctcttatccagtctttaaatgtcacttgggaatactctttccttattgttcttccacctggttttacaaatttcctaggacaggctcctccctttattccaacaaggtaggaggtaaggagaaaaaaaaaaaacagcaacaaggttagaaaaaaaacagcacctacataccccagaaagccctaattcaacaaggtaaaaaggggtggttcagatgaacagcttggatgaggatggatacaagaataggtttatcgctctcttaatcgttagattcctggaggtatctctttactaggtgatattaaatcattcaatttctgcccattcccttaagaaatcacttgctttacctcccaaagtgagttctgaagaagcaccttacctggcacaaactgtcgtggatctctacaggctaaagagggttccactggggctcctggtccttcacctcacttgttgagtgcagggaaatctgctgt

SEQ ID NO: 61462 - DNA, 1238 bp, Bovine  19866881054524
ccccctgcagtggaagcgcagagtcttaaccgttggaacaccagggaatctgatttgtgaagttttaaaaaataattcctaatggaagactttttcccccacctcaaaagttgtaagtatctcatactacttccctgtttcagttgtatcaattgtcctcagaaacaataatgaaacatgatttccactcttgctaatgaggagctgatttgtagagaaattgctaacttgattctcttatctcagcttctttctagctcttaaggaagagtcaagtggcaaataaaccagtttcaaatagattcaagccagaatcatttctgaattctttaggaagaccaagtatgttctttctccttttgagatatggattatgttggcattattctcatttatttttgtttaatcaaattattaacaagttcccacaaatcaggagtcttttaactgtgtcttctcttaccattgcttgagactaaaacccctttgtgactgccctgactccaagtcctgtcttcccataaatagttgattaatccccagctgaagcaatgacaatgaaatgaagctgagtaacatgaagacaatagaattcaattgaacattaatgatctgcaacatgacagatgttgaacacagacttttccatggagccactcagctctattactctgattcttaacagtcttggtcaggaatagcactcctatgacaggaaagactgtgtttagtcatcaaaatgtcgaatacaattctcggagttttcatggaaatcagcctgactaatgctattatttctcatgttcatttatctcatccttcccccaaggagcctcctctatgctactcttaggaacttttcccttaaaaaacactgttttggacactactgaccaaaacgttaatgagatgtatgattttgcaggccatgtattcagggttggtgatataattgcctgtgcaccaagagaattgtaaacacaatttgaagagaaaaaggaagtctggcagcatgcacacagctcagctatgctggaatataaactaacagatacgtgacgtgaaattgatccaataacagcattgctgcaacaaagggcagtaggaagtatacagtcatttatttctcaaatgtattttgaaggacaatttattagtactacaaagatgcttctggggaaaaaattctgctgtcagtaaatttgggaaacacatttgccataacctacttagagagt

SEQ ID NO: 61463 - DNA, 1466 bp, Bovine  19866881134243
aaccaaaaatttaaagtactaaacaagtccatctgcacgcaaaattttcaagaaggaagtaatactcaattcttccaggaacacagatgttaaaagaaagtgaccaatataaagccagaaggaacttttttgcaaacccaatctctaaagtggctatatttaatattttaagaactgcatattcttatatgtatatttttatatatttaaaatatataacaaatttaaatgagatctcctaaaatatccactattatagaaattccagacatttaaacttctgtatataaaccattcagtaaatgatatttaatgaaatatttatttaaataaaaacttctaaagtacaggttcctctaccaaggagttgagagattttgtctttgtgtagacaaaacatttttcttacttggctatctctacaggaaatcttccagaggggtagctgagccatttttgaattaaagcttcattcacagtccagatctgcttcgaaggatcaggatatctaaagtcatctggtggcccacagttctaaagtttaaaataagtagatgagtttgagggaagaggattatatacaaagcattctgcatctggaagttaatctctactaaacacctgaaaacaaaactggaaaaacaaactgaaaacaaaaacctgtcaaatagatccgaaaatatttgtagacttgaagaacaaaattaaggccatactttgtaacatataaagaatactaatatgaaattatctgatcttattaattattcatatgatttctattacctggggattagaataatgtgaaaagctttgatctccacctgagaaaattcttttcacgcagaaatattcttcagaatctgtaattaaaataaaatatttaaaaattcaagatttatatatatatattttttatagcatcaaatatgctactggactttctcttaatctctaacttaatgagacctcccaatcctgggctcaatgacacaaaatgactcagaatgttgaccaaccaagttaatggaacattaaatgatcccacaagcacttccagcatttgctaagctttttggttgcttttttacgtttctaagttttgttttggtttgttttttcaattggaggataaattgctttataatgttttattggtttttgttgtacagtcttctttttgatctgcatgtcaaacaacgacattttttaatctagatctttattatctcaatatattttaaactgatgatggtgtaaaaactgaatcaaaggtataaaagatagctcagaagaaaataaaaagtaagaatattcattttggggaattccctggtgtggtcaggactcagcattctcattgctgtggcccagagttcaatccctggttgggtaactaagatcctgcaagctgtgtgggacgtggccaaaaaaaaaaaaaggaacattcattttaaaaagaatga

SEQ ID NO: 61464 - DNA, 729 bp, Bovine  19866881202805
acctttctgttcctctagggatatctgaccggttatagcatatgtggtaattttttcaatttgaataatttatgacttccctggtggctcagacagtaaagcatctgcctgcaatgtgggagactggtgttcaattcctgggttgagaagatcccctggagaaggaaatggcaatccactccagcactcttgcctggaaaatcccatggacagaggatcctgataggctatagtccatggggtcgcaaagaatttgaataatttatacaattgaataacttttaaaaatcacttttaagtattgaatatttgtatattaaaaaatcagcttaatcattaaaaaacaattgataaacctggaaactagcactgttttctgcattttaaagaaaaatgtttatgtatttcaaccttcaaatatttattgtcaaataatgttgaaatattttaatttttattagtaggggaacattttctactcacttgtatgttaaatcttctagcaaattagcgaatatgcctctacagtacagccattttctttatgcttactctcagcatttatggcacaattctcagaggattgaaaagtgagttctttctctatttcttgcaatttcaaggctattgtgtttgaagtggccattatttacatattaacaaaaaaacatcatgtttatggttttacaacaccaagtatgctaacctaatataattagacagaaaaaa

SEQ ID NO: 61465 - DNA, 1522 bp, Bovine  19866881580729
attgggaacactaatcttttaagcaacaacaagcaaagaaatagctttttacccaaagtcactcattttttttttctgatgtcataccctgcagccccactcttcaagttctactaaacaattagcagttttctcaggacctgaggatgctaaataagatagaaaattggaattaccgattcatttcgtccttgttagggtccccttctgagtctgaagaagaaacccctggaaaaataaaaacaagtcatgtaattgtaaagataatttcttaaaccagcttctaggcatttgaagatttatggaagtttagacctagaaataaactcagtgattccctgaactaacacccattttacagataagaaactataccctaagtagttgaagtgcttgctcaggtcacatgcctagttagtgacagaattcaaattaactggtccagggatttccctggcaatctagtggttaagatgctgtgattccattgcagttaggcaccagttcaatccctggtcagggaactaagatcccacatgccatgaggtgtggccaaaaaataaaagaaaaacaaattaactggcccaaattctgtgggttcttttatataaaacacctgctgacacctttagcttaacagagcagtgtttgcagacattctgtattgtccataaatcctcttgctcttggcctacacagattaaataaaagaagggattacattagattccaaacattgtaggtgtaggtggatgcccttccgtccagtactaatattaacaagtcactcttcatcttgggagatgggagtatttgaagctctgctgccaaaaatttttaaaaatcagcaatcgaatctcagcactgctagcagagctttgatccctgatttgtttcttaatatagtgaattctaggaagatatcacaaaactaaatctggaggtatttatgtactccaaaaatttgaggatgaaaaaatataacatctatttatgtattattcatttttagtatcattattcatatatctattcaataagtgaagtgaggtgaagtgaagtcgctcagtcgtgtctgactctttgtgaccccatggactgtagcctaccaggctccatccatgagattttccaggcaagaatactggaatgggttgccatttccttctccaatctattcaataaaagtttattaaataaccactatgtacctggtactacataagatattagagatataaagaagaatgagacagttctaaccttaatatcataagaatacaatatttaagtgctaaaagcaaggcatgcataaggtataatagatgataaaagtactgaagagtggctcccaggaaaaacacagaagatgagaggaaacaggatcaaaaacttaggttgatatataaggtacataaattgattcctccctaaaattagtcatataagtttggtactgatattaatgcctttccaaggctccgagatggtcttcctgcttctatgtttgactccttttggt

SEQ ID NO: 61466 - DNA, 1314 bp, Bovine  19866882018878
aatgcaggggacatgggctcaatccctggtcggggaactaagatcccccatgccacagaacaactaagcccgagtgcctcaactagagagtctgtgtgctgcaaaccaaagagcccacatgctctggagcctgcgtaccacaaataaagggaagcccatgtgtcacagtgaagagcctgggtactgtaactaagactcgactcagccaaaaataaatattttaaaatatcccaggatttaaagaattatttaaaagaaaaaaaaaaaaagaactaccttggctctttaatgtatcctgctgtctactctctaaacctttatacttattgctttttctgcctggaacattcctgaggcctgcttacctccctgccctgcttttgattggctgggtcgtgctcccaagtcaggtctcagcttggccatcacttcctctgggattcatgtgtgctccagctacccagagccccctatacatatgtcaggtggccgactgtatattatattgttagcttgttaactgtttgcttattagttatactggaggctctgtgaagctggtcttgcttatctcattcaaaatggtatgccttgcacccaaaatagtatgaacagcacctgccatggaggacagctactttgtgcacaaactttcttgaatgagtggaagaatgaattcatgaacatttctgtaggagacatatattagttacccttctagaattaatattaagataggtatcctagcataaaactgtaaaaatttgataaacacttaaaaaaatcaccactacagattattctttaactgggttctctcccagtgaagcatggcgttgagttgtttttctgtcacggcaaatgatttccattaaggatacatgatgaatcattgtgcagtcattgccattctagttgccatagtgatgggagttttcatgtacgggtgtctgaaggtttcttgttcagagaaacactggactgtgtaaatactgtttaaaatgaaaagatacacagacattaatatcttcctttgtcaggcttgcaatagatagatgattcaacctttggatagaaattgttttcaaacatgttcaagcatctgtttacttaatttggatgaacatgacttcctgaaaatttaagttgttctttacatacttgcagaagggttaaggttactgataaaaatactttaaaatgtgaaacaaaaattcaccctgatgctggttttagcttgactgaaatccagaatatattggacagattttgaaacacatttcattaaggtaaaaagctaagcctgtagagcaa

SEQ ID NO: 61467 - DNA, 776 bp, Bovine  19866880803308
cgattgctttttgttcaaggttagtcttctgtttcctctgggtgctgtttgttccaatgcaaaagtggagggcagaaaataaccaagtctgtttttatctgtaagtgtattattccctggaaatataattattttgttcatttaaaattgcttttgatcaaacaggttggtataaaccagatttttttggttgcctgcagatggcagtgattattaacttgtcattctaaataaaaggtgttggttttacttagcagttctaaagtgctatattaatggcagtttattgtgttctaataaaaattagtaagatttacatgctgcctttgaagaagagagttgatttatatatttaacgtgatgtcatttaaaatattaggtgactagacacgaaacacaaagacattaaattaacatacttcactggattatgcaaaacattgaacagtgacaaaagcgtttcagagcaggatttgattattgtggccaaatccagtaatgtatcctggaaaatttgattccaaagatatgcaaaacatgataaactttgcactctgttttatctccagaacaagatatagcagtaacagttgattgtaccttgacgatattggcaagtcacattctggaatgcagacagcagtgctgtccaaatagaaggaattaccaaaaggcaatggaaaaaaatctgaacatataatcttcctcttacataatcttttggataatatatgcaattctaaggtcatgaggaggacacaaggagctgcagaagt

SEQ ID NO: 61468 - DNA, 944 bp, Bovine  19866882019056
ggaagctcaatcaagggagtgagtatccataaaatatttataccatgtatgatagcactcttgagtaaaacaagttatgtggctatgagaaatagtaactccttattttatggaatgtcaatttcaactgtaaaaacaactgacaaacactagttttttaggcttggttatttctaagacaggttcttgaaaatgaatgaagtgttctttgtaacacgaaggaaatgaactgaaaatacatgttgtaaatggtaaaatttgagctttaagttttcggagaacttgtatctaccatcttgacagcttccaaatacttaacaaattttctcaaaaagattagtgatgacattaacaaatatacatttttatattttatagtgaaatatgtcagccctaaataaactaaggttttccaatctcagcactgtagacttttggagctctataatcctttgctgtgcactgtaaaatgtttcacggtatctctagcttctatccagtagatgtcagtagcagccccaaagtttgacaaccgaatctctaaacattgccaaatatttcctggaggataaaatcatacccagctaggatctactgagttaggtaactcagtaaatagttattttccaaatggccaatgtgtgacattacaaagtcatacatgagttcaagatccattgggggaataagacagacaaatagattttggtggctcagaccgtaaagaatctgcctgcgattaatcagacctgggtttgatccctgggttgaaatgatcccctggagaagggaatggcctttggtagagtatcaaagaaaaatagtcacaattatgtgagaagacttattaaaggattcttttttccaactaagtatctatatgaagccagattttctttagaaacatcaaccaaaacaacatatttcagaagattcaatgtaga

SEQ ID NO: 61469 - DNA, 1305 bp, Bovine  19866880196511
ctaattttattaaagagatgtctagtctttctcattctgttgttttcctctatctctttgcactgatggctgaggaaggctttcttatctccccttgctattctttggaactctgcattcagatgcttatatctttccttttctcctttgctttttgcttctcttcttttcacagctatttgtaaggcctccccagacagccattttgcttttttgcatttcttttccatgaggatggtcttgatccctgtctcctatacaatgtcacgaacctcagtccatagttcatcaggcactctatctatcagatctagtcccttaaatctatttctcacttccactgtataatcataagggatttgatttaggtcatacctgaatgatctagtggttttccctactttcttcaatttaaatctgaatttggcaataaggagttcatgatcttagccacagtcagctcctggtcttgtttttgttgactgtatagagcttctccatctttgggcatgtaagaagtcagaattgaagtagtcacatgttaaaaattttaagtttagaatttgtgtttatattatacgtttatatcttacatgtttgggcttctctttcagagacatgggaacaacacaagtgtcacttacaacaattgaaagcattctcatgatgacccttgaattggaaaaactgtaagttgatttttattatatttattttcactctattgtgtatttttaggtttattttattattttttaaagtttattgatgtatcattttcatttaataaaatccacggtttaaaaatatagtttgatgtgttttgacagacttatagttctgtagccaccattacatttgagatatagaaaacttctggcacccccctcaaagacccctcatgtccctttgtagtcagtctcctcctcccactaccagcccctggcaaccaccaatctgatttttgtctttataattttgccttttccgtagtatcttgtacatgcagtcatgtggtatgtggcctttttgtttttgactcctttcactcagccagtctccttggagatttattgatgcagttgcacctattggtagttcatccctcagcaataatgctgagtggtattctcgttgtgtgggtatatagtttgtttatgcatttatcagttgatgaacatcagctgagttgttttgttttttggctattatgaacaaaacctctaaaaatattcacatgcatgtgtgagcatatgttttgtgcaaatgtatattttcatttctttgggataaaatacctaaggg

SEQ ID NO: 61470 - DNA, 1263 bp, Bovine  19866881036729
accagtttttgaaagcatcaactcttcggcattcagccttctttcaggtcaactctccacacctgtacatgactactggaaaaactatagctttgactattaggatccttttatactcttacaaattattgcaggcccaaagacctttgtgtgtgtgtgttgtatcaatatttaccatattagaaattagaactaatattaaaaaattatgatttaatttacaaataataggcctgctattttggaattttttatgaaaaaatatttcctaagacaaatttaatgagtggcattatttgtacatttttgccaatgtctttaatgtttggcttaggagacaactggattcttatatacaaattatgtattcatcttcatattattatagatgaaacacattattcataaattcttatttctgaattaaaatacctgagaaaaattcagtctcatacagacctgtagttggagaagggactatattaatacctttttgcttgaaagcctagattcattttgttgcaacaattactgatttgttttccttgaagtgataagttcattttattttcaaggaaatgacagtcacacaccaatgtctgtagaaccatgggttatctgagcctctcaagtaaaaatgatgttctgtgaaaaaagtggtttgttaaacaatcacacgagtgattctccaagagaaaaccactgtatttctgtgtgcagtgaaagtactttatgcatatttcctatataatcacccagatttttgaagagatgtattcgtgggtcaaaatttaatgaaatccacttttactgcctcatcaagggcactctgaaccataactggctttttttccctttttttcttcttctgtgagtttatgacaatgaagaatacaatgactcctgggacagtttggtaccactgccttgattcatgctaaggcaccagctgtttcacccgtcattgcttttgtatcatcagtgcaaatgtcaaagagtgggtaaaagcaacatcttagtgatattataaaatagctttaaccttgcagattcttgaatgagtcctgggaagcacacttaaagtactgctgtcttaataatgagagaggacctgtttaataagaaccttttcatgtctagaaggaagcatagctgaagaacattcagaataaaggttaagtgtgtcctttgaaagtaaagaggaattatgaaagaaaaagaagatatctgtaatttccaaacaagcacagctggaaagggaat

SEQ ID NO: 61471 - DNA, 1132 bp, Bovine  19866881144219
tacaatttaacattctcaagtcttcattgatacagattagaagtattaattcttccctcttaactttttgtatgttttcttcttggtgaaaattcttatttataggcatacctccattaatgccaggtgttcctcctctgatgccaggaatgccaccagttatgccaggaatgccacctgggtaagaaaactcttttaattgacttgtgagctggtgcctagtagtgatctttctcagcttgggtgtttacatcaattaaatgttattttgtggggtttttttgtgttttttgcttctaaaaggtatgggctctattaattattaaacttatctaataaagaaatctactaataaatttaaggaatataaatttgcctctggagagaatagatttttgggttttaggataaatgtaggcagccatctgcttcaattgcatctgatgtaattaaagtagctggttgtagatttgagtttttgagattcagaactgtccatgacactttgtagttgtgacagaagcaaattctgtaaatgatttgtcaaatcttcaagaactaaaatgaatttgaggtgcccgtgctcatcacttgacttaaaaatattgttggatgtgaaaggtatacaatacactttcccactgtattttgaaaatcacagttagattttgattttgtcatacattttcacagattgcatcatcagagaaaatacacccagtcattttgcggtgaaaacatgtaagcatctcattcataatgtaattcaggaggtataatcataatgtcatttttttgtgtgtttaatggtatctattcagttgacttcaaaacttttctaaccttcctcactaaaacttctaaaatttgcaaactgacacagatctcttaaaggagggaactaaaaaacatctgaggaaatagtaatagacccacataaatccttttctaactgtgcagctgttttccccaaactgctaaaagttatgagacttagtagaaggggttgatatttaagaaagagtatattcttaggtgaaattacatgctctattatgggaaagtaattgaattttctttaataaaacctgattttagaagttattctggtttgagtcctaaatcaaaaatt

SEQ ID NO: 61472 - DNA, 1208 bp, Bovine  19866881427224
caaagctgttttatatatagaggtaggcagttaatgcatttgcaataaacagagtgacagtatgagcttcaaaaaaactttaattctatattaataaatctaattaaccagttttttcttccacctaaacctaaggtgttctgcactatggtatttcaaaactgatacccttaaactgagaattatgacgcattacttcaattttctcagtaacaatatttgccaaaagtttaataacatctctcaaaaaaaagagatcacccccaacctcaaaaacataaggtaatatgccttaaaaagcacttaaaaagtgccttttaactacaaataggaaagagttgaaaaaagaaaacatctaatggatcattttaaggtgaacaataaagaacatacatcctgatcttttgaattctgaatgaattaaacacacctgcctaattcacaatgaaactgggttaccaaccattacatacatactacatataaaataatcttttgcttctgagttctggtgaggggtaaaaaaagacgaataggaaataccagtataactaggtcaaaatccattaaatgatgcccttcctacaacagtgcaacattgtttaacaattctagattaaagtaagaatcccaaaataatttgctataggattttacatttttgtctttggtttcattctacccagagatcattatgtaaaagaggaacatttttatttaagctctcagaaattaaatttccatttctaataaagtgaagagtaaccagcattaattactatgaaaaaacaacatacaacactattctctggtttcagttaatcttttttgagtagaggaaatcaatgtgtgcaaacatgggagagaataggccactctttagtatagttaataaattatattaaaaagattaggaaatacttaaataacctatgacaaactgaaggatttcagtaaactgcactttacctttaaatattaatgcactcctttttcaagagtttcaccttacctgtcccgcactggggaaaagaggcttagtaactggaggctgcggagccggaactgttgctgttggtgcaggtggtctgttaagaatacctggagctgaaacagcctgtgcttgagtcattggaggaattccaggacgtggaacagggagggggcatactgcagagaattaaaaaaacttgtagccaattaaatta

SEQ ID NO: 61473 - DNA, 1592 bp, Bovine  19866882076389
cagggaagaccctcacttagctttttgtgaggaaggacatgctgatcattgaggaataatggggaagagggaggcgaagggcagagagctgaatgtggcaggatttctgtctttgggacagcgtccctccattccatttggtccactgaagcttccatagacattgctgtccgtgccagtgttcaggagccccatcagatttcatgcatgggtccccctatttcagaggagttcaagatgtgcccttgagctgggcctgggccagggagcaaaggcagggggaggtgggtgggaggaaaaccaaagccggggcatccccacttgcctcctcccccaagactgatgttttccagggagaattccgggctcctttctgcttctgggtaaatggaagggagctttgaaagcactgcaggagtggccctcaaaggagccctgtggcgaagtcttttgtaaagtgaacagtccttttgtaaggtgaataattgtgctctgattatctgctttggaggttcagagtgttcagagattctcaggggaaagagggatttgtctgaaggccatctggcccaccccgcttccaatgcttgattctctcaagcacccgctctgagtgatgcgaagcccccatgtggacccctctgtgatgggaaactcaccatcccatggatcattccatctttggacagctcagctgattagaaatggaagcgtatcctgagcttaaaaagaaaagtctgtctctgaagttttatccattgtctctgcttacaggttacactaaatataccttttgcttatgttgactcacttgatagctgaccacagtgaacttgacctcccccagatcttctcttcatttgtttctcgaatgcaggattttgagttctcctatcgtcctgatggttctgttttgacttggcttgctttgctggcctgcatcgctttgtaaccatgagacctagcagctggggcaacattcagattatctatctgtgtcgtggagacagggactcgtgtctcccaggatctagattctcttcctatgttggtgcagctccagagcttttatgacagtaccaacccctaaaatctccaggctgtgctggtgcgatctgggactgcgccacaatcacttcattcaggatttaatagagatgatttctttttaaactccatctttatttttattgtactccaactcttttagcctttcctttgtttacaaattttctttttttaatttttaaaactatttatttttacatttatttgactgtgccaggtcttagttgaagcatacaggatctttaattgtggcatgcagactcttagttgtaccatgcgggatctagttccctgagcagggggtgaacgctggccccctgcattgagagcatggagtcttaaccactgggccaccaggaaaaccccactaattttatttttaaatttatttttggcctcactctacagcttgtgggatcttagtttcccgatcagggaacaaacccaagcccttggctggtgaaagtgcggaatcctaaccactgaaccaccagggaattcccagagatgacttttttaaatgt

SEQ ID NO: 61474 - DNA, 6423 bp, Bovine  19866880480839
tttcacaggcacctattgtgaggtggaccatggatgagtgtcagagcagcccgtgtgttaacggtggggtctgcaaggacagagtcaatggcttcagctgcacgtgcccctcgggtgaggactctgggctagggagcctgagaaagaccttttggggcaaagactccaggatgggagcgtataacatcgtgttagtggcttcctatatagcagataccaccttatgaaaaacactgaagttaattttaaaagtaaatgggctttccacccaaaccaggcagcacgggtgaggggtgactgctcttgaccctacttgggtctctgtttatctcacactccccgctccaggcttcagtggcgccatgtgccagctggatgtggatgagtgcgccagcacaccctgccggaatggagccaagtgcgtggaccagccagatggctacgagtgccgctgcgcagagggtgagggcgggccagtgacaagactgcaggaatctggaggcagggctagtgggggaaaagggccaataatgcgcttgggggaacgttgcgggcagagctgccacaaggcaggcccggagcaggaccaatgaaagagccaggaggaggagccaatcctggacataagcagaggtaaggctatgcggtgggcccaaaggatctggcaggatagatgcgcactggattggagggaccccgtctgaccccctccacccccaggaacctcccgtactgtcctgctctgtcacttcagttgtgtccactctttgcaagccaatggactgtagcccacaaggctcctctgtccatgggattctacaggcaagaatactggaatgggttgtcatgctctcctccaggggaccttccccacccagggatcgaactcatctctcctgcattgcaggcggattctttacccactgaaccacctgggaagcccaggaacctcccatgtgtccgcatctccagtggagggagaggcaaatcagggctgacggtgtaaggattggaagcacggtctcgctagggttgtgatttaacttgtagggtcctggccagggacaagtctcggaggtggccgctggatggcctctggaggccagccaggggcggagcctgaaatgagcccgcctcctattggctcaatgggccaggcctgagggagaactgagttaagattgggcagaggccatggctgtgggcaggaccttggccattgggtggagcctgaccctctgtcccccgcaggcttcgagggcacagtgtgtgagcgcaacgtggatgactgctcgcctgacccttgccaccacgggcgctgtgtggacggcatcgccagtttctcgtgtgcctgtgccccgggctatacaggcatgcgctgtgagagccaggtggatgaatgccgaagccagccctgccgacatgggggcaaatgcctagacctggtggacaaatacctctgccgctgccctcctggcaccacaggtagggccaggagctgggctgggacaggaatagtacatctgatgggacacagagggttcaggaatggtgtttctggcaggtcacggtggtggcaatcccagtcatgttccccttccgcaggtgtgaactgcgaggtgaacactgatgattgtgccagcaacccctgcacctttggagtctgccgggacggcatcaaccgctatgactgtgtctgccagcctggattcacaggtgggcaagtggctgccatggaaacggggtctttatagcgtgagggtgaaatcatctatctttcctggccgggttttgcccctctctttgcacgtgcttgtccttagggattgtccatgctttgccctgagatttttgctttctctcattggcatgtatccccatgttggctcaagattattctggtatgtccatgaaggtattcagactcagagattgaggtgtttctgagtggggccaaggcaatccttggcggaaattaaagtgacttcatataagtttgggggcaagggtgatctggggcgaggtatctctgggttgcggaggtggctgtcctaatatgcacaagagctgatgtgttatgaagcaaatgagatgctccttgctcaagggtgtgactgtgctaaatggggcaaagttgcccttccctggttggctccgctatccttgtcccgggatgaggttgcctgcctgctccccagggcccctctgcaacgtggagatcaacgaatgtgcgtccaacccctgcggcgagggagcctcctgcgtggatggtgaaaatggcttccgatgcctctgcccacctggctccctgcccccactctgccttcccccaagccatccttgtgcccaggaaccctgcagtcatggcgtctgccacgatgcgcctggaggggtgaggtctctccccagatccctgacccccacagcttccctaccctcctgccagccctgactgcctccctcaccaggttccgctgtgtgtgtgagcctggctggagtggccctcagtgcagtcagagcctcactcgagatgcctgtgaatcccatccctgccgggcaggcggcacctgcaccagtgatggaatgggcttccgctgcacctgtccccctggtgtccagggtgcgtgtctccaccttccctccccagggcctcttccttccttcttccttcttatttcctttctgcttcattctctcttccttctctgtgtttacccttttttttcttttcctttcccactcttacacaggagcttgggaggtgggtatcaaggtggggaccttgcggggagatgggaacaaggaatctctcaagactatctcactctgcctgcccactacaggccatcagtgtgagctgctgtccccctgcaccccgaatccctgtgagcatgggggctactgtgagtctgctcctggccagatggctgtctgctcctgcacccctggttggcaaggtacaccagttgcttcttctcttcctcacctcctctgcaacttgctctatactgggtgatgctggggacccagagaaggagtccccccaccaccggctctgccttaaaaaaatttttttttttagtaaattatttattatttatttggctgtactgggtcttagttgcagcatgtgggatctagtttcctgatcagggattgaacccaggcctccggcattggaagcacagagtcttagccactacaccagcagggaagtcccctggttctgccttttaagggagcttcctctgggaaggaacagagctagacacagacacttgcagcctgtgtagtcagttcaggagaagaggaagagatatgggctgtgttgttcattgtttagttgctaagtcatgtctgactcttttgaccccatggagggcagcatgccaggcttccctgtccttcaccatctcccggagtttgctcaaattcccgtcgactgagtcagtgatgccatacaacttcccatctcaccctctgttgtccccttctccgtctgccctcaatccttcccagcatcagggtcttttccagtgagttggctcttagcatcaggtggccaaagtgttggaggttcggcttcagcttcagtccttgcagtgaatattcagggttgatttcctttatgagtgactggttttggtttgataagggcttaagaatctagaattcaggctgagagtttggggagagcctggaggagcagacctcaatcacagaatcacattcttcatccactgaaataaggagaggggtgttctggaacagtatgtgcaaaacgcccagaggcaaattgttcttgccttcatccatctcagtcttaagagtcctcctgagcaccaggtactcccggaccctaccctgcatctgctaatcctggatgttatttccctccccacccccaggctcacgatgtcagcaggatgtggatgagtgtgccagcccctcaccctgtggtccccatggtacctgcaccaacctggcagggagtttcagctgtacctgccacgagggctacagtggcccttcctgtgatcaggacatcgatgactgtgaccccagtgagttcaagggagctcttggggggaggattttgacctagggaacatgtttatcaagttgctacagtatgcctagcactgtgctttcatttcatcttcacagttgtcttactttccgcatttgttcatgaaaactgaggccccacagaggttaagtgacttgcccaaggtaatgcagtgagtagagagatgagctaggttaggagcacaggtctgtttgactctgaaggctgtaaactgcctctggcagcaagcaagttaaaattgtatgtaaactatgagataataggccccttagtgagtcaccaggagcactgttcaataggcaaataatgcaagtcacatatgaattaaaattttttagttgatttttaaaaaatctttttttgtttatttttgaattaatttttaaaaaatttatttcattgcactgcatcttagttgcagcatgggggatcttgttcccttaccagggatcaaacctaggccccctgcactgggagcaggtagtctcaacctctggaccaccagggaagtccttgaattaattattttctaatagctgtattaaaaagcaaacaaaatgataacaggtgatattaaatttaataatatattttatttaacctaatacataaaaatattatcatttcagcatgtaatcaatataaaatgattgaggtattttacattatttttttcttttttcatatggaatcttcacgatctgctctctggtgtctgttttatgctgacagtacatctcaaattggaccaaccacatgtcaagtgctcaagagccacatgtggtcagtggccaccctactggctagcccaggcctggaggagacctcctgtgctgagctcaggaattaagcagatacaactagtacttggggtttcccaggtggtgctagtggtaaagaacccacctgcccatgcaggagacataagagatgagggttcgatccctgggtgggggtgatcctctgaaggagggcatgacaacccactcaagtattcttgcccagagaatcccatggacagaggagcctggtgggctatagtccatagagtcaaacagatttggatatgtctgaagcgacatagcacgcacgcaggcaactagcacttgggagctcaaagggaccttttgggaacttctcaaacctttcctcccttacatatagatgaggtttccatcagataagggagggaatgaggccacagagagaacagggtttggttcccctggctaagtgtgcccctcccaatgaagcttggctttctccccatttccctctatgcaaggcatggccaggtcagggggtgaggtgcgtgaccagacctcctcccttctgaccgtagacccctgcctgaatggtggctcatgtcaggatggggtgggctccttttcctgctcctgcctccctggctttgctggtcctcgctgtgcccgagacgtggacgagtgtctgagcagcccctgcggctcaggcacctgcacagaccacgtggcctccttcacctgcacctgcccaccgggttatggcggcttccactgcgagcaggacctccccgactgcagtcccaggtgggtggggcctctcctgggagtcaaggaccctggcatcggatggggcgtgggacccgaggagccggggacaaggagtcctctgctagacacccacttcaggactctgatgcccgatgggaacgtgtccgggaaggggtaggacatctgttgggaggtcaccttaggtaccctggtccctgtgggagcaaggccaggccacggggacgggggcctccacgtggcttccacatagccctgaagcatctggtatactggggttaagggacatgacagggcagggcctttgggggacctcagcttctccttggggtaggggtcttgtcacttccgctaggaggggcccaggagggggggcagggcctctgaagggtggggccagacgcgcccctcctttccctccagctcctgctttaatggagggacctgcgtggatggtgtgaactcattcacctgcctgtgccgcccgggctacactggcacacactgccaacatgaagcggacccttgcctctcgcggccctgcatgcacgggggcgtctgcactgccgcccaccctggcttccactgcgcctgcccagacggcttcaccggcgctcagtgccaggtgggcggggtcactggagccttggggaggagtctagagggatgttctgggggaggggccttttgggtaccctggttggttgagaaggcagcctggatcctggggaggagttggcagagggattgtggtgaggggccggcagggatcctagggagaaa

SEQ ID NO: 61475 - DNA, 3321 bp, Bovine  19866880527707
tgtctgcggccttaacattctgccaatccggagtcagttcacatcagggaggtgtgggcctcggtcacccccagtacacagccgggggtttcctgtgtggccttatcagcagttaccagtggacataaataatgccctggctttgagtttgcacttgaaaaatgctgatgggtttcagttacaaggaaacattttggcccacaacctgctcttttttttttttgagtacttgggcccccatggaccagacgtggtttattcagtgtgtgagacaggaagctgcaatactttggccacctgatgcaaaagagccaattcactggaaaagaccctgatgctgggaaagactgaaggcaaaaggaggaggaggcagaagaggatgaggtggttagatagcatcaccgacttaatggacacgaatttgagcagactctgggagatagtggatggatggaggagcctggcgtgctgcagtccatgaagtcacgaagagacggacacgacgtagtgactgaacaacaagtgagcaggggaaaggacacagttgagctcacaaataggcccaaggactccccagggctgtcagagcctgtcttagctctgactccttccaacccctccctgtcctcagggaagactgcagggtcactgggcctcacggcttaggcccagggcaggcaaggatgaaactccaagccagctaggcacagtccaggggtgggaagagagccaagagcactgacccacgaggccctacatggcaatggagccgtcccggaagtccatcctcccgacgaggatgctgaccacagccggggggccgtcttggcaccgctgctggtcgtcacgcaccctgacctcctgatcctcactctcgcatgagagcagcaagccctgggtccccagtccctgggctgccttgtgataatcagtgtaagccaggccacaggccacattgctgcccagagagggcacgtgctccctggaaatctgggttcagccagcatcatttcctatcaaggccatcactgggatcttgtgtctgacgaaggtgtcaaattcgaagagactatagccaaacgctccatccccaaacaggcaccagacctcagcatccagccgacacagtttggccccaagtgcaaatccggcgccaacccccagagtcccgaaggccccaggatcaagccaacacaagggcccacggggctgcaccaggtaggcagctgtgcccacaaagttcccgccatcgacccaggatggggttgtcaggcagagtgtcctccaccagctgcaggacccgcaccgggttaagatgctgggctacgggcatcagtgccttctcccgaaaggtctgctccttctgttggtcagcttgccgaagctcctctgcccagtctgaggcccacatctgaccccggaggccctccaccagcttcaccacaaggagcccacatctccctgcacagcctcttggggcttccagaaaatgtctgagttgatcaggacaacaatgattttgctgctgcagctgaggacacacccataggacaggcggaagtgacacactgctcctgccaggacaaccacgtctgccttcttcagggcggccctgcggttctgctggaagtggaggggggtggttgcggcccagcagtccccgtgccatccccgccaggaagcaagggatgcccaggttctccacggcaacccaaagcttgcctgcggatgttggaggcagcagggcctggctcctaattagcatgaggggccttttggcccaactctagatctccacacatcactgaacctgctggggggaggcctggggaatgtccaggggcagaggcccctcaggctcaagctcccaagctcctgcaaaggggttggccaggggatttgctaagtaccagtggaccgctggactcatgacgaccttgggcggcttacctggcaccatctccttctgaaccatgaagtaggggtacagcacgtccagaggcagttccataatcaccaggccaggggtgcctgactgtgcagcagccatcgcggccctcagggtggggatgatatcccgtactctccgcacagaagcacaaaacttgcagagtggcctgaacagggctatctgatcaactgcctggagtgcaccccgattctgcagcagggtgttggcagccccacccaggagcaggactggggactgggctatctgggcattcttcaccgcagtcactgcgttggtgaggccggggccggccgtcactgctgccacgcccatcgtcccagtcaggcgggccacagcatcagtggcaaacacagctgtgacttcgtggtgggtgtccaccacgcagatgtccggcttctcacaggccaccagcagtggcgaaatgtgcctgccgaccagcgtgaaaaggaagcgcacaccgtgggccttcagcacggctgccacattctccccaccatgccggatgcttgccgtgtccaccttgtgcatcaactgatagaagagccccaggcggtgagcggcgcccagcaaggcggccactagcgtcctgaaggccagcagcaggaaagaggagaagaagccccaagctggggcggcagccgccgtggtctccatgagctgacacctgcttctcaatgggtcggcgggaagccccgcctctctttgatatcaaggacccgaatcttcgtcctagtggtgagcccaccgcacgactacacccccacccccaagtcagcgtgcatgaccctctcctgaagctgaacccctccgctccagcgagcgcctggactccaatctgagtcccgactccaggccgtgagtcaaggtcagatcgtttcaggatgctcctcctaccccagtggcactttagccttcatccataggaaatggcgctggctccagaggaattcccaaggtgctcttatccctttcctgggaaccctggccgctaacgccgccgccagccatcggagggacagagcagtgggggatgggcagaagaggcactcctgcagaaggcaggcctgggccgcctgcctccaggacctttccccaccatttccatcctgtctgctgtccaaggggtctctgacatgacacccctcctggaccttcatgtgtgaaactgacttcgggggccgtcttctggatcaaggtgtcagatcctaatttgacaatgagggccccttttgtgggtggctggggaagcaatttttaagctgagttcctctgggcccatggtgcctgccggacgatggaggggcaagtggatcacctgtggtcacagccagtcagccaggctcagcctc

SEQ ID NO: 61476 - DNA, 1367 bp, Bovine  19866880528769
catattgttcttaattaattaagcatatgcttaatgcttatgctagaagctgggtttggggtgaaggataagcctgggagaggcctgggagggcagacaatccagagaagaagtcacaggaatggagagctaaactgtgactcataaggagaggggacttttgggagtggcaaagatcagagatgtttggaagggggacttggagcagagggcagcgtatgtcaggcagagggtactgcaggggcaaagacttaatgctaggaccctcttagaatcatgaaaagagtcagcagattttaaaaacaatatgtggatatttccaacttattttcaaatggttcagaaaaaataaagttacaatagttgaatctaggtggtgggtatatgaataaacttttctgtatgcttaaattttaaataaatgattgggggagaatagctactaaatatgggtgtgcatgctaagttgcttatgaactgcagccctgccaggctcctctgtccatgagattctccaggagagaatactggagtgggttgccatgccctcctccaggggatcttcccaacctagggattgaacctgcatctcttatgtctcctgcattggcaggcagattctttaccactagcgccacttgggaagcccactaaatacactgctggttaataaaaataaacaaaaaaacccaaaacactacaatgttcagggatgtgggacctttgggcagagctgggggatggtcttcccttgacttctacttactctttcccaggacttttgtgtcatctggacgatgcttgtgtcagcaacccctgtcacgaggatgctatctgtgacactaacccagtgaatggccgggccatctgcacctgtccaccgggtttcacaggtggagcttgcgaccaggacgtggacgagtgttccattggtgagggggcgcagtctgagggtagggaaggaggggagaggctgctcctcggccacccacacccacactgactgttactccaccttgcaggtgccaatccttgtgagcacctgggccggtgtgtgaacacacagggctcattcctgtgccagtgcggccgtggctacaccggtccgcgctgtgagaccgacgtaaatgaatgcctctccggaccctgccgcaaccaggccacgtgtctggaccgcataggccagtttacctgcatctgcatggcaggtgtgtggtgggcgtggctggggcggggcctgaggctgggaggcagggcgagaaaagccttcaggcagaggggcccagagcagatagaactggaagggtgagagactaaagcctgggatgaggtggaggcggagccagagcagagtctgggggcatggt

SEQ ID NO: 61477 - DNA, 1682 bp, Bovine  19866880669422
catcaacctgtcaggcacattagtctgagtcaccttcagcccaagttcagccttcagatgtctaaggtcccaactaacatccaaaatgtaaccttatgagaaatcccaagccagagccatccagcgtaaaccacctgtgcattcctaacacagagaaaatatatgacatgatgaatgttcctataaaaagactggtagcatttcagacctttgtttaaagatctgattctggattttttgtcctgtttttccactgctcctatcttcctccccttggtggtagagacagaaccttctttttcaagtatacataataaaattagattaaaaaattagataagttatcaaaaagatacattttaaatcaccttctacccttactaataatgctaacatttgctttaaggcctccagaaattcctcttaaaggcaacgagttgtctaaaatgtgacataaaatgcctgacattcattcattcattcatttatttatgacagcacttcctgacatgtggggtcttagttcccccaccaggaactgaaccagtggccctgcagtggaatcttaaccattggattgccagggaagtcctcacatgcctctgactttagtggtctgcttcttaaaagggaaagtcacacgttataaagcaactgtggttttcagttggtcaagatcaggggaaaactaatcataacctcattagcttggctacctcactgccaactcaaacacagaattacagcctacaagatatggagctgaaattcaaacttgaccatctgtgacctctatacatcagcttccttgtctatgaaattaaatggatcattattaagctatccaccagcacccaaccagtcttcccctggtttcttcagcagtcctgtccctaagaaccacaaaactgtcttccagttcttgataagatctggtgaataggatcagttttcaatttcagttatgttagtatcaacccgactgacttccctggtgaaccagaaaaggtacacaaaggctagggcagggttgctcaaccttggcactattgatgtttgaagccagaaaattctttagggtggggccaccctttgcactatagcatgttttagcagcattcctggtctctacccactagatgcacatgtagcaacttccaccccaagaagtgacaaccgaataccacgctacaaactttgtcaatgtcccctggagggcaaacttgcccttggttgagaaccactgggctaagggatggttgcttaaaaaaactggagttcttgccaagctcctgacctggaggagggacagctaacactaccttctcatctaaggccaacatacagctgtctatggagcagccccagaggctcagattccattctcagtcctaaacattccaagtagaatgcagcttacccagcaaccacacaagctcaagccctattaacaagggaagctcttggctgaaaagcctcatcagttattctgaaagcagtcccaggccagcctttgaattcattcagggatgatttgtaatcacccaggcatatcctatggctccctctctaatctcatcatcccctccctccccttagctcaagacccactgatcaccttgggctgatcctttaacacgccaggcagctcctgtcactaggtctttggagggcccccttgg

SEQ ID NO: 61478 - DNA, 1455 bp, Bovine  19866880773589
ctttttgttacattttgtcctcaatcttgagtgctttttactagttaacaccctgctctgccaatcttgggagcatcaggtctgctatgacttccccccaccatttatccatccactcacacatctgtccatcccatccaaccaaccagccattcatccatctgttcattcatttatccatccctccacggatccatccattcatcagtccatccaacacctgcccattcattcgttcatccactcatctatccatccatctacttctccatccaatcacccatatgtctatctatccagcaaatattttctgggtgtctattatgtgctgggcactgggaatacactgtataagacagacatgatccctgccataaggtagctctagtctatgatagaaactggagccagtgctgtgaggaaaaaggaattcaacactttgagaaagaaagcggaaggaagcttaacctagaattaagtcctgccttggccccttcccagctgtgtgaccttgagcatcccactctcctctctgagacagttttcctgtctgaaaaggacctagaaacaatagatgctttatagcaatggcactgtaaagtgggttttaggatccctgttgacccattggaaattgcctctccttcctctgggctcccacagctctgccagtctatacttatgttacaacttttgattcttattctagtgactgaacgagcagctccattttcagaactgatagcctgacttctttgtctctgtctccatcagggtcaccagtgtgggaatgggcacagagctggtgtcagggagaatttgttgagtaaacaaataaatgaacaaatgaaagaaagaatgatggatgtgtaactggatggacatttcttctgttctgcccaaactggactgagcatccattcgtacagggagagggaaaagagagaggagaaagtaggggactaaaggggagaggggagagagacagagagctgtagacagacaaacacacactcacatacatacacacagagagacagagagagacagacagacacgcatctacacatacagagagacagagacagacacacacacacatacatacacagagagacagagacagacacagacagacagacagacagacacagacatttaatatcacttactgactttggaagtaacttcccaaaatcaggctctctcaccacgctcctagctgccgacacgtcagggcactgaggaggggtcaggctgcacgtgctgaccttggagaaagggctgccagcctgggatcttctcaggtgtctcttgagaggcccgtctatgaactgggcaacacagctgtctgggcctttattgctggcaagctttctgttgctcaagaaaccttatgacaggagggacacacccttgacacaaactcggtgaggaaacagaaccaaacgccca

SEQ ID NO: 61479 - DNA, 988 bp, Bovine  19866880865176
accctccctacccgctacctccagtaagctccctcggaggcctgcccccagcactcccccatatctcagatccagtctgctgagccttcaggacaactgtgagcacaccaaggatgggagatgggggtccctgcaccccagcccctctaggtagctggtcagaggcctacttacccacccacagacccctagaagggcttaccttgccagctggccacaccagttccatatgtaccttaaattagaagaaacaaaaacatacaagatgtcggtttacaaaacgaaggcatgtaagacctagttccacaccccaaccccagccccagcccagacactgaaggacggctgtcaccttactccaccatccacagggccagagccgggggtggctaggtcagtgctgcaaggaggcccccttggttgcccactgaggtcaggaaaggtgcggtccactagctgtaaaactcacttcctacagaaatgctcagctaagcataaccagggcatctctcctaagtaagctgtcctttagggcaacagaaaggacactacagtcttttcccaggaagcttgtccagcgtgggccagcagcgaagaggctgccaggccaggtccccaggcagagctgttctaaagtgccagttttcacccggcgccagatctaaggcaccgccaacagcatggagtgcactggtggagaatcatgtccccagctcaactgagcagggacattgtgtgcctgagcaacacagaaggcctcctgctgggaaactaggtgataggtggaaaagcgactcaaaagcgaccctgctgccagtggggcaagggccaagtcccaggctcagaaaacaaaggaaaccttcaaccaatcccctggaacaaatgctggcaaaaagcagaaaacctggcccaccagagagcacattctagttcttcaaacacactaagtaccatgatgaggactcctgagcagcgtccatggacgggc

SEQ ID NO: 61480 - DNA, 865 bp, Bovine  19866880906736
cacccctgaagtgtgtctggctacacattttctgtgtgtctagagcctggtgcggtgtccctctctaggcatgtctgggtttttgcttttgtgactctgggtgtatctttgtgggtgtcactctgggtagatctcagggtgtctctggctctacctctgtctttcgttatttcttggacatgtgtgtctctgtgcatagtgtctctatgggtatgaatggcacacatgtgccagtgcctgagtgtgcatctctggctgtgtgtgtcttgggtgtatctgggtatttctcctgtgtacatttgtatgtatgtgcctgtacatttgtatgtatgtgtgtttctttgcactgagtgtatctgtagccctctgtgtctgggtgtttccatgtactgggtgtgtgtttttgctcactgagcatatctctgtgcatgggatgactgtgtgtgtccctttgccctgggattctctgtatcttcatggggagcatctgtgtccctctgggctgaggaggtccctgtctcgcccccactgcagtgtccagctggctacactggtgacaactgtgaggatgatgtagacgagtgtgcctcccagccctgccagcatgggggcatctgcattgacctcgtggcccactatctctgctcctgtcctccagggacactgggtaggccaggaccagggtttggggacaggtggggaggctgggtttctgagccctcctgatgttccccatcccccatccccctaggcgtgctctgcgagattaatgaggatgactgtggcccaggcccagccctggacctggggccccggtgcctgcacaatggtacctgcgtggatactggtgggggtttccgctgca

SEQ ID NO: 61481 - DNA, 4195 bp, Bovine  19866880919394
tattcttgggagctgatgctcagactggcccagaggagaggctgagaagaagcctggtgactaggctcctctgaggtggagctgacttctgtgtctgggtgaatagggttgttggtgggcaggcaggtgtcttcatcggctgagtcggcagtctgcagaccgcccacgagcctgccttgggccggtccctccaggcaggctgcagtgtgcacctcacagtgggcagcaaggctcctggcgtattcttccgtatgcctaatcctgtctctggtactttactgtaactggagggaaatgacaagctccacttagttcacatagatagataatgtgatccggtggtgccgaggaggtatgaggattatttgcagtagttgaagagtggtgctgctctgaggtgtgtgggtcttgtggggcaggggtcccctggaccttgtcactgttcctttccccttgtaaggactctaggtttcccaggggaggggggaggggagccttctctaggacaccagtgctctggactacctcctttcagtgggcccaagtgatgtgaaatccattgaggatattctgtatttattgagctcctgttgtatgcagagactgctgtgggtagtttgctggtcatgtctgtatcctttaccctttttcctttcttcctaaccagctccctcttccagtgtgtttttaaaatctgctggccagtagggggagccacaccccgtgcttgctgaggcagagtggggccttgggtcagggcccagtgcactggccagggtgaatggctgtattcttgggcctaattagcattccaggtggctgctgacctctcactctcagttccagccaaacctcaggtttgcctttgcttctggggttttgtacctccctgtgttttctagcaggcttctcctactaggggttttgcagccttttcccctaaggatctgagcaaccagagaaaacccccagagattcaaattggcagaggaccctgagggctaaaacccgcgcgaccaggccccacccagcgtggcgccttacggcatcgtgaccatcacaccctggtgtcccagtcctgagttcggactgtggcctttgtccctgactcctgagcttctgagtgccctgcaccccgcctgatgccgcctcctgtggagtaaccatgacggcatttccagcagctctctgctgctgccgagattttttttttttccttcacatttttccctcctttaaagaaagtggaaagattgtgcaacaagtaatctgagagtcctgggaacagctgtcctggcgggaaagagggcaagatttacagtcttggagccgccagcctgcaggctcccaggctccagcagtccagccctggcggctccctcggctgcctcagctccttcttctccccaggcgccctccccaccttgagttttgcgaggccgttctttgtctttgtggttctgccttttcctttgccatctgtgtgctccggggaccgactgagagcttctgctctcgggagggaccaaccctgtaggtttgtgccctgcacctcaggtgttccaggctccaagtgggagcccgtgtcctggttccaggggatgggctgtctgccaccaccctcccgcacaggaaactgcttacttgctgggtggttcctcgtgtggggtccatggagctgggtagattgctgtgactaggtacaggtggttctgccttggcagggaggggtgtgggggcctggtggggggcactggggggatttctcttggtctctgggggcttaactgtttcgcccttcttgttcttgtgtttccatttggattagagccgaaattcctgaagggcctgtatttgtcagttctgccaacacagccccaggactcaaatcaccaaaagaaactgaccagaggcactaaattggggctagggcagtggtacgtggtctcatctctggccactgtccatagacaaggatgctgccaactgctcaggacaggggggctggctgttgggacagggctactgttcagggatgcagtgcatccacagactggggtcagaaggaggggggtctttgcgccccaggcaccatgtgctcctcctcccgtgagcagcaggcagcactgttggccagacccaccacatctttagaacccaactgttacctgagtcatagtcttccattgagctttgattgtgcttaaactctgaatttgcttgagaggtttagtattgggacaaagacagtggtacaagggccaccctcccactacccctgagccagcgtaaactttcaccccatcccattgctgattgatgtctggctcctccccagtgctacccacaggttttatgggcacacagggctggacaccacctcctgtccctctcaggagcatccctagcctaggctaggataggagttcagagcattctcctggacttggttttggtcttctagttgcagagagagcatgcaccagctattttagtctcctggtttccttttcccaggattggagcatgtgggtgtttcttaatagctccagggggaaaaggaatgctttatgttttggaaagatttgagctggaaagtgcagacagaggccgtggggcattcttcctagacaaccaacctcaacttccgcgaccctgggtcttggaatgactcggttcctgtcccgtcttgaggcctgctgctgcccactccaagggtgtgatgcttgctcttggggaagggctgagtccctggcgggggtgggggtaggaagagatctggaggatggggctatagccaatctgcctgcagtgccaggcgacccctcacacccacacacatgcagggagggatgcaagggcttcccgggcgagggcgcgccttgtggaatgtgccttgaatgagagagcagccggtgggcgggtttttcccacacacacacacacacacacttggggaccatgggagtgcagtgttggttgcatccgtgattctaacagaagcatctgctctgctctgtgggtgggaaagagccccagcccctctccccagtcaaaggaagctgcattcgatgcctgggaaaaaagaaaggacaactttcttcctcaacttgtttttatttttaatttgttctcttccttaacagtgtatgtcactggctcctcttttttatagttttgcttgtttcttggagttcagaggaatgcagaggctgttagctagaggtcctgcactccagagctcctttcttaggggcattccctccttccagctgagccccaaggcagggtcagcattaccttgctgagatagggtgcagaaaagtggaccctggagggtaaggacagaatccgtgggtgcccagtgggtgtggcacaccacgcgggacttcagaagtgaggcaaggagaggacaggcggggtaatctctcagccgcagagcccagcaaaggagaccccagcacgcagtgcacacacatggagctcgttactggaagccattctgtctagaggcatgagcgggctcaggcggttctggagatatctgtgcgtgcctgatctgaggcccttttcaggggaaggtgggcctgtccccacccgcagctggccaggcaggggtggaactcccaagttgcggctctgtcttctcgtgccctgacagcaggcggggcaccggaaggctggcttggtctgcagttcttctgttctttatgacttgaacggtacattccacaccatttctctcacactggtttctctctccctctacgtaggtcctgcctaatcattggacacggactcttaataaaacggtcttcagttccagattccttcccagcaagctatagcttaagtccattttcttccgtgaaagggacaggactccatcaagttatggaattcctcagagccctgggcctgtcccccggggtggattagtcatgtccagcagctcacacctagtcccgcctccgggaaggctgcctgcctggctgcccgcccgcccgggcctcctgtgtaaagactgcctggctgttctgcccagcctccctggtcgtctggggtcctctgagtgggtggcatctcccagagggtgatgacaatccccctgcacacacattcatgcggtgctgctccgtgtgcaaggccccgcccgtcacagatgcgttttctgtctccacccctccctcttttg

SEQ ID NO: 61482 - DNA, 878 bp, Bovine  19866880980307
gctgccggcagccgctgatcgaggctgggtttccttttagaacatggcccagtgaggcctctgtgcaaggcctgctgggaggccgtgaggcgccagctctatgccggcctggtacagggccttgtcatttacagctgtttggagcaactgcacaggctttaacactgacagtctgaaattgtgtcttaggaaggagaagacgaagagggaaaagaggaggggaaggaaggtggcaaagaggatgcagagaagggtgagtcttctgagtggccgggcactggggacttttccagatggcttgtggcgggagggggccagccaagggcagggtcttggcagaaatatgcccaacttggatcgtcccggtgtggctgactatgtactggtagggagtaacctttcttcctctgcctggttcctactctggccctgatctcgagacagtacactggttttgccttcaggtgggcggggcaagcaaaagtgtgggggaaccccaggctcaacccctgccctcaggcccttagtaacatgcagttccaagtcctcagtggctggtgtccaagctgggaccctcgggtgcagtttttacggctctggtttgcatgtcctttcccttagcacctctacagcccctgttgggagtccgtgtctccctattcgagtgatgagcgccagcaggtacctaacctaaatccagcctcagcctactgttgccgcggtacccagtgtgggtgggcagggccatgtgagctttggggcctttacccttgggggctgcactcaggccccacctgaggccttcctgcattctgccacctgggtcctctgaacttttgccagtgtccccactgagacagcctctctttaccttccag

SEQ ID NO: 61483 - DNA, 1032 bp, Bovine  19866881000723
tggggcagggaaagcctctcaggtctagacttcaggcaagttcttgtcctttttttggaaaatacatgcataaggggtatggattttatggatgagtggacagacagtggctaaccctttgtctagggtgtaagggacttcaaatgaataagactgtagacgaggaggttatttttacataagtgtaaagaagaagtatgtgggtgtttctatgaaaaaggctcttaagggtcaggtagagaagaaactgttttgcaaatattatttagcctctttcttctgacccctcagtgcttgcttgcttgcttggtggagcaaagattaataaaatgacaaattgcagggcttaggggttatatttttgtattgttagagtagtttaggcagtggtaaaaaaaaaaaaatctccaaatttataatggtccaaacataatgaaattgtatttatcatggtcatcaccatccagggtgcattattttggtaggtaggtggctcagtcccacgaaaagacttccatgtttattggaatgtatgctaactttttctagtgaatatgtaagagaatatggtcagggcagtctatttaaacagcaacagaatgctatagttaccaagcaaatagagaatcaaataattccgagagtcctgcgtgggtgagtgctaagtcgctttagtgaatccaactcttagtgacgcaatgaaccgtagcctgccaggctcctctgtccacaagattctctaggcaagaatactggagtgagttgccatgccctcctccccagagagcatcaaggcccccgcccacttgccccagcggcctaagatgaagcctggtggatgtcgggaggcctgtcatttggtcccctaagcagaaagcaccccaacccgggggccccagacaaggacaaacagaaacaggagccgaagacgccagttgcacccaaaaaggacctaaaaatcaagaacatgggctcctgggctagcctgctgcagaagcatcccacccatccggtcctacacaggcaagtccg

SEQ ID NO: 61484 - DNA, 880 bp, Bovine  19866881056388
ctgtggtccctgaaagagccccacatacccactctagacacgtccatacacattactcctcacacacaggcacacacgcagggaggcaataaatatgttccgtaccaaaagtgcccccagcctgacacttcaggtggggcccctccaaaagggaggtcttataagtgcttaatttcttcaggaatggggaggaagaattggggaggggaagggccagactcttgctatctacttttgctggtttgaggcaattatgaggttttccctggaaaagagggtggcgaaaccacttgttttcctataagccccaggctgctcctatctatccagagcccaggagaggggctcccccgacaccctgcctcaaacagcacttcttcatagtccttgggcccactgagggagaagcagagtgcagtgctcaaagctaatactgatttggttggcagcagcaaggactgactgggagggtgtctcaccatctcagggtgatgctcacagtaactggtgtttccctggctaaagatggcggccctgcaagcagaactgccttttggtagccaggagagaagcccttggtactcaagaaaagatggccacaatagctggtccctaaagtcccccatgcccggccgtcgcaaccagtgtccaaatactgagtactggaaatagggaatgattctcagcaaaggatcggctggtcgctaggcaattccccagtaaccaggagttaggcctgagctacaggtctggtcctccctaggtcgttagggcaccgccttagcaaccaggagcctggccttagtaattggggtccagccccgcccggctcagagacacacgttgatctgcttggagagctctctctccaggtccagga

SEQ ID NO: 61485 - DNA, 912 bp, Bovine  19866881601170
ctatgcatataaggaaacagtattcctctaaaagaaatgaagtactgattcctgctgcaccatgtaaaaccttgaaaacattacaccaagtaacagaagccagacacaaaaggttgtatatattgtacaatttctggaatatccagaataggcaaatttatagacacacagagtacattagtagttgccatggattgaagggatggagagtgcctgctaatgaatagggatctctttttggagggatgaaaatgttctaaaattggttgtggtggtggctgcaccattctgaatatactaaaaaaccactgaattgtacactgtaaattggtgaactatcatttgtgaattatatctcaataaagctattacaaaatgactaaaaacaaaacaggaagattttacaatagtataatgctcaaaatatacataatttatattcaataaatgtttgggggtagatacattaaaattatataagccataaaaaaatcatcgtacaaatatctttttgtcttcctttatacatagtagaagctcaaaaaatcattgatgaaatagattggtcaatcacatgaaatcagggctcgatgttttttttaaatttttttactgacaaaatgagattcacattaagaaatgctacccatacttaacattacccacttcatctccctcttaaaatacttttcccaggtcaggactgaaccacaacccaaacccactcaccacatttcaaagtgcaaagcgggaaatgtaccgtagacagggcacagaggcaactgcatgccatgctgctttgactattaataagtttaccataattagagaccttaacgttaccttagttaaaattcacattccctgaaagtcactactaattatgcccactgttaatattttattgattta

SEQ ID NO: 61486 - DNA, 817 bp, Bovine  19866881918774
cccattctcttttccccccttttcttgccttctctggcccccctctgtcactcctcctgctctgacacaagtggattattattatttttttttacattttgtatagaaacaaattcatttaaacaaacttattattattattattttttacaaaatatatatatggagatgctctctgcccccctgcaaacccccccagtgcccccgtggggctgagtctgtgggcccattcggccaagctggattctgtgtaccaagtacacaggcatgaccgggctcctgtgtaccaagtacacaaccctggtgtgtaccaagtaggcacccttgggcgcaccctccggggctaggggtcgggtgagacttgggagcctcctccctgctccacctccctcacgtcactgcattccagatggaacttattctagagctttgccctctggcccaagagagcccgcccacagtccccccacccccatcctagggtgtgggccttctccctttgggagctgggagggtggggtggctggtgggactatgaggaccaagggagacgtgtgcattctactttgtctccctgtaaacaatgggcctgcaggaagagaatgagctgcctgcctggcacctcttcttcctggtactcccctggcccagcctcagggcaaaatagaagtatttgtaggctatttttgtaatatagcttctggtcacaatccctgtgtagctaagtccccaggccttgcattgtacagccccctgttccgtcaccacctaataaaggaatagttaacactcggtgtcattgttgtgtgtctaggtg

SEQ ID NO: 61487 - DNA, 1548 bp, Bovine  19866880354323
tacttaataaaaactaatttagagaaaaaagaagggacacaaagaccctcagaagccaataaggcttccaggggaacccagaagcttggcccaactgtaaaaccccagcactgcgctctcagcgagtagcaggagatttggtgacaatggaagcttccaaacctacacggcattggtgataaaaattaaggtcatttagaaacccagaaactaaagccggtcggcctctgaagggaattttaatttgttaatggattttccagctgatggctggggagaaagatagcaattcacaatgggtctgatgccaaaaatagggccacacaagccagcaagtctcagagagttctttcgtctttcttcaattgcatcaagaacacgctgtccggggacgcagatttctgcactcccccaccccacccccattttaatcagctaatagcagatgaacacctagtgatgctgccaaggatctcttaatcccatcagtcacggggaatgagggtacagagggcaggtgcctctggtacctctgccagggggatgcaggatttggcagaaaccccaggggacagtttcctcactcgtcaccagcggtttggagggagccaggaaagagaagcaggtgcagctctcttccttgtgcttgctctggggaggacattagcagcagaagtatgttcacttatcccacatatgattacggactacactacaatgactcagatggacccagtccccaagctcgtggagctgatggtccagcaatgaaaatgaatctgactgagcaaagcaaggaggggatgccacagaaccacattaacagagccctgcattcagtgctgcaaagagaggactggggcttgtggggaaacacccagagggagtccccaagtgggtcaagagaagagtttcagactttcctggtgggacagcggacaggagtctgctggccaatgcagaggacataggttcaatccctgctccaggaaaaccctataatctgcggagcaactgagccagtgcaccacagctactgaagccgcgagctctagagcccatgctccacaacgagagaagctatcacaatgagaagcccacagaaggcagagaagagtagcccctgccctctgcaactagagaaagcccatgcagccacgaagaaccagcacagccaaaaacagaataaaacttctcttaaaaaaagagagagagagaagagcttcacccagaaatgtaaaccaaaggccacccaccttatcctgagtgcccagagctgccgagagactcggccaccacctgaggcctctagacctgaccctccttgggaacaatgcccgtgctcacaagggtgcctctgtggtgaggacagaagagaaaaacccaatttctgaatcttatttttagctgcaagccaagcagaagagtagaaagaagccacttgactagaatcctgaccacacagaacgagtcatttaatcctttttaaaagcctgtccatgggatctgccatctagctggcatctaacttgggaaactctcatctca

SEQ ID NO: 61488 - DNA, 1727 bp, Bovine  19866880357007
gtgcaatagcaaacaccccagactgatggcctagagaacagacatttattttctcacagtcctggggggtagaaatctgagatcaaggtgctggcagcgttgatttcttttgaggcctctctccttgtcttgtgagtgaccatcttctgcctgtcttcacagggtcttccctctgtgtgtctgtatccttatctcctcttcttgtaaggatgccaatcagattggctcaagattgaccctggtgaccttgttttaaccacttacctcttcaaaaactgtgtctccaaataccgtcatattttgaggtactagggggttagaacttcagcatagatttgaggggaagattcaggccctaacacttctcatattggtgtgtctgattttacaccttctatccatttgtattcagccctatctttatgggggtcttggtgaatgatcagcagagatcccaaaatggaatgaatgtcccaggggtgttggagagggggaagcagaggggcctacccatgaccaccctgacctttgccccatggtggacctgcttagtgaggatgggaggacccagtctgctcagaatgcacgtgtttggggccggcaagggagctggtagtccttctagggagcgtggttgattaatataatcatattaactggccctcaaacagacatatttatagccatggtgacacattattaaggatctaatttggatcaggactctgggaatcttatttttaggtccagaggagagccctgcagtcaggtgaccaggaggtctccccggagtgttgtgtttattctgtccagttggaaactctcagggttggaagaaatttacaaggtcccatcaacccacccttccacatgatgcctgtatcactgcatgtgtccccactgagggaccatccaacctcctctaaatgccacccatattctatcccagaggcccatcttgacctaggaaagtgggaaggaacttctttctacatcttctgttcagctgtctgggtccacacagctggagagaacacgtccccctatttggcagctcttcagagtcactggagtcagggctaaagctctgctggctgtcactgctccaggctgagggccccacttcaccgtcagcagctcctctcagaatatagctccgcctcgactttttgaaaaatgtaaataaatgttcagtcctgggctctaggaccttcctgagtgcctgccttatggtactgctccagttctgggtccagatgaaacttggccaattgtagtcagctggcctttgttgaggaattctggggaaaacaggcttcttctaaagagaaatcactccacaggcacctgtgctcttggtttggtgaggagaaagatggaggctgagtattgatagtgggagtctgacccaggtgaggggcagcaccgtgcccctgggtcaggccatagcacagagggggttggccagagcaccctgacgtgcgatccttctgggaaatgagcacctgggcagctctggtttgcatgttccactctgccagccccaagaatgatggagtcccttcagccacacttgtaggtgaccctgatggtgggagcctggagtgcgtcttatgcaaggctgtgtcccctggctcacagcagacacctgcagtgtcacacacttgagacccagctctgctgctgaccaacccttccggagaccttgtgtgagcatcctcacttca

SEQ ID NO: 61489 - DNA, 937 bp, Bovine  19866880460058
atgaagaacgtgagttgcagagtgaaggaacgcctcctcaaaggccgattcaattttaggaatcttatgaaaagccatcctggtttagaagcagcctcaagaaatttggcactgaattttagctttgctcagagagagcaagaaggaaggagaggctgctttttctggaattctaggaccttcctttgcaaggtcagcagtgcagagatataccctaatgatccatgattgcctatatttggaacggaagtatttaatttggtctaattgtggctatttctaggagtcattgggaaattcagcagctaatgaacgtgcccctgttctgtcagatccctattggaatattcagtgttctctttttcatacttaccagctaagggaattactgaaatacatttctggagtctactgtggtaaaagcagggatatgaaagccttctttcccatcactgagtcccaatatcgcaggtgaatgtcacacttgtgttaaaaacaggccattgattcccagcaggctctggccagagcctctgcctcccaggactgtgccagactgacctccttttcctgctgccactccttttgggggcctctatgggtcttcattcagtgtggggctcgtgggtatccaggcctgcaggcagacacacttctacagagctggatcagaggacagaagacagaggatgaaggacactggcctattcatttctccttttctctcttttggcattatgctcagttttgctaacaactgatgggagctgttctatctagagtaaatgacccagatgcatatttctaaaattatattttggggcattctaatccccctccaattctggggaggctgcgtactctatctccctcttgatgattttgcatgcacatttacatcttgaagaccatgcaagtcttgtagtaaagtgacctg

SEQ ID NO: 61490 - DNA, 1891 bp, Bovine  19866880519522
cacacccagtcccaggcctgccgtgagttcaccacccacctttgttcacgatggtccctcaggctgcaggacccatccccccttctccatttagaaaagacgccacccgagcttaagttctagcttgaatgccatgcttcctggggagacctccctacctgcccccagttccctgcacacccccacgggtttactgtccatgcatctccctcccaccattgccctgtcccatgacactgctcggccccctcacaggcatcacacgtgcccaggagcctcaaaggctatttctctcccagggtctccttaaagctcaagggaccattggttgtcaggaaccaatgaatactggctgtaagaatgcagttctgtgatacaaatgaatttacttaccaaatagaaagagagagaaacttacagagttacagaatgaacctatggttgctgggtggggaggggaaggatgagcggaagggaaagttagagagtttgggatggacatgtacacaacgccagtatttaaaatggataaccatcagggactgactgtgtggcacagggagctgtgctcagtgtgctgtgccagcctggatgggaggggagtctgggggagagtggaggcgtgtgtatggacggctgagtcccttcgctgttcacctgaaactaccaccacgttgtttgttaagcagctacaccccaacacaaaatacaaagtttaaaagaaaagaatgcatttctgaaacgtcagttgcaccagaagccccctaagcctggccttgtgccacttcatgagggtctatgctctggacacagcaggcacttggacctctagggtgaagggaaataggaagttgagatgcaatggaaaattccaaattttcactatgaggcgagactggggcatcacctagagtgagaacgacgacccaggtcactcccaccagacctgaaagtaagtggtaaagactctgaccctcccacagacccactgtgtcatggggagacccaagcctgtgggggccccagcgcccataccggatgctgtcgcgctcagccacgatcttgtcccgctcctggaatgcccagtcccgccggcacttggccacgtccgcctcttggagggcttccttcagctcctggcacagagccttgcactgctttcgaaggatttcagcctccttgttggctctcccggcgtccatcgtcactgtgtctttgatctgcaggaggacaacaagcgagcagagggggaagttactgggccttctggtccggaagtgccctccaactggtgcaggagctggggctgcactctccggagctggatggagggaagtgctgagatcccaggaagagcccattctgacacaccccaaaccatgacaacatgctccacagccatgctcagacccctagtgacgctgtatttgtgttcacccaaactcgctcagcccctcacagagccaggactggaagcccggccgctcctctgtcctggtctcaggggcccaggggaaatgacccccagagggctcctcctaaaccccacctgccgtttacgggatgtgtgtcttgcagagagccctctgcatctctctagagagtgcttgtgacaaatcgtgacacgaggccccactgcagtgaaggctgcagcactggtcatgacgcttccccacccgctgtgtctgcaacacagctgatatactctggcatgcagttaccgctaaatctgaaaatttactggctgctgtttgctggggaagtcctgggtgtctcagctcctttaaaaagctgaaatctaaaggatctgcttctagacctctttccaaagcacgacatgctccgttaaaatctcaaatcaaactctttgaagcactcatacagaaagctc

SEQ ID NO: 61491 - DNA, 2620 bp, Bovine  19866880612241
gggtggagggttggcagcgggctaggtgggtggatgacagggtgggtgactgagtgggtgaataggtggggagctgggagggttagctgagacacagaaagcactcagcaaagcgccagaacctgtaacaccgaatgggggctgactgtagtggcgggagatctttgctgccccccgacacctgacccaaaaccttacgacgccttccgtccccttctccgtgtcttgtagttgcagactctgcagccttcagaataaacagcagcacttccctagcacaaggttaacactcaataaaagtctgaaccaattaagcaagaggctgggacttattcatccaataagtcacccatcactgagtgtttttttgaaaaaggtgttttctacaacccactccagggccagtggccagtaaaatttgttgcattaatttcactcatttgacatctctggacacaggacaatgcaccccaccacctaggatggaagagaggggacagattccaccatggcttcctcaagacgattgtaagttaccactggtgacagagctggcctcgctaagcctgctgatccttgcctacacagccttcccagggagaaacaagtgtcttggtaaatggctcatgcccctgaagataacgaggcaccctgtgatgagaagaagcacaggattgatggggtaggaggcaggcaggaagtgtatttccaccttgagttggactgctcatgtggcccggtggtggcagggactccttagaggatgtgtgtctctgaagcccagaaaaggaagagatactaccaacagtctaccttgagccacaaccggctgatctccctgaagttgtacagggaagcattcacttctttgaaaggctaattagtcaagacggcaccatgcttcagacacaattgcactggtcccatttgggtctctatgggtcagctgtgatgaaatttccattacctattgtgttttggttactggaggacaatgtgtgtttggaaaagtgggtgtggtcaagaggaaccacaaaaagccagaatatcttgagtatctgtaaaacccatttctgattttaaaacttcacaaagatgatgaatctctgggagctgaagagtcttcttggaatctcagcactgtctgtgggaacggctcctggcaggcagtgtgggctttgaaattcaagtctctccggcaacagagcagagtgagctcccccaacttggccactgagagtggaaataagacccaggaaagggagactttgtgttctgctcacctggccaccagccctcatgctcccagagatgcagaccacggttatggatatacgggtacatggcttgtgagccaggaatgttcaagtatcaacaaggataaagcagaatgacctcatctctcctgccttccagagagcaatgacgtgaaagggccagacatcaccctgggtaaacaggtgcaccaagttacggggtgtcaccaaaaggcccactcccccaaaagttagagctgggagggggaaggctactttagggaccatctcacccagggtttctcaacctcggcactaatgatattttggcaagataaacttgatgtgggcatctgtcctgtacgtcttggaatgtttaacagcatctctggccttcagcactcttccactctcctaggttgtgacaattaaaatgtctccaaacattgtcaaaagtcccctagggggcaaaaatcatcatagattgaggaccacttatctagactagtggttcccaaagtagatgcgaaggaacatcagttagtaggctcctctacaacccaagtattccatgatcaactaagtttgtgaatcactgcccaccgtaccccactgcagtaatttactgtattattggattggccaaaaggcgcattcagtcttttccataacatcttatggaaaacaacgctctttttggccaacctcttagtgtcattatattaaggaccctgaaaagtaccacagtaagtagaaacttgtttaataactttaactgttttgtgatctttcccaaataagatgcttttattattggtttatatctttcagagctaaagaatatcttgtaagatttttatatgtacatgtgtatgcaggcacaatacaccaggcaacctttctcccactgactagatgaagggaagccataagccagtcttgttcctaagtcccattaacagatgtggggcagagctacgcctagcagcctggagccctgaatcccagtccacctccttctgcacaaacggtttggacgctatccacaacagaagtccatcttctcacaaccatgccacaatatggttctaccaacaccgctgagaacatccacctggggagctcaagctagtgaatgtcagcacagtactccccggagaacaaaccaagcaggcacttgctgcaggtgaagtcgaggaggacctcacgaaggtgatggccacgaccatggaggatacaggcaggagctcaacatcatatccacacgtgcctccccagcccatccaagtgcaatccccaccagacacttaacctaactcatctctgtcttaatacaggcaccttcatatcggggcggctcagag

SEQ ID NO: 61492 - DNA, 1785 bp, Bovine  19866880652382
aagctctccccagaccacgatcaggacccatctctccccactctagcagcagttcccaaaggagggagcatcacgagcccctcacgcccatcagataaaagcctttttgccaaggaccaagggccatatctccacttccaaaagagtctttcctatttgcactcctcccacatcaaagtcgatgcttcctacacagcggaaacttctcagaatggaagcgtgccatccttgactgaggagggtgtacctagacacagggaccccgtacctcactggtacacagtaaatcagtacttgccattcttgtgtggcctcagatctcatgaagaaagctgcatgcctcctagaaaatgcctgatgcctgtgccccaccccctactctgcccttttcatgtattccttcagggcactccagatgctgcgacacccaacacacactgcagaggggtgtgcagactgagtcaggggagacccggagaggggcacaggccacaggaaaacggggctcagcggcctcaaacttccccaggcccaaaaccctaaagagaaagcctgtctcacccgaggagctttcaagggtttttctaagtaagcttagaatttggggcccaagtaataatgctcatagtcccatccctcaagggcaagaaacacagggacgttcacagggaacagcctccatcaaaagcccctccccaagccccaagttcctggcagccctggccactgatacctgatgtagaaactgtcgccaggcaggcccttaatcttggagaactcctcagggcggtactgcaccttcaggcggacgctgtccttgggcttcagcatctccacgtagacctcctccactgtcttgctacgtacatccagaccgccatactacccagagatggagacgggggtcagagggcagaagcagggaggcctgggcacccgtgaggggccagtagtgggataaggagaagattcagcatccccatcactgggcatccatctgccccacgtctacagaggctgaggcctctaccaagtgcctgctctgccctcaactgctcccagcagagaccctgttctagcctcccagccagtgaggcctactggaaacacggcacttccccttgctaaagctccttgtagctttcagtacctacaacctgcctgccccatccaaagggagacccagtgagagggagatggtgctcaccatcagactcgagtcctggtcctactgctgccaggagcagagcatctgccctcccgatgccagtgcccaagctgggtcctaacatgcctaatatgcctgcttccctaatatttacccagagtgggtctgggtagcgttcaacacccaagggggatgccaggctgtgctcccccgcctccatgtcacctgagacggcaggaagcccgacatgggcagagggcagcctggctgctgctcggcagctcagaacttacctcaaggatgaggtccccgggcacgaggccgtcggggcccctggcaggactgtcgtcctccacctcggccacaaacaccccgtgcaggttccctccacataagtgcacgccaagctccaactgcgacttcttgatgaagacgactcggggctctggggtcttcttggtggcatctcccaccatcctttcaggaaggaaaacgaagctcttcaattgtgcacaggaagggaggcaggcgcgaacaaagacgaaacggtggtgacaccctgaccattttctgctcccctctcaggtctcatgaggccccagaaccaggagccagga

SEQ ID NO: 61493 - DNA, 983 bp, Bovine  19866880675134
atgttgtgatctatctaggagatggccaggtccctgcttttaccggtcatttgttccgtggaagaggcagattatctaaaaagcaaataaacggatagatttgaagatagtgaaaagtgctttaaggaaacaagagactactgggaagtgagtgattagaagtgaggatcaccaacataggacaaggggagatggaaagacccacacaaagatcattctgttgaaaaccatgaaataagcaagcttttggaatttctctctctctctctctctctctctcacacacacacactcacacacacacacacacacacacacacacacgagggagggagaaagccctccctgagtttccaagagaggcaagcaggatgagcagcccaaaataaatacagttaaataaagattgattctgaggccaaacaagcttcaagataattatttctcccggtagtgaatcattatggctcacaaatgaattcatcttttcatgttttcagttccaaaggtcccagatagatggattaatcctctttttctcctggcttccttcacctgatcccctcacctccttgaattagaatgaagggccattcattcggagaaatctattaactcacagctcctagactgctggctttccactccgcctggcttgggttctgcctctcatggcgagagccctcacgcgtctctgttgtatcccttcatgtcccctttgggcctgtggctgaggcaggaaagctcaccagttgctacagtggctcctgtgtctttcccagagcccacaattaggagggatgtgggaacctaggagctgggcatcacttccaggaggcaggggatacccatgtggtccagtgcgaggtggcagagcttccatcagcctgggccccacagtgggagtatggagtggaccccaatccccttgtcttcattgatctataacttccggcttctctgggcctcaaggacatgttact

SEQ ID NO: 61494 - DNA, 886 bp, Bovine  19866880678374
gaagccacaaattcagagaaggcaaaatgtaaatgatgcaaaaagagatcaagatccatgaatattcatcttccttccccttatgatggaaaccaggtttgagaaggatcatcgagctccatttcctctgaattcctcagaggaattcacggtcggcttctcttctttctacctgaacacagaacatgaggaagcgttctcgcttccaggaactggtggttacacaggtatgtatatacgcgactgaaaattcacccacctcggtatttaagatccgtgcgttccctgtgtgtatttagacctcaattttaaaagtgaaagtcaaaagactggcagactgattctcatccttcacagcatgtttcaaacgtgacattctagtggggagagccttcctctctcaccactgagaataagtccctgcctcttcaccttgccctgcacacatctctgacatagctcctggccccaaacaaaacaatgaaagtgaagagtcctctagaggctgtttgctcccagtaagacaaacctggggctgattcatttctggatctgcttcatgaggcaaaggcttatagtaattgtttattgtgggaataatttcgaatggtctagaactctgtcccacacaacaggactggaagctctcaaggtctgtgtcttccagctccagggacatctgtgtgaccccagaggggtgaattaacctctctgagtctcagctcctgaacagcacctgcccttcaaggatgctgtgagaattttatcagctaagatgtagtagccatgtatggatgtgagagttgggacataaaggctgagcaccaaagaattgatgctttagtactatcatgctggagaagactcttgcgagttccttggacag

SEQ ID NO: 61495 - DNA, 4060 bp, Bovine  19866880770857
tggaggggggtggggaaggcacctttatctccctggctctcctgtgatccaaaccccaccaagcatcacataatcctacaatgactttgatcccggaaagccccagcccctcagtcctggaagtcaagaacgccccaggcttctgagaagggggaggagatcacaaaagtatttcaaatgcacaaatgtgggttacctttcacacacaaaggcaatcctcaagagacaaagttgatcatgataacaaaagaaggtatttcacttttcttgtgcaaggagaaggaaaaaaaaaaatccacatccacaaccgcagagtgtagcaaatgaaaccaaagcacaccagtccccagagacctcagggtcctcccagctcctggcacactggccacctgcagggaaccctgacggcacacgcactcagggtccttgagtcaatgggaatccccgtgctagcgtcactgtgctgtgcctgccatgcccggccctagcacaaggccaatgcttagttaaagcttgaagagtaacagctggatccttgttctcagttgcacttcagcctcctcagagcttacggggcccctatgccacccagccttgaccttctacagatgtccagaggagacacacggagccaggtgacgtggcgagctggagacagtgccaaggccagcttcagggtccctcatcactacagaaccacacataatagaaataatctgcaaagggctgaattgtgttccctctgaaattcaaatgtcaaagtcctaactccccagaatcgcagcatgtgactctgtttagagatggggtcttcaaagaggaaatccaattaacaccaggtcagtagggtgggccctaatctttctaagaagaggaaatttggacatagacaagtgcacacacacagaagaaagacccttgaggatacagagagaagatggctgtctataagccaatgcaagagacaggtctcacaagaaaccagccctgctgacaccctgatcagggacttgcagtcgccaggactgtgagacaatagacgcccatcgactgagcccccaagtctgtggtactttgttacagcagcccttccacactcatccagttgctaccgtgccaggctttgcacagccctatctaacacagacattgtccacagtgaaagccatggaaaactgtcaaatgaatcctttatcctgggtttccctggtggtcgagcagttaagaatccacctgccaatgcacaggacacgggatcagtccttggttggggaaagtcccacatgccaaggagcaaacaagcccaggaaccacaaccgctgaagcttgagagactggagtgtgtactccacaagagaagccatcacaagaagtccatgcaccagaacgaagagtagttcccctgccgcaactagagcaagcccacacgcggcaatgaagactcagcacagccaaaaataaataaatcttctttataaaaatgctatcctacttaaaactcacacactccagaaaagggatactgctattagcctcaatttatagacaaggttcctgtagctcagaaagatgaaggagccagacatagattattcagctagacttggaacaaatgtccccagttctgggccctgcacctttacccctgagctgcctctaagccaaaccctgctccctctgcctgtcccccacccactcagcagctctagtattatcccagaatggccctgcccacccggaccaccgatgaccaccatctgagaccactgccttcctcgtcaccctcaggcctcccaacagccacttaaggaaactctgttgtctaccatgaatagttctggtgtctttttttcttttttaaatgaatactgttttcatcatcaggaaaaaaaatattcaaaaagttaactctgttaatgaattctatagactcttcagcctgtgtgcaaataaataaatgatcaaaaggaatatctttggaaacacaattaagaataaaaagggggaaaaaaataaaagcaacctttgccagtgtcccatcagccaagatgagataagggactcacggggcaaaaagaagaccgtcacggccaataaccctagtcagcccatctcccgaaaacatctatttttaaaagcatgttccatttcatcacatttcagaagaacaaagaagagaccttgaggggcagacaggcaggctccaaagcgaaatgcagcacgctcacagctcacagcagcggtgtggtcgcccgtggccagacagtgattttcatctgaaaaatgcgaatctccagtgacagatggagctcagatacagagctaccatcagcatgcagcccaacaaagcgccaattttcatatctcctagggcctgctgggcccccaacttcttagtttaaatggaaactgtcagaccagattttgtgcaaacatgcgctttccttgggggcaaacattctgagtctacaacctgttctttcattttcccagctttctgtccatggcaacaacatcaaagatgagagaggcgggtggggagggctgtcaggagcaccagagaacagagcaaacacgaagtgcagaagagctggctgaataaccaggaggcgacaagcagcaggcgcctctctacgctgcccctcgctgtcaatcacaggcagacagggcggggccgcatgggaagagagtgccccttcttctgcagctcctgcgaggatgtaccagtctgtgttagcacagcttccctcctgataagctccaaggtcctggagagggaaatgacacaacaaaatacgcgcacaagcaaacacacacacacacagacccacacatacagaactgctggggcggggagaggcgaccatgcagacagtgaaagcagaattcccattggaacaggattaggtgacggggttaaacgtatgactaatattcacaggaaaagctgctggacactgtttcagctgctgataccaattcttctgaaccactttaaaacgccagtcactttttcattctaagcttattcattagagcctctttaaaccgtctcaaaagacagacaggcttctgcccaaacccaccttcatgccatcagcatgcttcaggcagatggaaggaattctgaggcagggacatctgtaaggaccattccagcccctgttactaaatgcatcttcctctaaagtttcatgcactaaaaacctcgttaagccaagtcacctactacagaccgcattcctctgaggtgtgtggtcttcaggagcctgcatggtgtgtctggggtttgtgtttggtgcggagtgatggagagactccctcaagataactgaagaagatttgccaaaactgaaacacttcaatcttccagagtctcatttccccagtgtgtctgcatctcaagcagacatgtcaaaacctggccgtgaggaaggctcacagcccacaggcaacctcccagacctgggcctgtgccaggagagtaaccagtgaggtttctcgatacgggcatgataaaaacactaggaaacatcatttttaatagcaaccaaaaagagagagcagcaatccccaaaactctgcgtaccccagaaaaacaaagagaccttgagaggcagacaacaaaaatggagtctggggtgggtctcccagctcagagcctgctgcccggggccccacccagcctggaagcctgtgtgcagtcacctctcccatgctgacggccactctgtccactggctcaccacaaaggccacttgtttcccatgagtgcccagaacagcggctcaaccagttggcccggtcggggactgtggtcctggtggatgggtggtgacagggctgctgtgacctcaacagacaattagcaaggtagtgttgagtttccaagctctggcaggtcacctaccaggctgggagagcatataggagtcagcttgcagacccaggaaggggtcaggcagggtcagctgcaggctatttcaactccatgcctgtccctccacactaagcactgcttcctctgacccggctgggggcaggggggtgtgcaggagaa

SEQ ID NO: 61496 - DNA, 1769 bp, Bovine  19866880791416
attggagtgtgaaagacattttgatggtgatgcggaggcgaggtgatgatttatttataatcgacaaggttgtatccatccagctactggaataattatatactttagaagcgcacactcactgtgatacaaaaagcccctccatgcattgaagatgggggccatcaaggggaagtcctgccagggaaggtgctgtgatgccaccatcctatgacagtgacattgctacaagagctatcggccaccggccgccactaaccccaactatatattagggactgaatgatctctcagttcccttctaaaaatgaggccttttcccggagtaagtgtttagtctccatctgcttctggggatgttttctcatctcaatgcagggataaagaaggattcttcatcttgtatctgatcttttgtttctgttttgcttatttgggttgaaggtccagctcctggattctccctaactaagatgctaatgaagatgtggggcaataatgacatctcattgaagggctggcagaaccgagttcaaacctgagatttgggaaacatcctttatcacctgcaacgtcctcatctggaaaacagggatgctggcacctgtctcactgggctgccataaagacaaaacctggcacaagagaaatcctggtatgtactaaaaattcacggctgtgacttcaggtgaaagaggacctacatgttgacactggctccttaataactggtgggtccggcttgttctgtttgtttggagaccaggttggcgcctgtgaccactgcttgcatctccaaaggctcacaagcactcagcttaacaatccaatcaaaaatttattcccagggataagccacaacatcattagaatagaaattccaaaattcaacttctaacacccactagaaatacgagctagaatgaaaagttccagaacactagaggtattccccacaatccaaagactccccagaggaagtaacagggggtgtatttacctcacaaaaatcaggtgtgctatttgaaacaagagtttgcagacactggagctcagacagggcaggacagtgacccctgtgaaacaaacaaggtgaatccatgaccaccccagccttcagcctggggggtatctgggccacagctcagagcaaagggcccaggcagagcccaggggtcttgctgagttgaagaatcagagctgggattctagggaagcccaggcacctagagttcacaggacagagcaccagagaggagaaagctgcccagacaacactctgaggatcagcagagagaccttcttgagtgttcagttaagtactgaatacttagtacccaaggtgggggacagaaacaccctgaaggagcacagagaacagcccctggaactcacgtggggccgggaataggtcatgtcccaccagccagagcaggaaagttcaaaaatcaaaatactgttatgagctgaattgggttccctcaaaaatccctatgttgaaatccttaaccctacccccttaccccatgcatctgaacacagctctatttggtcattagggtagaccctaatggaatatggctgatgccctttttatatttatttatttatgtttttatgactgtgctgggtcttcgctgctgtgcaggctactctcttgctgcagtgcacaggcttctcattgcagtggcctcgcttgtggagaacaggttccagggcgtgtgagccgcaggagctgcggtgtgtgggctcagcagctgcagctctgg

SEQ ID NO: 61497 - DNA, 2027 bp, Bovine  19866880795563
cgcaacaacacattttcactttcaacacctgggatgatttcactttgcagactttgctggaagaacccctatgtgtccagtgccttgaagagcgtctgacactctcaggtactccaggaatacttgaaggaatgggtgaatgacttggaggagagtccgggcatatacagtagaacctgtgtccttctcttctggtgacttaacacaccttcttccatcttcccaacagatttggggttgctgcctgtcaatggatggtaaagacacctccctatgtcagaaggtactggcatgccttctgaaaccagccctgtgttcatcagcctcacccacatccagggaggactggatatggggaccacagtgagcacacttgtccctctttcctcaagattcatctgtcagcctgccagggtttcctgtgacacacgtgcctacaatgtacagttcccagggagagcccagccagccctccggcccccagccggctcaggatggctgtatgaagtgagaatttcctggctgacttgacagtgatgagtcaggctggcatgagccagcttcagaaatgacagggcctgaattgtgtgcatggaccaaatatcatcggctggctggacccaaacctgggtcctggaatactcagaccccatttagatggccatgcccagaggtggctcagcactcttaaatgatgtctgagtttggcagtgtctgagggctcctccattcctgtcacaggagaggatttatcctccactccctgtccctgtgtgtctccacaccatcatgtttcctccatgttatggtgaccaggctcccttaatactaacaaaaataataatagcaaatgcttattagcactaaccacataacgggcactattctaaacattttacatatgttgatgcatcaaatcctcctaacaacatgaaaaggcagatgtgcactgctatatttaaatgaataagcaacaaggaccttactgtatagcacatggaattctgctcaatgttatgtggcagcctggatgggaggggggtctgggggagaatggagaatgtgcacagatctacctcattctttttagtggcaacatgacattttatcatatggttgtatcctattttgtattaccaatatttgctgcatgaatattgttatttatgtttcttgtatgagaatatcatacagtaaattccaagtagacaatttattgtgtgtttccattttgaattttgagagatattgcctcctgcaaggttgctccaacaaaacccccaccagaagtgaacagtgtggaacactggttcccgtacctatattactgcagtggtgcatttccatatttgcccatttggaagataaagcagggtatgatattattgttttgatttgcaattctttaactacaagaggagctgagtccattttcatgtccttactggacattcagattgtgtcttgggtatctgcatgtccatgtgctttgctcatttttctagggagttattcatcttggtctttttcattctaagcattccttataaaagaacacaattatccctttgttatatgtctcccatgttattattaggaatattttcccagaattccatgtgcacagggatttaatgcatgtgtgtgctaactcacttcagttgtgtccgactctgcgcatccctatgaactgtagcctgccagcctcctctgcccataggattctccaggaaagaatactggaatggttgccatgccctcctccaagggatctttgtaacccagggatctaactcacatctcttacatctcctgaattgataggcagattcgttaccactatcgacacctaggatttcacaattcttattaaattgtaggtattcttgtagtggtttgctctgactagtgagtttttccccactacaatatattttttaacacaaacatatttctagcacttttttggctcacattttagataggaatatttatttaatttacaattcatttttgtttgagaagta

SEQ ID NO: 61498 - DNA, 3376 bp, Bovine  19866880865030
ttgagtcgtggagggaagtggacaggacacttacttctctgtctttcttaaggaaattagggcacttgaaagctcaattaaatgtacccaggcctcttaagcactggggctgtcctttttgctcatctaattaactgtagttcacaaaattggccccgtgctgacatggaaggctctacgaaactgaggagccagggacctgtttgagtggaagctcgcttcctgcttcacaagcctccggggacacagatcttacctgaggacatccaggttacctgtgaacttgcctcctccctgggcaagcagacctctgggccttccttgtttgctggaggtgagttaatccagaaagtaaatggactgggcattctggtttcttgtagctatggaaaagccaggatccagcacattacgctgaaaggttgaaaaactttcaccttcccagactgcttttagtgaagaggctgaattttgatcttttccccatttccccatttttctcttttcagcaatttttttttcctcttcatttcatggtggctgttgaggaagcaactgtccccagggaaacagggagcaagcagctcacggaaaaggagagaggaagacaaggctccactcccacatcactctccctcaaatattggctttgcttatactaaaaatagcttgcaacgaaagctgaatgacagaaaagtagcatttcacagggcagaagctaccggctccctgacctccacagggacctgctgattctgttagcctgtgggcttcaacttgcccaggaaggggtggggtgcagaatccctctgggaggggacaacctgtttccttctgtgtcatgctggatctctctggagttagttctgtcagtcaggcattcacagagccttctgccagggcttgtgccccaggagtgacagataacttcctgcaatggagagtggctggtttcaggggctgcttgttcccacaggcccctgtgtgtgggctcctggagaagctgccatgaggttactgtctcccccaagccatgaggtgggcagtatggcttctcaaccactttcaacctctccaggaagaaagcttacatcctcaggaaggaggaaatgagtttactgacctagcttcatgcaatgtatccgtctgggccttggggattggtgatggtgttttaagatcaatttgggatatgagagcagaggttaccatcacttcctttcatctgaagaatggtgaacagcggaacactgtgttcttaatccgggctctgccataatctctctggtgaccttggataagtccattccttttcaaggtcttggtgtatccatggataaaataagggggactgtgaagaaagctgagtgccaaagaattgatgtttttgaactgtggtgttggagaaaactcttgagagtcccttggaccgcaagaagatccaaccagtccattctaaaggagatcggtcctgggtgttcattggaaggactgatgctgaagctgaaactccaaaactttggccacctcacgcaaagagttgattcactggaaaagaccctgatgctgggagagattgggggcaggaggagaaggggacgacagaggatgagatggctggatggcatcactgactcaatggacatgagtttgggtaaactccaggagttggtgatggacagggaggcctggcgtgctgtgattcatggggttgcaaagagttggacatgactgagcaactgaactgaactgaatagtctgttccctggcagttcaaattttgttatgttttctcacttcctctactgtcctttattcagcaaaggcagcaagtggtgcatttggcaatgagctcagcacttggggaactggaaaaggagaaagaatagtcctttatcagcttccagagaaactggagggatgcagaaaatagtcaaggacccagtctcctggccctgccctggcttggcacttcatttaagacaaaaacaaaaactctccctgtgtcatcaggcctctgcctccctctcatctcttaggattattttcctcctggactcctttccaggcgtatcaccatatacagagagagaagcaggtggcaggaggagcagggcctgtgaccgtggagttgggtaggaggaaggatgcggtgggaggaggggtcacatcccaagggaccagttgctcttggaagaagtgtcttcctgtaaaccacttccatcttggatatccctcctctagttgtctcccaagagtcggaaacccccgaggggatcacgttctgatttagtaaccccactggcagcaaagttgaactgaagagccttctttcccatggagcagccttttggagaccctcggggaggtctgggttctgccctttgctgtttgcattgctttgacagatgtcagtgagagtcccagagttcctggaagtctgttcctcttctgggcagagggcagagggcagaggcagctccatctcttgatatctgtaaatgtttcataagaggcacatttatttaaagtcatgaccgacagagacacccaagaggtgctgaggagcgaggagacatgaccgtggcaagagtcattttttgtttggggagcaaggtagctgatatacctgtatacctaatatacctagggggttgacaggagctgccaggcatttagcctccaaattacagcaaaggtgtgaatactgaggttcttagtgggtttgatgttgcagagtttcccctaaatgaagctttattttcagtaaccttctttgatgaacttgaaaaaataaccaccacagaccctcaactggccgtctattttgatgtttgcaatttagttcaagaaaagaccgtccatgtccttgggagtaaggactgagcccttccttggatgctaaataacaaaacatcattgttcctctgatttgtgcaaactttgcaaacaagtagaattttctggtagcttttcctaggaagttacattgctgaagcagattttcgtagcttcctggaccaggaggagttgttgtgttgggggctcagggctctctccaacaaatcaacctcatagagacgatgcagcaaaatacccttccagcctccaaagatgcagttcctcttccccaggttatggtggagagatccagatagaatagaaataaataagtaacttgattctctttcatttaactctcagacacagcctctggggctaattatttctgctgtggattttgtcagaccttgaatcgcaatccttttgccataggtggtatattttagaaatgcaaaatgacatgaaaaacaatcccctttcctgaaagacaattttgtgtacattaaacagacacattaagccattttacaag

SEQ ID NO: 61499 - DNA, 1369 bp, Bovine  19866880919556
cggggtgggtcgtgtgacccagacctgccccatgcagtgagcaaactatcccccttcccatgagctgaaacggacaggaccaggggcagtgacccagctctgactctgcagatgacaaccccacccccaggaaatgatagagggacacgagacaaaagggacttggctccctgatggtccccagaacagagctgcctccaagggactacctaccaacccagacttttatgtggcagagaagcttcttatcatgcttcagccattgttatttggtctcagttacagcactcaaaccaatatcctagttgatacatgtagttaagtctccccttccacaaaatgaataaaaaatgctcacagaaagagatagcctaaaaccagcatgcagatatcttcctgacacctcccaggtaccaatcactgtgctggcaactcagaaacacttttaaaaacttttaaaagaatagcacagacccagggcaaagaacttcctccaagaggagataataacatccccccttttaaagctttgaccatgacaggtaagctaggcatcctctccaaccccctttctccagtcttggtccctggcagcttcctctcaactagcatcattgctggttatgaggattcaaagtatatcccatggacagaggagagtggcgggctacagtccgtagggtcacaaagagtcggacacgactataaagtgtatccttttattgctcataaagcctggaaaatacgtatgtccaacaaaaaacgacagaccataaatattctgtaagtccctcttcactcagtcttgcgtttctgttgaaagcatccctgttgactcacactgacccccttttatcctttgtaacatcctaaaacgtgaatgcgctgcacctaccatttctctgtgtatggacattaagaccatgtcttcagctcaacagaatcgtcttctcccgtagtgactattaacattccacactgaggggcaccaatttagaagttttctgatcctctcagaataatctgctttgtcagaagtcctcataataacagaaccacagggctccaaagcctctcacaagcacaatatccaaccagagtcagaggcccagagaaaataaactccctgggaagggtaaataaaccaacatataatctggaagcaacctaatggaggtatgtagactccttttaaaactggtacggatattaaaatcaaaagcataaaagtaattatgtacctaatattcagataatataacaggaggtaatcagtgtcatccataacataaaggggtggaggggaacacagagatgtagcttttatataagattgaagctatcatcagtttaaaatgaattgctataa

SEQ ID NO: 61500 - DNA, 844 bp, Bovine  19866881012402
agcatgtttttttttaagtcaaaaagaaacaggtgaaattaattttaataagagtttatttagcctagattaggttctggtgagactgtcctaaatactaccctttcaagatacaatcaatataaaaattattattatcaataatattttggagtcttcctttcatgttaaaattttgtactcaatttgtactcaaagcatatctcgatttggactggccacatttcaaatgctcactagccacctagggttagtggttcccatgttggacagccatatccagttcttctggtccatgcacactcagccagaccaaggccatcccaggggagaacaacaagccatctgtttacctacgcacatcacccaccacctctctagggcagtctgtgattcactgccagaccctacatggtgtctgactctattagtcctagatcagcatctctaagctcccttacccccaattgccatcatcatgatgacgtcagcacaagatctaggccctgaaggagagcatttcctggtggggcaaactttgtgcctctggtcaattcacctgtgggttcgtgtccaaactgtgagggtgacctcagcagtgcaggtggagacagcacctacgtagccacttgagcacccccgggctaagccagtaataaacaaacacaggcctgcctggaaagaaggaagtgtgcgagcagaattgaggcaagcgatggttgccatggaaaccagccagcctcactccagactttcccctgatgtcttgatcattattccgtggctgatgaagcccagtagatacgaagcactgtccctgtacccacggaaaccttccaaaggt

SEQ ID NO: 61501 - DNA, 1174 bp, Bovine  19866881079984
atgtaagactggaacaggagggagaacggaacacaagggagagtctgcggttaccagcatggctttcctatggcttttggagtccagggaaagatttagtatgggttattaaaggagtattgacttggatgtgctgagcagttggaacgtttttgtttcctagacaagaaagcacactcagctttgtatgactggactttaaattgctcagtgaagcatcacttggtgttggcctgagtctgtaaagacccgcaatttgggaagaacaactgttgtagtattctcatgttccagggatggttgtggagaatagcaagttctatcagtcaatgaaagcacattttctccggatatccctactctgccttctttgactcagggtcctgtaaacattcctgtggggaatgggagtacatacccaagggtagtcagtacatgaatgtgaccaagatttgagtccgtggggatggagacaggtacaactgtgcagccatgggggtgagggatgagggcagagccaaggcagaaagggagtgcctccctcattcattgatccagccagcactgactgagcacccactgtgtgccaagtgttggcacattcattgatccagccagcattgactgagtgcccactgtgtgccgagtgttgttccaggcatggacataaagcttgatggaagagaatgatgactggtgatggatgtgtcaagcaggaccactcatcacccctcatagagtcagccatgggggctgcaagacagaggggagggctcgcttccttgggagttgaagacctgtgttgtatgataatgcttccttaataactctactctcagagccaatttagttggaaaagcactttactttcttccttcgttccctcccgtcctagcctctagcaactggtatttattttgcctctgttccccagcctgaagggtggacacaggcatgaaacctataacttcatctctttggattcagtttctgaacagagagagaagggggtcttccagatccatagtcagccacgttcttctccggggaggcgcatccccctgaagccttggtttttctttctgaacgaactaagtccatgatttcagatcagggcagtatcacctggtaatggggagccaggaaacctatgcggagaataggtacagttcta

SEQ ID NO: 61502 - DNA, 830 bp, Bovine  19866881139627
tactgaaggcgctgggtccctagcaggtaggggcttatctgctttccatggccttcacacatgtgccaagttcatgtcaggttgctaagaaatggtttgggtcttactggcatgtggtggacaccagggtttaagtggcctgtctggtgtattgggggtgttgggacctggtggaggaggaggtggtaccttggtgggagttggaggctggctgggctcacagtgttgggggcatttcagcacactccacagccggctcctgagcgaccagacccagctgaaggatgacgtggatatgctgaggcgggagaatggacagctgctgcgggaacgcaacctgctccagcagtcatgggaggacatgaagcggctccatgaggaggaccagaaggaaattggcgacctccgggcccagcagcagcaggtacaaccgggctgggcggcgggagcagaccaaggtcaggcatccacctgctcacagtctgttaccagcccccctccacctactcatctgcccacctacccacctacttgtcttacccacccacccactcaccatccatccattcatctacctacccacccacctatcacccgccatctatctatgcgtctgtccacttaccacctacttatccaccacccacgcatccgtgtgattacttagcaagtatttctggtgtctgctttttgtgaggaattgggctatctgtgagcaaacactcaacccttgtggtcctggactctgcagtctgatggaggatacacatgttaatcaaataaccacacgcactctgcatcattatgaatgttgccagggctaacaaggg

SEQ ID NO: 61503 - DNA, 1564 bp, Bovine  19866881207226
ttggactctctcatcaaggctacaattgctggtggtggtatgtaaatattaacttataaatttctctagagaaaagaatttgcttttaaatttccctctagtaattttcagtctaaaagaggacacagtatattttcattgatctgtagtatggttgcatcatgaaatttgatttctctatgtatttctgaatttttactctgcacttagcctcacattgaaagacatcttcaaagttgaacattaaacttggttttaaagtgctgtgttattttatccctcttctaggtgtcattccacacatccacaaatctctgattggaaagaaaggacaacagaagactgtctaaaggatgcctggattccttattatctcaggactctaaatactctaacagctgtccagtgttggtgattccagtggactgtatctctgtgaaaaacacaattttgcctttttgtaattctatttgagaaagttggaagtttaattagctttccaaccaaccaaatttctgcatttgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagctcaataaaggtcatatcccaaactagttgtgtataaaatttgcttgattatagtaggaacagctttgttgaataggtatcttacctagcaataacttaagcacatttcttccctttaaattactgttaattctgtctgtagatcaacaaagttaaaaggcccgagtatttttttttaaatactgtgtaatgaactattaaaagattttaaaacttcagcacaagttgatgttttttaggctcagtttaaccatctcagttcattagctttgattgctgtttgtgatagcggcactacaccagagcactggggggcttgggtggggttgggagcagagaccagttaggaaggtcctgtatgtagctacctacacagaagggacttttcagtttagactgataattgtagtgtgctacacgctgttttgaaggttacttgcgttaaattgttcagtatatggtaacatctttggggaacatactattcacatttaacagagaagaatcaagatttctttgaaagtcctgagttactatatttgctgctatagcagacaatatctttactgaacaatgtgtgaaaatagttactttgtaattaggttaagtggatcattttgacacttagtttctggcaagttcttaataccaagcaaaaagtgggccctttgcctccactgaggataccaacctggcaagtatttcacaaaggtgatgattaaaatgggagaagggagaaaacccaagtttacctatatgaggtaatacattgccaaagaactgattcctgtcctttctggtcatggctactagtgtttttattttcaccagaataagtgcaaactacaaattaagtgtttgta

SEQ ID NO: 61504 - DNA, 989 bp, Bovine  19866881260969
cctttctttcccccttccgccccctcttagctcaagttgattctgccacagtccctgagttaagcaaatagtttgttctctggcaacttgtcctctatggggctgggctctgaagaggatccaagggtatcccttgtggtggtgcttccttgggggaacccaccgtagatttggggctgagtgagagacagacatgggtgctctttcctccgcttatgcggtgagatggggagggccggggatttgggccccaggacctgggcgcagctcttgccttccccgctgatgcgctgtgtggtcctgggcaagttgctttctctaaaccttagcttccttggttgtaagatgaagaccatggagaaagttctacccagcatgtgacaactagtcaggtgctagtggccaccacgtttagtgtggatccaggtggaatggtgtcatttagccgaagcggatacattcaagcccaccgtcaagtcaccctacacaaagtgctgagttaggtccaggatggagaccagccctggagaattacacattgcttcacttgtccggctctctggctagattgtaagctcctaactctcgatcactcaggatttggcaggtgctgggctgtgaacttcacttccctctgtatccccagaaccaagcacgaaacctgatacaaagtgggcacttggtggaatttggcgaatgaatgaacacaggggcattcaatagactcttgctgatgaattgactaatagtccccactggttacatttatattttgggcactgaatctctttgttgtctgcggcttcttgagcactgagggtatttaattatcccttgaagctgaggttgaacctttcaggacaccttcaccaggacgagacccggcgcgcgtccaggccccaggcggcggcagcatgtgggtgcaaaggaagcctctccccaccctgctttccggtggcttggcctggggtcctgaagtgtctcacgcc

SEQ ID NO: 61505 - DNA, 1409 bp, Bovine  19866881328738
ttttcataaaaaaaaattctgtgtagtccttgacactgtagttaattttgaagggtattatggttagagttttatttaagagactctgtttttgcagctccatatgattaaggtatgaagaaactgttttatgtattttgattttactgtttctgacaacatcttcccgaggaagtatacttttgtgcaacagactgcctcggatgctaattctaaatttagaagccgccttcaatgggtgctgaaatcagtcacacaaaatccaggtgcttacttagaaatctgaatactcgggaggctggccaggtctctggtggagatttgggcagttgacctcttttaggaccccaggactgttaggatgtggcattatcagctgtggactaggctctagacaaccacatcaacacgtattaattttgcagggacaatggacacaccctcaaaaccccaatccgggcccttggattttcatttcatttctgtcacttattggccgtgtgaccttgactgtgatgattcacgtggcagctttggtttcctcatcagtaaaatgagcgcgctgaattgcatatgctctagggtcctttccagacctccaaccctgtataaaacaaattcaaagattcaagtaagagcattagctcttttttacctgggctgtttgtagtggtcaaaaatgataacatttattattatcattgttgtctgtactgtaccgcatgtgggatcttagttgtctgactaggaactgaacctgggccccctacattggaagtgcagagtcttaatcactggacccctgggaagtgcgatagcattttaaaaaatgcccctgctggttaaaatagccatttccctaagctctgtgaatgccttcctccctctggctccttccctgatagcatctggacctccccacaaggcagctcctaaaggcacaaggcttggcactgcagagggtcttcagtccaggcgcctgaccacctggtggagggagcaagtcacatagccttgcttacctcaatccattgcctgcaacatggggattataactgtcatttagtcgcacggtcatgtcttgactctttgtgaccccatggattgtagccccttgggctcctctgtgcatggaattttccaggcaagaatactggaatggtttcccatttccttctccaggggatcttcctgacctggggatgggaaccctcatttcctgcattggcaggtagattctttaccactgaaccaccagggaaggcctggggattatgatagcatttactttattgagctgagggtgagattgaataatatattaatatatgaaatgcttaaaataggataaacgtaaaagacgcttgctccttggaagaaaaactatgaccaacctagatagcatattg

SEQ ID NO: 61506 - DNA, 2457 bp, Bovine  19866881336723
agtcagtcctaaggagacagtgcgtgatgtgaataaaaatggacacatacagaccttggcgtagcctaaaacagagaaaaactgaagctaactcaggaccaaccatagggagacggttacacaggttagccatctgttcaagtagattgccatgcatctacttgaaaaatgaatatgcatcacttaaaagcatattttcaaagaactatcaatgagatgggaaaggatctctctatgcgtctaaattcatagagaaaagactgatatgaaacacatccaaatattagcagcaatcgcctctgggatataatagttcctttcatctttatgctttaaaaattgtgatcaaatacaaataccataaaatgtaccattttaaagatctttaagcggacagtcttctggcattaagtatatccacactgttgtgccaacaccagcactaaccatctcaagaactttttcatcttccccgactgacaagctggacccattaaacaactctattaattcttccccaccccatcctcactccagtcaactacctttctacctcttctctctatgaatgtgaaaactctagatatttcatataagtagaatcacacaaatgtcagtgcttttgtaactggcttattatacctggcatcatatcttcaaggttcatccatgttacagcatgtgtcaaaacctttttcttttaaagctaatattttgttaatccattcttctatcaacagacacttccacttttcagctatggtgaataaagctgctgtgaacataggcatacaagttatctgtttcagtcttggtctgcatttctttggggtatacaccgaatagtggaattgcgggatcatatggtcattttatgcttcattttttaagcaaccgccaccgcagctgcaccactttccattcccaccagcaatgcacagagtttccaatttctctacatcctcaactcacggtttttaatttttttttttaaagaaaagtcatcttaattgggaatgcatttttatggtttttttgtattttcagagttttctaccaggagcatgtgttatatttaagacagaaaaataattaatgctgtttttttttaaactgtgctgaagaatggctcatcaaatgctgcccaccccatctattatcaatgctgcagggctcaaagcctcctccagcctcctccttcacagcgtcaactcacagccatcacttgaggttctggttttctgctctgaaagtggctcctgccttcaccctctgcgagcttcatgaggtcatacagataaagaaagggatacgatttggggtccacacagtcttggagtgaaatcccaacttcactacctaccagctatcagacaagcaattacacctctctgtgcttcattttcctcattaggtaactgagacagatggggtcaatgccttaaggctgtagggccttgcactctgcctgccacagaggaggtgtttgattaaaaaaaaaaaaaaatgatcccccttcatttctggaatcattcgtagcttctaccgcaggaaggaacacagcatacctacgagtaaacaccacttaattgactgatggaaactcatcagtgtgaagatttcaattcaaacacttatagctcccccagaagcctccagagagtgcaatgtttaacaaacatcagtcctgggatttgcttgcacaaaaaggattccacagtgaaataagtgtggggaacataaacattagtatctccaaaaagagcaaaagagcaatcaacagttttgttgttgtttagtcactaagtcatgtctgactcttttgtgaccccatggaccatagcccaccaggcccctctgtccatgggatttcccaggcaagaatactagagtgggttgccatttccttctccagaggatcttcccaatccaggaatcaaacctgcatctcctgcactggcagacggattctttaccactgagctgcctgggaagcccagtcaacagttaaaggtctgcaataaggaaacccacggttctcaaacatagtgactacagacatctggcctaacatccgctaacatcacatagaactaactttggaagatgatgctctggtcctccttccacctgaaacatccagccttggatttccaaaagcaaactccggctagtatgttgggatcaatgtggactggtggtctccaaactgagaaagcataagactcacttggaggatttgttgaaacacagagggctggatagattccagcctcagattctgactcagcagacccagggtcaggtctgagaatttgcatttctaatacattctcaactgatgctgatctgctcctccagggaccccattttgagaaacactgacaggttaaaaaaaaaaaaaaaaaagcctcatatacaagttaaacagcagacatagatgaaactgtctactct

SEQ ID NO: 61507 - DNA, 665 bp, Bovine  19866881701350
tctcctgcatggtaggctgattctttatagtctgagcctggggaagcccttgtgtgtgcacaggtggccaaaaatgcaagctgtcacatacagaacacccacaggccgatacagctcttttactataggtgtttagagcatggaactctgtgtggctggattaggagaggtggggtgaagtgttccaagttgagggtgtccgtttgggcaaacgtaaggggaggtaggaaagcagagagccagaagggtgccaggagcagttgtgtgggaatgctgggtgtgggaagctaggttggggactttggctgtgaattatgacctgtgagctgtggggaggctctgaggggtgccatgctcgtgggggatcatttcagactctgctggcccattagcagttgagctgtcgtggatgggggcgacttctcattcattcaaatctgcgcccatttctgatgaacagagcggtattcacagagggagggaccagcagggcatgtgggatgctcgcccagtccctccatctgctatcccaagaggctggcccccaggccctggacgtgtccaaggctataagcttattgcctttcagctgctgtttgtgtcacacatgcctgtcccacaaggggcattaaaaatatcccagtggctaatagcatttctcaaaa

SEQ ID NO: 61508 - DNA, 777 bp, Bovine  19866881947151
gaagcacacagacaacctcaaggatgtggaaacagacctggatagttgaaccaagcctgactcttaccactaaatcattgtgttcctttatagggcatctccctggtaatgaatccgcctgaaatgcaggagatccaggttcgatccccaggtcagaaagatccactggagaagaggacaacaacccactccagaattcttgcctggagaattccacagacagaggagcctggagggctacagtccatggggttgcaaagagtcagacatgactgaacgactaacattttcgtttttcatagggcacccactgtatgtgcctaccaacccccattcagtcctccagcgaccatgaagatggtgtcaccatcctctgtgcaggtgagcccggagaggttaaggatcttgcccaaggccgttacttgcagtgtccagtggtcagttcatcaatctagtcctagaaaccacaccaaacgtttcccctaatgagtgcccgtaactccacaaagaaatccagcccagcctggataatccatcagagccaaggaagaaaactcctctgtcaaaatgaaagatgctaatagcaagggtgtttagcagcaagcattcaaatttccattaaaaaactccctgtacaaagatgaagctgaaaaaaatcatactgaatctgcctcttagaagccagtacctcccggaatcaggacatctactaaagagccctcctgctttcccaccgacctgccatccccaccctgacttattaaggaatcatgaggg

SEQ ID NO: 61509 - DNA, 994 bp, Bovine  19866880357435
cggatgcgcgaaagccgcagcgaggacgtgatgcgcatcaccgtgggcgtggacggctccgtgtacaagctgcaccctaggtgagcccgcgcggccttctgccggtccaaccctggtccagcctgccccttgtgagtttgcatccttaggggagaacccgggcgttggtctccatctatgatactcagagagggaagctctccgaggtcccgagaactcttaaactctccgaactcccttggcccccagacacaggaggagggttcccttgttttaccccctgccgtgcattcagcgcggtaccggcagccaagcttcccctctacgcagcttcaaggagcggttccacgccatcgtgcgcaggctgacgcccagctgtgaaatcaccttcattgagtcggaggagggcagcggccggggcgcggccttgatctccgcggtggcctgtaagaaggcctgcatgctgggccagtaagaagaaaggctgcaaggcaggaaggaagctgtggccggctactggacctgggctccaggggacactctccttacaagtccccccaacctggcccaatcgagaggcttctccttctgaggaccttggatgcctcccatcccagctgtcacctccagaagatgggggaaagcctctggagaggttgccgagggcccaggcaggctttttctctcagggtcagttggtgagatagccctagggccctgactgggtcgggagcagaaatgaacaggaatgcagaaccctcaaagtacctcgccttttttgctggaatcaaggacccagaagggagttattcactcaggattttgttgcatttctgcactgcttgtctcttggagctttcagcctggctcaaccctggctctgagaagggggtgccctctggaccctactatggcctggcttccccatgagctcagcctgcatggggaggcagccctcatcaccggccagacctagaccggattccacaggggc

SEQ ID NO: 61510 - DNA, 864 bp, Bovine  19866880368288
cttcctatgccagcggtcacctgctgcaacgggggaagtccctgctcatctgtccataggccctctttttaaagactaatcttggcatctctcattatttccggttcacagaggggcacacgtgtctgagctgaagaaagaaacgagccagcttatgaagagattgtcagtttgcttttccccagaactgtttaaaaacaagcccattatctgcgggccggccccatctgccgcatggtcgggggaggggcggtccttacagctgctggccggggttcagggagttctcatccaccacacggtcgtactccagcaggaactcgtccagctcgcctgagtccccgaaggcgccccactcggtgttgacacacatgcggccctcgtccccttccaccagctccacgttctgcatctcctccatgtagcaagcgttgcagcccgtgcctatgggaagtggcatcgtcggatcccacctgggatgccagctgtcctgggtgcatcgcccctgcaggaagccctgtgtggccctgtcttcccagcttctttgagccctcaaccctcaccactccctccatctccctgcagcaaaggaaaaccagctctcccaggagctggaaggtctgggtttgctgtgtgacctcaggtagataaacccacctccctgggtggttcttcttccccaaaaggggttggtaacacctactccccctgttacctggagttgagagaagtgagggaaagaatatatgttaaagtgctttgccaattacagatgggtgtggaatgttatgattttgtcttgtctgtgcatccctcttgttttctggcactttctaaacatttatttgaactctggctcagctt

SEQ ID NO: 61511 - DNA, 1095 bp, Bovine  19866880786782
acctcaggtctgagtccctctcctctgtctgggtgaagggcagagagagcaagttcttgtctatactcagtgtctcgccaccagttttctaccaagcttcgttacacaacttacactgactcaggtagccttgcgaaaggaaaagggtgttcctcgaggaaacgcgcttcatctcaacatgaactaccatatccctggaagaaagaagcgtactgactacagtagggtactgcaagctagtctgcccattaagggtgttgcccccaaagagttcacagggaggatgggtactctgggtactaagcatggagggatcctgagtatttgggcactgagcgcgcatgcagcagagaaacctgtccattaagagtgtcaccctgaagagcacagagaatagaaacgatgagtgctgagtacagtaaaggtactgaggatagtggaggtactaagtgctggagggtaattcactcagggttcacccccgaagagcgcagggaggatgggtatgggggtactgaatacacaggatactgtgggctaagccgctcctcaagggcgtcaccccaaggaacacaggaaggatgagtacgacagaggagtactgcaagacagaggggtactgcacagtaatctgttcctcaaagggtcgtcccaggggcgaagggtcagtccggacagaagccgaccagcgtcttcgcgctctgggaaaaacgaatgcccacaattcacagctggttcttcaagggcgcgccacccttccagccgtccaggctgggagaggacacagcctgacgactcccacgtgacgcctcctcgaccttgggggtcacccctgccgctgcgcccgttccctcacatccgccgcgcagcccacccctctgcccatcacagccaatggcttgccgctccgcgccccgcgcgacctctgcgctcgcccgcacccgccaatctccgcccgccaggaggcgccccctgcaccattggctgccacgtccgtctgtcaggctccgtcccacccacctacccccgtcagccccgctccagccagctccactccctgtcaccggggcggcggcgacgacgagggtgcggcgg

SEQ ID NO: 61512 - DNA, 1305 bp, Bovine  19866880911809
tgtgatgtggcgagcaggtgagttatccaggcaggacacattggacagcgaagccaggcttccggacagctccgggttcttcccgcactcatcgtagaaggcacagtagccaggttggtgtatgggtgtgtagacctcactctgggcctgtggaacagggcagtgtcaccacgggccccagcgctggccagcacctctgggtagctgatggggcagtgggcagccagggagggcgtggggaatgatgccaaacagggcaggtgaggggtggatgtcgggcagctccaggatgccagggggtccaggggagcactggaggagatgggatgcccaagtagcacatgggactctcggcggtgtctaaggattgtgagcggatgggtgaaggcctggttgaccctgagtgacagggtcactgaagaaagaggtgacctgacatatctgggagagaacagggtcacccagaagacccctggacccctgtgtggtcctcctgagaaaaagtggcccctggacaagtcgagggactgactcccaggagccatgtggatgcaggccctgtgtgcctcgggcatcattgccatagcagtcagccaccaccatgaccaaactgcagaccacacccagaggccgggacccctcttggagaatctgagcagagcttcccctgccttcatctgccgggagctgaaaaccttcacccacctcctcagacgtggaaatgagcaggaaacttgagaggtaagaacctcggacctcctccctggatgccaaatcctctgtgggtgattctccccttgaatccacctcatcagcaccccaggactggatcttcctttaacctcccacgagccaccttaggccaggacacccacagcagaccagggatgggaagaacttggtcacacccaagccacctgtcccattccccatgcttgtgtccatctgaccccatcatctggagacttgagcagcctaagactcccaacctgcacctcttatctagggtgcctggcatccctcatctatgtagaaattgcccccatctgcagacccctggccctctctcacatttgccaagcagcccttgcccagagaggacacagggattgggactcaccgagtgcaggagcagggcccagagcaaccagcccttcaggccagtctccaccatcctggcactgggcaggggtcagagggtaagtgaggccaggccttggggacagccaagggccggctcctgacaatgccagagcccacttcagccgtacatatactgaaactgggggacggactacagggcag

SEQ ID NO: 61513 - DNA, 914 bp, Bovine  19866880998503
gagagacacggcacatcacagcccacgtgaccgagaggcagagcacctcaacctacaagatgtgtacccggcctgggccccacgaggcccacgctgaccccagaacctggtcctgggaggactcacttggcgcagtagaggaagtggtccctccagtccacctgggcggtctgccctgacagcgtctggttggctgtgagcagcagctgagtgcggttgttctggaagtactgcaggaggctgttgacgcagcagtcggacagactggcgttatgtgggttgaggggggcgtagcaggtgtcccgcagggagacgttccgctgctcctctggcgaccacacctgcagatgccgcagcctctcctgcaattccagcacctccagcagcagatccgaggacaagatcccgctgaagttcttgggccccagcagcagggagtcatacctatagctgggccggtgaggtgctgtcatgaacacctggctggttcggaagaaggggccgaaatacttgtcgtggaacgccttctcacgtcgggctaggctgttgggggctgaccacaactccacggggtccgtggtcagttctataaaagccaggccccctgccagggccaccaccacaatcacagataccgccaggatggtcagtggccatgaggccacccaagtgccccagcactggaagcagcggctgaggagggtgtgggtggagaggctaagcctgtgggccaggttgatgcttgccttgggcttgggcgtcttgcgcttgcccctgcaccactcggccaggcgggaccgcaggaggaaggccgtgagcaagacaaagagagaacagaggatgataatgaggaccaggctcccttccatcctgcccaggcggaaggtggggtccagggcccggggctgggcaat

SEQ ID NO: 61514 - DNA, 1264 bp, Bovine  19866881052769
cctgcgcttccacagccgaggggcacccacgcccgcccgagcgcacggagaacagcaagcagagagcacaggagcagagcagcgagtgcagggagggagggagcggcgagcggcgcctgcagggcccagagctgtgcccgctgggacagcccctgctccccacacccctcggcaaggccgcacagccccgccctgctctcaaacagtcaggagacgcagggccaggggtggaggccggttcacccttgagagaaaggatggcagaggtgaactagtacagcgagtccccggcaggagggagctgaggggcgcggccgaggccccgcttccctgccggcgagggcgtcctctcctccggtcattaaaactgcacagcccccggggagatgttgaacatggcggggtcgaatcgctggcctcggaagggagagccttcagcgtcccaccccttcttcagcatctcatggactttctacaaacagaaaacagagaggttacttgtagtcaccaggcctgcacgtcccagagcagagctctgctctgcttcctctggaaaaggacctgcctgggctgacagcagaccctctgcaagcccctgctccccacattcgggttccaccccatcctgtccccagagcaacaccggccaccttcctggtttggatgctgtccctgctcaccaggagtatctgtccaagctccagagggcctgagggccacagcccacagagccgactgagctctagagagggtctctactcccctttcatagggacaaggtgggtagtctccaggcctgtgctctcagatagtctaggaatgtgactcaaaggaagagacctcaggatgtctgactgtgtacccaccaatcaccgatcccacagcccctgggggcaggggccaaagctgttatcaaaggtgggctcaatcatcccagtctggaccaccagcctttggggtggcagcaggaagctgctccctgtcccctcccacatctgccctccatgtcctccctgcaaacacactgggctggaaaccctctccccttccttctgaccaggagaaatgaagagacgcacggccacagggccagaaagccctgcccacctcttaacctccaggccgacagagtgagctgaggggaaagctcctggtgtctgacaagactgcagggctcctgacggggcctcctctgccccgttactccacctaagtggtgcagcagcgaacacgtcagacacgcagtacatactgcgctcggctc

SEQ ID NO: 61515 - DNA, 493 bp, Bovine  19866881029850
attgaaccctggtctcctgcattgcaggtagattctataccactgagcaacctggatgggtaggggctgactctccagtttcctaacggttgatcttctagggtcaccttatttctctgcatacccaaattccatgtataagctgagagactcttgcatctggagaactcattcattcattctctctacaaacaagttgcacacctcctctgtgcccagcatgagccaggttctggcatccggatatgacctcatctctagccttaaagagttaacaattcagaggaagggacagacacatttatagttactacctcatgtgatccaagctgtgacagagagattgtggaagcccagaggaggccctggactggcccgagaatcagggaaggcttcctggatgaagggtatattcaggatgggtcctgaattactcagcggggaagggggatggaatgtacgccaacattccatgaagagatcactcatgaaa

SEQ ID NO: 61516 - DNA, 1785 bp, Bovine  19866881064982
caatttcttctgaggaaaatctgttgactatgaattctcttagtattctttatactaagaatatcttaaaatccttcagaagatgatgtatttgttggatatagaattctggttctgacaattctttttttctccatattttaagaataatgatcaacttacttctggttttctgatgagaaatcccacaatcattcaaattcttattccactataagcaacacatgtttctctctagttgctttcatgactttttttcatttttagcaatgtgattatgtatgagcatggacttctttgggtttatcctgtttaagatttgctgagcttttaaaatctgtaagtttctgtcttttgccaaatctggaaagtttttagccattattttcttcaaataatttttctgtcctacactctttctcttctccttttaagactctcatggtcccagtgttagatcttttataattgtcccaggttcctgggacaaaaatattttttctctctgttgttcagatagaataatttctattgatctatttcaagtacttaatatttcctctgttttctctattctgctatggattcatccagtgaagttattttgattattgtatttttcatttctaaaattcccatttggttattctttgtatcttgtttccgagctgagatcttttatcattccatttgtttcaagactatttgcccttacttctctgagcatttttctaacagctgctttatctgtcagctaattattccaacatttgtgtcatcttggaatacttgattctttgcagtcccaaaaatttttaatattttgttatgcggtttcaggagaatcctgatattgttgtcttagcagacaaccaacccagctgggtctgggattcaagctcaggtttcaatgtcagttctgtttgcaaagcctttgtagcgctatctagttctgtaccacatatgtgctatccagtggtcagtctgagacctggcagtgggcgatactacagttctgttcccaaagtttttggtgtgctatttagaatcacatccacttatgtacattgtgcagataaggcctggagtccacaaactttacagagttgctttctgcactcctttctatgatctatcaccttggtggagaaggaaatggcaacccactccaatattcttgcttggagaattccatggacagaggagtccatggggtcacaaagagtcggacacgaatgagcaactaacgtatctccttggtaccttctgggtcctggggcttttccttttggtcctctggccagaaagctggggcactgcttaccttgctctgccatgtacctcccctgacagtgcctacgtccacacgctgtatcaagtggagggagaacaataaaagcagcagtggttcacttcatactcttcaaacaagtcttcttggaaaggaagagtcttttccctcagttttaagtgttttgggactgtcacatgttgggaattttcggagaaaaggaagaaaatacataggagattttcttcccaccctctctaagcactagaccccattctcagtactttagccagaatggaggactctcctggagtgctctctttccataccaagatccaattgttcgttttgggcttccttgagttcataccagaggccagtttattgatatttcagcctttggtcttctctcccaatgtacctgctatttttcagcatcctcaattaactgctccatgcattctgtatagctgcaatcaatgggaaagtcagga

SEQ ID NO: 61517 - DNA, 1293 bp, Bovine  19866881180297
ttattttctgcatgaggaaactgagattcagagagaaaaactgattgtccaaggtggcccagcaggttagtagcaaagcaggcttgaatcccagctggtctgacatgatgctgagaagatgtctcctgagctctgttggtcttcccttctcagagcctcaatttccccatctgaagaggagctggtttagaagagctttaagctgcttctaagttctcaaacacatgccacacagaatcaagaagaagaaaacgtctggtccctcttccatccccagttgctcagtgaggaggtcgggcacggctgcaccttacacggccacagtttggtgagggggctactggtgcccctccccatggttgttgatctgttgcatctggaacacatgcgtgtccggggcagcatcttctgcgagaggctttgtgactctgtttacctgtcaggtgcaatggagatagccttggatcttagtcccaccccaccccccactccttttgggagagtggattcccccaacctacctcctacccacagccttggtttcgccattggcactaaggtggaggtaggaggtagcagaaagcttcctgtaacctattctgcaaggtggtcataggagtcttggccaaacagctttgagcattgctggcttcagcagatttcttgatggcgggacttatcagagcattcgtggtgaagaggcagaggacagagaataggacctttcccaaaccagttacagattagcgaccatttttcataagacaactgcttggaaacttccacacaagatccccgagggtcttcccagctttgacattctggtctaactttggcaagagaatgtgtcctgaaggcacgtagatattagcaatgcctcttttctcctttcctctcccctccttcccagccccgcttccttctttaattccttcctttcttctttccttcctctctctctttcccttgctcattcaataagcattacagggcagaccctgcgccaggctctgtgttgggaagtctgggagtgtcaaggtaaatggacctggggcccttgaggagtagctagtgtggagggatgcccttccctggtcctctcccacctcccttccagcgtttgacctgctctgcaaggtcaagaggaacgttctctgggcccagcagccgccgaggctgagctgtcaccctcagggcctggctcccacagacccgtgcttcgtcaagctccaacatcacttttttttgatgaaacctaatttttctgtttccaagacaagaaagacgaaaaga

SEQ ID NO: 61518 - DNA, 1232 bp, Bovine  19866880397665
agacgtgacaggaaatccaggctaggttctcaagagcgagccggtccagagtcccgagagcctcccctttacttacatgtcagcgcggccgcccttacttcagcccaacggaaagtccgataatcaacgctaaaatgcccagcaacacaaccactatcacaatgataattaccaatttctggaaagagggataagagaaataaaaacaagtcatcattacaaaccaccaaaaagccggagtcagccatccaaaacccacctctgcaccggaagcctcttatggccccagagagagtgaaatgaaaagctgacatcgctacataaagacgttccactgggctctcgtgtttaagttgcctctgcactagcagtgccagcaggtgcaaatacggagcctccatcagctccgagctcacgctgcagccctcacgtgtggacagacgtggccacaaccgtcacggggtgtctaagcagcagtaaaccaagatacaacgtgactgagattttccttttcaggggggaatatgaagacatatttgacacagtcctcctaaatgcaaactgccatccatctctccccgaaagaacactcccacctgtcaaacccaggacagtgactgagggtctgaaagtacaggtcctgttgtgaacaggacaggattcatcatgtgaaataacttcccagctccctagacacctgcccaagcaacaggtaaagttgggaaaaaaggaactgaagaatgaaaatatcagagcacaaagtcagaaaagagcaggctaaaaagcaaaccccaccacagctggctactgcagtgactgagcagagatgctccaagaacaagggcaccagaactagaggtgggggcgggcactggagcaggatgaggtgacgggaagagctgggctggaacccgaatttgaatcccaagttcctacgcttcctaggtggccagggacttcagtgattcccagctgtttgatctacaagtagaaagcacaggtgtgccctgagagagagcgttcacatagccatcagcacatagctgggttcacggtggggaaaagagatcaaagaggacaggtgtgggctttcagaatggaaggcagtgcagaggaagtttccgaagggcagaggagccacgtgaaataccggacagaccaatagctctgtccagcggaccagcaggaacactgggcggtgacgggtccaccctgcagagctgcctgccagt

SEQ ID NO: 61519 - DNA, 1342 bp, Bovine  19866880583051
aaactatcggtgtttcactggtgacactgaaaacatggggtctttcccccagtttatggcgaaaatttaggtataacggagatttttgtgttttcccatttttgctttttcttctgtgtgagtttttccaaaaatgttgactttttttttttgctgaggaacaacaaaagcaatgaagggacagcaaaaataataccagcaggaaaactcgagtccctcacggcgctgagcttgacagcctgttttgttctgggccagcttgcccagggacggacggctctgttccctgcctgtggggtcagtgtcacgtatctcgtggctcccgcttcttaggatgcagttaaattcaccgacgtgtaacggtttggagccactctcaccatgagctcgcagtggctctgccacctggaaaggatcagaacctgcttcccgtgtagcaggaatcctaatggagcccgagcgccgcgtggctggttttgacacgtttcctgctctgggcccgggcacctctgctccatccccttccgcccttggaaactgttcctcctgtccctccatctgcgctcttgttttttctccccacactgccttgccgaggaactggtttgagattcaagtgatggtaagtgccgttctctctgcagaaagccaggggttgtatggaatgaaggtctaggtgggtggagggaattcccatcttaagatgcacagaaatcaattggaaagaccgaattccggtcaggaagtggcagctggggagggtcggtaatcttgcgaagagaccatgatctcttaaccagataactcaggtaaaaccaacatcttgttacttacagggcctggggatcccttagagaaagcaagcatccccacctcagctgtttactgagcacccaccgtgcgccaggcactttctgtagtagtgggcactcggttcaggctgaatgaacttggttcagatctgagtgaccaggaagacgccagcctcctggcaacatgagagagatgtattctggcttctcttctcacatgtttcatttttaaaaaaggggcgggggacccttcaggatattccaggcgtctagaccacgtgctcctggcgtgcagacgctgtctcgcatgggagaagtaactgactgaatatttcggggccggtgaccgccgcctcggcctgggaaagcactggcaatccaggggaggtgtgccggggttaccccgcggaaggctgcacggcaggtttcccgggtgtccctgtggcctctgcacgcgagctgggaccgtcctgggggtgtgtgtccagggcgtgacccggagtctgtcctccgcaggggggagatgttag

SEQ ID NO: 61520 - DNA, 913 bp, Bovine  19866880596288
tccattctgtccattctgaaggagatcagccctgggatttctttggaaggaatgatgctgaagctgaaactccagtactttggccacctcatgagaagagttgactcattggaaaagactgatgctgggaaagattgagggcaggaggagaagggcacgacagaggatgagatggctggatggcatcactggctcgatggacgtgagtctgaatgaactctgggagttggtgatggacagggaggcctggcgtgctgcgactcatggggtcgaaaagagtcggacatgactgagcgactgaactgaactgaactgaactggatatgttaaaactgtatgtctgcctaaactacctcgacatgggagaataaaaatctaggcaataattaaaatagagctaagtctagcagcaattaaaccaatttagaatatcatgtccctaaacaattcctgtttgtgttcaaacattgacctacaggggatggtcaagttaaaaggtgggttagcctcttggggcttggttgaaccaaaattggcaggaagatctccagaaatgagatcagaaagagtgagagtagagaaggaacccagggttctgttcccacaggtcctgaagtcccacgtgattaccctgaggagaagcagcgggaaggattgatggtgtctagatgggagcttctctcgctccggacggtttctcagagaggcagtcttagtggtttccaagccattaggagcaggattctagcttgtgcttcacccagcctcagggaaggccgtggctgccagctctcgagaaagaaggtacagagggtgggggaaggccaggctgactgagttgctgcgtggtctagaccatgcggatgggccaaccaaccctactgacctcgggcttttctcatcctgtgcgggg

SEQ ID NO: 61521 - DNA, 949 bp, Bovine  19866880645195
cccccaaaccccacaccatcactcaccccagaggtgaagatggcagggttcccactctccagcatctcctccagctcctcgtcggtggtctttttgccagctttataacaaaaggagagcgtcagatacaagatcaaagctcatcatttcaaaagtttcctgaaaacggccgtgttcagtcgctcagttgtgtccaactctttgcaaccctgtggactgtagcccaccaggcttctgcctgtgggactttccaggcaaaaatattggagtgggtttccatttcctcctccagtgggtctccccaacccagggatcgaacccacgcctcctgtgtttcctgcataggcagacaattctttatcactgaaccatctggaaatcccagtgggagcacagtaagtttcactctaaagccgtggcctttataagtctgctcgcctttctccgatgtctcccctaacccaatccagcctcaacgttatcagcaattaccctcctgaagtccacgtctgattatattcctttccagctcggaacgtctcccagcccccttcactctgccatggggtccaaagtcctcaggacaacaggccagttcccaggtgagccctccctccaaccgtcttacccccaccctgctccgcccaagcgcaccctgtccccaggccctggccggcctgccctccctgcctgtgaccgagttcattcagttctcagagcatgttccgcgctgcagggccctgattgctactgattcctaaagttactgactcctaaagttactgattcctaaagggcgaggctgtattaactcctttacacaaacggggcaacctgcaccattctctgctgtcaaacaggcagcaaagatgccatgagccccaggaagcagggctgtgtagcaggtatttccctccaggatgcggaaatgcggttcccaggcaaccaa

SEQ ID NO: 61522 - DNA, 2010 bp, Bovine  19866880276227
tgaaaggtggaggtgtattcattaactcctcagataaccctgctagcttttctgtcacctcctccccctttcttattctggggttcaagggcctgtcttctatctgcttgccccttgttgatcctaaaagctttagtttgcaaaacccacccaccccctacccccaggaagctcaggaaagacttctctctgggggctggggttgcatgtgactgtttagtttgagcagccttgacactcaggggctgttgtcagtaagtcttaaaggtcgtggtcatcaggctcctggaagcccaaggaccacagaggcatctgagcgcctaaggtgatagataaagagatttttgtatggtctctcaaacctgttgcaacagaacctgggatcccttgacaagccccccaatggtgactgcagccatgaaattaaaagatgcttactccttggaagaaaagttataaccaacctagacagtgtattgaaaagcagagacattactttgtcaacaaaggactatctagtcaatgctatggtttttccagtggtcatgtatggatgtgagagttggactataaagaaagctgagcactgaagaattgatgcttttgaactgtggtgtttgaaaagactcttgagaatcccctggactgcaaggagatccaaccagtccatcctaaaggaaatcgcttctgaatattcattggaaggactgatgctgaagctgaaactccaatactttggccacctgatgcaaagaactgactcatttgaaaagaccctgatgctgggaaggattgaaggcatgaggagaaggggatgaccgaggataagatggttgcatcgcatcaccgactcaatggacatgagtttgagtaaactctgggagttggtggcggacagggaggcctggcatgctgcagtccatgggtttgcaaagagtcagatatgactgagctgaactgattgagaaccaacggcagccaccagttcctattttcactgcaaattgaagcagaaatgcagtggcttaaatcacagaacaggtgtttcagattaaacattaggtgaaatttcttttttcagatgtatttgataaactctggaatggattgtcacaggaaattttgaagcttcttttctggaaactttaagaaagaggatagatattcatctgcctgagacagtggaagcataattccatctggagatgctctgatgcactggcttcaggtgggaatggaagggaagagcgatcacctttctactgaagtctcctggccaagcatttcattccacttttcagagcatttcagcattgctgattttatctgatttcaaaagttatacatgttcattacctaaaattcagagaatgcagaaacatatgaaaaagtaaaactcaaacaaaatcctataattcagaggtaaccaaaaatattttttctggcctatatattctccagacttttttttttttttttgtacatttcgcatagaattttccaaaaaaaaaaaaagtatcgcactgcacacttttgtagtctagcttttgtacttattataatgtggggttctttctatatcactaaatatggcttcatataatttttggtagccaaagacaattccatgatatccatgtagcataacttatttaaccaggtttatactgaggaggtttaggttgttctccctggaaatccctgtacatatgtttttgtgggagttgtccagttatttcctaataataaattcctggaagtgaaattgctgtataagggtatggctgtttagatttttcctacctattgccagattcccctccagaaaggtcagatcaatgtgcatcaccatcagtaatgcttgagtgagtctgttttcccttttcctacacgacattaactactgtccatgttcacaggctgttctcaatgttttaacatacatttctttgagttctagaaacattgaggttctcaaggtttttagtcatttctatttcttttgttagt

SEQ ID NO: 61523 - DNA, 1576 bp, Bovine  19866880350036
cctccctgccggggcatttgcaattgcagttactgccggaggcgcgacggccgctgtgccacaggcatcctcattcacctggccaagttttacggttataacaacgtgaaggagtacctggagaggtaagcctcgcaaatcagaacggagggtgagagtcctgggagcaggagaggggaagactgtgtaggtgggcccggggtgcctcatctcagcctgactcttagaagccacctcgagtgccggctgtgcgggatctgtgtgtgtcgggaatgtcacaaacagtcatagagcctacaaggcgggcagggaaagctgtgaagaccaaagagctcttctcaccctctgggacagagaggggaggcttgtgcgctgggatgaggagatgggtttagggatgtggggctgaggtgagcctgcctgcagtgaccggagtgaagactgaccttgtgtcgggagagcagtttggctgtggtgccctgggggatgctgctgtgtctgcctctgtgcccctaatgcttcctctttcttctcagcttacaaaagcagctggtggaggacaattaagagacgaaccagcccgctcactgtggagcactccaacaagacatgccatctgtgcctaagatctctttttatacagaaattctttgtagagctaaacgcttatttttttttaaagattgtttttatacgcttcaaaagatttctcaggaagatgagagaggaatctgtatacatatattatacacaggcctgtttgtatgttgagttattaaaagtatctgcagatgattaaaaaccacagtttaaaagagtaaagttccaggtaagtcctggaggaaacgcagcattgcagctctttatctcccagacagtaactggaggccaggtcgttacaggggttacacccccttgagtttatcatgagtgaccgtagttcaaaccccatagtttaagctgctctgggttgttggatgtttatattgaagaatgctcctctaaattacaaagtgcaattaaccatgcaactagagttttgtttttgttaaaacttgaaccaaaagtagactgtcacattactgacactggaggccttggagggtggctgcctggggcccatggcttctgtattttaaaagaatatataaaggcaaatttaatttagagatttttgtttaatatctataaaaactacactcccatgtgggaccaggacactccagccaaattgctttttgagttacagtgggattttgatgaaactgtgagctgcactaatcttgttgcaggatggggcagtagaggggtactggggaaacctattgaaaatatgtccctttcccatgttttttctacatttgcttctttttgtcccccttctctacaaggacagtgtttaaaaaaattaatgcacatttaattttctcaaaagttacataagccagaatatgttatgcctcccagtggggatacgttaccacgcccaggagcaacgacaggcgctgcttgtgttccggccaagccagggggactcaggggccacgtcaggcctccagcagcagagccacgcccg

SEQ ID NO: 61524 - DNA, 1548 bp, Bovine  19866880389490
aaattattttgtttgtgcttaatcagattacatggtacattttggcactgcttctcaaaaaataatggtaaattgtaacattccagggccagaaataggccctttcaagtacaaagcttttcttggctccttggactaaaggttaagttgcgcatattttagagcaccttaaatttcattgcatctgacgtagaaatacaggtgaaacagaactaccaacagtactttagggaatatgagttagtacagaaatgttgaatattcacattaccttacatagatcaaatggctccaataagcgtagtctgtcaaaattcttttcatttgctttcttggtaatttattttcacgggtgagtggtttcgttattgcagtgcattttgttggcgagtgttggaaagtaaaactgaggtagatttttctaactgctcctaagtcaccctatactcatgatttctagacttcagagtttgttttgttttttctttttttataactgaaaaaagaaaaaggcattaagcttagtatttttggaagcatttagaccatttcctttcatttgattatatttacatagtagaactctataaaaaggatctataccaagccaattaccattccaccttgacataacttggggatgttctagaaacctttgtgctttgtagaaataaaatggaaatttttagtgttttatacacttaaagtgatagaaataaattaatttatgcataaaagaaaaatacattcaagtaaaatcaaataaaaatagacaattcttttcttacgcctttaagtttaaaaagtagcagatgatcaggaaaagttctgtattaattaacatcatggctaattatagacataaattttagagctattctttagatttttacagcatattaatatattttatttcaagttacatagttcttaaacctgtaatagtatttgtcttccagttttgattggtattagcatgttgcttttatactgcaaaaagtaattcttgtaattaaaaatccactacaaaattttatattatttgtgggaagagggggtatgcccaaaaggatagttgagtatttttgtcagtgatgagccaagaacttgggattagatttagtgatttgatttaatggatagaatttcaaagacaagtttttttgtatattaatacctagatattcattaagctataaataaatgcatttttttattcagaatgtgagtctgtatggcagctatgaatgtgtttaagtgaaagatgtttttatacacaaaagtgcttttctacctagagtcttaaattaccactaattaagcagtatataatataatatataattatagtgttttaatatggttgccagtggatttgctagtctttctaaatggccattgttggctaatagtcttcaggggatcatttatatagccattgtggttctaaaaatatgtctaaataccaatgggacagcctttttttttttgaagcatggctgttaaaatgcacttctattgaagtgtgtcttttgcattaaatcactc

SEQ ID NO: 61525 - DNA, 2288 bp, Bovine  19866880437033
caggtttatctctgtttagaatgaattcaatttctcctctgtatattccaggtacatacatgaaaacaacagcctggtcccttgctgtcattttcttcagaagacctactttatgtttaaggacttaggagaccttcctgctctgagtgttctctagccccacatctctgtattctcatccagatcttcaaatgccaatatgaactcatacgatgttgccaaaatacactcaggcagattttctcatggtttactctgtgtttggcttagatcagggctacaaatgcttcacatccagtgacgggaagaaacatattgtcaaaggtctctgtcttctggttgggcatgatctctgacaccctatttactttcccactccttctgccattctggtccaggctctgctttctccaaggcatcatctcatctgtcccttctctttcacccctacagaaaggcagtgctctaggtatagtgctttgaagtttgcaaacagctttataaatatcatctcatttaattagcatggaaactctgcacagaatgttgttgttgttcagtcactaagttgtgtctgactctttgcaaacccatggcctgcagcatgccaggcttccctgtccttcaccatctcccagagtttgctcaaactcatgtccattgagtcagtgatactatctaaccatcttatcctctgctgcctgcttcttcttttacctccagtctttcccagcatcagggtcttctctaatgaataggctcttcacatcaggtggccaaagtgtttgaattcaacttcagcatcagtccttctaatgaatattcaaggttgattttctttaggattgactggtttgatcttcttgcagtccaaagggactctcaagagtcttccccaacatcacagttgaaaagcatcagttctttggaactcagccttctttatggtccaactctcacattcgtatatgactaatggaaaaaccacaactttgactagatggacctttgtcagcaaagtgatgtctctgctttttaatacaccatctatgcacagaatgcacagatgtgaatagtataaggaaaacacagaagtttctgttaacgtgattttatggattaccatgctaatacttcatgcctgggattctgtaacctgttttgctggctgcccagctttcagggtctccttattataaagcactcacatactgatgctaaaatcatctttcttccctgcttatctgaacatgccacaagctggagtccatttatagcctccaacactcttggggtaatgtatttccctgaaacctttgagactgcatctgctaagacctctgactgactttcctcaacctaggatgactgtgtttggctaggcagagttttgtttatccatttgttcatccatccagcattcattcatgtatgcattttgtaacatagcatctatgatgtgctaggcactgcaatggacagtataggggaatacaaatataagttatctctgccctacaagattttacaacctcatctaggtcttatatgcacaagtggttctagtggtaaagtacctgcatgacattgcaggagatgtgagagacatgggttcaatccctgggctgggacggtcccctggagaagggcatggcaacacactccagtatccttgcctagagaatcacatggacagagaagcctggtggctacagtccatggggtcgcaaagagttggatatgactgtagcaatttagcacgcacacacacaggcatttcaaatacaagactaactgtgataagaaaggtggtgaaaatagactcatagtggtaggtaaactctgaggtttacctgaggaagaattaatcccaatgggcaaagcatgcaagacctgcaggaggggtactgttgaatctgtgccaggacaagtagattccataagcagaatggggagatgggacaagactgattcatggaactaaagagcctcttgatgaaagtgaaagaggagagttgacttaaagctcaacattcagaaaactaagatcatggcatctggtcccatcacttcatggcaaatagatggggaaacagtggaaacagtggctgactttatttttgggggctctaaaattgctgcagatggtgactgctgccatgaaattaaaagacactggctccatggaagaaaagttatgaccaagctagacagcatattaaaaagcagagccattactttgccaacaaaggtccatctagtcaaggctatggtttttccagtagtca

SEQ ID NO: 61526 - DNA, 700 bp, Bovine  19866880441552
taatttacacatgggcttattagttcacactactgaatttcattttggaacatataactgcaattgatctcaatctaatctttaatttccatgtattttagttgaagaaaatactactttataaaacagttttctctaaatcccatttaaaatgtttacattaaactaaatataattgagcataaataattttgaatactttccctatgcttatttacattttttcttgattctgactgaattttaaggtttttgaatgacattgaaactgctttggcctttggagacgtcatcttaattgaaaaccttgaggaaacaatagatccagtgcttgatccattgcttggtaggaacacgattaaaaagggaaagtaagtattattgaataataattttattattaaaaataatcttaaagataatttttgatgtgtgttttgcactacacatgagtttgatcatcagcttctatttcatggcctcctaatgaaatgtaatatattgaaatattcttttgtaataattgtatttatttgtttatggctgtgctgagtcttcattgctgggtgggcttttctcattgcagtgagcaggggctgctctctagttggggtgcgcgggcttctcgttgaggtgccttctgtttttgtggagcgtggactctcgggtgtgtgggctccgtaactgcaggtcctgggct

SEQ ID NO: 61527 - DNA, 4084 bp, Bovine  19866880467430
tatgaatactctcaaaatgagataaaaatccaaaattggataaaaatcttctgatctacctaagtaaatgctattacagaccaatttctcagatgagaaaaaagaggctcagagaggttaactaacatgtgctgggtgaaacagtaaatagtggagtctggatgtaaatccaggcactttgattccagaatccttgctttaaatccctgaatgctaccctctttctactgccagaccatggaaattccttaagtgcagaaatcacgaaaagttcccttttctagctcagtcagcatcgagcagacaaggaatgtctactgaagaatataaatgaatatattcatgaaaggtccaattccttcctgagcggtaggtctcagagacggccctgtctgaaggtgggatcctaagaatgggggcggggttccacctcttaagaccttcttcagtgttggagcccgtactcaccgctagctttttcctgatagcccccaatttctcagcagctgcagccagttctaagtttgcctgggctaatgcttggcgtttgggctccacgtcacagtagacctgaaaagccacgtaagggttatttcacaaggcaatgaagatgcaaagagggcaggtaatcattcggccttctatttgctggaagctttacagttaaaatctctaattcatctagaaatttggtgtttactcttagtcatggtaacacctaatggcagatcaaaattccacatagccttccaaattctctctgcttgtccattactcactgacttgttgtggacattagagtgacaagcactagcataaaatgctacgcaggtcaaataccattaagatactacaattagtttttcgtaaaatttggagacaatcctcatatcaccagaaattgtcgagtacagcaactacagctaaacgtgggatcatgtctagccttaaaggcagaaaattggtgtggagaaaattctctgaacccagaaaggaacatgtgagataccctcacacagtataatgttaaccacactaacacttttttttttctctatgttctggccaccttaaaggttatctgaatgggtggtttgagcatttgagtggatcaaatattctgttgggaagggagaatggaaattaaattttcttttctattttatagcaaaacaacacagaacacagcaatgggtccagtgctgggcttgtctttccacctagggtgtgaggctggcacagtggtcaggcgtgccattatggagcgaggccgcccatcagctgtgatccgtctgcagtcttgcctgatacgggtttccttccgctaaagagagacggacagggtcctattcccatgggtccccagagtgaaggacagaacctagttttctgaaaatcatcctgggaatgacagtggcatttcctcagcaattccacctttgaatataacacacaagatttaaagacagaaatgagtcagctcttcctggcaaagggccatgcatgttccctctcacatccagtgcttggcgaagtgtttggggcatacctgacagacagatacttgataaataaaggattaactgagatgatcatctatctctatctggcccaaaactacaaactttagaaaagatcacacacagtcaaaaacgcattcgtcattaaaatacaaaagtcctccaaaggttatttctcatctcattaagtctacttgtagctggcgtaaatttctgctttgagagcagggatgaaatttaattaaacatgaactcaggatttgcagttgtttcaagccaacaactgaaatatttcaatataaataaatataattattctacccaaatgtttttttctaatcaaatttaattgctgctatttgatctaaagaagttactctaccctaaaaaagcatggcttccaacatttcagataccctcctttagagaattctgattaatctgacaccttcatgtcttattcttagaaatgtatcttattcagataattaaatatcaaattattttacatttcttgctggcctagaaattaatatatatatgacccttcctgaataacacccataaaccatctggtcatgcctgatacacctcatagaatttcatgatgttgatgacccaggcgcagagaccagctgctgcaaaagatttggtccgaatcaggtttgggttgaactcagggtctctcaaatactgttccttcaccacttttagacaattctctggaatgtgctctttgtcatagttaattaacgcttgtaaaaaatcatccacctgtaaagcaaaaaagacattgcaatgagccatttgtgctgcagagaaaattccaagatcaaaaggttaaaatcagcttttaggattcacatcacaaaggcaaaattggcaagctgcatttatcccactgtttgactttttcagtctttacagtctaaagttagaattagcaatggacacttttaaaatcccttttatcccagggtaaaatattcagtctttgcacaggaggcattcacattttgaagaaaagaaaggcagaaaagaaaaagaaaaacacataccccaaagccgctttgcttcaccttcttgtacattagtaacattttccaacagaagaaatccatgtaattttctccctcctacacttaaccgctttcataattttgaaaataattagcaaccttccaactgctgctggtgctgatctaggtgtgctacaaccccacgcgtaatctcccacttggcaaacaaaagttctaggtccagagaacacacagtagattactctcagcaaatctgaacatgacttctttttaatagttcggaatgttatagctttcttctttctcctcaaactgcctgtactttaagaaaatttattttactgaagtatagttgattcacaatgttgggttaatttctgatgtagagcacagagattcaattacacatatatagagaatatatatacacacacattcttttcagacggtccatcagaggatattgaatatagttccctgtgctataaaataggaccctgtttatccattctgcgtaaaatagtttgcatctgctaatcccaaactcccagtccattcgtcccttgtccctgctgtcaagtataaccacagaactgaacacagaaatcatcagaattttcacgctgccaggctgataccttccccatgaagacttttgctgctttccaactccggtctttcggcactctgccccggggagccagaaggaccatcacagccgcagtaacattggtgactgcatttggagggttgggaaaggctttcagctcagtgagattgacctgaagaaaagcacacacactctcaagaccagggcgctctgctctctcacaaccactgttgggtcattaagctggtcttcagtggctggtcttttccaccctctcctcttcacaccactcttggtttggcagtttttgcagccctcgcagagatcccactgtgggacaccagtaggtccaggtctttctggcacttttctgatactttgaaaacatcactgccttttttggcttccaagtaaatttatcttcctgatgtaccacctgcagagtcgtgcacactgaggccagggaatttcataaatgtacaggttttagggtatttatgggttcatccaacctatgtaatataactgcctttgaatcaggccttccagaaacagggacttccctggtggtgcagtggtaaagaatctgcctgccaattcaagagacacagggtttgatccttgggtagggaagataccctggagattgaaatggcaacccactccagtattcttgcctggagaatcccatggacagaggagcctggtgggctatagtccacggggtcacaaagagtcagatacaacttagcgactaaataactgcaacaacccagaaacagagtcctttagctcagaatctcttagttttgtctttctgcttcatatgtacaggaagcatctattacactataatgactcaaccaggaagatgcccgtagaggctgaaccttctttctacattcctccttagt

SEQ ID NO: 61528 - DNA, 805 bp, Bovine  19866880494816
gttgcaaagagctggacacaactgaagcactggacacatgcttacgttgatcacattaaagccaacttattcctaacggtaagatgtagcaataatatcaataggataagcattcagaacctctttgataatacaggaaaagggattagttgactttgctggagatttacctcttggagtctaacactttccgagaatgttttagactgttcaaggtatgaggaaagctttcatgcaagggacataaggatcatgtaaaaaaggcaagtttttaaaatgcatgaagtaaatcgcatgtgaggtgtttgttggtctaaacaaatctgttcttcccaaactaattctatagcaaagtttctggcccaaagacattttccctttgatatccttatacgtggatactgatgtgccattaggatctttcttgctaatcaggaaaacgtggtgctttgatgtaagtccttgtattcattttctgccttcttttgggggagagtaacacagcagtgggagtccagatgtcattggccaggatggtttgttgggcaagtgataagggggcagatgcaggcagcatctttttgtttgggaaacagaagaacaaggactgaaagtctgaaatacaaatcggagtttagtatctaaatatctgaaaaatgaaaccgcatagccctgaggctcattggatgtcatctgttgggggtgttttctctccgcaggtgtcgcatcagccgcatcctgcagtcccctcagggttatgcgctcttgatcggagtgggcggcagggcaagcagagcctgtcccg

SEQ ID NO: 61529 - DNA, 2024 bp, Bovine  19866880557412
taacttgaggacttaaaaaattttttaaaatatattgatataagcataatccatgttttatttcattgtcatagcaaaaccccaggggtgtccaatgtatacgtgtttccttataacatttcatatatataaaatgttcgtcaagaaattcatgtggatgagcagttagagctttggggaaatgactagatcaagaattgagagagcagctttgaagactgaaggagcagattcacctgctcttttgaaaagatgtcagtgtcatttgcttgctcttttcggattacatttggccagtacatctgcagcgtctcctgttctttgtgccatgaaattgaagagatttccacagtaaggaatggcctccaactgttcgttttcatctgttgagatttgccctccccctgtctctgttacccagatgaaatgccaataatatccccaactgttctactgcaggctgacaggtagacgactcccaggaggtttatgcttgttctcttttgatgatagtggataatttgggtaggaggcattcataaaacaaatctttagaacaaatccttggtctgggtacttctgaaatttaccttcccatataaagcatcttctactgaacttcacatagtagaacatttccactgtgggtagttctgagtatttgaaagtttgtagagctaaaacatgcctttttgccacaagagaagccactgcaatgaaaagcccacacaccacaacaaagagtagcccctgcttgccacaactagagaaaacccaagcacaccaacggagaactccctcagcccaaaaaaggagatgtggaaataggtgatactgaagaccagatgaaaagaatattatatatgaaatattggacattggactctgtcatggtgtcatgggaagtctttgaagagttttttagcaagagattaacataagatttatattttctattgagtatgatgtggtttgaagagaggtaaatgagaggcaacagtctgagttgggaggagatggtgggttgcattaaatcaaggacacctcacttcttggcttgagaccctggtacatggtggtaccattcactgcctgggtatatgggccatgctacagattagagagtggagggaagtgtaagaaactgacttcacatttggaagtgttgagtttgagttactcgtggggcatttaggtcctggaggtggatggggatgagacttttggaccctggaaatgcagatagattgaaatcctgtgagtaagtgaggttgcctagggagaatgaatagaaagagaagaaggttgagagggctaagaacaaaccactgaggatcatcaaaacttaaagataggggaaagcgaagccttgagggaagagaagtggcagccagagagaaaagagaagagcctggagggtatgtgtcatggaatcctggtggctaaggacaagaggacggtaacatgccagaccctgctgaggacaagataaatgaagactgctatatcacgtcgacctcgaggaggtgaccaccttggggttgtcccgtgaatcctgtcaactcctcataagccgaacagatggtacttcaaactgagtacaatccaggtgttgctgtctctggagtccatcatttcttgctgacctgaatgtcatcctcgtactgttccaaaatcattgttatgcaattctaaatctcatttccattgttaacttataccatgcttatgatcaactaaaaattatcacatctttctaatgtgaacctcatgcacaggagatacatgtacacatagcagacctaaataacagacttaaaaaactaacttacatataggggcttccctggtgggtgcagtggctagagactccatgcttccagtgcagggggcccgggttcagtcgctgggcagggaacgagatgccacctgccgcatgtgagcctgaagcttcacatgttgaaactaagacctggcacagccaagtgaataaatattaaaaaaaaaaaagaaaagaacttacg

SEQ ID NO: 61530 - DNA, 1946 bp, Bovine  19866880567658
cttgctcactgctatcccctctctgtactcctttcttgaaagttcttggtcaactcagtttatcttgtaattatttttaaaggagtcttgaccttttatttcaggcttcccagatggtgctagtggtaaagaacctgccagctaacgcaggagacttaagagacatagattcgatccttgggttgggaagatcccctggaggaggcagggcaacccactccagtattcttgccttgagaatcccatggacagaggtgcctggtgggccacagtccctagggtcacaaagagttggacacaactgaagcaacttagcatgaaagcatgcatgaccttttattgcaagagacatgcaaaatttcagactcaaaatggtgtggaaatattaatactttcttctgtaggactcattccctggagaggggcatatctcttgggaaaaattaaaagatttcaatcttgtgttgttttgcaaaaattttggtctaattcagttttatgtgccatccatatatgagttgtaaaatcattttcattctagcttagcaactgctttacaaatagctctcttggtgatttaaccttaccttcagtgaaagctcctcatggaagttgttaatggcatatgtatgtaaaggctttcatcccagcctgcatgttgaggtctgactactgacattgttttggattgaacaagagagttgtctaggactcagggatgggtgtgatgaataggaagcccatgaggccaggaccaaaactcacatttttgctgatggctctgatgacaatgtcctgtacataaggatcacaattcattaaaaaattgatgtgcagtttgcatacctgagagtagtgaatgcagtgtccattctctgggacagaggagggggttagattttactagaaactgcattgaccatgtggcttcatatcctgtattaaatgtagctgtcacatcataacccattgtatatcttagattcttcccttggaagctgatatcttgcctggcttgtatagatgattaaattcaaacatggggaacctcaaaattattgacatttgactttggggtatttatttcttgcattgtttcctgtagatattgttagctctgagtattcagaggttgatggcatgagaaagtgatcctaaacacttcagtaagttggccacaaaacagacactgaccaagtactgatgttattagaataggaactctgagcagagcctggtctacatcctgtaccaccaagggtcatttagaaatggaagggctgccccgtctcttctcgctgtgggttttcagtctccctactgcactctcatcatcttctgttgcctttttctctccatgggtcttgtccagccttctgcctcttcagggcagccagggagggtgtgaagtggactccatggagaagaaagagggggaacaaatgaaacgtcttttctcgtagaatctttaatctgtcgtatcttcttgactatttacctagtgatttatctccctctcatgaacccaaacatactcatattagagctaatttaagtttggatttctttctgactgtagacattttctgaatcttgtatatataaagaatcactatttgcatctctggaacactgcctttctgttttagggttagaagtggaggatggtgatagaagtagaggttttatatttttctaattataaaaggaatatatttaatatagaaaaattgaaagtttgaaaagataagaacaaatctaccagtagccagtcccatgaagaccattactattagcattttgatatactcttttctatttgtttcttaagtgctgttgacctcatactgtctctttagttttacttactttctaaaaaacgcttttcaccaaaatacttcactgtattacaagttctttacaatgcttttaatgacttcataaca

SEQ ID NO: 61531 - DNA, 1197 bp, Bovine  19866880626779
aacttgggaaattgctaaaggatgaaattacttttggaagcaaaaagaaagacagccttgaactagtcattttaccggctgacaagttaatacttaaagactccctattgaaggagacaaacactgtacaataagccgaaagctcacgggcagtgttctttcaggtagacatggggagtgagctctagttatagtcttctgttgggccttacttatcctctgagaatggtttattgtgtgttttgaataagatcacacagattacaagctgaccctattgatcttgtgacctgaacagaaccctgcgcttccactggagcctgtcagatctctgggttgctggcctcccatttttgccttacgatctttatttaatatctcattaaccctgagaaaaacacaaagaaagtaactgagcctcagtagttgaaaaatgggaggacagcataaactaatcaaccatgtgttggggggagggggagcagatgaagggcatttctgtttgccttttgttatcactctagagtcaggagaagatcagaatgtacttgatgttaaagcattatgtgagggaacattgtctcttccgctttattactcagaggcagataaaatggccctgcaagctaatcgtttacatagtcaaacaaatacagcccatctccccagtcccagtgcttctttccttcctctccctgggcgtcatgcctcctagcaaaacattctctaaaggaaaagagcaaatgtttcagaaacatatggagttacatgaattttaagggagttcagagagtagttgaatatctaataagatatattaggaaatactccagataatatgatatttgtatattaattgtaagtgaccaaagatattaaatgattccagacaatagtgagcttcatcaaaatgagcatttacctctcaaggcagtactgttacagaaagtagtgattgggtccccatgcagacaaaaggtgctggagaaagatggaccctgagggggcctggtggcacagtgggggcccaccccccttggcagctgacccaatgtcggccagggccgcacatgagtctgggaattaatgaatggctcgttttacccgctatctatttgatggctgtgaaataccatttttacactttattaaattagattcgtctggagttctgatgtgcgtatactcatagctaat

SEQ ID NO: 61532 - DNA, 1554 bp, Bovine  19866880659233
atgataacaaggtgaacagaaatactgtttatcgtaaaatgcaggtctgagatctttatacttgcatgagtttcagtaggacaatttaaaattgtgatatttcagattctaaatacagtttattttttatggtattcaggccttttcatgttaaaaccgttaaaacgaaagtcttaaatttagataattaccatagttgtttaaaagttggcatgagtaagtgcacgttgatgagtttgttcctcaggggtcagtgagctcccctggggatgaactgatatctttattgagactgcatttctcactcgggcagggatcatttctaacttgggcactgagctcatatgtagcctttggcacttctcctgggggcagggccgggggcggtacttcttgctgttgtgaaaagttagcagccttgcctttgctccctaatgaagtggccgcttttgtgctgtgctgctctgtccaggtgctgacactggccagcaatgagcgcatagctctgactccctctatgaagctgctctttgagattcatcacttgaggactgcaaaccccagctactgtttccagagctggtattctgtatgtgaacctacaagatttaggctggaatccgtgagtatggcttttttttttttttttaattgtggtaaaatatacataatgtcaaatttaccattttaaccgttttaagtatagagttcagtggcattgagtacattcacaattgtagtacaaccatcatcaccatcagtctccagaacctttttcatcttcccaaaatgaaaccccatagtcactaaacagtacccctcccagcatccccagctcctttctactatctgtctctatgaatttgaatattctaggtacttcttacaaatggaatcatatagtaatttttgtgatgggcttatttcacttagtgaaatgtcttcaaagtttgttcatggtacagcaggtgccagaatttcctttctttttaaggctgaatggaatatatacccaatggaatctgtgtgtatatgtatatgtgtgtgtatatatatatatatatatctcatactgtttatccattcatccttctgtagacactagggctgcttcagccttttgactgttgcaaataatgcttctatgaacatgggcataatctctttgagtcccagctttcaattgtttttgatatgtacccacacaagcagaatggctagagatcatacagcaagtctatttcagattttttgaggtaccactatgctgtcttccactatggctgcaccatttgacattcccatcagtagtgcactagactttcactttctgcatgaccccaccaccacctgtggttttctctatattttataatagaaacatcctaataggtgtgaagtggaattgcattccaattttgacttacgtttctcttatgattaatcatgttgaacatcttttcatgcgttcattggccatttgtatattttctgtggagatgtgactattccagccctttgcctgttttttaatctaactattggggttttttg

SEQ ID NO: 61533 - DNA, 1677 bp, Bovine  19866880669242
cttgggttaagagattctgcacctgtggcctgagctgattaaacaaattgaatggccaggggccagtcagatctcttccttgatgattagcccagagcaatcccaagcttgagtttgttagtggagaggcagagagagggggacccaaacagaggaagtcctctgccacctaccacatccctcaatctatctgctctttgctctgattgttcagctttgtcttggagtcgtggagataccccagttgcttccaataaactttcttctagctctcaggccagtgagagtaggactttgtaaattgtaagtaatagagttttagtgagtgaagtgaagtcgctcagtcatgtccgactctttgcaaccccatggactatagcccaccaggctccttccatccatggaattttctaggtaagagtactggagtgggttgctatttccttctccaggggatcggcagaaatgatcttcaaggtgttgtgtttttttttgtttttttttttagctctaatattacactagtggttatctaagtatggtcttcccaccagcagcatcaacatcacttgggaatttatcagaaatgccccaccccagacctattaaatcagaaactctaaggggggcgtccagcaatttgtgattttacaagccttccaggtaattctgacatgtgatcaagttttgcaaactgctgtatttactattttaaagggttatgttttatgtaagaaagggattttcataacaagtgccactatctttcttttctaattaagttactagattgaaggtcaaaagatgatttttattagtaaaaaagttaatttaaaaaaattattaattttattaaatcttcaccctagcgtattttttctttttataaagccatgtaaaaattttattttattaaggtttttttttttttttggctgtgccacacagcatgcagggtcttagttacccaaccaagtattgaacttgcgccccctacattgcacgtgtgggggtcttaatccctggaccaccagagaagtccccaaaagttaatttttataaatagcatgtattacttttacaactttaaagaaatgtcaacagattttgtttttctttttttttaatttttcatttcagaggactaagactgacatttcaaggattagcgtaaaagaatagaaggaaagtgtgaagaatgaaaatgctgccaataaagaacaaaaaagtaagcaacagatcatttcaaatggtgaaagtctggaagggaatacaaaacagataacccagatgctgtgtggttttgcactggaccagatttcgcaaaatgtaccattaaacactgaaatgactaataatttctggcattgggaaactgcagtaatgattgatttacataagtacagtaaaaagtgaaacaggaaactttgacttaagttcatcctggtggttttcactgttaggtttggaaagataaggttaaattggaattttcactgtcacaggatcttaaacaggcagttggaatagatagggctcttttatggggttggttgtttgaaagtaacatattattttcccatggaaaatcatacgttggagggccgactgcaggtagcacaacaaaatccttactggaaggaaatcacagtgctgataatagtacaggtccctggg

SEQ ID NO: 61534 - DNA, 4052 bp, Bovine  19866880704256
ttccttccagccctcttctatctgatcatggccttgatgagtgccttagtcaggatgagaaatgtgaaagttggtaattaatggagtcagaggcaaaaataatgatgaggtttttttttctcataccaacccatatatgtggattccagagaaatagtgtagatgctctcctttgcaaagcagaaatagagacacagatgcagagatcaaacatgtggacaccaagggggaaagggaggagggtgtgatgaattgggaaatcaagattgacgtgtatgcactgttgatactgtatataaaatagataaccaatgagaaccttctgtatagctcagggaactctactcaatgttctgtggtacctaaatgggaaggaaaccccccaaaaaggggacatgtgtacatgtgtagttgatttactttgctatacagcagaaaccaatgcaacattgcaaagcaaccatactccaataaaaattaattttagaaaaactgcaaacaaaacaaaacaaacaaaaaaaaaccaacagaggatcagggaagggaaaaggaaaatggttggtttaaattccatcaattactatttttgcctttcttttttctgtgcctgtgctatccccttgagaacacttaaacctttcctttttatccattcatgtcagaattctgttgagttatatatcagatacttaccatttttcattgactcttacatgcacattttccccaccttttaatgttactgaaaattgagatgcatcataatttatgtcatgtgatggtttgtttcatggcctttttctttttaaataataaataaaataatgtgcaccttaaaattggtggcattttacagtcaataaaataaattaactctttttttggaggcagttgtctaatgttaatttgctaagtgaaggaatttgaagcagtttgctagcagtcagtcactgcagtagcttttcagcaaacaaatggccattgacatttcctgggcagtcatggtgctcttccagcctgggagtggagtccatttttcatttgaacttaggttgaccctgtgatttactttgatcaaaagaatatgggagacgtgacactgtgcaactttggggctgtcagagacttccaattcttttggagagccaggaacctccatgtaaccaaactaagactgctgaatgatgagagacacatggagagagaggcgtttggaggagaagggaagtctccccgccaacacttagccccaagtgctctgagcatgtgagtgaggccatcttgcatcttccagccccagtcgattcgcctcaaataacaccacttgaagcagaggtaaacaatccccattgagcctgctctgaattcccaggatcctgaacaagagctgggtttttgtttgaagcccctgtattttagggttgtttgttaggtggtgatagataactgagagggcaattgagttaggacttaagtcctacaaacatttttttcaatttttcccaacttggagcaaaccctctcccctcagataaagaaatatccttcagtgtttctcattgtttcccaaactgcccacgtttctccctgttcagatttcccagcaccaacaaaacaatccttaacgtactatgaggagtcacagtccaaaaacaaatcctgctgggattctcatttcctcaaatcaccttcccacttaaaattgtttctactcaatgtggtagtgcttcatgggggtatccgcgactcctaaaatgtgtttttctacctaatctaaagtacaactacgtaatcactagggaaccccctccaaaaatgtccagtgcttctaaacaagaaatggcatggcaattctatgaggatacacgttgacaactattgttcaagatcatgattactcagagaaactgaactgcatccaacagacccgagaacaactatggcacaaggtgtgtttgccaaagcaacaatcacagtggaggcatgtctcctgagaatggccactcagaacagctaaccctgctgaccaagcaggatatcctcagtgtgtgcagcagtttctcaataggaagcatgagaattaggaacattgcaaaaggaagggcaagaacattgagagactaatatccggtgaggtgtgaggggggaaacttaagctactcactttgcaggaacaacctcacatggaaagctattttggtagccaagtgtggaaagttaactgtaaccaaataaaaccagggggtcataaagccaggaatgtgtacgaatgcatgagtctggttttcctaagcttatttgctctttcaggagaaaatttcctctattgctccatgaaatatgagtgtatatgtgttttaccctttaataaaacaaaccacattatctcttaaggtcccattattcctattccacagcttaatccaagtatgcaatccagtaattataactgatttaacatttctttaaaattgaagcacactactttttccttttttctgcctaacctttttaaagggacaattaaaattgagaatgaaatatcttctgcagtcttttgactggcacccgagaccttcccccaggatctagctggggttataaaacctttcatgagttccagtcaattggtcaacccagaaagtccatccatatgaaacctgtggacattgatctactgatgggggtaataaagatgcagattaataccatctttattatgatttagtggagaatcatacttgactttggattgctatataacatctgggagagactttaacccagaaggaaaactgtagaatgggatcaccaagaaaaagcaaaccacaaaggaaggggaaagtggtgtcagaaaagttcagtctgacagatacggccatgaatttactgactttatttgcaatgagacattaagaaaggcatcctttccctaccaaataccaaagcacatttttgttttatcactgtggcaaagacacaatgatcgactttaagttggcaacatcattttgaggcctccttgcctttcctctagactgcatcagcagtttgccagatatcataggctgtgcattaaaaaacctcattccaagctaaaaagaagcactgttggtttttcttaaatctagaaaaaatatttttttttcactttctcctctagcaaaggaagtaagggaattcacaccagatcagagacccaaaggtgagttccctggggtttgacccttctctcttaacaggaatagctttaagtaactttgggggtgacagtgtgagatgtcctcatgacctttccccagccctcaacatttccctcacagcacaggagtgttttcacttctctttgtgatgctctgctgaaggactgccagttaaacctacttctaagatgcaaatggcccagcaaggaaggtaggatgataggcactctgatcttcccttggggctgagcatatagaatgggacaaggcagggctcaggaaatgtgcgctgaaagtttgaaggttgactgtacgtgggttactgatcttgttaggacttccaggtggggcaccagagctctgaggggcacctcagatactgaggccaaggagcggggcagctgatggggggagatgacactgtggaaatcaggacctttgtgacacaggacaagggcagtgggaagcactgggcattcagggagagggacttccaagatgacacagggcacacaggttggtggaagggggcctttcaaagtacatggggtctcaggtcagcccgattttctgaaagatgatgaaggaatacttctcttccttctcttcctcccaccttctgtgcctaggaactaagactccagtgggaactgttggtaccaagacttaactttggactgggtcttctttaacctctttggcacccgtgaactgatttcttctcagtcactcttgttaactgtattacatagcacatgatattctgtgaaccacaggcttacagaaacaatttgtgggctgtttttaaggtaagactatctacatctcattaagatgttgccagtccgt

SEQ ID NO: 61535 - DNA, 3292 bp, Bovine  19866880723585
cgcgccaatgggcagtggctggcttcgcgccccgcgccagatccgggatctcctactcttgctacctggtgaaggcgccgacagcgcccaggcgagcctggggaagagtcgccagcgccacagacgctttcagggcatgaggacggcagtgggctttgtcaagatgcagccgccgtgcgagagcccggccctggccggcgtggcggccgtggctgcggcggacggcgccctgcgccgcagccccagcccgtgtgagctggggcgcgagcagatggtgcctccgcggccatggatgtgggacctgcaggcgctgctcaccctgcggaggaagcgccgcgccgctgggggccgggggagtggccgggtgagtggccgggtactgcgcggcccgagtggccgtgggaggcgcgcgtggagcccgcgctcaccctccggggaggccgaggtggtcatctggaagttgggaaggtgtcgggggccaagcccttgtgcaggcctaggcagaagagggacccgggaaggcggggtcctagggtgaccccccgcggagcagcgtttttttttttttttttttcctctcccctagatgcatctgacttagcgcacctggactctcgctgcaggacagtgagcatcgcccaaagaagggcagtttgcctgtccccagaggaggagctgcaggtgtccggtgcctaaagaccggccctgttgggacagggagcccaatgccccacgcgtgagaccttagtttgcaggaggcaggagacgtgtgcactgctgtcggacgcctcgttgcaactttgggcatcgacactggcttagaacccaactagggacactcctccaccaggaaatcctagggaacacatcagcaggaagtcagtatttaagattctgggagcatcgccgagcactaatctttgtcaccaacactggctctggcgactgccacggcctaaggacagacgcgagttgaaggtctggggcgagctctagctcctgggctccccagtcatcagcacttagttcttggcgacgccaccagagtcttacgtattgacttcctgctggtgtgttccgcaggatttcctggtggacgagtgtccctagttgggttctaagtttatctaatggcccaagcaggtcaggcatgctttgtgatgaagaaaagcaggacagcctgggatctctcataagtcactcagcaggccttgctgacttgtcgggtgtccctgctcactggggccttgggcacctttgggggtgttttacttagcttttaaaaatcttaaggagactttaaggagaaggtatcacaaggtagatattttggtctgtaatgtaagaaagaagtcttagtcgtatgccttaaaagatctcactgggggactttcagctcttgaaagattggtttgtgaaacttgagagttagggagaaacactgggtttggtatggcttcctttgggcaagaaagcatctgaactgatatggagtctttgcctttctaggctgtgttcctccacccctgagaattcttcccacatagagatgactgtacatgatcgacctaagaaggatgttttgaggattagctgagcagtaataggacatctttaggtcaaatgaccagggaagtttaggaattacccaaaaatgaccttaatgtgtggaatacagggttacctgcaaagaaagcgaggaaatgtgtcccaaaaatgtgatagccaaataaacacaaaaatcagaattagagactttgcaggagtctaggggaaggtaggtcaaattgtattcctgttatccttggacagttactttttcactgcacaggatactgacaccatgagggcagccaggcagtctgtgaggaggattacccagggtttctgtgtaaatagatctggagtgttcatctgcgtagaggcttgtgtttccccatgcctgggatgatgttgtggtgtaccttgccaaaatacatatttactctaattattctgaatgtggttacttcaaataaggtatactttattagcccttctttggttctaatactgcattagctctccttgtgacattccaaacacatttcataagtgcgtggccagttttttgtttttttaattggggtaagattgtcaaattttccaacattgaaaacccataattttcaactgttttccctcctttggctctggaagcacctttgtggttgttgaaccttcccatcaaaggggttggaaagggtttgaaagtatgagaaaaacaggtgaaaaatgtattagtttgttcaggctaccataaaaaaaaaaaaaaataccatagacctggtggcttacataatagaaatgtatcatctcacggttttggaggctgagaagtgcaagatcaaggtgccagcatatttagtttctggggagagctctattcctggccggtagacagccaccttccctctatgtcctgacatgaccattccttggtgcctgtggaggaaaagatatcccctctatctctttttttaaactgaaatatagttgacataaacaggatattagtttcaggtgtaccacctactgattggtatttgcatacattggaaaatgatgactgtaagtctgctgctactgctaagttacttcagtcgtgtctgactctgtgcaaccccatagacagcagccaaccaggcttccccatccctgggattctccaggcaagaacactggagtgggttgccatttccttctccaatgcgtgaaagtgaaaagtgaaagtgaagtcgctcagtcatgtccgactcttagcaaccctatggactgcagccttccaggctcctccgtccatgggattttccaggcaagagtactggagtgggttgctattgccttctccggactgtaagtctagttaccatctgttcccatatgaagttattacagtgttattgaccacatgccttatgctgtatatgacatcctcgtggcttatttattttataactggaggctatacctcttaagcttgttcacatgttttgtgccaccccccatcccttgtttattctctgtatctttgtctactttcattttgtcttggtttttagattccacatgtaagttagatcattcagtatgtctttctctaacttatttcacttagcataataccctctagatccatccatgttgtcgccaatggtaagaattcatttttttggatggctgagtaatctttcattaaatgtatataccccatcttcttgatccagtcatccttcagtgaacatttcacata

SEQ ID NO: 61536 - DNA, 2742 bp, Bovine  19866880738244
aatctttagacaggttattactgaagcacctactttaccaccaaccgctgaaacgtaacttccttcatcctctctactctgaatacagctgtgggggaggacaacaaacactgaacgtggaatcaaagacccaggccatgtcccacatttattgatttattagctctgtgaccttcaataagcacttcatctctttgagcctgtttcctcatccataaaacagggaataataaaaatctgtggggtggttatgaaagctaaagtaaataatgcctatgaaaacaccgagcaaacagcaaaatacatatatatatgttgttgtcattaataaatctcatctattttatgtttaaagctgatctaacttaaaaaattccacaatgactacttaatcaaaattatctccaggtaactccctgaagtcctaaccaggccaccgtgctatcactgccaagtacccaggtttgatccctggtcagggaactaaaactgttaaaacttaggctgactgcaagccatgcagtcaaaaaaaaaaaaaagaaggaaagacaaaaaattatctccacacatacacacatgcaagtgtgtgtatgaccggatagtaacatgaaatttgcacacatttttacaagcccacaaattttatgaatgtcttctgggcaatctccccaattagtttttctgaagtctgaagtcaagccctaataaagagaaacactatgacacatcaatctttatttctaaaaacatttacttaaaagtggtagtaatgttgataagagcaacaataaagaacttttttagaaaattaaaatgtgacactcctctgattctcttcctatgacctggtctcttaggagggaaaataaagcttgaggaggagatgcttgtaggagtgagaatttataactgctattagcagagctactaacgaaattttttatctgcaggtgctcttttatgtctattgatttagaagtaggaaaagctgttactcataaagttcctgtttattcctgatgaaatgtcaaaacctgcattgtcaaggctgaaagaacctgactctgttctccactcgattcaggatgagccagttttggttatggcccactgagttacatgcatatttgttatccttggctcctctttggctgatgtcattccttctaaataccatgtaaattccctctcacttacagagttgttctctgcatggtgggcattacaggcaactgtagtcttatgatttcagatcaaaactgatactgtttcacttttcaactatgtcgatttgaaacgtttgcagataccattcacaatggtaacaatggagtgtcatatttattttcaagggagacttagaggatcagaggtaaagtcttaatagttcttctcaagctgcatggacaagatactttttagacctctgtttatggtgtagatatcagaaaagaagatgaactcaagagtctatgaaatcacaggaaagacttggaagcactgtcggaagctgaatgagatacatctttggcctcagttccttcatttgcaaaatgaggaacaactctcctcattagatcactgtggagaaaacgtgagagagtacgtgtaaagtacctagaacaatgaaggcacagtcaggagcacaggctcgtgagaggatatttttattactattcaatctgagctatagagattcaaaaagggctggggactttctaaaatcatatgaaaaatgcctgcgtacttctctgatgaaagagatgtggatgtcatcagattttcgaaataggtacgagtgtgcctgccgagttgttttagtcgtgtctgattctgtgcgaccctatggactgtagccaaccagactcctctgtccacgggattctccaggcaagaatgttggagtgtgttgctgtgccctcccttcaaaacaggtagcctaatcacaaaatttctaagacccatggcacttgggttgagcctaactttctaaactgagtgtgtatatacagaccacagatgaagacaaatgcaggctgccccatttacacttgcagcattaattgtgatgtccaccacaatgtagagttgctcctccattagtgggcccatatccagtacaaacggatctccctccagcacccaacaccactacccacgaccacaagatacaaacctgaaaatgaacacaagttgacaatccacactggtggtcatcacgtagccccgtatctgatggccaagaggttttgggaaggattgaaggcagtctgggaaggggcaaagcaagtggaaacctgatatttctgttgatgcttacatcctaaaaataccacaaagaagtgacatctatcacaggaccaggtatgagagggaaaatgctagaggaggagacagcaaagaaggcatttgcaggaggctgctttactgtttcaattttgcatttttctttcaaaggcagcacagatcctctgtaagaagaaaaagacagatgggatgacagaattttgtgcctgttttccggagcatttactagagaatttatgactcttcgtagttactgttgggtatgcacttagaataattttctgccatgacaacaggtagtcctcataaaatttcagtctctaacaagagggcagagatgtcgcttttctagtgtttctgcttttagtttgcacattaataaccctgaatagctattcagtattctaaataaattgaagctgccttgcttgaaat

SEQ ID NO: 61537 - DNA, 794 bp, Bovine  19866880757395
cacaggatttcccagggcctttgtggtgtgtggacaaagcatgctggttatgtggaacttggtgggtatgctggctacggccaatgtcatctagagaagatgccaaggaaggggccctggagccccatgtgtctgtcccagggatttggatcacatcccccgagtggtgcttctgtcttcgagcagggagacacaagtaagttctgttgatgtgtcttctatttactgcaattgattccatctcagtaacataccctcgaagtctaagcatttacagagtaagaggacaaacttcaaaagaacatgaatctttgtaccagatggagtttgagagttctcttgtgatttctctgggtctgttctggttagctgtagagcctcaggcactgcacgggtccccgaagagtgccaggatgatgagttcagactagagtgagctcaagttggtggctgagtcctatagacgaaagctctggactcagaaggccagaggtcctgggtctggctgggtaatgtagtcacgtaaccactgccagtcaaggagtacctccagttagggcccagtcgaagtggttttctggagtttgtacttagaactctcccccatgggtgccttacattagaagcagtaacttctcaactgactttcagacagatcctgagaagataatacctgacaatttccttggggtataagccctcctaagaatattcacattttaataagaggcagttggagatttaaacagattgttaggcaaagaaagaagcctttttgtaggttgggtacaagg

SEQ ID NO: 61538 - DNA, 1096 bp, Bovine  19866880916930
ttgaagaatatcccttttagacatgtgcttgtcaattacaacaattctgtggctttgtacactttacctaaagccgtaatttgatagaaacacgctgtgagagactctaacatgcggtgattataatcaacagactgccatccactagcattccttcctgacacttataagactatctgaaatacacactcttgtattgaagaatcactttttcccccattttctgacaggaccctaaaatttttgactgaggacaatgtcacagtatttaaaaatacggacgagaacatttgatgatctcacattaattccatcaagagtaaagatgacacacaagatctctgagggagagaagggaacagagggagagagagaagagttgtttttaatccactgaattgctttaaacacagtctcgagtaatttcatttgctgatgttacattaaaactatggttctgctaaaattaaacacacttttgagacagtatcatatctccagaaattttagaatctgctgctccaaaaatacctgactcatatcacacatttaaacaagtttctggaaatacagctggaccctcacaaaatcacaagtgtttctactaaagtacaatattaagtgtgccaatataccccaaattcactgagaaaatgcagtcatttttaaaactttaagacgagaaaagcattttctttttaaggaaataaaaattcattttccttttaaaaagaactcccccctcccaaaagtttattaagaataaaaatcagcacaaattaactgagaaactgtgctacagagattatagattatagaactataaatagaaagaagtagcatcctttgtttttaaaagatatatattagggagacaaaatataaagggaaatctaaacaaagcttttctcaaacacatctttataagaaaaactacaagtatactggggtttggggtttaaaaagcaaccttcacactatgtcaaagagactatacagatttaagccaatatcttattcacatgattataaaaccaaagatattctacatattttgtgacttattagagagggcctttatgctttatatttaaaa

SEQ ID NO: 61539 - DNA, 3468 bp, Bovine  19866880985909
ttcagggatggatcctgccgaaccaagcagattacaaagagaaagaaaaatcaatgtgctatagaaacaattctaaatctattttcgctgttacaatttgaacatgatttagacatagagtggttcttcctaagaacaaagtagataaaggtttcctaggagaataaactcactaaattagggcaggaaatctaggcaatgaatgaaagtcaagttactggttgacgataatgggaaatgactgccaaagagagacaccttttgattgccctattattttccctccaataggttccttaagtacagtttcctctccataatttctatcatgaggtaaacccaaagtcttttgttaggcacacctcaaagaaaaactgccctcataatgcacagataatgcagagaaaacaaaagaacatttttgttgtgttctgaaaagaaactgcacattttgttatctcaaagatacaaggaatgataaaaaggagaaatggtaaaaagaaaaaaagaataatgcataagaattgcatagtaaatttaaactagctaatttcataggttttgaaatggactgtactgaaaaatgtgccttctgaatatcacaccaaaaagaccattctcgctacctttttccatggagaggaagaagcagtaaccattaccctccttcactccattaagaagcaaagctacctgttcatatacaggtgcactagtctaagctacctgacatggcagaatggagatattgaccactgaaatctaggaagaaatctgaggctaactatcagtttgaagaagtaagtccactatgctcaactacttactgttaaactttcaagttcagagaaaagtttcttaaacttcccagggattttctaaaaacaaacaaacagaaaaagaaaaggtcaaaagaagtcagttattttgagaggaatgttcattaagttgcactatatacttcacatttctgaacataaatccctctatcaactggttctaccttgattgcttctcattactcaattttcatcattccttaatgtgatgttccttgggaatgttgctaaagacagtttaaaatgaatagcagccacaggatttaggaatccaacttaagacagtccacacactggtgatcttttcatgaaagcttggatttcagttctgtatcctacccttgacaaacgctctcaccttcttaaatggtcttgttgagtgggaagtaataatgttgactgatattttttgtataaatgatataatgatgtttcacagcagaggtttaaatagtgaaaggccatgaaaaccctcattgatgaggcctgtactttagtgggtagaatcaccaaaccggaaagatcacccatgcaaacagtggcctgaagactgacaggggatggaaacgtacactgtcctcccaaataagaatttgggcctaaggaagaagggcctgggatttcccagcctgcccttactctggtgaagtaggaaagccagacgtctcggtagtcagtcagagtttgaattctgactctgccctctttctagctgtgtgactgcagccagtctccacgttctctgattgaaatggagactactcacaggaaacgtacagtcgacagttggtgctcggcaaatttcagcacgtaacacttacgagtgttctacaaaatgtgtgggattttctgtttccaaaacaaatcaaaacaatgaggtaaacccttacaataactacacttttaaatatcaatttgataattctgaatatggactcaacaacacaggttattcaacctgtttggaaactactgttacacacaccaacacatacgtattaataaatggatgataaatgcgaaacgataaaatgcagacacctgcaactattcttctgaagctgcatacctgagtattttggatatcccacaaaaaatgtctcagttgcgcgtcaaactcaacgcatctagggccaaactgatctactcaaggggtcagccatgggccaaatatgaccccatgcttttgtaaataaagttttattggagcatggccatgctcatcatttacagactaaacagggcttgcacttcaataggagacttgagtcatgccaatggaaacaacatgccaaaaaaaaaattcaccatctggccctttaccccaaatgactgctgacctctcttctagttcctgaaaccaacttttcctctattgactacttaggccagtgtgatcattttccaggcctagaaacactgaagtcatcagctcaagtgggcgtctctctctgagaacccaatggccttgatcatacaacagtgacaggcagaaccaggatttgggagacctggaacatataacattttgtgggccctcttttttaataaaaaaaaagaatataaaactacttttgtaaattttgcaaagatatctgccatccacgtgaacatactgccaggaatattgcaaatgagaggcctggtagcttaaattcataagcatctcagcaaatctgcctctggacaaacggagcttttgaaaggaccaacatgaaactgtaaccatgccatcacggagaaaaacagaaaactaattcaagttaggaggcatttttcaatttttgtttctttcatatatattatagaaccattttgaagaccacttgatcaaaatatttcctaacaccttttaaatatagcagtgtgtacatgcctatctcaaactcccaaactatcccccacaaccaaccataagctaaaatggataaccaataatgtatagcacatagaactctgctcagttggggcagcctggatgggaggggagtttgggggagaatggatacatggatatgtataactgagtcccttcactgctcacctgaaactatcacagcattgttaatcagctgtaccccaatacaatataaaaagtttaaggagaaaaacagttcctaaggacttgagacactaatttataacatttgtttctagtggtacttctctcatttaaaccatttaaatcaatttactttaaataaggacttttcggtggaacatttcccattcagtgttatttgtcctctcccacccactccatccctgccatggacccccaaggctcacctcccaggtctgagatagccggctcacagaagcagtgttgagacccatcacgatagcaaagaaggagttcaggtttctctgggctttgcagctgtggattaaagaaagcaggaggcactgttaggcaacatccttttgccagatgagcacaaaagataaagctgccaagactctcctaggccacagggttcagcctctagggaggggctgaactctgctccatgacccatgtgcccctgggagaggagtggtacctgctgcacaaaaacaaattcaaatacttccgctcatcattgcctttaggaaaagacctgtgctttttaaaaaacttaattaattt

SEQ ID NO: 61540 - DNA, 779 bp, Bovine  19866881000985
tctctgtaactgcccttttgagtaaatacagcagcgcaccctcctcctttcactggcaggtgggttgaggatcccagggagggagtcgcttaagactgtttgctgggaggctagaagcaggcctggaactgggttcaattccccttcaacacgcctcactgcctttatgtgccctgtaggaactggaagagtggaaacgctcacacctatggcactgagatactcttaatgtcattggcatcaggcgaatagtctccagtaaccgatccaatttgatgtgtacacgcgcaagtaattttctgttagacatcatcatcattagcattcaacaattaaaattctcatccctttagcctataaaagccggcagagaagctgttcaggtagttctgatccaaatttcccaggtccaagaggcttggttttcccccatctcatgttcagtaaagcatgcaagtaattggccgtggagtggcactgaacggctgacccttttgaggcctgccggccactacgagttgctctgttctgactgtcatctggcggccacagctttcaagcaattacccgtggccacttagtgacagtattaaggaaagttaagttgggactgttcccagctcctaatttaccactcggtaaaaatggaaagttaaaaagaaaactagcttggctgcagcctctaactgtttctgaaaaacctatccggggcagatggttgtgaaggaaggcaactgacagagaacttggcttatctggagatgctgggggaggacttg

SEQ ID NO: 61541 - DNA, 3291 bp, Bovine  19866881072161
tattttctcccattctaagggttatctttttgtcttgtttatagtttcctttgctgtgcagaaacttttaagtttaattaggtcccatttgtttatttttgtttttacttgaattactccagaggatgggtcaaaaaagatactgctgcaatttgtgccagagagtttcctttcctctaagagttttaaactatctggccttacattcaggtctgtaatccattttgagtacacttaatatttttaaaaacctattttaaattcacttttttttttaaaaaactcagcctcaccccaagtcatagcatgtacaaaatcatgtgtttacttgtgctagttctcttttttcctatatgttaaaaaaaaaaaaaaaaatatatatatatatatatatatatatatatataaaccattaggataaaaaagaattcactagtggatccctaagaacatcccataccagcagcagtggtagactcggcacactcttgctgagacctgcatgatgttccaagtgctgctgttgccccaaacgccatctctccatcacatccttccaggaacagggaaccattacccagcaggcaacatgtcactctgtaattgtgtaaaaggtcagatccagtagttctgtctctaactgagcctggatgggctcactggagattgtggcatgtccaaagctctctgtgcctcttccctcaagaaaccaacattgccacggcttattccactgaatttccttctcttttttgttgtttttcttcacagaggtgtaatttcagaatttccccaatacttttcttccttggcacccactttctgcctcaaaggtgtcttttctctcttttcatcactggattattcctgtcaatttaaaatgaaaataggtctgcttaagggtgactaacttctattttgtaaaaagtctctctctaactgattagtatttattatacaattcaccaattaaatccatttacagtgagtgacaacttataattgtttaataaaccaaaatttacccatacatgcatttagaagagtctaataagacatttgacaaactgcagccctgacataaataaaattgtggccatatctgatgtgttaaaaatacagtgcaaaatcttggatgtcactaaagtgtaatccttgttattaaggttctgactctattatgaagacacagaatttttgtcagtgaaatacatattctcttagctttaacttgaacctttgatgacacaatttaggtgtaaaaaattctgtctttctctctttatatatatatgtatttttttaatgtttatttatgtatttggctgtacccagtctagttacggctagactgggaaactctgaccttgttgtagcaggtgagacgtgggatcttttagtttcagcactcaagacctttagttgtagaatgcgaactcttagctgtatcatgtgggacctagttccctgaccagggatggaactcaggcctcctgcattggaagcatgagtcttagccactgacccaccaggaaagttcctatatatgtgtgtatatattgataatctaaaacatccaaagactgataaatttgagtcctgatttttttctaagtatggatatagttaagtaaaagaatcccagagtatttttttatttgtatttcagaaacaagttgttttatatagagcatcaaattctttatcacaaaatatcacaccagggcaatttattccaaattaataatctttcctgaatatgtgctaagaaaagttatgaccaacctagactgcatattaaaaagcagaaacattactttgccaaaaagggtctgtctagttaaggctatggtttttccagtagtcacgtatggatgtgagagttggggctataaagaaaccaaagtgccgaagaattgatgcttttgaactgtagtgttggaaaagactcttgagaatcccttgggctgcaaggagatccaaccagtccatcctaaaggagatcagtcctgagtgttcattggaagctgatgctgaagctgaaaccaatactttggccacctgatgtgaagagttgactcatttgaaaagaccctgatgctgggaaagattgaaggagggaggagaaggggacgacagaggatgaggtggttggatggcatcaccgactcaatggacatgagtttgagtaaacttccagagttggcgatagacagggaggcctggtgtgctgcagtccacgaggtcgccaagagtcggaaaagactgagtgactgatctgaactgattaggctttatagaattgatcatgtcattgtagctgtttttaaaagttgaagaaaattttaaatgatctgtaagaatataataaatggagtttattgcatgcagttgttactgtaacacttctaactcctaaactctttcataagagtggcaacaactgcttttatgaaggtaattttgtgtaccttgagttttctttagatgtttttagagttttgttattcagagaatctgagtccttgcaaattgtgtcagtcactgaataaggcttctctgagaactgccagaggcaggccctgtactggtggtcagtgattcagaacccaaggtacagaccctgcccttaaggaagctgcatttcctgagggggaagtcagacctatacacagcacaagtcatacatgccatgggtatgatgatggaagtatacacgatagagagtcatctgctccgtggtttagacttggaaagactttgtgttacatttacatttagtgtgaatcttaaaaggtcagtgggcatttgtcagacaaatgggagaagagaattctggaatgagaagactcataccaagtactaaaacatactaatcagcccagcagcttcggggaactgcgattaagattcaaatatgtggagagccccattttggggaaaaaggtgtatgaactgagaaaggtgggactggattgtcaggccccagaatgtgagtgtccttgggtacccacagatgacccacaggttggccttttcctttgttacaatgcttttcccccaagcacattgaaggggcacattcctgtccataatgctagttgacagtatccatggtttgtaaccaagggaccttgtcttcgtggagtaacacatctggagtttctgtatgttcacttgagaatcatgagcagaagtcagtgggaaagctagtgaagactcttagcatgctaagaataatgcaatcagatttatggtttttgaaagggcacgttggcagtatggagtatt

SEQ ID NO: 61542 - DNA, 1621 bp, Bovine  19866881091735
atcgaacccggtctccttgcattgtagatagacgctttactgcctgagtccaccagggaagcaccagtggcaggaaagcttctgctaaacccactgaccctcagcccttcctcattactctcaggctggtgttgagcatgttagaggttgaggtcttctcagtgaccactcagaaccatgctaaggacgttccacactgaggaactttcaaccttctaggctcttacagccaggtccacagttctggaaggaggagccctgagacaaggctgaatgcatggatgaatgcattagccaggcctcacctgactgtgcctgtaacctctgcagctgctttggtgaaaggatcacttgtgattgccccaagaggaaaggttttgtcacagaagctatttccctcttgcatctttttgtgaatctttttctattagtgcattaatcataagaagtattgctggcttaaaggatttttgtgagtcagccaggggtctaccaccacggtgtttaatcaccttcattgccacatgatcttcagctcgcagttgaaggccagaaccacaggtttaaagggccatgggcgtctcactccgcacatccctgctgacttatttaccttctgttcattgactggtaaaaaggaaatagtaaaggtgcatgttactctattatttttcatctaattatttagaaaagcctcccctgtgaattgattaaggtattataccgagggaagatttcagatcgactctgggtaaatctacagactcgtgtaaatccacccattacatctaaatggacttcctttgaaccaggtcactctgtaaatgatgagggccttaatcctgtctttcgtttaaacacgtctttcaagataatttctcctagcaacctgttggggtattagttcggctctgatgcagacggagttagcgttgaactgtaaagcacaaaatcccttgtttggtttcccagaatttgtttcctaaaatttaataatatttccctgtttttcttttgtttgaataacagcgagggagtttacttgattgaagcttcgacattatcttaccctagacagagacactgagcgccaaaactgtgagcggctgtgtgttaaagggaccatccctgcccgaatcctctttcatcttctgttcccatctggccaggttttccttccagatgctcgtctcttctctgcttctccactcccacttagactgtttaacagcctcaggtgttatcacctcaactgggagtccccttggttatcccccagtctgcctccttgatcttaattctagatattccaggcaacgatgcctcctgtttgtctgctaattatcctcaagcatgcttccaccatgtccgtccccaactaagaaacatactgtgctccctacggattaccacgcaccttccagtgttctctgctggactttcgaggccttccacaatctagcctgtcccacacagcccagcatgctctcatgctccattactcgacgcactttgctttttcctcttaccgtgagcaagtcgggatcgtttccagagccagtggatatgggtgtccagcttgtgtactgcagccctgggcgtcatgcaaagccgatcattt

SEQ ID NO: 61543 - DNA, 869 bp, Bovine  19866881138953
gctcggcttcctcgctgtctgttggtcaagttaggtctcctattgccttctcctgtgtcttcttgggcctttgaccacaaagaaatttttttttttttaaccagtgtcctaaatactcaagggctgtgtaaacgtgcacacctgacttaaaaaaggaaatttccagtatgataacagtcaatggcatatgaaaaggcataaacagacagattttgtttcaagattatgagtgtgtagaagacaaacttgcaaggaaggacactcacccttatcagctggtctctggttggagccaccaatgcaaatagtgtaaggaaaaaatgtgtcatccttgaagggaatatttgcatgatgcatagtgcatgatatactacacaaataatagcacagcatcacacaggtttgtcatgaaccatctgatggcagatagtcctatttgtgattcttgaaaactaaaataaaatgagtaaggcttaacatttttgggtttgaaacatgtttcattattttgtgacttttatctcaattgcatattcattccataataaaacataaaaatagtattagtatcaagcacacacttctgtgtggcattctcagcagaggcagggtgggcagtactgggtttcaagtgcaagctctgcctctgatctcccacttcagccttagttcttggggaaggtcccattcagtccatcttgatcattatatattaaagcgttagcaggcttgaatagagaggcaaaactgtattttagattttctctttcaattagctggtaaagaaaatgcaaaacatcttaaatggaggaaaaattaaaacaagagatgttgggaagggatgggcaccaaggaggactcatcaaagt

SEQ ID NO: 61544 - DNA, 1481 bp, Bovine  19866881139569
cgttttctgaatgttaagctttaagccactttttcctttccctttcctttctcaagaggcttgtgagttcctcttcactttctgccataagggtggtgtcatctgcatatctgaggttattgatatttctcccagcaatcttgattccagcttgtgatactcagggtgggtgcattttatcgcaggaaacaaagctgatttaaaacatgagttaaaaggaatgggttcagacgcaacagcacaagttctctgacagattgccgtaagtgtataaactggcagagtatgtgtggaaagcaggttgtcagtaaagacctgaactattcaccaagtaattctacatgcagaaatctattctggataataagctgaaataaggataatgcttcatgtgaagggatgtttacagcctgctattttgtgatcataaagaaccgaaaagaaaaacacaagccctccatgtcagacaatagggaatggttaagaagattatggatgagccaagggagtgaccattttggagctacaaagaaatggtatttctaaagaattttcagtaatatgacaaactacttatgtcaacacattaaatgagaattaaatgaaaatcatgcctaatctaataacttaagctcataaaacaggaattataagactagaaaaaatataacaatatttctaggtgataaaattgtaatttttttctttattcagtttcatattttccaaatagtctgtactttgtcaaaattatatttataataaaaatcattttattataaatataataagagctagtattaaatgttcaatgtaccatgtaagttttatgtaacaattttgaggtctggtttcatatttcacaagagttaatttatcatggtgaaagttctctctataaagggatcccaaagaaacaataaggggttttccatagaaattcttgagtaaaaacaaatcatttaacagtgcaaaccagcaacgttaggtggcatgagcgctccagatgctaaaccacaaaagcataacacttgcctgaaaagagctttgagattttctggtaattcagttcgaccagcatatcctgggttcatagtgataaatattccgactgatggcttcagtatgatagcttcgccaagaaatacaaatctaccagaagaagaatgctgatggaattaaatgtgttcattgaatatcaatgcacattgacaaatgcaaaccactgcaaaatgcaaattattattaggaagctgtttatgctgtgtaattttctttaaaattcataagcatacatattttgaatatcttgaagcatgtttattaaaaatacactcccttcccccaaagaaattacaagtatggcaaatatccctttgtattttagcatggccagtgtgctagaatataaaaatgaggacttgactacttcaacagttaatgaaaggtgatgccatctggacttcaacatgggctgcaat

SEQ ID NO: 61545 - DNA, 2006 bp, Bovine  19866881214417
agagctctgctaagtgacagggaatgtgaaggttaagtaaatcacagtctcaaaatattacataaagaagccagattaattttatcaggacataaagattttattgagcatgatacctgtcacacttggctaacacttctgaaattctgtaaatttagcttcataaacatttatatctggaaagggattttctaggtaactgaatttgctcttcttagttttcaggtaaggaaaagggacaagaaatagagagcctaggaaaagacaccctcttgccagactcttcactgagtgacttacttaacaacattcatgtaccttcaggtttgtgttaataactgtgctaaagccttgtaagagatgtgaccacatatatgtaagtaacggaaggccttttatgagaccagtgttattatgacaaagttaagaaaaggaaactgagtgtaaacatgaaaactgtaacaaatattactgaatgggatctggcaatatataaaaatgataatatatgataaaatgatatttatcccaggaatattagggtgattcaacatctaaaaatcacagtataatccaccatattcagtccccataagaaaaccaaaagtatatgacaaactctgcagatgcatgaaagcatttttaaaaattcaacattcatgataaaaaattttcagaaaaccgagaatgtaagggaatttcttcaatctggtataaccttacatgaaacatatagcttacatcatacttaatagcaaaagactgaatacttttccgctaaaactgtgaacaaggctaatatattgccttttatcactgtttccaacatgagccagtgcaatacggccagacaaagaaatggtatacagattagaaggaaaaaaataaagccatctttctttgtagatgacctaataataaacataaattatatacagagaagattccaaggaatccacaagaaacccactagacctaataagtggtttagcaagattgcaggctataagatcaatgtacagaatcacatttctctgtactagcacaaaaaagaacctatgaaatgcttaggtgcaagtcttaagaaagtgtgtaagagctgtatgtcacacacttcataagcctgatagtaaaaaatcaggaattaagtagggaatctattcatgttcatggattggaagctttgatattgtttagatattaattctccccacattggccaatcacttctatggctgtcatctcctgccctgttgccctcactatacctatataatataaaacccatgtttggaaacattgacctttaagcagggagtgtctggagctcagtcttcttttttctgctgtctctctggatgcaccgtcactcagtcatatttttaatatcaactccacagtgatgactcccataatttcagatccctgtcttctccgaggactttattatataataatagcaccaccaccaattcctgcatcacctctgacccctttattctccttatcctgcctaacttgtccttttttatctgacatgtgtaagcaccatgagaaatccattggcatccttaatttctgagatggtgctagattaacacctaactggaaagatcaactgcaagtccgcattcctgcttccccaaactgcactttgtattcttgactttttctgattagattctcattttatgatccttggagaggacgaaatactggatgagtaaacaaaggttttttgagtatctctcaaaatttttttcatgatgaaacttggcataagttttgtattagggtcatagtaaaaactgctatgaaatcagctgttctcagtctttgttattactcatcactccttctcctaaggaaaaactaagtcctctaaaatttccattgtttacagataagacttgctccaggtgtggaaacagactgcttttctctatcagtttaggaatagaataggaattttaacaaaaattaaacttttaggcttgcttgggcca

SEQ ID NO: 61546 - DNA, 1030 bp, Bovine  19866881219162
cacaggactgctatgggcatgaagtgagttaacacctataaagcatccaggaatggtgcctgcaacagcgagtgctacgtgcatgttagctaccatcatcatcatcatcatcacactactataagcaatacggctgagcttaacaacaaattataatagaaggacacttcagtccctagttgctttactatttcatttgtttaaacccttcttcctatctaaattattaaaactccttgacaatcagtactgcttctgcttgtaatatgcctcctacatggcccccacattgccaggagcataaaagtgactgataggcttcactgaaaagggccaacagtgcaggtatttctagagtttatattttttttaaaaatatacttttagatttctacaaaattctgaagcttttacaaaggtatgtaagacagacctcagatttagaaattcactttgaaacttcagagggatcaaccaacgagctgtggcctggcagcttttggcatccaagagataactgctgttgaatgaaccaagggattgtggctgtattcgacaagcagtgtgtattacttttgtatttctgccctagcaaatcacgacccacagcttaagagaacacccattgatcatctcacactgccataggttaggagtgcagaggaagcatggctcagctggatcctctgcttagagacttatgaggccaaaaacgaaggtacaggcggagctgtgttccctgtggaggcactgggagagaagatgcttccaagagcatccgggtggttggcagagtctgggtcctgcatctacgtgactaggggacccatttccttgcttgtgtcacctggaacctgccctgagctcctagaggcctctctctggtccttgcacagggagacctacttctcagagccagcaacaacacactgaatcctcacactcgaatctttccttattttctcttctgtcatttctctttgatgctcaccacagcaaggttcacaggattagactgggtacttgcaga

SEQ ID NO: 61547 - DNA, 1064 bp, Bovine  19866881249687
tggtctttaaatgaggtcgtgcctttgaattgaagactgggtaacaaattagctacacaaagtaacaaaacatactttagcttaatgttcccagacaggatcttttaatctggtaggttggtggggctgggagaaggcagcatttcatttgcaagaaatccagagtgctttaggaattttaggagacacctggagatgagttgggaatattttccaaccttgggcaccagcattgtacccttgggagggaaggggctctgtggggttccccccatctccaacggagtgtgggcggctctgcatagaacagtgcctccccttgtttacattctactcacacagccctccgtgatcagctaaacagtgtcacggcagcattctctgttgttttcatggaaaggatgtgttgacacgcgctacctagctgtgaatataaacacgaagatgctgacagcagccggagcagacggctagcaggtacccacacttagagcgggcagatgtttaaccttgacatgagcagtaattaagcagagcctcggtaaccagtgcctccccaggagccaattaataatttggtgggggagatgttatatgcagatttccccccaaaccactgcagcatgcctttccagcctcccccagtggacggggctgagcaatcatttgtaacagagccctgtggtgtgcgtgtgaacaaattgtaattaggcaaattaaatgaatgctgcatgtacatcagttaatttctggtcacaagatagacagcgatccattatatatcaaagtcttcatcttggaggcagcactcacccacctctgcctacccctctctcttctacacccacccccaggaaaagccttggccctcacttaattctcattgagttacttcatcccagtttgtttatttctttttggcagcaatatagcaatatacacattccaagcagtcttctgactttcaaaagagaaaaaaatcctgctttaaaaagatgtttagaaaatgcatgcatctagcatatattgttctttctggatccagtagtgatagcatccatttc

SEQ ID NO: 61548 - DNA, 661 bp, Bovine  19866881333265
ctatgtttttcctttgtatggattctcagtaaattacttttgtatgagtcaaacccaaaacagacagcatcctctttaagagacttaagttcccaggataaatattctaaattcggagtcatgaagacgtcatagtaaatcagatggattgctaggaagcaagtgacgcaaatcacagtgataaaaaaaaaaacaacatggcttttatttttgcagtagaaccccttttgattcatcaattattttgtgaacagagcaactggcttctactaatagaaacccaacttccatgctaaagcttaaaatggattttagtagctccccaccaccaaaaaaggatgtaaaattatagaggatgaaagaaaatctgtgtatccccaaacttagtaggtactggaccgtacatcccaccggctaggacagggaaaggggctgctctcctcgttggacgggggtctccactcaggtttcgctcccagtgtcaagcccactggctctctctgggccaagggtctggcaggtaaggagccagttgtggtgtgctttaaggcgtgttctgagtctgtcgcaggagcacttggtgggctgcgggaggacagcctggcattatgagtgccctttggtgccctgtgttcttcccacaccatcagagaaaaagcta

SEQ ID NO: 61549 - DNA, 788 bp, Bovine  19866881354611
gaggcagactgcatgtggcccatgggctgtaggcggctgacccctggcgtgagagctggagtcccccctcctcatggactgcccagagcagagcctccacgatgattctgtcattcaaaaatcggacctcagaggacagacggaaaggcatcagggctcatttaaattcagagaaaaagaaccagaggtccacaggggcttctgtgataatagaatttcagacatcctgagcatttgctgctgggataaataacctgtgggcagggttcatatcgtttttcatttcatcaagtcaagagcatgtttcataagcaaatgcaaatgctcaagagcttttctgagtttgtagcaagtggcaggaatttacatcctgtgtgtcccagtggcatggtgccaggggctccctctccacccttctcagacctgttggcctaagtctttgggggcattccctccaagaacccccaaactggactggaggctatctagggaagagctaaacccatgcctgcagctcatgttaagggaacggaggacaaaagcataaagtcttcaaaatcgtcatttctacatgaatagaccaatcaagcactgaagattcaagcatgaggatcaccagtgcgaagcttttcagatgtcaacagcaaaagggaaacaaaatcaagaggctggactgcctttcacctccaccctggttcactagcttttagttgccaattatctctcaacgctcctgtcccatcccctgtcatgtttgtctggcaagcatctaagcctctctctcatta

SEQ ID NO: 61550 - DNA, 978 bp, Bovine  19866882071709
tagtcgtcttttctagtcttgagaaggtgtaaaatcttacgcagcacttacagggtttgatttcattctggcttccaaggtattggttttcattccaattttgcagtcattttcaacagcagtgatgtgctggacatttgtggtaaaagtcaggtggctggggtacttggtatggcagtgattcccactgcctgagaaccaggacaccaagtagaagagatctgtgtttctatgtttacagagagccaaccaagagagtagaatttaaacactttttattaatgtgaggaaaaaacagtttcttctttgcatttgactctgcattggatccagcattgttttccaaagcatcttagtggggaaaccctgcatttataatcactggatactggcactttgcttctttttatttttgccttcaccgtgattggctgcaagatgactgcaaatgagatcaaccagttttcattaaggggccatatgtagcaggaatgatgttcttcgctccatcctgtaaaagtgaaaaatacagcatagcatcaccattgctgtagctgtaccaggagccctctcctcccagctccccctgccccccaaaagaaaattagagataaatgaatggcagaataaataatttatgctaatgaaattactgcaattagtagttctacaatgacccttttaaaagccacagctgttaatgtcaggaagtgctgtcactactgaccttatcataagagaaagtgacaaattgagaatgcagggaagaccagtcatcaaagaggtctgttctggaacgattagagttttctgaaaaacagtgtgaattacaaccagctgctccctggctctgcaagtctcccatgctgtgccattttgttaagcccgataacaatagttattttgccccattgagacaagttgtctcgggcctcttccagctctaccggaaaccacttcttccatctcggatttaca

SEQ ID NO: 61551 - DNA, 1776 bp, Bovine  19866880373773
agagctaaccattatatcagagaaacatgtgtccagaagtggcactgttaacatacagtaggtatctaccaatggaaacaacacccattccagggtacttttggctgtggaatcccagcactacgcttgggggcagaaggtgggtagaaaaataaaaatatgagttcagttcagttcagttcagtcgctcagtcgtgtccgactctttgcaaccccatgaattgcagcacgccaggcctccctgtccatcaacaactcccggagttcactcagactcacgtccatcgagtcagtgatgccatccagccatctcatcctctgttgtccccttctcctcctgctcccaatccctcccagcatcagagtctttcccaatgagtcaactcttcgcatgaggtggccaaaatatgagttaccacatactaaagaatcaacctgctaactggtacctatgtcatgattctagaaatgtactaacctgatgctcagatgagccagagctcacatgttttatggaataataatctgtcccactgggggcacacaaaaatcaagacctaccagagaagcaaaaatagggaatgaattatttaactgggataattttttaaaactaaacttttaacccttttatatatggtattaaatttaccttaatactgtagaattgtgtattaagacacgagaaacttttccacgtttcaacacattaaaaggtatatattttaaaagtatgtataagttaaaacagggatccaaggatatagagccaattctgcagcagagtggaggagacctgaacaggttccactgaggaaatgattcttccttaacaagatgggagttatgagaggtgttataaaggagaatctatacaactcggtgcccaaatgaggtaagtgaggaaaagcgggtctaggctgactcaaggctggctagactgactgaagagattaggtgaggagcctgactgggtgaaatgaggagttctgaacacagttcatctgtagagttgctgagacttgacctgctctcctcagcagggagatggcgtgtggtgggggaggcagactgacaacaaaagaagcaggtggtcagaaaacaaaccacgtaattaaaaaaaaaaaaaaaaagctgaaacaattctcatagactttagatcaataaggactttaaatgctaactgctctacacacaagtaacacgttttaaaaagttaactactctcatcatatatgtgagtaaactagaaacgttttgtttttgctttaatgaacactatttattcaagtggtaaagaatctgcatgccaatgcagaagatgccagagatgcggttcgatccccgggtcgggaagatcccctggagcaggaaatggccacccattccagtactcttgcctggagaagcccaagggcagagaagcctggtgggctacagtctatgggggtcgcaaagagtcagaaacgactgagcttgcaatctaccaccaaaatctgtccccaacccgcatatcaactaagtacacataagacaggtgggctcaaaagacttctgcctctgcaggcaaaaccctaaagaaatgtgatcgccatggtttataataacacatctcaacattaacatggagaagtgattacctgtactacaggtcttcgaaacatggcttctactctctcttcttccaatctaatctttagtcttttcctgaagaaaaagagattatatcctatagcaagaacacgatttcactgaagtcctaaattcctaacggca

SEQ ID NO: 61552 - DNA, 2420 bp, Bovine  19866880389510
agcacaaactctagggccagactgcctgtgttcagacaccaggtctagcattggctggtggaaaccactttctctctctatgcctggatctaaccatcttgaaatggggacaacaggactgtgggcgggattatgtgaattaacatatgtaaaagatttggcacatcagcattatgtaagtattttatattatcaggattaggttcttttgactcacactgagggtttcagcaccaggagcccctctttgtgaaggtctctggctactccccagcccaggctgagttaggctccctcccctgtgcttccacactgatccggccctcacaccctcactgcactgatgtcaccctgttgtcactgcaggtttaattctgcagatcttgatgagggcagggtgtgtccccagggcctcacacagcaccttactgagggaggggtgagttaagatgctctggaaataggattacttgagtaagaggtgtgctaagggacatgcctatgaggtcaaagcgggcgggaacagaagaatgtagggagagccttcaaaccacaaggtaaggtaggtctgacatgtgtgaaggaggtggggaaggaaggaggtctgggtagaaggatctcagacctcagttcagttcagccgctcagtcgtgtccgacttttgcgacctcatgaaccgcagcacaccaggcctccctgtccatcatcaactcccggattttactcaaactcacgtccattgaatcagtgatgccatccaaccatctcatcctctgtcatccccttctcctctcaccttcaatctttcccagtatcaggggcttttcaaatgagtcagctctttgcatcaggtggccaaagtgctggagtttcagctctggcatcagtccttccaatgaatattcaggactgatttccattacgattgactggttggatctccatgcagtccaatggactctcaagagtcttctccaacaccacagttcaaaagcatcaattcttcagtgctcagctttctttatagtccaactctcacatccatacatgactactggaaaaaccatagctttgattagatggacctttgttggcaaagtaatgtctctgctttgtaatatgctgtctaggttggttataggttttcttccaaggagcaggcgtcttttaatttcatggctgcaatcaccatctgtagtgattttggagccccccaaataaagtcagccactgtttcctcattctacttggcaaacaatttatgcttatgaacaacctagagtctgtaatgcataggttgtcactgaggaactcctggctccagccaatctgaatccacacttccaaaggtgtacccagaacatgccaagggcagcccactgcacacccatgctggtactggcttccttacccaggaggccttttcacactcccatttgcagatcttaccccttcttcaaggtctagtttaggatctgcttttctcatgaaacttcctataaatatttgagcttttttaaggatcttgaccgtccaacatctcaataatgatatccagcgtgcgttctcagtcacttcagtcatgttgaactctttgcaatcctgtacactgccaagctcctctgtccatgggattctccaggcaagaatactggagtgggttgccatgccctcctccagggcatcttcccaacccagggatcaaacctgcatcacttatgtctcctgcattggcaggcagattctttacccactgagccacctaggaagcccatgatatccagcatttacatttaatcacttattgatctttgacattgttttcttttactgatatgtatttattatttgtggattaatgcgtttctttttgtgtacctgttttatgacacaaacataattataagcttcctgaaggcctgagctatacaattttttccttgtgtttcccttattaactgatacagagcttggctggtaggagttacttggcacttgagagcagaatgagctttaaggtcatctgggacttttactttatttcaatcacagtaatctattttaaaaataagtttttttcctctacaagattatttattgacccgttcatccctcccaccttgccatcagtatgtaaaaacaaaattttactcattgaaaaaagtgtcctgtttcttgtttgtgagcttgattatgtctgattgacagctgagacatactccatgtttttcacgacaggttgttggctcatcgtccctgatgaggctgtgcaagtgatgctcagggtggaatcttgcccgtggtcacagggttgaactccagagagaggaagaaatagcaacactgcagaggctgccaaacttaattcaggcaccacttggccttgatgccttttgtactgaaggatattaacataaaga

SEQ ID NO: 61553 - DNA, 1216 bp, Bovine  19866880402324
tttgccacctctaaagatttctgctttcagggctaagaggttgacagcccctggattacaggtaccaagccctaagaggtgttcagaaaatgaatccctgtagttacttaaatgggttcaagaacactttggattttgtggtcttggagttgccatgaggaatgagaccctgtcttgctcacaccttcgtgaccagcgcctagaacaaagctgacacacgaggcaaggcactcggtgcctgtttgttgagtgaaagggcaaagccttttcacgtttccagcttcttcgcagtgatttgactctcctgacccacagctctctccctgatctcaggaaaagaacaaggggggctgccaagcaagtttgaaattaacctacattttgcaatttgtacaagaatataattagattccttctccagaggtactccattaatgtaatcgatgatagtagttactcagtatgtagccttaaaaaattgctgatgcctcataaaaacaaacacttgcctagtaaaattctctgcccaggactagtcacttatctgttttattttgtatgagacctggtatctcctctgcagcatgtccacttagagacagcagccaggcctgctcccttggaggccggaaggacccctcagtcatcacacctgtgaagtggagggctcttgctgctggtgggaggcatggaattgcgtggttctcaccatcagctagttctcccatgctggctagctggtgcttcccatggctgaccatacgatccagtcagcactgctattgccatacaacttaactcttttattttatctttttaatagacatgtaaatatgtatgaattcagcaccagttaaactcatgtaaatttaggggagccacttccttctttcaccctgtttcttccttctcctaccagaaagcattctctagccttggggtgtcatgggtctccagttgtcctgcctttaactgcaggcaggctgatgcccatcagggaccctgagcctcccctcagagacttgtggggagatatcagttgggccctaaacccgggagcaagaggctagtgatggagacatcaccccccggttgagaaaagagtgaagaggtcatctgagcacagctgtgagctgccatctctaataaccagggggaagtgggtgatgtcagttcctgcactggaaagttcttttgagtgacttggagcagatgg

SEQ ID NO: 61554 - DNA, 5654 bp, Bovine  19866880420550
gaagacgaaatggcaacccctccgtattcctgccagacaatcccatgggcagaggagactggccggctacattccatggggttgcaaagagtcggagaggaacaagcatacatgcacaggaggaaaatagtagtttttccttctacagaaggaattgggaggttgggaaaatgaaagggaaagagacattctccattttgtattttatataatccttctgtatttttaaaaccgtgaaccatgtcaatgtctcacctatacaaaaaaagtaaatgatgatgctaaaaacaaaacaagagtagagatcacaaaaaagaaaatccagctctgcccaggatggttttgaggcggtcacctcccacatctgaaccacagattctcatccctgcccttctggctcccacatcactcttgcatggcactcagcatctgtgatggtcctcaacagacacttttccgttctccgccctccaagccttcctctcccccacaatttgagtcacccctctcttaaccttaaaagcagggctgtgcctttgcagagagacattacaatggctgacacagccagtgggtgagccggtggccacgagggcctgtctcaggctaggacaaggtcagaactgccacatcaccactcactctgccctcacctattcaccagtcctgccttgtcctcaggcccagggctcacaggccagccacttacatcaccagttcctccaggctgaggactccacctgccccttgccaggatggatggctgcatccctagccctggatgagccggaggcgacccagccactggctgccagcctcctgtacattgacccagcggcacacagcctgcccctaagttcctattgctttgcctgtcttctgtcaggatgccctgggcgctagatttcctccactccttgtattagtggctgccccctgggtacccctgcccactgccgggagagctctgtttcactcccacacctcccacagccaacttggtgaagctttgctcccagaaacagcccttcaagtcttgccctcggctatgttctagtacattatggtgagggagtgtctctcatcatttgatgttcattctaggctactttaaaacagctcagaaaacctctcgtgacgtccgcggccagttcgggcatcacggctatctggaagatgaactgtcactgcagtgtgacccttcagatctacgctggctccactaccctcttcccaaagaatatagtgacctccctggtttggacttcagttcttgttgttgagtctctcagttgtgtccgactctttgtgaccccatggactgcagcatgccaggcttccctgtccttcactatcacctggagtttgctcaaactcacgtccattgagtcgatgataccatccaaccatctcatcctctgtctcccccttctcctcctgccctcaatctttcccagcatcgagggcttttccaatggacttcagattccttgtcaattccatcatcaccaatcctggacctcctcaggcagcaggactcaggaacgccctccagctcactttttccaccagataactttgactgttggcagggttccccaggtttggacaagtacgtgaccttgattctctccaggcttatcttcaatccacagcacatcccagactttcagagcagcctgtaatttctgtatatcctctcatgtgagtacttcaaggtcacaatcaccggcaaagagcaatcagcgctcaaatgactgtcttaatggatgttgtttgcagcctctctttactagaaggtacgcttatttcttttttatctcctcgtagcacctagggaagtacaaggctctgcatacagatgtgtaacgtatggaaagaaagaggtacaaggctagaagtcagaaggcttagtccacgctcttccacttactcatcgtgcaagtctcgcaacttcccagtttcctcccatgtaaaatgaaagccacagcacctgctccacaaggctgctgtgaaagcttgaggagttccagtgtatgatggcaccgttctggacattatcatcagtgtactgagagtcctcttacaaacatcttatcaaaggcatacacgtagaagatacaggctcgagactatccaagtggacttgtgatgctgccacatgtcagatactcagggactccttaaagatgctgcagaggcaagagccctgacatgagggtagcccatgctattagaaggccacgtgagtctactcactgtccggagggaatcaggagaacccccttcctggaaaccagataaatcctgccctacccaaacttccttctaagagagtatgcatcaccagtttttcctgatgtttaaacagctgtatactgaaatatgtgaccctcaacccgaaactgggccggggatgggcaccagccacccatggcaagggtccagcataagatccaaaactcagccagtcttcccgcaagtgaatggtggcagaaacactgaaggaaagcagcggaagataaaggggtagcatcaagttaagctggtaccaagaaaagcaaacagaataatatacaaaataaaatgcagattaaagttacgagggaggcagggaagtaggaagctgggtagaaagagcagatgagggagaagcagaggcccggaaagactctttctttccggaaggatcccaggctgcccgggttctttatcttcccagctgcggtccatcctcgcaatcacctccctccacttgagtacctgtgttccttgaagtcaagccagtcagactagaaaaactcctagttcactgaaaaagcatccagtttccaaaatgcagctggaaactgcattttggtccctattttgaccacggttgttggcaccaccctctcagttcttggcatctacccagactctgtaggatcatctctggtttcctaacccatgaccttgactcttatgatgaactcaatgaactgtcaactgtcaccccaactcactgatcatagccgcccccaaactttatttttttttttaatagcatcaagtcacagtggacaggaaagaagaccaagttattaaggatccaaaaggttaagaagctgaagtttcaaaaggaaagaattctcaggagaagctgacctaggaccaaagtttacatttaatgtcataattaagaccatctctggatggggctcacgaatgaggtgctaacttaacatcagcaccccagaagcactgagagtaccatggtaacagcctaagctgtccgtgactacttggggcgttagacgtgtctgggcacgtctggaggattggtaagacagctgccatgcagagcagaaagagtgctaattggacttcagaacatgtgggtgtagtcccaggattaccctttctggactttccagaagtttatttgcacgagggacccaggagaccactggaaaaatatccatcctaagagaagggtcactgtgcacaagcctggcccaaggaccacggcccagggtgggggagggcgattccaagtacggcaggatgtgtcattcaggggtccccagctcctgggatctgtgccagagccctgggaacaacagatttaacaaaataaatggacgagccaagtgacagaagtccctgtaagaaagtcactgccacacacactcgaggcagcccatgctggtgacccacgaaacgggggtggggcgggggcaacggagtcccttcctctccagtgaaatgacaaccaggaggcgggctccgggcagccaggaccatagaaagctgggccagcccgtgtctggaacagactaggagggcagagaccccactcaccagacacgagcagcagtgggggagccaagtggtgggaacagaagaggctgcagggcaggagtcgctggtggagagcagagatcttgactccttctgaatgaatcacgagagccctctggggagccaagagccaagaacatgtggacataaacagatacctctaggatttcctgaacctgctgagaggaattggagggtccctaaagaacaatatggacatgaatctggggaaatagtgaaggacagtgaggcctggtgtggctgcagtccatggggttgcaaagagatggacatgactgagtgactgaacgacgacaagaaagaacaatagtgggggaagaaggaccttgaagatcaggatgagctaatccatgcctaaaacctaaaccaaaacaataaagcaattgcaggtctagcactcactccaattaggtacaagccagtcaacaaacgcttccacaaacaactgtggaagatgatggaggagacacagcctccaggatctcactctagaacctgtgtccccacaagtgcggttctcaccagtctgtgctgttcagaccctgtgagggagtggaactgcccagaagaaatccgtgaagaatgtcggtactttggttaaaaaaaaaaaaaaaaaaagaaccctcctgaaggaaagagttccaaggaagcatgggtaccaagagcccagtggggagagccacccagaaggaggctgagcccagagggctctgattccatcatttctgaagatgctattcctttgctgaggccaaacagggctgctctgtgccccaaggaggccagcatgtggggatgaactcggccacaggccagcactcagacaaccccatgaccctctgctcaaaacctgccccttccaggaaagaagtgaaagtgaaagtcactcagtcatgtccaactctttgtgaccccatgggactatccaggccagaatactggagtgggtaacctgtcccttctccaggggatcttcccaacccagggattgaacccaggtctctcgcatcacaggcgattctttaccagctgagccacaagggaagcccgggaaacacttgcttatcagaggtcaaaaccttatcttgttgttgtttagtcgctcagtcatgtcccaccctttgtaaccccatggactgtagcccaccagactcctctgtccatggggttttctaggcgagaatactagagtgggttgtcatttccttctccaggggatcttcccaacccaaggatcgaacctgagtcttctatgtctccagcattggcatgcaggttctttaccactcagccaccagagaagcccacataaccttatatgggttcacaattatccatcactcctgacattaggtattgggcactgaactaagggttagggtaagaaaattagcaaaatacattctcattttcaacattttaaatctaatgtggacaagggagcagaaaggaggaagaagaggaaggaagctagaaatcatgtccagggaaacatcacatgagtaagcagaaataattggtgattaacacatcaatggtcaaggtataaacaggtacttctaaattgtttgaaatcaaacaattatacttacacgtctaatatgctcaatcaactattttttcctaagtaccacaaagaagaattccaaccccaaacctgtttgaagaatgcaaagttctaacttgaatgaagcgctaatttttaccactgacgtccacgtgcattgctaacaattaagggcaaaacaaaggacctggaatttgagagtgagcatgtggatgacaggctg

SEQ ID NO: 61555 - DNA, 1895 bp, Bovine  19866880486528
tagattctggggtgttcattggatactagcttaagtgagacagtgactattagccatagaagctagttccagtgagtagagttatgtacttttggccatagtttagcattttgacttgggatactggattgtgggtgacaaataatttcttcccctttacccagctctgttattggaatagacagacaccagtgtgtccatttctgggactaagttccagccaggctaatgtacacaacagagggaattacagtacctgtcaaatggatggattatgtatcttatctcaagacctttttagggcttaaattaaaaatattttcactgtaactccttgatatggaatgcaagactaaagaaattcacatgtggaactgcaaacatagtgataatcaagatagcatcttttatgtaaatatataaataagtttgggcattgaaatgtacaacatttttctcctctgtgggctatatatatatatatacacaaaagaaaaaaagtctgtgtttagaaaaaaataaaaatagatttttgccatcgagaaataagtttatatttctgggttttgccaaccactattcatggtcaatttggttttctaagtgcagaaaatactcttttttattattatctttatttttcattttaggctgttatccagaagttcctatatctaggtaggtatatatgtctctatgctaaataaaatcttttgttgtctcttggtatgctctctgcaaatattgtaccatatgttaagcattatgtgtgatcatttgcttagacttactgtttttagcattccttagcactgagccctggagaaggcaatggcaactcactccagtactcttgcctagaaaatcccatgggcggaggagcctggtaggctgccgtctatggggtcacaaaagtctgacatgactgagcgacttcattttcacttttcactttcgtgcattggagaaggaaatggcaacccactccagtgttcttgcctggagaatcccaggggcgggggagcctggtgggctgccgtctatggggtcgcacagagtcagacacgactgaagtgacttagcagcagtagcagcagcagcactgagcccatttatggtataatatttaaaggcactatttgaaatgaacatgctctttgagaacatagtattaaaacctaaacttgaggaatggcaggcaagacgagatcatcctatacttcctcctacacttgttctgacccttcggtctgccccaccacattgtggtaagtatgtggtggagtctttccatgcatgcttttttaatatgttgtttagttgctaagtcgtgtccaacgtttttgtgaccccatggaatgtaggccaccaggctcctctgtccatgggatttcccagacaagaatactggagtgttgccatttccttctccaggggatcttcccgacccagggatcaaacccattgcattggcaggtggattctttgccactgagccaccagggaagccagtttttttttttgttgttgttgtttgtttgttttttaccatacattcaattctattcactgagagagacagagaagtaaatagtatagaagattctattcttcctctcactccattgggtgacctctgagttctgagtgaatttggagtggaagagacacgtggtatttcttgtgaagttcaattccttgaagcccttcatctcaccatgctgagtattattttgggacgtaaagataagtatttcttttacaactggggctggaaatggaaaacacttattctagctaaaaggacagtgatgggagggtctattcaactttacgtgaattctgttttaggcatgtatttcaggctctaatcctcagattagatgctgcatttt

SEQ ID NO: 61556 - DNA, 1616 bp, Bovine  19866880506924
aggtgaaggtattaatacttcgcacaagaaagggagtgagtgcccatatccactctttgttcaagagcaaaaggcttccctgtgcatgattttctagttgctaatgcaaaattagcttggggtgaagatcacctcaaatttaatactaaagtttatttgaacaactcagagccatgagatgaaacaacaaagcaatcaaactcctaaaacatggatttagaacagttagggaatcccgaaagagagaaattcgttcatagtgtctattgtcattggcatccgtgacaacatttcagaatgttttctgccccctacttctactaaatgtatcatgcctttgtcactttttaatttcacgtttctttttggtatttctgacatcataagtttaagtgacataacaaaaaagcaacctaaccatgcaaattcatctgcaagttatactgtgcatatttggaggggagggaagaaaagaaatgtgatcttaaatttgaaaggatgaacaattcaactctaactagagagatgaatatttaagtgcaatacctgagacggggaataacaatgcacagggtatgactcagctgggctaaagagacaggctttaaagtacgaatcaacagttttaagaagatttgactttgagaggtaacgactgctctgaactgatatccttggggcttattcggcttaggcatgaatctggctttagccagagcttccaggccacctgcagacatgaacaaattcccagaacgccaaccagtccggttctgtgttctttggactaatccagaagtaaacaagtctgaaggggtgggcgttggaactgcttttcaccagatggttaacttccttgagttctattcagagttggctggcagcctgattcatcccgatagtgagggaaaaaatagccaagctgcactgatgcaaggtgctgggcaagtcccctggaacagcccaagacttctgcacggtggagataaggcgggttttaattgtttcatattaaacggcattacctgagcttcttgacaggctgctctccttagtaggttatcactatcaaagtaaacaaaagagaaggaacgttagctttaataagtaggttcagatccaaatcatcgttttttaaagtaaatataactctttaaagtagtcaagtgaacgttccttaagacctgtaacaaatcacgggcacatctgaaaggtactttctccgaatgaaatccgtgttaggagttcccacacaacagcaggcagaataatccccactccctttaagatgctcacatcctaattcccagaacctgaaaaggttaccttatgtggcaacagggtttctacagacatgattaagttagggtctggagatgggagagaattctggatgatgtaggtgggcccaatggaatcgcaggggtcctcaaaagcagagaaacttcagcagcaaatgtgaccaggaaaggatggtcgcaaaggtgcagcctcgctggctttggagatggaaggtggctttaagtcaaggagtgtgggtacccaggaaggagaggggttctctccggagcctccaggaggaacgctgtccttgctgacaccttgatgttaaggga

SEQ ID NO: 61557 - DNA, 3008 bp, Bovine  19866880558768
ccatgagaagcatccccgaggggaacaggatgaagcagtagttacagaattggtgccacaggagggtgaggaagagccctgtgatcctggctaaggactcctaggtctaaggactcctaggctccctcccacaccccacgatgctctatggataaacagatcccttggatccaggcttcagacaaccaggctcacaccggagcatcgccacaaacatctgcttcagcttactatttcccagaatgagaacataggagtggccagcaagatataacattgcaattacttctccaatctttgcaatcatcttagttgctggtaagaaataacctggatgttaaaacataaaaggaaagatagtagagtaggaagagaaagaggaaggagaggatgactctgatggccctcctgtgggcctcggtactgagatctctggagctggcacagtcttgatgcatctgccgcatatgcctccccagggagaggataagcagaaagtaggagattagcgatatgactaggggagggaggtcccacagagtcccaagaacatggatcagtttatattctttttctttctttctaaaaagttcagtcatattcccggttctatcaattccaccaagaacagaatagatcttaaattcccggatcagagagatggcactgcaacatgataacagcagggtactcaacagcatccatacaaccaccctggaaactctccatttgagccagaggaacataggatgggagaaactggccactttcaggcagtagaagacactgagacaggtggtaagccaaatgttcagatggtttgtaaatgtccagaaaacatcaataatttgcatgattatcccttcatcatgtagtttgggaaagaacaccagtaaaataccatcgatcaagagaatccacagcaaaacaatcctggagacagccaggttagtgataacgaagtcatgcaaagagatcctcttgctcttgaaccagctgctgccattgacccaccctatgaaaccattccccagcattcccaggatgaactgaatggcggtcagaaccagaaaccccatattgctgagtctcaacatgtttgctgttcagcagacctgatctttgttctttccattgagaaacattctcttgctgatttgaaattcctgttaatcacctctacctgctgcttctctgtacctgtctcttatctctgcccagtttggtctgttgtagacacaacacagcaaaccttctcctggctctttcaggttagtctgtcctctttagaggatgacttggtttgtcacattccatctacgatctaaactcagaagctctttgccaaaatgcaaatagagtagtgtccagtgtcacgcagagaagaaagagatgagtcacaaagaagatggaggatttgggctccatttcaaaggtggtagggctctgagtggaaagtggaatggaaacccagagtggaaaggtgggtcaccagaagggtcacacagaatcactcaggaggaacgactcagggacacatacaaaagggggaaatatcagaatttcaccatatggctctatcacaatcatcctggagggaggtttacattcataaaacaggaaaaattcagagtcaatggtcctggatcagaattaaatggagtgcctcttagtgcctctttccttgttttcttagagtatgcttcacatgaaggggctacaagctcatctctagggagtcacgacatcggaaattcttcagtacctgaatgtttaaatgataacaataatgaagtatcgtaaaagctgctcaaaggatggattttttcagagcgcctgaccactgtattgacatgtcagcaataattcaggctaaccaaaaaaacatatagacactctctgtgaaccaaaacagtgccttacaaatttcccaggacagtgtgcttccatgtatatcttattagctggtgaccagaattcaatttctcaaatgactttgttgaatatcattatcactgccatcattccatcaggtatcagtgataggaattatgagcccacagttataactattctcatttcttaacataaatagtaaaaccatcatactataactaaaaccacagcattactaaaggctgctgccaaaatgtacattgaccatggtctaccaagtaaccacatgtatttccattctattaagcctgaagtttgttggagaaatcaatactggagctgtgatattgtggcaacccaggctgcagatacctaaaaagaatactaagatcacacacttgctctcaaccattcttttcagtaaaagaccaaagtaagtaaggtaagtcagggcatgggcaaaaataatttgcataccaaggtcattccagaagtgtttcaaaaaggattattttttaaatgaagacagagtattagggaaactataaacagatagtttaggactccagggcaggaacagagggtactacaatatgataccactcctggagaaagagctgtgtgtagagaggacctccagaccattagctgatattttctcagctgggagaccctgaagagagtcagctgagagaataccagtcagcagactaacaaggcattctcagatcatcttccaccccttcattattcttggcactttctccccaaggacttagacatcatggtccaagtctctgcatcattcctgcttctgatactactctgcatgacaactgtgtggataaatgttagcagtacactcagactgacatcaagacaaatcttagacaatatccatttataccaatcaaagttcactaatctgaagagcacagaaggtaatcagcagagttgagtgtacacagcagagagatcagcaatacatataaaatgataagtggtctgcagcattgcagggcctttaaagtcctgacctgaagaatgcaccatgtccagtaataagtctacttcagttcagttgctcagttgtgtccgagtttttgcgaccc

SEQ ID NO: 61558 - DNA, 1433 bp, Bovine  19866880584268
aattgcagcataagcaaggtgagggtatgggtattgtattttttttttcctaaggaaaaaataacagtgcagaatgaaacctttcaaagaagattacaaagctgttttctttctcattactcatcactttcttcctccgcagaattccaagtcctattgtctcaccaaacagtgaaaagagtaaaatgtaagaaccttccagaattaacctaggctttgtataccctccttgttggatgtgtgtcccttttgtgctttggtttggtagaaattaaccaaagagtaaagaaatatctggggtcccatatcgggatgctaattagttgttttcttgtcaaaggaattaaaaagatgtttctgagagaatgtctgtttgatttggaagagaacttttgtctcaccccagttttacgtggtgtccccaggtatctccaattagctcaagaggtgttacaccattaaaaaaaaaaaaaatctcaaagtgaaaattagtttgctttggtttaaaacatacatgcaatatatcccttcaggaggaagaaagctattataaaatctggaaaacaatttacaaaaagaacttagctccctaactgctcggaaggaagtctggtgccctatactgtctgaaactgactggaaaatagagttgttgttttaattgcagttggcatttgcaactctccaggtgaaggaagtcagcttgctggaacatttcttttggcattagaagctcaggaaattaataagaaagaaccgaggacaaagtggtacttaccgattaaagcacacttctggaatttctcacggaccctcaggtaacctttggtttgtagacattgagcgattgctaagcagagagcgctgtgctggtgcagagagctcccttctctaaaggactctgggcttgctgggagtaggaaggaagcaagagagagaaccagagttagtggcatgacggatccgatcctcagtgtgttgggaggtcagagaaaggaggggccaggctggattggagtccagaaaagagataccatggctggcccggtggtgcctgatggggtgccttgtttgccggtgagcagagatgactcgaaagggcattcaaaactgaggaatagtgtgagccagagctggaaggcaagcagtgtgttggcacattgggtaggtgggtagtggtacgtggaggtgactcatgagaggtgaggcaggaaagctgagcaggtgctgatctgtgaaaagatggtgctgtttgagtctggaatgtctttcctgaactcagtttcctccatcctttgctctccacacccttccccttgtttgggcgcacacagaaactggttgggaaatgttgctgtaaacagtgagtggtcaatggtgctttgatcagaggatggcatgtctcagaagaggattatgtaagaacttatttt

SEQ ID NO: 61559 - DNA, 1596 bp, Bovine  19866880642908
tacactgataatatttttttccccccaagtgaggaatccagtccaggagaaggcaagggagaacaagggctgcctgctaaggtgagcactgctctttggtccagatgttgtaacacagccatttcattctaatacctcttctttctccctccctccctccctccctccccaaaccttgacacttgtagtaaatatgtcttgcaggtgaatttatctggactgtaaccagggtctatattcttagctagttgttactttatcagacagtgtctaacatctatactgctgaatcattaccttggactattcttaaattcaaagctactgtttctgtctttgatctgggggaaagttctgtattcctgggatatagaagtaaagggaacatcaagatatctaaggtccaaaaaggaaaaaaaaaaaaaaaaaaacagaaaaatagcgtaaagccagaggtttatatgtaaaagttttagctcttaaatgtgtcaatatttattgattttataatgttcacaatctttgatctaatatcactcatttgataatctaaactaagaaaataatgccgtaaatattaccaccagagatgtttgtttcagccttaactataagagcagaaaaagaaaagaaaataggggcagtaccaaatatccaataatggaagaatggttatgtaaattagaccataaagtcagtggaatattaaattgccatcaaggtgacatgttggacataggcatgttttcatgatattataatgttcagtgtccgtacagggcagggaggacaatggggaaggggcgatatggatagtaagctggtacttggtgtctgagatgaggatataagggagcaggtaagcactaccagagccttcaggcctctgatcagaggtgaggattcctcatgggaaacaattaggtatgtctcattctatggcatcatttcacaaaaataatcttactgatagaggagacagagaaagggcgggcagctggagcaagtccagaggtggaggaaattgagcttgagactggtaagggcaagggaaattatcgatcttgttgatgaagactgactgggcttggatgttgaaaatgaagagctggtaagagtcaagattttttaaacatttaaagttagaaggaaaaagttcttgctaatggagatattgggaaaaggtgatttcacagggatgaatcagtttggactgagattcttataaatctatggatatttccatcatcagctactgtttactgagaatttatatatattcgtgatatatgtgattctcatataatatttgaaaggaccatgagacatagttgctctgatcctcatctgacaaatgagaaaactgatacaggagttcagtgacttgctcgagttccttacttagcaatgagtgatgtcacggttggccagtagggggagcggttgctgcagctgagcacacagtctgaaataaatcaatttgacaattttgttctctagactaaggctttgggggaagcaaactaaaaagtatgtttattgcacttaagatgaaacattagcagccagagtgtgagacaagtaagcaagaggcaa

SEQ ID NO: 61560 - DNA, 1080 bp, Bovine  19866880689490
cagagtttagtattgactataattaaggcttccctgttggctcagtgggtaaagaatctgcctgcaattcaggagaaacaggaggcccaggttcgatccctgggtctggcagatgccctggagtaggaaatggcaacccactccagtaatcttgcctggaaaattccaaggacacaggagcctggcagactatagtccaaggggtcgcaaagagtcggacacgactgagcgactaagcacacacacagcaactgtctagctttcatagggatggtagagggcccattgcaatatccacaatcaagcacgtttcttgttaagcccatcagggtttttagattgtgaaaattagaatcaaaacaagtctgctcctgaggtaacggacacctaagatgcctctctacatatatcctgttcaatgaaaaaaaacgtggacttgggcccaggacaaccaaggttctggtcttagatctgctatcaccagctcaactttgggccaatcacttaaccttttaaaggcgtcatccttgttactgtatcatatagaggagttacaaacattaaatgtggtaagatagtaagtaagcaagcagtgagcattcaacaaatgtgaataatgcctcatatctcatctttaaagaatttgtatgtgtgttattttcagtttcctcaatgctttcccgtctcttaggactctggctatgcatgaagtttatgcccatgcggtgctgggacaacacccccatgtggtgcgttactactctgcgtgggcagaagatgactacatgatcattcaaaatgaatactgcaatggtaagcatgtgggctcatatctatggagagggaggattagcttttaagtctttgggaaaaaaaaatctttgctttcttcttttacttaatagcaggtatagcagaatcatatctaaaagtctgtactactgttttgcttagaagcagagagctggaggaaatgagttgagctggaaaggaatttcaggcttatgctgtaaggtgcttctttcaaagctgatgtgtagttggtacataggagctatcacgtccttcacactttaatta

SEQ ID NO: 61561 - DNA, 1492 bp, Bovine  19866880767987
agaaatactactgatttttattctgtattttctatttcccatttgttgatttagtgttaaagaaggaaagtttttactcagccattaaaaagagtgaaatattcacactataaaatagataataagaacctactgtatagcacagggaaatctactcaatagtctataatggctatatgggaaaagaatctgcaaaaagagtggatatgtgaatatgtgtaactgattcactttgctatacacctgacactaacataacattagaaatcaactatagtccaaaaaaaacattttttcaagaagaatgaggtaacaacatttgcagcaacatggttggacctaaagagtgtcgtactaagtggaataagtcagacagagaaagacaaatatatgacaccacttataaaaagtgaaagtgaaagtcactcagtcatgtccgctctttgtgaccccatggactatacaacccatggaattctccaggccagaatactggaatgggcatcctttcccttctccaggggatcttcccaacccagggatcaaacccagggtctcctgcattgcaggcagattctttaccagctgagccaccacggaagcccaagaatactagaatgggtagcctatcccttctccagtggatcttcctgacccaggaatcggaccggggtctcctgcattgcaggtggattctttaccagctgagctagtaagcagaatctaaaaagaaaaaattgatacaaacgaacttattcacaaaagggacacagactcaaagacttaagagaacaaatttatggttaccagggggagagactttgggggagggacagattgggagtttgggattgacatgtacacactggtaaatttaaaacagataaccagcaaggacctaatgtatagcacaaggaattctgctcaatattgtgtaatagcctaaatggaaaagaatttgaaagagaatagatacatatatatgtataactgaatcactctgtgtatacctgaaactaacacaacattgttaatcaactatactccaatataaaattttaaaaaaatttttaaagaaggaaaaattttaaagtcagtcctctttgggagagctatcaaaaaattatctcaaaacagtctcctgaccacccctctctccagctcacaggccctgggctcttcaagcacatacagtcttccacaggattctctgacatgcctgcttcatcctggggttccccatgatcagtatgacagaatgaagaaaagggtaggtggccatgagtgtctcagagatgaagacagtgaagagatctgcaggaaaagtcttggagctgatggagaaggggctggccaggatgtagaccatgtaaagtacaaggaaacagcccaaggacttcaggacagtgatatgagccttggcctgagcatctcttctgccggctgtatggaccttcatcttcctgtagcgtctatacaaagagacacagca

SEQ ID NO: 61562 - DNA, 843 bp, Bovine  19866880770997
aaatttaaatttagttttatttttattaatactttttaatccaagtaaaagtggtaataaaatacaactaaaaatgtcctaaagaaaaaaggccagtcctttgccgcttattttccaagccaactttttagttactttggatgttttttaattgtttcctcattttaaagtgatacacttatgtcacgatgtgttagatattacatttaaactttgatatcattgattgaattttagtctttatatcctatgctgcttcatccacctctttatctcaatataattatatcacaatttttggttaaaatcccttatcagtatttacattattatgactgtgtaaatatcatttattaatacttctgagctagatagtgtactcagattctatttacttctcatacattttattttcctagaggtaataaaactgcctttcaaaaaattgctccatgttttatgtatcttttgctaatttctccccaagattctttttttaatttattttaattggaggataattactttacaatattgtgatggtttttggcatacatcaacttgaatcagctgcaggtatacatgggtccattccatcctgaacccgcccgcaacctccctctccctgagattctaatagagctgtcaaatatctatcaatcctgttttccaaacagctcaccaggagagagaatctgtaagttctgtttccccttctcacatccctctttcgttctgctctggaggctctttctttagctctttctttaggccggtagtgcaaacccagtaatccaaggactttgaccactctcatatttaaaatccccttttcattaatgt

SEQ ID NO: 61563 - DNA, 590 bp, Bovine  19866880776028
cggttcgtcccacttttccccatagataggatcatgcatgtgcctgtgcacttagtctcgtcagtcctgtctgactctttgcaaccctatgggccatagcctgccaggctcctctgtgcatgggattctccaggcaagaatactagagtgggttgccatgccctccttgaggggaccttcccaacccagggatcaaacccacatctcttatgtctcctgcattggcaggcggattctttaccaccagcaccacctgggaaaccccagatagggtcatatgtgtacataatacctaaagttgctacaactattgttcggccatgaagggagccagccccagggcaaagccagctcacagagggtgagcaggaagagacggaaagaacttgggtgcttggtggcatcattgaggcaaatggttggactatgcctggagtttgcttaaacttggacatcctataatgtgaaataataaattccgttattgtctatgtcagagtcagcgtattctgttccttgaagccaagagcactgacctgataaagtgcaagtcatcagatctcggtagtagcagacacagtaggacattt

SEQ ID NO: 61564 - DNA, 894 bp, Bovine  19866880823556
ttttttctttcattgcaacctttctggacataaacaaaagaagagaaagtgttgctggtttaattactcattgctatcgcctgtaagagaaaaagaatgacaaatatcacctacccatccgtgaaacacgaatatgtgaaactaccatctccttgaagaagagagaaataaatccctattcaaatgagaaaaatctcacttttggcagtagagccagtttcaactttatatatattgtgcgtgtttattagaatttaacaaagaagagaaatttcacgtaattagtcaccagaggatacccacacaaccccataaatgtaagagaggcatattgacagtggcataaaaggaaacgctaattaaattccaatttcctccaaatactgccagatcattcaggtataagctcacttcctgggttgttgagcatttactcaaatgagcccagattccagattcatggtgctgcgaaacacagaggaatctggagcaaagcctctcgtgagcacaatgacgtgtcctccaggcgggctgcgctttgcacagcctagaagagtacagtggagtcagagagatggggaaggaggtttagttaagggaagtgacaggaaccgctgaggaatcttctagaaacacagaaatgtaagtcaagttaggagctgtgggttgggaaagacataaaatgaaggagaaaggtaaaaggagatagagagaggaagagaaaagaggaaaggagaatggccatgggggctggtgggggttggatggggcgggcggtgtggggaacgctcgcagggacagagcactgggctctgccatcctgggcagttcaaaaacctggtcagtgttgggaataacagcttctccccaccatcttcagcttgtcccttagca

SEQ ID NO: 61565 - DNA, 2651 bp, Bovine  19866880849763
ctgtcctggaaggctgcaaggcaccaaggagtctcccttactgtcctagcccagcaccccttcacttagtcctggctctgtctctgggaacatcgtgtaaataaaaccagacaagtttatctgtgtcctgacagatgcccaccattcttatgtgccagagagcaaaaggctgcctgatagagacttgacctctgggccgtggaagatgccaacacaaatgccagcttggaaaagggattaatgatgtaaatggtctgagggaaggaaaatgctattagtactagcttggctcactgagaagggtccattaattcacatataggagttccagggggaaaaatgttgccctaattatgtcttgggtaatttggccatttacatggctaaccaatttgcagcttggttcttcctcgaggtatcacatctttattcagtactgtcccttcccacccggggccaggctgctcttccgatatatgcaacattgtggaggtgttagcttgtcttggctgatcgcgaccccgcctcctctccagtcatgtgaccttgtagctcttctgcgcgattggaaatgtgtctcgctggagttatcaccctacgttagcagaattcttgtagcctccggaagatacagggccagataccatgtttgtagcatcttccatgaatagctgtgatgggtaaggatcagctttgtcattcaattaagggcagattcagaacctatccaagtcccgttctggtgagatgcctgctggagaagcctggtacataggaaaacacagtgccctgctctccaggaaggacccatcctccggagatggccttctcatacccagtgagctgagtatctggaccttgccatgaacatcaccctcaatcgtgattgactgataggctccaagtgactgtgctgatgtttttcccaggatgccagacatgtctccaggctttggtggagagagatcttctggatcaatgactatgatttttgcttccaccagtccctaccacctaatgcctttattttcttggactccaaaatcacttcaaatggtaactgcagccatgaaattaaaacatgcttgctccttgaaagaaaagctatgacaaacctagacagcatattaaaaatcagagacattgctttactgacaaagatgcatatagtcaaagctgtggtttttccagtagttatgtatggatgtgagagttggactataaagaaagctgagtgctgaagaattgaggcttttgaactgtggtgttggagaagactcttgagagacccttggactgcaaggagatcaaacaagtccagcctaaaggaaatcagtcctggatgttctttggaaggactgatgctaaagctgaggctccaataatttggccatctgatgcgaagagctgactcattggaaaagaccctgatgctgggaaagattgagggcaggagaaggggacgacagagaatgagatggctggatggcatcactgacttgatggatgtgagtctgagcaaactccaggaggtggtgatggacagggaagcctgttgtgctggagtccatggggttgcagagtcagacacagctgagcaactgaattgaaccacctaaggcaggcaaagacactgaaagcgtgactgtgagaaaatgtgatgttcttcccaaaacagcaggaagaaaagcaacaatgagtatttattaacaagatctcttttaataataatagataaaagctattatttttcatatgccaggcttcatattgagtgtgctgaacatatttctttatctaacttttacaataacctaagaggtaatggatatcatggtctccattttacaggttatagaaaagaggctcagagaggtttggtggcttgtctgatcacaaagccagtaagttagtagaagcaagattccagtcaggtttttggattcaattgtccacgttcttttggcagctcatagctgcttagggactagtgttcattgcagcagctgaatgtttaggatttaaggtaaccaacgttagttcagaataccagtgagcaacattatagggttgttaattgattccatttctaagagcgccacatgtttctcctctttctcttcctgctttgcagatctttcataccctgtattggtgagtcaagatggaggtagaggagaatagaaagtggtgactggaggtgggcaggcagagttgtcacaggatggaagagctccatcttttgtaaccagtcctgttgttcttttgagaaaatggcagtgaatttgctccactggctctgtgtgccctgtgctccccccgcccccatgcctcctctctctttttgtccccaaccctccccccaccaaatgtttctttgcactccactcagtcctgtactattgccagattactatcccaaagtaaaaatcagatcacatcagctggggcaaacatcttttatggtctgtggcatttggagctttccatggtgtgaccccaagtcactttctggtcttgtgctctgccatcacttccctacactgaaaacagggagagcagtagcaatagtagtaatactaccagtagtactaatactactactaggagtaaagcagcagcaatataggagcagccagggtcacagaaca

SEQ ID NO: 61566 - DNA, 1687 bp, Bovine  19866880887517
gtccttgccgcctccctgtgtctgcgtccagcccagctttctaggtctcacggcctcactttgttcttgggtcattggttgtgcaggtgtggctgctccagtgatttcaggcccataatgatttcttgcgccttcttgactctcctcaccagtaaatagtgatccgttcataccatgtcatagaaatatgtttgtttgtcatcgtctattctatttgggggccttgttttctcagaagcccgcaaaggcaagaattttgtactgatgatattgcttctgtttcctccatatacatcgtcagtgctaaatgagtgcatattggtttgaattgaatagggagcagttaagatgggctggtaggtgaaagagacattttaagagagaagtctactttatgctacttttctaaatccaaccaggcgtctttttctcttcagtagcttttaggaatttagcaatatgaagtagaccctctttactcccagatttccatttcccatgttgaagctgcataacatgagtaatgcggaatgatgctgatttacagattttaattgtgtgtttgtgcgttgagagagaacgcggtgtacagcatgcagccattcagctcacgagtaatacattagcacccacacccgcatctcttcgtggctttatcactctccactcattcagaatgtgaacttaactgtgttccacggtgcaaagtacatattacagtgatacctgtgaatttagagattcaagaagactctgattatatatctcataaattgcaaggatttagctgatgtataactaattatgttctgtttgacgtggtattcaaatgcagattaaaaacttactgtaatacttttttatgctaaaccacaatctccaaacctccagagcagacacttctggtagaggtgtaattctaatgtattatctgtcctgaatggtatctagcacattgacagttttcttaatagtctaatcagatttttatcttgctcttttttaggtactggtatcttgggcctctaaaaaccaaagcagcccactttttcagcactcttaaggtaaatgcaggctacagtattgacatttgacctctggtattttgttattcctttgtgatgtgtgtatttggaatttttaaaagtttcttgctatagatgtatatggcatgctcctaaaatggggcctatttacttacacacaaatccagaaagcattcctgttctgatatttctcatctgccaacttattctctattaccaagcccatatttaatttcattttagtatttcacttccctttgttcattcactcttaaccaaacaaaccttgaacacagtgacctatatctcattaattacttgcaaatgtgtctatattagtatcgagaagctaactgaagatttgtatctgaatacgccatgaaattaaaagacacttactccttggaaaaaaagttatgaccaacctagacagcatattgaaaagcagagatataactttgccaataaaggtccatctagccaaggctatggtttttccagtggtcatgtatggatgtgagagttggactgtgaagaaagctgagcgccgaagaattgatgcttttgaactgtggtgttggagaagactcttgagagtcccttggactgcaaggagatccaaccagtccattctaaaggag

SEQ ID NO: 61567 - DNA, 1108 bp, Bovine  19866880911652
tacagcacaaagaggtcctcttcacaagggttgtaatcttcttccacctcctgggaatataacagcatctgcctgttgggaaggagatgaccatcagcttctggcacagctacaaggacccccaaggccccaggctaggtcactgggcgggcatctgcatgggtcactgcctctcaaggaggaggctgaaaacccagagcaacaccccccaccgctgccccggccaaaggcagggagagaaggggcagcacagggcttggagtccagggctgggcctggccctgggtaatccaggacgagggacagtctttcctaattgtcatacaattggggtgaggccatgaagccatttatcccacccctgataccagcgtgctgttccaggcttcacagattccagaggccaccagaaaggagtcagcccaggcatgcctgctgcccatcagtataggtggggagcttcctcaaccccccgctccctgggcagatgggcaaaaaatgtgcacagagggaaagggcggcaggcagcggagctggaccagagcccctcggatgtctggacaggggcggctccccttcccccagcctcacctctgctcgttgagccgccggtacttctcccggtcggcgctgttgatcttcagcagcggctgcaggtggtcgtggtgcgtcttcacgttctggttgtccacgtagacgtcgtagagctcccgcttctcctcgaaaatcttctccgtggtgcctgcgggagctggggttcaggaggtggggaccccccgcagggtggccctacagggaaccagggaccccggggaggcgggggtgccagggatgggcgggccccgtactcacaggccacataagacacctctacctccagggtctcgatgtcggccacgttcacgtagaagaaaggcttggactcgggcacggtgcccccaatgccaggcagagagacgttggccaggcagcagcagcagtacactggcgggagagcggaagtgagggcgcccggggtccccctcccagcctgccccccctacctcccaggctgccagcatcactagggtctccattcagacacgggtcagtctttctctcaggagat

SEQ ID NO: 61568 - DNA, 1380 bp, Bovine  19866881092943
tgctggttgtatagcataagtaacatgcatgcatgctcagtccctcagttgtatccaactctttgcaaccccatggcctgtagcccaccaggctcctctgtccattggatttcccaagaatacgggagtgggttgccgtttctgactcagggatcgaacccacatctcctgtgtctcctgcattggcaggtgagttctttgccactgtgccacctgggaagccctacaagtgacataccagcttgtaaaaattaggaagatgttcttccttgcactgaagcttcatccttcaatccttcgtcaccttcctgcttcaacattgaaatgtttcagcttgaaatgaggccagactccaagcatcagctccagacttgatctgaaaatctatctcagttttatgtcctgcacatggccttcaagtacatgttagtgaagctttgcttttcaccgtcactctcttttatccctttataattagcacaagcgttctgcccactgctaagccgctggttgacttctccataatttaatggattttcttctaggaactatcagaacttaatgttatttttcctattgttagccttttcaagggttgtatacagactattctactgggatctgttacatctctcgtttctcttcccttcctccctccagtctgtctctctttctccccttctctccctcttctttttcttctccctttatttacataggcacacccgcacattgctgagtcccactactaagcccgaacacacagctgggagatggaaaaacgcagttgagaagtagagtgtggggactggatgtggtctcagggttgctgcatatttttgtccagaatagactatcatgtaaatgataccctccagatttgtgcagtgcacaacctgggcaatattcacagtggcccagtggtgtaacgtcaaggctgaatccccccaaaatttgagacacagcatatcgaaagcagggtggatgcttgctcgttggtataggggctgctacaaatgttgtagtggagacatggatatggctgttgtttgcctataagcaaactgctgctgcctatttggaagcatttgatttagtgaggatgggcctctcccaggtagcatgatttgtagagctcatctctgaaaaatcagctcaggtcccctcctgccttcccaatcttcccactagctgtggaggcttagactagtctcttcatctgacaaggaaacagtgttggtatattgactgttatgatttgaattgtgtcccccacaaagtgatattgcagtcctaaggcccagggtgctcctgattctgtgaccctatggactgtagcccaccaggctcctctgtccctgggattctccaggcaagaat

SEQ ID NO: 61569 - DNA, 1478 bp, Bovine  19866881140323
gactcttttccccgtgctcagatggtaaagaatctacctgcaatgtaggagacccaggtttgatccctgggtttgatcccctggagaagggaatggctacattctccagtgttggtgcctggagaatcccatggtcagaggagctggcagactataatccgtggggtctcaaacagtaggacacgacccagcaaccgacactttaactttctgactttttcagtgcaactgtccttgaagttcatgaagagttctgactttcagcccatgttattataagccgaattgtgtcctctcaaatttacgtgttacagtcctaaccacaggtacgttagcatggcccggggctggggcgggccctaatccaatatggcggacaccactggaagaagaggagcctaggacaccgaccccgagagggcggaccgtgtgaagacacagggcagagatggccatctacgagccaaggagcgagaccagaagagctggttctttgatctcagcgttctagcctccagaatcgcgagaaaataaacttctgttgtcacactacccagtctactttcccaaagcagccccggcaaacacaacccattaatactgaataatagatgcaactcagtaatgatgaaagcaagggtagaagaaggagtggagataattacgatggtgctcagatggcagaaatagggcaacggacagaggaaaaataaaactctggaaatctgagtgtgtcttcagacttagaaaagaccttggctttgttaaacagcattcttccctgacacccaccaatacatccgtgcctctgcaaaggacctttacctctttcgcgggcagtggaaggcgttcctgagccccactggaggccgaggtgcaaagaatatgggctgtgcaatgaaggcccctttgtccccacagggggaaccaagacagcccatttcctgtgagcctccaggtaagaagacaaaggctatgccacctgcccagatgctcttcctgcatctcaggaggctgggggaacatgaattctgtttgttttacactgaaatctggtcaatatctgacctcactcagattcaactaaaacacaggtagcaagagcttgaaaaatgcatgaatatgctcccagttgtgcattacagggggcggggatggatggaaagaaacaaagacaattgtttctagtctgatacccagatgaggaagactctcttctctcaacagtgattatgcagacaacctgtgaaggatctgaatccaatcacccctttttccttggctatgatgaggtttacaagggaaaatccataattccaacactaatacagttagtaaaatctgccaataaatcttcaaaggaaatctgtcagcaatgctgttattaaataaacggaacaacatattgcatggtacaaattcaaacaacacacctcattactgcatgaattcagatttcttccaagtcaaattctgtc

SEQ ID NO: 61570 - DNA, 1771 bp, Bovine  19866881140705
tgggggattgacaattggttcaagataaactggagattagagtcaacagatttctggtggatgggatatgggattggggagagaggaatcaagcacaatttgagcaaatttggtagatgctggtgccattattgagatgggcatgacagaggaagggactggtttaggcgaggagaattcaactcttttggggcacgtgaagtttgagaaaagtcttagacattgtgtggagatgccaattagacatcaattagatagcagggggtatctgatcctcaaactcagggaaagagggctggagatttaaatctaggatgaataaatgaatgctggagacctactctctgtattaaaagtggaaaaggttctagccaagacagaatagaagagtataaatgcattcagttcctctcagttacaagagaaaatgtattatttctgtgggcaaaaaagaggggactgaattgtcaatgtcctaagacatgaaagcccctcacacacattttttccaatatagggaatgtttgctactaaggccctcattttctagattcacttaaatatatttgagacccatatgtctttaataaggcaaggtttgagggatatatggaaagaagtatgggaatatttagaaatagccttttaaaataataatttatagacagaaatatttgaagctcaggaaagaaaagaaagaaatatgaaaaatgaaagttgctccttcttgggaaggaaaaatttcacacagcacttagttctctgacaaaccaagtgtggcccaggaaaatcaaatgaaaattacctccccaacaacttcagggaaagaatctacatcgctattcagaatttgttgctattgttcaatcgctcagtcacgtccagctctttgtaacttcatgaaggtagcccgccaggctcctctgtccatgggatttcccaggcaagaatactggaatagattgccatttccttcttcaggggatcttcctgactcagggattggatctgcatctcctgcattggcaggtgggttctttaccactgagccccagggaagccctcctattcagaatggagggctggaattgtcttttatgtggattaaggatctagaagaatttaagaggtgtgaacaaggccacagaggaaaatcaggagaagccacatacaagactctgatggggtgcagtgggcatgccagggcacatcactgaattacatgaaaagatcacagccacgtggatgctacccttgccttgacttctggggtccagaacacttctgttcaccttacctcattcgctgtactattatgagaaagtgaagcaagcatacaaaagaaataatgctgtgcacacaggtaaggtgtggaccatattgtgctacatgggataagagtaaggagacagtgatgcacctgtcactggggtctcagcatccacagtattagcctctgaaatactcagttacaggtctgattccttctaggtaagtatctgagtccagaattttcagacagacaggaaggtataagtctcttttcagagatgatatcctgcctctaaaatacaatgagattagcacactgagacaacttcacttacaatgcaatgattgaatatagctgcagatgattacaatttatgtgaataattatcttagggagcagaatgataaatgctatcaattaatatttgcttgtagaagggcacagaatccttccctaaataaacatacacacatgcacacagacagcaaaaacaaatag

SEQ ID NO: 61571 - DNA, 1173 bp, Bovine  19866881284406
tctgaacactgtgtaatagacttaatctttaaatatcctgaggtcttattttccttatttgcaaaataggaacattacaatgatgatgccttttgcatttatttattgagctatggactctggaatgatcatatctgcattccaatactacttccagaattttctacttctgactttggttaaggcattcaacctaactttgctttagttttcctttcttaaacattataatggaacctaccttcattgctgggataaagggaaaatgagatcatatatataaaatagcacaatgtctggcacatggaaaaaatggacaccatatattctctgttccaagatggctagctttctcatttgacatttctagtttttggacttacgtaatacagaagaatataaaaactaaaatgccaaaatagactgttttttcctgttttgaaaaaaaatcaaagttgcaattcttgtaaatttaactttgtcacctacatacaagaatggagttgacaagaacacagaagggtgttacaggcaagaaatggttacataatgaaaaaagcaggtaccgagtacctgagcagtttgaatttgtttgaccttggtcgggccctttttaccacagagcttagacacgtctcctgtatttaacatacggcagaattaaggcttggagtactttttctaatctactgctacagacctataggaatctaccacagttgtgcaattagtgacctgttaaaacagtaagcagggacttccagtttccagttccacatgtaaggagcttggagattgttactctatcctaacaataaataaaaggctacatattctgaaaaatcagcaacaatttttagatccataagaggggggagaatgcagtgataaatcactgcccccaagattagagagacagacaggtgaatacaggtcatccagacttatcagagcagactctcaagcagagaccttcacaggaaccagtgtcagggtcggaaaacctgagatgtattgatgagttgctagaggcttgattgagacgatgctcagagttaaaaactccaggggaattcagccataggaaggaccccatgaggttgtgaggtttacctccaggaattctaccaggttcccacagtaaacactggggaaaatccccttgtgcttccg

SEQ ID NO: 61572 - DNA, 1493 bp, Bovine  19866881290702
atgcaggcacacacaggcacacacacagacacacacacagacacacacacacacacacacagtggaatattactcagccataaaaaagaatgaaatgttgtcatctgcaacaacatggatggacctagagatcatcacactaagtgaaataagtcagaaagaacgagaaaaattttatataatattacttacatgtggcatgtaaaaaaaaattattttaaaaacagaaataaactcacaaacatagaaaataaacttatggctaccaaagtggggagggataaattaggagtatgggattaacagatacacacactattatatataaattagataaacaaagaagatttaccagttaattgttttttttttttttttttgccaagcagcacgtgggatcttagttccctgaccagggattgaaaccgagcctcctgcattggaagtatggcatcttaatcactggacggccaaggaagtcccaacaaagatttactgtatagcacaaggaactatattcaatgtattataataatcaataatggaaaaggatctgaaaaaatatatatgtatatataactgaatcattctgctgtacatctgaacctaacacaatactgtaactcaactataatttaaaaaaaagaaaaaaatatctgaacatttgggcctttattcacatatttatgtgatgccacaggtacagacaatctcgaagatgaaagtgaagacattttttttccttctaatgttccatataaaagattgaaaaacaagtgttaccagtacgaaatgtattatttattatataattaagggtgagatagcaccagagtcaaataaaaactttctatactacagcaatttccaggttcctgcacacacaaaaaataattactccttaatgtattatgtattaatgctaaacacagttatcttatttcctaaagctctaatgtagttttaaaccagtactacataatgaaatagctacatgataaattataaattatgtgtcagggcaaagccaagatgacaaaaatagtacaattaagtagcgaaagcaatttcagagtgactgcttcctagaagcatgcaggattcaccttgtcaaagcggaccatgactttagaaagattttccttactctcgtctgcagataaaggtatcatatttttcaacaagaacttcacctttaaaatcacaaatacatttccatgtaaaagtgtaagcagaacctaaaactgcttttaaaagaagtgtcattgtttaaaaatgcaaatatctcttagatgtaaaaattcaaaatgactgattatagcttaaacaattgccatatagatcatcagaattggcaagttactaacttactaggtctctagaggaataggacctggaacagttacattagttcggacagagggagaggtccaagggtggagagtcaagtaaagaaccttttgaactcagcctacagggtcagtaagggcttc

SEQ ID NO: 61573 - DNA, 2496 bp, Bovine  19866881309137
tgataaacggatttctgctaagaagtaaagagaccaggatataaggaggggtggcttggataaaattaacactctagagcaattctcaccttaacgatagtaacatccatgccagataagtgtaaaatcggggcagcatttttttcaaatagagtcctggctttgctgtaaacaaaggaaaaaatacaaatattttaacaggagtgctcaggagggaaaataaaaagcccaactatcttctctagaataggacgaggaacagcctagcgcacaaaggcttcctctatttgttcaacccaggaagctaatgatgagtaatgaatgggtttctctgggtagaaacacaaactctctcactctagagcccccaggagcttgcccgtatccatatgggatgcttacagttcacattctagctcccccaggggaaagtgtacactagatatggctccagtctagcaacaacgtctgattcagtcaacaagcactaccgaccttctactgtgtgctagacacataggagcgggacaaacaagaggacaaggcagacaaacaaacgtgtgattcaggtaaaatgtaacaagccctcaagggacttcttatagtccactggtggactgagaatgtatttaacatttttcatgtggtctgagagaacagattgaaccaaagagagtattgcttaattctgactcagtgaacacaacctttgaaggaaagagacatcatttttaacaatttcaaatactaggagtatctccatttcttgagttttacccctgtagtgaaatccctggagaaagagcaaaattcttttccatggaggcagaatttctgctgggaaaggggagaagttctaaattacctaatcttactatgggatatttggtagcttgtctaaaactccaaggggcctccctggtggctcagctggtacagaatctacctgcaatgcgggagacctgggttccatccctgggttgggaagatctcctggagaagggaaaggctatccactccagtattctggcctggagaattccctggactgtatagttcatggggtagcaaagagccggtcacaacagagagactctcactgtcactttctaaaactcccagtcatgtgcttctcagggtagccctggcacatggtccacacctctcacagggacttttaccttctatgatgaatagtggttcccaagacagtcttcaggactagactggaagccttgcaaaaacacacacctaaccttattagtccttgagtcctatggcctttagcattatgactggtatacttagaaggttattcagtaagcacctggtacattaatgcacttatgaatgaatgaataatccattccaaatgtagacaggtatattgtgaggaaaaggaaatgagacaattgtggtatctgataacaacagaaataaaactctcttaggagagtttgtgtgttttaaaagtatcatacacatcattctagtagtgacccttgtccaattcaggtcaagattcaaaaacaagagcctagaaatcaagggatacagaagctgcagaaagttcccaatcacagagtctcaaggttaaataaatgttaaacataccaatcagctgacgtcttttactcaaatattttcaactatcgtatcacaaaacagaaacaaaaactagcactttcaaaacaatcaacaccaaacatctaacttttactttcacacttacccagtcctctatcaaaaagattatttttcttatcagtgaggcatgctttgaatttcttaagaatattttatactagaaagagatgcaaaagtagtgaatgaggaacatgcaaagttatgcacagaccaaattcaacgttctttaaaaagaagtaactaccacatggaatacaaaacataaaacgtttctgattatgaacgaaaacagaaattgagaaacttgagcaaattttcacaacagacaaaagaatagcttgagccaagggcccacctaggcaggtaataagcaaatgaaacaaaccgatcctcccacttctacggctccacttctacggctccgaatgcttattagaatgaatgggaaaggctaaatggaaactcctccttcccaaatcaccatttctggggcttagaccaacaataaaaggctgagctggtgatactgtaaacactccttcttgcaggactgctttcattaacaggctagtaagaaaggtcaggtggaactggatcagatctgtctctgggaggcaggactctggcgaagtctcaagtggctatattaatcacttataacacacctgtgggctcctctgagctagcttaggaaataacatttgcaaaagtacaatgaggtatcaccctcacacacagtcaaatggcatcatcaaaaaaatctacaaacaataaattctggagagtgtgtggagagaagggaaccctcttacactgttggtggggatgcaaattggttcagccaccatg

SEQ ID NO: 61574 - DNA, 792 bp, Bovine  19866881325630
tattctggcctggagaaattcccatggactgtatagtaattccatggactgtatagtccatggggttgcaaagagtcagacatgactgagcgacttcccacttcactttatcattaactaacaatagtaattctttcaattaaacatcatcggttttctaaagcaactttacagtgttctaatcagatactcagaggaagctgacttgatttcacttcccgtagagaccaaaaggaaactatgttattgctgctgctgcagatgatgacagcaaccatgtgcaccataataacttcgtctaatttaagcaatatcagtgtttccttctggttttgggtgtcagcattatgaaggagattcgaatatagctggtcccacaggcttgtgggacactgtgtagcttctggacccttcctaggagaagagacttttcccttcctcccttttaccatagttacagcaagtaaatcaaaggctgcagaagcagctattcagcatctgaagaactggtacccaaggcgagaaccacccaaactgagcaaagacactgtgctgccagtgctggcacagagactgaggtagccatggagacccggccgctgcagcagcaatgtctaacccttacgtgggcacaagagggagctctgagacagagttcaggaaaaaatggagcagattccagttggcatggtaacacacagccttctcagtcgctctgaagtctggcggaaggctgagagcatccttaaccaataaaactcggcagaggtacggcttacaaatcagacagga

SEQ ID NO: 61575 - DNA, 767 bp, Bovine  19866881449959
catatccgtagtggtgtggtggctggctgggcgcttgcagatcaataaaagctgctaaaaaggggaatgcatcagagaccataatggctccttcacagaagatagatcgtctccagctagtgaagtgcactcaggagcaacagcaacatccctgtgctgagcttctcattatttagaagagagaaacggactttctcaaggtgatgagtcctatgatgcagaccttaacatgctaaacataccctccaagagagtttctgttccaaacagattcagtttgtttaagcagaagaattcctaggtggcgaaatacagaattgattctcttggcctcaaacatgacttgattgtagttattctgcagcttggatgtcctgttaatttttaaaagtcctcttatgacttgaacactgatttctaagagactcaggtgggcttgggtacagcatccgtgacgtgttgggaagattagtgaccctaatgagtggggtttgagagcggtggaaacttccagaagatggtacagagttgcttggctaaagttcttgacttgaaggctgtggacacatggagtcaaggttttgtttgagctgagtgtacttatgtgcaggtgggtccctagggtatgatgtcagagaggatggtgactttttctagggtgtgtgttctactctgtggttctccttcctgatgccatgaataaattacacaaattatatattcacttattcaacacatatttggtgaatacttacatgtcagggttt

SEQ ID NO: 61576 - DNA, 913 bp, Bovine  19866881700576
attagtcgtaaaaagagaatggaataatgctatttgcagctacatggatagacctagagattatcatactaaatgaagtcaaagataaatgtatgatatcacttatgtggctacaaaggaactttataaaacaaaaacagagtcacagacatggaaaaaacttacagttaccaaaggggtaaaaggggagagggataaattaggagtttgggattaagagatacacacactacttactatatataaaataaataacaaggacctactgtgtaatacagggaaatatagtcagcatcctgtaataaccattataggaaaagaatctgaagaaaaatgtgtaacaaaatcgctttgctatatacctgaaatgttgtaaatcagctatatttcaattaaaaaaagcaaaaaaccccttcccaaaccaaaaatttgttgacatctttcacatgtcgatgttgccttttctgtacgcctcagtgaaggactcgctagcaacatatcaagaaggaaagttgaaacccaggtttgtcctgtctaatgcaggttctttgtccaagatcaaggaattgttattgatggatttatcaatgggccatgagagtgttgcatttaagaattttatgcttgtcagcttcagagggcaaagggcattgattatgcaaaacaaaccccatcctccagtactgcatggagactgcagactcaaccttaaatgtgattacacaaatgtatcatggtcagggagaaaattactgataaggactttttcctttttcatcttgtccattgtttttcttcttcttttttagaaaccacttttctttgtgaatctgaaggctctgaatgaaagataatgataatagcttgtttatgtagccataaagacaaccattatagctagttgttcccatag

SEQ ID NO: 61577 - DNA, 968 bp, Bovine  19866881745089
tgtggacacaatgtaccctgctgtaatatgcaatgtcactcgcagctaatccctttattgattttttttttccctctgaatttgctgacagcaaaagattaggtctagagaaatagttgcagttcaggttctgtttgacaatatttagaatttaaagtgacctttaaaagagagagggctgcctgagagggatttaagtggttagggacagggccatactaagggtgaggtaaaagggaatgcttttttaatgctggtgtcaaggcaggccatcctggacaagtgtcctctgtccttaggaccacgtgagagcccagggccaggttgacccttggctttgttgtgaaggagacgaagtttgatttttgtcccatttactctttaatgcacttgactctcccttctgtaacctgctgtctctggtctcgctcgcgctgtctaaagccctccactgtacatctctcccaggcctgtgcaccttccatgccctgggctcccatgccacctccaggagtcctcccatctctgcccatttttaagaggaaactgatcgaatgaaactaacaagatgtgtgtggctagtggtccttcactccccatgaagtaaagcctctgaaatagtatatagacaggtttttttcctttgtgcatatcagtgatgtggtttaacacattaagaatttaaataaaacataaatatatccaaaaacacggcactcgttctagccctctcctgtctctaccctgcgctggtggtcaccccttctcttttccttggtcactttcccgggagcaacatttataccctctgtagacttggtgtgtcacgtggagctcgtgtttatgttggtcgtgcttttaggagttatttcaccttggtatatccaaattcacctgatgtgttccattctatccttttgcttgtcagtatcaccggcagaagacagtacgtttccatagttcccaag

SEQ ID NO: 61578 - DNA, 1379 bp, Bovine  19866880390593
tattctctgttgtccccttctactcttgccttcaatctttcccagcatcagggtcttttcaaatgagtcgttctttgtatcaggtggccaaagtatcggagtttcagcttcagcatcagtccttccaatgaatattcaggactgatttcctttaggatggacttgttggatctccttacagtccaagggactctcaagagtcttctccaacaccacagttcaaaagcatcaattcttcagtcattgcctttgagctcagaatccagtggcagaggcagcaaagtctgtatcactgcactacaatgaaggaagtgtcatagtagatacatatggaaaagttttgtttcatccagggtggaatggaggaagtgttaggtgggtagtggtgatcagggaagtttcatagaagggacaacatttgagctcagtgttcagggatatatagttaaatgtcaggtgaaaaagacaaggaactaacaacagtccaggcagaggaaatgggacaccaatgactggaaggtatgcaagattatacagtatgggaacaattgttaaatcctgaagtgatttccatcaccccattccacgaaacatttgaggcagtttttaaaaagattacaattaaagagaaaaattacaagtaaaataaaccatcatctgggaaaatataaatgagaatagaaggtgaaggccatgtagggaggttaattagaattcagatgtataggtcatagaatcccactcagtttctaaaggggagctgcacttgtgaccaggtagccaaaacaaaggcaatggcatctcactccagtacttttgcctggaaagtcccacggacggaggagcctggtgggctgcagtccatggggtcactagccatgtggctccaaagcccacacactgggatgtaatccaggaccagttgattctgcattccttagtctgatgcaaagtgtagaagctaagaatatagtgtatttttcatgaagctgtatttgctcaattgaaaggactattttttattcagagattatagatttcctatatttttggtttttaaatgttctgtcttttatgaattgcaaaatggtacatggttagtttttgttatttttttccatgtcttttcttggcaaattaagaggttggcaaccttaaatatatagatgtatatgcttttatcttattcatctctaaaatccagaaatctaggaaccaaagatgaggtgtgaaatgtcctccctaatgccttcccaaaggtgttcacagcgtccctgaatctgccaaatgttctaacaagaacacaaagaacaaaataggaaggaatagggggaaggtgggctataaagatagataattgcaaaaacttatactaaaga

SEQ ID NO: 61579 - DNA, 1107 bp, Bovine  19866880644284
tctgggtaggcaggaatgagatcatgaatgacccctatatgccatgttatggagctggactttctcttgaaggcaatagagaactactgccaggtttttaagtgggaagtgacagagaactgcagcttggaaaaatcacagagcagtgaaaagcctagtttgggtagaaagcctgaagtagatagatgagccaagaggcaagagacgctgacagaagtcagtgtcattggggctggattttatgggtagaattgacaggacttagagaaatcgtttattataataggaagggtagctctgaagtttatggtctgggtgagtgtgtgatgcttattcccaacagagaagataatttgggacatggggaactaaaccttttgacaagaagggaagtggtcacatgcaacttttctgagctccccttgcccatggagtttcatgataatattctatatattattgggaggggggagtgctttaaactccaaagatcaggtaatgtagcattgacagagaaaggataggtagaagtttatcatccaataatctatataaaacagctctatccaaaaacaaaaacaaaaacaaaatccctcacttcttttgtttccaaaattcccttttgcccactttccttaaatggccagagtcacacatgtcagaaataaacacttgcctcataattaagttcagtatcggataggatgaggagtattttttatgccttttgaactgagctataaggcaaaatcttagcatacatctttataaaagttccttcaactgcaaagcaatatcttttagccccaaagtgaacacctaagtccagccaccaaactgcatccacaaaatgaccatcttaaccaaaggcacacacagagaacctaaccacagtacccaattaagagccagtaattcctgattcacaaagacaggtccaaaatcaattagccaaaggtttcattctgacatacacagcctagctctggtttaatttttttacatgactcctttttttccccttacccaattcaaacatttttggtacctgtttttggagttgcagctatttcttcttgccaagggttataagatctggtcatccaa

SEQ ID NO: 61580 - DNA, 1939 bp, Bovine  19866881315101
agaaattgaagctgccttctagggctttgctgatactgacagagggaggggcacgtgatttctgctcaccctgtggcctccactaacattgactggggataaaagatccatacggccttcttctacccactaggctcccacttagtctttgctcatgggaatgagggtaaggccctagaagttgacgctcccttctagggctttgctgataccaccctggctgatagagagggaggggcacctgacttttgctcaccatgtggcctccactaacagtggctgagagaagatccatttggccttctcctacccactaggttcccgacttagtctttgctcattggaatgagagtaaggcccatgtttttcctatattgtttggctggaataaagtgtttattatctaaaatttttctgaattgctgtttgcccctttcttggtcttttgactagagagagcaggctttcttgaaactagttttgtctgtgctctttggtttctctgggttgctggcttcctcaatacctagtccaagataaatgaagaacacccaggaaattcatcactttggtattccttggatcccaaaagtccttagccagtctgccttttttttctccacctttcagagtgcttgtgttagttttatataaaataggtttttagctgtacttattgggaaaactaggagaagtgcatctctttatcttgtgctagaaccagaagctcagatatgctttttattattctaatttaccatttaaaggtgtttttctagaattcgatgtatcagccgacagacccaccccactcatcatgttcataaccatcattgaaattatatattttaaccatgctacctctcagccttctttcatcccttggatcatttagttgactttcagtagataatcttcaagtccatggtgacttctttgaatatcctgatggtatttcccatatttctcaactctgatacctgttcttacttccaactctgaacttagtcattttagcaactgcccagatttttgtctttagtgaacagttaagatgaatcctcacttcattgaaaaccatgctcaaatgtcacctcttcagagtggcttttcatgaccattctctgtacagttactctgctttcttttcttcatatcacttatcactatttgaccttttataatcatgtgtttgttcattgtccccatccctctaatataaagactcttaggacaaggcctgtgttttattcactgttgtattcccaatgctcagaaaagtccctggcacatagcagtctctaagtaaatattttactgattgaatgaataaatatgtcacaagggatttggtgaaagaggaagaagagaatggagagttcagggcacctgatccaaaaaattctaacttatataggacagtagcctccagattagacatacatggaccaaacttagataaaaatgtgtgaggggcagaaaatttctttttgtctttttggttcttttctctctctcatgtaaaccacatttcttgttctatgaaaatactttagcataggagcaaaacctttttaaatatggcagttataaccctctgatggcaaggttgaagactcctgaccagaaatttccacattttgcttagaagacggaagcaagtgacagttcggccagctgcagtgcatcagaactcatgtggtccgtggaagaactgtattcattccaaatgcaggtctttcagtgaagcgcaagaccttgagttgaatccagtttttacaggtgagtagttaaaatgcatagaagaaagcagtgaggtcatccatccggagcagtcaggacctcatcatatctctactcaccctatgacttttgttgcagctgcctgtggagccctacgtgggctgggatctcttgctgtcacagcaaaggaagggat

SEQ ID NO: 61581 - DNA, 688 bp, Bovine  19866881632504
ctcggatctttccctggcgtatcagcatgagatcccacaagagaaagtaagcatcacccgcaagttgcaccccagtatccgtcccttatcctgagggtgggggatctggctgcgggatgcagtagtgaggaaggggagcagagctgccagggccagaaggaggggctgcagaaaaagaccaagagaagaaagaggatgccaaggacaaattggaccagctccaaactgccgctccctccctttctccccctctcctcatctggtgctctagaatgtataaaggggcagcacccagcccattttcagcaggagagggagagatcctctccttccagggaaaggaaaaccaccctgagcagtcaaattacactgctgtgttgggtaagattgatttaattcctgagggggaaggggtaagaaagagtagcaggggaagagggcgcctttttggtattgctggtgctgaggtggtacttgaaaagagtgccaccaaggctgcttcgagagccagaagctctcttcctttgctagggcttaaaagagacttgccactgggtttctggatctcatttccaatccaaatccaaaagccacaactccgagcctttggggaataagttcatgtcttccagagctgccccagcacctacagatgtttatcctctcccctccccttcctcctcctctc

SEQ ID NO: 61582 - DNA, 1791 bp, Bovine  19866880125930
aattgatgcttttgaactgtggtgttagagaagactcttgagagtcccttggactgcaaggagatccaaccattccattctgaaggagattagccctgggatttctttggaaggaatgatgctaaagctgaaactccagtactttggccacctcatgcaaagagttgactcattggaaacgactctgatgctgggagggactgggggcaggaggagaaggggacgacagaggatgagatggctggatggcatcactgactccatggacgtgagtctgggtgaactctgggagttggtgatggacagggaggcctggcgtgctgcgattcatggggtcgcaaagagtaggacacgactgagcaactgatctgatctgatctgatctgaaggacctactctgggcttcccacacggcactagtagtaaaggacccacctgccagttcaggagaagtaagagatgtagtttcgatccctgggatacagaataatccctggaagagggcatggcaacccactccagtattcttgcctggagaataccgtaaacagaggagtccatacagtagcaaagagtaagacacggctgaagcgacttagcacgcaagcacacatgcatatgcaaggtcctaccatacagtacacagagctgtattcagtattctgtcatgacctatatggtgaaagaattataaaaagagtggagatatatatatatatatatatagggagagagagagagagagagagagagagataactgattcataaaactttgctgtctgtataacagaaactaacacaacattgtaaatgaagtatactccaatgaaaatttgaaaaattaaaaaaaaatactctgttggatgagagaaaaattttcattacttgggctatgctcttcctaacgttgtaacagcgttaacactttggagggagtgaggaaggagttgcagaaggccttcctggatgttagatggggctggttacttaacacagttatcatctacatgactcattgctgctttcagcatgagctgagctccactgggcctctttttttttccccccaaaaaaatcctcttctatcttcctctcccagtttctaagcagccaagtactcactaaagagaaactagggagagtgtgtcattgctttagatattacaaactgctgcttgtctgaatactaaatattccactctgtgtcacttccaaagatgcacagactgttttgataaactatttctactctttgagttttgcaactttaggtccagcagggaaaaagcccacaaaagtgataaagaaaagcagacggaactgtcaaagaaggccaaaggcaaggagcaaagggaaaaatgtatattttctgaaaaagtcaagtctataaattaaattgttttcatctactttatgcccgaaaggtatgatttgtgtgaccagtgttgtccacagcacataagatggtattgacactgacttttctaaaacaccgagagtaatgccactactgtcagggcaattttataaaggaatagtaggggaaattggtgttatagtcagactttttcattctacttctcactagaatgtgagaagcattgacaagactaaaacttctgttaaaggaattcttgtacttaggaatcagtgtaatttagagttaagaacaagagttttgagttattgcaattcaaaatctggtatctcacatcagttctgaaaataacttataattgtttattaagagtgcattttaaatctcattttgttatttataaaaattatt

SEQ ID NO: 61583 - DNA, 1629 bp, Bovine  19866880604885
tctgagccttatgctcattttatctatactcatgataaaagtgagacaggagacagaattctctgagctagatttccaagcatttatctgcataggagagaaaccacaggaggcaatagtatccagagggaaaaaaatatggagatgaaaaaaggaaaatagtaggatcggagggacgtaagcacaagggaagccaaaaaactagaattcaattttacaatggagtaggatatattcagttaccgtttacacatttggtgagtaaaaataacaataagaaatgatgaaattacctatgtggcattgcttattaaaataattgctaaacatattccagttgattttgacaaggttataacactgtgatcatttcaaattatcatccaattctcatttaatcacatagcttaagcaaaatacagagcccagaaaaaaagggggaagaacagcgaaccaaaagcagtttaaacattataagtgacatttattcaaaaagaagttgcaggctgcaaggcaagaaaagattattttagttgaaatcagtttatattactgaatacgtgaccttgtgatctaaacgttggaacactagtctagaataaatctagaacagcagaatataaatatgtatatgtgtgacatttaaaaaatattcccatttgaatataataactatgtgtgctttcttgtttttttgtctttatcctcattcttatccaggaatgaattaaaaatttatgggaaggatgaaatcaaagaagagagaaaaaggcacacaataaaatactttgtacatgtataaacaccagataatttgatctttttactatgattaaagctgaaaactaattcatcttagttctcctgggcttcctccccgcttcttacctttttctcacttcatctatctcaggcgccctttcgctttaacatgcccatccttctttcaacagcaattcataggtaatggtacatctctgttgttaacatctttatataaattcaagtcaacatgtaactaacttctaatccttattcactcttgcacagattaaatgcgatgttattaattattatcctgtacattttccaatttaccatgcctttcacatacctcactgtattagtaaactgtgaattaaaaaagaaacgattctctctgagaccactcttatcactgcttaggttttgcatatgcctagttgacgattaaaagtttttacccatttcattgaatactttaagagattatggaacagatggagatgtttgagcaatagtggggacaacaggaaagcctaaatcccctcatatcacataggaaattggctattctagctagcacatctgaacaaacacaatgcttgctatagaagacatggagtgtggagagtgacagcatttaaggattgtcagggaagaccctccctatttggctaacaaaaaagtgactccagcaataaaaaatttgagcaccccatctctggttgtcctaacttccccttttaaaacattttcctccataaagaagaaatcttatttcttttcatactttatgctctttcttccctccttcaaccttgcaatatctttacttagttggattcagtcttattaaattgcaaatga

SEQ ID NO: 61584 - DNA, 2578 bp, Bovine  19866880649892
tactttgacatttccctgtggcttttctcacaggcaacaaatgaaagcaatcttgaaatcattctgctaaaggctcagtgcaggaggccagtccatacattgtcatcagaaaatcttccaatcaggcttgaagcatttacgtctagaggagcaacaggtttttaatagaaaatacgcaactccgagctcaaatgtttaaaaagcaaacaaaatttaaagataacatgcacatccatacaggtatacatactcatatgattgttccctattataattaaattttagagaaaatagaagttgaatagctgaaccctcaagaaatgtagaaacagaactatttctagaaggaatactaaagtagcaacaaagagggaaaagggagagacaggcctgtcagaacacatgtgacaggactgtatggacccagtgtgaccagtagagagttcagctaagaacagatagcaaagggaaagggaggctcacagaagtgaaaaaacaggtatctttagatttgaaaacaaaaaccaaaaaacaccactcacagaagtgaaaaacaggtatctttagatttgaaaacaaaaaccaaaaacaccacacacacacacacacacacaagcttctgacactgtgacattgtaactctaacgaatggtccatggagggagctgttgacacaagttcctgggtggagataaaacgacaccagtacatccagctgaaaagaaggaaagggaagagaactcaactgcacatttgaaatgatttggcagaaataatttcctttaagctagaaatctgctgtccaagtgcttccccatgtagatccctccccagcacctgtgtaggcccccatggtgcctgggtcagaacccagtgccacagcttccatcagtccacagcagaagcaaagattcttcgaatcacagaagtaacccaccactgcaaagaggaaagcatcgagaaaagctgggaggaagtgagttaacccctgaaacgccagccattctattatggtaaatattggcgttaggcaacacatcaggtaaatagattggagggaagctgtcacaagaaaggccactttcggacccctcagaagggacagggaatgtgggcagagtatctttttgcataacatctgactccagaatgcataatgggtggcatcccttcaaataatgtctgttttgcacatttccatgtacagaagttttgcagagtgattttctcttctaattgcttggcaatagacattgactagtttctgatgatgaaagtggaaaattatagacgaggaactaagaaccctaggtgctcagaatttatccccaaggatcctcacccacctaatctggggggtggggtattcttcagggcataggactcactgttccctctaaaaggggcaaagacagggctgaggcagagcagtctgtcctcagctgccttctgcctcagctcatcagaggaagacctattggaaacagcagacttagacagaatctaagagcaacagtggtaacattcattcataaaaatgggataagctttttctgaaaaattgcagacttcctccttctccctttttgtttctttaaatctctgtgtgatacggtgaaaagctcagttcagcaaagactattacctaactttgagtaaacttgtatcattaggaattaatattttgtaaaacaaaacttttctttagcagcacatgtatatttccttttagaaaagctaccacaaaggttattatccaaggttgaagaatctttttgaaagtgcagatgttaaaatgagaaattcttctacttctcaatttctatggaatttacatattcagccattatcacaagtcatttgcccataagtcataaaattcagtatatatttttgagatgtttaagattctcataactaatatttgctaaaaataaagaatataaaaataccaacattaaaactatggtttgaccctatctgcttgtaatggtactaaaaaggtatagataggccagggaaattcttttccatggaatttttgtagaaattaatgaaatgatgagacttgtacttgagtccttaagggcttccttgaattaaaatgctcttttgcctataatgtcacatttgtcctcatgtcaaatttagatgtgggacagaagttattactaatatcaaggattaaaatgagactatggtaaaaagttaatgaccattaataatgcttaattaaaaggaatgctatttattctgttcacattttttagtagctttgctttctgctgggtaacttcaggccttgagataattaccaaaaattacttttgatgtataacctaaagttggttttcaaaagcatgatgcttgtatttcaacatataagactaaggacttatatattgatctattaaattgttttcattttctaataaagaatccttcccggtctagctttcttgtacctgaattccaagttgtttgtgatgtgtgctaattgatcaccctgaataaacattagttattgttttgttattttttaaatttaaccatacataagaacagataggaaacataa

SEQ ID NO: 61585 - DNA, 833 bp, Bovine  19866880876592
tgatgaatatttaataatgcttctaataatctcaccaaataaacatttcttgtgttgctttgcaattgagattggctatcagaggaacttgcagatggttatttttatattccccagtgaaagtcttggaagtctaattggactggtaagtgattttataattattaataaattttaatgactaatagcttagagtaaacaaaatgatattaaaacatgttttctaggtaaagtttttatcaaatatatgttgcatcttttcctaaagtattcacttattttaaaaagtaatgttttacactgtaatttttaatttatactgttcctttatgcatcccctaaccactttaactgtcacatttagtattgtggaaatcagtaacatcaaagagaaatgccagccataatacacaagccataaagatcatttcagatcataattaatttggaaatgttgatgggtttgctgtgaccataagtaaaactttttttttaagaaaaagacccattgtagtggtatctctttcagtaaacataagcaaaaatgaaccaggtatgccatagctggaaaacaaccaacatggaggaaaaaggataatattacataaagtattgttgaaaagtaaactgttatattattaaatgaatcacaacttgctgctgctgctactaagacgcttcagtcgtgtccgactctgtgcgaccccatagacagcagcccaccaggctcccccatccctggaattctccaggcaagaatactggagtgggttgccatttccttctccaatgcatgagagtgaaaagtcaaagtgaagttgctcagttgtgtc

SEQ ID NO: 61586 - DNA, 779 bp, Bovine  19866880886906
cctggggtcacagagtcggacaggactgcgtgactaagcacacacaccctatggataagacctgaagtttaataagccttagcaatggcctaagatgagtaagtagcttactcttaggcaagatctaaatttctggaaagacaaaacatggcgtgtaaattgtgttaaagtaagattcactggagagaaggagttcagtggtggaggctcaatcccacatctgaactataagacattgtaaaaaagtcgtttgggggccagtggtttgtcctgagacctcatttctctgactaaagtaagaagagttgttgatgtttcagtttgtttagttttttacttgttagcacagagtgtgacttctaagctctttacttgctgaacttcagtccttctttttagactttctctacttctaacttgaattagcctcatatctactgacaagttgcttgggctgtggcatgcgtgtgtgcatgcgcagtcagtcgctgcagacgtgtctgactctgtgcaaccccatgggacatagccccccaggctcctctgtccatgggattctccaggccagaatactggagtcagttgccatttcctcctccaggggatcttcccaatccagggatcaaacccatgtctcctgtgtctcctgcattggcaggtggatcttgcaccacaccattatgcatgctgctgctgctaagtcgcagcagtcatgtccgaccctgtgcgaccccatagacggcagcccaacaggctcctctgtccctggattctccagg

SEQ ID NO: 61587 - DNA, 1396 bp, Bovine  19866881057674
atgctgttaatagtttctgtgttaccttggggcttcctaggtggcacagtggtaaagagttctcctgccagtgcaggagactcaagagacaccagttcgattcctgggtttgaaagatctcctggagtaggaaatggcaatcctctcccagtattttacatggaaaatttcatggacagagaaccctagcaggctacactccaaagggtcccaaagagttggacaagactgagcctgcacacaagcacacacaccttgcatttagtaaattataaatgttggctactgtacccaagtttgcatgaaaaggacccttttcttcaaatttgagcatataaattgaacactctatacctaacatacataaatatggcacttgataagtgcctagcacaaatatagtacagcttaaatgctcaatttaccctcattccccccttgtttactccttgttccactaagataattaacagaagcttctgaataatgatatgaaaagctctgtgatacacaggcatatcaccatgtgaaaacctagcatctttcccaaaaaaatatgtgtccattatttggtcccaagcactaaacattttgttggatggaagatactggaaactaaggctaatttgctcaaaagaagaggcatttcaaatatatcttaaaaaaatcattttggtgaatctctatatacatcactttcaaaactttcttctgagctttcatggtgatatcttttcacatcccaacagtgcatacagtagtttggaatgaagtaggaacttccaatttgcaaaacactaattggctgatagtgtggtgtgttagccaccagaaagaatagggcaaaaagggtagggaaaatagaggtcctgtttcaaaacaggctagtttttaaacttcattatacagaggtaaaataatgcaatagcatgaatactgaaaatatggaataaggtaatatgttaataatgtaaattatatttacaaatttatcattattacatttcagaaaaaaacgtgaataaatgggtaatattttaggtaactatttccaggggaaaacaatcatcattttactattcaaatataatgtaatttaaataaaaagtaaaacagaacccaacataaaagtagttatatcctgtataattgaagatagcttaaaatgaggacagcttagatcttgaattaatgaagccaagaaggtcaaccctgatcatcaaaaacattacttgtgagagatgaaagtttaactaccattactttcttacagaaaaagtagaaaattggaatctaaaaagaaataccaattaggcatatatcgatagcatttaactgagtttaggtacagaaaatagagtggtgaaggtatatttttatagcacatctagttaag

SEQ ID NO: 61588 - DNA, 1428 bp, Bovine  19866881181007
caggaagcatggtgcaatttaggtttccaattccccccaacaaatatcatgccatctttcactactccttatcactttagagttaatttaaataatataagatctctccctaatatattcatttattctatgacttcatattataaccaacccccttagttcaattttcaatttgagaaattttaatttttgatttgagtaaacatcctttggttttctcagactttgtttagctatttttccatctttttttctatgaacaaactatttgataatttttacgtacaatctctaagtgcatttatttacctctgctttatttattattgagaaactatacactgtgcactatgctaatccctgatgatactctgttcaaaatgagcacaatttctactctgtaggaaatttcagtctattgagagaatgtttagcaaacctggcatctggattcagtgagaatggcctggcatgaggtcggaagtgactgtcctctgagggacatctaacagttttaggaagctaatgacaggctttctgaataggggccattagctggggtatgaagaatcagctgaagttagacaagaagatagttaaaggtagaatggtatgggaagtgttttaggcagaggagggcagtttggtcaactgttttgagttgaaagaaagcatttctaactgagactgattatttaggttaacactcccatctagaacagtaactaaatccacatatacagttacataaaatatatagtgggccttcaaatgtctttctcaaccttcagaatattacaaaagcttttattgcagaacacgcacttaatcccactccgtgtttgtcagtgtttcattgagaatttagatgctttaaacattttaataaacgtttgtgtgctgagctatatttttttacatctatggaagcatatccaactattctttaattcacctcagaggttttgcattcattttatattctcaccctcaatatctgaagaatgctttgaaaatactgcacatttagcaaatacgcttactgataatgagtaaaaacaaatatcctacttaggactgtgattaagaaaatattggcaataatagctcctttaggattttagtagtaattagatattatcttactaatgcaatgttttcaagtataaaagataaaaatcaatatttcattgaaaattaatactcctaaatgtaaaggagtgtatatgtctcccttgggtaccaatatacaggcacaaatgagttttcatatggaattacatgggttttgtactaattgtcagtgactaaagccccttaatgaatcaaggaaatgctatataatataacaatatattttctattacaaatggttaattcttatcattctttgaattttatctggctaaaatataaatcccaatattt

SEQ ID NO: 61589 - DNA, 4887 bp, Bovine  19866881200351
aacattgtaaaatttctgttagaaatatctatcagaagaatttctccaactaataaatcttcaatgtgaagagttaacagcttaatttttttttttaattaataggtaaaatacctagtaaagaaagaattaaaatgaaagctaacacattcatggagaaaggctcaaactataaaacttgtcacttgaagcaacctctttttgggtacctggtactgactggttcttaccacctgtccgtcacacctggaaaatgaaacagatgttagaaagctgacatagaaaagcaggactactatttaggttttggtttcttttttcttcctttaagatacaactaatgtaaatgacacagaagtctgtgtatggcagcacttctgaaaaagaactctttgtaaatagagcatgaaggaggcatgaaggaagctagcaagacccatttgggtctttaggcctaatagcccagatctggccctcagatgtgcatgtacgcacaaggtgatactgagtttgaccaaagctgtgcaaacaatcctaaagccaaatgagtcaacgcttgatgcctaaggagttgaaattgaaatttccagacaagacagtcttagaaaagctactcaggcacagaggaaatgtcctgtttcatcctcactgagacccagagtgacattttaagaaaaagaaatatttatagtttttaagtttttttctttagggagttcataaccagaattcctttcaaatttatttaaagccatcagaagtaaattttgtgacttaaaatacttcattttaatcatttaaaagatgtgggtatttgtgatctatcaaagtcagtgaaagatttaaaacttataggtgtgtagagaacttcagcttcaccaaagtgaactcagtgcatttgcttgaatatgcaatggtgcaatcactaaaataaatgtacttgctgcactcaattaaacattgtattgtacatgtgtgtttattcaattgtgtgacgatacagtgattgaaatacacacgctcggagcatttgtctcaatctgcagtgcatttatataaatgtacaatcaatcatagtcctctgcttttagtttttcctttgtatttttagagaatactaaatataagccattgtgtgtatgctgtgacatggtgaagaactgaaatgcacattaagtaaagcaatataaaatgggaagtttcagggaaagaaataatgcaactcatatgtgtaaatggccaaatctgtcaaatctaatatataaggtcggagttttatattctgaactgtttctgttgattaactgctgtgcgtgtggtggtactaatatatctttaatagtaattaacaaaagggatgtaaaagatattcaaagctatattaaaatatttgcttcatatttgtatatagctttattgagtcttgctcaatattcattattttaaacatgcttattattttattcatcaggcttttctactgtctgaatttgtggtgcctctcatccttctgttagttctacctgtgaattcttactccagtgtatgatatcatattgtgtaattaaaaaaaaaaataacctcttcctcctagggctctctctgtgtttattttaggtggtccaagttgagggaatgtctctccagagccagttttcctgcccaatgttctgacctggaaccccaattcaagggtttcatattctcattggacatttttctctccatacagtgccaaggtagagaaagacaacctgcctcacccacctctggatttttgttcatgtattttctctacctagaaagtgttttccccctgtatgtgacatggtcaactcttctcatattttagatcttaacttatatctcatctctttaaagctgtcctcataaacaattctacctttttctttcatttatatatgcattcaattgatacttcttgaatgctcataaccttctaggcattgacgatatagtgatgaaccagatagaaagtgttagtcactcagttgtgtctttgactttttgcaaccccgtggactgtagcctgccaagctccttggtctataaaattctccaggcaggaatactggagtgagtagctattcccttcttcaggggatcttcctgacccagggattgaacccaggtcttccacatttcattcaattaatgtttcttgaatgcttgtaatcttgtagccattgaggatacagtgatgaactagacagatacaaccactttaaccatggaatcgataatctgtctgtgtcaccctttcattcttcatctccttattccaattcttgtgcagcacatgctgtagtttgctttttttctacttgcttatgtttttcctttgtttattttgcttggctacacatttccctaggaaaagcaccatgcctgtttttgctcaccaatgttttccttaatgctcagaacagtggaatataataagatagtaaaaagtcagatgactttattagtcaagagaaggagagatgaataaaatccttgcagtaacccaaagtaacctctactgtccctactttgcattgaaaaacgcagaagctgagtggtacaaatggcatgtccaaaccatgctgctggtcagttatatgatcagagattactattaaatcagtgtccccactcttctccatggtattctgaactatttcattgtgcaccagtgagtgacagtatatagttcagggagtaatctctgaagagagcaggtccaaattcaggaaagtttctaaacctccctcatctctatagtgagcataataataatacctgactgcttccctggtggctcagacagtaaagcgtctgcctgcaatgcgagagacctgggttcgatccctgggttgggaagatcccctggaggaggaaatggcaccccactccagtactcttgcctggaaaatcccatggatggaggagtctggtaggctacagtccatggggtcacaaagagtcggacacaactgagcgacttcactttctttctttctttcaaagataacattgtgactattaaatagatgatagatgtaaagtgattagaacagtgtaaatattactattgttgatatagtgattattattcctatctaaaaacaaaaactgtataattgattgtcagaattgtcttctgtgtggaagttatttgaatgatatcatttcactgaaaagctaaggatcatttcttatacttgtattgagaatagcacataagtctgtaccattcctcaaaaggcatttgagctatatgtgttgggtggatggctaaatggaagatgaataaaaaaggaatgacttaattcctttgctgaaaaatagattgcaaatgacaaatccagtcttaaacaatacttcaaaaattattaagcaagcacagtcttttttagcatatgattaaatccaaaaatgctgtgtgtttcctgaatgtagagataccctctagagatcagaaaagtccagaattttagcccagactctcctcttaactttcctatatgagtctccttgtactacccaatgcctataaaatagggttaccagtgaacagagaaaaacgacaatgatgatacttaacaacatatctgacaaggccattgtcatcactgaaagtagatttttaaaagtaaagcattttgacacttaaactaccataaacatcagaactatgattacttttagcaagagctggcaacacctgacttaagggaaacagaaaaggactcaagtgccagtcatgacttcacttgcacttattagaaactttcagacttttttcccctttgagacttaaatagaggttctcttcataatccctattcaaaggtctgtgtcatcaggagcttttccataatccaaggcagaagggaagaggaacagggcagagggaagctcaagaggagggagacaggttgcttgaaaaaacgggacctcaacaaagacagtccagagagctccaaggactaaaacctcacccagtctccgaggaagctaaatcactgcctgccattcactaaaactcaaatagggatgagattactatccatatcatccagtctgggctcactgtggactcctggaagacaacacattcctcttcctccatgaaggacagctacccgaccaactggggtcaggctgccatgccaggagggcccgtgtaagaggaatctgctcgctttgcagctgggcagctcagcatagaaacagccaccctggcaacttacttccatcaggacaaggccttctcagttgactctcagttcctttatttatgaatcccatttagccccaggccactatcaatcttatgctgttcagaagtttactacttgtgctacatcatttttgcctaatgctacctacaccaagctacactgacatcagtactgcctgccagaaatgcttctactcaagtccggattattggggtaattgtgtctccctagtttacctaagacagtcccagtttgcatctcttgtccctatgtgataaccatattcccctttcactccctgaagaaccctggtttggttcataaataataggagcatactgctatgtcctgattgtaacacaatggccttcacattcattcagtagagaaaatgcatccttagtcatgtagataaaacaaactaccaatgattaaaaaaaaaaaaaaaaaacacagtaatttgactcctaatgccacagtatttatcaatagctgatataccatatgttcatgcttatatattatccatcttccctaactggaatataattttgataagggcaggaactttgttttgcatactgttgtatccatagcacttagaaagtgattagtaaatttatttgtctgctaaata

SEQ ID NO: 61590 - DNA, 881 bp, Bovine  19866881397928
tgataggtaatatttagcagtttcgttatattcccttattttttgtaaatttatttgtcaaagtgcttttcataagaaaaaaattaactccattttaaaacaattatgtactgtttagagaaatgaaatgaatcaaataaagtagctgcttgttcatactgttctccctctgtttttaagattaaactacaaacataattctgaaatagaaacataatactatataattaggaagtagtgtgtttcatttgttacattatatttcttgactgttactgaaattttaaattaattcattttgctatgggcatgctgttttgttttgttttgttttcaaacagtgggaggagaaaaaaaaaatcagagagtgccacgcagccgcagccggcggcatgaatgttctcatcctttctttcatagtcttcctccagctctatacaaacccaaaaggctattcagcagcaggggtgggagcaccgagggagggaaggggtcacgtctcccatctctccatgtatctcattgttcatcacttgtcagtatatttcccacacaccatctccagccactctgcccctcatcctgactgccggttccatgacctctatgacattattctctctccctccattccctacatctacagtcttgttttgttttttaatttttcccagactgtggttgctataagactgtcactctgactataaaacatagaaaatatttgtcggaacaaccataacaaaagtttctcggtacagtgatgcctgattcctactgcatcgtgttcttgccctacctccatgcttctgcctccagtttcttcacaactttgtacaatgattgttaacttttcactgaagcagcatgtgttgtaagaa

SEQ ID NO: 61591 - DNA, 1256 bp, Bovine  19866880364577
ttttatcctgttgtatattttgaattcttcaaaagccttgtgagtttttcatttatccttcctcctgaagtgacctttgtacaggttcgtttggtaggttcaggctgccagcagcaggccacttttcaatcttgctttgccattattaaagatagatagccacaattgcgggattaaaatacctatctatgtaaacattaaattcagtgttgtgtcagaattcccctgaggatcaagaaaaggactttaattttaagtgaatatgtgcaattttattcacagtctgggaatattataagattacaggtataaataatttcaagaaatttatgagctgtaaagtgtctgcctacaatgtgggagacctgggttcgattccttgatctggaggatcccctggagaaggaaatggcaacccactccagtactcttgcctggaaagtcccatggaggatcctagtaggcttcagtccatgggatcgcaaagagttggatacgacttagcgatttaacttttgtagaatacatactcaagagtaaaaccaccaaaaaaaaaaaaaaaaaaaaccgaaaaactgcatgcatataattgagcaacaaataagccacaatagagctgcttagtggcacaatttgcaagtctggccttagaattcaggttaaatagtgtccctaggtttcagtgggatatttcttttcgctgcctttgctattggaagtctgtattgtcaagggtgaatcacaaaacagttctgatcattagtgggagagttcttttgaagtgggtgagaggcctagaaagtaaaatcttggaaatcaactaaatgcccttgtgttttattagctcacactttttatagctcataataaagtcagctcagaaggtcacttcttgaacatggctgtgaatattgtagtttatgaattctcaaattgtttataagcaggctgggtgaggatttttaataaatacttggccaagagaactattctgatatatatgtatatgaatcacgcaatgaaaagttgtatcagattcctcttcttctctccccctcccatttcctcaccccagggcaacaagtcccatcctcattgaagccatggttactatattcttgtttttccttatgcatttgatgtctatagactttgtggggattacagagctatttacatactttatttataacttaactgaaggattttgtcacctgtatttcccaccattttataaatatttcttaacatttttt

SEQ ID NO: 61592 - DNA, 1433 bp, Bovine  19866880370492
gagcctggtgggctacagtccacagggttgaaaagaatcggacatgactaggtgatgaacacttttgcttttttcacttttctactccttagcaattaacaatgtaaaatttagttctcttaagtgttttattatctacctgggaaaattcagttacctacaacaacttttgatgcccataagccaatttcttgctcctcaagtaaataacccattctagatatactgtacataattaaatctggagtaagtttcagagtttctgctctggttttgacatttcgaagtcctggaaccttcagcaaattgcttaaactctctaaatctcagtttgttcatatagaaaagtgggaataataataataatgcctgcctcacaatgttgaggaatgtgcattgaatatttagtatagtgcctggcacagtggacatccttaataaatgacagatacttttactttaaatatttcactttaaatattttggaagcaatatgtgagtttctaaacactaattaaaggcaatatattttctaataactttgaagtcatgccctctaaatataattagcatgaaatctcagcacaaaggtgtaagttcatcaatagtcattagtccttctgtgtcccttcatgatctccagcagtccaaacactctccacaaacccagtttctagaagattcaattctgtagtcaaatagtgtccaggtcaccttactgttccctggctaggccatgtcaagctattaatatatagtaaaagatgacagccaggaaggaactaaagtgtttataaccagtaaataagtaataaaccatatactacgggttctaaagcagagagttttagggttgaagtcttcgttctgccttcattagcttgatgaccctggtatactttcttttcttcttttttcaaatgtggatgtcagtatatgcacttcagagggctgttgtaagtattaaattgaatactgaatgttaagggtgtttagtatatcgttagcttcttctggaacccttccttcttttgcccctcatcatgtcctttgggtttcctccagcgtcagagcagggtccttctcagcctcccagccagtcccattccctgcttgaaaagaaatggagtgcctgaaggttcttggtccttttacctacatagatggcccagacgtccttatccaatcccacatcttaaagcaccttccattgagaaggaagatctaatttccaacttattaacactgctgaagtagtttacattggccaaaactatacagaaagggtggaattggcataaaatcacatctgtctgatactgaagtccaactattaaaaatgtaggtaggagagagagagagaaaaaaagatgatttcgtacaagtcccccaagtacaagttccaaacaagaaaaagaagaaggaagcattag

SEQ ID NO: 61593 - DNA, 1076 bp, Bovine  19866880390036
aaatgtctggggaaaaatcgaaactatgtttagcaaatatctaaaataaaaacagaagtaatcacacctcaaagaaatgcaagttaaaagaagcatcccaacttacacctcacgtagagaaagaactcacccagaagtaggttactgaccctaaataaacaaaaccatatttctctcctaaaagctgcagctctccaacttccactgcttcctgtcatgcggtttgcagtgattttattcagagaacacactatatttattctgagcagcaaataggagacaaactccttgtttttcctaatctataatcaaaatacctgggtgctaggtaaatctcagtgaactgagatttttcattttacataaaatgaacatttgggcaaatattaaagcaagttattgtactgaaagtgtgttcctagaaaaacaggcacaatatcagtgttatcagactcagtgtgaacatggaatcatacatatgtttccttattgatattcaagggatcacaggctcagttgctctatgcccacttggaaaagtgtatgtaataatgacacctaccttacagggttggggaaagaatgaagagttaccatacacaaagcacagcttttgtttgtttgtttcacttccactgtgtctttattgcagggcaagggctcagtagttgcagcttagatgccccatagcatgtgcgatcctagttccccaacctgggatcaaacccatgtcccctgcatcggaaggcagattcttagccaatgggccacaagggaaatcacacacataaagcacttcacaaagtcctggtatatagggttccatcaatatcatctgcttattctagtaatgttaagagtagaactagtaacagtagtcaaaagcatctttagatgtccccaaattttccaatttagagtgtaaataaataataccaatattaacagatggattgtcctgagacctcatcataagagacagatgtaagccattcatttgtttatgcactctggaaacactaagcaggctttgtcctacttctgggcagatacattggacacaagcacagtagcga

SEQ ID NO: 61594 - DNA, 1840 bp, Bovine  19866880392899
ctcttttgtatccttgaaggccccttaagtgataaagaaattctcctgaccttggagtgactccaagagacaattcaaaggcaagatacagcagccttcaaaaaaagctcaacataaatttgaatgtgctctaaagagagggcagctgtcaccatggtgattttattctttcctagactgagttcaaaatgagaggggaggtgttttcaaagtaaagatgctgaaataagtgaattaaagatctggatataatttatatcaatagaaatatggtgcttagtttgaagtttggagcctatatatggatttgtatactcaagataatgattgttaagtagcctgagagatcatctttctattgtcaaaatatttacagataattacagttgtccttatcattatcaatattctgctaaaaggcattatattctcagtgatttctcaactaatattgaatgtttactattcctgtgcaatacacaaagttttgtgcatgctttatttcatttaatctatgagagagatagtataatcattcccatttaaaagatgcaaaaactaaggcaaaggagacaaaggcttttgaagttcttttaaatgtttatttggatttgattttaattttttcagtgccatagttttataaaaaataggttaaaaagccccatcctcatgaagcatgcatgccagtggtttgtgtatgccgcacagtaaatgccagatgtaagagtcaaacccaggttcaaatacaaaaaccctagtgtaaataactcgagtcagagtatcaaagcatacataaatattataggatgttgaaagtcttgtttaagattagccatacctacaggtcagatttgggacaatacaggaaggaaaacctttgaaacaattctggagggctcacagctacttttgtgctccattatcagaattttaggaatacatcaccaaagatataacttttttcctatcccctgttacccagaagcctctttggacttctggaaattcctgtcaactacatttgaagaacgattctcttccagttgggaagggccttctcttaaactgagcatatgaaaccgagatttatcaaactcaacctggctaccattgtggtgacagatgtcccagctcaaactccctcagacaatcctggagtggctctttgcagttctacatgtgccaacagtcgttttcaaacactgcatttttttttgctcatgttctccttgcttttcatgtgaacttcatcaggtagctctttcccctgaatatgtgatttctgacttttaaaaccgggaagagcaattctttcctcttagatcactgaaagtctgacaagttgaatatcttggtgaacgtttatcagtatttgggagtactgaccctcctgctccaagtccagaggtcctagtgttgttcacctcctagccccaaagcaaaagaaccttcctttgtctcttttttgaatactttggagaattcctagccagtaacttcatttccctggaggaaatgcatgagagccagctgctaagtgccggtgtttgcatgcacctgtttgtttattttctaaaatgtaattggaaatatgcctggaagcctgagtctgttctgtagtacactcaaaccagattcagtgcacagaagacaaccacagccttgtattgtgcatcttgcacagcaatacaactattgtgtgcacaggtctctagttggcgttttgcaaagacatgatgatcaggaatgcctggaacacaaacttttcatgggtgaccgagatattgacaattaaccaggaacattcatggaaaacaccacacagtattcataactc

SEQ ID NO: 61595 - DNA, 1386 bp, Bovine  19866880428179
tcttcttacgtctcagtgttcttctcatattcttggtcgcttcttagtctgtcatcacatcaatgacttgcagtatccttaacccttgccttccatctcatctatgatttccctaacccaacagatttccctaccttaaaatgtccgtggttatcaaagacagaaaatcgacttcctctcagcagtcagtactgcaactagaaaaggctccttttggttggctggtgattctttttattcaaggaatagcccttggtattttaaaatcaattttctttatgactatatttaactctaactcattttgtaaaactttctcttattcatactaagtcaaatcagcactaaactgtctctgtggttgttctgtatctcggctctcctctgatcctcccatggaattgagagtaagaatgctagaagagatcagtaaaagatcaacttatcaaccctactgttaatcacaaagtgaattcactcttaccagccacccttctccaaggatagagagcactgagcatctctctattcttccttttgtgtgttgtgctcaacggacattctccatatctccatttctgtgactctgccatcaaggacaatctcttagacactgcctgtcattgtgattattggcaatatcactgaattaaggtaatcaggccacattcattgcgtgtacttggagcagaagctgaaaccacaggtaaaattgaaatgccaagtaatggccatttcagtgttggtttcctgtactttttctaaagtacatttgcttttacttttcctccttgcctgctgagatcattgtgtgggtgtgagtgtctgagggctcgggttgataagttgcagagggaaagggagatgggggaaggccacacagcttgaataaataagtgcgtgcaaatatatggtgctctagcatgccctactgccatgtctccatcactacacaaggatgtcttcgtgtattaacttcagcatcagaattctaaaggcagggaagcaaaagtagcagctgtgggagctccctaaagtggcgccgggcatgacattctgaattctgaaattgcaaacccacagttcagtggttgcagcaacacagaatgcagatggcgtgttcctttggattgtcagggtagttctacagtgtagagaaatggcttcggttcactcctgttggctctgtcactgccttttaacacccatgtgtcaggaaagccatgctgcagtgacaatcatgtgttggtaatggggctcagaggagagtacccagggaaagtttgaaattaaccatttcagaatggaggagtcttttccacgtgttccatgttagagaaatgaaaaaaggctgcactgtatagattagggggctgcaatactcag

SEQ ID NO: 61596 - DNA, 1700 bp, Bovine  19866880459875
aagggtaggatggggtgggaggtgggaaggaggttcaagagggaggggacatatgtatacctatggctgattcatgttgctatatggcagaaaccaacacaatattgtaaagcaattatcctcctattaaaaataaattttaaaaaattagcccaatagagttgatattccaacatgggaaatagctaaagagatacaaaaaggactgaactgagaaaatactggtgtaatggcaagatttttaaatgcaaaatagaagtaataaatacatttaaaggttaatcccccccctcattaaatatagagcttagaagttatccatatttgtgtaatacattaatgagtggggtggaataaggagttggatgctactttgttacctgtctcattaaaatggaaaatccatgtgtactaatgtactactgcaaataaaatccacttctttaccttgcttttgacacagctctcaatgaatcaggataaataaccaagttcattatatgtttctacaagaattgtcaaaatatgaagaaataataaaaaccaaggatatggaggttttttgtttttttttttaagaacttggataaatgagaacacaattttctatttattggcaaacacttgctttcagtagacctataattctatgctaaatgtaaggaattctgttaatagctttaaaatgtacagagctccaattcccttaaaggtgaagtgtcatactgcaattacttgatgaaataaaatcatcgtagaccgttcctgttttagaagtgctaggaaaaccaggatcagatgtgacagtcatagaatgagattaataaataacaacaataataaaaactcagctctaaaccacagaaaaccaattttgaaacaattacaggcaactattatggtgtgcctctaaacagtttaagctaaattccctcagcacagctctgatgacgataatgtgcactgtgtatgcagttcactgcacatacttgaaaatgtactctgctgtattttgtattaatggataaggctactggcttaatataccatccttaacaatagaattgttcacaagtgtgaggatacaacaatgtttcctttgtggcttcacatccagaagaggggtaatttattgtgtgggtgttttaaagtttttactaagacctctgtggctagagttaaaccaggatacttaaactgcagcctggagtcaggagggaaactatgcaccaagagatatgaatttccttagccaagatggtgatggtgctcgtcaacaaaacatgtgtttatccaataaaacagtaggaaaaatggatcagagaaagctgaataatgctaggtcgcagctctggataaaggaaatatgcgaactcagccaggtcaggttcagaatccaatcccactctgcctaggcttttcataaactctccacttgctggggggaaatcaacattcatgaccagctctcataaaaataaaagaagaactagaatattgcaagtgtatgttgtaaaaatctactgctaacaatgaacgctatgaacaatcacctacttagaaaagtcattcacctccactaatttttatcttttttccttttagtgttttattggactttacacacatatgccaagaaaaatcaaaattcattatataaagtgatgttaccaagataatagtgaaaaagctgtccaata

SEQ ID NO: 61597 - DNA, 1263 bp, Bovine  19866880460799
ttaaatcttctgtagaatttgtaagggatagataaggttacacatacatgaattatatagagcattgcaataaaatttttctgtatggcaaaataatctactaccatgagttggtgattgactttaactcagggaaaagtgtttctcatataaaaatatatatgtcaaaagcctcccagaatttattttaccaagatcattacataaaaacaaaaaagggcatatgtccagatatctgcttatgaattttgtttgaagttcagagtttcatgccctaaactccttctgacttttggttatacgcccaatatgcaaatctatgtatgatacaatttgactgtacacagatcataaaaaatacccagattttcacatacatataacacattctctgacaccttcatttacaacaatgacaacagaaaaaaaatccattttaattctcattgtcttcctctgtgtatcagttgaagaaatgttgacacttaaagccagattgcataaagcagaagtgataggaaaagatatatgcaaaacagatcactgaaatttggccatacaagtatagttatagatggaaaaactgaggctcagtgaagttcaatgccttgctggagatcaaagtttctaagtgacagcctgaatttataagacatcggtctactactctttcaaggtttttagaaccaactgcattgcctctatcacagctaaatgttcagctttttccaggaagtcactgaatttcctgtccatgactacagttatgggtcactcacaggcttccttaagaaactttctctgagccaatttaaaaaaaaagttcatgaaatgtttctcagtatattttaagttctttatcttacacttagaaaagcaagataggccattttactgacagctagatatctctttgattctttttttaggtaaacatttctctgattcttttctaaatctctgaaaccaaaccttagagatcagagcagacagtaacagggctgactcctcgtctgcttccctatgcctaacgttcaagcaacgttggctaaatcacttcgtaatcttactcgtgaagtagttatgccagaattaataatataaatattttaagcagctaaatagatagatttttattttcttgattcctacccttagaaaaaggattagatgagttttatggtcagttggctctcccatcaagaaagcaatggtgtcaaatttgaaatgtgaaatggctgatgatctttaagaaagattcta

SEQ ID NO: 61598 - DNA, 764 bp, Bovine  19866880475301
ccagtgagtcagctctttgcatcaggtggtcaaagaattagagcttcagcttcagcatcagtccttccaatgaatattcagggttgatttcctttaggatggactggtttgatctccttgctgtccacgggactctcaagaatcttctccagtatcacagttcgaaagtgtcgattctttggcattcagtgttcttacagcccgtctctcacatccatacacaactactgtgaaaaccatagctttgactatccagactacacgggcctttgttggtaaagtgacatctctgctgttttaatatgctgtctagaagttcggaattctggccagttattagcttgaaactcaccatgcctcaccaagtatctctcagaggaggacttccttaccagaaattttgttaacaatgttgaattaacataaaggagacattcattatcaaaaaatgttttgtactaaccaaaacaatgtaactagaggcaattgcttgtatttagaaggttgctgatttgaaattgatactttttctttggctgcaagccaaaactgtgcatctccagaagacagacttgtacttcactgcttttgtgacaagttggaaatttgacctttttatataatatgtgtttagctcttccctgactgctcctgctaattactattttgccaattcttttctggcatttaggtttgtcactgaatattaaaagcaccaatgatgatatcaaatcatttttttcttacatcactgtttctcccat

SEQ ID NO: 61599 - DNA, 1881 bp, Bovine  19866880477194
gaaaatctgggaaactgtgacaaccaagaaagcctaaatagacatgattactaaatgtcaagatgggattctggaagagagaaacgacattaggaaaaaactagaggatctgaatgaagtatgaactaattattattagttaataataatgtgtcaatattggttcattaattgtgacaaatgtaccatactaatgcaagatgttaataaactgggaatggaaatatacaggaactgcgtactatctttgcagtgattttgtaagtttaaaactttaaaaacactttttaagattacaggtttttttcttcttaaaaaaaaaataaaagcaaaaacaaacaaaaaaatcccctattgtgttctgtaacctcactccactcagaaatagaaaagaaaaaagtgattaaaaagggggaaaatatcactatttggggagattaattggggaaactatttggtaaaatgtaagttttgctgtttctcttttccttaggaatagataacatgtactaaatgctttatactatacaccatattttgtgctggagactttatattaattacctcacttaagacaaagaattataaaatgattattttctcctttcaatctatatatggaaaaaatccaaatataaaaatcaacaggatttttttggaacctgaaaatatagttgcagtgtacccctgaaagagtagaggtacaagagcagttaagaaccatttagaaagaacatcagtgagggaaattcttgtaccatcagttcgaacagtatattatataacttaattcaaagaattttttttttttttttaaatcacagcaaaattagccaagtaatgtcacagctgtttctttgccctcaggcacaacagccatcctttggttgagaatcagagacagacaacctcatcttcaacaataacacatagacacatgattcctcctttacgaaatttaagacagaaggtttcgtcaatcatctcaaatgtgaagtactccataaagatcatgcactgccttgctatgaataatttaacggcccagtattaacccgctgactgaaatgttcacagaaaaatcaagggaaaaatggaaaaaaaaaaaaaaaaggaggaagaaaaggaagcagtccatgtgttctttgttgaaacaggtagatggttccgtcaagttataacacatgaatcaatctagtgattaaccttgactgattttctcactgcctatcctggcattttggagaacaagaaaagaaaaaaaaccaaaaactaaaaaatccttcacagtagcaaggaatgaaagatagtttatccttaggacaaaccaatagctaagttagatttttagctaaaataaaataaaaatatccttttctaatttcaagacatgaagatggaaggaaaataataaatgacacagttaaactagaacaactcacaggagagcttgacatggcctgttcatagagaaatggtggcacacctgtcagttagctaaagttagacccaaacaggaatagcagaggcccgggaatttactgacagtaccttcagggatggcctcgcactgaggcagaatctatggtgtgtcagcagaattgcctccattctgcaaacagagaaggaagggaggcgagatgaagagtgagagatgagcaggctccctcactacttccttctgacttgtctgttttagaatcttgttgaaataagttaaaaaaagaaaagcccatacaggaatattttaggatctaaatcttgacaatatttactaacaacttttagagcacacagttgaataatttctcagtgtaattaatatgggttatgctattataccaccaatccatcctttatatgcaacagaccattttggat

SEQ ID NO: 61600 - DNA, 2076 bp, Bovine  19866880545638
ctgtaatcagaattttgcaaatgaagaggtcgtttctcaaagcccctgaaatgtaatatatagcaggaaaaccaagaaaaaaaaaagtgaataaagtaacatatcaaaaccaaaatacagtagcaacttcaacagctatttcttaggaaaaaaaagaaaaaaaaccagcatttactttagaagatcaaaagactagcttagaatagtaatcaggctatcaaaaaaaaaaaaaaacataaaggcgcacaatgtaactcccaaattcatgaaacactgtgctcaagaatgcatgtatttattctttactgtgaagaatcctagaatgtagattcaaatagacagatccaaatggtattttgacacataacatcagggctaaatgtgccctagtttacttcagttcctgctttactcacactagatttaatgtaggatccaaaaaactgctgaaaattctaacttgaaacaaagtgaaacgtcctaacgaatctagttgtctatcatctggctctgtgtttatcccatttgcaaaatcaacagggaagttttgtgaaaggagaattgagccaagaatcagaagacttcaacttttattgtaaaatctaccatctttgggctgtgtgtccttgggcaagttgtagaaacactatgagctgtgttttttaagaccctgcccagcctacatcagaggagttgtggtgttgttaggattaaatgagataaggttactaaaggctttgaaatatacaaagctggactcaagtgtagcacactgccacagcttgccaggtggcgccagtagtaaagaactcacctgccaatgcaggagacttaagaggttggatctctggatcaggaagatcccctggaggagggcatggcaattcagtccactattctcgcctggagaaccctatggacaaaggagcctggaggactgtctatagcgtcacacaaagttggacatgactgaagcgatgcacgcacgcatggtatagtgctaaacagggctaagttgtgacatcaacttcctaagccggagggtagtgatattctggaactggctctctcacaaaagagccttgtacatctcatgactttttcacatggccccagggaagacaaggaagcccagatggtggcagtttgctaactgaaacccaacctaaggattttgtaagagcaaatgttgatgttaaaacaaagcgtgggctacctagagaggtagtgaggagacttccagagaccacgtgatttattttctaaggtttactacataaatttctatttcctcttatctgcttcagattgaacaaaaatagatggcatttctgttctccaaagaagaataattaagcctttgtattgtgtttatccagttcttagaagaaaggtcttctttcacaaacttcgaatgtcaatatgcaaaatacaaccattttgattacatctgttaaaatcaaagtacccttcacatgcaaccaactccagtatttttgcctggaaaatctcatggacagagaagactggcaggctacagtccatggcatcacaaaggagtcagacacaactgaacacacacacgtacatcttagttcacagcattgtctaagccaaacgtttataaatttatagttctcccaagggtgatcttacctatagatttgaatgaagagcaagcttccttgtatgacttcatcattgcaagggagaaatcagtagagaggaggaaaagatatatgggtcttggaattagaaggtctcagtgggagtctaggtcagggtactcaacagttgttggacctgcttggaagtttcctgatttgcagaacaaaatactattactactctctcaaggtcacagggtctgtgctctgggagcatttgctgagtaaactagctcatgcttgactacgagtgaagaataattcgtgaatttagcatggcccaatttttgcttctttatcttctgttaaaacaaaaagtattctcagttttttcagattttaaaatagcatatgtctaccatgtaaaatttggaaaatatggacagtataaagaagaaagtaaacctct

SEQ ID NO: 61601 - DNA, 556 bp, Bovine  19866880550815
tttttgaaggaaatacactggaatggtttattaccattcttctctgacagtaataaatcattaaaaaggaaaaaaagaaaagagaaataggcccacctgtgcactcaatatcaattgaggctgattatcagaaactggtactgtttttgtactggcacttgaattcaacaggaattacctttttatataatctgtcaatcctctataactaaagagaacagcctctcccctgtaacacctaagccttgcagacaagccttgcctgctgagttctaagccctctcgtcacccagctccagtcttactggcagccctctactttggaccctggacaacaagtaaagcaatttaagctcagagcagcttggtgatagggcctaatccaagcagtatctctgctttcaaatttctccctacagtcaccatccctatcctctgtctttaattcctggctctcactaaaacacctaataaacttgcattttcatctgacttagacctgcagatcctgttcaaactctcccatcatcctgttcctgtatcaacatgctttaag

SEQ ID NO: 61602 - DNA, 2623 bp, Bovine  19866880554193
tgggcacttgggcagacccaaagccttagaccggtgaggagtatacctaaatatttgtatatttttatttctctgcattctatcaagttttgtttcaagcaagaaataatctgtccctccttcatttttgcacatcacagagctaagtttcccgtgttacaccaatttcaaaatgttcagcaccatttatcccttttttatagttcatataaagacatggctccaagacctcaaataacaaaaagtttatttatgtatttatttttgcatggcatgcactgatgagctagtctgctcagcgagcgtttcacagattagacgcctgagtatggtttcaggcaaggctccctcatgtttctgcgcattggctgataaacacttcaaagtaaaccgctcataaatatgaaatgaaaagccgaggagtcgttatgcacagctttgagatacaaatctctttattcccttctgaagtggggtttgattgacataatgagtcatagagcctgtccagggatacactgccttttcccctttttctctggagacagggagacttgaaagaaatccacttcagaacttggtgatagacagctcacttgaaaaaataataaagttgaatcctatattaaataacttattattttgtgttaatgccgactttgacaaccatgacatatgtcaaagtttcactccacatcctcagaaagacatgattagttacaactctaagaaaaagattgccaaatttcaaaaaagtgctattatcttttttgtcatatatactgttgctctacaggcccttcatttggtaagagaaaaatcactacttcaattaattcagagtagactaaaatcccggaagccaaaaggctacagggagtaatacgggcaactgggaataattattgtggaaaattcatttcataaataaatgtctttcaagaaggagaggctcacatagcagaactttctatgaaaaataggctgaagaacaattcaaagtggagattcagtttattcttgctcacaagtttttaataattatctgcttgcttgaaaaagataaaaatttcagtgaggtcgcacaatttcccattagattatattttgtaaatgtaaatgacttacagaaacccagtggttaatgtaagaagctaagtcaagttgtgtacagggcaataaggagtcgtggagacctgttaaaaaatgggaggaagtacaggtccctttcgatgaggcagctattattcagccagtagatttttgtcattcaagaagacagaattactgttgctaggtattgcaatttttccagaaaaccctgatatctagattttatgggctatttacctatcgataaatgatggtcaaaaatgtaatttcgaaaaagcaatccaatagaagagatgtttggcctgccagtctttcctctctgctttagactttcaggagtgacaatttaaataagttttaagaaatagggacttccctggtggtccagtggttaggactccatgctttcactgtgggccccggttcaatccctggtcagtgaagtaagatcccacaagatgcgtggccaaaaaaataacagaaggagggagagaaaatgaaaactttaaatcagaaaacaatgagagaaaaaggaatcacaagatcctcttgagtggttttaatatctctttccaggatccttgggggtctcttcccgaagtcttttcaaccagagcatttgtgctttcttatttaaataacgattgtgggccagcaaacttctgaaaacagttaattaagaccatctccttgtttgagagtaaagcaatccagttatccaccaccctctcctcaaatatttaattggcttaaggtttctgactccattaagtttcagggtcagatcaactctaatcttctgccttagaaactcatcttgagtgtcagagataattaactgtccaccaaaattagtgtctccctttccatggtacaaaactgccatagagagtggttttccagccaggacctgtcattcagtctccattgcatctaggtgagcccatgtatctagctctcatcaacctagtgaagcagaagtgatggggccatttaaaaaccagagaccttaaaaggcaaatgatcctttcccaggttcttttccccttatgatatgagtgatatgtgtgaagatggactcaagatggcagtgccactagatgaaagaagccttgttcccagagttgcacctggagggaaggaacctaggcatcagtattactgatttctgacttcacaggaatgagccattaatcctgactgaggtgggtccttcatatactttagatttccttgttccattaactagatttatctaaaataatgcagttaatattgaattgtttgaaactgtattaatagtaaatatacacaactaaatgatccaaaaaagaaacactgggttcttattgagaacttgctaatgccaataactaccattttcagatctatttatattaagtaatggaggaccaaggaaatgacatgacccaccaaagaatataaaactggtccatgtaaaagcagtattcaaacccagatgttggcagttccaaataagttctcacca

SEQ ID NO: 61603 - DNA, 2001 bp, Bovine  19866880571205
agattccatggcagaataattcaaagttatgtgatcacattgtttttttggaattacacagacctctttttaatttcagaatatacatatttgagttatttctgggtggttcagagatctagactacattgtaatttttgcaaatataccaatttaataggagttttttcagtaatagggcaataactaatgtgcattacattttattccagaatgtttcttagagcttatcttactattttttgaattatgttaatattcatattatattttcactttaggagctacagataaatatggaaataaatatagacttatttaatcaggaaaaaaattaatttggtaaaaaaagaaattctttaaatagcttcaacttcccttctcattagaagctcaaaaatttaagaacatcaaccaaaagcacgaaagaagaagaatccctggaagttgtaatagcatacacagaaagagtctaaacattaggctgaatctcaacctgccactgttaccttctcttaattttaaagccttatttggtagttttcactataatagtgccgaagaaaatacactatactcagtagccattaaaaatgtccattcaagttctaaaccagaggagagaatgctcacagtttctggaacatggccacaatatctaatttgtagtaaaactgatgtgaaaccaattaatggcttataaattcacttgacaggcaaagaatatgagttacctgctgttaataagtttggttaacgaggggaaataaaaactaatcttatgcctattgttccatatttactcagtatttattaccaaaattcaattaatcttttggaaaatgaaaaaaacaatgtatttttttttctcttggcagagcacaagaaaacagaacttgaatcatctcaatgctatatttttagaaagtctaataaattctagatttacctgaaaacattaaggcattaattggtattgattctgtttattgacaatctaactcgagattcactatttacccaaaggaagaaactataaacttcgagactgggaagtagttgtcaaggatcatagtccatcaacccccttgacatttgctgaatataaaatttcattttctcccctcctttacaaatatttgtcaaaggtgctgaggaaatgaggggaaaaaggagtatttaaaagttaaccagaatagaaaggaaaagatgcttttcacttatgaaaagcagcaccaataattattcaatgaatttggaaatcaactccagcagagaagtgtatgagattcctgctgatgttggtcacctaagaaataatgatttattgctgtttggtatatgcttacctatgtgaatacaattttccactgtggaatcaaaataaaataagtgttccaactgcttgcaaggtttcgttaaagagacgaagagaaacaaattgtgcactaatgagtatctttagacaagctgattcactctgtaacagtgaagtgtacaaccagcacaagaaaaatacgcagtggagttgctttagccggtttgtatgttttaagtacagagaagaaatgataaaggctgaatctaaatgataatttagggtgatattagatagcattgcttttcaatctctagttgtgtcatgctgcaaaactcaaatgtttatgtaaatatagtgagcccacgccagtgatgtgctgttttatgggtgtaaagcactcactgtgtttttccagattgggaatgtcacctaaaaatatctgtggtggcaagtgggtaactgaacagggttaaagtttatatgcaggacagcttctattgcattagaatttaacttctatgtatttcctctcatccaagccattattttttctcaagcattgctatatactcaaagtttcagtttatagaaagcactgaaacatcaaaaaaaaaaaaaaattcccagaatcatttgctttagtgtaaagtagtaaggttctcatgtaaatacataaatat

SEQ ID NO: 61604 - DNA, 1646 bp, Bovine  19866880575893
agaccaaattaactgcaaagatcctatcgagcctgatcttcctgcatcactgtatcacctgagcatggtcacccaaggctggattaggtgacaaggctgcctggctcagagttctgatactgttggctctgaagttggctcttcaaatcccttctaataagctatagagcaagttttatttgaaaaaaaaaattctattaggagaataaaaggcattaaaactagtaatggctatttattgagtgtttactatgtactaggaactgtggcatgccttgggcttatagtgtttcccattgttacactggagacttccctgatagtgcatgttggggagagaagagagggaagaagtattcatgtttcagggagagtgccgatgggagatttgaatgtgctcatagtcaggcaagccatttcccctccccgctcacatatgtgtgtctccatacacttaatatgtccaggtctgatacatattcacgtgattatgctctgggtatcactgtaagcattaagctttcatacttacttgtcacagtatagggctgcatgcaaaaaaccatgccttctctatgttagagccagcttaagggattttccagggatgattgtttctatatacgattcctattttatctcatttttgagtattgaactagggaagttgcaatgctcctataaggcactagcttacataatcctcaggacaaccttttagaatgagtgtttataccctcttttgttactttacaaaagagaaaatcagaaagcttaagaaattggctgattacctagctttcaaatgagcgaattggggttctgactcaggtctgttggaatctacaacctaggtaactgcttcttttttttttttttttaaaaaaaaacaaaaggtactgccaagtttgtgttattttaaaaggattactaaaaagcttttaaaaatgacatgttctattgaagaaaattttttgaaaaaaagagggaggagtggttgattccgcattttctggagggtgagcagagtccagcctctagagagttctatgcctctacaccttagtttctcttccaccaccaggcaaatgacaaaaaaagaagccaaagttacagatgaaaacactcaaaactaattaacttactagaacaaaaactaatttttcagcgatttttatgccacttgtcaaaatctggaataccagagttctggtaggaagatttgtccccacatctaaatctggaaagttggggtcttcttagaaaaaagatttgtgattaggttttaaatggattacagaagtctatctatagttctgaatatggtgcaacttgtgaataactgtataactccagatcagagatcagtggctttgattgaaatgcactgattcagcttgcagagaagctacatttttcggttaaacattttagccttttattcagaacattttatactcctttttttaaaaaattaaagacttcttgttttataatcatgccccaaatgttatataaattatgagacactaacgaccaatgattctcagcaaatgtaattcgttgagttctaatttgagtcattccatgcatctggccctctccctaagtatccttgctctcaaccaaggtcctctggacagaat

SEQ ID NO: 61605 - DNA, 1033 bp, Bovine  19866880610501
ctctttggaaagtacttttatgaattatcctatttctgtaaaatacttgaatgactatgggtttttcttctcatctgggcctcctcatgttctggagcctctgagggtagctcagttgtcttcggcacacagtcctacctgtgggtgtaagtgtccggaacactgattagttttctcgcttccccttctgctgcttcactggaataaccaaactgcactcctggcttgtattctggactgtcacgcttttccttcctcacatgcatcctgaatctcagatttaagctgctaagtaggatactggcagctggtaaaaggacagaattcagcccctagaaaatgatgatgttaggatcattgtgcttcccaaatgaaactcaacaggaaaatagaaaattgtagaatatgcaatctggcaattgtatctcatatccctatttggcatgaatatcagtcagggtttggttataagtaacagaaactaagtccggctgacttaagctaattaaaaaaaaaaaaatctaagtacaagacaaactaagcaatcaagcctctgaaaagacagtaatggggcaactctgagtagcaaaatttaggaatcaaaggagaatctcttcatggttctatggttgagatggagccctgccaacattttcctgcccacacatcatttaaaaagattcagatgcccaaaggagaggtcggctggcccactgagttcaggtgtctactctatgaccagagaacaagacaccttgaatgaatatcacacaaagacaatacatgttgggcaaagtgtagtttttcaaaggaaaattgaaatgctgtttccaaaagaagggggaatggatactgggcaggcaaaaacaacagatgtccattgcagcaggtctatttggtatatctttgatgagccaaaagaccagaaactatgcaaggatacaagcatctctctctcacacacacacacaattctggggtcagttcctagagaaagcccatctcatttgattcactttattcccctttgatt

SEQ ID NO: 61606 - DNA, 1466 bp, Bovine  19866880612706
tccgtatactcaagacaaatgtcaccgcaaggttcctgtttgcttgtccagtctgaaaagctctgcctgtagcctgccagcactgctgggggttaaacatgtgggaccacacccaggcgctggtttcctctcacactggctgccctccactactatccacgtggtgacaaggattcagtcagttctctctgtggtgagtttttactgccaaccaccttgggatactcacacattccaaatgctagtcccatccttctgtttgctcagacaagtaaatttgtcacttgaaacgatcttttaattgtttcttttcctctggcttctttccagggctttgtagcaaatgttaaatgctgtttaaaaaatgttttttcttctggtggaagaggttagcatgcatgttggttaactgttgcattttgaacttcccacttggtaactgacagcctgtaattaagcagaacttgaactctgaccatgtctacatgtagttttgtagcctgtcatcaaatcactgtagaatattttctgtgaaaatggcagaaaatgcaatgctctctggctgagcagtatcttatcatggtgaggttaacacattctctgatgggttggagacctgggaattttcttaccatgtgaggaacatgttgatttcttcttgaaaacatagttttctatataatacatcaatgatatatttcccttagggacacagaagctcaaatcaggtaagagaaggtgaagggagggcatttattgaaatatttaatatgtgccaggcttcgggatatgtttttcctgactgcaggatggggcgttttacctcttacctgttcagtgctgacactcctgattgagggcttgtgaattaacaccttggtaacagcatacggctcagatttggggattcatctcagacaccactggggctcctcctggtcacctgccttagctgtgtcaaagaactgggacctgagaacccagaaccagacacaagggtacgagggcaagtgtgcatgcttagtcactcatgagtcagtcatgtctgactctttgccaccccatggactgtagcccaccaggttcctctgtccaaggaattttccaggcaagaatactagagtgagttgccatttcttactccaggtaatcttcccaacccaggaattgaacccacagctcttgcatctcaagtattggcaggcagattctttaccactgatgccacctaggaatcccactctagatgtgggggaggcttactaacaagccagctgcttccttaggggactccatcttagttattaagacactccagaggagcatggatcagcagcagttcagagttctgaaccagtagagaaataaaaagaggatgaagaagatgaggtgaaattttactgtgttgactaatgacacttatattcataatcaaaaatggaaaaacatgctctgctagaattcgg

SEQ ID NO: 61607 - DNA, 2275 bp, Bovine  19866880619202
cggatgagtgtgtctgcctgttttcctacacattaaccatgttgagtatttacagtttttaaaaatgttcctcatctaatgagtcagaaatggttttggttataattttcatttatctgattcctagagtagctgggctcctttcatggcagtttggtttgccattagttttgctattcacgttatcttcatgaattggcagtctatttcctattgggtgtgctgcctttttacgatcaatttgtaggatatctttgtagtgggatatgttaactctttgtctccttaattctttgtatattcaaagtacgttcttccagttgtcgtttgtttggactttgttttaaaaatcatttagcaggagaggtggttaaaaatactgagggtgtttccttagaaacatccccggtttgggaaccgtgcctgcccagtgtattgatgtacacatttgtgaatcatatgcatcgttcctatttgggtcagtgtgcacaacttgagtaaatgccgtccatcctatttataggcatccgcttgaggaattcccacaacaaagcttttagcatccgtcctgcaggctgtcccccttacagcttgtgcggcacatcaacgcaggagacaagcacagggatcagaggccgggcggcccaagtgtgtggttatcaggcacttgtgagaaaatgagcttccaccagaaaacgtgagaggatcagctccactgtgccataggcatcaactcatttacccccttccacagagacttgagctcccaagttaaattttaggcttgagttatctgttgtgatagtttgtattgattaagtgatcagctgcacacaggcgcagccccacgcacccacctggcgtaccattcctctccctcccgtggtgaagctgagcgaacagacagaaacattctttcttgcactggggactcctttgtgcctctccacttttatttcctttctaacccattcattatttttccttattactggacctctctacttatttttgataattcgaagtataaaaatatttacttttcaaaacaaatcagtgtctacaaacttaacagacttcttgccaagtacactttttctttggaatgaagtgttaaaaaatataaaataatacataagaaaaagaatttttaagctaaataatatttaagcaatgggtttctgtatctagtttgtactcctcaatgataatataatgaagtggtgtggtcccaggtttatagagataattttttaaatctccaaatccctgaaagcttctttggccttggggttgttgaacttgctttttattcatctctgcatgtcaattcatgcacatgaagtccctccccgcccctccgccccccgtcacgggagatgaacaaccctgtgatatatatgtttcctaattaaagcttaaatctggttcccagcaattgagcttctgaaatgttggaaccacagagtgaaatatttttaactctttccattcatcacactggtttctaggttgctggtaatgtcagccagaaaaaatatctgaattaggagcattttttcagagacttctagatttcttaaatggataagctagtattaaagatatcactggaagttatcccaaaatataattgaatttttttattggttttagtgtacagttcttatttgttcagttcagttatgaatcataggaagtgaagaacgtggcataggttggtgtcagaacagcaatgaaattttacaaaggaatttgatcttttaggaaatcaacccctttgctgtccatttggtattttaatgaatagcttcttggatatttgaacttggcgtggcagtgctaggtaagaacatatggagtgttactttttggcaactaattcattatttcgaaaaatgaataaaaatctccttcttggatacctaatagagtttgctcttctactactttatgactatttaggcaaacctctatttcattaaaattaatagctcctcctttaatctgtccttccctaaaagaagtattacatttgttttaaatagaaacaaacgttttgattctattccttaactctttttcctttttgtgtcacacaaattttatgaaactagggctattgttttaacatgacaaccacacgaaggccatagtttttttggatgaatgattttaaaatgatacaatagcaaattataaaccaaatgttaaacttagcactgccctgggtgttttgcagaggactttataaaacattataccatttgttcct

SEQ ID NO: 61608 - DNA, 614 bp, Bovine  19866880630549
ttttcacctggggcaactctgtataaatccaagtcctgataggaaatatcccttaaatatagtgtgatgatttttcgcagtaatactagttcaaatatagtcagaatttcatgaccatagataatgcacttagaaccaggaagcaattcttttgttcctgcatttgacagaccatgaaagtggttctgaagtcagagttcaagtttaggtaatagatggttatttcaaaacttacagatagaatgtgttccttttctctgctttaattttctcagtattttacatattccaatgatatagataattcaggctctgttcctcttggggactagaaataaaaataagaaattgtccacattacctcataaattccttaaccaaataaaaagtgaggtgtgagctaccctgcagactgaggtgttacttcagtcaacttcttgctctttctttttgacaaattctttttagctcacacacacaaaaaatcaatgcgttttcacctgactaattttttgaagtttgggaatgtattatcatatagattgacagttgccccactggttccatgccacagcatggacacttacaaagccatcattaatttctcacactcg

SEQ ID NO: 61609 - DNA, 1048 bp, Bovine  19866880686227
aattcttggtattaggtacatgtaagttacagtcagagaagctaagaaattgatgagttgtagataatctctgttgctgtgtttgaagacagttcatgggtgaattctgaaatggagtcctctgttgaatagatacttactttggtagcctcagtattattgatccattgaagataaagaggaaaatgttctgatccatatgctaagaatttgctttctggggaaggtagacattctcaggcttcctaatttttcattacaattgtgaagcctgcctaggaagacagaaatgtaaattattaaagaaactgagtttttgagccttgaagcagaatttgcagtactctgcaaattttacaacatcttgtttgaaaatacacatttcccccatcatgttcagaaacagaatgaaagataattcactcaggagtgagaaaagttagccatgacactaaaactcaactgaatgttttaaagtataggttgggttttagacacttcctttaagaatcagagatttgtaatttgaacagctggcctgctgtttgctattatgtcagtcctaaaataatctgtgggaaaatttaatgttgttattaatattttaaatcttttggtatagataagctggtataataatgcttaagttttaaaatcatacatgattttttttcttaaaacatcctattttgtgttatgacatgaatcaaaacttttttaaagaaaagaataaagcttggtatatagtgtgggagaataagcattttgctttcttcttccctagatcacacactaactagtaggtaaaggtgagggttttaggacaattcaggctagaaatacattctcttgaccatttttctaactgtaaaatattgaccaactacttaatatcttcaaattatagtttttcaacctgtaaagtgggaattataatagaaaccatcttttgagcttgttataatgatttaatcaggaaatagattgtaaatggagtagtgtcggaaaagaaaataaatacatcggatgttcatttattctagcatct

SEQ ID NO: 61610 - DNA, 1263 bp, Bovine  19866880701031
ctctctagcctaacaagtgaattgtatccctattttttaaacagataaaccaaagagaaatgttaatgatatgcccaagagcagctttatataatcaagactgagctactgccttccaattctatctctagtcttagttttctggagccaagttaacaaggaaaaggttttcaggtaacctagactgccgcttttataagtgcttgttatagctgtagcgaaataaaaagaagtgctgagtgggaggaacacattatcacccataaaaatgagtaagaaaggaatcattttaggcctgcacattggataggaaagtgaaaagccccatcagaagtgcagttccagaaatttgctaattttcaggccatcacagagaaagggagttctcactcaaaggcaagatctggtttgaggtagctgcctcgggggtctctgcatctttagtggttttgaaactggctcagtaattccatttcaaagaatttatcctgcagaaatacacagacaaaagtgaaaagatgcatccaggggggtgtttaccgcagttttacttgcactggtgaataactggaagcacaccaacacagactgttaaaagtttggagtggaatactacatagtcatcaaaaactcaaccgtttttatgaaagtatgcctaattactacgtaaaaaagcaagttgcagaaccataatacataaaaatttagtatatgaacaagaaataaagtttcaaagaatatataataaaacattgataagaggacattcctggtgttccagtgactaagactccatgttaccaatgcaggaggcccaggtttgatcactggtcagaaactagattgcacctggcacaactaagagcctgcacgccacaacggaagatccatgtgagctatagtgaaggcccagtgcagccagataaatagataaatactcaaaatacgataagagctatctctgagttagacagaattacaggtaattctcatattcaaaattgtacacttttgtactaatttaacaattatgtattatattgaacattagaaacaaaaaggattttgtaaaggaccctgaaaaattatagttctagcctatttattccaaactcatttctttttttttttttttccggatgagcaatctggggtcgaggaattgactggcctgattccacaagcgaattaattgttcagaaagccacagaaattgtcaaggcccactgtaaacttcaaaagagcaaaaacctgcctggctgt

SEQ ID NO: 61611 - DNA, 1517 bp, Bovine  19866880766310
tttctgttgaggagggtgcagctaccagcaaagaaaacactcaccatgattcaaccacggttcagttcagaagcgcagaaggcaaaggaagcaattttgacaaagaatagcaagagctatccatacaaatgtagaacaaaaacacacacaaaaaagcataaaaggtattgataattaatttcaaataccatatggaaaccgtagctaaagagagggagagaagaaagcccaacaaagacaaatggaactgccgaggccatgaaagcaaatgccccaacacttcgggctgcaattgcaacgcccaagttttttcctgtaattatggttctacttatcccatcttagattcatagaaaaatctgagtggataggggactatttcatgctgggaatacaaaagtaagtttgaacaaattgcccatttgtgattatttaaataaaacatcataattggaatatgttggtcgataaaggcaattttttttccttctttctcttttgtataagaacaatagactaaatgctatcctgattttttttactgcatttctgtaaatacagtatttaatgccaggtgccccctcaattttacattgtgatgggctacagaaaaggaggagtaaatgcactctgagttgttttccacaccacttgggctctgacaaatcattcacaacattctctgcaaggctattgtcttctatcatcattctcggcagcctgactcagtggtgctccagttaaaggggggttcacttttaccacatttattctaataatggttccttttaccacatttattccaatggatggttcccttatacagttctatttgccatcactgttttcacagaccctttcgaagtatatctgtcaaatagaagtaagtactcctttctcttttatgtccagtaaaatatattctcttttgctcccagcaaagaaaaagatagttttttattatcttgagataacagaacttcctgcatcaaaaaataaatgtttcttagatatggctaacaagatttagataccccatgtcatcaattctgtaggcacacatagtcaggtcttgaggttaaagggcctggtcttatttccccaggcaccatctatcaagcttttgatcttcaaagagtttctagttgattggacttttcagcttttatatatacatttttgaaatagtttcttatttcaacaggcatttaagcagtactgaacaagttattctttcataacatccttcaatagataagaaataaaaagtatgatttaaaggtctacattgaacaaagtttgggtctacaaactttggagaaaatctgaagatgtatacctgtggcggattcatttggatatttggcaaaactaatacaattatgtaaagtttaaaaataaaataaaattaaaaaaaaagaagaatgaaacatcacctctgccttcaaaattaaggggaagacataagatacagacctatgagtgttaccttaaaaagcagctaggatcccagatgc

SEQ ID NO: 61612 - DNA, 949 bp, Bovine  19866880877271
aaattaaaatcatattggctatatcacaaaatccaaatgaatggctgaagagaaggataggagctagagaagttcagaaatctaggtaagaaactagtagagggtatgactggtatctgattggtgaaatttgattaaaatctgtccccttctccccccattgataggggaagtgagatacttccattcaaccaatatcatctctgttgaaggacaaagtgttcatcaattacaaaattctagatgctgatatagttttgacctactctaaagctttatgtatataaacacacatgtacatatcacctgtacatgcatatgtagacatccatggtcacaacattgcgattaccaaattttcttctggtattccagcgcaagaactccctgcctgtctcaggatgattataggtgttgagcagcatgttgaaactgtgtgccacgtcagacattgttaaagtgcatagtgtccattagcctgagtggaagtctgccttccagagggagaaaattctcctttgattccctgcagctagcagccataaaaatatggctgcagtgttaccctttaagatgccttttcagattatttgatatttattctttaaaagagccttaaataatagcctggaccctgctgagttcaccacagaactgtcagagacttgtatttattggacaaacagtagttacttagaacgcagagtcctagaggaaaagccagctacataaacatctcctacccccaaatatctgcttcagtgatgggcccaaactgaaattgttattgagtattattacagtagaaaatgattgtttatttgtaatgggaagatacagttcattatttaagaaagaacccaccttcttcacgataaatttggggcattcctcatacgtacccctgaagactctatttcctttttcttcattagaaaataaaatgagt

SEQ ID NO: 61613 - DNA, 1707 bp, Bovine  19866880895976
ctatagcgcacatgagagtggatgtgagattgttgggaacacctatctgggctccccccgtcggcgtgtttaggctcacaacgaaaacaggcagattgattttccctgattaaggctgcttcagtctggtctgatgagtaaatacccaaagcagccacatgcttagctgccctccctctgcaattaccttttttttcccctacacttcaaatttgcaggtctaaatttgtaattcttcacttgtcagagtaagcaaacctatcagtcacttgatcttgtaattcccccccaccccgcccttctaagagggacattcactccctcatttttcatttattcaagtatgtttactgaatacctagtacaaagctccaggccaggtaggctttgcagatgcaaaaataaaatatcatctcagtcttcaaagtgctcttctgtgcccgaggtacagagaagagggggcagtcaggatatgctggccaaatgctataaatagtcctacatacagggcgctatgtgatcacacattggaaagccttaatgctgcctggtgcctccgagcatgccttccagagcaaggcatttttaaactgaggtgtgaggggatggaatgaactgggagattgggattgacatatatacgctactatgcataaaagagataactaatgagaacttactctagcacagggaactctactcagtgctctgtggtgacctgagtagaaaggaaattcaaaaaacaggggctatgtttatacgtatggctggttcagtgtgctgtacagtagaaactaacaccacattgcaaagcaactataccccagtaacatttttttaaagaagcatgtatgaataactagcttccttctgtcaatagatattaaaaagatttgcaaacatgaaaacaatgccactcttctcactaaattttttaattaaaatcttgtttaaattttaaaaaactataaataaataaactgagatgtgaggaataaggagctattcttcagggggccaaggagggaaaagacactcctagcagaggctgaagaatgtccacatgcttaggaatcagggtaagtgtcatagtcgtccagaagggagtttaggataggagaaggatcgagagggccttgatagtgcagtgtttgaatctgacttggtgactgcatttgtgggagcgtagcgggagacctaaggagtgaatgaacagcaactgaataaaagtcacgtacatctcaaagttaattacaaagataatctaattttatcttggtgatgccatccagccttctcatcctttgttgtttccttttttcctgccttcaattttcctagcatcagggtcttttctgactcaatggacaagagtttgtgtggactgtgggagatggtaaaggacagggaagtctggcgtgctgcagtccatggggtcacaaagaactggacacgactgagcgactgaacaacaacaaaaattttatccagtgaacctatctacagtcttaagtaactggagacaccatgatcggtcagaatttgtaggtaacttgctgattctccccaaaagtatccctttgtcttctcccaggactgagtcaatgatgtcagctaaagaatcatcattaaacccccatagatattaactctttgacaacttcccagccaagcgtttggctgagacagtcatccacgggccacagt

SEQ ID NO: 61614 - DNA, 758 bp, Bovine  19866880946813
tcacttttcccatcaagtacctaattaccaaataggcaagttgtgaaagtgctgagtcctaagaaagcagggacaccaaaacatatctacaaatcagctttaaaaaaaaagaacaaagttgaactttgtaatcaaaggaatttggaaaaactccattttaatttcggcacatacatgaaattatgtgttttatgatttagttgttttttaattacaaatgcaagaggaagtaccaaatattttcaggttttagagccctacaaatgtcttcagctgaccttgttctgcactgaaatggaagcaaagtccctctctgagagtgtccaagtatcccaggctgtgtgctggtccaacagtgtctttgtgacccagaaggtaattagtctgagccctgaaggatgattggattacccttatcggcacatgagcttgcagctcgacagacattattaatggtcataaaattatctgatccctttttaacaccagccttagcatttgtctccctgacctcatgcaggaattattcccacgggctgaccaatgtgctgggcaaagatgaattcctttttattggtttgaaatttattgttcgttaatttcattgatcaaaaggaataaaagatcaaagaaagagtagcccattacatgaagatacaaatcattattactttctttaatatttttgacattagcattaatcactatgaattatggcggggctcctctggacataatgtgcaacttcaaacacattt

SEQ ID NO: 61615 - DNA, 2353 bp, Bovine  19866880946908
taaagctgggaaaggtcatggaatacagcgtcaccaaataaaagagaaatttcattaactatttattaatgtatttgtaaatgagggcagcagttcctttaacaaaactataaatggtagctgtgggtgttctttttcccccagtgacttggtactttttgttctgtgattacaatattctacttccaaaagggatgactcaatcggtaaaacaatgtcttcttacttgcagaataagattgctaacactgaaagaatggatccctgtactctgatgcctgctgtctcttaggtttccaagtgacaaaaagtatttcgtgttcccatgaaagaagaattcagatagctaaaatttatcaagtccttataagcaccaaacattgtgttaagtaccacatgcattaactaatcacacatataccacccaacctatgtgggcagacactgtctttattcatattttatagatatattaaactgacactcaagagagatgaagaaaatttctcaggataatccaggtagcaagtggcagagttggcatttaaacccaactttgtcaaacatccaggataatgtcttgtctgttctgatgtcaataaataggaaataactattgcttataacctttcactttactttgtattattttccatttatccctacccacttttgctatctcattagacctctttatcctcaccaaaggggcttcccaggtggctcagtggtaaagaatccaccagccaatgcaggaagtgcaggagacgcaaatttgatctctgggttgggaagataccctgaagtagtaaatggcaacccacttcagtattcttgtctgagaaatctcatagacagaggagcctgggttgggggcagaggggctgcaatccatgggatcgcaaagagtcggacacaactgaatgatagagcatgcactcatccccactaaagctaccacaagtgttttagaaggtcccaggcttttctaatagggcttctgaaatagtttttacagcaattgcaagccatccggatttcatttttccttttagtttcaatggtgttacaagagggtccccactgccctcactgcagacacctcttgctgccctccttggatccagccactggcttgcagatagatgttcccgttgttctaatgcctcactacacctaaagttgtatctttagaaacattgatcttgacaatttttccaactgatctcttttttcccagctttttccactttttacaattgatccctttttccaactcttttcaacccaatggattgtagccccccaggcttctctgtccttggaattcttcaggtaagaatactggagtgggtagccattcctttctctaggagatcttcccaactcagggatctaatcctggtctcttgtgctgcaggcagattctttattgtctgagccaccagcgaagctccttccctttcctagtttgatctaactgtattagctgttagagtcatgttcttccaactcttcccaatattatcttctcatcttacaagtctcctcaaagacatcttctttgatctcatcatctaaattgtatctgtactcacactcatgttcatttccatcaggtcactaattataatatattacacacatatgtatatatatgtatatacatgccttttaacttaattgtcttttcatctgcttaaatggtaagttccatgaaatggaccctctttcatctaatgcttcagtattcccagggattcacattatgcctggcatgaataaacacttgttgaatgagtgaatgagtgaacttcaccctgggtttgagccccttaagctaggtatgggataatataattgacatataaaggtggctgcatttatcccaagttatagaaaagaaatattagacattatgttttctttttagatgaacattagacatggaattaactttaataactttatataaaaattgctatgatatatccatggggcagagtgggaaacctacataatgggctgttgacagaggtcccccactcctttttcttccttgaacatattgagacatattattgctttttacatatgctttgttaaatggatttgcagaatatattgccaatttttaactaaacagattcttacagagaaactgcagattgatgatagcaaaacactaatgatagaaacataagtgagcaattgaaaatgaaagaactgacacttcctgttttagaatatcatcttcaaaagccgcaaaatgaggtaaaatacaaacacgccagtaagaccatctaatcacatttgactgaaaagttggtgcccacaaatgaatttatcaaga

SEQ ID NO: 61616 - DNA, 1404 bp, Bovine  19866880947947
cataatcatcaggctattgtcagtttatccatttaagagtttagatcctgaggcttagggaagggcgatttttcctaaggccacttacttagctgtggtgatgcctggactcacaaccagactagagttttacatccaaagccctagctcttgactactcttaatattaagtctgcctccaagatgggaaagtggtggtttcagagcagaagctattaatattttgaccttccttttgttaaaataaatttacgtatttattttctattgtgctgggtctttgttgctgtgccagggctctctctagttgtagtactctggcttctcattgtggtggcttctcttatgttgaagcctggatttctaggcacacaggcttcaggagttgcattgcgtgggcttagttgtcccacagcatgtgggatcttccaagacaaggaattgaattcacgtcccctccgttggcagacggatccttaaacaccgggaccaccagggaagtccctgacctttcattttaatttttgctgctcgtaagagaaatccctaggaaagtctctttttatttcctgtaagaccttatctctcaaaaagtaaattggatacattcttggatttgaccaaaaatctagagcagggtctaaagatacatgattcttctcctgaccacattccttgccccaatctctgtatacaaaacatgccttaaatattcatgttaactctggaaatagatttccttctggctttttgtctgtagtgtgggacccagaattctgaagtgtgaatgtttatagcaggtagcacataacactcgtttgactgtggtacctggaagtatgatctctggactttaccttgaaatgactcttttagcatctatgtactatgcccacgaaacaattgacaaacttgaattttattattaccgtgttattgataccttttaaacccctaaattctgcttcctttctctctgcttcactatggcatctgaattgaataccaaagagaaattattcattcaagcatttcctttgcaataattattttgaatccttaaatcctgacccatacctgttgggggtcccaggtgggctaggctaccagtgtggatagttggaaggctcctctgggtactagtctttccatcacagcttatattgtctttgtaaaaatgaacaaactctgtggaatggaggaagcaaagatgattattatgaccaatagcatgttggaaccttttttttttttggtttgtgtacatcatacttgtctgcataagttaatgaataaaatgtgaagacttcctacttatcattttaatacagttttgagtttcacaggagagaatttcttatttgggtcaaggtgattttttttttttttttggtgtgtgagtgt

SEQ ID NO: 61617 - DNA, 1527 bp, Bovine  19866880953998
attaagaggaggaaatcaaattttattaagcacttaccaaagatgtgataataatatgaatcctaaggacacgttaggcaattaaagtttatatactggctgagaggagaaggggatgagggcttgaaacttgaaaggggaggaaagcaactgacaggaagatgaaaagagcaaatatttggtaaacaaaatgtttgctggatcagagacagtgggacagaaaagactttgacaaacaggccttgctgagtttcccccagtctaccacacacttcatatgatactttagttctctatggtgatagttctctttttctggaataggccgtttatctaaattgttttaaacagataagggaggacatataatctcctcctaaacttttcgtttcatgaaagcgatcagtacccagaattctgaagctgaagagacacattttggagtggctagttttgttttccttcagtcgcatcaacattttgtaatgtcaattgatgactttgctaatacaagtatttcatgataggtttcttgtttctgacctacatgagcagcggaataaagcagatttaatttacacaatggggatgaagagaaattacgtgaagaaatgttttggattttttggtaagactgtcagaatctcaatgaaaaggttattaattcatataatttggtttcttaatgactaccttttatatatgtttatttgtatcattaggtgatactcatatgcacatgattcaacagttgtagaattcactggcaaaaggaaatatggtaatcctcatgcctcaggtatcaaagtatctaattgaaatgcactaggaggaaaagtcaagtttattacccttgcctacaacttgcagtgtgacattttgctttatagcatttggaatctctcacctccaaagaacaatgaacttcaagaacataatacaagtgggaaaattgccttaaaaatgtaattttagaaatgattatctgaaaatactgttaaatgaaaaagtttggtaaaaagatgaaactaatatttcattcatcttctgttgattcatatttaaacccaatgtaaagttcagatgtttaggggaaagaggaaaaaagaaagtgattgaataaaataagtcaggataagtccttaaagtttaactcagatattgttatttgagagtctgtggtgtgtggcttatgatttttttatttgctgttgttgtttctatgggtaaaacatcttttcaaggaaagtaatacaattattaaacctatgatttctttgggggattccattttcatttattatggacaatttacccataaacagcacacaaaaatcaaattctttcatgaaggaggggtaacctaattgagcatatgagcagtggtaatcctaactgttagtctgtgggttgcaggtggttctttcataatacagtgcttacaatagataatagttcttaacagtgccagccactaaggtctttacacacattaaatcattccatccctgcatcaatattaggaaa

SEQ ID NO: 61618 - DNA, 2736 bp, Bovine  19866880971825
tatgtcttacctgtgagatttaagaaagcaaaaagcctaaaagagtcaagttatgccatcaaagaagtgctgcagttttagttggttactcggagttgaagagatgtgaattaatgacagacagatgtgtacctgctttagtctccaacatataaactgcaccttttggtctttgcttcccataataagtcattgatcacagcacacaactattgtttaccaagtataacacgctttgcatgtctttgtttctctccatcagtttttgccacattctttctgagggaagaattatcctgaaaagccaattcccttcccaaggcctggttgccttctattgatagctaatcctgattcaaatgttgaacttaatatccttgtgagtagtagttgctcaatgggtaaagcccacaaactccatcagcggtgccacaggacagaagatcagaggttctggcctcatttaatccagacacaatgggatttgtggagagaaggtgagtagcggggaaaggagagtctaatcttggaagaaatgaataaatagctccaagtctttctaagggaaagattgaattgaacatggcatttgcactttacaaggaagtagatatctaacccaagcaagaataagagtttagggagaattcttggtttaaaaatgaggagatgatcagaatgaggattacaactaacatgcttgcatttattagtgttctaccaacatacacacacaaatcacactcaagtttagggcctcagtacagagctcagcttcataaagaactgactaatgaaaacagagatggattgataaatacagaggggaagagaagtcttcatagtagagtgagtaaatatatttttgaccttaaaatgccgttattggtacagctgagagatgaaagtcaaattccacttcattattgtagccatatgcaggaaacaaggatttatgccaaaaccttatctcttcccaggcagtttggtgaaatgtcacatttgctttgtccaaagtaggccaaggaactgctaatactggaaactctggataatcaacatgtatcaactgcctagaggaacttgggtccagttgtaagcttctagaggccttcagttgactaaggccttagttgatggcttaggcttattgtaccctctttctaaagagtccacactcactgtctactgaagcctcagtaactgcctgttccacgccagagatgaggttattacgagctttcatgctcattgtttgtatagtggattactgttatgtctacatgttgttatctttgataataggtgaacagaagatgcagttaaatgtaaagagttggctgcaatatttcagattcaagctcttcattttctttgttttgtgacactgagtgaggaagctaggttctccaagtctcatggcttgtgatgaagaaggaaaagatgcttagtcattatttggcaatagtaagccctcaaatggtggttattactttaaggttttaaagactatattccctctttccacactatgatattatataattgagcataatgttaaggacttaggtgctctggtcctttttgtattttctgtagaaaacgttttttctttctcctaatatcttccttttgtatatatatgtacatatatatatatacatatatgtatatatgtatatatatgtaccaaatatatagtaccaccaaatatataatatatatattatgtgtatatatatttatattaagtgcccacacagaaaccttgaaggttaatatatagcaatgtattctgtatacgaaagttaatacatagcagtatgttctcttcccacccccaccccgggatgttacagccaaacctgttagtgttgtttccttacaaatcagtgacttaaaacaccatgatggcattctagtccagaggactttaccatgtcaccaataactaaatagtcttaggtatctttttggcctctatggattttgaaataacacaattttatgctaaagtaagatacctattacagtgattacaataatgattacaatgatgataggaggcacaagaatgcctctgttattgtttcatttccttctttttagaaatctatgaagaacagaagcataggggagcttatgtctctatatagttcatttctgtatggtttgtgcagccatttatggcttcttttgcttttctctttaattgattccttattcagcaaatagaagcaagatacaattaaccttgtgaatagttctttagcggggtacatattcagatttgattgggtctcagttgggtcactctcattgacctgaaggtcaaaaaaagagcatgctgactgcttttgggtaagtaatactgaattaaatctcttcagagactagtttaaagcctggaaaagtcttctggcttaaacagagagagataattggtgtgtcttgtggcattgagtgtttgagtgcaaattaatattttggtgtgattctttgctgtatgtttttaaaggattcccaatgaaagtgagtttagtatacacataaggctcacaattttctgttgagaacagttgtgagtagcagttacggcactaattactggacagccaatctttcagcatacaaagatcaggtcatgtttttatgacaccttaaacaagcatctacataagccagggtgtttcaaaagttaaatgccttctgaagacatgtagttaattgaaattt

SEQ ID NO: 61619 - DNA, 1631 bp, Bovine  19866880981729
acattaaaacacacactcaagtctcttcatcttacactcctatctagctaacactacattaatctgctcctcagccgaactttccaggagttttctaaacttgtggtcttcaattcttttcaaagaatactttatttaactcaataccttgcagatgtcagatattcttagtgttaagatcattcccaatatatattactatcccagacatgcatacatgcatactcagtcactcagttgtgtccagctctttgcaccccatggactatagtctgccaggctcctctgtccatgggattattctggaaagaataccagaatgggttgccatttccttctccaggggatcttcccagccccatttcacttgccaaaacccggaaggatatgtggttaccagaggagataagttttgacatgaatcttgaagttgagtttaaaatgtaggcagaaggctgaaagtgaagtccccaggtcagacccatggccttgtctgagtctaaccacagagagagtgaacagaattcttattgtggagttagggtcaggaacacagaaggcagaaaaagaatcagcaaaaaagagatgagatgccagacttcctatgagaagaaacactagcagaaacttaaaagaagtattaatatttgagacattaaatctctaattatgtctaatttccttgtgtctggttctagaaaattcttcttttctaacactttatcttgtagaggtctgactgaattaccctgcaaaaaaaataatatctgtacaatgtgtcttaataaatgctgaaaattatacaaatagcatttccttcactggcagttacaaatcttactttactgtagtttgaaggctataagtacactgagctttaatgaatctttgagttaaattattgatgatcatgaatgctctcacaccgaaagccaacgagagctatacccctgcagtttcatgaacataaattgtgtctgtatattataagtcttttaggagaatcacaatttcctgctgatgagagctgtgggtacaatcgttttgcaacatggtggtcagttttcagtaacccttaggttattagatactaatcagatgcattttctgtttcatgccacttgaggcctttggtaaaaggggaacagaacccaataaatgaatactatatgcatgtagatagtaaaccatataaatgtgcatctcctcagcaattggcattgaagttgtgacaagtcaggctctatccagtgcagttccctgggggtattcaacatttatctggcactggtcactaatatcagtgtggatatgtgtctcattaagagtcatcttaaggaataatacataagggaaataatatataagggatgtcttaaggaatgcctttggttgggaagataccccctgctactgctgctgctaagtcgtttcagttgtgtctgactctgtgcgatcccatagatggcagcccaccaggctcccctgtccctggggttttccagatgggttgccatttccctatcgaatgcatgaaagttaaaagtgaaagtgaagtcgctcagtcgtgtctgactcttcgcaacccccatggactgcagcctaccaggctcctccatccatggggattt

SEQ ID NO: 61620 - DNA, 1427 bp, Bovine  19866881026250
caataatggccttcaactcacagggttgctgtgatagctaaatgaaataatacacactaaagcatttagaacagttactgtgtggtggtaagcactcagtcttaactattttaaaaatagccttgttgaattcttcttaatgcttgcttccctatttttctgtgcaaggaatcattttagaccagtattagtagtttttggtttcctgatgattcttgctgttgttcccgatgatgcctgataccaaatcttcagatactctcagtgcataagtttcacaatgatttttgctaatgcatcctatttttaatctatagatgtcctcaaagaacaaggagtctgcgggtgcacacatatgtacatacacatgctcatcacctatggaacttctaggaaagcagatgttaccttgctgccttaagttaggatgggcatacacatctgtaaagatggtaagctggttgattcagtaagaaagagattcatttattaatctttattaacatttagcagcacagtgaacttaaattcatttttttcttcctttaccataaaaaattccatctgccatttattaatattaaggaatttgattacaacttactcttggtacagatgaatgctaaaaaaaccccatacaatccttcgtaagtactaaaaatgaactaaggagaaaagacatatcaggaaaagaaacagcatgggggtaattctgttaagagtgccttaaaagcctgtattgtactattgccacgtaaaaagggggaggctgctgccaaacacattgctgaaatgagaattgtttaaactacaaagaagcatgacagctccatgtgaacaccttaaaggcccaaggtcacttacaagggagaaccaggtggtgaaaccttggagcgaaaaaaattacagccatatattgactctagttatcctcagttaggagatgtagcttaccattttcaaaaacagagattcttgttctgcatgtggattgatataaaattgcagaaaacagaaagctaagaattttttgttgttgttgttaatatgcctttttctaccctgattacctttctggggctttgtatcagaatgacctctgtatcagaaacattaatattgccagagttaaaataaataaatagtacaaaatcagaatattcataggcttgttccagcggggcccaatatcagggtgtttctatctcttttaaaagccagtgttctaatcacatcagttgtacaggtaagggaaattaaaggttcagaaagttagtgacaaagagaattaaaattctttggtcaactacatactacacagagagccaaaaatggagtagtgattaagagcacaggaacaaattccactgccagtaattactcctttgtttccttgcgaaagttaaccttttttttgccttaacttc

SEQ ID NO: 61621 - DNA, 857 bp, Bovine  19866881097941
ctctatttatgtagagaccagggcaattttaggaaaagggtagtgatgaagaccccccaaatggtccacaaataaataattctagtgatacggatgcatgtggcttgtgcatgcatttcaataaaagtgtctagagggcactgatttgccatgtttctatgggtctgtgtagcaagcaccgcacatgtgtgggtattacttgtggataagcactatttattctacaaataaattactatgtagcttacattgttagggtcacatgatagccctatagtttaaaagactgaaataaccatgcatttatcttgtcactacaggtacttacagtgtaattacaaggtcaacagttactatgtaattacgtagtttcaacattgtggttcttaaaaaaaaaaagtacacgattctcctagtacctgctgagaacccctatctctactccaacatcctcacttgcaaaaaattctaaatagcttcaaacaacattttcaaaggaaaacaaatcaaggaatctttattggaatgatagctaacttagaattagtatacagtggtagcagtcagacccaagatgtattttggttcaatgccctcattttattggaagaatttattttttttaatttcctacagaattgtacctaatttagaaagtaactcaagatagaaagtatggcaaataggtgtttttatttaacagtaacaattttataaatggctgctcatttatatatagtaatgagatgggtttcccatgtggctcagtggtaaagaatctgcctgccaatgcaggagatgtgggtttgattctggggtgggggaagattccatggagaagggaatggcaactcact

SEQ ID NO: 61622 - DNA, 1096 bp, Bovine  19866881114492
atcaaagcccaactggggactggaattattattgtcactgaggggcgatgagctttccctgattcccctacagagggtcgctggaggagaggaagggaacctcgacgcccatctgcacacagtggtaatgaagtgcccttccttctccttgctggtgtttgaggaggataaatgttaaatctagtttcactaccactgggggactcacagagaactcaaaggaggtagccctctccctctcaagcaggttggtatatgcagggtcctagtagggagtctgaaaccccaactctgcaaggaggcattcccaccccactccaccccaattgccccgcttgtcaaagtgagtcaagtgaggaacctgggctttcacttccacctgccagttaagcctcagggtcccattgttcccaaaggcttggtgtcagaggaggcctactgaaacaatatttaaataagatccatatttttgaaacaatacttccaatagccaggatacaataaaaaatcattcatcataccaagaatcaggaaaatctcaatgtgaatgaggaaaaataattattaataagaaattaactagaggccatttggaagattaaagaatctaaatatttttgtttttgcaaaatatggccctctgtgatcatgctgcaaaatgcaactcagaatgaaagatgaaatattgtacagtcatacagctgtgccataaaatgtatattgtgccccacacaaattattattctttatccttttgaataattatagtgcagctggaataataaattgtattaaacataaaatatactcttgataatcaatcttattttctcaagataaagtcacaataaattatatttactatttaatatgaaatattgcttctttctaaacagtgattcatttttgaagtggccttttttctaggatcatttatcctaagacaaagagaatctcttataaataaacatgggtcactcttcttgagcaaatgttagactctacattttaaagtcagggatgaatcctgactccaaatttttgtaccagatatttaagaaaagaacacaaattataataccatagttctctttat

SEQ ID NO: 61623 - DNA, 1382 bp, Bovine  19866881116593
tagtagctgttgggacccttttttcccccccatcttccctcccctagccttcctccccctttcccctctctctccacctctgcccttcagctgatgtaagttgaattgaaaagttagcagcagtgaatttctcattcaatctgtgctcccaggaacctgcttgtttggaattcgcatccccgccctccgtcccattataaaggaggtggagtgggggaggatcgctgctggccttaattttccaagaacaggtgaaatacattctgtcgtgaataaaacaccccgagctgtaacttttgaggctctttcacatttcccccccctggcagaggctgttgtgttttgttacagcagcaggaggagttgttattagagtgttatggaaaccaggtgttagagctgattagtcactaatcttccatctctgggagcttggctccaatcttctgttcatcagaatcattctgtcgcgttaatttattcatcccggctctaagaaccttgtcaaatcaacatggtggtctccgctgggtccctaatgcactatagccccgatcacaaacctactatatgacacataattcaggataattggcagtcagagctcaaacagccctgtgattaaatgggtatggagattgaaatcgcttctcacctattagaagggagtctcgctaggccaatggcgttcttcagtggaggctactgctagaaagggctgtgttactttccccagctttatgtggttggtgattgatgagataacacttctttttcctcttaatattttacctctcaaaacacaaaatgagccacttaactttatatttccttttttagactccatctcaagtcttcattagtaaatcttaatgactgctaaaattataggaaacccttcacttagaataaaagggaaatataccattcccccccgccccattttgtgttgcttttgccaacagctcacttttgacaactgactgtttataatgccacggagggaagagtttgacaaggtttttgatttttgacaagtaatgtgaccagttctatgtggcttaaaacagttgtttctgatgaaaataatttagcacagctgggaggaatcattgcatggtagtgaaagctgcatttatattcactctgaaccttgtttcttctgtctgtgaggtctttaaaattatagaaataatatatgtttgcaaatttggaagatagagacaaataaggtgataaaaatctgtgctagctctctattcagggagaaagtatttggcatttattttctttgggtccttttgcacatgaagtaaatccaaagtgtgtgtggattagattaattagattcatgatgtttctgttctgccgaggttcctata

SEQ ID NO: 61624 - DNA, 977 bp, Bovine  19866881120324
atacaggagagtggagagaggacatcatttggttaggatgtgtccaattttgacttttttaaaaaagaaggaggtatagaaaaaaaagatagaaagagggatggagaaagaaagagctgacagtaacaacccttgggtttcagcatctcagtttccttccgtattcactcattgggaatttcctctgtactttttctcagttgctattaatttttgcatgtcttttactatctcagttttgaataaatactgtctttttgcagaagacaaagtggtaaagaaatcgaggtcacactcttttcccaacagattatgggttgtttaaaatgcagttactcttgctattgtggttagatggaaacacttagtagggaatggaccccaactgtctcctaaagtggtaaagggccttcacaacgctattcttgggataggcacaaccaaatttcagttctgtcatttttttggcaagcttttaacaggttattgaaattcttaaagaatatcatcacctctttttaaaaataacatttcaatctttaaatatgttcataatcagtagtactcgtttcttgaatacctaaatgtgtgactagacccacaagctggagtagcaattaaactttttttaatatcatctgtgttcacccacagttgattacttaaagaagttttgaaactaagaaaaaaaaaagaatttgaaatttcacaggtggctttgcaagagcgaagaatgattagtttgcctggaatacttttcccgtgctgtcatattgaaggcttgaatgatgtatatgatgtatttgattttatctcaaaattgagtagccttattttagtataataccctgaacaatgaggaaaaaaagcattttctttatccctggttacccttataaatgatatccaccttgaataattgttcagtcgaagctgagatcagtgcatagagaaaaatatatttcctctctttttta

SEQ ID NO: 61625 - DNA, 1569 bp, Bovine  19866881136084
ctgtcaatgcaggagacagaagagatgtgcattcgaaccctgggtcagtcccctggaagagggcatagcaatactactccagtattcttgcctaaagaatctcatggacggaggagcctggtgggctacagtccatagggtcacaaatagttgaacaaggctgaggtgatacagcatgcaggaatgcagaccacccttttattcactaactccatctgcattttaccaatgagcaataaaataaagaaacctggcttaagaatacataaaagcagcagaggctggataggaatccaggtatctagttttaaacctcgatttcacccacaaatgtcacctctttttgtttctatcctgtgtcctctattgtttctaaacaacaggttaaatttctacaatgtaaaaatgatctaaaattttaagcatttcgaaatgactctatttccaaccacctctcattattatctaaattttggaaaattaaactttatttccagtaagaagaaacttcaaaaacaaacgaatgattttccagccctcgtttgtgtgctaagtcacttcagtcatgtccaactctttctgaccctatggactgtagctcctctgtttatgggattctccaggcaagaatcctggagtgggttgctacttcttcctccagggttccaacccttaatcaaggttgaattccttgacctctctttcagtgttaaccccttttccattatacccaagtgttttcatgtgatttgttaaaagattaaatttaaattaaaatttactccaggggaattctgcacttctccttgagatgaggagtgacaatctgcaatctcacaatcatgataaatgatcgctgtaataaggagacactaaaaggagaggctcagctggttgaaggaggagaagagtcagacagtccaataactggggcttgacttcattcagtttctaaactttgcactcaacaagcacttactgtgcatctccaaagaattaggaactatgctgaatacagtcaatagacaacaaatcagacagggattctgttttgagcttcttgcccattccttggaaatcagaccaaagcacagatgattattgtaagtttgtcacagtgtcagagccatgagcaatacaattgatacatagtgatgatactgtatacggttgtggcgctggagtgactgaggagatatcccacatccaagggcaaaggagaagccccagcaagacggtaggaggggcgaaatcatgtttagaatcaaaccccatacctgccagagacactcagagggctcaaacaaaccttgtgtgcaccaggacccagagacgccacagagactgagacagaattgggtttcagtgtgtcctgtggaggtacgggtcagcagtggacccgcaggggcaggggctctgggtgcagcagattcaggtatggcatatgctctcttggaggaggttgccattaactccactatagagctgccagaacttacagaggactggggaaatagactcttgagggcacagacagaatcttgcgctccccaggacccaggagaaagg

SEQ ID NO: 61626 - DNA, 1262 bp, Bovine  19866881154263
tggattctgaatattcccacatgatgcctaattttttccactggagttcattggaagcctggttaattgtgatgcattgagtagcatttggcaagactagatgaggtcattgaaacaaagattttgcacttctggacacattgtattttgttgcattggagattagggggaggtaatttttcttttcctctcttgtctttttcccttaatattgtatatgcattttatttttaattcagagggtgaggaaaaagtgtgggatctgggagaagggtgattatgatgacattattactttctgccagtgtagcatcccttcttctcagtgcctctggccaaggaggtttcaaccacatgcccttccaagcttgtgatttcttctatcccatcagccacagggtgctcagtgggcaccatgtgatgctgctgtgccctgcagactaaaccttctggtttgacaattccacagacccatgcaaagaggaaagggaaagctgccttggtattgagttgtagattggaaaaaatgggaagagacttaaatgaaaaacttatttgccagcttatctcttggtcttctcctatccccttcaacaggggaagatatcaagctgttgaaatttaaaacaataagaaaagcaagccctgcgtcttactgaataaatccagttcccctgagcttggagataataccattaaaccccagctttggtcagaaggactgagcctatttttgggagctttgaaaaagcaaaagaaatgaaaaggaaatcatctccttatttaataaaagcaaggaagtaaaccacttttcagctatagctcttccctactctgtgttatctttttgtttgggcagcaattgcagacccatatgctaagcagtggaagatatttttcagaagcatttgtctccttgggaggcttctaagcttgttttattggcaactgtgaaaccaccactgggtctgtcgtgtggctcttctccagatggtttgcatgggtggctcgtttctactggatgaaatctccctttggactccagtttggatttgagaaatttttgcactatctagtctttactttcatttggtaaaattctcatactgtttcacctgtaggccctttgtctttggagcttttgatgggtaagaaggaagtaacatggtggaagccaatgtcagtagcactgatacaaaggaacagtctctgaagcttcatcagccatcattgtcaattccagtttggatgggtgacaagtg

SEQ ID NO: 61627 - DNA, 713 bp, Bovine  19866881159979
tctacggatccattacctcggcaggccacaggactagcacaagcaaacacccacaatcaacaagccaattccttgagcctttgactcccccccctccaaaaaaaaaaaggcattagttagcatttagatggatgacaaggcagcagacagtgaagtctgaacccggcagaaaggcatccagtgttctctggagtgtgtaagccttcatgactggctgagtagatcacagacaaaaacaactccgtgcaagataaagagaaaaacccaatagtctcagtagttttaccaaactaatgctgcaaggtgtttggggccaggtctatatatgttgcgtaagaccttccctttaaaaattataaggcttcattgaggtagaattgacctacctgtcctttctgtattattatcatgatcattttttctaaatcattgagtatattaattctcattactatcatataggtctctttaccccttgactagataccatgaataaaaactcagcgtggagtagctgagaaacactgtcagtgttcagagaacacagatctgtctggaatggattaatcacgggcttcaggatttatgaaatgggaggatgtgcaccgagactcgtaaggcggatagaatgtggacaagtggaggagagaccaaaatctcaccaggcagcagccgtgaaaacaaagaacccgagaaagtctgaaagagaatga

SEQ ID NO: 61628 - DNA, 1515 bp, Bovine  19866881164609
acagaaccctcagggataggagactgtcaagatctcaaggatacaaaccagcctctctgttatcacttgctaaatcaagaagcttacttaaatagttgcaggatttaacttctaatacctactcataattgatttacatgtgaagggtttcttctcaacctttccaaaactcatgtgaaattattttgtaagtttcacatggtaaattatgaaggcaaaataagctatctctaggacatatcagctggagaaggcaatggcaacccactccagtactcttgcctggaaaaccccatggatggaggagcctcataggctgcagtccatggggtcactaagagtcagacatgacagagtgacttcactttcacttttcactttcatgcattggagaaggaaatggcaacccactccagtgttcttgcctggagaaaccagggacggggaagcctggtgggctgccgtctatggggtcgcacagagtcggacacgactgaagcgacttaacagcagcagcaggacatatcagaggttgaaaaatgtacagatgaacacccacttaatgccgttttgatggtaaaaagcagaatgattacctgtgtactaagctgagcaaagaagctgggaggggacctagctcggggatgaaggtcaaagatggccctattcttgtctgtgataatttcctcctacttacaagaagaatgattagatattcataaaataaaaattaaaaataatgagagtaaagaaaattgtaataaaagctacataaagaaaaacatagtatttctccattagactagggcacagttttccactttgctgatgacagatttaccaacagtttgctggaaatcaaaggacagagaaagaagaaattcttcaacctgcttagtacagagatgcatggagcaaactataaacagggacactcatactgaccttggagttactagaagtgagaaaaatgtgtattattagtagtgtactgacccatagactctgaccaagaaaggattcacactatttattccacacttttagtagccatgcatttcaacatcttttcgcattccatttgttggtgataattttcagtaagtaagaagcactgtacctttaagttttaaatataaaaaatgacactgattaacctttaaaatggtgccatttaatcaaagcgagtgaatctttaatgggttttcaatggactaataaatcatgagattctttttcaccatggaaatatacaaaatatttaggaggaaaactcttgttatacttcttggagtgtttgtgtgtgagagaatgaccaggaagaaaggcaacaggggttcacacatggttattatcaatgtgactgtgatttagaaggggaccactttgccttttcttccagtgagttcttgattagttaccttctcctctgtgtgctgtaagtggccatattggggatgttttaaggaactctgacaaatcgtgagacagctctaagaaatatagttgagcatt

SEQ ID NO: 61629 - DNA, 832 bp, Bovine  19866881172842
aatgactatttgctttcgaagcagaagaggtaccatgcttgtctgactttaaaacctttgctctttgaagaggtctccattataactagttgtatttgtgacttctctgttagatttttgtcctgtgaaggcaggcattactgttacaactgtatcttctatgtaaatattgtaatttctgagctactagaaaaagatatcaatttaataaatagggagtgataactctatcaggatggagaagaaagcagtctctgtgtgattcttatggtttgatcttggtacaggaccaaaatagtatttttaatcctgtcctctcccactttcaaggggccataggtagcttgacctaagaatttttatctgggatatggtaaagagaaactgctatgtcagagctttcacaagttcttactgttgctgaaggtgttgacccagggcagccacgttatagttaatcacattaatgatgcttttagttggaaaagtaacaaccagatgtagtccaggcaggcgatgtttagacaaaagggaaataaatttgttccacatgataaagagaaagggctcttttgttcaggttttcacctggctgccttgaagatttcatagatggtgtttgtgctggatggatagtagttgtatattaaagtatcgcttgagatataggtaaatacgtaagtcctaaaatattaaaatacagggcagtcactactgctaagggaagagctcattataccaaagttccaaacctatctctttaagtgttctccttctagaagaagagagagtctaacatgttgaatctaaaatgtcctatttaagtggcttc

SEQ ID NO: 61630 - DNA, 717 bp, Bovine  19866881175942
ttctggaaggtggctctagatataacttgctctaggtatactttttctttttctgtacttttggcagaatcatttcctttctgcatatacctacatatacctttaacaggaagcagaattaaaaattcatttatcttcttttgaggaagaaaatagtacactgggagattaaaaaattcaatatttttggagcttaaataaatataattttagagtagaataggaggcatccttttaaagtgggtttttccagacacgtccaggtgtacccaggtgtgtatactcgggagatgcactggaaagtgatctcaggggtccatttattctgaattcctcccttatgagttacatcactggcttattgcaactcaaaataggctctaagatcatgggtcagcaaaagagaagcaagaacaaccagaatctggcctgtttctagaaagaatcccataggaataaaagcctcaactcaaaagataagaattttttttgaagtagatgaacacatgattctgcagataataattaaatgattccttcttcacttcttcctcaggtattactttgcacatcaatacaagtttctgctaatttattgagaaacattttaggcacggccccgcagttttatacatccgggtcagaaacaccacctgaagggtccatgaaatcctgtacaatgagacccaccttttaggatgagaactggctttggga

SEQ ID NO: 61631 - DNA, 723 bp, Bovine  19866881350845
aacaacaaacaacgtgggtcggaaactgctgcagtacttcctgaaagcattctctgtccgtggttctttaaagactgcagaccaatccccttaatcatactttaaaatacagacaaatctcaatttttttaattgaaaaaagaaaaaaaaaaaaaaaaactgtgtggttgatgctagatggcagtgctgtgtaattaaaactcaaaaggattccattggaatctgtgactcaggccacctacttttctaaacaccatcctaaggtataattatgagtaaaatacattaggaactcacagttctttcttagaaagtcattaagaaggtatgacaaagcttttaccacttgaaggtcagtagttttcaaaaagaacttaaaatagcataaatctaagtgtatatgctatggatttttaaaatgaccatattaggcaatatcaataatttaccagggaatgcattttttagataaaacaaattctatttttctgttatgcctgacattatagatatatcatttaaggcatctttcaccaataatcttttaatgatgagaaaataatctagactacctgctgtctggatgccatattgcagcattaccaggaatcattcgttcattcgccccaagtatctatgaagaactactacatgcgctaaggatagcattaggtatgacaaaagagacaaatgcaacatctcaggtcctcatcctcaaggaga

SEQ ID NO: 61632 - DNA, 1223 bp, Bovine  19866881420924
gaaatgcaccaggaaattccccagttgcagaggcctttcatctctcctcctgcctgttaaacacagtggtacccgtctctctgctacccctctctgctactcatgttcaagttcaatgattttctcttggcctacagaccagaggagaggcagagatggccttctttgagattcaaattgctttaaaattttgtgccatttccttcatgaaaggtaagtaatggagggaggtaatttcacaattctccatgaaaccattttttttaagtagagggaaactggtggtgagggcattgtgtttcacatgctttaacatgtgtagctgtttctgtgtgtttcccttaaaaatgaaaagaaaaaatcttctgatgataagaaaataactttttaagaaatagtagtaggatcatggtatcaacaacctctgccaaggatggaaggaggttcatattatgtctataccaatttcaaagtcaccaccaagtttctgggttattccctagtgaaagtttgtacatctttataatgccttcagaataatttatcacatagtaaagattttaaaaaatcattattcttttgatctaaaaatccttgtacttcaactttaatatgttcttttctgaagaagtttccacgtatactttactcctcggagaaatcaacagtagagcactcaagcaaggttttagaatcttccaatttcatttaaaagaaacttcttgggttttgttgttgttgttttgtctatccaccatgacacatacttttgggtctaaaatgtgaagccctctgaaacataagttggtgagttcattagaagggagattcagatattcaaactaatggttaaaagctagtttaatatttagaattacttcttccctatggcagatacattagcacagcatcagtaagctaagaagaacattgatttttgtttctgtctttaggctgctttaaactgtatttttttgtttttttcacaaccaagtatcaagggtggcagacatttcggtttagttcagcatccccaagaagcatctttgtgaaagcagtgggacgccaaccaaaaacggtagtattattctctcaatatcaaaggtattttattcaaaactaacactcatgcatacatgcacatgcacacacgtaaaatatatataagctgataaatccttctttgaggacaggaactataaacgtaatcaaatccattctcc

SEQ ID NO: 61633 - DNA, 2483 bp, Bovine  19866881479236
cttgttgcagatcgctggctctagagcacaccagggcttcagtagttgcagcacaagggctcagtagttgtggttcaggggctctagagtgcaggctcagtagctgtggcacacgggcttagttgctccaggaatcgttgtggacagggatcaaacccatgtcccctgcattggtaggcagattcttactcactttgccaagaagtgatgtgaagtgaagttgctcagtcatgtccgactctttgcaaccccatggactgtagcctaccaggcttctcagaccatgggattttccaggcaagagtactggaatgggttgccatttccttctccaggggatcttcccgacccagggatcaaacctgggtctcccgcattgtaggcagacgctttaccctctaagccaccagggaagccaatcccgtggacaaagcatgatgagctacagtccacagggtcacaaaaagcgagacatgactgagtgactgatggtgcatgcacagatggcttcacaggtttgaaaggaaacatttcattttcaagaaaagttcttcagtagctctcattgttaaaattggattttatggttttatgtccatcattcaggggtctaccctaggtgtaaccccactggtattcactgcttcttcctcctccctctcatcttcatcggggcagcacttatcaaccatagtggcttttctgctgggtccagattgcagcaccagagcccattcaactcagtgatcccgtagagctactaccccacaggttggtgttagtaaaagacaggaataactattttgttgttgaattgcctgtctcttgaccgtgatgagtgagaaccttgagatctcaataggagaagggaattctgcacgtgcccacagctaaacaggggcagaagtagaaactgattttccagacctgtagcccagcatactggtggctcaaatgataaagaatctgcctgaagtgcagggggcctaggttcaatccctgggtcaggaaaatccactggagaagggaatgactacccactccagtattcctgcttggagatttctgtgaatggaggagcctggcgagctatagtccatggggttgtaaagagtcagatatgactgagagactaacactttcatacctttattagaaaaaaccatatataaagtatggtatgtatcatagaagtgaaataggatagtgaagaaggaaaccaattcccttttgttggttttgagccttcccaccatggctggaaaatctcaaggtattaacccttaactgagatgcaatagggaatgatgatttctgactctcttgtttgtacaaatatagagctttattcatgaaagtagtgggtggtgatgttccttgtacctgtctgacattgtggattgttgaagaaagaaaggtggacagtgttgtaggacataaatacccacagtggctgtgagggggaaggcagcaaaggcacctacaggatctatgggatctagtcctctctttgtgcaagtttgatatcagtgatggaaaacacctgcatttgaatctgcattgctgccacaacgtagaaacaccgactgagcacttttctctcaaaggagaaaatcatgctggtgaggggaggagtgtagaaaatatctaatatatcttgttcacaaaaagtgtcattttagtgtcagttcctatttcttttaaagccattaaaacccttacattgaagttggagtcaggaaagacagacatcatgatacaatttgttcctgacaccttggggtacatttgtagcattgcacccctgggaaatcactgtaggtgtgcagttcctgcgactgttaaatggaagtgtgaatctgattccccacgtacacccagcaaacttacgcagaagatacctttgttttcttaagcatttcaacttattgtaagtaaagcctgtgaattctttccttggtacatagcctggggagtatctctaccacacagctaatatcagatggaaggtgtgtggtgggggagacaagacccaaaaactttcttctcaaacatggataggacttctctatttctacataaaaattactctaaccctgggcagagtcacagacccaggagaggtatagctatttgcagatgtgggcttaacttttaaagttcagactgtcattttgagcctatttgggatgttatagatgacaatatctgtaaaaataacttttgaccttgccagtcaagatcagcagtgacaacaaagatgatggtgaaaattgccatttactgaatgtttacattattaaaatacctttcaaggaccctcacagagtatgtttatttagagcttatttgacagaaattgtgtagtgtactttacaggcatccttctttgtcctagcaatgaatgtttctgatttttttctttttggatgaggaaacaaaatcacaaaggtgagacatgtcgcccaagatgactagcatat

SEQ ID NO: 61634 - DNA, 1034 bp, Bovine  19866881861985
tttctctttatctttctcttctctatctcaatattactctgaaccttcaaccaatatttacttcctccttgtagaagaaatatgacttcattctgtcaaaactaacaactatctgtgtgcctttgttttgacattctacatgtgtcatcatgattttactcttttaccttttatattgtctatttcccctttcttcaaaactccttctctcttgcttacaaatatacttagagctcccctctccaaatagaattttatatttttctcactgttctcctcattatcatctaatctctcttttaatcaccttttttattcttacttgccaaaatatgagtttaatattaaaaatttaaattagaattaaaacagaaaataatataaaactgctaatctcaagtgagatttagtaaataatactagttatcatacttactcaaaatactttaacagaaactaataaattataacacgaaagccctactgtgcaaaccttcccttactccctccttagaggctgtcactctcctaaggtcaatactgccattctcatgcattttaaaaattctgttttttaaaatacaaaatttttgtatttgttttgtacacacacatatttgtacacacacacatacaaaatgtaagacacaaaatacaagagtgtacacacaaaagtgtatatacaagagtgtattttgtgtctttaaaacttcacatagagtgcatggtgtatatattctttaatttgcttgtactattgctttatgtaatactggtttatcctactgaaggagtcatactgctttccctttgttactactagaaaagtgccacgcacagctccgtgaccatgtgggagggtatttggggaaagtatctagaagtgaaggtgctggttcaaagcgtttggacaattttattcatcattactaaagtgaattccaagatgactgttcaaatttacattcaaaccagactctgtatcactgcttgtttccataaatcctcaccaatacttcatgctatcagactta

SEQ ID NO: 61635 - DNA, 774 bp, Bovine  19866880381051
accgtaacagaatgaagaagcctacagccggatggccaggactaaaaggacagcagggaacacggcggccagtatcacgagaataaacagcaccataaaaaactgctgcaggaagttctcggcgtgaaacggcagcctcacgtccagctcgtccatatccttggagaagcggttcattagcctgccagtgggcgtcctgtcaaagaagctcatggggctctccaggatctgcgggtgaccatggagagtcagcatcgaggtgcacgtttggtggccccgacccccctgccgccgacaccccgggaggcctgcccggtgcctgggatcacgaaccaggcctgagtttccctctggggtccgacatcctgggaaagggaggctgcggccaccgtggaggagtgtgacaggggagggattcagcctccatgaaggatggggggattttgtgccccagggcaataaaaagtcaaatcccactgtctctatgcgggcctccctcgtgcgctccagccagggacctccccggctgccggggaatgaggaggggatcccagggactcaagagatgctctctgggcctgcgctcaccagctccatggcagtgtcctcaggaagaaaacttcctgaccaccctcaccttcacccccagccccgtcgggcccatgacacgcctgcagctccccagagtttacctttgtggttgataattagatatgggagactcaacggtaagctcagtgaacaactgtgtctaccccagagcccagcacagtg

SEQ ID NO: 61636 - DNA, 1854 bp, Bovine  19866880393460
tgaccccatagacggcagccaccaggctcccccgtccctgggattctccaggcaagaacactggagtgggttgccatgtccttctccaatgcatgaaagtgaaaagtgaaagtgaagtcgctcagtcgtatccgactcttagtgaccccatggactgcagcctaccaggctcctccatccatgggattttccaggcaaaagtactggagtggggtgccattgccttctccgatatatgcaataatatgcaatatttgcttttctctttctgacttacttcactctgtattacaggctctaggttcataaacctcagttcaactaactcacattcattcccctttatggctgggtaatatttcattgcatatgtgtaccacaacttctttatccattcatctgtcagcagacatctaggtttcttccatgtcctggctattgtaaatagtgctgcaatgaacattggggtacctgtatcattttgaattatcgtttttcagggtatttgcacagcaatgaggttgttggatcatacggtagttttactctgagttttttaaggaacctccatactgttctctatctgtgaggcagccccgcagttacagctaagcattcaggacctgggggctgctttgactgttttatagcataattgattaaggacttttatctttgtgagaagtcaaataagatttaagaggcaaaaatcaggcatatgctttctttttgtttagtccaatttccacttaaagtcaaaagaaaccaaagcaggtctgagcggatcagaaacagggggccttgggtaacacttatttgggagaccatgaggacaagaggtcaggggatcagtgtagtatggtggtcaggaacatgaactctggagtcagccttcctgtgttcaaaccccacactgacctttggcatttaacttcacttctctaggcttcaatttccatatttgtaaaataggacagtaatagtaatggtaacaatcttggaatgttctaggtcaggtagagatgaattgtgagaactagagcattgagggagcctctgtgactgttatgtgctaatgatgttgacccagatccttgcttcttgcagcctggcctttgttcatcatagtcctcaattgggggaatcagcttcccacctcattggccagtggaggtcttaccagtccccaacccataagatagaccattttaaccaggatccagtcaaaagtgtagaaatcacaccaggtcttccaaacagaatcaggtttattatggagaactggtgacaccggtaatgcaagagccaagaagccaaacaaaggacagtgaggtgagccagaaatcagcatcggcaagaagtcactatcgtctgaggactggaaggacatgagaaaatacagctctacagatcccagaggccaggcttccaggtaggtgctgaaaccataaggtgctgctaggatgtacctgggacactggagggagggacagtttggtggaagccatggatgcctgccaatgcaggagacgcgagttcaatccctaggtcaggaagatctcctggagaaggaaatggcaacccactctgatattcttgcctgggaaatcccatggacagaggagtctggaggactatagtccatgggatcacgaaagagccagacatgattttgagactggaaaacaacaaagcctcgaaagagacagagccactgctgtgtatgctataaaacagcatagtaaacagagggagacggggaaaaaactggattttctccccatctctttccatccagtgatcaagggagtctgggaaatgtagtttcttatgacaccaatttgggatacaaaa

SEQ ID NO: 61637 - DNA, 3000 bp, Bovine  19866880495793
ttttaggaagagggtacccagtacaatgtatattttggaaaccttactacatgagaaacagactggggctgtgcacagtaatctcagccagaaagatgacgtgggccaggctgcgggtagcagggtgccaaagggtgaagcagtcagagatattcaagagacagggttgcagtgattagtgacaaagtgatagcagagagtaggaggaagacatggcgagcaagacacctgggtttttatttgaaggttgatagatggggccaccatctgtggagatggaaatctcaaaagaaaacaagcctctgaggggaaatattgagttcaaactttaacaggccaagtttgaggaacctctgacacatccacatggaaatgtcaggaaggcagtggggtttgggggtttgagatttagaggctaggtttaggctcttccaactggagtcatgcacaaaggagggaattgaagatgtgggcacagaggaaatccaaagaagagattaaagaatgagaacagaaaagaaattggactaaacctgagttccctcaaacatttaacggccaagagaaactattaaaaaaaaaaaaaaaacagacagacataatggtcagagtgggaggaaaaaaccagcataggaagggagcatgttaaggatgacttcatgtggaggtcatggggtcctcacctgagctttgcagggagtgatgccagaagcaatagaattcgaatctgctgtcatttgtgatttccatggatatgaatgccagaagccccgtgttgcactccctgccaaatactaataaccttggtcttgacatttgaatccaagccaagctgtttgaaagaaagctggcttcatccaacctatttctcgcattctaatccagcagaagaagacagaagaatttgaatttgttgataatcttttatgttagggtcaagacaagaaacagagtaattatttgcagctgaaataaaatctcgctctcaacctaagacagcgaattcccaggtggatgcaatgtgcacccctgatgaagagtccgtttgctacaagatgaaatgtggcaaagctctgagagtgtcaccgcggcctatgacaagaccactttgtcccttcgagcatgttacaaagactcgggaaaggcttcattttgcacctgacatcaaagcgccattaaaggattctgaatacaatctcaaagccaggcaattctgagggtgacagaagtcatgaactcatcccatttctcttagagggacagaaaaaataagacgaacaaaggtctgtttaaagaacagaaaaagctcaggaatgaaagaggagggatgcaactgcccgtggaatcgcagctttaaatagcacacggtgttcctggcttcctaggaaggagctgccgccgagagagcatctgcgctcaaacaggccgtcatgtggatgcaaggcttgagccatgccttccaaaactatgtgtacagacaactgcgacctctcctggggtgggcagggggctctctgtcagtgtgctcccttcccagggtgttctgagttcccacagttctcagccagttcacacagtcatctggacagctagtgagttcatccccagtcacagaggaagtatggagctcccatggggctggtgggaggcagaggagcatgtttgtggctgctccatcttgaagaaagatgcaatggctgccgcttaagggtctactgtgggccagtgaccacacagaacacttcatataggctcatctctaatcttcacaattatcctgaaaattaggcacccggtacctccattttgggtttcctggtggctcagtggtaaagaatccacctgccaatgcaagagatgcagattcgatagctgcgtcaagaagatcccctggagaaggaactggcaaccaggtcctgtattcttgcctgggaaatctcatggaaagaggagactggcaggttacagtccatggtgtcacctagagtcagacatgactgagtgactgaacaacaaacctctattttacagatcaggaaactaagtccaggaaacattaagtgattgtccatgtctggctccaaagtccaccctccttggactacagcccagattcatatctggttgtgtgcaacatcaggaggcggcattagaaagtaaaccccatggaaggatgtccattaccgcctgctagtccagcatctattgttcctttgaggatattgcctcccacactgggttaagtcatgctggaatcgaaatctaagcacctgccctccacctggaagctgagagcttccagattcctagaatctcctcctctgttctgcaaagaccagggtttggctcctgacgaaggcttggccaaccagcgtctctctcctggagtattgtctcctgagccgaagagcaagagtggaatcaatcacagagttcattctctgacagcagaacccaggtcagatcactcagccttccttcccactccaaacccgggttccttagccattcttcatccagtgaggtctcaactgcttgcacccagtctctattgctcagagtccaagaaccctaactcaataaacttagaatgtaaaagagttctaatattttataaaacaacaaggagaattatggtaaaacatttctaagaatatattaagggagtgggggatgtatgggcccttggtgagagggtggacccagcaactgctgtgaccagtagaatctggcaaaagtgactctgggccagttctgggcattgccctcaactggcttggagttttccattcattgccttttggaacacttactcatgacacattccttcttgagatccagccaccatgctgtgaaaagccaattcacatgaagggaccccttgatgtaatccaggtaacagccccagtagagcgctcagttccgagtcatggggacactgtcctggatgtcctgctgagcttcaggtgagcgcagccctgcctcaatcggctgcaatca

SEQ ID NO: 61638 - DNA, 3805 bp, Bovine  19866880518038
tactgttcttatattatgatgtctaaatttacaacttgcatggctctacctgattcacacaagaacacagagagacagatgcttcctatgtgataaaacttttcactatttaaagtttaaaaaatcagggccacataacttctactagatttccaccttcaattatttcctaccaacaagaaaatatctttattgctttttctgattatatgaattttatgaaaaatttaatccatatcctacaagggaatgatcctgttattctctcaatcccttaggcaacaactctttcactttggcatgtgttaaaaggagtgtaatttattgtttgatccctaagaaacactggaagtataaaatatggttacaaatttttaacagtacatagataaatatatacccatatcatacacacacacacacatgcatatatttacataaatgggttcatatactatataatctggtattccagttttttaaaattagtattgttcttttctacaaagtaaaaacagacctagaatgaactagatgttaatcagtgccagaggatgagtgcttaatccaattaagaggtctccttaccatatttaaaactaacatggattcacctgatgaaggtagctcccaattttttgttatttcaaaaccaattcagtaacaaccttttgtcagtgtagtattacttctgcaggataatttcccagacttgatagagtcaaagagaatatatattttctttcaaacataatgccaggttggtcaccctccagaaataatggaccaattacatgtacattaacagtgcagaggacatttttgtcactctcttgggtcacaatgatatttcattttaaacaactgtattcaaatattttgtggttgaccattttcctatatatttaatagctatttgtatgttctatacattttttcctttgatcaaatattttactcaatttgctcatcttcaatgttgttatgaaatgtgagaatgacagcacattaattcaaacatcatttcagcatgtggtatttcaatctaaacaattttctgctaggaaatttcacaagcacctttgatgtgctgcttgtttatgccacctacaactaaatttatttaaatgtgtcaatcacttccttaatggctttttggcactggtgttactctaagattggactttcccttccaacagttataaaatgttctaatttttcttttagtaattttatatttaatcattaaaaatatttaaatctttaacctgtctggaatttatttttgtacctgaagagaggcagaaatctaacctaaatttttttaaatgtaaaataaaaccaactgtctttacacaatctactgactatgatttgaactgatttcaagtatcaatctcaacatacacaaaattaacaccatcaccagagctctctgttcattttgtcatgatgcacacatgtatgtcagaattaggtctgtctctctccttctgcactgactatacctagagaatagcaccccctgagttggcactgtgcctggcatacaactggtgctcaaaaaatacttggtggatgaatgagaaagcaagttaacgtcctctggagccacatgtactgtgcatattaattctggaatagtagtggttttagacaaagccaactagacagaaaaagttctctataaagcattttattgtataggctgcactgaaactgcaatgcacagcacgagatggagatatccttcctttgtatttacctaggtagaaaggaaatctttaaatactacccaattacattaaaagcagcttccttaacttcctgagccacagaaggtctatgacaattaggtaatcagatgcagaatgcttgctgtattacaggatgcagataatactgttcctatgttatatacattcacaccatttaatgtgctgaaacatacagtagggacaaaccccacccagaaacccagaaatacttcattctcttgggttggccaaaacttttgttcaatttttctgtaagatgactctagtagcacttagttgtctaacttcattcaaaacaactgttggattgtattgtgacagctgtcatatcagtgtgcataaaaaaaaacaacttagcaaattggtcaatttttgtgtagccattttaatactgaggatggaaggggaaaaaaaagcaacattttcagccattatgctttattattgcaggaaaagtaaaaacacaaccgaaatgcaagaaaatgtttgtgcagtgtatagagaaggtgctatgattgattgaacgtgtcaaaagtggtttctgaagtttcatggtagagattttcactggatgatatgccacggttgggtagaccagttgaagttgatagcaatcaaactgagacatcaactgaaaacagtgttataccacacaagagacagccaacatactcaaaatatctaaatcaaacactgaaaatcattagcaccagcttggttatgttagtcattttgacatttgggttccatgtaagttaagcaaaagaaaaatcttcttgatcatatttccacatgtgattctttacttaaatgtaacaaaaatgttctgtttttaaaacaaattgtgacaggcaatgcaaagtggatataactgtacaataatgtggaaggaagagactgtggggcaagcaaaataaaaccatcaccaaccacaccaaaggccagccttcatccaaagaaggttacactgtgtatgtggtgggattggaagggagtcctctatatgagctccttcagaacaaaatgattaatttcaataaatactgatcccagtaagacaaactgaaagcagcactcgacaaaaagtgtccagaatcagtcaacagaaaatgcataatctctcataggataatggaagactgcatgcttttttgatgaccaggtaaaaattgctacaacttggctgtgaagttatgatttgctgtatttgtgacattgcaccttcagatttccatttatttttgtctttaaaaattctgttaatggaaataatttcaatttcctggaagactgtgaaaggtgcctggaaaagttctttgctcaaaaagattaaaagttttaggaagacagaattatgaagttgcctgaaaaatggcagaagatagtggaacaaaaccagtgaatatgttgttcaataaagttctcagtgaaagcgaaaaatgtcttttatttttacttaaaaacaaaaggaatgttttggccgacccagtaatggcagagaggaagaggttgagaagagatggaggagatgagggacacattgaggaatgagagccaaagcatctgggaaggtcctggcttagctaggagaggcaactcaatagaaggaagcggatgtggaaagaggtgcatctgtaggtttggtggtgggtttctaatggcttctattttatctgtgaattggaaaataagttcataagttaagatgtaggggaagaggctgggtctgaagtttgaggagagagaacgttcgggactgtccttatgcagaatgagacagtgagctgtctggagaggcactgtggtattttcagggttgagagcttggttaagcagggttgattggcctgagtccctggttttctccagtcacactcaatagccaggatgcagggaagagaagccagatagtagcaccatttggagttggagttttccagccagacaagaaggaaagacaaggggacaagtgagtttaagttaagtggacttccctggggctcagaggtaaagaatccacctgcaat

SEQ ID NO: 61639 - DNA, 1356 bp, Bovine  19866880540898
gggagttatgtgaaggtctgtggaagggacaggcagagtctccagatttccctgctattgctaggatgcagacagtaacactccccagaaactgaatagagagcctccagatacagggacactgggcacagaggagggaaggtgtgccaggccagacctgggggattgggtgcaggattgcacctcgaacagggagatcactagccccttggccaggtgaaatcatgccattaatggtgccctaacttactcagcagtgagtcaaaatttttgaggttgtaatgttgaaaacattcaaatgttatgatataatcattttagaagtttgtgttaaagagaggcagggtgtgagagagacatctatttacttgaataggaaattgtattcaatatggaaatatttggaaagggtggtaaataaaaggcatgtagctaaaatggttaaaagtggttgcctctaggaatggagttaaaggaggatgtgttatatatgtgggggctgctgttttttccttttaagcttttaagtgctaattgactttttaatgatgtgagtgtatttctttgatgaattaaaattaaagagaaaaagggaaagcttgctcaggcacttacttgtctactacttaatttgtgtatattatgagttggatttccataaatggattttgttcaagctggccactcatggagattgcatgtcctaaacaagaattaataatcttgggaaataattgatctttagccaaagagagagcactgattcctaagaaaagagtctgggtttcagcttaaagagttaggatctctactgtgggcttcattctggtcaaaattctaagagaaaccctgtattacactctctgtgattcaatcaccatactgttggtcagagtctaactaaccatcattccaactaggaaaatgctcgtgcttgctctctgttgccatagaaacggtgcagctcaagtctctctgttgctttggtaacccacccccatttcctcacatcactaccgctggggtattttgctgccaagataatggtctctattgtggaaggaatgttaatgggacggcaacctaccccagcctaacccagtcccctcctcagcttcacatttgaagaccttgtctaagaacatctcaatgagatgatgataggcattcaaatcagatggagagagactgtggtggtttcagtggtaggggttcctcgttatagagaaataaggggtcagctccaaatcttgaaaagggaggaagggagagagcctctgtttgagggttcagctgtgtgtcaggccctgaagcaagtcttctcgatcaataacaaacgatcataaatgaagcttg

SEQ ID NO: 61640 - DNA, 1750 bp, Bovine  19866880594545
ggtggctatgagacttcccccttttcccctcacagcaataggctgaatactccttaaatgataaagcctttccatagatgaggaaactgctattcacacaaagctaatcaagaccagctgtacagtcttgctgctgctgctgctgctaaatcgcttcagtcgtgtccgagtctgtgcgaccccatagacagcagcctaccaggctcccccgaccctgggattctccaggcaagaacactggagtgggttgccatttccttctccagtgtgaaagtgcatgaaagtgaaaaatgaaagtgaagtcgctcattcatgctagaaacttcctaaattctaggtcttgactccagacccacagtagttgattaataaaatttcctctgcgttctgaagcagtaattatcaatttacctcatgccaagacacctgattttcttcctccaagggcccaaatccctgccatgattgtgttaattatgatctgagacacagttcaccatcaaagatatcagaaatatattgctgctcaagggagcagctaagactcaagatctgagtccagaagcagaacccatagagatcggaaagtagaatgtggaagtgggtgaatgaaaggattaggcaagattagaagcttgagacatcagaatctgaattgtcaaatccaggtaagagaagagaaactgcagaaatagttgggaaatactatattccagaattcacatggtgaaacaagctagatggacagaaagaagtcagtcccgaagggagaggagtctttctgaagatcttaaatgcctggttgatttcttttttctagagtaaagaagtattaatatctcttatgtcccaggcaccactataaactctttacatacaaaacttcatttaatctgcacaaaatgatctactattttctgcattttgcagatgaagaaactgaggcttaagaaaataaaatgacttgctcagggtcacatagctattgggagagaggaaagttactgggaaagggagaaagaggagacagacagagaagctgagcaggactcaaatttgacagcttcactagtgagccaacatcttaaccaacagttggtactgtgcccagataaagctttgccttcaattccttttaagatttcctgacaacatatgtatgttataaaaagtaaaagcaagtttatattcatttgactttgacagttgagcattttttttacatcctttttggtgacttgagagagcttagaattgagaaccactgctttgggcttaaaaagaccccacagatggggcagtcaggatgctcacccttgagttccccttggagaattcagtgtctctattataactccacatggtccctccagcctgctgtctatgactgtcatgccttagagtattaaaaaagggagagtgtgggcaaattagaggacatacaaggacaaatctaagcattgtaattctgataaaaaaaaaaatcaagacaccataaaattctatttctgaagatttatactccacttaaagccacgaggacttaaggtggctagaaaaatttactcggaaagcaaatagaattattggattgtgaaattgagagccataaaatttaaaacaattttatatgaaactccattttttttggtattccaaagtgaaagagttagacggtaccaagtaaatttgaatctcaaaaggcttaaggatacaggaaggaggagaggaatggaaagggttccctttg

SEQ ID NO: 61641 - DNA, 1341 bp, Bovine  19866880631268
tcctgagatattcattggaaggactgatgctgtggctgaagccccaatattttggccacctgatgcaaagaactgactcattggaaaagaccctgatgctggcaaagattgaaggcaggaggagaaggggatgacagagggtgagatggttggatggcatcaccgactcaatggacgtgagtttgagcaagcttgggaagttggtgatggacagggaagcctggcgtgctgcactccatggggttgcaaagagttagacatgactgagtgaatgaactgaactgaatagagagtgaatgaatgagatgaacaaataatcaagagttacatccaaagtccctacccagactgtggtctctccttgagattttggcataaaatgaagtccaactacatctaatatggcttcatttgactaggcttttcctacataaaagagccttgatagcaagtttacaatatggtttgcgaataggttgattaaataaaatttgtactttagcaataatggagacaaacaaatttctttacactttttccatgaggaaatttttcagatttgaaatgaaaagcaccaaagggggaaatggagccatgctttgacacaaccttaattaaattactcccagctttttagaaaagtcaaatctatatttttgcccacggactgttcttcaagaggatagtaacgcatcactccactaattttagccttgcaaccagcagcatgcagtaatttaattagctgatgtgtcatatcagcagtttagagactgtgattctgctgtctgaaccaaccaaacaaaccaaaaacaaaaaaacaggacatttgattggaaagtggcagctgtctctacaggtcctgggcagtgaatgacatgtggagttttgctaatgacttcagatctaccccaaaaagttgacccctgaattccctaaagtccatctgttctgtaagtgctatgcctttgggaaattctagctccgaggctggagagaaaattgagaaaataatggaaagaaaggaaggaatgttataggcgagaagatcctgcctacctcccacgtttgcatatatttttcctccatctagaagcctcagcattccctcactttcttacttccctttgcctctgctcaaatggtcacccagcagttcatcctagctattttcacaccctttctcctaacctgacctcctttactcctcactccttatcagttcagttcagttcagtcgctcagtcatgtccaactctttgcaaccccatggactgcagctcaccaggcctccctgtctatcaccaactcccaaagtttactcaaactcatgtccattga

SEQ ID NO: 61642 - DNA, 3631 bp, Bovine  19866880632436
ctgacctgcctcctgagaaatctgtatgcacatcaagtaagcaacagttagaactggacatggaacaatagactggttccaaatcaggaaaggagtacgtcaaggctatgtattgtcacccagcttatttaacttatatgcagagtacatcatgagaaacgctgggctgaaagaagcacaagctggaatcaagattgctgggagaaatatcactaaccttagatatgcagatgacaccacccttatggcagaaagcgaagaaaaactaaagaacctcttgatgaaagtgaaaaagaaaagtgaaaaagttggcttaaaactcaacattcaaaaaactaagatcatggcatctagtcccatcacttcgtggcaaatagatggggcaacaatgaaacagtgaaagactttatttgggggggctcccaaatcactgtagattttgactgcagccatgaaattaaaagatgcttgctccttggaagaaaagttatgaccaaactagacagcatattacaaagcagagtttttactttgccaacagaagtttgtctagtcaaagctatggtttttccagtagtcatgtatggatgtgagagttggactataaagaaagctgctgctgctgctaagtcgtgtcagtcatgtccgactctgtgaccccatagatggcagcccatcaggctccgccgtccctgggattctccaggcaagaatgctgaagtgggttgccatttccttctccaatgcatgaaagtgaaaagtgaaagtgaagtcgctcagtcatgtccgattcttcacgaccccatggactgtagcctaccaggctcctccgtccatggattttccaggcaagagtactggagtgggttgccattgagcaccggagaattgatgcttttgaactgtggtgttggagaagactcttgagagtcccttggagtaccaggagatccaaccagtccatcctaaaggaaatcaggcctgaatattcattggaaggactgatgttgaagtggaaactccaatactttggccatctgatgcagagaactgactcatttgggaagaccctgatgctgggaaagtttgaaggtgggaggagaaggggacgacaaaggatgaaatggttggatggcatcacagactcaatggacatgagtttgagtaagctccatgagttggtgatggacagggaagcctggtgtgctatagtccatggggtcgccaagagtcagacacaactcagtgactgaactgaactgaaggattttctgtatctgtgattatatcacctgtggataaaatcctgtagtctaagtcacttacctttgtacttttaacttacgtaattaaaaaaaaaatcttttctttctcttagctcatctttgagtttctggatttcactttattgctataaactggcgttgttttatcaattccaagatgttttaatacttaaaataggcccctgagagttcatgtgtcaaaattttcttaggtgtgtcaattaggtaggacattgaattacagtttttttgttttcctcactgtaccttccacctgatcactatctccatacattaattatcctttataaaaattgaagtatagtttgtgtacaatattatatgcaacacagtgattcataatttttaaaggctctgtttcatttaaagttataaaacattggctatattccttcccattcacgtattttaaaacatttcccaaatagttactattctgtagtaaaattaatgcttacttgaaaacatttcatgtaaacagcccatagaaaatgtagatcgtgataacacgaatagcttaggatagtggttctcagatttaaagtgcattcaagcacctagagggcttgttaacaccccattcccagaaagcagtgagaattggcaagcttccaggtaatgctgttgctctgggaaccacactttaataatcactgctttaaagaaatgatgacagatcattaattttaaatgattaatggatgcttggggctggtgcactgggacgacccagagggatggtatggggagggaggaggaaggagggttcagaatggggaacacatgtatacctgtggtggattcattttgatatttggcaaaactaatacaatcatgtaaagtttaaaaataaaataaaattttaaaaaatcattaaaaaaatgattaatggaatatgcagttgctttgagaaaaagacaaaaaattgcaataagtaaactagatattagatctaaaatatttaaaggttgatatttataagatgacagtttcatatttttaatgaaatttgggtcttcccatttttcagcactattagatatctgagaggccaaagaagtatacattttattacaaagagaagaatatagcaaaaaatcagaggtatgatgatcctttgatctgtgagcataaaataatgccatttcattgggccttaatcaaagagcattcgaatgggtatattaaaccatactctgtggctagtgtgtgatatacaaaatcttttctagggctcagaattgacatgacaaaagctctattcattgatctgaatgatgatgcccagcccgatattaccatgcaaatatcatcatactacactttcttctaaacataatcatttttttcccttgagttactgaatataagtgatactggaattaagactactcccatcaatagtatgaccatttgtgtagatcatggtgaacttagaaatatttttccttggagatcactaactataaggaagaaaaattaacatagtgaaatgtcagactgaagtctattagacattattcttgggaagttgttataagtgttaataaaaatacttgcttgtgaatattcatcatataacagttattcttttatagacaaatacatcagagttataaagtattcccttttctcttctagctctgttggcttagcaaaagcagctctagaagcaattaatggattcaacctctttggcaaccaggtaaaaaaacagcagtagcaacaacaaacttcattttttgatttgcatgtttaattaacttggccatttattaaccaattcattcatcatgatcagagaatgtctgaaatttatgtagcagcccagggttgaacaaactttcctttgaatataatttgcttcttaaattttagttttctaacaaaaaagattgcttaatttaacaataaaactcttgatgaagaattttcattttccaagttcagtagcttctctctctagtcttttgttcaactttcagcatttttatatattccttgcattaggtactaaatattttacttgtcaattcccttgttggtttcaatttaatgtatatagatgtatatttcatgcagaggggaaatttggttcagatgtgcagccaaggaattggaaattgggatactagcttaaccctcaactgactgtattcatttgtctaaatctcattttctctgagataaaagggaaaccctgaggattgccttaaatttttaactgatttatgcacctaatcaagtgatcatggattgagttgtcaatggaaagaataatatgcagtaatactggttattactctggatcaagaagtagactg

SEQ ID NO: 61643 - DNA, 1105 bp, Bovine  19866880654190
cttcctgtgtgctaatttctcaaccctgtttcattatcacctttatcaaaagtctttttagacatttttccttatttgccttccactcatccatgaaatattagtgccacacatacactgtatgtctgtttacatactacatacatctctgcttatgcctaaagagagagagagatttttttttttacccctgtcctcccaggggccaatttttacccccctgggggtgacttcaccccattgagaatgcaggctctagagagatagtactgattagcgtggcctctgcttctggtctgtacaggaaaaaacagcacatcctcagggggttattgaagaactaaaggtcatactgcaagtaacgagctcagcacatgcttggggtcagttaagcactcataactgctatcacattattactagtgttaatcataagagatttggggaatgtttactggggaattattatatgatgggattagagcttgccataaaactcagtgacttattgctcatagaaaccctgcgaattagggactgttattatcatcttacagattagaaaactgaggcacagacccattgtctgaggtcccagagcccatacttgacaaagccagcatttcattccatggagtccagactcctcaccttactgttaaccctgatgctgtgtgcattagtcgtgtgagtacaatgttagtggaaacattaggattaattaacacttaaactttttcaatgccgcaagcggcctcactggtactttgacttcaagtggttctggcccctgtggtcatctcaggactctgaaatgaactttcccgattctttccttgcaggcagagctgcctgaattcctgataaggatcagtaatttgagttcccacttcccggcctggggaatctactcaggcatccccatgaccattttcccctctttggaatcaagatggcaccgagtgtgggctgctgctgaggagatgcatgttgccatggcagcagctcatgcctccttcctaccctctcagaggtgctctgacacaggcagcagtttctatggtaacaagctgagtgggagggtccatgaagaaagaactgtgtg

SEQ ID NO: 61644 - DNA, 794 bp, Bovine  19866880670237
ctttgaactttgtgaaaatttagaagtaatttttgattgctctgcacctatctatgtcactacttgtcccccttcccagtccagtcctgtcaattctatgtcctaaatattcctgaaatgttttcacttgctccttcttcattccaaccacttctgatctttcaactgcagccctccatgaatatccttgtgcccactctcccttctgcaaaccatgtctatatagtagccattataatgtatgttaatatagataaaatgcttgggcagaatctgacctacagtaggcactatatatgtatttattactgttgttctaaaaatgtaaattacattgagtcttttcattgtttgaaactcttttagtggcttctcattccacttagatgaaagccaaatcccttgttgccttagaagccccttttgggccttaactccacccttattcctttttcttttgcttgcctgttatgctccaaatacactagtttcctcttagttcctcaaacacttcaagtcttttcttctcagggcctttgctgttcattctgcctgagtgtttgttactagatcttgttcctttttgctgttgaagccagtctcagatttaatgacatcctccaggagaattattttctgaccatcaatctaaagtaggcctatctccagttactctattgtatcaccctttacatttatccgttttattcttacagctcagatacctttttctataaagttctcctccactctctgagactaaaggagctactccctcccttgccttcaaagca

SEQ ID NO: 61645 - DNA, 1268 bp, Bovine  19866880686677
tttgggcatagtcttgccgagctctctgaacaaggagcaagcttggcttctgctatgaacacccccgtcttagtctgctcaggctgttcaaacagaacaccacaaacgggatggcctcaacatcagaagctgatttctccccatttggcagtttggaaagctcaaggttgtgctttgtcctcatgacctcatgcaaacttgatgacctcccgaaggtcccacctccaaatgccatcatattagtggttggggcttcaacatgaaactctgaggaaggacaccaacattcagaccttcataagccctgcctgtcacgaggcggcctttcaaaaccatttttctatctgaacattctccacttcccctgaaatgaaggacactgtgggtgacaaaatctccaaagatctggcagccaaacaaatgtgccttaatttctatcactttaggaccccagagccacagaggagagaggtccaaggagccaaagtacccatgagatcatgtggaaaagcagagaaagtcaagatctgcgagggtgaagtaaatgtccattgacagaaatgcttggctcttcctccaggctcagaagtctgagaggaaggagacaaacctggccccacacctctcagcctctgctctccctcagcaaccaaaacccagcgagagatggttcatctccccaaatctcagttccctgaagcacatgcttcaaaatgctcaaagagcaaccgagaaaagcctctgggctcatatgtgtctgagctggggcctcaaggagagctcagaaagcagtagagaagccgggctctggtttctaatgacagtgggaaaatgccaggagaagggtgggcagaaggggaagacgaaagactggaagcatttctgatgaaagagcccgaatgaagtgagtgtgaggagaggtgggtgagagacacagaaagcgaaaggaatgaggcagaatgagtgcaggtcaggggagaataggtatccaacggagcagggtgacccatcaagtcacacggaggccagcttggcacagtgccacctgccagccactcccaccttagggagaggagagatgttaggttagggttagggttagggttctgccttttaaagctgaagactcagagtgggcagaagcagtgggtgcaggatttggctgatgaatggctggtccccatttctatgtcgatcctggagagcaagggttaaggacactcaccctgtcttctgctcacagcaccgattttcatatggggaccttc

SEQ ID NO: 61646 - DNA, 1095 bp, Bovine  19866880691261
gaagaagaagcagatagactatggaaaatactgcacaagagccctttggatttcctttttttttttttccttatcaaatgttattatgaattagcagcactcactcctgagccactgggactatgtctttacagcctccgtcgtagcaaaccttaaggctggaaagaaaagccttttatttgagaaacactgtgggggtttattactgagtcaatggagaaagcaaaaggagtctgtgagaggaaatagtacaaagactagaatatcttcagcaaaataattgcaaggcaacatttcagggtagtttaatttcctactgcattttaatgaccaatatagaagatataaaaatgtcgtttacagacaaactccaacattttgtttctctggttgttctaatagatcaaatgggacgtacaatatgattttttttttaattttttcaccaaacactgtaatcaatctttcaagctacagatctgtgtagttacctcttgtcacacactcaaaatagatatgcctaggaagtgggaagaaaagtcttctttttccttctgataaccaggcaggaaacctttacaaagtacatccttaggcattctcccattctgttcgtaaccttttttggaagttacaatgttttcattcccaggctctgaggtgtactgatgagaacacaggagggatgatgagggatttaggaactgagggtcagttttctaatccatgagcttcttctgcctctgctcatcactgagagccagacccaagccctccaggaggcatgtgctgggcaaagcagggaagcaaccttcaccctggctcttcctgtgttccaggctctgggacagggcagggcagggcggagtagggggtggggatggtggaccagatctaacccctgagatgacggtccctgaccccataggcgcatctgacttgtctcacacagcctcctcttcgtctaaaatcagctgacggcatccttttggaagtcttatattcggactttgttttctgcggctagtaacatcgaaaaggcagaacctggcttctcagcaaggacttcaggcttatcaaactcgactaccttgg

SEQ ID NO: 61647 - DNA, 1696 bp, Bovine  19866880747394
agctgcccagatgagcaggaagggcatgggcctcatggcaggcagctgtttgtgctggagctatatttttcagacctatactttcctctcgttttgtcagaagcaacgtgttattttggtaactctttcattttccgcactgcaggctctccatgcaattattgaatgcaattaggtattccatgctgcataattactcagctatctgtgcctctgaaagatatgaaaataaatgatcatgaaagtccatagtgaaaatcctccatccaaagaataagcctggattttctacctactttacaatgtgtctgaattagacaaaataaaatttaaacactctgggtttttcttccatctgctgtacacgtgcatgaatgaaatgtaacattagcatggcagaacaaaactggcttggttaacttttctctgtcatctaaatctatggcttcttattctggtttgtgcaggtatccacataaaacctctctgtggcatggaaaaaaaaggagtaatggatcaaggtctaaaaataattcataaatccagtttaaactagtgcacaggtagctggaaggtccatgccaagttcattcctttgtacaaaggcaaagagaatagccaggcatattaaaatagagtaagggctttggtttttatatacatcaatgttggctgagattcttttgcttgcaagtgacagaaaccccgttgcagacagtttaagcaaagaaggggatttagcaacaagatactggggcatctcagagaataaaaatgagctgcaggagtatctgaaactcagaaactggacctggggacttgactctaagactttgtctccctctatgcatctctttgtttattctatcttggcttcattcttttctatgccagaaaacgtttctttatttagcagcattcaacactactagaaactctgggatcacatctctgaagcttctatccagggcaaaggaatcttccttgtaagttctgttaaggaaaaaaccaaaaacaaaacagccaaagcgtctactcaacctgtattggaccagatccccggagaaattcctggcttgaggggtaggttaaggtactaagaggtaagttactaaaaggggtaaattaaggtattaacctaagggggaggttaaggtcctatacccacacctgtgcaggaaatgaaggtttataacagaagaagatgggagttataacagaagaagacagaaagttttataatgaaggtttataacagaagaagacagaagacaggagaaggcagaaagcaggtcagttgacaataacacgaaagtacccacatgtgactgcaaacttggagactgtcctcagggctcaagagaataacctgatatatatatagacatggatcattttgtatagaatcttagaattcagttttctgttcttggaacttgtattttatttatttatttattttttgtgaccaggaccctagtgaggccacatagaaatgcataaagattttaggaagaattattttcaggacaaatccaatatcaaaactctagatactggggcagggaactgtgatggtaaaggcaagtaaagtctcagggagccagttgtaggagttgtcttgtcgggttcaagttaagcaaggcagtcagaataaaaagaatgttggctgctttctcccactcagaagtttcag

SEQ ID NO: 61648 - DNA, 1017 bp, Bovine  19866880928873
gagggcaggaggagaaggggatgacagaggatgagatggttggatggcatcattgactcaagggacatgggtttgggtggactccaggagttggtgatggacagggaggcctggcgtgctgcagttcatggggtcgcaaagagttggacatgactgagtgactgaactgaacttaactgacacccaattcctgcatcaataaagtgaggttaatgctacttctctctgaagattattttgatgattaaatgaggcagaaccatttgaaaagtaaatcagctgatggaatgctctcactcaagacctgccaaaaggttgttatgaaatttggaatagagtccaaagtctttaacgtggcgacacgatccacctccgtctccctatgtcttgatctttattgtctcacttcttgtgctccgcacacactggcctctctacctctccagcagctcaaacactttcccacctcaggatttctgtgctggctgcttcttctgactggaacactcttctttccaatagtcgcaagccttgtgttcatctcattcaggtctctgtccagggccatgtcctcagagagtcctttcctgacccacaactaaaaacttaccaccactcctatttctttaacctgctttatttctcttcatacctgtaattcctatctgacaatatgtgattttatttgcttactgtctgtccccattcacaggattggaagctctgaggcatcaggactttcgctctttcattgtggactccgcagttcctagaacagtgcccaggactcaagtatttgctgagtgaataaatgatggaagttgtctcagccagtgcttggcgtgtagtaggaactcaataaatatcaattctctttctccgcccttctcagcaagaagcttatactttacagctgaagataagacagtaggagatgggattttttctggatttagttaagccatttagatctttttatatcccaataactacacagcacagagactaacagaaagt

SEQ ID NO: 61649 - DNA, 984 bp, Bovine  19866880964954
tgatcttgacatgtatccgacctgtgtgagcctctatttccttgcctgtgaaatcatttaaaattgcctacctcctaggataggaatagaaagaaattgtctgcccaagggctctgagctctaaaacacaactaacaggagtgagctaaccctgctatcctggttatcattattccagattctgtgtctttagagcctcacacaataaattagagttttctatgttaataacatgggaactaccaatatggtttctcactctttggggataaaatcatgtgcatttcaggtgattgggggtgggatgctcctctgatcacatggtggtggctcaaccctgattcaagggcaggctgggatggttcacacactcaacagctagaggccagtgggtcagcaggggatgggcagagatggataatcattgatttatttttctctgtttgaaaacgagatgtgtgtccctgaggctcctttacacatagaaggcgcaagctgtcctcgtgggtggccacaacatggggaaatcacgttccaggattaccagatgaaatacagagacaacacgcccattgtcctcaacggcctcagcctgacgattcacagccaggaagtggtgggcattgtgggaaggacaggctctggtgagctcagggtccagggcatgccctgtcttcaacattggatttgggtgtcagacttgtcttcagacatgtggtgactcagtgaccctacaaatagttactggggactcattttgtgctagaagaacaaaacccatagtcactgctgtcatgggatcccagtggaggcgacagatgttgacaggtcatcaaataaggaatgaggaagataattgccttggtggtgaaggccctggggaaggagaggggtgatgttaacagagccacggagttgttgggcccttgaactacagtagtctgcactctgaggccaatgtttgcgaggaagggtaacagggtg

SEQ ID NO: 61650 - DNA, 1876 bp, Bovine  19866881048265
ttgcaaagaaggtccccacaaggcactagttgttacatcgcttaggtcacggttaatctaaaacaatacccctcaccccattattcttttcatgatgttaacttgcttggggagacttaaaagattggtctttaaatctgaaatttgatgttgcttctattatactaagctgcctcaaatgtaaattttaaatgttaaagaaatacaataataaatagaaaacaactctgcctaaccttaaaattaaaagtagaattttttattttaaagagttcacagaacagtttacagtaagtgaaatgttgtaagaattaatttcataagcgactttaaaatcaaaataaaatccaaagtagtaactgtatccttgtgacttttatgtctgtattagcattttgactaaatgtagttcataatagtgaagatgaacaaataaataaattttggtggtttggtgttttaatccctaagtcatgtccaactcttgcaatcccatgaacctgtagcccatcaggctcctctgtccttgggattctccaggtgagaatactgtagtgggttgccatttccttctccagaggatcttcccgacccagggatcaaacccttctctcctgcatcacaggcagattctctaccaactgagctatgaggaagtcctaataaattctagtgtttggcaataatataagtttagtccaatttttcttttcagctgattagagaagtgcaaattgtacatcttaactctgtcacaagttctgttgcacgtatcagaaaactcacaaacatgtattttgttgtttgtaaataccttgtcatctttactgttcttaccaaagagcaagtattaaatattggtcatgtactgtcagtggtaatagtatgtattttacattattatgtcctattcttgagtatttcttcatggctatataatctatctcagcatccaactggcctgctagttaaatgcctaacttccagaaatggcaacaatgaagaatagtgaagaggataggaaaaagaggcgagagttgccttatcagaaggattggagcagtcacagagcagggacacactgctttgtctcctgtggcctggctaagtgggcagggcgatatgcttggttgatattacttactattcaacctggaaactgttacatttttcctaccattttcttccactgagagacattaaagtcactccataaggatgccagcagtattgttttgcaagccagccttggcagaaagacaaagactttaatttttggttatttccgtctaactttttcatctctatacctgtgataagccttgtaggcagtctttcaaaggagtgcatcaagagaaagatactgaaatattcgggtgcagtagcttccctgtgttaagtcttcattgctgtaactagtgtttctgcctgtgcactggctgtacagcccctcttttgagacaaaacctgagtaaatagagacacattctttccagatgctaagctttcctgtccctgtctgttattcagttttcgccagaggatttaaggataaagtataggattctgctgtgtaaaactaattccctagcttttcctaatggtgtgtagagttttgattccctaaggcacagtgttatttccagagttttcttcaatttgcataactggtttatctgacttctttcctcagaataacagaaatgaaatgagataacactataaaaatactaaaagcttctcaaattaaagagtaaaattatttacacataaaatgatgaaatattttgggcatatccaggcatataactaccaggcacacaaacagtgctcaataaatactttcctaaataatcatataaaagctggttctgta

SEQ ID NO: 61651 - DNA, 1657 bp, Bovine  19866881075496
tctgattataaattataaaattattctttttttatcattagctattgttgctaacctcttattatgcttaatttatacattagactttatcatagctatgtatagagaaaaacatagtacatagagcatttggtactacccatggtttcaggtatcacaggcgagtgggtcatagaatgcatactcatggataaggggaggggggctattatttattaaaaacacaagctcaagtctggaggtcaggcttttttttcaaggctaaacaactgatatgttagtttctctttaaaaaatattgagtaagaaaatatattacagttaaataatggttttggggaagttttaaagttatcattaactgtatgttatcttacattattctagtttaacctcaaaaaattttcaatctaaagatcatgattttcaaatgactcttatgtgataaatattcttaaggttatttatgcaaaaaaactcaaaaaagtacatggctttctacagactcatatgaacattttctaaactttcaaatgtaaacaaaaattaaaggtataactaatgattattttattctaagacaagtcaaatgttatatctgaaataccattttatttggtttaaaacaacatgtttgtggttcatttacctatttcatggcaaacattgattttctaaaagtctaaaaataaaaaaaattactgtaataattaactattttctaagaacacagtgggtagttcaggtcttgggccaggaaatagcataatgagtctttctgctctaacagtgaaataaaagtcacgtagctttgttgtatattattcattaaggtatgtgtgtgttagttgcttagtcgtgtccaactctctgcaaccccatggactgtagcccaccaggcccctccatccatgggattctccaagcaagaacactggagtgggttgccatttccctctccaaaaggaactaaagaaagaaagaaagtgaagtcactcagtcgtgtctgactctttgcgaacacatggactgtagcctaccagactcctccattcatggaattttccaggcaagagtactagagtgggttgccatttccttctccatcattaaggtatacatagagcaaaatattaaatttcatctgaattagtgaaggccatatattatagaatatttttaaaggttttaaaggtttatgttctattatttccataattccaattaattgcccacaaaatattgttaagcagatatccaactgagggtcctttaatgaataaataagactttgttcgtaaatgtggtggctgggatcttaacatccatagaaactggatggttcttagcgagggcacggggaggggcaagaatacaacagtcaagagcaactaaatgattcaatcttctgagatcttattcattttaaccactgagttgttaaccagatgacacagagctaggtcagagtgctaattaatatgcagcatctctttttttttagcaggagataagaatgtggtttcgtagtttgcaacaccacttttgcaggttctctactgcctttttagaagtacagcaggaaaaagagaaattgactatttctttaaagattttctttttcaaaatggtcatgaaacagagataaaggcatgac

SEQ ID NO: 61652 - DNA, 883 bp, Bovine  19866881143664
cgtccattgaatttgctttcctggagtctgggcacaggacaacttttcatattcagggcctgtgtgtcccagaccagcacaggctgttttgcatcagtacttatacgtgatttctagaagtcctctgggcactctgctgggctgtgcaggggaggcacccaattagggctgaggttccagcatcctcccaggctgtgtatcagggttggggtgtgaagctgcggctgtcacctcacagggccagcagtgacccattggcccctgcctggcctggccagcacaatttgcggatgaccctctaagagctgggagactgacgggtcttttttctgtttttctgataggggaagatcttgggcatctgcgggaatgtcgggagtgggaagagctcccttatcgcagctctgctaggacaggtgagctgcgtgcgcagcgcggtgacggtgcagtggttccctgcccgccttgtccagggtcctggcctcagccgcacgggatgctgtcctcagagtgaacagtgagtcccaggcagtccatgcgtttggcagctccaggcctgaggggccggaccttccacactctctctgctttgcccactgagttaagcagtgagagctttcttgcctggagctccatcttggtcaaagggagagacgggtcattaaacccacggttttctcatgacatgcttggcctgcgctgattagaaaggccagccaggtggcttggcagggaagcacctgagaacctgcaaatcacgggaactttagatccacctccatttcccccgcgtctgcccagaggaggtgctggtccttggaggaggggctgaatgaatgcacaaaccaaagcacacctcgggtaggaatggggggctcttgtc

SEQ ID NO: 61653 - DNA, 1663 bp, Bovine  19866881191936
ctgtgtggtgcagagaccatcgaggagggacgtagagagccccgtccttccacctcctccacctgggctcgcgggcacctcagaccatctctggggaggagggggttttctgcactcgggtccacacgtcccactggaacctgcctgaagccccgatgggagcaaggacatcctgaacacactgagtgctccatcacatgtaggaagggctaggcgggcgggcagcgaggttttgacttttcaagatgggatcatcagcaaagaaatcaccccaaaaggaggatggctggcttgctgagaggtcttcgtgcagacagctgcctgcctcccagcaggtccccaaccccacacagtcctcctgctaagagatcgcccactaggtcaggaggcaggggagatctcatattctcagggagcacacactcttcccctgcttcttagtggattttgaaagccccaatcctattttccaggtgctcactctcccagcctcccttacagcaaggaacaggcatatcatgcacctaagccaagggagatgtaagcaggagacttcagggagacttctgggcaggcttttctctcctcctaagaagtatagatacaagaggagagttccctggtgcttctcctccctcttttctctgccctggaatgtagacgtgattcctcactagcggcagccatcttgcaactgtgcggtataggcataaggttgaaaagctttcacggtcagaagataaaaagcatctggatttctgagggcattactgagctgccagactaaccttgagactatttaaacctagaattcttattgacatcttgacagatatcctgatgcttcagatcatgctgttggattttccgtcacttgtagctgtaaatacccaaactgatctgtcgtttataagttctacgcatcaagtgctactgctgatacagggaggtatcagtggagacctccagggggtcaagaactcctgtccccgccctgcagtagccaggatccctgcccccaggggtcaatggaagtcaggtagggaacctggatttcttcccacctggaagtaatgaggcaatgcctccacctcccttgcaaaagcagcatcacaggaaatcagctaaaagagaagatttaaataagatccagggtttcataacataatacacaaagaatccagataagctgaaagtcgtttgtcataccaagagccaggaaatctcaaactgaagaaaacaagaaaatcaaaacattccaacaattagatgacagagatatcagaattatctgacaaagatttcaaagcagccatcatgaaaatactttcataagcaattaaaaatatgcttgaagtaaataaaaaactacaagttttcagaaaataaactagaaagtccctacaatgaaatagatgatgtaaagaaaactcaacagaaattttagaacttaaaatgactaaattttaaagaatttaaaaagaacaatggatgggcccaagcagaagaatgggggagacagaagaaaaataagtgaactggaaaagagaatatagagatcacccaatctgaataacagaacatttaactaaaagtaataataacagaattgcaaggaccggtgggactctaaaaagattgaggacttgtgccatcggagcct

SEQ ID NO: 61654 - DNA, 2514 bp, Bovine  19866881213880
tttatttacttacctctgtgcaggttttcttcagttgcagtggccgggggttgctctttgttgtggtgtacaagcttctcattgcagtggctttgcttgctgcagagcactggtctagagcgtgggcttagtagtagtggtgtatgggcttagttgctctgaggcgtgtggcatctttccagacccagtattgaaccggtgtcccctacattgacaggcatattcttaaccactggaccgccagggaggtcccaatatacccttctaaatcatatattttagtatacttgcagagttgtacaatcttcatcacaactctgaagcatcattatcatccccattttacaaatgaggaccctgagactcagagagtttatatgtaacttgcctacagtcccagagcaataggtggaagacgggcagccctggagtccaggcaaactgacactctggagcctctgcctttaagtcgtgctctacgttgccttccctggatatccttcagtctgcatcctgtacatcattcagagcttgaggatgtcttcatcaagcccccaccatggcgtgcagagccttgtgacctgggttgcttttgctctcacaggtgtcccactgccctatgtgcttctttgacacaacccccactggccggctcctgaactgctttgcaggggacatgggatgagttgggatcagttcttgcccataatgattgaacagtctgtgctcctggttttggcggtgatcatcatcctgttgataatcagtttcatgtctccctatatcctgctgatgggagtcgtcatcctctctgcttgcctcatttattttaggtgagtgggttctttttgcttgtgaatgaggtttgagtctaggaccgacctagaactggagggtgtcagaggtggatggcccaggtcgctccctcccgttctcaatgcaggatgttcaagaaagccatcaacgtgttcaagagactgaagaactacagctgctcccctttgttttcgcacatccttcaccaccctgcagggcctgagctccatccatgtctatggaaaaactgaagaattcatcaatgagtgagtccttctgctctctgagggtgatggggaatgtggcaatggtggggaacaggaaggaaacagagcacctgggaacagcaccatcgtcagaagactcagagcgatcattgttttattccatttatttcactgcacctccagaaccccatctggaagatggtacttataagaataaaaaatgtaagggatatgaaaaatgtctgtcagttttaaagacctgtgctgttatatacatattttaatacaatgaatggtcagatgtattgccatgttagtactgaatgcatttctttctttctttcacttgcaaacagatatctaaatataataaaataataaagaacaatagttttcgaaatagcagaattttcttcactattcacacccatagatttgccttctaaatgtttgttgaaacaatcaaatcctatgattgttgctgaggtttaactgtgtaacataaacttatctacttgtaagcatcagtcaaacatggtctgcactgaactacaaaaagtttgcagtctaatggaagacaggggacacagatgtatatttttgtaataagacaagtgttgaatacaatgcaatagggagaaacgcaggtagaatgacttggggtttcagaggagaaagtgataacccgcagcttgggatcagggaaggctttggggaggaggcaacatctgaggtggccttgaagccagggaagatttgggcatgggagatggtgtgtgctctgttaactgaaatattgaatgaaccatggtgccagctctcccgttggcactagagagacccaaagactgtgcagagactaggactaagggatcattcagtcaacattgagaccctcccaggtgctcagcacccagtggggatacagctgtgagcaaggtgaacagatacgaagaagggattgctttccttcattcactcacaaatctgggcctttattcattcttgttggcccagtagagtaacttacccatcctgaatcaattatcgaggcgaggagaagagaacttctaataggcctaaatcggtccgagctcactcctagatctggggtcaggtgaactccatggctgagaaaggagtagaaaggaatcctctccaattttcttcgttggttctttggtgagactggggagctggatgctggagaaagcaaccagtgttaggaaaccctgggtcagacagacacatgtgactttcatgttgtcctttctttgtcaggtttaaaaagctgacagatgtacagaataactacctgctgatgtttatgtcttccacgcgatgggtggccttgagactggagctcatgaccaacctggtgaccttggtggtagccctgtttttggtttttggcctttcctctgtcccccattcctataaagccaggctttcagcctgtccgcaggtaagg

SEQ ID NO: 61655 - DNA, 1504 bp, Bovine  19866881216916
gtagagatctataaatatttccctcgcttaggctagtaagacaaaattatcttaaaaacactgtctaaacagtaagtcgtaaaggtttcccagtaattccttgcctttccttactctccttcccaatacaactggatatgagatgtctcttattttagggttacaatggaaatatctggccttcttgatcatctctcaagaaaaggtaaaacagttaaatttagaatttgattaaaagagtctttaacctttcattcaggtatatttgcttgctcaggctgccataacaaagtaccaacacccccagtggcttaaacaacagaaatgtattgtctcacagttctgggctctagaagttttgaggtcaagttgtaggcaggatagtttcctctgagacctctctccttgacttgtagatggctttctttccactgtgtcttctctctgtttgtatctgcatccaaatttccccttcctatatggacataggtcatattgatatagtactcaccctaatgagcttattttaatttaatcacctctttatggaccttatcctcaaatacggtcacattctgggggactgggggggggttatgacttcaacatatgacacaattccgcctacatcagggtagagtttatttccttggatatttgtgggcagaaatgaaagacacacaggcatagacccattgactgcttatcttcaagagtgaaaaaggacatgacacctgtccgttcaacgtgggatgctctccagcagaacatcccaagatgggcagagcagtggtttgattcttctatggtttgaatggtcctctttccatcagagtaggaacaaaatagctatagacattggtttcccctttcccttccatttccaaagaactgggatactgagagcagaggtagatgtcagggatgggtgcagggtggacacatcgagtccattccaggggttagaagcccctgttattagtgcaaagctttgctcatggtgagggtaatgggttgtttctctgagggaaagtagagtgaaaagtgaacttttggaggttgcagatcacatctgctctgactttgattaagcatgcagctgactgcttttaggagataaacaatgtttaataggatagcctaaacatcccatcactcttcctcaagacttggagatttttctgagcagatgagaaagcccactagcaccaatgtcacttaccttcatttgcaggagcaagaaggcttggaaagaaataccggagatgtccacacgtgtccctgtagtggacactaatttttccttgtgtcctctctcatttccactttacatgttcagatcagctggattgtcctttagggaaaattcttgatatccctgctactgaaaatttaccatagttcctagcttttagaaaggtttttctttcagaattaccttggattctatgagctatttatatttcctgcccaaactttgctctcagattccactcacaaacca

SEQ ID NO: 61656 - DNA, 1591 bp, Bovine  19866881284549
gccttctagaaatggagtttggggaaggaaatggcaacccactccagtgttcttgcctggagaatcccagggacggggaagcctggtgggctgccgtctgtggggtcgcacagagtcggacacaactgaagcaacttagcagcagtagcagcagcagaaatggagtactgtatctgtttatagtgttgaaacatcagccaaattatttgtaataaaggtctttatcagtgtattctttttttattgaagtatagttgatatacaatgtgagtttcaggtatacaacatagtgattcaatatttctatagattatattccatttaaagttattataaaatatcagctatattccctgttctgtagcatatttatttattttatgcatagtttgtgcctcttagtctcccacacctatcttgccctctactcttccctcaccccactggtaactactagtttgatctctgtagctgtgaaaataaaatactcttaaaacacacacctatactcattttgtttatgtgtacatagggtatttctgaaagaacccacaagaaatcgatagcattcttttgcctttggggaaagggactctggtctatggtacagcttgggcttttcactgataatcctttttaacctttcagatttttgaactttgtgaatctattatttttttctaaaaatgaataagaactttttaaaagtattttttatgctgttcacagactgttgattggttttgttggttgtcagtataggtgctccagtccttcccaaggtgctctctgtgaccattgtatggagcgcctctgtctcctgtgggcagggacccacttcaactgttcgtgtcctgctgcttctactaggcctgtgtctgagcacagtggactgttgcaaccttctgttgcttctttcccagcctccgctaatgcctaccagactttcttttaattatctgatcgcctggtctctccttgctgacaacgtgttaagtatttttaagtgccaggctcttttctaagtgctcctttaatccttacagctgtcttttgtggtaggtactgtattagtactgtttgacagatgaggagactaaaacacagctcagtggttttcccgaagtcgtacatccaaggaagcacatgacctagtgtgaccctcttcccagcagtttggcttctgagccttttctcttaacttctcctgctacactttccacttctttcagagactggaaaaataaggtagcctgatagctcttctctagatttaattatcatattgcatactagctatgctgacttttcaaatgagatatattaaaaggacattgatgtgaacccatgaaaagatcttcctttccttctgtaaccccattaatctcattgctagacatctaaacagttataattgcaggcatatctcaaatagtgcaagtttggttccagatgatcacagtaaagcaaattacataattttttctggttatccagtgcatattaaagttatgtatacactatactgtagtctgctaggcatgcaatagtgttatatctaagaaaacaatgtacataccttatttaaaag

SEQ ID NO: 61657 - DNA, 1615 bp, Bovine  19866881336818
gagtcccttggactgccggagatccaccgtcctcctaaaggagatcagtcctgggtgttcattggaaggactgatgttgaagctgaaactccaatactctagccacctgatgcaaagagcgactcattggaaaagactctgatgctggagaagattgagggcaggaggagaaggggacaacagagggtgagatggttggatggcatcactgactcaatggacatgagtttgggtaaactctgggagttgctgatgtacagggaggcctagcgtgctgcggttcatggggtcacaaagaatcggacacaactgagcgactgaactgaattgaactgatgggactggatgcgatcttcattttttgaatgttttaaaccaactttttcactcccctcttttactttctgcaagaggctctttagttcttctttgctttctgccataagggtggtgtcatctgcatatctgaggttattggtatttctcttggcaatcttgattccagcttgtgctttatccaggcagcatcttgcatgatgtattctgcatataagttaaataagctgggtgacaatatacaaccttgacatactcctttcccagtttggaaccagtcattgttccatgtccggttctaactgttgcttcttgacctgcatacaggtttctcaggagacaggtaaggtggtctggtattcccatgtctttaagaattttccacaggtttttgtgatccacatggtcataggctttagtatagtcaatgaagcagaagtagatgtttttctggaattctcttgctttttctatgatccaaataattgaattatattaattattaaaattaaatttgaaaaagaagaggggaagggaaaccattagggtacattcacatttaagtttctctatatactctttgaaagttgtattttactattttatttataactcctagctgaaaatctagccttgttactttctttgatctgatttgggtaatttgaaaactagaatctagacagatgtatgtgcagtgttttaattaccatagtttaaaattttgagcaagatgggttgcagtattaatatagatagtgcccagctcatgggcaaggtatgctataaaagtttctcttctactgtatgcttaaaactgataaagatagtaaattttatgttatgtgggcaagaatactggagtgggttgccgtatccttttctagggagatcttccctacccggggatcgaatccacatctcctgcattgataggcagattctttaccactcagccaccaggaaagctcatacattccttaattgcttattaaaaatatgtgtgcatttagttaggattctttcccttagttagagatatcctgtttaaatttgcaaatatttatttttatgctgaggggaagatttttgtattgctaataaaaatgtaacaatatttattttaaaaatattcttccagattaccaaatagctgccaactgccttctttaggtataaggtgctgagtacatgctaagtgagaaaagagcatgagagggtcctcaaaggtgcactctgtagtgatacagaccactcataagcttgcagaaagccctgg

SEQ ID NO: 61658 - DNA, 900 bp, Bovine  19866881397297
aaatagctcattagcaatccagggagtctggccaaggagagcaggccttggacaatcccactgctatggagccaacaagccatgggggacagagtggtttggttccacccacatcaccccctccccagggcaggaggcatgtcctgaggacaaactgccagtgacatgcaaggctcacattcaccagccggcaacaagcaggctgcccgcccaccggaagctctctccccggcacgtggtagaagggaagtcaagtttcctctggcacacccgtttccactgcatgtctctttgctcctgcaatgggtcagtctgaggtgatctgcacagcaggatcatttaggaaatgatgagactgctctgtgcagagagcatgcttggcttggcaactgaagtggtcatcatggtgcttcaacactaatcaaattcctcagtgttctctgatgtagggattttagagccaagtgtcctcattctcagtgaaggcaacatgttactatctggactgacaaagtggaggacatggtgtgaagtgagaaaaatgagcctggaccctggccttctaggaaacgctgttggtgacttgcctggatccctctggtcaggggatgctccagccagctcttgctttcccagggctctaccatttcctcttctcccgaggactaccctgggctgctggagtcactgagttcacaaaaggaaatgcagaagaacctggaagtttacagtcttccaggttaaaggaggccagccccctagtctcaggctggggctctttggaagtgaaactcacactggcagggtcccatgcgggatcagggagtctgcccaggacatggccagaatctgacctctcctcttcgttgtcctgctttccctctgcccttacagatgttc

SEQ ID NO: 61659 - DNA, 753 bp, Bovine  19866881416886
ttgatttgagagtcttctgttttctgggagttggtgatggacagggaggcctggcatgctgcgattcatggggtcacaaaaagtcggacatgactgagcgactgatctgatctgatctgatactatactcctcttgcatgcttttgattacttggctctttttcatctgttgtcttaatgtgaaatataacattgatttgagagtcttctgttttaatatatacatttacagctatgaattcccctttgagcattgctttacctaaatcccctacagtttggtatgttgtgtcttctttttcaatcatcatcagaaagtatattagaaagtatttcctactttctcttttccaacccattggttatttaggaatgtattatttaattttagtttgtgaacttctcagacttctttctggtattgatttctaatttcattctattgtggttgaagtatatactttgtatgatttaaatcctgtatatttactgaagcttattttatggtctggtatgtgaaagatgttgcttgcatattgagaaggacatatattctgctcttgtttaatggagtgttctataaacacctgttaggtctagttggtttatagtgttgtatagatacattgttgatctagtaatttcccttcttttttttcagctgatgaattaattagtcctaaagacattgatcctgttcagcgttttgtccctctacagaatcaacgaaatgtgagcatgaggttttccaat

SEQ ID NO: 61660 - DNA, 779 bp, Bovine  19866881486926
tgggctgtgtgctaaaagtcaagactgcctttggggagcaaccaagcatcttccttttaaatgccattttgctgattacagccctagaggaaatgtaaaccagaggtggtggctgatggatgcacatccataaaagcaagagcatccctggggagctaatcgaccaaaggaccagcttgaagaggaggcttcactgtgctgtgggctgtgtccacggtgtctgggggtggagccaacacatgggtaggccgtcatggctgctgcccagctagcatagcacagacctactggggaggcttcagtctggctaacaccctgggttctccaaggaaagggctcttcaggagcaagcaaggatctgggggaatgttccagaggtgcctctctttctgcaaagtgcaggccatccccctgagactggtctcagggagctgtgctgaactccaggagagaaatcccatcctctcctctgcctgtgtcttcccaaggcctccccactttggttgtcatagcaacagaactataccaaaatgtaatcttggaggatggggaggcaacctcacagcatttcctgggggctccaggaaagctttgaaaccatgggccaaaagctgggagagtttccagcaggcctgagggagagtagacttatcagtcctcaagaggggcctggcctggatcaagtttgggaggcaggaagaggcctgcaggggccctgcagcagatccaggttgactttcttttttttttttttaattttattttatttttaaacttta

SEQ ID NO: 61661 - DNA, 1896 bp, Bovine  19866881957551
ttgaccaggcttccctgtctgcgggatttccaaggcaagaatacaggagtgggttcccattttcttcttcaatatatcatttgtgtaaagcttaaatcgggaatctggactttgaaatattttcccctagtggaatgtaaaaaaagaaaccaagatgattactcttacagcaccaagaaattcaggttttaggcagtaatgctaagaacagcagagacaataacagtgtttcacgcagtaagcatttcttctggtgcaggtgtttacaatcagcctgcttcacagactgtttgccataaaagaattctgactaatatgataacctttttaatggaaacactaataatgttaaacattttatcaaggaatggcacaggcagatgcataaagcctttctgtgttcattaaattaaccttcatttcaatgtgtccaaagatgcttaggctaaagttttaggacaagctgaaaaataattcttcaaaagattatgaataatggccccattatgcctcccccttactgagtaaactgccaacatgtatttattggaaagaagagaactttgatatacctgatttcttttgcaaagtggatgatagagctatgaccaagcatggttgttatactaagtcagaattgtattacatttacaaaagagactacaagtttccatagccttctgctaggaacctatacagtaagctaaatgcagcgcctaaatgatcatagtggtacccacacacctatttgattttcttcccagaaaatgtccatcatcattcagtgcaatagacatattaatatacttttacacgataagaaactccaagatgaaaactcccaaactcattctataaggccaccgtcccttgataccaaaaccagacaaagatttcaccaaaaaaagaaaattacatgccaatatcactgatgaccatacatacaaaaatcctcaacaaagttctagcaaacagaatccaacaacacattaaaagaatcatacaccatgatcaagtggggttgacctccagggatataaggattcttcaatatgtgtaactcaatcaatgtgataaatcacattaacaaattaaaagattaaaaaccatatgatcatctcaatagatgcagagaaacctttcaacaaaattgaagatccatatacaataaaaactctccagaaaattggcatagaaggaacctacctcaacttaataaaggctatatacaataaacccacagcaaacattattctccctgttgaaaaagtgaaagggttaatctctaagatcaggaacaagacaagggtgcccattctcaccactattattcaatatagttttggaagtcctagccaaggcactcagcaaagaaaaagatataaaaggagcacagagtggaaaagaagaagtaaaactctcactggttgcagatgacaaacatctatacatagattttttaatgtattttttatacatgtatagatgtttttctatacatagaaaaccctaaaaaatgtcaccaaaaaaactactagagctaatcaatgaatttagtaaagtttcaggatatacaattaatacatggaaatcccttgcgttcctatacattaacaatgaaaagtcagaaagagaaattcaggaaataatcccattcaccactgcaacaaaaagaatcaaatgcctacaataaacctaccaagggagacaaaaaagctgcatataggacactataagacaataatgaaagaaatcaaggacaacacaaatagatggagagatatactatattcttgaactggaagaatcgatattgtcaaaatgactatgctgctcaaagcaatctacaaattcaatgtaatccctatcaaaccaccaatggtatttttcacggaa

SEQ ID NO: 61662 - DNA, 1016 bp, Bovine  19866880590840
atagcttgaaagaaggtatcttcagattttcacccataaaagtggaatactttgattccaaggtaacattccaatttctaaaaaatgtctactgttgacacttggtatgtgccagcttcttaacaacagacattagttacctttgatttatccctattcattctgaatgtctgttatttgaactactttagttactagggaagcagagtgtaactttgagactcctcatgtcagatgatcctaactggctatgcctctaaaatcagagtgatcctcactgacagaaggaaataaaatatagtgtacttgtgtcgaattttgaaggtccatttcctagtcagacaaaatacaacggatgtcaaaaacagaaaatgtttattatcacacgctgctggaaactccaagttagacaggcatggactcagtctgtgctttgctctttgggtactgtcaccttcatcatcttcactaccaccaccaaccctcttccatactcactgatgggactttccgtattatttcatccattttcaaaagcagcctcagagaacagagcaggcactttcctccttctaggccaggtgagtaaatggagcccaagagggtaactatcccaaggtcgcagagatgttagcaatagtgtccagatctttggcagagtgcctgtgggtctccatgaataacaatctaaccctgatccgtggttcgacagcatcactgactcaatgggcaagaatctgtgcgagctccaggagatggtgaaggagaggggagcccggcgtgctgtagtccacggggttgcaaagagttggacacgacttaagagacaacaacaacaactgatccacgacctccaccaacacctagaaagtaaccagcacaagtcacaccactgtcgcgtcacggtacggaattctcgttacactccagcacagtcccggaaaactgagtgttgtgaggctggaacagtagtaaggccttgcagatttaaacatacagcagggagcaaggaacga

SEQ ID NO: 61663 - DNA, 2881 bp, Bovine  19866880727321
cccatcaggctcccccgtccctgggattctccaggcaagaacactggagtgggttgccatttccttctccaatgcatgaaagtgaaaagtgaaagtgaagttgctcagtcgcgtccgactcccagcgaccccatggactgcagcccaccaggctcctccgcccatgggattctccaggcaagagtactggagtggggtgtcattgccttctctggctttctgattagcggtctattttacacacagtcatggtatatgtcaatgctactctctcaattcgtcccactctctccttcaccagcttaattcacaactccattctccaatctgtgcctctcttcctgctctgcagatgggtgcgtcggtgccatttttctagattccatttatatgtgttaatatatgatatttgtttttctctttttgacttacttcactctgtataacaggctctaagttccaacctacttcactatgacctcatcttaattatctctacaatgactctatttccaaataaatcatattctgaggtcctctaagttaggacttcaaatatatcctttgggaaggggggaaggacacaattcaacccattatgattactaatagtgatagtaaccacatctgcatatgatctacataccgatctcacttaacctaataactatcattctcccttatttgaagagtgagaatctttcattacaagtcccttgccccagcttacagagctgataaaggtggagtcaagatttaaataaaaactctagagactgacccctttactatcaaatgttatcaaaggatgtggtttataccatcaataagccttccatattagctgggattaactgttaataggcttaactgtaagaatgatacattagatgggaacatagggtgatctttaaataccaatatctgttttgttggagaacagtcaacaccctttagtcctcagactctagggtttgagataccacagtttgaaacagctcttgtgcccgtgatataacctgaaacaaaagattttgaagatgccagattacttgaatagtgcatatgtacccttgagctttaaaatgttcacctacacattttacaagccaagaaaaaaaaagttgctaaaatttcctatatagcacaggaggagaaaggtacaatctgtttgcaggatgtatattaagttaaattaaaaatgcatcccaatatatagcgggtgcccacaaacactgtttgattccacttacacgaggtacctgtgtgtgtgttagtcactcagtcgtgtccaactctgcgaccccacggactatagctctccagactactctgtccgagggattctccaggcaagaatactggagagggttgccatgcccttctccaggggatcttccccacccaggaatcaaaccccagtctcctgcattgcaggcagattctttaccatgtaagccaccagggaagcccattatgcactaggcatggatccaaagactgagtgtacagcaatgacgttatattattatatttaaacttatatgtgagttgtatttgaccccactttccctttttctccatcttagcttctagtcaggaagtgaggacaagtattgagcaaataaccagttattgggaagaacaggatactttggtcacttagagcagaagactaacttaattttataaaatttgtattggagtatagttgctttccaatgttgtattagttgctgctgtacaccaaagtgaatccaatatatgtatacatataccctctctttcttggaatttcctttccatttaggtcaccacaaagcattgattagggttccctgtaaattctcatttataagaaacactgacttaatcctgagattggaagagatctcctttcaggagtgacctccaggtggtaactgagaatgaattttctgttttagaattttctggatagaaaggaaagaaacaactcttgaaacaaagcagagtggaagagatgattaaaggtttttttaaagaagggtctgatgccaaagggcaaggggaaaccaggcactaagccaggaccctgtgtaacacgttctgtttgtgctattagatttaatcccgatgaccacaaggaaaatgttattaccacattttcttaaatgaagattaaggttttttaggtggaattagcaaatgctcaaagcatcataagctaaaattctggctccatattttctaaataacttaatcacaaaaatccttttttaaaagacatctagaaatgttccattagaatgtgataacagcttttcatttcagaaagagtttataattgttttaatgagaaagagaagaaaactgaggtccctggtagaatagaaattctctttctataatttcaaaatattccaagtcgacatgaaaagagtagggcaatctgtgcttgaagttcttcatagattttgaatgatcattgtaacagactgttggaaattcttttttcgtgtgtctgatgcattcaacaggagatacagctgaatcggtcagaggcacaatcttcagaacttttacatgacactcagccccgcgtaaaggctgcttcagtgcaaacagaaacaaggaagggctcctcgctctccagtaggatgtacttccaaagcactttcccacatctgttaccaccacttagtcacctctaaaaccttttcagtcatttcaccgtttcaggaaaccgttagtgccatcctatggatgagagaccagagacacaaggctgcacaggacagtgagcacctacagttgagcacagggaactctactgtgtggtggcctaaacgcgaaggaaatcccaaaaagaggggacatatgtatatatacagctgattca

SEQ ID NO: 61664 - DNA, 832 bp, Bovine  19866880841335
ataatacaggaaactatattcaatatccagtaataatatataatggaaaagaccctgaaaaagaatatatacacatacatatataactgaatcactttgcataagaaactgataaaacattgtaaatcaactgtacttcaattaaaaaagagtgcttggcataagtgttagccatagtaataattgttgttatattattaataattttatagtaattattagttatttatgaataatatgttttttttagatattttagctatctagcatattatagtaaaaaggtggctttgtagaagagtaagattccataattatctagtgaaattggggccataaatcattgaacatcttgctccatttttgtgtgaattatttggattgactaagtgctcttgttaccgggctgggttaccatctgctgtgttttgcctccataggtcaggcttgtcctcctagggaatgaggaggtggaaagaaaggccaataagcgaactccagaatgtatcctaactgtcttgttcacatttataggacagttttattgctataggtaagacggataactgggcattattccaacatcttggcagttttcctttttcaaggtactaatattaggattagcatgttgttttaaagacattgcctttctgcaccttataattgcttgttcttgggggaggcttggacggtttgaattagggtcttcctgccaaatatgcaagagcgtgtctattttgtttgaacactttgcttgatttttgaagttgtgattcattttgccggtagaacaaacgagaggccgggggggggggggcgtgctgcacgt

SEQ ID NO: 61665 - DNA, 1013 bp, Bovine  19866880969374
tttggtattttctctccaggcaatgattctcaatcttggcctgtatgttagaattacctgggggagatttttttaatcataatgcttaagccactccccagaccaattaatttagaagctcctgggatgggacaaaggcatcagttttaaaaaacagtgggcagccaaggttgagaagcactctagctccagcacgttgatcttgtaggtagaaaccagcagttaggcttgtttagtatcttggtgaaaaactgaaatcataaaggacctctccacggccaaagagaagtctttcctagctcttcagtctcattggtacctacctccatagcacttggcctgcccttgaaattctttcctctggttgctgagactatacactgccttggcctttgtctaaccatctgtactgctcctctctctccctccccccgccatgaaaaccctgaagtcaattgctctccaatattcacagtctatggttctttctctccaagaaccttgccagcaaatacatttataaaactacatctccagccctagtccctctcacaagttccttctcttatatacctccacatggatgtcttgttggcatctcaaatttcacataaatgtgtaaaatagaacacacaattcctgcataaatcagctcccccttacgacttccttccataaatccagccacggttttcagggttatctttagttcttcctcctacagtctatttccaaagtggcgttggacttttctgtgcagtatcacttttacgttcttatttccatctttaaagttcacatcctaagagtttcctgtctagactactgaatcagccttttgtctaatcttccttcttctgatactccctaccacaaagtaatcaataccccacagtcagattattgaatacaggatacagctccaatcatgtcactcacaacccattgctcaaacccattaataactcatcacctgctcacattcgagtataaacctcctggcaaccaattcc

SEQ ID NO: 61666 - DNA, 1227 bp, Bovine  19866881337765
aaatcccatttaaaagaaaatcatgattagctggtcaatagttctaaaattatctaaatacagaagaaaaatataaagtggctcagaatttttaaaaacatcttctagaacacttttaagtgagtgaagcctaaagtcaccacagtatactgagaagacagagtcctaattccattttaaaggattacaaatgttatatattacactcttgtaatgcaattaccttctctacttaactacctcagtaaaatttagaaatgtgattttctattcttttaatgttaatgtggattaaagttgaagggagaaaacagaacatttatttaagtgagcagggaagatgttacagggtatattgctgcttttataaaaaagggtatacattgactttgacttccctacaaattctaccttggccgtggtcaatgaaagtagtgtctccctctgggatcctatggcatttgaaactctcatgatactttttatattctgcctgatattaattcatgtgtactctgctttaagttaggcaagttataagatcactcagaacatgagtttttgtttataaaactgaaataagctactcttaagaatctaaaaagattaaaatatacttgtgaaagcaccctagaagttccatgaaaaacagttataatcacattctgctttaaaggcgccaagcagggtggccacgtgcagcactgcacacacacctccagggggcgccaggcagtgaccctggcaccacctggaagctaaccatctttcccagaacagacttttcacacacatttactactcagtaatggtttctgaaaccaaagtgaattctaaaaatgtaaaagaaaaccagatcgttgagattagccacaaaactagcagaggctgcctgttaatacaaaaatctgatgagtgacagggatcaacagcagggtgtttcttaccctttctttgttcaattcaaaaatactctggcctgatatcttaattgaaggtaattttttcccgacgcatacttgtactttgattatgttcagatccttcaaaaggaaaaagatgttctgaagcactaggtcacctttatatttctttcccaaacaatatcttgtcctttcactgaactttagaggcaagtgactgactcaatccatcagccctgtgttctggggttaaccataatcggttaaaacttggaaactcaactaacacaacctgtaaaaacgg

SEQ ID NO: 61667 - DNA, 1158 bp, Bovine  19866881371506
atggaagaaagatgcgggtcgctccaggttggtaggtggccggtgtaattagcaggggaacttacacaggaggcttttcttggccagatgcaagatgagcacatttctgcacttgctcgccagaatcttaatagtttatgtagagtccttaatggggttcagtccaaacaactcatggtcaacttgtgctcacatcctctccatgacctctgctgccgacagagctgtgcgtttacataacacgcggttccagtggtcttaggagatggaagaggcattattaggagttggatgtgactcctgcatgatgaccaacttgtttctggatttagggaccatgagaactttcataaagtggaagttggagcaataagtggcatggacaagctacattttaagttattttaaaaatactttactcacactagaattattataacctgtcaaaatgtgactaaagatgtcaacaaaattcttgaaatttttcagattggtaggtgctaatgtacttgaattaacgtgacgaaatgtgatgatttagtaactttattttaatgaacaatgtgattgattttaacctttaagaaaagaaaggtaatatgggcatgtgtatttactttactgtggagaaagttctcctttaaattcttaatacagtaataggccttaaaacatcaaatcttcatttggacagtttgcgtttcatagctgaggacctagttgtggttaatttaatatcttattcatttgcatttattaatacaatgctgggaaattatgctgcattcttcttacagtggtgtttttgctgattgattttgtctctgaaaagataacaagacactaaagccactattatagttcttgaatgaggatgtgaaatacagggcaaattgtgggaaaaaagtgctgtcctggaaaattaatccttttaaagtcagagagattaaacaattcggaatttgaaaaaaaatcacactgaaagataaaggtatataagctcacttaactattaatgatacaaattaatctgcagagaattaaaagcagctttgttgatggtagaagacacatgtagttaataaggacattacatctcatttggggttaggttggcctctcatttattaatatctggttaaactacaaatagaaaga

SEQ ID NO: 61668 - DNA, 1765 bp, Bovine  19866881418212
caactgtctcaattaccttagctttatctttcaaatcaggggatttgatatcatctctgaggtactttagcaaatttgagaaatgtaaaaacaattattaagtcagagccaaaaaaaaaaccaacaacttataaatttataatacaaagcactgactagccctaaggcataacggtgccactgtatccagtttccatttatctgctgaactgagacactctagggctttggtattcttcctggacttttctggctcagaacacatgtatatctcctctacagttaagtagcagcaatccccctgatgacataaataaagaacctgagaagatctaggtaggtgtcatttcccaactactaaagcaaagtgtttaaaatatgctacaggaatataagggatgcgctgcagtgactaaataattctgaaaagcaggaaattaagggcttcatattcttcttctctccttcaccaggggatcaaacattccctttagtgctcctaagaatcttctaatccctccatcttcccctctcctaaagagccttcccaacacacacacacacacacacacacacacacacacacacgcacatattttcctacagattctctagccaatgtaagtaagggcgctgctatcctaggaatgtctccagggttcaccagaccctgtcaaactctgaccttcataaaatcaaatcattattcctatctaatcagcccagtgtggataaagtgctgtaacatacagcctgtctatacaagcactgagtcacttaaataaaaagcaatatgtttcgcttcttcagctatataaatatagacttgtatatataaaaacaagcatcatcccacatccacatatatatggcatgggcatgtgagaaggatcgatgatgtttataaatgtctatatgtatttatatagagatatacataggctcccaagcaaaatgttccttgtttttaaattctctgattttggttggtaacagttatttcttgttaaccacatagtaaatatgagactatcacattctgtaaaccatgaaaggctgattgagttacattttccccccctgcaaatcatattctgtgaatttataaagggagacacaagttttgaacagagacacactgctttagttttaagtaaagaattggttaaagaaaatctgatcatacagaaaaagcaacagggaggttccctggtgcctcagcggtaaagaatccgcccgacaatgaaggagacacaggttccatctccaggtcaggaagatcctctggagaaggaaagggcaacccactcttgcctggaaagtcccatggacggaggcgcctggagggctacagtccacagtcacaaaagagtcggacacaacttagtgactaaataacaactgttaagaacagtaacagaagcaagcctgccatttattagatccaaaatcaaacataatttttggagattgctctgagttgtattcctactactaattaaccaaaaaattcatgtaaaaaagatttcactctgaaatcactgtgctccttaagcgactatagagttgtggcatttcttcattcagtctgtccttcataatcccaagtctaataatccagtttgggaaatatctaggctttggtatccttttctttgctcacatttcttctttggcttctgcactatgtcacagcgacaaggcagagagggtcagaaaaactggtgacatttctaccagtcagccttgctctgaactaggaatt

SEQ ID NO: 61669 - DNA, 1020 bp, Bovine  19866881700704
tgagcaagccgggtggggaactgtgccctgtgttagaccctcccgtatgttttgttttgatgcagcacctccaagaatgggctccatcaggggggtgttctgctggctgttgactcggtctcagcttcccccagtgacagcctgtctcaacactgtcgatacctcttcattgttgacgacgagcagacctgacggcaggttgttctcgtctgttcacttaacgacttcgctgatgacatgcaggtgtgcactggtggtgtacctagtcttgaaacttccatgttctcctgggtagaaggagggctggctccattagcttctagccttgtgagaatacagaaaactgttctgggcacttgccagctcaagatgagccatgtatggtcataatgaatccccgactcataattttcaagctagcattatgaaaatgttaggtcacttcgtctaacagaccgaaatgcatcgagaatgtgctttcagttggaggcatttgaggaagttattctacgcctgacacatgacaagtataagattgttcagcctttaaagcaagttatctgcacatgattccaaacattcagtaatacgttggcttcagttttactcatccttctagagagagagagaccataaacctgagggtttatgcatatgagccctgcaaataagctgtcctgatttcaaacctagcttagagcaaggtcctaacttcactgtgactcagttccctcatatataccattggaacacttaatattacctcccttttagagctaacattaatatcaaaccatgtctggcacatagtaggtgctcagtaaggtgagctgttattaatggggctgaaagcaaaaggaagtgaaattatttttctttagactagagaaagggtctgagacctacctggtaattcaaaacaggccttgagctcacctcttcacagctgtatccaacagataatatcccccagacagtgccagctatcagtggtgattgagtgatgatcctttatagcca

SEQ ID NO: 61670 - DNA, 1098 bp, Bovine  19866881761592
gaggaagggcgggacggaggtgagtaggggcaaggaagagcgaggaggggaagagaagaggggggcagagagccaggacggggctccagaaatcatccccagggcctctggggttgtttaacttcatcctttggcctaacctttctccagacatcaaacagatcatatcaacgtaagtcatctctcttcttctctgaaagatgatggtcaataacagctttatgaatcgtggtgatggagttaagtgagagcaatctgtgattgactagagttcagataatagacacctattcacccaattttttgagaaaaagcaaaggtgaagttttagttctaataagaatacagtatctcatgaacttatggagaagactttgaggttaccagttcaagtatggcctgcctgtttttaacttgtcaaatggaaaggtgtctacagagtcttttatgacttggatgaagccttccccatggacttaattgctgggactctctcatcaggcttcttgctgatattccgtggaatattcccacctgttttgagatcagtctggctcatccatcacccgtcagggatgctgtcgaaaacagggccacatttggcattgtggcaaccactctaatgcaactggagatttttgatccacctctgattttattgtctcaggccaggctggtccaggcctttgtctcattcactatacatcttgatagttcaactgtgtttaaaagttttcctccatccctggtggagtctaactccaaacagtggagaagggaaccatgagacctggaacagactcatctactatggatcctcccaagcaattggaactctgagtaaacatggaaccaatttcagggacagatggagcatgcgtgtgtgcacacacacatacacacaaacacacacgcacattccctcctcttggtgtctgtctctctttctctctgtttgtgtctattttctcttctcatactttgcccagattttgaaataaattctgttttttccttacttctttcacacaacttgaatcctcagatgctatgaaccttatatttctcattctatgatctaccaagtcactgatgtca

SEQ ID NO: 61671 - DNA, 914 bp, Bovine  19866880359190
ttatacattttacctcagacttcctttctatggcctaatgaactctaagatgatatagaatggttactttccttcaagattcttttagctgccattttccacaaacagatttttatagggagccagaaataagccaatgcagtaagttcctcattgcttctttctcttttgtgagattaaatttccaacaaggcaattcaataatttttccgatgttttgcctttagtggagtgggattttcatctgaagtctataaaggcttacattgctgctctatcttgcccgtccatattaaccatctggttacgaggtctctgatgtaatcccaggataacacttctgttctcctttcacactctcctgcagctgcttcctgcatgctttaccttcaggtatgtggatttccatgcatgtgcacatctttttgacatatactgcttctcctctagctgttcgattagacctatttatttcaaacaagatacacctttccatcatcatattccagtcaggaatcacatttcaaaatatcctcgcaagacttaagagatgatttttaccaaaaaattattttcgtgtgttttaaagttctgtttgatgatttttcatctcctacttgtctgtatacagacaattgagaatgtgagtacctcctgcccatttctctggtatcttctgaaaattgctggggaagtcctgcagtatttttctttctgcgccatcccttttatgcttcatagtatataatatggccttacagttttctctgagtacttttctccttcccctcacaactcaattgaaataataaaccactcgatcaggctgactggtctcctgccaacactgtcttgccagtcttatgagatgcagtccatctcctactagaagcagcaggaagaagagatgaaaa

SEQ ID NO: 61672 - DNA, 1938 bp, Bovine  19866880360164
tgggaagccccctcacctaaatcatgctgctactgctaagttgctcagtcgtgtccgactctgtttggcctcatagacagcagcccaccaggctcccccgtccctgggattctccaggcaagaacactggagtgggttgccatttccttctccaatagttctattcaaatgtaaggggacacagttattgtccctttcatgcaagccccccgccccttccccattaattcccactccatctggatgacattgaatgaatagtcacattccctttaagagtcgttttatctctgcctgggagtcagacactgcttccccgtgcttttgttgtttcactgtaccgcacttaccccggcacacctcgttcttccctctgctgcttcatcattgccttcatgttttctctacagtgtttcttctatgcttgacataaccatttttccttcttccctttttcctgaggctgtgggttatctattttcatgcttaatattttttctgtcccacccatctgtttattttagcttgtttgttctctcctctgctggcctctttatagattcctctgttcaatagtttaaactccatgacaatgctttgtttatcctctcagctagcacagtatattattccccatctgctatagagagggccccagtgccccacaaagttaactaagcccctcttgtctgaacaagtttttcagccatgcattcaagtttctaatctacccccatcttccctggttatgagtgtgacaatattatttctaagcaagccatgctcaatggatctcatcttttgttcttctttttctttcaaatacctcagataagaagtaatggtctgctgctacagacgtaggcagtttcaatatcagtcactcagtaaatatttattgagtatttgctatgtgactggcagtgtgctaaggactgggtctatttccagagacatacaaggtacacagtccaaggcaccacaattttcctgatctcggaggacatgtagtgctaacatatatttattatgcagtcgctgcaatccaggaattgtgctagaaactgggaatacaacatgaattttaaaaagaaagatatctatctttatggagctcatagtctaacaagggagaaagacacatgttaaaaattatttacagttcattcaaatatgtacaaaatgctctgggaacagagaggagtgaaagggattagttctgcctcgggtaattgtggaaagcttcacagagatggtgatatttaacatggagtttaataaattagtgttaattaagcagagaattaataataaaagctaatatttattgagtacttatgaggtttcagtcactgttctgcatgcctgtgaattaactcatttaagcctcaccatagccctatcaggtacccatgttttccttagtttactgattaagtaattaataaacagagaggttaaataacttatctaaggtcacacagctagaaagatgtcaaaaccaagatttgattccaaaatctggctctagaacttgagcccttaatcactatcttctactgtctctcatgaaagggagaaaaaaaaaaaagaaaagtggcattttaagcatatgagtatgttggcaaagcatagtattaatacataattagaataatttgcagccatgggatcttaaatccaatacaactcattcttttgttcaataaaacttatagaaaggaccaaactagaggtaataatgaggaaaataatccagttttctccattggtcttaatataatgtgaaagggcaagggagatgtactgattacacatctaagaatttcagctggagtaccaggagttacacagtgacctaagagtccctaagaacttagaagtctttgctagccaacatggtatccaggttctctttgcatccttggaagctaaaaa

SEQ ID NO: 61673 - DNA, 1718 bp, Bovine  19866880371174
caaatcaattctgctcactctttggtatattttatttatttgatgaatatctaattagcagttgtttaaaaaaccttggtttaatagacattttgtactttacatagttaaaatagaacccttgtgcttttagtatgtcagcctgctcttctatcacattttttccactttagttagtggtttcacccaataaacttgatactcaagcaaaggtaaaaagaccttctagtttgggtggcatatagtccaaagagtcagagttatattacaacatgaattttttttcccatcttttcttcagttcattgcaatcctctgaagtaggatgagtttccattccatttaacaaattaaaaaagaagaaacaaaaaaacctgaccttccatgtttcccaggtcacaaatctgtcagtggctaccaggcctgagctttagttagcatgcaagcctgaatatagggaaggcacagagaacagttcccaagaaatcagtattcgaatgttaatataaatattatcattattaacttaaaattaagagcaggattaagctctaaaatcccaaacaaacctgaacattctatgtaagtgttctgtctctcgggaatgagggagctgtgatgtcttgacaataaaatttaaagtcgtctacatgcaatctatgtaaactttctgtgacaacatattactttataaaggtacttgaactgtaataaattctataaagtgaagatgaaatgacacctctttgaagtcttcttttctaaaatgctaagtgtccataggacattaagtaaataattcttcttctgtccttttagaattatgctgaatatttttacttcaacttcatagaacctcctaacctagattcacacaggagctgaaaaggccttgaatagctttctattgttattgtgtttgttttaaattattaccaacattttaaaaacaggtggctgacaaaaaaaaaaaaaatctacttctttcatctcttgaaataaagaaggtatggccacacttgacctataactagaacttcgttaggctcctttaaccctctatgtggtacacataaacagcagcagacatttgaccaaggataagtgttcactcaatatggattttatcagtatgtacctctctgattcaaccttaaaatattgaaaccaagccttcccaggattttgctaattttctgggttcttgacattgaagattctctagattgccttcttcagccagcagtacttttaattcttagaccctccatcagctaccaaaagaaaaatagtagggagtagagtgtggcgtatgggataagttgccttgtcttcctaccttcctattttatcttccacatagcaaaaaagaagagcaggaggcaacatgttccacaggactttgtaatactagttacataactccttaagatgattttttgtgcttgccatcagaaagcatgtatttttaaagctttttcttatttttcataccagctgttttcttctttgccttgagtcaatgatgtggcacagactctcagaattgaaaggaaccttgaagatttcccagttcaacctccttatttagaggacaggaatttgggactgggaagtgatctaaatagccttagtctgagctaaccaactagcagagcccagcgcctggaatgcccttgtcattgacccccgtctagtgtgctgaccagtattttcta

SEQ ID NO: 61674 - DNA, 2513 bp, Bovine  19866880373796
tttgtggtgatttacttaaaattgtatatttagttatggctcttggattctaagattgggggaaagtgtcttaatataagaaatgaacacatttatatattgaaaaaactatgtgtgcaataagtgtttagatgaattattaaacagcttagaaatcaacataaaatggtatattaatttaataattgtcattgttactataatcatacctcaaatactttaaatttaatatacttttgtactgttcaactgcagggttttgtatcatgttttatgactcaaaattgttgccttatctctgcttaacaccttccaagaccttcccaattcaaactcagccaggataaatacaatatggttagattgtgactttgaatttcaggcagggcttctgcttctagttaggagacagaaagccaggagagattatactcccaccctaaaaccagaacaaatcagataatcagcaatattggatttgtttaaaacccatccagattaaccccaatgaactaaattccagaaagcaataagctcttttggggagagaagagactcttgactgcttttcttcttagaggaatggtgggagggggaggaaatcacaatagagaaaccaataaagatttaaagaatatttagtggatgtgtctggagtggtatgatgtttgagaacctcaaagagcccaggcagagaacctgtcagctattagcaaccaaatctttgccatgtcattttgataccattcacctcagatcccactccagtactctcgcctggaaaatcccatggacggaggagcctggtgggctgcagtccatggggtttcgaagagtcagacatgactgagcaacttcactttcactttcacttttcactttgctgcattggagaaggaaatggcaacccactccagtgttcttgcctggagaaccccagggacggggaagcctggtgggctgctgtctatggggtcacacagagttggacacaactgaagcgacttggcagcagcagcatgcagaatgcatcatgagaaatgctgggctggaggacgcacaagctggaatcaagattgccaggagaaatatcaataacctcagatatgcaggtgacaccacccttatggcagaaagtgaagaggaactcaaaagcctcttgatgaaagtgaaagtggagagtgaaaaagttggcttaaagctcaacattcagaaaatgaagatcatgacatctggtcccatcacttcatgggaaatagatggggaaacagtggaaacagttactgactttatttttctgggctccaaaatcactgcagatggtgattgcagccatgaaattaaaagacactccttggaaggaaagttatgaccaacctagacagcatattaaaaagcagagacatcactttgtcaacaaaggtccatccgtctagtgaaggctgtggtttttccagtggtcatgtatggatgtgagaattggactataaagaaagctgagcaccaaagaattgatgcttttgaactgtggtgttggagaagactcttgagagatccttggactgcaaggagatccaaccagtccatcctaaaggagatcagtcctgggtattcattggaaggactgatgttgaagctgaaactccaatactttagccacctgatgtgaagagctgactcatttgaaaggaccctgatgctgggaaagattgagggcaggaggagaaggggacaacagaggatgagatggttggatggagtcaccgactcaatggacatgggtttgggtagacttcgggagttggtgatggacagggaggcctggcatgctgtggttcatggggtctcaaagagtcggacacaactgcgtgactgaactgaactgagtgaggtacatccatgttgctgcaaatggcattatttcattcttattaatggctgagcaatattccattgcatatatgtaccccatcttctttatccattcctctgttgatggacatttagggttacttccatgtcttggctgttgtagacagtgctgcagtgaacattggggtgcatgtatcttttcagggagggctctttattgttaatatcaacttgagtctaatctattcttcctattcacattccatctccctgcccccctaagacatctcttctttctctactgtgtggttttgtcatattgagcatattcacgtaatgcagttagaacaatgcctagcacttagaacattgctttttaaaaattagctttgctcttcctccttttcttccttttcctcatggtcggcttctattcctcatttctctgattcctgttctagtctaggttgagttacatttctgaaaatttcagatcagcatctcaacagcagttcccagttgagctctacctattgtccagaccatagactctaccctttctctccttttttgcctcctgatgtttcctatctattttaagccttagaagtcttaacttatactgcagcagggaaagaggc

SEQ ID NO: 61675 - DNA, 2292 bp, Bovine  19866880376076
taaaattgttggacatggtaaaggactggatgaaaacagggaagacaaaaagtggagaagtaactattttgacttttgaaattgagtttgaaatgcttaaatacagaaagtggtcagatacgtggatagaagtccaacctggaggtatagacgttagcatcatctgtacagaaggggtgatcaatcagcatggaggagagggaagaagtctcaaggacatcttcattagatctgaactagttgatgatggacagggaggcctggtgtgctgcaattcatggggtcacaaagagtcggacatgactgagtgactgaactgaactgaactttattatatgtattactgaatgtgaatggaatttacaacagagttaaccccaaactactctacctcagaatctaaatggttgacatgcaattgtatttgcagaagagatagcaaatgaccatgttgtttaaaatgctttataaaattttatttaatattatttgatcatacagattttgtggtaaatgtgcatttctaaaagtgcataatcaaacatttatttttctcttgatcttgcatttgtcatagaaaggtgctatggatgattacatgaagatttactacttatggattcatattaaaatatgccacaaagaagagataaacaagtttataagatgctatttgctgattttaaaaatcgaggaatataaaaaatattatttggcagtaacagaaaaataccatttcttttttaatcactttcgaaattcaacatggacactaaaataaagagttggtaaagtggtatcacccaatataatatatattacccatactggatttctcattcttgaataaagaagcacatgaccccacttctgtataatctgtgctgtgttcaaacattaattgctaggatcacgaaagggactatattagaagcagatagaacagatctgtgcacagcaaaagagtggctttaaccagagttccatcctaatgtcttactttgttaggaacatagtttaaatatttaaacaggaatgtcatgttgattcattggtagcatttggacacacatctcaggcctgagcggtgaatagcatagcttgatacaaatggttactgaacactctcgccttcagtatccagttatttcagtgaagagaccttaaggaaagtttcccaaaccctcattggctttcttttgctaccacagtaaataattatttgacttcatctgagctttatggagctaattacttttgcttagaaacagagttaaaattaaatgtaatttttaattataaaatgtttccttggaaacatttgttgtaagttaaattgtactttgttctaaaatacttaatttcccttacaattagaaatgaaagacagaactcagcatagggcaatttgaaaagtgtagcattaattgctacaaaaaagttaattttttcataatggacaactgatggtgaacatccaattaactgttccatagttatattgaacaattctgctcagaaaagaattattctattttatgaccattaattgaatgatcactggaagcagacatttttaaaatttagaaatttctttagaaataatctttttttaaatttagaaattatatgtttgaatttagaaaaagctgagcataatgatcactattgaaaagatcagcataagtaggtgaccctcgaagttcactgcaactgtttcacaaatcaccttaacacacaggattcacagccaagggcaagcctctctttggttcataaggtgttgtcctggaaaccattttgatgcagtcgataatagggcagacggagagacacagggtacagcctgtacaagtgtcagtaacggtgggcaggtgggtttcaggatcaaactggatagcctgcaaacagaaataaagagtcttgctgtcactgcccacaaagggcaagaacgcccctattttagcatcaacgtttttctccactgcaggagagctgcacttggagacagctacgcccagactgtggtgcagctatagcaacagttgagctgctagagaagaggggggaaaaaaagacaggaaaaaaaaaaaatccttttaaattagaaacacgatgtttaaaattccttagaggtatttttctttctttgtgtgaggaaaatatttcataacatagtaactctctagtttcctgcattgtgagcagactgtgggtcctgccggtctgaccatgacctggtgggtcggctgcctgaggcgggcagggcgcttccacaccttgtccttttca

SEQ ID NO: 61676 - DNA, 1208 bp, Bovine  19866880694564
taaagatggcaagttaatacctccttgaccattatttaattttgcatacatcaaaagaggcctaggacatggtagtgctaatgcttatgaaactgctaaagcaatatcatgtatctactttaagataacagattttgagaatatcctgagacaaatttttaatgtatatgaagaatttaataccaaatttaatttctttgtattttttctatttctcatatgctttctaccccaaatatacacaaactgcaatcacacttggtttctatgaagtcaatgaagattgacatttagagcttttctcaaatatgtatattgtttattgggctttgactcttgggtggaatttgaaaataacataatttgtctattggtaaaaggcctcactgtcaggcatgtcagcatgtatatatccaaagctgtggtctaatcctcaagtaatttttgaaagaggagggaactagagaacaatataaagttttctcaccatttaatggcaaatataaattactacctaggccagttagatttaacaagaatttttacatggttaataacaaagaaccatataattcgatccataaatgttttaatctactaagtgaagaatcactacccaatagatgctgcagtgacaagcacatcccacttaactaatcagaggttttcatactttagtgtgcatcaaaataacctggaggggcttattcaacacagcttactggggccccatcccagtttctgatttggtaggtgtggggtgggcctgagaatttgcatttttaacaagttctctggtgatgctgaagctgctgatccactgctctaatgtatcattgatctagtttcccactgtctaattagagctataagcagtgtgctgttttggggcattttccatcttagttaaggaagcattaatgctacagaatataaggtttgatgaaacgaagatgtggaggcatcatcagcatattgatgtaattctgattccaaatgtctttcagtctcccctgtggcctcacacacatgctaaataggatgctactgaaaaactagcacttcgcagccaagggtccttagggaaaccagccaatcattcagcactatcctctaagaagatgagggaaaatctgttaataattccctccagaactttctgcaagcttaaatagggagattaaatttcagaggataacagaatcccc

SEQ ID NO: 61677 - DNA, 1234 bp, Bovine  19866880875691
tatggggtcgcacggagttggacacgactgaagtgatttagcaaccagtaaaccaggccatatatatatatacatatacatatatatatatatatacacacggacagcttaatctttaccttaacagaaggaataggtttttttgggataaaatggtttctttcaagtggtagaacggtcacattttcttttttcagtctcaacttttcctctgctatgattttcttgcgcttctcaagataaggtccaaagcttggcagtttctaataggaaaacacacaaataagaaagcatgttacttcacagaatagaaaaatgtgagaatataaacacataaatattatgaacaaacaaaatgtgtgtttggagattggttcaggtaaactgcaacaaggtcttcattcttggaccattagtcttctaggtattagatttcattaattattaaaaagaacacaatatcacaatacctttaccaaatatgtatgtgttagatatacaaatgttaatttaaaatacatctctaaaaacagaataaaattcacaatggtaaaatcagaccactcacttaaaacaatagctcttagttagacaatttgtttagttcatatagacagaaggtgaaacctattgatggtttttttccttttcatcaggtttttagcacagtatagacacagcccagtctctgacaaatgcttttgtcaatagcaaagatactttgccaaagttctaatctgtatctctattttattatgttcaaattcttactacatctctttaaagattgtaactaacgtttattgcagtctactggaatagctgaaaaacagaatggtaaaaatattgatttctctgtacagaaaataaactttatttgcatgaaggtggcaaaaatagaaacaaaaagcaggagaaatatcacattgcttaaacaaactccatcagtattcaaaatcacattatgtagctttaaatctcaaggttatccaattgtactttacaaagttcatttagaaagatacctgggtgtcatggaaaaatgctaagtggtttcaagttaacatgaatatgccctcctattattcattatcctgtaattatttcctcttcactttgtccttctcttctagaacctttgatcttcacttttactgacatatactgctgatgatgggcaccattgaattccaaatgttacgtgtttgcttggaaccctggaactgctaggcct

SEQ ID NO: 61678 - DNA, 2251 bp, Bovine  19866880891744
ataaagattgccatgacttgcataaaaattatttctggacctccaccatttataatgcaaagtaaagttcacttaatatgtaaaaaggcatcaaacttgtcaactgaaaggattaatgtgtctctggtgcctgcaaagtggtgcctgatggcatctacgctttggctgtggcacgcatcttctgccaagaatgttctgggtttcaaggcacatttctgaatattgtgcagttctatattgtgtggataattcttctagttctcacatggattgcaatattattaaaaggattattaacaaaaacaaaagttatataatataacaaaatgcgggataatctgagatgtgttaatttgaggcacatgtgtctgtgtgagtgtgtgcaggaataggtgaggaaataaacagcttccatgagattttctcagctctgtgcctgcgtgcttagtcgcttcagttgtacccaactctttgcaactctatggactgtagcccaccaggctcctctgtccatgggattctccaggcaagaacactggagtgctttgccatttcctcctccaaggactctttccaacccaggaattgaacccgcatctcgtgcattgcaggcagattctttacccactgagccacctgagaagcccttccttagctctaaataataattcaaactgaatcaaggaagtttggatcagatgaaggaagaatttcctgacaccacagtttggttaacaccagagaaattttacaaaaaaatttccttccaagtctgaggaacctagaaactttgggaaatctttcatctaatgataatgatagaaatgcttatagttccatgttcactgaagtgatacagtctctcatctttttgtggctttatactgaagtaactaacctcttgaatctcacaggtgaattttagtttttcaaaaattatagttatacagctttggacaatagaccaaggaagtagacatatatgtgtaattcaacttgcatttcttaatttatgtagttttaaatacacaaagcattgctttgaaactcttacaaatgttgctacctcaatattagaaaggaaataatgtgggcaaactttgcaagatttttcttgtttcaaaacaaaaatgaaaagcaaacagcaaaacacataacaaaaaaagcaatacacacaaaactttttcaaatgagaggtataacttttcataaaatgtatattttatttcatcaacaaaaatactactaatgtataggcagataagatacaacctttagttgtaatttgttatggttagtttggtcactaagttgtgtccaactctttgcaaccccatgaactacagcacaccagccttctctgtccatcatactctccctgagttagctcaaactcatgtccattgagtcagtgatgccatccaaccatcttatcctctgtcatccccttctcttcccgccttcaattttttgcaacatcagggtcttttccaagtgtcagctcttcacatcaggtggccaatgtattggagcttcagcttcagtatcagtctattcaatgaatattcacatttgatttctttaggattgactgatttgatctccttactgtccaagggactctcaggactcttctccaataccacagtttgaaagcatcaattcttcaattctcagccttctctatgatccaactctcacatacatatatgactactggaaaaaccagagctttgaccacacagacctttgctggcaaagtgatatctctgctttttaatacactttccaggtttgtcatagctattcttccaaggagcaagcatcttttcattttgtggctgcagtcactatccacattgatttaggatgccagaaaaatgaaatctgacactgtttcctcattatcctcatctatttgccatgaagtgatagaactggatgccacataataggcagtcctttttcatgttgtacatacagggcaatatttttgttttgtttttgtgactttttaccatagtgtggtgttatagcaacccagtctgtttgacctcataatatactcaagccttcattttctgaaatttgatagcttcttcccctctgcactattgctcaaggaacttaagcatcttaaatttcagccctcatcacaaggttaattcctcccaaatccaaattgcaacctccagattcagatttccaagagacttcaagacatttggaagtggatactttgttgttaatt

SEQ ID NO: 61679 - DNA, 1166 bp, Bovine  19866880898951
ctaaagagtaggatgctgcttcttaccatgttttcatgctatagggaaacaagagaagatgcagacgcttttaaaaagccccgctagaagtagctggcttctttagacaggaaaaaaatttgtttggaaagtataattgttactctacttaatctttcactcagaggtcaggctagaataaattagagtagaaatttagaagaaaccaattacagtgcagtgtttgaagatggaggaaaatgagacttgagccatggaaacaaggatttggccaaattagtcatgttatctttcaagtaattagtatatttaatatattctccctaatgcatgcctcacgtattaattgattaaacttcccaagcaatgtttcttcatgtgactttggaagagcaagaagtcaggcatttatagtttgctctggtcttatggtgcaagttgtataaatttgtgcctgcaagcatgagagtagattccataggaagggcagtcatagctcttctacaccacaaagctgttatctcaaactcatggtgcttgaataccatgtggcatacatctgacagtgtagattccccggctccactcctagagatcctgatttaactggtcaaaggtgcgtccaggaatctgcattttaacatcctgattctgatggaagaacacaaagatccatgttgccaagaggactgaagtgaatagcaactgatgtacagtcagagactgagaagatagtgatggacataacacagcttcttttgtaggagaaagctggtaagaaatgattttgagctggaagagaaatgacatagagaatagggagaggaaatccagagaagcagcacactgggttctgaatgaccagtggttgaacatgcccattgaggaaccagggagttagttcagttgttggatcaaagacacgtaagcaagaagaattgtaacgcagagacagttgtcaaaggcatgacatccagagtccatgcctgacttcttgctcttccaaagtcacatgaagaaacattgcttgggaagtttaatcaattaatacatgaggcatgcattagggagaatatattaaatacactaattacttgaaagctaacataactaatgtggccaaatccttgtttccaggctcaagtctcattttcctccacagtcag

SEQ ID NO: 61680 - DNA, 1660 bp, Bovine  19866880968643
taggtatgcagtgctattcaaaatcaggatttcactatcatccaagactactgcactggcctcaaagccttgctttatctgaaaagcattgaagaactacaggactgggatgggcagagtccagccacgaagagtcaccagaaagggaaaccagtcccttgtattgctgaacttgtgggaaaggtacgtggtcacctctcttgggttgtccttgaggactctggctttttcattttccatttcgggtcttgtttgccctcccactgtcctactaacaggggaaacacagatgccccgttggatgtgactgcatagtagaattgttctgaaggagccttgattacaactatatgacaggtctctgagctacatttttatgaaacctgtataacacaaggtcacataaaggaaaaagattgaagtttatagtataaaatgcctccaaattcttgcttactgtggtgatgactggcattctttccagtgggaggctggagatttctttattctttaaccagctctggaaattataacattacctttctattttcagacaatcaaatcactggagccctgaataatatgatgaagtttttaaaattaaaatctaatcagtatcttttgtaactgcttctgctatgtgtgtggttaaatctgggctcaaaaggttatgtcccaactttctctctaactgctattttcagagaaatatacactacatttacattttgtataatacagtgattttagcaaatcttttctgaaacaacattcagtattttgcctttgtatttcctttgtattattctaaatagacaaccattgtcagaagacgtttcttgagtcctgaatgaggggaggaaaaaattataattcttagtcttttcagcttgtcactacatcaataattaactttaaaaaaagagaggcaagtataaaaagattctttaaggaagcatttaataattcaaatgaatcttaacttgaaacaggtcacatgaaaaagaatggaaaacaaaaaccctgggttctgtgctttcgatggcatggttagggactcagaaagaataagagaaacatcatataatgatttacattgagatagccaaaaataagagcttcttatagattaatgtgtatgaatgactgcaagtccagtgatcaaaaataaaaggggggggggaataaaatcttgctggtttccaggaaaatatcgtgatgaatgactccatgaatggcaatcaaacagaaaggctgggtgacattaatatttataatattataattagcaagactgtgcccaagcagtattattagtgtaactaatcatattactataaactgagtctgagagtatttagacagtgagtgctcatgcctttatcaatgaccatcaatatcccaaggttgttcataactaaaaaaaatttacaaataactttatgctcatgcaatgtaaacatatccagttaattgtttctgacgtgggtgggttttgatagtttatgaccatctataaaagcattgtctcaaatatatgcagtcatcgtgagagctgaaatggaaaaggctgcattgcactgcgtcattttgtctctaaaggacttccacactcatttcaaaacttacatattcaaataaaagataggtaatgatggat

SEQ ID NO: 61681 - DNA, 1954 bp, Bovine  19866881038335
atggtattagatgctgtcatgcaagcaaataggaaccatagtaaaatgttggtttcagcaaatgaaacccacatccatgatgattttactaggaatgagctagaaaactatcgtgctctcccatgctgcccatatgcctattttcttcaactcgagggtggagttgaacatcactgaattcttgatttcattcaactctgtaggtaaccacacattcacactgtaagctctttttcttgtctagttcatcatctggcctagtgggaggaggggtatgattatggctaagtggggtgggtgaaaagaaagaagcaacttcttttgttcctttcctttcagacctgatattatcctgaagaagagagtacaaaatgacattgcagccctcctgctggggagagtgcagaattggtcatgggcaattgtgagccctgagctgacatagtaccctggtgacccgagtgagttaatgtattgtccagaagctctaatttacaaccaggaagaatttggggtattgagaggcagattgaataggtccattttggcccattgtgatttcagtgacaggtccagtttgctctagtctaaaccgactcaccaaatcatgcattcagacaattaaatcaccagccctttgacatactgtaggatttctgcaatgtgacacagccctgtcactttgggttccagcttaatgtaccctttactttccagtccttttctctttccaggcattttgcactgaaaatcttctttgacactgattttaaaacaagatatacatagtgttgcttatcattctattagcctatgaatacaaaatcttgtctataagtctgtaataaaaccagatacacaaccagaaatacagctgctcatcttgattctaagatttgtgcctttttaattaatgaacactatatcatatctgtttggtcttttcctgtgaaattttcttagtacataataaatatcacatttaattttatctactgatgataagagataattccaaaaaaatatatagtcaaaaagaattaaaaaaatacttccaaagtggttcataaaactaataagaatcacatctggaaaacatttaatatttttttttaatcaaaatacctatggaaaagtagtccctataataaagggtattccatggttacatgggaacacttcagaacttttgctagggtggtttattcagaagcagccatcacattgctggaaggaggcaggatggaaatatgtctttcatcacatgggtagaaaaaacaactgagagtgttagaatactattggcaaagaaaacacagacatgtggctcagagaagaaagaaaactgtcatgtggaaataagaccggctagatttgtgaaagcaagatcctttggccctactggttaaactgtatcaccagaactacagtaagggggaaatgaacattgattatgaaactatttatcaattattatttgttatgcaaatacttatagtgaagttcttcacaagcattaccgaatttaggctcagtaatgcttccaagatccttctgtcactttcgtaagatcaatttgaaaagagtcttcctcttctccagacactgatattagtatatgatctagtgtgcccttgagtattatatatctcatgccacagtgaataaaacacttttccacatgctgttttaattaaggttaaacttctcttagagttttctaaaatatacaaaccaagcaagtaagagttcttagttggccagtcccagtttcccaattctttattctaatatgttccaaaggcattgactaactggattcagtttttcagatttaaaatttttcttgtattaaaaatgtataaagttataaaaatagaatcacatttattgaatatagattcagatttaaggcagatgagtctgccttaaaaattttagggcatatcatgac

SEQ ID NO: 61682 - DNA, 650 bp, Bovine  19866881047620
gtccattttacacatgtatttacctaattgaccgtgaaattttccacagagcccaggtttggcatgagttttgccaatttaaagctgactatgatgaatggctttatcacactacttgctcttctgccttctgtagaataaaatactgaaagtatttttgtcaataataagccttaatttttaaataagccaattttacttttaaaaagtcaaaagcttttatatatgtataaagatacagcttaaagatacattccatatttctcacactctatatctaattctttaactgaggttttattcaatattattttgtagcttctcattagcaatcaatcaaagtaaaaggggaaggaagaaaaaaaggaaaatatgtttgagagaaagaaaaggaaaaagatatgccttccattcagtcaaaatagtctgttagatctctcaacagaagagcaatttgtatatcaaggagttcaatcttgaagtgtgtcgattaaaaaaagttccctctaatctttgaaatatggaccagctcagggcataacacaggaaggaactatccccaggtcttcatatttccctggagggaagcaataggcaggatggttccaccatagctcatatggtaggcacccaataaagctttgtagagt

SEQ ID NO: 61683 - DNA, 797 bp, Bovine  19866881052367
aatgattagcttcctttaaaaaaaatcactagaaaaatggtatggatgaacccgttggcatggcatgaatagagatgcagatgtagaaaacagaggtgtggacatggggtgaggggaaagaggaggtgggatgaattgggagactgggattgacatatctatactaccctgtgtcaaacagagagttagtgggagcctactctatagcttagggagttcagctcagtgttctctcatgatctagatgggtgagataggggaggtgtgagcaaggtccatgagggaggggatatatgtacatataaactgattcactttgttgtagaacaaaaattaacccgacattgcaaagcaactgttactccaatgataaaggaaaatcaccactgtgctatgaatgtgagaggatggaatgctatgtcactgctgagaagtgacatttggcatgtctggtctgaatcccatacttcacaacaaaagatgctttttgctacaaaagccagaagaaacatgcctcacagcaccctaattacagcatgattcttacctggtagccagagtcattacaggtcatgtagcatttgccacagttgatacacatctcttcatcgatcacagccacaacctgctctgtgttgttcagttcaccatatgttccaaggtactgcagagcttttccaatcacatcctaaaagataggcgccggattacttacggggctcattttaaaacattatcgtgttatgactaatatcggtccaaatctccctgtttttatagaatgttgcattatctaa

SEQ ID NO: 61684 - DNA, 1768 bp, Bovine  19866881079676
tctttttagtatagctgaagatatgtttttacaagtatgtgtgtgtgtattctttccatgcatcctcctgtccactgtgttcacctttttcaatgattaaaacattcagactaagaagaagtcactgctaaatattttaaaatagaaatagggttctgatgttcagtttctaaatggccctaactttctgccttgtatttaaatgtcagttatggaattccgaagtttcagcattgaatgttcttgcctaagaatactaatatccagaggaagatatttttaggtttgggagcaccaagtagtcatttccacaaacattttggtgttgaatgcaaaagcattagttacacataaatccagtttcatctgaaatgaagaagatgaaaagaaaaccaccgattttatttttttaattgttattttttttttatttatttctgtttacttactaactcttggctatgctgggtcttcattgatgtgagggcttgtctctagttgcagtgactaagggctgccctgtagttgtgtgcagacttattgcagcacacgggctcagtagttgtggctcctaggctctagtgcacaggctcagtagttatggcacacgagcttagttgctcctcggcatgtgggatcttcctggatcgaggatagaactcatgtctcctgcattggctggtagattctttaccactgagcgaccaaggaagcccaaccactgattttaatgaaagctctttgtgcttccttaatgggaacaccaaataaatacatactgagaatactggtaaagatgctggtgaaggtggacaggatgccaaaggactcaccaccaaagacttgtttttacctttcactttagttgtttgtggaggtctggttgaggcaatgccacattcttgcacaaaagaaactacttttacttcagagaatgcctttaagggaccattgacttatgagtgtacatcagaaatattaaactacatagctatattgtgagaacattaatttactccagattgtgttaacccttgagagtctaagcagccttataaagtgtaatcatgtgaaatatgacctaaaaaatgatgtcttctgtccatccctgcagcttttattacacttagcaaataatgtattggtgatgtttggttaaataatgtataaaaaatcaagtatacaatctctaattactgaattctagtcaattctctttaacttggttaaaaatttctaacatatgaaaaattagattaggctcactgtgtttcgtcagatttgggaaaatacatgtaaagtgcaatatggaatctgtaagttcatcagcaccttacttgttttgcagtatctcgattcacaccagctgctttatacttcgtggaaacataacagagctgtatgtctatttatgcactgtatgtggttgtttttcttttacaaaatctgccattccttgttctttctcaaacagatgcttgagtgttccatacaatcttttacacagtactatatatcaaactgtagtatgtatgtattttatgcaggagtttgcattgctctacccacttgcataacattcctgcatgcaataatagcatcaaagtccttaaaataagaatatatccatttataaattaacatactttgaaacatagcaatgtttctattttgcatactcatatatcttaagcagagatgaaattgaattttgtctagtacaacactgccatcacacagtagtgttataaggcggtatgctcaagtg

SEQ ID NO: 61685 - DNA, 1283 bp, Bovine  19866881108074
agaacatattaatggtaaattagaaaataggagtgcttctgatagcaaaagtttagatttattaaaaagtggaagaagggatttatatattaaattcttttttcttttcagagaatattcatgaaaattttatatttatcaaaagttttagtgctgatcaaaagttaaaattttcttgccataggaaaaacatggtaaatacttctgcagaatatcttcctcatattcatacactccttggatttatttagttttagacttaaaaattaaaacccatatcactccatttcctgtaagttgccacttcttgacactgtacaattcttggacataattactctgagtctctagagtaagatcagtaagcaactaatgaaagattcctggcagaaggagatagaatgagacaacgactacataactgagatcaaatgatatccatggggaatatggtgctctctatattccataaaagtctacagtaaaagctcactaatttggatgaattgtgtgaagagttcttttgaattggtgaaaagtctgaattatagattattgagaaagaaatacacatccactggaaaaaattgctaacaaatgctcatttaaaacagcacattcattgttggttttcataagaattttgatagcatacttgaaagctgttaattatcttaagtaggttaaacagtttctggaaatgtgtttatactgataatttatttaacaaggcagtattttttatatcaaatagcataaaggtatactacagctactaatgaataaacatcctgcatttcagttatatctaaactttacaactgtggtgttgaagactcttgagagtcccttggacagaaaggagatccaaccagtccatcctaaaggaaatcatccctgaatattcattggaaggactgatgctaaagctgaaactccaatactttggccacctgatgcgaagagctgactcatttgaaaagaccctgatgctgggaaagattgaaggtgggaggagaaggggatgacaggatgagatggttggatggcatcactgactcaatggacatgagtctgagtaagctccgggagttggtgatggacagggaagtctggcatgctgcagtccatggggtcgcaaagagttggacacaattaagcaactgaactgaattgaactgaaaatttacaagtttgtagttttccattattagtttctgaaaaaatttgaggtctttctttcagaagtccactactcttatttaatattcataaatacataa

SEQ ID NO: 61686 - DNA, 848 bp, Bovine  19866881115940
tacagtatcacctataaagccaaaataaatggggtgagataagagttctcagtcttgggttatagtgtcaatgcaagacttgagctgtgttaattcaacaagcttgatcttgattgccaaagcatgcttgtcaatatttagctcccagggggcatgtcaggggcctttacagaaactagcttaaatacaaaatactataccaggatttgtgatcctttttctaagactcagattaaactgctgattttttttcttttagctttttaaaccaggaacgtgttttccatatttctatagtaacaagaagaggaaaaattgcaaagaagaattgtaaatgctattattaggatttcttgaaacccagataaaattctgtcacatagaatcactataaggcttttatctgaggtttgaaatagcatttccccaccatgattataatacagaaaaaagtttggaaaaaatgttaatccatactgagaaataagtgtaaaacagatgagattatgggtagtgattcctacaaacttaaaaacaaatagtttgcaattttaataactctatacttagaaccttcttcaatgatactatgaaatttctaagcctctgtagccattatcctttacatttaagaaaatatagtgaggatcagtcttataatgaagaaaacctatacccactctggcgattaagattaaatcatgataagaaaattagtattttgtgatagactaatacatttctatttcccatctgacttttctggtttaatagatataggttagcaatctacatatcctttttattgagcctgacaaagcatttatgaaattcagtatgatgaagat

SEQ ID NO: 61687 - DNA, 1115 bp, Bovine  19866881122046
tgaaagaaatatactctattctatttcaaactgtagttactccatgcatgctcggtcgctcagcagtgtctgacgctttgtgaccccatggactgtatccagccaaacttctctatccatgggattttctaaggaggaatactgaagtgggttgcaatttcctcctccaggggatcttcctgacccagggattgaatatgtgtctcctgcactggcacatggattctttatcactgaaccacctgagcccctgtagttactaaaaatgtagacagtagttagtggtaatttagctgaacacttaatatttgtgccctgtatcctatataaaatacacttcatacaaaaaataaaaaatatgtaaatatatataagaggtagcaaaaagtgtccatcttaaaagtaaacatctcccagctggatccacgtctaagaagttttagatggttagatcactcaaagacttcattttacaaaatatgagagcatccttcccattagtgggcagaagctacatctgagagaaaatgaatcttacattttaaaagtaaacaggactaaagatcatatctgcagtacattacggaagagaaatatggagaacaagacgacccatcagaagtactttttaagatgttcttggcctcttcaatgtttgtaatcttcataaaatattcttgaaagcaatgcttttaaagatgccatatacatcctatgtaagcatgtacacgaacaaatacacaccatcagtgatgttactgattgttaagaataaaaatgaatggagtaccaaagtgatgtaaatataaagacaggttttatggccaggctatagatctaaagcacagcccctgaattttccaggcatgctaagcactgcttcatgtacaaagacacaactccagtaagctgcaaaggctgtttggctttttgctgactgttgtactgagtaagactccagagccaaatttcaaaaatgtcatcaactgatcataaatattgttaacatataataagagtttctgtttctgcactttatgtccaaattgctatttaagtatatctttacctctccaaaacaagacagcgagtggtcgagggtgttattcctatta

SEQ ID NO: 61688 - DNA, 3611 bp, Bovine  19866881148133
ctatggtttttccggtagtccgtatggatgtgagagttggactgtgaagaaggctgagtgccgaagaattcatgctttgaactgtggtgttggagaagactcttgagagtcccttggactgcaaggagatccacccagtccattctgaaggagatcagccctgggtgttctttggaaagaatgatgctaaagctgaaactccaatactttgtccacttcatgtgaagagttgactcattggaaaagattggttgatgaaattgctatccccctacaatgacaaaccacagaattgttgttgattttcattcaacagtttgttctcaccttgcaagtttttaatattcatccttaatatgatattaccgcccactttgatgttctggattttcactagcactcctataccagaggtgtctcttctctttcagattgatctccctgcttgcactgtgtcttatcctacccaacccatagacgtatatggaattatatttcaaaaacatggatttaactgtatggcttttcatattttctgattgcttaaaggataaggcacagacactttaggaagctgactctaaactctcattgaacagtttagtcatatctcctctctgttcccttcaaaagcaataatttagatgaattttttctatttcccatcacaccatgcattcctatgctttagaggcttcctaggtattctttatccatgtgtttctccagaggccctactctagttgttgccacattgtgaatccttcaagactccagtctttcccctcaaccccaaaggcatacactttagaagtaaataaaagtaatcactctgccactaatgtcccaccttttttgtacacacttcaaaaggaaggaaaattgtttggagttctttttatgtctgtttcttattccaaaatgagaccattcataaagtcttcatggttagctgcagggtgattgcaaatgttcagaaaggtttatattctatagttttttaattcccacaaacactgtattgagcagggaaaggaaaacgtaagaataagactattgcatttgtgattccaactgccccatgttaaaatctaggaatattagcaactggaaatgcataagtaaagtctttttgtaatgctgaattctgtccttgcccaatattctagaaagctaattatttgctgcagcatgtgaatgttaattgtatgatccagtaaggtttaccacacttatttttaagtgaaaaaatgcaaagtagaaactatctaaatttagcagtcctttgggtactttacatttgttgaatattacaaaagtaaatacttatctctttttaatactaatatgattttgtgcatcaagcaacttgaagatttttccctcatgcaaggttcatcagctgttttatcaactgtgtaggctgcaggcaccttagtaaagttgagttgggataaatgaaagatccttgtcgaattggtaatcatgcaggtattcagagtgaaagggagatcctattttaatttaatttcagtacttcaagatattttttcttatgggctgtattaccagtctctgtttacatatctatcttttaagaaatcatagctactcttaatacatttcaaatcaagcttccctatacctaggtgatatgtattacttctttctgcaagggcctctttaataatatgatatcttgcttattatgacatattcaaatgctaaatcatttatagacacataatgacatataataatcccaaagggcatttatatattctcttgtctttgaccaatttttagtgccctaagtgattctgattgtacttgaggacaaattaataccttattttttaaaataatttcacaattcatggaaagttttaggttaattattggggattaaataaaaatattatttatttatactatataatccatgaagctaaggacctgccccacccaaagctcctttctaaagtaaaattatcaaagacaatatcttgctgtcagaaaagtatgtgtgctagatatcttgaccacgattcattggaatagattttgtatcctgagcaaaaaagtgaccacctacagactaaagaaagagaatagcaggctatcagggagtctggtgtcaaaggcaataaggcactctatatttggtgctggctaactatcatttagaactcttaattgtaagaaacagaaaccgattctggtctcagaagtgaaaaggaaatttattggaagtatacaagatgtctaagagaaccagagaaggcaggaacgccaggcttagaagagggacagaaaccaatggatccagaaaatgggcagcaagggttttccccataatgcagcctctaccagggctgatatcagccaccggtgcctttgttgggcactgtcaggagatgctgcaccacacactacacaaagacacgtcagccagttttctgattatgagattggaaatttgggctggaacagaacagcagttggccatgcgtaaaaccgtattattgtttattagttgacagagaacagggacagaaaaattctctcttcagtgggttccatattggtgatactttctgtgtcccaccaaaacttcatgcaatgaggatttaacaaaataaatgggaagggtgcgaagtaggaggaatggccaaaaaaaaagaattattctgcttgtatctgagaatcttctgtgtgggtttggttttgaaatatatagattctgcggcagatcatagcaaaattgaattggagaaccaaaaaggcaatataggaaaaaaaagaaagggagtagaagtagaaatgaaaaaatagatactgaaaagtaagagcaaattcattaatatcacagaatttctaatcctaaaaaccatagacaccaactcttaaaggaaaacaagagagtaagagctgctttttgtcactgatttcaccaaagtgtcatcagagctgctgtgtgtcctacagacatgaaagatcccagaccccagaggcctggctcttcctttgtcaaaaatatttcctttaccttcttacttccccatatatacttgtaagaagcctccataatggggtgggagggggtaggctcactatggttcctttcctttacacttgaaagactttaaaataaagaatcttctttttacacacataagttcatacatacacacacacacacacacagcccttgtgatgtatactcttataaaccatgagtatgaatagataaatttataaaaattaaattgcattcagattgctcaaaatttgggagaaaatataaaatccatgaatttcaagagtttgtgaaaaaccacacttcctacaggtcacgttctaaatcttccccatcccatatttttacacaaaaacttttgaataaagtcacccttcttttagttatctcaaaatctttttcagctcgtagagtgaaatcagtctactgtactggcaagacaaagacctagctaggtacctcttcctagctctcatagcagcagtaggaagaaatcccttaaggaactgtaccaacttgttatggatgcattcccttagctgaaaccattcatgccaagggatgcagtttt

SEQ ID NO: 61689 - DNA, 965 bp, Bovine  19866881153636
acagtatagacaaactgatattttttgtatgagcaggaagaatccaagtgctgtataagggatttcttttaaactcatttttttttctgaaatgattttggattaacagaaaagttgacattatagtacatagtttccatatgcccatcacacaatttcttttatttttaagaagtattttaatttacaaatttaccaaagtaatatcttatggtagaaagtatttatgccaaagcctttattctgacaagctaacaaagtgaaactggaggctgagaaggtcataagggaaagaagccaaaaggaacaaagactaaaggaggaaaactggggttaacttgcattctcgtgaagacgtgacactttgctgtgtataaaacagctccctgacaaatctgaatctgttggaagagttaactgagacatgactgggcaaatgtttgcttttgcttttagatactaggaaatcttttaagaaatgactaaaatctaagtagtgagaatgttccagaaagaatacaaacactgacattcattttccatttgacattttccaatgtctatgaatgctattgatttcaaattctaaattatttcacttctgaacatgccttgtagaattattacaatgctgtttgtgtgggcttgtaattattgattgcagcattatactctccataaatgtgccattgtgaataattaaacttgttagcattttgtttgcctacagtctttagagtgctagcccgttttttggcaatctcaaatatgtttctctagttcagtgtgtgctagatatgggacacatatcattttttcttgaaactttttaatagtttgccattttaaaatttcaaatcttaagagctgttctgtaacaatttagcttttagtaaataataactctgggaatcttatgatttgtattttggagtttataaataaatgatcttctagaatgtaaa

SEQ ID NO: 61690 - DNA, 1038 bp, Bovine  19866881165369
accagagggcgagtctatttactcttttgccttaatatttaaaagtgtgagcactctggggatataactactttaatttataggtgcagcttcgaaaaagaagctaaatgcaaggcaaactagagctccgagtttgttttaggtggaagaagtcagaagttctgcccacagctgaatcatggaagcctgaaagtgtaacaaatgtcttgggatgtaatgtttcgagtcttaaagctgtgatgcatgacaacttaagctcttcagtgccagaggtctctgtctctggggcactaaaacatcccttcattgcccaaatgtcttctgtttggtgtgtatctgtgtaggggtgcgtgtgtgtgtgcgtttgtgtgtgtgtgttttcctttgggacatttgctttgaagtctggtcatcaaaccggctgttccctggggagagcaccatcctatagaaaaaacatctacatcagcctgcagtttgtgtgacttgctaaactgaagacagataacactgcatggcaactggaatgctttcatttatctcttaatttcattagatttttcatctaatggtcaaatttccagttttcttttttcaactctgatgatgaatattcagaattattttactcacagctctatttcattctgtagggaataagaagcattctgattttttttctttaaagacctcaataatatttatctcctacatagaatcttcaaatacaccagggctatcttacggcttgctacacgctgggacatgtctactatgagatccctggaaatagctggttttaattaaaatgaaatgtcacaataatatcattgcatattctgatgtcataacaaaaatcatttgataaaacttctaaagattgttctacataaatggaatcccctacagtgcattgcttgtatttcctttatatgcttctggtatattctttcttgcattatagctattttaagtcttacctttcaactaaattataagttctcaatagataacatctgcttcattctaagttcacag

SEQ ID NO: 61691 - DNA, 672 bp, Bovine  19866881181671
ttctcagcagtggctactgtctctttcattttctctgttagtttttagaattctgaaaatcattattgtcagttcaagtgatttttattttctaattgcatctccttgagagcactcattacatgtaaattaacattcttctctaattcattagctcttccttaataatagctacctgttcagcttgacctccttcccacaacttacagagtctatggaataggtattaattcttctttgacttcccccatgtcataggttttgtcactcaagaacagtccaggacttgaggttctctggagcaagtggaaggttgtggctgatgcacaggttttgtttcaggagctagtggtcacacagacccctgaaccccttctctgagaagggtataggatcaggtcctaaaactttacaggtccaagtggaagaaagtcagttcttcctaaaaggtgaatgcttggagaaatttattccttctgctccccagcctgcagcccttccaggtctgtctgccctagcagatcaggtaccttcacggaggacagatgtgcaagataggagcatcactggcatatgttggctgagccctctctagtggcaacaaaaatctgctgtattaatttcagatctactgggacttctgcttctttccccttcccaaggttaatgaag

SEQ ID NO: 61692 - DNA, 1686 bp, Bovine  19866881214861
taaaaggccagtataatttagaaaattagaccaaaggaaagctcccctttacacagctgaccataaaacaggttttatagattacttcaaaagttgaaactcatattatcaagatgttttttgttgctttggtcacaaaaatttggtgcattccataaaagggcattcttatatctaattctgttgttgagagaatacttttaaattgcagttttacatagttttgacattcattttgactaatgcatgtagcttaaaattacaatgtgtaaacattcaatttctattaaacattaatgttctaaagcatataaaatgccaactataataatttatgaatcagattttgtgttgtttctgcctgaaaaatacttcataggttaaaaaaaaacaggacacttactccacagaaagaaaaaatagtgctaaatggcttcaactgtcatccttcaaagcttttaaattaaagaatcacaatttctggtcaaattatttttatataattcatttctttatggaataaagaaaatgattttattaagcatttttttttttcaagctgaatgacaatgaagtctgcatgtcagaaattatggtgaagaacaatataaaacttccaagttttatctttggctgtcttgtcaaatttccaaacatttgcagtctatgcttacaacacaagttggaaatactgttttggtatcctgtaatcatactgtgaactacaatggaaatttagtcaatagttcagctgcaagacaacctaaaatttttagtagggaaaaacaggcaaagcgcaaagtgacaaaggggaacagtgtaaattacaagcagtcaacttaggttttctcaaacaatttaacaaaatctttcctaaaactacggggattatactacattgaagaggaaaaaataacatgggacatgtgattttcaggcatttaaactaaaaaaaaaagttcattaaatattaaataattgtacaatattcaaattggtaaatgttctttatgccattatatgaatatagtgaaaatgagataggtacaattttcctggaatgtacacattgagagaagaacattaaaagtaaaactcacaagctcttcaaattttatatggttattgttaacttaatggttgcaaatgagaatagtactcttaaagttctcctttatattattttaatatttagtgttttctttcttgcttattttgggacatacatatatctcgcttatacaactatttctaatacgaaaaagccatgttcaaggttacaaaatgtgcacatagttttcatagagacacgtgtaccccaatgttcatcgcagcactgtttataatagccaggacatgaaagcaacctaatgtccatcagcagatgaatggataagaaagctggggtacatatacacaatggagtattactcagccattaaaaataatacatttgaatcagtgctaatgaggtggataaaactggagcctattatacagagtgaagtaagccagaaggaaaaacaccaatacagtgcttatggatatatatggaatgcatatatatggaatttagaaagatggtaacgataaccctagcaagacagcaaaagagacacagatgtatagaacagtcttttggactctgtgggagaaggtgagggtgggagatctgagagaatagca

SEQ ID NO: 61693 - DNA, 1109 bp, Bovine  19866881283379
caaaatttaatatacatataattattttcaatgcaggatggcattatgagaagatttttctaatgtttttaaaggtcacatggaaagaacccttaacatttgttccctattgcataaaagatcatcactaccatctgttgacagttacctgagtttcaaaactttgatagtgagcatgactcatctgttcaacttattataataaaggtaactgttaacacaccatcattgaatggtatagccgcaagggaagcccaagaatactggagcaggtagccgatctcttctccaggggattttcctgacccaggaatcaaaccagggtctcctgcattgcaggcagattctctaccaacggagctatcagggagtcccatagataagcataaacatatgcaagagataaaaaataattctcctgtataagaaatgaccttatttgtccaagactttgatacaaccttgtcctgtatagaatatgaaataaagatgatttttaaatgagaaggaattcgaaactatttcactaggagatcaaagcctttttatacatttttctcattttttataggaatactcttgaaggttagcacagatttcactttaagcttgagcaaggcagggattatgccttagttatctttgatttcccacagcagctattagtcaaagccatatatactgtgaagttattgaagattaagctccagggtccctcacttgcatgggcctctttcaagacctaaatttgaatttgcaatttttttctttttttatagaaaagccctcaaattatataggcttcaggtctcacaaaatttgaatctattcaagctcagtgaattgtaaatagtaggtgctgaataaatgcttgaattaaagtgaaattcatgagtaatgtgttttatacttttttatgatttaatgcacatggtatgattcactttaatattagagtgccattactaattcagtcaataaatagtcaggagatgttactagaagtttaataagtaattattgcatttcttaaaatattcagcaccaacactataaatcaacctaggaatatgtatttggaattcaaaagcactattctattcacaggt

SEQ ID NO: 61694 - DNA, 1309 bp, Bovine  19866881425805
actataaagttataagcagattttcaactttgtagggggtcagtgctcctattacccatggcgttcaaatttactatcttatagagatattatgaagattcaatgaataacttatgaccaatatttgacaatgtccatgtccatacattctaagtactcaataaatggtagttagtaatatgtataaaaataataatcataacaatgacctccaatttcaaacaataagttcaagacagtgatacagaagcaaccttgaacagagactagaattgcccaggtcaaatttcttttccctagatggcactacatttccatacttattagcctttctctagggtatttatttacttggaagaagaaaaaaaaaaccaccatattttaaaatcaacaattcatttatgttaataagttagattaatttatgtcatgatgtctccgagggcagaactataaaacatggatgcaacttgtgagaaggctgatttggggacaatgaatgaaatatatttctaaactagatctttctatgcctatagctggctgcattgccttaaagatctagcatgttctatcactaaaagtattcaagaacaggctacatttttttttcatcagggctcttcacacatgaacttagataattcagccaggtaatttttattccccttgctgatactgtgtgatacttacactgttttctaaaaaattctctgtatttttaaaggcttagtcaacaacctaaaacttaatatgcagtctatgcacttagaaattccactgacattttcatttttagacatataaacataaactataaaagcaacctaggatatgaaaattttaaattggccttttctcccttgattgagatcaatactcagaacaatcaatttttttgtgttaactatctgtttatgtggctagaaaaaaaataagctcaatatgctcttgccaagaaatctatgtattcatttactaattcatttatccaaagaatatttatgaaacatttatcaaactcttcctatacactcagcattgtgctgtgtggtataagactattttatggcaacagttacaatcaatactttgatgccaaagaaataatgaagaaccttaaatatttctcagattttagttttcagtattttatgttgagagaaactcattatttgtatatctatttacctaattatttgatacttaaaaaataaaatatatgcattcgagatattaaaaaatcaatcacaagtgtactgtaatatatatatataggtatgtgtgtgtgtgtgtatatgtgtgtgtg

SEQ ID NO: 61695 - DNA, 1255 bp, Bovine  19866881425826
aaaattccctcggcaataattccttcttgcttggatttcataaagttcccagaacagaagcatgacttccctagactcccttcagcctaaatgtatcagcattatgggtgctccagggcagaaggcggttttatactagcctcctccctgtgtcggttaatcattcacaccaatacggggttataaagatactgaggttttgtgcttctggttgtttttaactctagcattcagaaatgtggactaagtgaatagaccaacagatgtataaaatatcaattgttacactgtttacactaatgttttgcattaagaaaacaaatgtcaacctgcctgaagtctgcaaagaataaaaactccttgttatacacttaaatactcacttgcccttatctaaaatgaatccacacacagtagtgcaagtgactgctggcatttcattacctactgaagccttttgagtgtgttctgaacagtgattgggaagcctgctgagtttcagtttggctcagctcgcccacagttttgaacccctactggtggtatcagcaaaacatgtgcatagcctatttttccatagagtaagattttttcaagttactctgagtaacctcattaagaaactatggacaacactctttttgcatgatggacaatactaacctttgaattcacaaataaatgacaccccacatataaggaaagatcaaggtctttgcagggcctcagcataaataatgctgaaaagaatacgccattttcacaaatgttttaatatagaggattttgaagcatctctatttctatgaactatcgccagaatatgattctcaacgtgcatttgtttgcctatgaagatagacatggagcctgtgtcattcttgatttgggtggggagagggatgataaaaactaaaacaaaggaagtagtgatggaaatacccagcataggcaaaggaaaatcattgtgaagcagaagggaatgactggctgtaactgaccgacaggtcacggatcaagtgtgggtgcaaacagggcaactgcaggtcaattcaggcaagactcaaggagatcttatccagaaagaagtgggcaaaggataaagtccagaaatgcaagagttcaggcaagcagaatggatatgaaagcaaaagcagactttaggatagaatattagagacccaatgcacctgtaggaagtttacaaagcgtctcttcagacattattaattaccattactttcttttatcaaca

SEQ ID NO: 61696 - DNA, 856 bp, Bovine  19866881465952
tataacatgactacttttgttgaaaaataaagcaaatggtagaaattttattaggcctatattaatttccttgtctagtcctgagtgttataaatataagtaataaaagtaaagacatctcctatccatttcactggatattttttgacagttatctttgaaaaattattgaaaaggttccctatttttttatcaccatgatagtccagaagtcctgcctggtgtccaattgaaatccctcctgctttattaaactgatttctgcttgtttgcttctctgtgtccatggagaacaactgatcgacatccttcatataaaaccctttatattcttggaggcagtaatttcctgtgtgatatttagttgaaagtttcataaactttaagagaaaaaaaggactgtggttagtttttacttcataaaaatattatccaaagttttagacataaagatagttacatttaccttcctgtgtgacaaattaactttaacctctttttaagtagcactttaagtcctatcataacacatttaaatcatgtatttcctgtcaagcgtggttaatcatttcgaaagcgtgtgcattgttgcaactcttttcggcttctcttaatttcttggtaattctcttcgactgtgttctatcatttaaatttataattgtttcaatatgaattatcactcattttgaattgattttggcaatttgattttaaaacctcgaaatctgattatggggaaccaataaaaaaaatcatgtcagagacagacacaaaatattaccttttaaggttgagtgattcaatttcaggagcagtttttaaaaaatacctcatctctagcattcatttcaca

SEQ ID NO: 61697 - DNA, 1192 bp, Bovine  19866881543593
ggaggagaaggggacgacagaggatgagatggttggatggcatcactgactcgtggacatgagtttgggtgaactccgggagttggtgatggacagggagttcttgtgtgttgttgtccatggggtcctaaagagtcagccacaactgaccgactgaactgaactgatattttagtttacttaaaattatttttctcactgaattgacattttatatctagtacaatgtagaacaggtattttaaccagcagccatctttgtttcacaatgacctgaaagaaatgcttaccattaagtttgatatatattgcaattattctgcaaacatgtttgattacttttaaggaaattcattcctgttcatagttgtctaggatggttttaaaattataagtagatttgagttttatcacatattttttctgtagctattgagatgatcatgtgaattccttcccttttaactgtttatatgataatttatattaatttatatacttctggttataaacttgcttcattgagataagctccaagtgtcattccatgttcacctttcttaggcctagtgggattcaacacgttaatattttgtttggtgctttgtatcagtgctcatgaataagattagcctgtaattcctcacactggccttttaatatcgaggttatgcctgtctcataaaatgagttgagagggtgttcctttttttgctatgatctattatattttaaaatctttcctccaagcacttcccattttttaaaagccacttttggaaggtctgcttttttcctatgcgctgaagaccaagctgaatgtaatgttggttagcaattctatagttaaaatggaaaataggagtctttttgactaattaggtttcaaacagctttggttgcacagtatattcatggatgttaggatggcattgtcacaattaaggtttttgaaaaaatcctttccaagaggttgtttcccatcaacaaacagaagtaaaattaaatgcccgattaacaaacataatgtcctctttaataattctcagcactctggtaattctgctaatattactgtgctatctgcaattctttccttttgtttcatgttttgaataattcaattaaaagtctgatgaagcaataacaagggattaaatgttgtcaaattggaactcgaaataaaaacata

SEQ ID NO: 61698 - DNA, 648 bp, Bovine  19866881604037
ctgggaattttctctcaaacacgaattgtgagatcatatgaaaaaataggagcaggaagagacccccaaagtcagtacccaaccttgattctgtgtgacaggaaacattgctgagtgcgagcaagccttggagctccccagattgtcatatgtgtaatagaacctggaccattgtataaccagtaatggcttctttggccataagtcgaagacatcctatttacactagggtccttttttcaatggtgaatagattgcttttaaattataaacttggaaaggagaagtaaaaggattactgagtatgagagatgaatgaagaaaagcagtaaatcctgtgcgatcagagggataaggctcacagttcatctgacataagagatggattacaatggctctgaagtgaaggatggtttacttaggaatttagcagtaatttgcatttaaggaatccattagtgccatcacatacacagttccatcatgcgatgactaacaggagtctatggtatttgcttatgactttattgattcttataaattaggacattattgttttgattcattcttattcagggataacctactttcccaggactattggctgacgtaacccacaccagccattataaatggcataacaatgct

SEQ ID NO: 61699 - DNA, 786 bp, Bovine  19866881644806
tgcaaatcaattgagctgtcctttcatgttgcatccttcaactgctgaatattctatatggcatttcacagaaatatgatttgatttgagaacatctgcagcagtctggaacatattttcccctgtacttgacttttagctcattatagctctcagatgttctctcagcaatcctgtgacatattggagtgttactgaacaaacatcagtgaagcctatgtcttgagtagtgtcaatctcagttgaaaatgtttcagctttcttagcatcaacactggaagaatttaattaacccactgaaactttcaaaatgatagttaatgcatgtaagaaatgagaaatctgaaacggaggaggagagtggataagtgcttaacctcccacaagctgatgcctgccaccctcagtctgcactgagccaacccatgagaagccttgctctctgtgcagcctcctaaattttgctacgaaacctctggcttgctctatagcccctccggagatggagaaggtggaggtggcaactactgctgtcacactcccctggtccccaaacaaggtcagcttccagcctctaatcagctcccatccagctgctctcatgttttcagtaggtggggttgggataccaaggtcagaaaagcactgttggcagtgacacggttttttgcccactgctgctattacattaaggaagcagctggtgagataatgtatgccaaagtgctttgtaaattataaagtgcttatataattgtcaaaaataatcacttctgttatttcatt

SEQ ID NO: 61700 - DNA, 761 bp, Bovine  19866881710217
tttcatcatagttcttaagaaaattatatatatcttttaatctgaaaaatgatacaagaatgacaactattttaaattattttggaaagagtatcaaagaaaatgaattatcattctatgcggtggaaaatgtggacgtttgtttaaaatcaaagcttccatgtagtactgtcagcttatgaaaacccttgagtctacattctggaatctggagtttgctgaaaggttcatataataagtgaggcacatatggctagtctagtccctgttggacacacatctgtggcgattagggaaactacattcattattacaagcaaggtatggctgtacaaaggtcacgtgatgtgctatagtcatccctgattagtggaaaagtttatgtatgaatgtgtatgtgggaaaaagtgatgctaaattctttaaagtatagatgatacatttgatttaaatatctgttcccaaaattaatgttggaaaagagtacagaattctagaatcacatctttgtcaattaattatttgtttgggataatcaaaagaactttgtaaaagagatcagtcaatatttctgtttaatacaaactttaggatcaaagaatgaggaactagaggacccccatctatccgaaacagccaatatttaaatcatttgatgtaggtgtttaattactttaccatttccttttctgtactgttaccaatgtcacaggttcatattttttatatcaggttcactgcttgcttaattatcctatcaa

SEQ ID NO: 61701 - DNA, 816 bp, Bovine  19866882238017
acaagtcaagcaggaatagtctgaattccacccaaaagatgtgaaaagaatgtgctgcaattaaggtagaccttggaagaatgtaggaatcaaatttgtaaagagaaggaaggaatctaagctgaaagcaactggctcctttctttgtttatgccatcctcaacaccagaaaagagtagtatgctaggttgtctcagactagaaagaataaaatggacaataaacaccataatatttaaaagtgatgcaaatcaaagaaagtctcagttaacaaatctctccattccataattacgatatttgccaaaggtgatctgcttgttaatttttcttatgaagcctaaggaatcatatggcaaatcccaatgaaacggttcactttgaagcatgttaattgttcagctgttggtaccccagtactgtgtagtgtttggaggtcttttgtagctgtggaatagtgggacatttaaaaatgctaagagtatagtgtcttcccagagttgagtatgctggatgccagcctcagtgacacatgtcccacctaaaaaccatgccacacaaccccataatgtttgcagcagatttaaacatctgccttggagagacagaacatattactatggatttagcttggtgtttaatatggttgttaaattttaaattgctgtacaatgaccaatactttaggtagcaatgtaattcttccaggtttatcatctctcttgaagcttgactattcagtactttgtgtagcattaaattccagacagaggaagagtttttctttttatgtacttatttttaaatacacaaaca

SEQ ID NO: 61702 - DNA, 1109 bp, Bovine  19866880393312
cttggttaccgaaggaggttcatggtggaggtgtgtaagttcccgcttttatctttcattagaaccagcctgcccttgcacttttccatttgttctttaggtggatggggtcagctacctccttcaggagatctatgggattgaaaacaagtacaacacgcaagagtctaaggcaagttccatccatggttctttttttttttttttggcctttccctgcaggatatgggctcttagttcccctaccagggatcaaaccctgacccgctgcaatggaagcacagtcttaactactggaccaccagggaagtcccccatccacagttctgaatgtcctcttcccaggaggcagggtgaggatcctgatccagccaggatctaggaatttagcacaccaaactctgaaatttgtctggtcctagaagggtacttcttcttcctcatttcagatgattataattatatttaaatttggaaatgaaaaaatgggctggtttggatgggttcttctacggggctctgctcacctagttccctggaccctcagtttgtcgctgccccctcccctgtgtggccttctgggctcctttagctctgactgatggagaggaccagatctcagctccagaggaggagcttggcacacacagttgccgaaagtgaaactgggcgtgcacatgcacttggtaaaccatgaagttcaatgcaggtgcaagattctgttcacaggacttgtctcagctctgcaggcgagctgccttctaaaccatgggggatttccctgggggtccagcggttgagactttgcctaccaacacaggggttgcaggttcaatccctggtcaggaggctaagatcccacatgccttgcagtgaaaaaaccagaatataaaaataaaaaaacagaggcactattgtaacagattcagtgaagactttaaaactgatccgcatgaaacaaacagatgaataataaaataaaccatgggtcatgagagtctttgtgacactggctgtctgcccccacccccccccccgacaggtggctgaggacgaggttagcgataacagtgccgagtgcgtggtgtgtctctccgacgtgcgggaca

SEQ ID NO: 61703 - DNA, 931 bp, Bovine  19866880456341
cctgggagggggtgtgtttcatgccctcaggggctcctgccctcctccccacagctttccacctcctgaggccgggggttcagcagaaaggctggttttcaaagctgcccttggagcccacgggggccaggggtgcgagggggtccaacggactgggctgctctcctctctggctctcctgcacgctcttggctcaggaaaccctccccggcaagcccggccctggtccctggggttcggtggagggggctcccactccaaagggccctgcttcccagggagggtgctagggcgtggctcacccctccactgggcccgcaccccacagcctgaagctgggcagcagcggcttcctgcggggggacctggggcaggtggagcggagcgtggggcgcctgcgcaccatgcactccaagatgctcctggacatcgagaaggtgcagatccactttgggggctccatcaaggccagcagccagatgatccgcgagctgctgcaggcccagtgcctcagctccccctgctacaaacggtgggcagccgggctgggcctgggagcctggcaccagggagggcagagtgtgtgtgtgtgtgtgtgtgtgtgtgtgtgtgtgtgtgtgtgtgtagagtggggcaccagggagggcagagaatgtgtgtccgtgtgtgtccgtgtgtgtgtgtgtgtgtgtgtgtgtgtgtgtgtgtagagtggggcaccggggagggcagtgtgtgtccgtgtgtgtgtgtgtagagtggggcctccatgtaggacagagtatgtgattgtgtatgtctgtgagaatgtgagcgtgcgtgtaagtgtgtatgaaaatgtgggtgtgattatatgtgtgaatgtttatgtgtgtgtttttgagagaatgcaagagaatgtgtattgtgaatgtgtaacatatgtgcgaat

SEQ ID NO: 61704 - DNA, 1344 bp, Bovine  19866880456984
ctggccgctgttgctgagggactgctgccgatgcccgtgtggccgggactgcttgttcttgtgcttcatccccgcgtctgatgggagacggagaggggaggctcagttctgagacacactctgagggggccgtggggatggggagaagggcggcgggctgctggtctcagcctgcctcagcgggcgcccttctcagtctgaattcgtggaaatgccctttataagcaagcactttgctcattggaaaagaccctgatgctaggaaggactgaaggcaaaaggaggaggaggcagaggatgagatggttggatggcatcaccgactcagtggacatgaatctgagccaactcagtgagatagtggaggacgggagcctggcgtgctgcagtccccggggttgcaaagagtcagacataacttagcgcctgagcaacaacaagcacttcatccccctgtatgtctgtctggccatctgtccatccatccatccacttactctgatatctacccacggacagcagccccatgccaggtgctgggtgagttctgacccttggtttacagttcgggaggggaagtgactagaaagatgcacacacacctgctaagacccagagggaggtgacaaagcacatccaggatggccaactggaaggggacattccagaacacgagaggttcacagagtgtaggggctcaggaagagttttgaagagtgggtgatgctgggatcagaggcttaggtggaaaaactggggtgacagcctgtggatgaaggctggccagaaaagatggggccacgacattcctgctaactggccaagactggacagctgtccccctctgcaaacactcacctgggggcatttggagtcagggaggtggaggaggaaggcagtcggggtctggtggccccaagaagtgctggggcctccaggagccagacagaccctgcgggacccaagcaaggagcccgagggcctctgggccatctggacactcactgtctttgttcaggaggtccggcagccttgtttccatccgtcccttgtaaatatgtccatccaggcccaagatgtccacctcgtcgtgctgtggagatgggtgggtacccatggccacctgccgcctgagcgcccctcctgtcccctctctgagtcaaatggtgctcagagccctcgaaggggctgagtgacagggtgaaggggatgggccagatggccgggagggctgtcttcttcccaggaaaggaaaagaacctgaggctttgactgggtctgattaagaaactgcccccgaagctgagggctgaacaggggactgctggcggcttttccggaggg

SEQ ID NO: 61705 - DNA, 4145 bp, Bovine  19866880649063
tgccctccctgtgggcttggaacttggaactagcttaggcaggagggaggaaacagcgctgctcccctgcagtctccatgcccagcatcttccagagaatccctcaaccctggtctcaccctctcccgttctcagatccttccatcccacctggccgaccccaggcacccctgagcccgcatggggcttcataccacatgtgcacccatgagcccgcctgcgtgcaggtgccagggaacggtctcgggctagacacccagccaggaaagagggtgcccctgagtctacctgtcccccggcttgaagtcgcgtgtgattttattcttcttcctcttgtgtttcctctttaaattctttattgacaaggggatgctcttcttgcgactcgtgccgctgccgctctgggaggaggtggtggagctggcggaggaggtcaccgagctggtgtcgtctgtgtcgtcggcggcctcatcgtccgcgtcctgctcggccgagtgcagcctgtcgtccccaccctccttcagcaggaaggggggcagctgctcacccgcctcgtgggcctcctctgggccctcgtcctgcatctccactgggcttggaggacccatcgggcgtctcctcggggctggcggagcccgtttcgctcttggctttggccgcccccttcttgcctgcgtcctccatggaatggtccctggagcactggacgtccggggagcaagatgtgatcctcacaagctgtttcttcaggaggcgcttcacctgccggcagagcgggagggcgggcgccatggagagctgactccaggcagctcggtcgaggggtgacggctgtatacacctaactggcctgcaagggtcatcagggctgccccccaaggcctaaggcacagaccttcctgctgtggaaatggctcaaggccagttcctcaaacgcccgccaagccccaaccccgaggacataccttcttggccacagagccctccccctgggcgcagtgtttttctggacattcacaggcaatcttggccggctctaccttggctgggaagacatacagacagcgctccccaagctgccgctgagcatggtcaaagcatccgagacgcttcaccctgggaggcgagagggagaggggaaaggcagacgctgggcgagggggtcctcggcaacacccccggcatctgtgcctgtggcccagagacttgcttggggaccacctctggggctgctggagcaggcagggggcgtgctggggccgctcacctgcctaggttttcctgggtaatgacagagggtggggggctgacgctgtccgtgccccctggacagaagctcttggtgatccaggtgaccttcagctctacaacctgcacctggggaggcgggcggacaggcccggtcagcagactaatgccgctcgctcccgcagccgtcctccagagcgggaggcaggtctacatcgtagttcagaccctcccagaggtcacggaggcctcctccctccagaagggcccagcggacctgccactggccacctccttccttcgctcagcccgggctccccgtcctcagagcagcccccttccaggcgaggcaggctgggcaggagtgcccgggcctcactccctgccacgcctcctccttacctcttcgaccaccacgcggaacttgctcttggtgctgagcaccggcttgacgcccgacagccactggacgctggagaagatcttggcagggccaatgagcacctggcccgggtagaagccataggaatcatcgaagaagagaccctgcaggattgggggccagaggagggtccctgtgagtgctgcctcttagggggcgggggcagcagtgtccacacctgccgtccaccccaggcctccatgctccacaccacctaagactgcagagtagcacctctcagacctcagatgcacacaaaccgccaggggttttactcactaaaaggcacggctggcccatcctgcttataacaagctctcgggccacaacaatgctgctggtctggggggacaaagctctaagagcaggggtccccaaacctgcttgatcacacacactctcctagtattacttaaaaactgtcatttaccactgctctaaaatgtcacatcacagtaaaatactgtgtacactccaagaaaaagggagattttaaaaggatgagataaaaacttaacaaaacgcaaagaaagttctatgcttcctgcaaacacccaagcttttacaccttctgatacacacccccctccttccaggaaagcactggctgagaccactggtcgccccgggccagaccctggctctctgccgagaagcccctaagctccctcctgcagagcccagggctgaggaacaggagacgcgccccccacccgcggccccccaggctcctggggtggagccaacgtacagagtcgctgacgtgcgggcagacgtcgtagagcttggcgccatcctccgtgttcatggagcacctgcaatagggggcgggggcttggtgggcaccggacccagtccctgagtctcaggggaggcgaggcagccaggaccccggaaggagctggtcagtgtctacaggacttgtgtggaggcgtcagtgcctctgcaggccttaaaatgggtaattcacccctccacccacaccttagtccctgcactggaacaaggaactctctaaaacaaacaggactcagccagcagatttcagcgttcacccccttaaagtgcctaagggagagcatcagcccctcttgggggtcctatgtgatgacgagggtctccccaagccagggtagagcgaagaccaggaactgagccggggaatccagccaggctgacaaggagaccagcccagggtcgggccctgagacgcaaggcccgcagcccctggcatggccctcgggggacctaggacgcacccctgccccttccccaacggccccgccctgcgagggctcctgtgtggtggggagaccgcacctggcgccgttggacagtttcaggatgatctggttcttcaggtcgtagaccttgcccagccagcagtcgtaggcgatgtagtccccgtacatgaagggctgcagaccagacagacaggcggtgagagacgacggaggactctggtgtccagaaccctcgttcctcttggccccacagacggcaggaaggctccatgtgggtcggacctagtaactgtgcagcaagcttcccccaagagtccccagctgctcgcccccacaggggcagaggctggacggccttctgaggacacaggacacgtgagtgggagtgagctggggtgggtggttacacagtaaagtgatttaaataaacagataactatatggaggatattaagagccaagtctccctgctggggacagcagccactaacacaggaaggggaagagggaggagctggactggggtcagagggatcaagacgggctcacacatctgaatacgtacacaagatgggcacaggcacatttagacgtgcatgcttatccacctacatacacatatagacgtgtgcacttatccacctagatacacatacgtggattccctagcgctgccctgaatggggcccaggagcaatcagcacacccagtttgcactgagatcatggcttttgaaagaaactagggctcgctgaagaaacggctgattctagtctggatcagaaatcaaacaatatggaaagtaaagtgttttttaaaaaaatggtggagacatgtcaaaagagcacagatgccagcttgaaggggttcctactggccaaatctgggtgggatcactgaagcaacagaacaagtaacggattacaaccaatgaataaaacaggagtctctgcatctgatgtaaaaaatgaggaaataaatgggacagaaagtacagctcttccatatggtagaatgccaaactcataataaagcaggcagtgatggtgtcatgaaatcaccatttagcagccatcaggctgctggctgggtcaggtgggaattgttaatggaggctaaggctggtggatgggagttgagaaccaccagtttattgacacaatcccggaatatctccccacaaaaccaatatgatcgcggccaaggggtga

SEQ ID NO: 61706 - DNA, 2304 bp, Bovine  19866880649695
tgtatcaaagagtcgaaagtctttttctgatggtgctcagggatgacgtccgtcagcagctggtactcgctctgggccagcttaacaaaggcactgacgcagtgaatgtaggcatcggtttccacgtccagcatgtcatctctccctggggggacagcagggcccctgagctactggtttggggtagcccctctccctgctggggtgggggccgtgaatctctccagctcctgggctgcagccagattggcagcagatgggaggaagactgctggcagaaagctgagaggactctagcagagccgccagggtttgagggggaaaaaaaggggctgagtccagccttggtctgagcttcattttcagctctgctgtgggcagtactactgtcccagagcatcaggtatgggaggtgtgggggagatggattcaaggacaagacccctcagtcgacttcctggagaagacacgtctgaacccagacgggggattttgaactgtactgggaagacgacactcagggatgggcaagaggcaatatccaccccgaggaggctggcgccatctcagaagatgctgggcctctgaaggcagacactggcctggccaggccttctggaatgtataaaaaggcggtgggctctggtctatgaggctagctgacatgggatcaaagttggacagcaggccacgtaagccccagagagggaggcttgcttggtcgtcagctgccccgggaggagcagggggtccctccacgggactggaggctggggcagtggtgtccgcaggcaaccagatgctacgtgccaagggacgggctctgagggggtcagagccttggagctgctgctggagtcaggtgcgggcgctccctaccctccaaggggccgcctgcagcttctgccctcggcccaggcctggaaagcccagcctgcactcccgtctggagagaggcagggagacctagtgcccgagagagagagagagagaggagaccggggagagagagaggcgagtaggcctggctcgtccttggagcagaggccggctgggcagcgggagcgggcccttccgggggtggccgggagtgcggcgctggcggcccgcgggctgggctgcggtactcaccggccagtggcccggccttgtcgttcagggcctcggacaggtgcttaactcggaaatcatgctcgtgacctagcgagacgtcagccgcaaacacaagcagcgtttatccaggggcgggatggctgcctcttgggtgggggcgggggctgagaaggagccctcaatctccagggggcggatatgagatggggtgtacggacgggggcactggagagggctctgagcccctcctctgcctcagaccaccttgggaacagccgtttcaagcctgacttgcagtgcctggaccgcccttgggagccggcttccccaaacccggaggctgagaaagctgtgaggaccacagagggtttctgaagagtttccggcagctgcagtaggtctgatgctcagccccaggggctgtgtctcaccgtatttggggagaggtccagttagagatatgtcactgcccaatgaatggggacaggctccttttgtcccccaggctcattgttttgaaggcggatctggtccaccggggcagggctgtccctcctctgatgggagacggggggacacaggctgcgcacgctcccccttctgaaggtggggggtggcggggggcagccagcttggccctgccactgctggtctgagcgtgaaagggctgcccgtgacagagaactttctcagagttcaaaggggagacaagaaggacagagacaggatggggagggggcgggaagcctccccgggggggcagagcctccgtcagccagacaggactgggccaagaccacaaaggctgcccccgagccagccagcggggctcagtggccccagggacctcagttccccccgcccctctcaggcttgtgccagaagccctctggggggtggaggctctgccctgccacgggagtggacacacagtggaggaggagggaactggagaggaacacggggtgattaccttccagaggaatgaggttagagcccccctttttcccatctagaccatgctgagaatattgtttcagaagattctgagccttacggatcgtccctgtcaccagagccacacagagaggagacaagaagacctaggaaatgagcgagagaaaacagcagcagccctccaccgagccctctcccccaggcctgcgcccaccccagcagtgagcacgcccg

SEQ ID NO: 61707 - DNA, 2894 bp, Bovine  19866880659586
gtggcggaggaactggtctctgtgagaggagaagtcctgttaccgcggcggtggcagcagccaagaccctctctggcctccccttggcccggggagcagctagggaaaccctgggaggggccttcctcgggcagagctgggtatgtcctgagctgcggggctcccttcctgctgaggggagcgcttcctgggactcttctggaatctggggagacccctccatggtcttgggtggtggggttaatgagctgacccccaaggaccggcaggaagacaggcaggatgggcgtggggacagccccttcccccaacccaagctgggtggtacctacaaggcccatgtatcccatttattagcagcagagttttagaataagcccctgatagcctctccaccttcttccccaccacccataagctcctctaccaggccagaggtgtcctgcccacacagagcagaaggccagggggttggggagtggacagggtaggaaggggacagggaggtgctggaccagcctgaagggtgtagtcagggtgctgggcacagcaggatgctgtctgcagaagcccagagacagaaactggcggtcagggagctgagggggtcaggagcaccctgaaggaacccgtgcccctctgaccctgctccaactggggccctgagcctgtccaggggcctctgtgcccagggaacctcacccacggggcttcagagagggaggatggggctgccgagccctgctgcttacctcgggggtctaaaggaatattgtatgtgtccccaagaactacgcagtgagaggcagtgcgcacagaggggaaggggggagacaaaggagggagaaagatgcaaagtgcaaaacaggttagagacggccgccacacccgagccaagcagcccacgcccctcgacgccgggacacagacagcaggacagcccaggttggacccccgcaggccagggacacactgggaagtggacatcaggagaacgacaggccagaggctgcccccaggatgcggggtacagggaaggcccagggctgggtctcagcgcgcgcctccccacgtgctgacttcccaaccccggtcacgggaagataccaggctggccctgagaagccagccgagcccgctcagtgggtcagcggtgtgagaccaagtaggaggacaggcaacacaagaggaggtggggagatgcagaaggagggggagcgggcgggaaagacaccttcagacaagtggggtctgcactccagggcgaggacagtggagggagccggggggacagaggccagggcaggaggtcagaccccggccctcctgatgctgggtctgatgacccaagaggcttgggggggagggtcctgtcacaggccacaactcctttccaccccctagggtggggggatctcctcacccagagaggagggtgccccctgggggggctaaccccacgtctccagcctggagggaggaatggggtggagggccccgctgggaggggtcaagtaccttgggaggccagcatggcgcccgccgtctcctggaagtccagaagctgctgcaggaagaggatggcctgtgtggggagaaaatagggccaagaagaaggtcaagggcaggacccaaaggctggatcagcccccacggtgcagcccctctggccattccaggacaggtgagggcaggcgtctgccggtgaaacagctggcagcaaacctgccacttcacccttgtgggtctggcctccggggaaaggccccgtctgcagggggtgctcagcgcctcccgcccatcctgccacctatgcccctcgcccgccccaggagtccccggcagcacctacgttgctcgtgagctcgtgcacggtgccatccttgggcatgttgtattccttgtccgggtcattctgtgggacagacagcctgaatctctgagacagctcctaaggatgccccagcccacccagcacctgtctgtgggcccaccgcgcaacctcctggcagacacgcatcaggacaccccatcgggcacaaacaaaaaagcaagagggacctaaaggagcttgatgcctcgggtgggggtctctgggaaagaaagggaggcccgtgggtactgacaggagaccagcagcacggctggccggcttccccgcagggcaggcccaccccacttggaggcctgctctcaggagttcctgaggccgttggcagtggccctgcctgcagccccgccggccggccggggtggcgtggacagaggaagggcaccttgatgttgtcggcaaagtcctccagcgctttggctcccacggtctccatggaggtgatgaggctgggcagcttgttcttggtgctggcggccgtgccctgaggatgtagccacatggctgcacagggctccagagccctgctccttcccagccccccgccccggggactgtctcttctcctcactcccccaagagcacctccacccacccagggccccggggaagctgctgctgcccctcactctgagcagagaatgcagttctcctgggaggccctgctgggcggcgggacacctcctcccggcgtccccaagggcccccctgcccccacgtacctggagcacctggtcaaactcaggcttggtctgcttgaggtgccgcaggatggggaagacagtgagcacggctgagaagtcgtggcggatgatggccttgcgggcggccaccacaatgttctcaccttcgagcatgagcccatccagggcatcctgagagagtggggcagggggagggctcagggaaggggcagccagctggctcccatggccggtgagggcagccggaagggtatggggggcagtgtgcctccgatcaggacacatcacccagttcagag

SEQ ID NO: 61708 - DNA, 1255 bp, Bovine  19866880667453
gaaaatccccatggacagaggagtctggcagggctacagtccatacagtcacaaaagtcagacacacaaacttagcaactaaacagcaacaaccacaaataactaaaccactttgctgtacactcaaaattaacccagtactgtaaatcaactacactccaatataaaataatttttaaataatattaatactaaaaaaagaaataaaatttcaaacttgaaaaatagaaaataccagaatacatccacgtaggaatgaactcctagccactcgtactattcaaaactgtcttcaatttacaaatagaatcaagacacggctgctcttacatggcaattccagccctgggtggacagtcgcgttcttgaccatcggcggggaatggcggccatcatccatgtccatctctgcacactgggcctccccgtggatgacagccaggcccagacgcagcctctccgcgtacgactgggccctgagaggaggccaacaggagtgggtgagacgcatgagaaggaagacccaggcacagctttctcatcacttcattaaccacagaatgaaaataccagtccaccgtttagggacacacaaagtaactgtttctacaagtcagaatgtgaggctcaggccagaatgcaaacgtctcaagaggcaccctaggggggaagtgggctggcatctgattctgggcattttggttctactctttgcccaacagcctcacattcatctttagttgctttttggttttgtctttttctctattttttggccgcttgtcacgccaggatattagctccctagccagggagggaagctgagaccccgacactggaaactcactgtcttggccactggactgccaggggagtcactcatcttcagaattctgttcaaaaaggtttcaaaaaccaatgcctgaaaggcgcttgtgcaattcttgttttccttttgctgagaacttgaaggaagaacttcattttctcccaagggaaaactgagtaattccaagaaccactctgttacttggagactagaggtaaagctgtggtttggagtatgacaatgacttgggggaaagctggactcgggagctttcacaggctgtattaggacagaccctgggtcctaacacagcccatttggacttcagaagcacccaaaaggggatggagtgtgtctggcttatttaccttttttgcagcatcaggcgacttagctacaatgactgcatttctgtaatttgggaat

SEQ ID NO: 61709 - DNA, 930 bp, Bovine  19866880718597
accccatggactgtagccctctaggttcttctgtcctgggattttccaggctagaatactggagtgggttgccatttccaggaagacacaggtcctgaaaacaccaaaattgccaaagctattttttcttgggtatcaatgtggtctgttctgaagctttctttaatgtttaccatttgcagggcacagctgtagacgcccagcagaggcatggaagaccaggcccccgagccgttctggtcatctgctgtggacataaagtcaacttgggcagagaaagcaacagaattctgcctctgatttgtagctgtgagtagtggagatgcttaatcaatactttggcttctgagaatctgtttggcaatgaataggagtagggcttccccttctcaggctgggaaacaggagtgcccccctcctgggagcacagggaaaatgaatgaggtcatgtttgtagagggctttgagctgttgggacgaaagcagctccccaagtgcaaggtgttattaaccgaaggtattattattttcatccgagaggacagagcgcagcaggcaaaacagagcaataaaagcatgcccattaatagcgaataaagtacagtagtagtctcggaaggaacaaaatccttgttacatcaatggtctaggctacagaaagagccaagatacaacaactaggagaaacagtcttagctagtatttcctcgggggcaggggaggtgggacgggggtccagataacaaggatgttgggaatgcaagtcctgaattggtggagagacaggcaacaataaatcgctgaatcgtcaccaacagttgcaattaaccaagcatttctggtgagccaggcatctcttgaagactttattgttgtttagtcgctcagtggtgtgcgactctttgcaacccagggactagcccaccatat

SEQ ID NO: 61710 - DNA, 1538 bp, Bovine  19866880776840
cagggcctgaggctgcagcctccggagtgcccaccccggacgcctgtgcctgcccaagcccgcctacttgccattctgtcctcgaatgtcttgaccatgatgccatcaggcagtgaggtggccagcagtgccatctccttccgcactgtgctgaagaacttcttggcttctggaggctggaactcaattttcttaaaagagtgattcgctagagggggaaagagggtggtcagtccctcaggcgaggcctgggaacgccaaccggaggagcagcggcggctgaatgtgctccccagacaggtggacaaagcccccgcctcccccgccgccctctcctggcatggggactggggcccactccagggacacggcgccctggccctggagtgaggccagacgaactcacagggtgcgaactccagcaccgagaagacctcgcccttggcgctggtgaatgtgactccaggcttgccgccgcactgctggcagagcaccggggtctcactgggccactcggccttcactggcgactgcccctcgggcttgtcctccttgcgctccgtctccggcaccgcctccatcttctcttcctcggcgatggccacattgtccagggtcttcttgaggttctcctgcagcttcttgatgtcatctaagaacttcttctcccgcgtgggtttctcaggctctgccgtgggggaggtgggcgagcctgtcagcagctgctccaccgtcatgttcttgaggctctccaggatcttgatggcttccttcagctcccggaagctcttcgggggcccgtccttgcccgccttctccatcagcccggccacgggggcggccatggccacggccccctggatggcggccgtggcggcctcctcgctgatcaccacacccttgtcctcctctggggctgccggctgctcggcggtggggatggggggctcctctatcttggggtgctcatcctccaccagcccattgtctgtctcccagctgtcactgtcgtcttcccactcgtctgaggacgctccactggtgctgccttccactgagtcgtagtccgactcctcgatctcagactcgatgttgtacaggtgctgaggggagaatgggggcgcgggcttggtcagaggccctctgccagggaccccgagcctcagagctgacactgaccgggcaccctgaggcctcagcagccctgccgccctttctccctttcctgctctggcctcgcggttgggcctctgcgctaggtggtccctaggcctctgggaggcaccccagcccagcccctgggtccagggtacagcaaatgccagtgccagcctcctcgtcactgaccgcacttggtccgctggaccgcggcagactctgtgactctgttcccattcctggaatggcctcctagacgaagggggagccactccttcgtccatcctgtactggcacagggagaggggagctggggtgtgagcatcagatcaaacgaggggcacagaaatggagactgcgaaagcctgtccattcctgcc

SEQ ID NO: 61711 - DNA, 1410 bp, Bovine  19866880909834
ggggcttgggggaaaagggggtccgtggaggctgggcaggattgtgtgggacagtgcctctgtttgtgcctgcctgtgtgtgtgtgtgcacgtgtgtgtgctcacgcgtgctgggggaaggagctgtgctggcagggctaggtgggggccgggggtggggagtgatgggttccaggcaaagctggggcgagagggttgaaaggtgcctgctgagtgtcacccatttcctgtgcctcagtttccccatcagaactctggtaggttggttccccacaggctggaacctgacggtgggagagtagggtctaggcaccctgtctttcatcttccctggtggccttcctcaccctcagtctgcattggagggaaggtgccaggtggggtgattgcacccgagggtgggaagtaggggccctggggctggggccctctgacctcacaccctgtccctccagaaagggaccgaggaagggaggagctggagacaggcccaggcgaggactgaaggcaagcctgggcaggcccccgtggtgggggagttgggggtggtgggggagttgggggacgtgaaaccagccctgggcaagcccggcctttgtgagtccccagggccagggagggagctgcgcctcctttgctgctgcccgctggggactacaggtactgtctccacactgcataggtacaggcgctggggcctggctgcaggggacccctcccccagggctgcctctcagtccttgtctctggggacacagaggtcatggggagggcatcagctggcactctgcaggcctttggtgcccccaccccgtcttcctcccagcccttcccccttggcagtgaagcccccaaaaaaactggcccccactttcccccaaacaaatttgcaagcaggtccatttaaaattttttaaaagctttatttttaaaaatgttttactgtaaataacttttcatgaaaaagttaagttgcctcacggggcaggagggtggatgtgggacacagcccaaggggctcagggtggagcaaggcactcccctgcacaagcacaggcagggggctcggggtgatcccccgtttcctggtcccagtggttctagcaagcaccgcgtccctcccggttaagcctcagctatagctacactcactaaattagtctttctgtccccccttccctctgcagcttggctgctcctgtccccaaccctgcataaaaccaactccccgctgctctcagcctcaagttgggctcaaagattagggatttatacctctagagatggggccagaaggccccagaggccttagaaaatctcctggctccacccggcaccccgacctcagttcagtctcctctctctggcccccttccccagctccgccccacgtactgccgtactgccggc

SEQ ID NO: 61712 - DNA, 1669 bp, Bovine  19866880918629
catgggattttccaggcaagagtactggagtggggtgccattgccttagagagaggaggtttgaaggtaccaggaatgcatttgaggctactctgtatgaaactagttcctgttcagtctaggaaagcatcagagagaacataaattgagatctggctttaaggggtggaagggaagccatcctgtggtgattttctgaggagttaatataatgcttgcctcgccttcagatcaaactgcagccagtttatttgggccacctccgatctgccaggcacgtggtagatcctggggatacagtggggaataggtataccctctccctctcctcttggagcctactgtctagaaaaccacagcaaatgccgaagacctggctggggggccgaagcagtgctgggacaaccctgaggcctgagagcacggggcttgcccccgcaggtgtctatcctgtcatcctttgagagtcgccttatgaagctggagaactccatcatccccgtgcacaagcagacggagaacctgcagcggctgcaggagaatgtcgagaagaccctgtcctgtctggaccacgtcatcagctactaccacgtggccagtgacactgagaagatcatcagggaagggtgagctcgggccagagcgtcacattcctgacgcctcttggaccagtaggctttggaagggggatagaatatgtataagcctggagtcccctgtgttaattctgttctcccattccaataccattcctcttcatcttccatctgcccgggctgatgtggctcttctcctttccaggcccacaggtaggctagaggagtacctgggaagcatggccaagattcagaaggctgtggagtatttccaggacaatagcccagacagcccagagctcaacaaagtggtaaggggccagcagagtgatgtgagagattggcagacaccaatccctgcccgggtctcattactgacactgaaccagctaaaagataatatagtcgaataaaaagaagtatataatactatgcacatactatagacattaaaatctctgtttcaggaattacaggtatacattttgattgcattttaataatttagctaaattataagttgttgtttagttgctgagttctgtctgactcttttgcaaccccatgaactgtagtctgccaggctcctctgtccatgggattctccaggcaagaatactggagtgggttgccatgcccttttccaggggatcttccttgaccccggaatcgaacctgtagctactgccttgcaggcagatttttttttttatttttaaactatctgagctaccagggaagcccaataaaaaaaacaagcaaagcaattaaaaataacaaaagatttgaatagacatttcactgaggaatttatatggatggcaagtaagcatgtgaaaagatgctcaacattgtcactagggaaatctatattaaaaccacaatgaaatcaacctactggaattgggaaaatagcaataataaaggaaaaactgataataccaagtgctgttgaggatccagaacaaccatcctatattgttggcagggatgtaaaatggtgacagtccctttggaaaacagtttggcatttccttaaaaagtttaatacactacctgctccaacaatttca

SEQ ID NO: 61713 - DNA, 738 bp, Bovine  19866880962196
ctccagatccacgtcggcgatgaaaccccacgccaggctgagcacagagaagaggcgctgcccgcaggcggtctgcagggatagcaggtccatgggcgccagcagccggcggcacagcagctgcgtgcagttggtcaggaggtcttccttagtcacctgctcgtacctgcaggggagggagtcggatgaggagctggggcaggccaaagtaaccttgagcccctgggggagttgacagcgggtgacagccaactggagtcactgagagagagagagagagaggaccctggaacagaggctcagggctccagagacgagtggtagctcgcaggcactcataaaagaaagcctggcaggacctgagggaaaataaacccgcttggaccctggctctcacccggcgtaatagttcaaagaagcggccactgcattgccagagcctgccgggaggctacacaggggcttctggatggcggtctcccagtcaggccgctccatgagcccgttcaccacctgttggagcacaggaggcctcagcctgggaagctccccccacccgccacggcgcccccacaacccagacccaggcccagcctcccctgggaaggcctcacctcgtggatcagcccatctccggacatgaccaccagcgcgtcccagcgtctcaggtcctccgcacgcaccagctcccgggcgtggttccgccgctctgtgcagagggcgcggctatcaacgtgg

SEQ ID NO: 61714 - DNA, 1331 bp, Bovine  19866881112238
cccctgcccaaagaccctgacgctgggaaagactgagggcaggaggagaaggggcgatagaagatgagatggctggatggcatcagcaattcaatggacacgaatttgagccaactccaggagatggtgaaggacagagaaatctggcatgctgcagtccgtagggtcaccaagagtccgatattaagcgactgaacaactgaacaacaacaccccaccctcctgagttcaggacccttccctgctttctgagacttcccagtaggtcctgggaggtggaactgagatctgaggtgttcgaaggtaggatttttaagaggcttcatcaatgcccagtgtgctaggatgtaaggcagtgtttaggctgcatttgcacgagaatgtgaaagtaagaaggtcctcccttcccaacctttccctgctccccttcctcccaggctcccagaaatgggcctgtgctcctctggggcatcctgggatacacctctgggtgggaggaggctggccagttccttggccactcaccaagagtcgtggagagctcccagcttctggtctcccagggatggagacctaggtggcctcttgcccatgagggctgggttctgaggctgaagactgcgggattttctcctgtccccaccggggtgctgcccaggggctaagctgtgactacactgagtgacatctcctggtactaactctgagatggaaaccagcctggaagggctgctgggggaggcagagagccgcacctccctcaggccgctgagcctgtcccggggctgagtgtgagcaggtaggaaagtctgcccggtcaaccacccgcccaggctgcctagggtgggcatcacccccataccttctccagaatctttctggcaaattccagctggtgcagttgctgctggtgggcagctgccacctcagtgtaggccttcgtcaggttcttctcctggagaggccaagggagggggtgcgccagcgtcagctcctccctcagaggctgcagagctggcagcccgggaaggaggaacaaagagcccggctcacctgggcttggatgctgtcctgcaggggcgcaactcgcggtctcttgggggccgatcccacctgggtgggctccagggaacctcggtaggtgtctgcctgcagctcatagtcctgagcaggtggggaaggacatagactggctgtcagtggggggagctaggggaggggggagtcggggactggcggaaggagggagggggagggggagcataaagagggaggagctgaagggactgcttacctggagggccacctgcaggtgctggagaggcgggatg

SEQ ID NO: 61715 - DNA, 1139 bp, Bovine  19866881380786
aggaggagcagacgagctggaggcaggcagggaggacagaagacgccccccatcacggccaccctctgggggtactcactgtccagtcacaggtgtctccaggggacggtcacatgagaggcagtggaagtgtgccaagagctgcctgtgagggatgggacacacgcagagggtgagagccctgcccagagggccccaaagggagggatggagaactcagagggtttggctggtaggctggacactcaacgcccagggggaacggggccccaggccactggaggcaggtctgggccccactccctgcacacatcagctcctaagaggtgcccacttctgggcacacatctagcgcccatctaccctaacccaaaaagccagcagggctctcaagggccccggcgggtgggtgccctgtgtaagccttgacagccctctggtggccaggaatggaaatgctgggactcgagctgccatgagccaggcacccccaggaggagttgcccccgcaggctctgcctctggtgggctggggcctgtcaccctgggagctgagctctgggggctatggacccccctcccacctgtgcccagagaaccttacgccccgctcccttccctctctctgctataatatgaatcggcctgagctacaagagcttttcaagctctgtcccttgctatggccggacagtcccagataggatctgccagtccctctgaacacacatggggaccctccagccggcccaccctcgcccctaccgggcctcacctccgcatggcggctgcctcgtccgcctggtagagtggagagcgctctttgagctgctgtcgcaaggatttccaccgatcctccagtgactgcttcaccgggtccaactccaggcggtccagcttgggggaggaagtgggggacggggaccaggtgagctctgagaaagcaggtgggggtctgcagtgcccggaggaggtggcgttgcccgggtcaccttgttgtccatctccaccaggagcttgtccagcatcttctgccagtcctgctcctgccccgtcatcttggccaccagctcctgcatcatgggttcagctgctccgtggggcgtcgaacggacgcggctcacttggccgccagggca

SEQ ID NO: 61716 - DNA, 474 bp, Bovine  19866881790171
cagcctggcccagtcggtcatgtccatggtgtcctcccagagccagcactcccagatcagcaccgacaccgtctcctccatgtccggctcctacatcgcccctggcacggaagaggagggggggaggccctcccctccccccgggccgccagcaggaccccctcagatgaagaagaggtaagcggggggtgcgggatggcccttgccatctgcagagctctggttctgcaggctcatcccaagcagctcagtccagggtctgccagggagatcagaaagcctccccagtgctcgggaagggagcccagaaaacagggtaccgcgtccttaagtcgaagacaccctcatatctgatctttgatttggcaccacttctgtcctgaggattggtttgggcttgctgccaggcgagctggggaggtaagcttgcctggcagcttacaaggtggtgtctgcaccttgatttttgccgct

SEQ ID NO: 61717 - DNA, 1053 bp, Bovine  19866882106742
ctgtttcgggccgaggatcactcgccccgaacttcgcgcgcggcgatggccactcaccttctgggatttttttacacaactggactcccctccccctggcggcccccggggaggggcttgaagacccgatcccacggagagagccggggctctgactcatcgtcgggccggaacccgaggtcctagaaaagacaggctctcaggaaaagaccctttccccctgggggtggtggtggtgggagctcagttccaggacccgaacgcccttggtggcactggacctcggctttctggacctcttggaaaaataggcgatgccggtgcgcgcggctcccggagcgtggtcccagaacctaatggggcgccccctacctcagggggccgctccagactccaccagcgcggtttcctctccctcagatccggcaaccgcagggaatgacgcgggtgcccccacagccccggcaacgggcagggagggcgagccccatagccgtcaccgagaggcccgcctgggcagcaccgataaggagctgaagtcaggagccgccgcggcggacagcgtccggacggcgccggggacccctcggcagcggggcgaggtcatggatgcaggtttgtgggggcctggcggggaaggcctgtagggggattcctattctccctggtgaggaaagttggccggagtcaactgaacaagaggggctgggtaccctggaggcgagcccttttccccatgagactagaagctggtgggagtctgagcccagccaaactggctggagtgccccgctggaggccgctgccgctggccaggctcagctggatcaattacccgtggatttcaggcgccgcgtttccacccgggtgcccgagttgtgatcctcagcccctagtggcggttccggtttgtgtttacagcgggcggctcccggaacacgctcccaaggccctgccacgtgctggtgttgttaaatccgcgcgggggcaagggcaaagccctgcagctcttcaggagccacgtacagccgctgcggcccaggccgacgtctc

SEQ ID NO: 61718 - DNA, 1485 bp, Bovine  19866880363722
ggggctccaaaattactgcagatggtgactgcagccatgaaattaaaagacgcttactccttggaaggaaagttatgaccaacctagatagcatattgaaaagcaaagacattactttgccaacaaaggtccatctagtcaaggctatggtttttctagtggtcatgtatggatgtgagagttggactgtgaaagaaggctgagcgctgaagaattgatgcttttgaactgtggtgttggagaagactcttgagagtcccttggactgcaaggagatccaaccagtccattctgaaggagatcagccctgggattactttggagggaatgatgctgaagctgaaactccagtactttggccacctcatgagaagagttagctcattggaaaagactctgatgctgggagggattgggggcaggagaagaaggggtcgacagaggatgagatggctggatggcatcactggctcgatggacgtgagtctgagtgaactccgggagttggtgatggacagggaggcctggtgtgctgcgattcatggggttgcaaagagtcggacacgactgagcaactgaactgaactgaactgaactgaaagaactaaagttagctgaaaagtttattcagatattcctccttttataattatacatctctttaaggctagattttctttatatactcaaccagaacaacatatcactacagaattgaatgcaaaaagcatatatgagaataaagctgacttctgttaattcagacattaaagctttgcaaaaatgtaaatcattgccactcttctcaccaaatctttttgttttggaaagtagttatgttttcctaaaatgttatttatgttaacatgtaatggattttcttttttgttaagtgaattaatatttttaaatgtttgcagttttaatttcaaacatgataaatattgataggaataatcaactttggagtcctgagtaaatagtaggaatataaagcggtcctacttgtgagtagcatataaaagcccaaactagaagttctgacctgaaagaacagagttctagtactggctgccatgaacctgctgagtggccttaaataatgatttaacgtctcaacatgttctaattcatttagtcagtccatgtcatagggctatcagaaacaaattaaaggtaaatagtattcactaggatttttttttttttttttttacatcgctcagttgtgtctgactctttgcgaccccgtggactgtagcccaccaggctcctctgtccatgggattttccaggcaagagtattggagtgggttgccatttccttctccataggatttttttttaaggtatgctgggagagaatattacttgtaaaatttggaattcaatgagttaagccagtttgagttgcttatattgcctgtcatcaggtagatgttttctgttaggcagggaaatgttttgttatcccaaaaaatgagt

SEQ ID NO: 61719 - DNA, 987 bp, Bovine  19866880398932
atttgctctctgagaataaacagcatggataagtaaacaaaatcttattgttggagtccattttttcattttagcttgttttaaaaggaagaaaattccaatttgagagtttgttactgggacacaaaagaattgggatgaaaacaaagtagaacccttgaatatgtgtctgtgtagcatgaagtgcattgttggcattcactgcaggataattttatctttgttatgaatatccttaggtcttaaaacagtaatggtagcttttatagcatgcttgttaacatgttgtgcttcagtttcacatcattacattagcctttgcttgctgctgttaaagaatttctctctcctgaaaagaaaaactctttggtcttttgatctatagtgaatttgttttttttttaataatttttttttttttggctttgctgggtctttgtttctacacgctggcgcgctctagttttggggagcaggggctactctggttgcagcgctctggcttcttgtggtggtggcttctcttgttgcagagcacgggctctagggtgcacagtcttccgtagttgtggttcccgggctctagggtacaggcccaatccagttgtggctcacaggcttagctgctccatggcgtatgggatcttctgggaccagggattgaacctgtgtcttctgcactggcgggcggattctaccagtgagccaccagagaagcccaatctatagtgaagttttaatttttaatagaataatttcatttactaaacattctgcagagatggtagacaagttgcctttttttgcttagtgcccaaagtgctacttattggttgtattccactcaaagaattttagagtttaaaggctgggatatgaattagttaatggtagaacagtagtatttccaaaagattcatttcatgtgaattatgtttcttaaaagaaataagtagctttaagtgtttagataatgtggaatatcta

SEQ ID NO: 61720 - DNA, 762 bp, Bovine  19866880494448
taactgtgtaccatgaaagtatctttatgaattctacattaggtgataaaaatgcccattttaaagaaaataattcaagaactaacctttttgtactcctaaaacagcaggagagttctcctgtaaagttctgtcaggttcctgaggaggtacaaccatggcaagtgtatgcattggcacacgtggaacctaaaaaatcaactcagaaaaaaatgatctcagaccaaagaataaaacaaaggtccatacatgaaacagagatcttgttttagattttcttcatataccacccaatgaaacagagatcttattttagattttcttcatataccaccaaattaacttttttgtttctttaaaagaataagagggaaaggaagatgaaaaagaaggagcagcagcattgtttaccaagcaataatttctgagaatactgatagggcaaattcaggcaatctacacatagtccatgatttaagctaaatggaattaatatcactctcttgttaaggagacagccttgctggttttaattatagctaggaataaaagtaacatgatcaactgaccaatttacccttgttcaaattctatagggtcaaaagaaaaaaatccaacacatttcccaaattagtgtatttttagcagttctcaggatatcgttgtagaaaagaacttaagacatcactgaactttgtatacttattatactctctacatactctctgtatttttaggtagttttaaaaattaatgaatttt

SEQ ID NO: 61721 - DNA, 959 bp, Bovine  19866880521959
ctggagcgtggtctttacatctctaattaccaggcagcctgaaataactgaaagggattttccagtaacacttggaagggtagcacgcagggctcagtggagccgcacagctcctcccggtccagtttatcattcagcagcaaatcacaggtgcctggatcaagccgcaaatgctgtctattccccttaaaaacaactcgggcgccccgggcagccagctctcccatcctgagtcccaggtcttttgtcaggttggccacaaacgtgccactttctgtctcttccagtacagagtaccgaatcgtttctgaacctgcctcccacgaaagaatcaatgtaatgaagatcatcacttgccttttcttctgatgtagtttcctttgcaccatttccattgttatgtctggttccagaagaaaaatctttttccaatcccaatcactacgtccactgttgacccttcaaaatgtctgctccggaatttcaaattcgttcctataacttgtctggcagcgaatgctccctgaacacttctgtcttagcttaacctgtaaatgagctctatatttttctcttgggcttctctgaaatggagtccaccgagtctgcagagcttatatccactcttagcctgcactgccaccatgcgttgaaatgagtaacttcgtgggggtgctgcaggtcaacaccacatccaaaatgtaaacattataaacgttttaaggaaaacgctgagtttctcagactgcagtgagtgaaccacatgcataaagacttatctgggagtcttgttttttttttttttttttctttttcaaaacttgaattttctagccttctggctgtactaactaatctgtaagtcagtctttctctttaagaattctgatacatactaacacatttaagagtcattccctcaggtaatataaacttcctataaccaattttcattcatt

SEQ ID NO: 61722 - DNA, 772 bp, Bovine  19866880582608
gctcaagtcctctagaacttttctgacatgacacaatactctcaaatagactcctgaggtaatgcatcttgtgacactatctctatagacttttcttaggaacattgttttcctctctttctcgaaagtaatgcttttcctgtctgtcctaccttggggtatagaagttttttcctctctccctttttattttccaacttatcaaatgaggctttagacaataccaaattaaaaactcaagagattcaatgattctcctgttctctcagtttgtggaactataaaatggtcagagggggccagttgcccataatggggaaatttagcaagaggccagcatctgaggctgagaaggcatgtattggcagatggggtaaaacgtgaagagggcagggaaacaagaggaagaagagaaaaacaaaggccatgcaagggcacaatgagagaagtcagaaagggaaatgagacagggatgggcagagctctgaaagtccaagtgcaacgagagtctgcgtgggtgaggagcaccagaggcagaaagggaaggccaaacctgaccaggacctggagataagagacaagtgatccaaggacacacgtccacctgtgaactcatctgcgtttatccacttcaccattaggaaacaatgaggctgcaaggtaactgctgagctacatatggccgggagatgagctcaaagaacgagagagcaattttaggcatggagcaagagaataaaaagaagcctaagaagcggttactgtctccgta

SEQ ID NO: 61723 - DNA, 670 bp, Bovine  19866880649350
tcataggaagggcagacctaaccaacccatacccaacacttttctttctgcctagggctgtcaacatcctgccgaaccgagtggtaggcagtgtgggccagcatgctgaggagcctgtagagaacctagctctctcccactgcggctgtttcctggccagcagtggccatgaccagcgactcaagttttgggacatggcccagctgcgggctctggtggtggatgactaccgccgacgcaagaaaaagggaggaccactgcgggcactgagcagcaaggcctggagcactgatgacttctttgcaggactgagggaagagggagaggatgccaaaactctggaggaggaggagagtgaggatgacagtgactgaagggatgagctgaacctcaggatgggttctcagtggacaaaagtcttgttttctgggttggatccctagagaggctgggaattgaaattatccttttgtgcagcacaagaagatgctcaggatcagcacactgctgtgaggaagtactggctttgtagcagctgctcactccaccagtgtaagacaaagcccacagttggggcaagacagcacagacacaggtatacaccaaccaggggtttaatataaatacaaccagcatagaagaattcaaaactacacatacaccaaaacca

SEQ ID NO: 61724 - DNA, 1126 bp, Bovine  19866880678735
tcagctgttccctgttaagcagagcttagcgaacagtaattgaataagaaggcagagcactcagaggagcaggaaacaagtacaattttatgaaaaggattatgcagcacaaggtcaaaccctgccacggtttgttttcctctcccttgtattcctcttcgatcagcagaagaggctgttatcagttgttggcattatgactgggcacatccgtccagggtcaaacatgctgcagtctgcaaagccagcagcagattgcagtgctctgcagtccagccagaccagcagaacttgtgtagtgccctgttataaactagaataccaaactggggatgttgccttaatggggcatttgagggcaaaagcaacgaaagcttttcctgtttcagaacaaactgtccttccataagtgctgccttaggaacatagaacatgtgttttgttttttaatggaagtatagtttatttacaatattgtattagtttcaggtatactgtgattcagttatacatatgtattctctttcagattattttccattttaggttttacaagatattaaatagagttccctgtggtgtatagtgagtccttgttgtttatctattttatatagacacagtagtgtgtatttgttaatacattaacataatacatgttaatacatagacctgtttggagcaagccaaagccaaagctggtcctcacagcatcattaaattctgttttccatgatatttaatctgtgcatggaccctgatgagctagtttaattttcttttgaagtgctgtatatgtggatattatcttagagttgcatatgaaatggcaacttcaatattttcaatagatgcatggagatgtttaagaaccaacttaccgatgaacatcatcactaggagatcattgttttgccatattaacagaaactccctttgtgattttgcagccacgacagcccaaccctgactggcgttactctgcctccctgagagcaggaatgcacaggtatgtctttccctcctccttctgtcagaagttactgtaactgtgtgactcagataaactcttgtcttcataggccggaagcagctgtcaaaactgagatgcctaaatgctttgcca

SEQ ID NO: 61725 - DNA, 686 bp, Bovine  19866880695041
gtggtggtggtgaaattgaaattctggaggaggtacagttactggtgtcagtatctctggggtatgactatggcctgggtgactcaggtggggtaaagtaaaaattgtgagaggggagagaaggtcatagtattaaatggatcatctccactcttgttgaagtcaccttgagcggtgtagctgtggtggagagggagacggtgagccattgatgaatgaggggccgcacccagactactggtagattgcggcagcaaggaggggagaagaggatggcacactgtgatgccacagacttcaaggaggaaaaaagaaaatggtttggcagtaggcttgatgaatgaatggaaggctggatggatggagatttatgcttttattaggcagctttcattgaaagttaaaatctctgcttgctggattcagttctaccttgttaaggctccctcgttttttaaagattctcttccttgctggctagatctggcttgcttcttgtttttgtgtttttagaacacagctagcccatctgtttacacattaaaaaatttttatttttggctgttctggtgggtctttgttgctgtgctcagactttctttagttgtgataagtggcagctactctctagttgcggtgcgtgggcttctcattgtggtggcttctctcattgcggagcaccggct

SEQ ID NO: 61726 - DNA, 976 bp, Bovine  19866880713467
tgttggtatattataaatgaagaatgaagaatagagacaaatgaataatgactctggaatttctgctttgagcattggagtgaatggagtatcatcgactgagatgagagatttagaagggaacagaggagaagaatcatgagtttgatttcagattgcttctgtttgagatgcccatgagactgccaagaggagataccagacaggcagttggatacatgagattggagagacctgtggactttaagtttgtatctcatcagcatatttagatggtgtgtatacccatggacaggctgagatcccaaaaggagagagtgaagagaaagaagaagaaaagaagaagaagaaaaagtctagggccaaacccaagcgtattagatgagtatcttgtgaagaaactaacagcccgagagaagggtcaggagaatagttttactgagtgagtgaagtcgctcagttgtgtccgactctttgtaaccccatggactgtagcctaccaggctcctccctccatgggattctccaggcaagaatactggagtgggttgccatttccttctccaggggatcttcccgacccagggatcgaacccaggtctcccgcattgcaggcagacgctttaacctctgagccacaactcattaaacgtaagtctttcaggactgtcctggtgggaaagtggttaggtctctgtgttcacaatgcagggaacacgggttcgaaccctggtcaaggaacggagatcctggatgccatgcagcatggccaataaataaataaatgtttcaaggtttgaaactaatgctgctgagaagttcaataagatgtgactaaaatgtgatcactggctttggaaataatacaattagtgagcttgctgtgagcagtgttagaaaagcagtgctcaaggatgccaaattagaggagattgacaagtgatgggaggtagggagatggagatagcacacgtag

SEQ ID NO: 61727 - DNA, 768 bp, Bovine  19866880776667
gatcctggaagcatagcttccatcgcctctccctgtggggtcagagtataccaccctccagcacattcatgtattcaccaaacaaaaactccactgagttttagtgtctctaatttttactggggtttcattatgtaggcataattgactaaagcattgcccaaacgattgaagttgtgcgctgtctgccctcccctctcctagtctttgaccatggtcaaagatcatatgatctatgatcatatgatcatacctgtctgagcatcaacatttgctatagcatttatataacaaatacagcaagagtaccagcatgaatataacatttggaggagcaagtgtggggcacaggtcttttggctccagtgtacttcataatacatgtgtctatcaataccataattataattttactaataatgccagtgttagcccatattgaaaaatggcagatataaactgaaaaatagaagtcaagagatactgacacgttactaaagttcctttcagtcattcataattagttcagcccatcatcatggtgtatatccaagacgtccccatgggccagggtcacacaaccatgcagacttccatttgagattgtcaggttccaaaaaaaggagctgtctcagctcgatatgcttcactctttctggcatctggaataactggactaagggctattttggggacgaatacaaggtttattccattgcataatccatgtattcattcctttaccctcagtattacttccccgtctct

SEQ ID NO: 61728 - DNA, 1110 bp, Bovine  19866880795983
ctgcaaaacattaaacctgtaagaaaaattcaaagctgttaattttatgagacttttccaacaccagagcaattctgcttacttcaaaggcagttccttgcccagataagagagatttgcagatgagaaaaaacttaaccacaggaaaggctgagtatgttcactgtgtttcctgagatgccttcctggaacttgtctatgtttgcactgttttatcttcattctatttctccagatacttatctactttgcccttccaatttggatatctttatgataacagtttccagctctttatcttcacctcatgctttctaatttacttcctgcattcgtattctgccactgagcttccctgggctgctcctctgacccaaatgatatccctaaggtgtgtgatctccctttattataccaaatcaaggaaacaaaaatatgtcatgccaaaatagcctttttaatataaaaattgttttgatctaaaggcaattaagaaacagcaaaagctgtggtggtggtttagtcactaagtcgtgttagactcttgtgacttcatgggctgcagtcagggagccttccaggctcctctgtccatgggatttcccaggtaaaaatactgaagtgggttgccattttccttctccaggaaaagcattctgcctttcccttattttcctaaaaacaggacataaatttagaaatatatccctccttctctctctaccaagaaggacaaacattaattatgtggacaatagtagacccttatcagcctggagttggcactagaggaacctatgtgacaaactttaccaacaagccttgatctcccattcgcttcccatttatttgccttcctatagtttgccacctctagagactcaaggtatttgcttttgtcttgtgacttttttaaaatttattgtcctttgttgaaaatgctacataagcctgaattctaagccacctctttgagctactcattcctgagcttcttacattaacatctatctatctatctatatacagatgttgataaacttctgtttgttttctctacacattttaaattcttgggtaagctctgtaacagatagactgtttcctggg

SEQ ID NO: 61729 - DNA, 1558 bp, Bovine  19866880803529
tggccggaccgaggagaagtccccagcatcttgcgtacctggccacccagcggacactcagtcaggttcaggccaccaccccctccttctgccccctttcccatttgcagacagggcccaaggccaagagccagttctctcccacagaagtccaggtgacactcaccacggaggggaagaagcgactggtctttacgtgcttgagggccatggcaaagaggaaggaagtaaggaagaggaggatggagaagaaggcaatatctgggactgtatgacagccgggcccgcgaggatggcctccccgctgggcacactcaggtgggggcagcaaggatgcattgaccaggcctaggtcctgtgtggagaggtcatccaggttgggattatgggcagtgagataaaggtccactgatgcccaatgagactgaggacaccagataagagatctccagccatagcaaatggttgggcctcagtggcctatgaagggtcagaagagcctggaaccactaactttttgacctccaccctctctttctcaggccctcccaggaacaggccctcaccatgctcaagatgtcatctctgtctttagggtttgtgcttgtccactgagactcatttcctgggaagcagagaattcaagtgagttttcttcccctgggaaccttctccagccttaattagaagcctaatttcacaggtccagctgaaccagagagttctttgttctgactcatctgtctgctgactccaatcactacccagtctgttctcaggacactgcctcttgcccttatcccttcaaattccctccctatctgtatccctggtggctggcacaggaccggccaaagcaagtgcctagtaaatgactgagcacacacatttgtgtgtttccaccagcatcagaattattgttgttcgtgcctggtacagagtctggcactcttgagaggatgcctattccccagtcctggtgttcctggccatgtggaaggaaatgtgctggtgcaatagtccgagctcctctccaccctgtcactcacatggcccgggggaagagtggtgatttatttggttggtgactttgggagaagaagctgggcatgcttggtcctgccccttcctctccctctctagggagtaagcaccctgcatgcattgagctctgctcctctagggtgagacagtccctgtccagcatggccatgactgggtgagtaagtcaatccaattttggtttcatcattaggaagcccacatactcatagatataaccatggtcttctcttagcactggcagaagtaaaagatgaaattaggcctgctctgttgacttatttttcatctgactcagaaccaaagaaaggaagtttgctgctggctactgggtaggtacacagcattttgctgaacttaactaaggggacaacaacccttcctgcatcctcccttattttgccaagctccctatttccctcgggcttcccaggtggctcagtggtaaagaatctgtctgccaatgcaggagatgtgagtttgatccctgggtggg

SEQ ID NO: 61730 - DNA, 1817 bp, Bovine  19866880839317
aattgtgtcagacaaaactaaattatcttaataaattaataaaactttattatctcatatttactaggtagagggccctaggggaataacataacctctcaatttcatctgtaaaaaggaaatgtgtacgctatagagttgttgatgcaagggttaaatcagataatgcatgtgaattacttaacacataacagtatatagaaatatacccaataagtactaattccatcataatcatgagtaacaaaccagttgctggtttttgaggatttgagcatttgaggattccagggaaaagaatggatttatgcatatcatgaggcaaggtgaacagctgccctatccaatgaacctactggaccccagtttcctgaaggatgatatctgtctgtcctcttttcttttcctactaatcatttcctccaagcccccacccccacccagctggttcaggcttcagaagactcttcgggatctttctgcctttcccttggtctccaggcgcagtgtgtggggtgtgcccagtaccttaacacctcgctgttcgctgcagcatccccagccggctgacagatacgatgacttcagccttaagctcgcttaacgagtatcctcattggcttccatccccaagggctttttttttttttttctgaaagggaaatgaaaggtgagtttgctgttgctttggcaacaaatttcaacctctacctaattttccagaatgagaacatatctattaatacattcgatagactggggactggggagttgagttgctcaacgtaatttttcttccaagttcaaaacagctcacccagctcggttagcctttggaggtgctgcggttagaggctagcaaagccgagggcagctgttaccggaacctgttggcagagaagtttaaagtgtacccgcaacaggtggcagctgctgctgagtgcgcttctgagaaaagaatggcgactgcatgcagaaaactcctgcaaagcaggcaagtggaaactcttctccttttcctgtgcttatctgtggggggtgcagcaaccattcgctattcggtggcagaggagatggagagtggttcatttgtagctaatgtggctaaggacctggggctggaggtagggaagctggctgcgcgcggggcgcggcttgtttccgagggcaataaactgcatttccggctccaccgcaaaacaggggatctgttcgtgaaggagaaattggatcgggagtcactctgtggcaaagccgacccatgcgttctgcactttgaagtagtcctggtggagccactgcagtcctttcgcgtggaggtcagggtatttgatatcaatgacaatgccccggttttcctaaacaaggagcctcttttaaggattccggagagcacccccctgggttcacggtttcctctgcagagcgcccaggatctggacgtcggcctcaacggtctccaaaactacaccctaagcgccaatgagtatttccacctgcacacccgcttccgcagcaacgggcccaaatatgccgaactagtgctggataaacccctggatagagaggagcagccggaagtcaacatgacaatcacagctgtggacggagggtctccgcccaagtctggcaccgcccacatccgggtggaggttctggacgtcaatgatcacgtaccccaattctctcgactggtgtaccgcgctcaggtaccggaaaatagcgccaacggttccctggtggctacggtgactgccacagacctggacgagggctccaacaaggagataacttactctttagctcaaaacccagaa

SEQ ID NO: 61731 - DNA, 731 bp, Bovine  19866880866806
cgccgagtcgcggtctggtagcagagccttagccactcgggttcccctggtcctcaggctcccttcgcaattgcgggtggccaaggggccctctgtccggagaaggaccccagctgaggacaggcacggccgcagacagcacgcggctaacccggagttgcggcggacaggcaggtgaggcgtgctgaggtggaagccagggtaccttgggtggggggggcagtggggtgtcatgggcttgaggtgtgcagtcactgtgggggacgcggggggaggctcacctggccccagggacttgggatgctgaagcctggatcactgacaacccatgggcgggaggctgttcgggggccttgtccaggacgtgcggcggaaggcctcgtggtaccccagcgacttcttggacgccctgcacccccagtgcttctcggccgtgctctacatttacctggccaccatcactaacgccatcacttttgggggtctgctgggagaagccaccgacggtgcgcaggtgggtgggtgggaagcaggcctatcttctgtgttcaaccagccgtgccctatgccctcctctagtgtctatggttgggctgaggaggctcccagggaacttgggtacctgtcctgacaggggccattgttggcttctaagggggtgctggaaagcttcctgggcacggcagtgactggagctgccttctgcctgatggctggccagcccctcacca

SEQ ID NO: 61732 - DNA, 884 bp, Bovine  19866880904643
cacgaaacgtcctcaggactgaagccttcttggctgagaaggaataaaagtttaaaagtaaattttgccttcaagaagggaatcaggcttcaaggatattcacagacaagaaaaaaagtaagggagataaaaatctattgcaggctaaaagaaaactgaacaaataataaaaatccgccccaattttaatttttcagttttctgtatcaaattttatctagatatctttcaaacaatatttgtaaaccacagctcttcctccaatctttaaaaaattttctctgtaacagcagtaactcatgaccttttcaagtcacaatcaactactgtgttaggatcaatgcattagtgtttatatgagttcctcacacaaaaagcactgtataagccccagtatcttttactatatccagagtgtataatacctctgaaaagctcaaaaagcacagtggcaattttcaactttttccattttacatccagacacattagttacagaagatgagggaagaaatatggggaacctttaaaaattaatactaaaactgttttgggactttatgttcataagtcttgctgcaggcaaaggaagaacaaactatttttatagcctaaagtaagtaaactgaaatatttcccttccactggaagcaagggaaaatctcaattactcaaatctcttttaagaattatccaactcagttataaaaaattaaaaaaaaaaaaaattacacagactgtttcttctctttgcatataacttaagagtttagcaaaaaactaaacatcatctcttaagaacccatacaagaaagcacattaagttagcaacagaatgtttcctctaccaagggcacaaaaacaacaccgttctcacaaaaaca

SEQ ID NO: 61733 - DNA, 1116 bp, Bovine  19866880959008
cccctctgctatagcaatgttagtctgactcacgttgagcaccggcctcgggagtctcattcaaataggtcttgctgcattttctcacaaggcaaacaccaccctattgttttttatcgaacaccaagtgtgtctttatcttacgtatacagaccacaactggcttctgcaggtaccaggttcctacgttattgattaacagtcctagcagatatattgatgcaaaatgccccaggttgatttcttcctccttggtcaagcttaatttggcgacagtaaaaatagctgggttttcacctgaatgcaccccagtgcagagccctggtacacagtgacctctagggcagggcgggacaggatgaccactctcagtgagcatgctgagtggtgatttcagcaaggcaaacctcacttgtaatgactgtctcctccataggcctctactccctgaagcacaccgccagccatttcccagcaacaaaggtcgtccttgtagatttggaaagaactgtgaggggcgcctgggctctgccgagtaatccccaacagttcctcctgctctttaactgccacaacccagcatccacccagaagtcaaccaggaagggccccgaaaaccaccacccaacctgctgagatgtgcccctcggcaaatgtgaggccagagacgtccctagtggagaaaggcgggcagagggggaacctggcccgtagaaaagcttctttccatggtcaactctactattaatattaatagttctagccagcttgtcattgaagctagatccaaaaagtctcccaacatcgtgaccaatcacctttccagtgaaacaggaagagacaggctaatccttgccatgaaaggctgaggtgggaagctaggtgaggttagccctggtgatggagcaggtacaaagggagccccattgtgtcaagagtgacggaggcagctgactgctccccatctgctgagcggggttcagttgcccaaagtggcgggtttactcacagccctgccggtctggagaacgcaaggcctctcagcaaagtcagaaagcccagccccctcggccgagggccccctcctgttgcccagctgtcgtcctgagtcaggag

SEQ ID NO: 61734 - DNA, 976 bp, Bovine  19866880971139
aaggcatttaaatgagaatttagtatttaaattaggaatttagagtaacgaatgctctactacaagtctagctgacttggagatctctatttatacaggttcaaatattagtttggatcttgtttttttgagttaacatatacagtgtgctcattaatacaggtgtggcctgtccacattaagtattgaacaactcatttcttctggccagcatctattacttcagattaaaggggacctaccatataaagactgatcatagtaagaatttagtatgtgctgtgtgtgcaaagtcactttagtcacatctgactctctgcaatccgatggactgtagccttccacactcctttgtctgtgggattttccaggcaagaataatggagtgggttgccatggcctcctctcggggatcttctcaactcagggatcaaacctgcatctcatgtctcctgtattggcaagacggttctttaccactactgtcacctgggaagtcccaaaaatctagtacaaagaaagtatactgaccaacttcaccttaccatcaagttacaagagcaaggaggcatacaaataacagaaaacaaaatccaaattctaactcatcaaaagaaataattcactaggcagcctgaaaatgaatggaggaactctcaggcacgggagggaggaggctaaggacaaacatttatggttagacaaagaaaagtacagaccatataaagcatacagctgcaaaggctgaggtcaacaaccctctaaagcattcaaaggaagagtctggtgtggttacggacaagtgttccaccctgggaatgtatcctagaagaaaagaataactgaatcaagatgcaaaaagcttaattctggactaactggaatgcaaaacctttttaaaatcttaatcacaaaatgaagacacagaaatgaacagatcaaatcaaaggagtatgtgtgtaaaatatctgtaata

SEQ ID NO: 61735 - DNA, 1015 bp, Bovine  19866880989371
aatctgttactatgtaaaagtagtttagaaggggaaatataatttgtataaataatttaccttgtttcacatttctctgaaatgttcatgttcctgaaaagcctgatgtctttaagggtaggcaccatattttttcatctttgtaatctaatcctaaagcccagaacaaagcttaacaaatagcaggttctagttaaattactgtggaatctgcaataccaatcagaattcttaaacagagtgccaagggttctaatctctgaaagatataattttattatgtaagatgtgagttcatgaaagaggccctaccccaaactaaacattgcttttcctcagtagagactgagaacatgcttttaacagactaacaaggagataatacacagtagtaagtacttttgataatgtatttttatattattcaaaattttgtgggggaaagggtggtaataggtcaaatccatgctcctgatttaagtatagccttaaataataatctcttcaaaccaaaagaaaataaacttttctttgttgtcagtcaagtcccaagcacatcaggtactaaaagatagtacacattctcactattcagagccaaactaactagtaaattaacataattgagaccatttgggcagtaatatctaagatttgtttgtgtaataacacaggtgataacactggcttgggtgtcaagcgaatagtatgttactcaaatactgaattcatacctcttaaacaactgtcagaagataccagatgcaaacactctaattgacatgttttacactttattctagttacctgtttattattctggaaaaagaaattctgtccatattcctcttgaggctatatatacagtccacatcagacgcacttagactacaactattcaaactaaccacctccttcctcctcaagttagtctcctctcaaatatatacccagtttctttctgggaggggatgcataaaaagacactacaacaacttgttcttctgatagcttg

SEQ ID NO: 61736 - DNA, 736 bp, Bovine  19866881007845
tctctgttgctgctgaggcagaacaagaaccaagtaggactggctattagtatacttgatgccaacaagtatgtaggtaacaagtagggtaggaaaaactttccctctaccctcttatattctgtaccagagatctgcaaattaaactgacaaaaaacaaacttaaaaaaaaaaaaaaggagtccttgtcactgccatgaaaataaggaccaagatattgagaagggaaaatcatcagatggcaaaattatatacacacaatgtaacataacttaattttaatattttaactcataaggcaatgatatattttactgagatataaatgtatgtgtataaatgcattttaaaaacagtagcaaaaaaaggtatgtgtaaaaaaggtaaagtggttacctctaaaaaagggactgaaattgggtatgttatcaaagacaacactgacttcattctgaagttttaattctatacaaaaattaattcctaaataacgcaaaattaaacatgaatttttaaaaattagcactcaccctgccattatttcccctctaacacttttatgcagttggcctaacccagttaaagttcacagagataatagggcaagtggtatgattctctgaccattcttcctgacaagacattcagaattctttcaccatcaccaccaccacttcgctcatttcccagctcattcccatggttctatattaaaacactcactggtggaaggagt

SEQ ID NO: 61737 - DNA, 1078 bp, Bovine  19866881021751
tgggttgcctttccctctccggggatctgcccaacccagggatcgaacttgggtctctcacattgcaggcagactctttaccatctgagccaccagggaagcccaattattcagtaagtatgaatatttattgtgtctctatgttcaggcaacatgacggtagttttcaaattgtggtaaaatgacacagtatgttactaaatgcttggtaaaatgaaatagggtaaagaggcaatgttacataactggtcaggaaatgcctttttgaggaggtgatattgaagttcagatcttcaagattacctgaattgtaacttgaagagccagctactgaagtctggcagaagtgcagtctaggattggggaacaaatgtaaaagctcaaccgtgttatgcatcttagctgaataacgttaggcatgttccatacaattgttcgttcattgttctaatctctaaaagatgagaaaaaggaatccacccctcatatacttaaggttcaagagatttggacaggaaagcactcaacacaggcaaaaccaatacaatattgtaaagtaattagcccccaattaaataaatttatattaaaaaacaacaacaacacaggacctagcagtaaatggtcaacacagcattattttagggtttactattgcgattcccatatgccacctggacccgcactgaccatagataatttaaaaggacctacgttggggggctggaccagcatctcttctcccctaactgaagcctgttctgaaccacaaaaacgattcctatgcagggcagggcccgcctccacatgttacttggatacaaacactctgtaactctgcgagtgtatatttccttatttgcatcaagatcaacagcaaagatgaagtctgagtcccagtccctgtataggtttctgtgtgaccttgggcggctctttctcttttggagcctttgttcccccagcggggtctctggttcccctgcgtcccgcgctcaccgtagcgggcccagagcttgggctgcacatccgagcactcgcggattaggatgggcaggtcgggattcgctttcttcag

SEQ ID NO: 61738 - DNA, 1437 bp, Bovine  19866881112196
aagcggaggctgcaaggttaaatgacgtgtggctacgtagtaagggagcatttaagtacaggtccacaatcccttatctgaaccttttgggctcaaacacataaaaaaaattttttaagcaaagaatgtgaacataaccacttacgactataagtaaaatgagttcacgttagaatttacctcaaaatgaatctccctcatcccagtttgtagttttcaaagattatggattcttaggaggggctgtgggcttcactgccctgccttggaggacagaatcagccaaagtatgaactacaccctctatatttctggaagggtgtatagtctgctggtagtaaaatcacagattctgttttaccttgggaaagacactgttgacttcctagtagatgctttgtgttatgtccaacagggtgcatatcttttgttatttgcagacacagcattctattaatcttttttttttttttaatcctttcttgtttgttccacaggcattgttctctgttcttggaagaaaaagaatgggctgttcttgggctggttctcttctgtcttcaagttattttttccctatctctaagcctaatgaccattgctatcttattaacaatttttattttttgctctttgagtggagactgagaactggagatcatactagtccctactcctaggtggtcagtggtggtagtcttgggtttctttgtgccttcattgtttttgggtggttaaacttttccatatatttgaaaactccaaatatggtgaggaagcttatatagtaaacacctgatcttctgtgtatcacatatatagctgggtttttggaagtgtgctgagattaggatagatagcgtagtgttaagagttcgtattgctcaggaccaaaagtatttgcaggttggtggtgcacagggccagagataccacagtcctggccagtatttggttgcgctaagtcttagttgcagcatgcaagatcttttagttgtggcatgggaactcccatttgcagcatgtgggatccaggggaccagggatcaaacccagccccccttgcattgggagtgtggagccttagctgctggaccaccagggaagttcctttggccagtatgagagaaactgtatctcacatttttcctgccaggttgcagaggcactgtttgcatcccaactgaaacctcatcaagagaagtcaaattttactatcaagaccccaaaggtaataccctgtaccgcaccctgtccattagagtgccttagagttctgccctctgcttcccttcccaaccacttttaatgtttttatgttttggccatactctgtgtcttacaatgcagaatcttagttccctgactaggggttgaacccatatcctaaacacagagtcctaaccactggacccccagggaattccctacttttaa

SEQ ID NO: 61739 - DNA, 3712 bp, Bovine  19866881126830
gctggagaaggagcccttggtgaggtttgcctagaatctatgggtctgttcacagctgtagatcctgccctgaagctggaacaaaacatattctcagtagtagttggatggttgttggaagcatctagaagcatggctttccagctcaataagttaagaaataggttgtgcgcctgttcagtcgtgtccgactcttcacgaccttatgagctatagcctgccaggttcctctgtccatggaactgtcccagacaaggatcctggagtgggtacattccctcctccaggggatttttcccatccagggattgaacctgagtctcctatgtctcctgtattgacaggtggattcttttctactgcaccacctgggttctcctaaaagctatgaaatagactttacctaaagataatttccattttttagcatgtatagtcacctctcagtagttccaggaccctctcaccaaaattatgtggatgttcaaatctcttagataaaatgacatagtatttgcatataacctatgcatatcctctgaatactttaaattatctctggattacttgtaatacctaacacattgtaaatgctttataaatgattgccattcaagctttcctttctggaactctctgggattttttttttttctgaatatttttaatttgctgttggttgaatccaaggttgtgaaacctgcatatacagagggccaactgtgtagaaaagtgtgtatgacaaaaaagtacagtttaatgaataattatattcactaatataactgtaacctattcaggtctagaaatagaactttatttttaagcccaaatgagatagtaagaatgctttgtattgtaatttgcttttttcactgtgttggcacttttccattatcagtgcatataattctacctcattcttcttaagggtcaaatagaaattctgtggtttggaaattccgttgcttatttaactgtccccatattggtggacctttaggatgttaactatcatttatgtatgtgtatgtattttatatataatatatgttatatagttattataagcaaatgttataataaatatttgtgtttgtggtggcaaagaatcagcctgccaatgcaggagattcaggttctatccctgggtggagaagatcccctggagaaggaaatggcaacccactccagattcttgcctgggaaatatcatgcacagaggaagagttggacacgacttagtgactaaacaacaaacaaatatatatgtatttgtatgtattttatatataatatgttatatagttgtaaacaaatgttatagtaagtatttgtgtttgtggtataaaattgtgtaagtggtgtgtttttttttggcatactggcactagtctataacctctaggataaatcctaaaggaggaatttctcgttcatagaatagacttctttttattatttgaaagtttcacttaaaaatgagtctttattgaagaatttataaggaaaaagaatgaactctcagtaaaaagaaagggtgtttcctccaaacattagagaggaatgggattctgatgcgtggatggttcagcatacactattttagttgttggtagatattttcagagagcgatttttgttgtttttgcatttgcatttctctttttaaattttattgaggtatagttgatttacaatgctgtgtcaatttctgctgtacagtagagtgactcagtcatacatgtatattctatccatattcttttccctcataacttgtcacaggatattgaatatagttccctgtgctattcagtaggaccttgttgttatccgtcgcatacataaaagtttgcctgtgctaatcccagacttcagtcctttcctcccctactccctctccccagtggcaaccacaagtcagttctctgtatctgcgagtctgtttatgttccgcagatatgttgacttgtgttgtcttctgtattccacatgtaagtgatagcatatggtatttgtctttctctttctgatttgcttcacttagtatggtaatctctaggtccatccatgttatttcattctttttgatggttgagtaattcaggaagcttttttttttttgagggctgtttagtaaaggttatatatcttattccttagagagtgacaggcctaggatccagccagagattctgtatagaaagctttatgcagtgagattttagcagatgatatgttttctgtgttgaggggaacttctctggattctcacagtctccaaggctgcaagtttattgttggagggagatgagattggctatagccatgttttcaaataatattgaactattgtggattattaacgtgtgtatgacttttcagacttcattgttcttcatctaatatatcaggacaaatggagaatgcttatatctttgtgttagtttaattttggagatagtggcttaaagcaattacctgagtggctttagcaagccatgttactaaacagttcgtagatttttttagtttcatgtgtaactcagttatataagcaataaatagtttttatagcctttgtaagaaggggaaacaagacagtctgtgaaattcttcattactctaggacagggcctccgggggtggatgatccactattatttttttgcctcccttgttcattttgaggcccttgttcagtgaaaagcccatttctgagctctgtgtcattgtgcattccactgagaggctactatgctaaagccacaagccaaaatgctgatacaaaaggcatgccctggtttattcattcattgattatgtgaggacagctccaggcccggttaactctctggcaaacgaaagatcatgaatgaagtagggatggttaataatatttgggagattgataccagaatcagtatttagacagtaatgaataaaacagcaggttgtctccttcccgcctgttccccaaagaaaaacaacttaggaagtggtaacatagccaaatgtgttacccattgcgaggaagtcataaaaacaaagatcttgtctaggtcacagtatcaactgtcagagtctcctggtgttgctctgttattgtgaatgtcactgccaccttttagaagggaatcctgggaattccctggtggtccagtggttaatactctgtgctttcactgaggaggccacaggttcaatccctggtccaggaactaagatcccataagccatgcagcatggccaaaaaaaaaaaattcagtagaagtgaacccttgctgttgctgttccccagggccccagtgtgaagtttgcatgtcaggagtaggttcttcctagatgaaggcctgtggctgtggaatgcctgttcttgtggctttggggtttggatttgatgccgttgcttcttttcttggcccacagcagactcacactatgtggcccacttcctctgttggcagggtcattctctacttgtacatgagtttcagtaaacttgagtaactctttgcaataactgccctctgaaccaggcaaagcatctggtctgtttagccaaaccacccacaccatactgttgaaatttggtgaacttccagatttttccatctgatgcagtaaccaacaaaggaaaagataattttatttttattatcagaggtactgaagaggaagagcaagccagctagagtagttcttcctc

SEQ ID NO: 61740 - DNA, 755 bp, Bovine  19866881179399
ttgtctatgtctgtgattctgtttctgtttcatagataggttcatttgtgttattttagattccagttatgagtgatatcatatgttatctttctctttctgacttatttcacttggtatgataatttctagttgtataaagcttcacttttcctattaggatttttgtgaggattatggtgcatgtaaagcatttatcataatacccagtgtgaaggacatactcagtccaggatagctattgacaagctccgacttctagccctctgctggtttttcccattgtggatcttgttggcagtctccttgccagactcatggctgtgcgggtacaagtcagagtcaggctatggatgtgcatacagcactgggctttcctgagaggggggaagctctgacagggtcctgcctggagccgggcacaataggtcagcggctatccccattatctcaggccttctctacgggcaggcgtccttagaaaaagtaggaacagggcttcttttaaggtgtctggatgacagccacatcaactatgtgaccttttcctaggaagcctggtttccatggtgagcaaggcatgttctttctcaagctatggtctgtggtctgtgacttgtggccctctctggaatctggtggcagtggccccagcaactgggtggggacatctgtccagaggcttcccctccaatatctccagggtgtgcaagtgcagagatagcctcccaggctctccagtgtccacaccagcc

SEQ ID NO: 61741 - DNA, 709 bp, Bovine  19866881186405
atggacgtgagtttgactgaactccgggagttggtgatggacagggaggcctggcgtgctgcgattcatggggtcgcaaagagtcggacacgactgagtgactgaactgaaatgaactgaacttaactgggaagccattaaactgggaatcagagctcccagtgctttctaaaagaaggaagcattttacgtaagatctaggcgtagaggactccaaaaaagggcattggcctagtgcaaggcagtcagagagatttaacgcaagcttatttaaccagatcacctgggttgattgtatttcgggagttgaagaaactgcaccttcttgaaccgggtttggacttaacggagaccgcaccagcaaaaacgcttcagaaaacgcaacttctctttcttgctatattgttcctcttgtgggaggctggctctgaagaaattaggtattccatgacagaagaaacagaaagtgggtttttgtggccaacttggcaaaagacctgggtctcagggtgggggaactagccacgcggggtgcccgcatcgattacaaacgaaacaaacagctcttgcagctggatttaaagaccgggaatttgctgctgcataaaaaaccagaccaggaagtgctgtgcggggcgacaaatccttgtatactgcatttccaactattactggaaaacccggtacagattattcaagctgatcttca

SEQ ID NO: 61742 - DNA, 1014 bp, Bovine  19866881194879
cctgctttcagttcttttgagtaggagttgtaaagcacaggagcaggatgtctttgaaggtcagtttctgatgactcacccttctccactgagagctgggcttatgggccaaaaggaggctttactcgtggcctaattttagactataacgcaaccaccactggtcactcgtaacatcaggcttccttttgatatttgataggatttcacaacatgttaaaattccagttttatgtattagcttttgttgactacacttagctggtgactcccttgtgattgtggcagccccttgtcactcagcggtgggcattgaccctcggcagtgcacttccttacagctggcttgttccaggggtgcaggctcttgctgacttcgcccctcctcacctgagttgagctggtcttctggccttgtccccacccctggctccgtcttgggacccaaaaccctgagcccctgccagctgagaatattgaagtcacttgtcttcactcccagcagctttgggcaggcatggtgttatcccccaggtctactggttctcatcatctgtttttatttgatccggttttcttacacaacatttagcattattcgaattttatgtcattttccccccaggaaaataaaatgcttttctgaaacagcttggcatttggagttgccacaggaagtggtcttccccgcaccagcttagaccagcctgaggcccacagtgttggtgaggtggacacatccagggatgacaggccttcagcggattcacctgtcctgtcgtgggtccctcgacctctagaggagacttctttggccagtgcccgtctgtatttgccagaccagttaggaagtggacatgggagcactgggagaagacctgctccctgcactcgaggacctttatagtctgttaatagctatggcactcagaaaccctgaggataaaccagccatttctgaggcagtcctgttttcttatctgttccagcgcttcaggtaaacagaaagcactg

SEQ ID NO: 61743 - DNA, 1771 bp, Bovine  19866881240912
ttagtctttctttgtggatgaaggtgctgaggctcagaaaaactaagtgcaatatttttactcagtttcctctaaatttcccaaggatatccaaaattggcttgttttaatgcacttcattgccttgtataaagtatttaaagtagcttacaatggaagatatttataagaattatttttaaaatctgtttaaaattcaaagtaaaagatcaagagaagagtgggaacaatttatcaaaaaatcagtaataggttgagtgcaaatcctaatactcatcttcctagaagtaaatccagaaatataaaaaagaataaaaggaaattctctataccaaattttcaagagagaaaaaaaaaaaaaaaaaaaccaactcctctctgctataaactcaaacagttgattactgatcattatgtaagggtttagcaatatactcaagagtatgtttgatagcagttttggaaaaccagctgaaacatatttgttaaaaatactatacttgcatagtcactaagtcaagagcataatgttaaactttatttcctatgtttaattctgaagttacacaagcattaaatgaacatatttttgtctgcaaacattcaaataaacatacagaaaatgtcctacgaaagtccccttttagaagcattctataagaagttagtataatttagtagttaagtttctagagatttgaactgatacagaactgttgcttagagtgtttcaaaaaacaggtggtgagcatgtttctgcaacttttcaaatattaattatcatccctccaggcttttggcaaaaatcagcaaaataatattaataataataataattttaaagtcatattgccaagtttccagctcctttaaatgtgaggtaaactttgcaagattataaagttgagagagataaattgaagcacaaaagagtttctcttccctaattcacactaccctatgtccccacgtccaggcttaggaatttctctagggacactcaatatatttactgatggatccattccacaagcacaaatggaaagcctactgcatactaagtcctgctgtagaaactagggacctagcaagagtgaaacaagataggtgagtccctgacttcaaggtgatcacactgtaacccatttaaaatcacaattgtgttatgaaaagactctggatttggtgtaatattgcctttttcagttttatttgtctaaacaaattgtcttataaaggagaatctcattctattaataactttttaaaaataggcaatataatgctgactgctattagccgtagttaatattcttatgccattcagaatctttgtgccaactttcaatagttttgtcttcctttataagatttcttccatgaaatgtattctttcctttcttcttctttattaagatgacccagttgccttatttttcagcttttccaccattctttgctatcattaatgtgttatatagatttatgggaaagtttattaatgtgttatatagatttatgggaaagtttattttttggtatgtttacaattctaattagtcattcatttgggaaatgtattaacttaaaatggtcatatcttcaaaaggtaaatttatatatgctgagatcttatcagatatggcaggctacagttcatagagctgcaaagagttggacagaactgaagcaacttagcacacatgcaatttgattagttttggttaatattaattatccattaaagctggcagcttcacacctttgtcat

SEQ ID NO: 61744 - DNA, 1191 bp, Bovine  19866881316842
agtgaagtggctatgggctgaagatataaaaaataaaattaaagaataaagaatctaactccttaaaacatttcctagcattttaattttctttatgaaaactaagacattcctcctctgcacagcgatacctattacatatcagagaagcctcaaaggcactcttacaataaacactggaagtcatacacatgcccaataaaattcctgaattaagtaattttattccacatttaaaagattcagtaaagattaggaagactaaaggctcacagaagaagaaaggaaactgggaaagcataactgggatgagaggaggggaggagaatatgacaagaagaaacagacaacagtaaagaaaaaaaaaatgttgcaatcaagagacagaggactggcctgcctttgaatatcactccagctacatcttagttcttggtcttcatccactgtcaacagccattctggctgcatttctgaactgcgctctcatggaggtgatacattcaccagccatctttaggaaggtaaatgattaattgcactgttttcccactgctgcaaggacaatgaaagggaaagtaaacttgtgcacctcatttcatatctagttgtaattttccacacaacaataaacagaaacatatactttaagtttataaggctggtctcttttttgctttggtgattacctctgtgtgtgtttgagtgtgtgtgtgatgtctgtgcgctttcatcaagacagttactacaaaaagcccaatctccaaatcattatcaaatggacaatactttcaatgtacattagatcttctaatcacacattttaacaatatggaatgcttatggtttttttctgaatatcccttttaattagaatgtttaaattgatctaataaaatcataaagaaaagcaatgtgatttagagttctcatttccaaatatgaaaatcaccaataggaaaattaaatgtctaatcttatatgattatctctaaagcctgcaaagaaattctattttgagatctcctacccaagacatgagacagggtgattttgataccaaaggtctaaaataaaggatcatgacaactttatttctttgcttttgcaaataagaaaaagaagagggaaagcacacttttgtgttttaatgctgtgagtttagttaaagtcacttccaaaacacctcaa

SEQ ID NO: 61745 - DNA, 1620 bp, Bovine  19866881320483
ccgagtccttaagacagccatgtggtatagcccagtctgcatccactgtgtgcacctttgccaccatgtggcccacactcacttaccccgccaccagctggctcacagcacggcccagtcacccagctcaggaggcagcagccaggcatgctgtagttcacattggctacctccacaaacatgttggtcgtggtcgacagggaaggtgagcaccttacagtcaccaccaccacatatttcgacatgctttcacagtccagggctctgtccagcaccaatgaattcttttaggtggacatcagcttgaaggggacatgaggcctcagggtgcatgtcacctacacactgacaccacagtcacagttggacaaggagatgaaggcaatgacagtgcagagtgaagggtcctctaactggtaaaaagtattatcgtttatatccagcactcacaaaaaccttgcagtcatttgatattgaggaccttctttatcaactgcttttacctgaatttcatagggtttcatttcttcatattcagtctaccaaatagcctaattttccctgagctggaatcatttttgaagctttttgtttctttttaagtcaagagggatatcattgccaaaggaaaaggcagtttcaccatttacatgttcatcagcatcacaggtgtttaatatgatcactaatgttccatttgctatagtgtctaaaagtacactgtgtacacggcctgggcaaacaatggagcatcaagcactctgatcagcagctgaactgtaccttctagttctggtttgctcccgtcccagtgcctgtcaatcataaacgaagttctggtgtttcttcttatccagacttcaattcaggttaaagtgacttagttcaccacgtgcctgtacacccaaagagaaataaaccctggagctaagggttagaatagcattgtaccaggaaacgtgaatctagcaatctagattcagaaataaattaacctgtttctcttgctccaaagaccagaggatttttattaaagcatgcacctccacatccacatggaaaacctcaggtggcctgtccacaattacctctaggtggatactacatttggccctctgtccacatagcttctcccaatggatctagatattcacaaacaaaatgccattctgcaaattcatcttcataagttccctgtggaaccagttccccatacaacccagaacaggcacggcaccagctccgccagctccagctccaggtcctgggtgatgctacccacgaaggtgctgtgtttggcttcctcagggaccaagaacgaatctggccactgccagtccctcaggctgtaaggagcagaagtgagagcagcaggcactggtgtccctggccacctctccttgaaaatagcattgaaaaagcattacacctttcctgtcactctcactttactttaaaatcttgcttttttaaagcttcatatttgaaataaattatctttttacagtttttgtcttctctctggtggtgacaaaatggtttccttctttagtttttggtaattagcttactcctggaaggaaagttatgtccaacctagaagcaattcaaaagcagaga

SEQ ID NO: 61746 - DNA, 1197 bp, Bovine  19866881369273
tatttaccttaggctaaatttctaaaagaggaatgactggagtaaaggtatgctctctttttaatttgtcaaatcatctccattaataattacactaatttataccatgtatcaaaagtcataccaaagtgctaatttctccacatcctagccatcaacagctattatcaaacctttaaatgttttttccccaaacatttaaattttgagtttccctagtctggcaaaggaaatttaaatcactctttcactgtgcatttctttgtttattcatgaagctgtgccttctccatttatttactgaaaatttatatttctttttctgtgaattgcccatgaaattatttttcattctgggcaagttatcttttgtcttattgattttaagcaactttttattcttttttttaacaagttttttttttttttcctaaacaaactaagaattggtatcaaaattttggcatctctaaaatgatttttcccctttcttttatcatcaatgaaatatcttaatgttaagctatctcacacattctaactctacttgattatagtatttattcttttaatataacttctgggttcataaaaacaccctcattttctgaggcacactgagcctcagaaaggtgatcttttaaaaaaaattttccattatattagcacatccaaggaaacttagacatttactctttaagaatttaataaacaaccgataccccagatcttataataaagaaagatttccaatgtcttaataaatttctgcctacactaatggtaaaacagcttaggcaataatatcatgtagaaaactgtgacgtgtttaaaaactaattcttcacttatatggttaaaaatatgttttgtataacaggtcagaataaaaaaaaaactgatggtagtttgataatttatcattttataaaaagagattttgttaagattatagtcctataagtagcaaatgtattctactagattttcaaccagttctaaaaaggaaaattatatttctcactcaccttttccagatcaagttcctttaaaagaatacttgcattcttatttgcttctgcagcctgttggtctttagccttcacaattgtctcaacacattggtgacattttttcaacagttcctataccagaaaggaattatataaatacggaaacacaaaaagaggccaataa

SEQ ID NO: 61747 - DNA, 2356 bp, Bovine  19866881404560
cctgcagcggccggtccacgatcacctccaggtggatgctgcactccgctctccgcccgcacagctcctcccggtcgatccgagaattcacaaacaaaatgccattctgcagatttacctccagaaggtccccgtggcctttggatgccactcggaacaggcgcggcaccagctcctccagctccagtcccagatcctgggcgatgcggcctacgaaggtgccgtgtttggcctcctcagggactgaatagcggacctggccgctcgcggcctcgcctacagctaagagcagaagcagcggaagcagatcccggacctccatgcccctactcttagaagacaccatcaccaattctcagtgagttgatcaaattagaatatcgtgttgtgcaaaattttaaatgttgttctctaatctatgctcaagtcctgctgcttctcttattgttctcctcgctggagttacaatagggttctgggtatttttcttcttagaggatatactgtggtaagacagcgacatcatgtggccaaaatgtaggctctactgttgattgtgtagatttaaattttaacaattgtccaggctaagtttactgatagctttcatttaggaaaaatacctatcttaaactgaaatatatcacttcccccttttactgtgttaaaatatataacaaaatttaccatatcatccacttttaagtatacagtttagtttgttttagccacaatgttgtgaaatatcttgagaactttaatcttgcaaacatgaatctctatacccattagaaaacaactccccttttccaccatactacatccctctcagaaccattctactttctgtttctacaaatttgactactctaggtacctcacataagtgaaatctcagtttggttgtgactggattatttcactaaggttcatccatgtgtagcatgtgatgaatttccttacttataaagccaaacaatattctgattttttatataccacattttgtttattcattcatccatctgtccatggatatctgggttgcttccaccttttagctattgagaatagtgctgttataagcatgggtatgaaaatatgggcttcccttgtagctcagttggtaaagaatccacctacaatgtagaagacccaggttctattcctgggttgggaagatccctggagaaggaaatggcaacccactccagtattcttgcctggagaatcccatggactgtagcctgccaggctcctctgtccatgggatcgcaagagtcagacacaacttggcgactaaaccaccaccaccatgaaaatatctgtgagaccctgctttcagttctttgggatataacagattttttttttctgtttcttcaagtaaagcacatagaaatcaaaggatattttagtttatattttataaattgaaaatatatttatatatttaatttttgctttgggatttaattttgctttctggactgttcacagatgtttgtaaattaataatttattttcctcatctggataatatattcttaattaagaatatccccttttctgctacatttggatttttattcaagaacagtacaattgatctctttttagtgttgagaatatcttaacttcaataattcttacctgtccccttaatatacaaatgatatgaaaatatgacaaagataacatagggataaaacaaaatgaattgagggtaagtcagtgtcaaaatgcataaaagttatcttcagttactctaagcaggtcacaaccacaaagaaggctgaatgctgaagaactgatgctttcaaactgtggtgctgaaaaagactcttgagagtcctttggacagtaaggagattaaatcagtcagttctaaaggaaatcaaccctgaatatttactggaaggactgatgctgagctgaagctccaatactttggccacctgatgcaaagagcctattcattggaaaagactctgatgctgggaaagattgaggacatgaggagaagagggagacagaggatgagatggttgaatggcatcactgactcaatggacatgagtttgagcaaactgcaggagatggtgaaggacagggaagcctggaatgctgcagttcatggggtagcaaagagttggacacatcttatgactgaaccacaataaggaggtcacaaactttgttttcggcaaagaggaaaacaaaaattaactgcaaaatttatagtatcagtaaaagaaaaaatccttgctaaagaaaaactagcttttcctggtactgaaacccaaggctaatttctcccttgagtccaatatcttaagatattcattcacatcat

SEQ ID NO: 61748 - DNA, 1027 bp, Bovine  19866881407264
cattccattttgttgctttgccatctttaggacatgaccctttaactcacagtccaagatagatatccagctattacactgctattcaaacttgccaataggagaaagggaaagctgtcttttttttttttaaactacttctgtgaagtattccatagcacttgtgctcatgtctcactggccataacttggttacaagaccatccccggtcacaacagaagttggcaagtataatgtatagcccacatgtcctcatgggcagctaaaaatgagacatctattgataataggagaacacatatttgggtgaaattagtagtctgtcacacccactcagaccacacctgtagcccccactacccactaggaggagacagagtcaaataaattgcctgattggcttggtttttggaggagcatttgattgtaatcctccatattggtggtgtgtttttgtagccaaaaaagttcttgttcccctgaaagcttagcccctatagcaatgaagtaataaattcaatttctggaagaagatcctttgaaccaatgatgttcccctcctgtgttattggcacctgtcatccatccctacttccttttatttacgtaaacaaaaatttagggtctgcaaagcttaaacctccatttcacagactcatttgaattattattctggatgtatactaggatttaccagtgaaatgccttcacatgagctttgaagacaggcaaaagtcatcttcccagtcattgctgctagccaacagatcagaaagatatgagtgcttgcagccaagtcagtgtttctttgcccagccatcagtttcatggggaactggaggccactgtggcagccagacatgttccactgtgtagtcatcaattttggaggtgggagaggagaggcctttgtgggagtaacagtttgaatagtagcaatagcagcacttaggcagtaatggtagtatgccttcaaaaccaggaattcagtgctgactttcgcttctgcttgtccagttcggattt

SEQ ID NO: 61749 - DNA, 1485 bp, Bovine  19866881469933
tagctcacaaaggaaatatttacacagctggggataggtttcagagaggcagctatccccttgtcagtccatgacaagaagtaactcaaaattaccgaaccaagatagcagatctggtgcaaaacaattactttatgattaaatactgcattttttgcactcaggaacgatggagacaccgctacccaaaatgactcagaaaaggcaagtgaccgctattattattctattattattgtgggaggcgggcggtcagatcattaagtattcagttctagaagagagggacagcggctcatttgtagccaacctagcaaaagatctggggttgggcttaggggagctggtttctcggggcgcccggattcttttcaaagggaataaacagcatttgcagatcgagcagaagagtgggaatttgatactaaaagaaaaactggaccgagaagatttgtgcggtgacacggatccatgtatactgcatttccaggtgttactgaaaaacccggtgcagtttattcaaggtgaattgcagattcaagatgtaaatgaccatgccccagaattcttggaaaatgaaatcctcctgaaaatatcagaaagcagccatccagggtctgcatatcctttgaaaatagctcaagatttagacgttggtagtaatacagtacagaactacacaattagctccaacttccatttccacctttttactcgaaatcacagcgatggcagaaaatacccggagctggtgctggaccaagagctggaccgtgaggagcagcccgagctcagattaaccctcacagcgatggatggtgggtcaccgcccaagaccgggacttcccaggtcctcatcatagtcctggacataaatgacaatgcccctgaatttgctcagcagctctaccaggtgcaggtcccagaaaacagccctataggctcccttgtcatcactgtttctgctagagatttggatgctgggatccatggcgagctctcctactcatttttccaatcctcaaatcaagtcattcaggccttcgaagtaaacacagccacaggggatatacgattaaaaaaaaagttggattttgaggaaattagatcttaccatatggaaattgaggcctcagatggcggcggtctttcaggaaaatgcactgtagccatagaagtaatggatgtaaacgacaacgcccctgaattgaccatatcactactcattaatgatatcccagaaaacacccctgacactgtggtcgctgtttttggaatttcagattcagactctggtaacaatggaaaaatgatgtgttccatccaagaccatctccctttcctactgaagctcacgatagaaaatttttacaccttggtaacagaaggcgcactggacagagaagaaaaagccgagtacaacatcaccatcacgggcactgacatgggaacccccagactgaaaaccgagcacaacataaccgt

SEQ ID NO: 61750 - DNA, 1595 bp, Bovine  19866881767528
acaggactgagcgacttcctttccttttactttctgcattggagaagggaatggcaacccactccagtggtcttgcctggagaatcccagggaaggggggcctggtgggctgccgtctatggagtcacacagagtcagacacagctgaggtgacttagtagcagcagcagcgagacacaccaaagctggccaatgaagatttccactgtgtctgtaacttccctggtggtccagtggttaagactgcactcccactgcaggggtgtggacattcaattcctggtcagggaactaagatcacacaagcagcagggccaaaaaaaaaaaaatctgttactttcttaataaacacatttaaagaacaagtcagcaaaaaacaaaaaaggacgtgggggggaagctgttctttagaccaacttcttctctggaactagcccttggagttgatcaatgaagtttgcagtctcttccacaaaatatccagttaaatacctgaggaaattcagggagttgaacttgggtaataggaagttaataacaaccaccaagactagagaaaagttatggaaagtacccaggctgaatcactgggataggggcaggggacattgagaatcctggcctgaggaactggggatctccttttctccaacccagacaagcctgggggcatctgagtcatctgagcactgcctgggtcagaggaatagaggccttgcaagatccttcctgttatagcccctttccaggcaacatccttcattgcgaaatttccaggaagagtagcgaatggggtggctgggaggaagaaaagtggggagtgacagggttcaaagaagggggagcagagcgacatcacagggttacataaactctcagaggctgccaaagagtaaagacagataggtttgtggaggctggaagccggcgtgagccactgtaaaggaaagaatccacagtccagccgacaaccagagagagaggcagaggctctgagaatctaccgactatggtgagagtatgttcttggggccgaagcgtgggctatttggggaaccttaggaacaggcttgggccgccctgacctccgctgtctttccaggtgtgcgtgccctacctgctgctgctgctgctgccgtcactgctgcgtgtgtctgcggacacaacagaaccctgcgagctggacgacgacgatttccgttgtgtctgcaacttcacggatccgaagcctgactggtctagcgccgttcagtgtatggttgccgtcgaggtggagatcagtgccggcggccgcagcctggaacagtttctcaagggagccgacaccaacccgaagcagtatgctgacacaatcaaggctctgcgcgttcggcgactcaagctgggcgctgcacaggttcctgctcagcttctggtcgccgttctgcgcgcgctcgggtactctcgtctcaaggaactgacgcttgaggacctggaggtaaccggcccaacgcccccgacgcctctggaagccgctgggcctgcgctcaccaccctcagtctccgtaacgtatcgggacaacaggaggtgccggctcggcgaactgcagcagggc

SEQ ID NO: 61751 - DNA, 984 bp, Bovine  19866880272090
tttttaaaattttaagttgatcctcttattctttgaattatcagattatataagtactactgtaacagtgattccactttaattttataattcagatttaattcacttcacattaacaataattattttaaacttccgctctctctttttttttttcacctttgaaatcactctctgaatcactgactcaaaactaaagggaataaatgtaattttccaggttaatgattattttaaaaatgttatctttttcaatttgccttagacacaagctggatttcaacagatggaagtcagaattaaagacttggaatctgaactctccaaaatgaaaagtttgcaagaagattctaataaagcagagttggaaaaatataagcaactctacctagtagaatgtgaacttataaagtcattggaagataaactagacaagtaagtcaaaacacagaatcacagaaacgaaatttagttcattgatttgtctctaaagcctaatttttatagagtggggcatgagattcgtaggaagggaaagctaactagctggccactgctaagggggagccctaagaccgactgttagcactgtgtcaaggcttcccacactgtgtacaggcgtgtttatgaaacaggggaaatgaacacatgggttagaggcagggtaagtcacaaagtggctaaaagtaatgtagtgacccgactgaggggtgtggaggatggaaagggcagatcccaccggcagtgcccagtccaggcttccccactatctgaaagcagagcactcctaggaaggctttcaaaagccaaagcagcataaagcaaagaagcagggacctgaggacacattctgctagtcgatacatgaaatgaatatgcacaagtgaagcacaggtgctcccagacggggcttagggctgtggcgacttgatgctgagatgtggggtgggcttccggggaaggaggtcagtggggccagtctcc

SEQ ID NO: 61752 - DNA, 1371 bp, Bovine  19866880353416
tataaagaactctcaaagctctatagtaaaaaaaaaaaaggacataagtcatgaatttttcactgaaggtaaggatggcaaaaaagcatatgaaaaaatgttcatcatcatcaaccactagggaaatacaaattaaaacacacctatcaaaatagctaaaattaagaagtagtgaaaataccaaatacggatcattggatccataataccaaaccaaaaattggatccaatacaaaaaattgcatcaaaaataccaaactggatcattcagattttgttagtgggaatgtaaaatggtacaactaatctggaaaacagtttggcagtttcttaaaaaaagtaagcacacaactaaccacacgtcctgcaactatactcctaggcatctaccccagagaaatgagaatgatgttcacacaaaaacctgtacaccaatgtgtacagtagctttacttacaaaatccccaaactagagacaacagatgttcttcaacaagtgaacagttaaaagtgtggaacaatcatacatggaataccacttagcaataaaaaaagaacctattggtaaatgcaacaaccttatacagatccagagaactgtgctgagtgaaaaaagccaattccaaaagggtatatactgtatgattctatttatataacatatttgaaatgatgaaataccagaaatggagaacatattagcatttgcctgtgattaaggagaaggtcagaaggagaggcacatagacagctttaaagagcaacatgaaggatccctgtagtgatggaaatattcaacttaactgaattttatcctggttgtgatgctgtactatagttttggaagacgttacaattagaggaaactggtaaaaggtacacgtataggctatttctgtagtatttcttactacagaatgtgaatctacaattatctcaaaatagaaatttgatttaaaaatagcaaacaagcctcaattactacatcacttacaaagttacaacttaaaaagtctaacctcttttttaaaggtatgacagagaaactgtgagatgcattactgtcttcctaataatctgttttgaaaatgctaaataagaagaacattatatagttgagtctggccaacttaatgcatgtaagtatctaaagttctctgaagaaagagaacagaagtatgcatatacatcttgtcctacattttatttatctatttagaacttaaacctaagctactccccaaaaggctaagagatgatcataccttagcaccatataaatctgagttcttcattaaaaactctgctgaagttcgtactgtgactcctgtggtttcacactgcagtacacagttttccaatgtcgtcttg

SEQ ID NO: 61753 - DNA, 4290 bp, Bovine  19866880365010
acaggagagggaatgagaagagaagatgcaggaggagaggggacagcggtggaggtcctgccaggtccacatggaagggatggatgcacatcagaagcctgctgggccgtggtctgagcatcaggggaaggcaggaagccagcgtgagtgagctggggagatgggctggggaaaacgggcatctgcagggaataaggcaggggtggtggctccagtggggtgggggcaggggggagcccaatagacagcaaagagctgataaaagtggggggaggccaaagggatgtgcacagaaagagggggtcagcctaggaaaccgcctgggagacacggcggatgccccaccagacttggagacctctccacggaagagaaccaccccccagcctcatcccgcctggtcccaaggctggtcctggggatggggtttgactgctctccttttcctgctcccaaggttcctcctcccgtgccagaggaagctgacggaggagggaggaggtcagcaatggagttgggcgggacaccctgtcacccaagccaaagggatatttatagacattcatggcgctgactccaaagcgtcatggtggcagatgggccctgggatgcggcactggggtcttcagcccgccctcccttttgccaagcttcccagggtagcaacttgggtgtctggtggagggaagcaggccctagaaagacacaactccctatgccaggggcctggagacgtgggaaggcctgcgtggggcaaatataaaaaccgctgaagggggcagaatcccagtaatcttagcctcctggcccccacccctccctggtcaggcattaagtgtccctcgccggagaggcggggccctccttgagctcccctcctccaggtcccgtgctctctgctggggcctgagtttcccttacatggtcgggggctcgagcctctggcccccccttcccttctaccgtcgctccttcccctttgagaggcctcaagggcacggagaggtcaagatttaaagctgaccaagcttgggggtgggtggaaggagagggaagccaggcctcaggagggggtggagaacggggcccttggcagggcctgggttccacctgtcgctcgcaagggctggctgagaggagggggaacaaggggtctgcctgcagcttcggggacaggactggctgttcctgctcagactctggtggagaaggatgtgccgtggccacagtgccctggagtgacccccgaggagtctgagaagaagaagccgagactaccagacatcatcctggctacctcctggacacgggatcggggctgagcagcccccaccctccccacacacatcttcttggcctcaaaacccatcctggaccactcgttcccatcactcaccagccacctccacgatgtctccaggaacaatatcccgagctttgatcctttgtactgacttgcggtcagcccggtagaccttccccatctcgggttcatattccttcagagcctcgatggcattctctgcattccgctcctggggggaatagggttgaggagaggagggtcagcagagaaaggaaggtagtggagtgagaagggaccgatcaaggaggatggggtggggtagagatggaggagcaggggccagagtcgtgggggaagttggggcatcacagaggaggcaggttatgtggtcctggctcctggcccaggggagcagacaaacttcacacgatgagtgaggataccgtcacccatagctgagaataggtgagggggtttaaggcctttcctggtggctcagacaataaagaatctgcctgcaatgtgggtttgatccctggttgggaagatcccctggagaagggaatggctacctactctggtattcttgcctggagaattccatggacagaggagcctgaagggctacagtccatagggtcgcaaagagttggacacgactaagcaactaacactgctactactactacaggggttttgggaagagtaaagaaggagaatcaaagaaaatcaggaagcaggggataggaaaagcagagggtgggagaaagcaagaggaagaaggatatcaaatgagcatttactgaaatcttcctacatgccagacacagggctgggtactttcacactcatcatcttgttaaatttcaccacaactcaagggacaggattatgagtcccattttatggatgaggaaattgagactcagagagatgaaggcatctgcccagggttgaacagccagcaagtgaaagtgggaataccaagtctcctgaactgggcaaaaggaccagatactaggcaagcccagggtaagtgatggaggaggaggagacagggagggaggctggcctcaggtccagtgtcaggatgtgaaggaatgggggggtggggtcaaagctaacctgccaaacccccacgatggcattggcaatgaggatcaagaggatgacaaagggttcaacaaaggcggtgacagtctcttcgccttcctcaaaccaggccagcacctggggagcaagggaaggagatcaacagataataaagcccctcaggtggttaaggggagcagacagagatgagaacacgtgcaggagcaaagggggcggggcatcacggaggcactgcagccccacatccctttaagtgcctacacggtccactcctttaactcacacaagcgcagccactgctgttattcagcgagaacaggcgggcacagacatgcacagctcggggattaactgggaatgctttcaggtttccctgaccaagttgctggcttgtaaacgaagctcaggggacacccaggccaactacccccaagccacatccatcccacgggagccaaaacccgatagaaaaaaccctgtggtcctcgcaggcgccctgcccacccacagccctcccccacagcccgaggcagggaagctccaatttcatgagggagcaggaggaggggatagtgttacggggcctcctgtacacaccccaccccagctgttgccactgccaggcaacagccccaggcaaatgtcaaggagcaaatctgagaagggagaagtgaggttctgccagctagtactcaagggcccgcgaggcctctaccacagagaccaggggacaaggagacgcttttgcctccagagtcctgtcttccaggaggactacgatgttaaggaaggaagtccaaaatgcaggcgggactgctaggctggtgtgtgcgcaaggaagctccagggcaggagcagaggcaggcccttgagagggagtgggggcagccctgaggttgagggggaaggggagggtcaggtcaagtggacgaggaagggggtcccgggagttccagcgctgatagggggagcagggaggcgaggcccagggacaggtaaggggtctgggcctttgggagcctttggagtccccctcgcaccagcagctctttcccgcctctaggagggagtctctgtctcgaccaatcagcgtcaggagggaggggcaggagcttctggacgctcggggattggcggagccctgtgtgagccccggggcatgctgggagccgcagtggcctgggaacagcagtagtgtctgagccccggagcccggcgctggggggggtaacccgagccctcggagcccttgaagctccgggggcggcttagcttcagtgttttggctgagaacatccttaaagcttaaaataaaacctgcctgcggggtgtgggggaggacagaggagtatgcaagtcagcgtcatcccactccctcagttctagtctgtaggacaggatgctgaaggcttggaccaaaggagccgctgatttggggttgcccacgagcagattctccagatccccccaatctacagcccaggctagcccctagatgcaccccccctccccccaccaccgcgcaacatacttacaaaggaaatgcaggcggccaggagaaggatccgcaccaggaggtcttcaaactgctctaacaccagctcccacagggacttccctgagggcagaggcaaggggaggggagggaagtgccgggggggggggggggacggcggtgttaaggtctaacggatgaatgcagggactccaggtgcaggctggggtccagcctggagcaggaagggtctaaggtgacgggcaggccatttggtactgagaaaagggctgagggagctggcccgaagtccagaaacaggctcctcaaagtggtgggcagttgttcaaggattggatgcctcaaggagaacgtg

SEQ ID NO: 61754 - DNA, 1444 bp, Bovine  19866880414827
ctcgggggtcgggaacaggttctgtgtgcttgatgacagagacagactcgcctgtggagaagggccggacgggctttcagatgacgtcatatctttcactcagacttcctgcccctaactctctcccttctcagcctaggaaggatcaagcaacaatcctggaggaagtctggactctgaaaagaagcccctggaggtagatgggaaactcattgcccttagagtaaaaggccttgaccccaatccccacctgactatgcacaaactgcctggctttggatgacttaacctcggtttgctctgctgtgaaacggggacaatgatgtgcacatttcagaacacagtcttggtaaaaatcaaataagcggatgtacctgaaagtgcggtctcaattggagagcgctttcgtggaagggagaggcccccaccctggggaccttgtatccctcaccggaagggcaggagctcaggcaatcaccctgagccagcccagctggcctccttggaccacagagcaagctcactggctctctcttctctctcccagggcagaaacggaagcagctgaggtgttaagtggatctgaaccctgtatctgatcctagaacctatgcttcctcacttgagggcttttgaagaggcaagatggttctctgggtgacggtgcccacgtatctgtgcggaagggatgagttatgggcgatctggagatgggcataaacatcccactgtctcccatgaccccctgtgttccaggctcaggctgtgagcaaagctgaccagggcagacatcgctgccacgatggggccaggacaggggccctatggccaggggtcccctttctctctgtccactcagttcctcccacatgaaatcctcctgtgatgcatcccccgccctgccctctggccagtagacctgtcaggatggactggtcgacccggagggtggtagacttgatggtgaggatgcggatatctgccgggaccttgtcccccactgtggagagagaagaggggcatgaagtcagcagagaagggagaaaaccccatctttgtctgaagacccctcctccttcaggtctcagggggtcgtcctgtcatcccagcaaggctctccctctaaccctcactgccactgtctccctgccgaatgttcttctccctattaggcaaccacacggactgtagcccaccaggctctgctgtccatggggattctctaggcaagaatactagagtgggttgctgtgccctcctccagggagtcttcccgactcggggatcaaagccatgactcttgagtctcctgcaggcgggtcctttaccactgagtcaccagggaagccctaaaagtgaggatgctaagtcacttcagtcgtgtccgactctgtgcgaccccataaacagcagtccaccaggctcccccgtccctgggactctc

SEQ ID NO: 61755 - DNA, 1269 bp, Bovine  19866880421575
agcaagtgtcttttaatttcatggctgtagtcactatctgcagtgattttggagcccccaaaataaagtctgtcactgttttcccatgtatttgccatgaagtgatgggaccagatgccatgatcttcgttttctgaatgttgggctttaagccaacttttcactctcctctttcactttcatcaagaggctctttagttcctcttcactttcttccataagggtggtgtcatctgcatatctgaggttattgatatctctcctggcaatcttgattccagcttgtgcttcttccagtccagcatttctcatgatgtactctgcatataagttaaataagcagggtgacaatttacagccttgagttactcctttcctgatttggaaccagtcactctctgtttaaaaaaataaagaatttacaaatgctgaatagtatttatcacaagtatagagtaattcccaaataagggattgatcaatatttataggttaaataaaatgttgcttttgttcttttacaggtttatgaagttctttttttccattaagtattttttgtttgtttgttgatattttagatgaatagccaatagtttttcctgaagccagggatcatgttctcacatctcttttttttttttttttttcataattattctggtaacttctaagagtaacaaaagctcttcaagatgttcgtattaaatgacattatcttttatggtactactcgattgtgaaattgtatgtattcttttataggtcactattcaggttttgaatcagcttatccaaaagattcgagaagacctcccaaatcttgaatccagtgaagaaacagagcagattaacaaacattttcataacacactggagcacttgcgtttgaggcgggaatcaccagaatctgaagggccaatttatgagggtctcatcctttaaaaaggagtcaggctcccatcctcctttccatgcacatccagtaagggttttattatactaggcttcccttccatagattgtgcctttcagaaatgctgaggtaggtttcccgtttcttacctgtggtgtgttttacccaagcacctccggacactcacctgcaagaccttaataaaattattcacttcataagtgttcaggtctgtctgctcatcctaagtagcatgattgatctgctatttaaaattcctgtgatctgtttaaaagaaacaaacaaacaaaaaagccaaaaaacccccacttatctctgttactaatgaagcg

SEQ ID NO: 61756 - DNA, 910 bp, Bovine  19866880440033
cttcttttcttgattctctgagtaatccctggtcctacattctacaatacagataccatcggtatctatttgatcctgggtttgagttaggctgtgctcagtccacttgccctcattaccaaacagtattgttttattcttgcagattgatgatcttacagcagagctggaaactgcgtcttcaaaatgtctgcacctggatgcaaaaaatcaagttcttctagaggagttattatctatgaaatgaatgcaaaagaaatgtgaaaaactagagaataaaaagaagttggagcaagaagtagtgaacctcagaagtcatatagaaatgaatatgataaaacacagtgaagtagagcagtataaatgggagattgatgaaagggtgagacaggatctcgtagagaaattaaaggaagtcaacctatttttgcaggttaatttgttcatctgtcatgttcttgaattcacctcattgtaaattatgttttggatctatacagcttctgtgtttcctctacttcccttagagcagttggtttggtggttttctggaaggaagggggcatttgtttctccctttaaatatttctgtttccatcacagttatcaccaaattgacctatcagaatgattctcactggagagtcctttgaattattagaccaattggtataaaacaagactactaggaggaaaagaaaatatcgtggtttagaactggtcccatcttcttgaattatgtttaagttgtcttgttaaatttttaaaattttaagttgatcctcttgttctttgaattatcagattaaataaacaccactataacaataattccactttaattttataattcacatttaattcacttcacattgataataattggtttaaacttctgctctttttggtg

SEQ ID NO: 61757 - DNA, 2691 bp, Bovine  19866880607293
aggaggggacaagggaggaatctctggatagagtgggctgctctggggccatccacagtgccctgaggacagccaaagagggcaagatggtgggatggattcgccgactcaatggacatgagtgtgagcaaactccgggagacagtgagggacagggaagcctggcatgctgcagtccatgggattgccaagagtcagacacgactgagcaattgaacaaaagtgccctcaggacagtcaaggagatgcgcctggggacatgtggaatcaggggaaaggtcagggctggcagtggtgtttgggggatgaccagcacatatgtgatagctacccccaggagggtggaccaaactgaactggggtcttcgcgaacagagcaccatgcttaacagcaggtgggagagggccctgtgaggtccacgtggcagctccattcctcagatcccgaggacactgagacccagaaagatgcagtcactcagcccaggtcatgcagctacagaaagtgtgagctaggatgagcccccattcttcagctccagggccttctcgtttaaccgctgaacgtgatgccttccccacagtgtaagctcactgcagtgcccatcagccagccagggatgggggctgcatagttgcccacagctgcattcagaggggaccgggccagaaggaggaaccttggacatggggtcacctgagctttgctgcttgctgtgtgacctggggcaagtgacttaacctctctgtgcctaggtttcctcctttgtaaaatagaggagtattaatgcccagttgatagggtctttataaaaagtgagttgtaaccgtgaagtgcagaaggcaggacccgcaatgtgtaagtgctctgtgaacacacacgtgtcacacagctctgtacccaggtgggtacagatggctgctcaagctcagagtcggggacacatgccttgcaggccctcacctctgtgtgtctagtgtcttcttattcatctgcttaacaaacgttttcggagcacctgctggcaccaggctcttctgtgagcgctggagatacaacagcaaacaagacacaggttcctgggacttccctggtggggcagtggttgggacttcagctcccagtgcaggggagtgccggttccatccctggtcagggaactgggatggtacatgcctcacagccaaggagcagaagcaaattcatgaaagacttgaaaaaatggtccacaacaaaaaaaatcttaaaaaaaagacagtttcctgtgcttgagggccttctgactgggggcagacagacacgatacgtaagtacacagtgtatcaggaggaaaatgagagggtggaggaagcagcaggcgtggcgtgcctcatggagggctgcaggtggggcagagaggacccagctgacccctgacttgctgcatggccttcccctctctgggcctcagtttcctacctgtgagacgacagtccgcccactggggctcccgtcgagttgtgcgctgtggcccggacaggctgcgcagacaggcccggctgtgtgaggcgcaggggcgcagggagaggggtcctcaccgctctcactgtcgccccactaggcacgaagatggcgctgaagtttgtgaacaagagcaaaaccaagctgaagaacttcctgcgggaggtgagcattaccaacagcctctcctccagccccttcatcatcaaggtcttcgacgtcgtgtttgagaccgaagactgctatgtcttcgcccaggagtacgcgcccgccggggacctattcgacattattcctcctcaggtacctgggtggtggctgagggaggggagaggctcttctgggtccctgagtgtgagagctgaggaggagtcaggcccctcccttaaatcatttattaggcgcctactgtatatcagccattgtttggagggctgcggatacacagtgaacaaaaggtcttgctatgggcctagtgggagaaacagaccctccacagttagccagatgaggcattaagatgatggagaagggaatggcaacccactccagtattcttgcctggaaaatcccagggacagaggagcctggcctgctacagttcacaggttcgcaaagagtcagacacgactgaagtgacttaggcaccgcactgcaatgaggaccagccggtgggcgggatgaagtccagcagccccctcctccactgctgcataggaacaggtggggacccaagaggggaagtggcaggaccaccagccttcccagaggaggtgcacgggacggggagactgcccccggggattcccggcacctggctttgcagtcggccaggatgaaacactgccctgccgctcaccggataagtgacaaggcctctcagagccgccgattaagggagattaggtatacagtagaccatgcgggatagggtccttattagcccagtacttggcccaaagcaggcgctccgtacaggtactgggggaaaagctggggaaggttcgaggggtgtgtgggggccagggagggagccgaggatgcccaagtaggataaggaagggcggttggccccggatctgcccaggaaagggaccccgcaaggagttcgggtagagggacagggcgggggcggggatgggaaggagagggcgggacggggagtgggcggggatgggaaggagggggcg

SEQ ID NO: 61758 - DNA, 2581 bp, Bovine  19866880866191
tatgcgaagagttgactcttggaaaagaccctgatgctgggagggattgtgggcaggaggagaaggggacgacagaggatgagatggctggatggcatcactgacttgatggacgtgagtctgagtgaactccgggagttggtgatggacagggaggcctggcgtgctgagattcacagggtcgcaaagagtcggacacgactgagcgactgaactgaactgaactgaactaccttttggctactgtgtataattatatggcaaataacagtgtggttataaaaaggctgggttcatgctcagtctctaaatcatgtccaattctttgcaatcccatggactgtagtccccctggctcctctgtccatgggattctccaggcaagaatactggagtgggttactatttccttctccaggggatcttcccaactcagggagcgaacccaaacacgggttctgcattgtgtctcctgcattggcaggtggattctttatcctgagccatctgggaaggcctataaacagatttcaaacgattcaaaaatacttgtatagaattgactacactcagtaatctgtaagccaattagcaaattttttctattttgtaccaactgggtttaaaattaatagaaaagtatatatacaaaatgtagaaaataaagagataaagctataatgaataaatgtacttttacatattacttgtaagacaatgcagctggctattctaaaggaacacctagatgcccttcctgccaagtatggaactgaacaagtcagtttaacatgaacacgatttcactatacacaaattaggtaaccaatgacccctcactcataaaagtcatttacaaatgactctgtacatagcagttatatatatcagagaaaaatggaaacactagagtcaagatcaaattaacatttgtgattaggcctcttttaccccacacattcaagccaaatagccctcacaagtctacagttaaaaggtgcagagaaaacaaaggtcactatgaacatatcacttataaaactagttccaattcaaacaatgtgctttcatttcctcttgcagcaaacaaggataatagaaatacttgtatcattgttatgagtaataaagtgaaatgacaccgataaagcttgaaaattacttagcagttagtaataagctatccacctaagtgttcccatcattattatattccccatagataccagcaattatctacaaccatcctagagacttgttgatctctccactcacatagatgttttcaagatagatgtaatcaaacaatgcaatgttaatcaactataaaatgaaaataacacatctcacaaagatacagaatttcattatgttaatgaaaacactatttttaaaatgacggtaagacacaaaatagcaactgaagtagggagaactaagcacgatgaaaggatgggaacatccaaacatgtattttaacaccagcatctccaatttcatttaccaataaatttccccaggaatcctatgatggcacacaccacgaccgtttacttcccccagctttatctactagcaatacacattcttctccacctagaaaattcctactcactgtcctcagaatctcagttcacatgttacttcctgtaatctttcccatactccccagaaccttctctcctttcgtggccccacagcactgaactgacggactgtcctcagtactcaaactgtactacattaagttccgtaaacatgtcttctgctagactcttaagttctttgaaagcatgggctacgttttcagggtccagcaccgtgcatgacataagacacacaagacgcatgataaattgaactgaatcctagattttagaattgggaagggccaaaaaaagaacatttattttcagacgcaaaaaggagactcaaagaagaatgagtgacttgcccaagtcacagagacggtggttgtgacaagactactactgcagttttctttcccagtcaaattcgtgaggacagtacagggtgtctccctcactgttccaaactggttcctcacgcacagaacggggatatacaagagatcctcaagtagctgcttttctattacaaacactataaatggaaatccataaatgttgagaaacaaacgccagtttaatttttgcaccattcttatatcaattcccaaataagaattcagagaaataagcagaatcacctcgtacagcatcatattatatgcaagcaatatatgtcaaacattttgctttttggcattagtgcatttaaaccgaagcctgtttccaggcttacaggttttgacaagcctgtctacacaaactgaatagtgagataactaaaacggatactgtacaccaacatgcaaaaacattatttatacagtacaggctatgtcaaacgctaataaaatgcaagtgacaacttgcctttggggaaacgagacacaaggattcacactttgaggaagttcaagttcaccagccaacagctacaccacgatttgctgccagcaggagaggcgctaaggagaatgcctacttccagtaag

SEQ ID NO: 61759 - DNA, 1028 bp, Bovine  19866880918132
tatggattagttgagggaagggaaggagcacttcttaaaagacaggaagtatggccttctgcactcttaatcatttggaacagtggttctcaaagtgtagtccctggaccagcagcatcaatattttcttgtcacttggtagaaatgcacattcttgggccccactctagacctaccgatcagaaacttggggcttgttttcacacgctccaaggtgactgtcatgtacagtaaagtttgagaaccactgatttaaaggaagaggaaccctggtctcacctgcctgcctctgtcttgtcgtagttcatgcttgttccggtaatggaaggctgaaagaagggttggcattttttggaggatttcaagaagttatttcttcctgaaaggattggagcacagtgatgtttggagtcagggggtttgttctgacttgtagaaccctgtcctctctcaaaggatgtgagttcattcccagccccaaatcaatgtgcataagagttagggtcagaatgaagtccaccaggctgaatttattgcttaccgaagtactgggcaaccttctgaaaaagaaagagttttagtgaatgtgttgctcaggaaagcggaggagtacttgcgactgtcccgtgtgaagtgtgttggcctgtctgcacgaaccacagaaaccagcaatgcagtcatgtgcctggaccttgcagcttcctgcatgaagtgccccttggacagggtaagtaggtcccactgaatgtctgaattatctggtgtggcgctgaagtttaatcatgtgttttcatctctggttatactagcccctttcacaactctgttataggattttcatctagaatatgttattctacatgaagtttagaaccattttgaaaagttggagaaaaaaacttttttgcaacgatctctttactacgtactttccctgagcacttctttccttatacaaacccatctatcaaattgccactagcatcatcctcctaaatcacatactttaaaaccactgtattattttt

SEQ ID NO: 61760 - DNA, 1964 bp, Bovine  19866881028719
gttcacagatgcacggagaaggccacaggcctctcactggcggccaagatcatcaaagtgaagagcgccaaggaccgggtgaggtgtctgccccaggccaacgggtgccctgggccaagctcaggactccttcacttccttctaggcccctctgggtcctgcactgcctcaggcccctccacgctgagcaggaaacctggccacctttccttggctcctactctctagtcagcagtcaccttgcaccctggggaacagggtcctcccagatctccagggttcttttcggggtctcagggatcctatctgggaaatgggtgggtcccttctgttgtaagaagctggtgtgggtggtgagttgaggaaacctggtgatgctgcaggaaatgaggatgcagggtgtgtgtgtgtgtgtgtgtgtgtgtgtgtcttgggagatgcaactgactgctcttcctaacccatttcttggaaactcctctccctgttggcttcacaaggaggatgtcaagaatgagattaacatcatgaaccagctcagccatgtgaacctgatccagctctacgacgcctttgagagcaagaacagctttaccctcgtcatggagtagtgagtgggaggcagggccagggctcagggtggggctaggagccaaggttgcagcaaaactctccctttgccctctctgtgacactcagggaatgtcatcgcttcctctacctgacctccaacataaaacacagaggacaaggccatttgtcagaaaccagtgaccagtgagccttgcttgacctgcagatattattttggcctacacaatttttagtaattttgatttagtgctaacagttggaaactgggaaagttcacattaaaacctaggtgcctgatttttcttgcaaatataaaagatctagtaatgctgggtctgcattctcagttggaaatggtatgatggagcttgtggtaactgacctttgtagacagggcaacccatttcccatttgctacagtccccaccagtttcaactacccgtagtgctgaggccaggggctcaggggacatttattagcgtgcttgtgttgctgttttccttctggtgcaactgaggagagggcaacctttgtcatgtcatgcctctataaaaaatggaaaaacaaaagttagactaaaggctgtgtattccaagaaaacttttgtctcacatctggtctggtttgtccacttagattcttgccatgtaggcactaattggcccctgtaggccaatgagtttataacctgggtctggactattgacagtgagtatccagagtgagcctgggtgatcagtactgcagacaagccccagtctcccatttggcccatcacttcctttttatcacccacactctgagctgggaatagaccagagcaaaggttcccccgcctgccccccccgtaaaaccccagatgggagtggtgccctcgtctcacctggtgatgagtagaccagtcctctgagagccttgctcagtcagtgtctgcctcccctttggccctggcagcgtggatgggggtgagctctttgaccggatcacagaagagaagtaccacctgactgaactggatgtggtcctgttcaccaagcagatctgcgagggtgtgcattacctccatcagcattacgtcctgcacttggacctcaaggtcaggctccgccctgggcatgtggcgggtgggtgcccgtgttcctgagcctctgcggctctctcatctttgagagctctgtcatcacacagtcctggcttcctttcctggctctaccatggcctagttctggagtctagggcaggccaagtctcatagcctcagtttctccatctgtgagatgtggaaaatagctacctcattaagtgttctttaaagatcaaatgaaacaactttttttttcctataaaaaaactcaaaaattagttttaa

SEQ ID NO: 61761 - DNA, 1044 bp, Bovine  19866881158209
ttttgggtggtaaaaatgttttgaaactgagtttccctagggcatacttcttcataagcataaataaatatcaaagaaaaagttcaatatcttttacactgaacactaactcacacaacaaaactaatagtgtaaaatgctgacaaggagcatgtgcatttaaggattctgacttaatgaaattcactattcatcatgggctagttctctgagaccaagcaacggtttgggttttttggctccttatctctggatgcaatagatttaacaattattagaatcaatggatttcactaggttcagaaggccagctttgagataagcagaaatttttattgtgataaaacatacacattagaaacgtgtatgttagaaaatttttattgtggtaaaacatacacaatgtaaaatttccgttttaaccatttttaagagtgcagtttggcagcattaagtacattcacactgttgtacagccactgccaccatccatctccagaactttttcacctttccaaagggaaactctgtgagcaataaacagtaacttcccaccccactcccgccctaggcaactaccactttctttgtctaagagcctgacttctctaggacctcatataaggggaattttacaacatccattcttttgtgtctggtttattgcacttggcataacatcttcaaggttcatccatgttgtagcatatgtcaaaatgtcctttttaaaaactttaattcatttatttatggccgcacttggtcttcactgctttcagtgggctttctctagttgtggcaaacggggctactctctgcttgcggtgcttctctctcactgcggatacgggttctagggctctcggcttagctgcccagtggcatgtggaagatgtggcaatcttcccagaccagggatcgaaccctgtgtcccctgaattggcaggcaaattcttaaccacattcttaaccactagatcaccagggagatccaaaatttccttcttttttgagggtaaataatattccattggggtgtatata

SEQ ID NO: 61762 - DNA, 737 bp, Bovine  19866881262179
atggtaagaatctgcctgcaatgcaggagactcaagttcgtacctgggttgggaagatcccctggagaagggaatggctacccactccaatattcttgcctggaggattctctggacagaggaccctggtggcctacagtccacgaggtcacaaattgtcggacaaaactgagtggctaacactttcacttctaggctttcctaggccctctttctgaaatgtagaggaatcagcctcaaactacaggcagttagttctgatcacttcactgcaatggtcattgagaacatatgttcaaacttcatgctgtcacttcaagtgttcacgtaagtatgaattaaatgctacttttatgccagttgtttttgttctgaggcatttttttaatcaaagtaataggttttgacatgaggcttttttctccctaaataatctatttagaatcaaaatgtaaataaaaaacttagtacacttctttcacaggacatttaaagaagacaaatgctgcttttactaaaagaaaaacagataccttccatttcctctgagccatgtatttctgcagcaatagttgggatttaagatgaactttcgattttgaagctttagcaggcaaattattcagccactcatgtttcaggcactgtgtggcactcattctgcagctgtgaaatcaaacagcaggtgagacttttagctggggttgccttttctggctgtccaaaatctgttcaat

SEQ ID NO: 61763 - DNA, 987 bp, Bovine  19866881330709
acagcagagtgggagataagcaaaggcaacggcttgtagaaagcctggtcctctgggctccctgaacaacccaggcagtccctagctaaagaacaatgaacttccagacaccactgcccaagtgaaagccagaggtctgtggctcttccgaatctgcactcttgaagagtcttcatcaggatgtcaggagcccctaaggagagtttggggccccaggggctaccggggctgggcaaggcctgcttaaccaccatggacaaaaagctcaacatgctgaatgagaaggttgacaaactgttacatttccaagaagacgtcacggagaaactgcagtgtgtgtaccgaggcatgggccacctggagcaaggcctgcaccggctggaggcttcccgcggtctgggcccggctggggccgaccgctccccaccgtctgatgctcaggctgggtggccggaggtcctggagctggtgcgggccgggaggcaggatgccgcccagcagggcgccaggcttgaagccctcttccggatggtgatggccgtggacaaggccatagctttggtgggggccgtgctccagaactcgaaggtggtggatttcatcatgcaagggagtgtcccctggaggaagggaagcctggccgacgtccctgaggaggttggttcctgcttctgtgccccggtgcccttctggctggaagggaggttcagggccctggtgggttgcccagacaggaagctagtcttcggagagcgggagtgctgttgtctcctctagtgtctcctgcatgacttgttgatgggaaaaaggagagatggaagcttaaaggccataggtggatttccagacagggcaggacgtttgggtttctcccttgtgccctggcaaagaccgtggggccctgggcagtgcagggcgcctaaaagtgggggacaaatgagccaccagggagaggagggcagttacacttatctgacatcccaggga

SEQ ID NO: 61764 - DNA, 877 bp, Bovine  19866881402100
taaatgttgggactgtataatgtctttaaacaccaaattaaatgcatagattaaaaatattatctccatgccttctgttcaactaagagctaaacgtctctcatgaataagccagacaagtacttagtagatactcagacttacagaactaatgttaactaaatcaaaatcattaataaagatgtaaaaaagaattcacaaaaatgttttaaattcactattcaaaagtcagaacatctacccttcaatacgggaaactcttacctatcaattaaagcaatgattatgtttttcacatttacattttggtgtaactcagcacaggcccgaagaaaaggattcaaagtttgaaggtggaattcatcagggaaaacctgaaaatcaaatgataatcaattattactaaaatcaactagcaaaaatcaattagtaaaagcattttctactatattctggacttaatatttaaagctcatatttatgggggaaaaaaattcatcttaacattatacaagaaagtgcaaatacaccactttcaagcctctctaaacataaccccagaaagaaatattctgttaaccaaagtacatctacaattaaattaaaactaatgatacctagacaacttggaggttactctttgtatattttgggaggaaaaacccatcaatacaaagaccatgttattatattaataggagaaaaggattcattcaggaaagcttaatctctcttcaatcaagatttttccccccaaaacaaagaaaattaatgaaatacaaaaatgagttcttcaaaaacctggaaatgttctcatctacctgaataatgcactccatgagatattcctgagccaaagcatctctgcaattcacca

SEQ ID NO: 61765 - DNA, 1126 bp, Bovine  19866881607649
cacatctccctcgcctgggttccctcctttctcagcctcctcctctcgcaggtgggatcgtcggtgggacccgcggcccaccgggaccatgtccgggtccgacaccgcgcccttcctcagccaggcggatgacacggacgacgggccggcgcccggcaccccagggttgccggggtccatggggaacccgaagtccgaggatcccgcggtcccggaccaggaaggactgcagcgcatcacgggcttgtcttcgggccattcggctctcatagtggccgtgctgtgttacatcaatctcctcaactacatggaccgcttcaccgtggctggtactgacttctgggagaaagttagaagaggggaagggagcggggtcctgagtggggctgcctcggacggcccatcctgagtcttctccttcccaggagtccttccggacattgagcagttcttcgacatcggagacggtagctccggcctcatccagaccggtaagtggaggctaggcacacacagcggctcttctttctgtcctgccctccttgaggccacatgctggcctgcccggggcctcatttttgggaggtactgtggccagagctaggggagatggcctcgactctaccctgaagctgtcctgtttgaataggacaccacatttaaagagatttcaagagggagtcagtttagtgtaatggtatttaggccgacatgggtttaaacatcagcttttcactgaatgtgatggtaggtaaggccctcggtttctctaagcctcacattccttgtgggtgagatggaactcataataaccaaactcacctcctagggctgatgtgaggattaaatgaggtaatgcctgtgaagtggattgtgcaatgtcggcaaatggtaggcacccagtaaatagtagcaggaggggaagaggtgagtgttacttgttcagaactttgggatttgtgggagaggcaaagccaagacctactcctctttaccttccttccctccttcattcatttctgagcacctacctgtgccaggctctggagggagtgctgatgacatccaaagagcatggcaagacctcttagtctcattgtcttctatccttttatcagccaaagaa

SEQ ID NO: 61766 - DNA, 2058 bp, Bovine  19866880365829
tccagcgtttctcatgatgtactctgcatagaagttaaataagcagggtgacaatatacagccttgacgtactccttttcctatttggaaccagtcagttgttccatgtccagttctaactgttgcttcctgacctgcatataggtttctcaagaggcaggtcaggtggtctggtattcccatctctttcagaattttccatggttttttgtgatgcacacagtcaaaggctttggcatagtcaacaaagcagaaatagatgtttttctggaactctcttggtttttccatgatccagcagatgttggcaatttgatttctggttcctctgccttttctaaaaccagcttgaacatctggaagttcatggttcatgtattgctgaagcttggcctggagaattttgagcattactgttccttatctttagccagttataagcctattctctgcagccttgacagtcatactgttgaacctaccatctgctaggaaataaacccccagtcctacaggtattgaaataatacaatcagataaatggaagcagactcctgattcagtgattttaaatgagattgtatatgaaaaataggaagtattttcctgagttctgttaagagatagggaattttttgaacctggagtatctgggataatttagggtttttagataaagagttttttactgagttctaaggtaataacaaaggatatttgtaaagagttttatctttgcatctgttgttgttcagtctctgagtcatgtctgactctgtgaccctatcaactgcaggacaccaggcttcactgtcctttactatcccctggagcttgttcaaactcatgtccattgagtcagtgatgccatccaaccattttgttttctgttgcttccttctcctcctgccctcaatctttcccagcatcagggtcttttccaaggagttggttcttctcatctggtggccagagttttggagcttcagctttaacatcagtccttctaatgagtattcaggattgatttactttaggattgactagttttatctccttgcagtccaagggattctcaagagtcctctccagctccacaattcaaaagcatcaattctatgacactcagccgtctttacagttcagctcacacatgtgtacatgactattggaaaaatcatagctttgactatacggacctttgttggcaaagtgatgtctctgctttttagtatactgtctaggtttgtcatagcttttcttccaaggagcaagcatcttttaattttgtagctgcaatcactgtccactttccagttgcaattttcttgataatattaagtcctttgaatcagaaaattttgtcaggaaaaaaaatttgatagcctcagtcctttagattaacagtttaaatgagttaatagataccttatatttatatttcacaaccatttgaaaacagatggtaaacatgaattttccatcagtgagatttcttgatggtagaaaggattttactggtatggaaataattggttttggtttagggaacactacttcctgacctgatgaattaatcactgatgaaagatagtactacaggatttttatctgaagcttatgttgttcgattatacttggctcctttttatcagggaactcactggctagagtgatattgacagatttgaggttttgtcttaggacaagccactcacaagcaccaggagcccactgaatatgagattacagacttctttgcagccagtaaaatgcaagatgaaatttgggccttgagacagaaaatgaagaaactaaagatgggaaatgagacacagaccaaataagaattgttggtgatctatactaaacttctaagaaataagacactggtgtaaaaactaaattctcacttgtgtggtctgcttggagacatttctacttaacgaaatagtagattgaaatctgtagctctgtttccagttatagattatttttaaattaaatgtgttggcttaaagttcctgtgtcagaattctaattagatattgttgaggg

SEQ ID NO: 61767 - DNA, 1504 bp, Bovine  19866880608700
aaaagaaagaaagttgcacacccactcgtctctttacagcaaagcatgaaaagcattgagcgggtaggattctagctgtctgagaagacagtgtgggaggcaagcggaacagttaaaaatgcttagtcgacccaaacagaaagaccaggtttgaattcaggctctgctacttagcaagagtgtgatcttgagtaaattgttgacctttccgtgccttagtttccttatttgttaaataggattgaaagtattaatgtgacagaactgtgataaagatgaaaccaggcaatgtatgcaaagtgcttgcctgacatagatgagtaggcactcaaaatgataatttcctcctttttgcttctctagtgtaactcattgtttggggatatgggggatcaaaagcagtcagaacccaataaatctttaaagagatgatttaaccgtgtctttttttttttttttttttcacttgagaaaaggagttctggataagttgggtttgattgatgattatttagtgagccagggacagtgccaggacagtgctcataatgtccaggtgtgagcaaggcattttgtaccagtttcatccaacaaagttgggttttagcgttattggacccaatactaaatggaaattgataatgaaaacagaatacaggatgaatttttaaacacaaacattgtaaatgttagtattacccatgcatattagcttgtaaatggtccatttactaacaaacatgtatggctaatactaacacttatgaagttcttttgtcatttatttttaacatttatcacgagttgttctacaggctttacatatattaatttatttctcctggcatcttaataaagtctgtactattattatcccctttaatagatagggaaactgaggcatacagagattaatttttgcaaggctgcagatttagtcagtggtgaagctaatattccgactcaagtgttttgactcaagacatggtctcagtcactgtgttgtacactcttcctgtgaagttactaaatatcataccagtagtcagtatataatgtcctagaggttggatctgcattttattgtagaggcatttcgggaaaaagaaaacaaatggagtaggaatttgatataaaagcattttactactgaggacccaagagagtcactgaggtgtgtgccagctaatttagtgtttcacagctcctaattcatcttctttgccctgaattgtgatattagagctgtaacctgtaaacatttgttttcagttggttcagtgttagcacttgtcaatagaagatgctggaggaacactgtttataaaagggtctcttttcttgtttccagtgcttttcttcttgctcctgtggtgtggtggtcagtgagtggctttctggctagcagtgtcctaaaaaccagtattgcacgccccccagtaatttgggcccaatccctagtgtgtggcttcctagcaagcctcaccagcaacccagttgatgg

SEQ ID NO: 61768 - DNA, 880 bp, Bovine  19866880965381
atctataactgatgctcagtaaatatttttgattttggaataaatacattattttagtttcaccccattctgtggctcttgatgtatcttatgtgattatcaaacccaagttgagaagtttagagaaccttctcaaaacataacctctctgagagagtatcagtgatcattctttttgatgttatttctgcccctaattataaaacaaaagcttatagaagctagcttgtgagtgcactactctttacagtcagtaaaatgtagtgctatccacattaagctgtagacccaaggttttaggcctccacttctctgaagataagaaaaagggaaggtgctgcatttgatagaaaaagctccctcctgtagccctgtggagcgttgtgaggaacttgttgcctaaagcaatgcgctggcaaattctgacaagatatttgaagactatttcaaatcagagataagtattagatgtgaacccagtagctttttctcagacatatcagagtctgataaaaagttttgaaaacttggatgtggataacaatagcagacatgcacaataagtatgagcactcttttgaacaaaagtcagattttaaaacttgagaagaatacatttaaaaaatgtctttggttgccattttaacaatcaaacaatgtttttattatattgttataaaatgaaagtgctgctgttttaatcattaatatttaaactggactcttaattagtttaataaacaatgggtcaccttgcaaaagttatagctgaaagcaattcagtgtacagatattttatatgtagtataattttcttacatgcatagaattcatcttattaggaggtattcttttcctactttcagttcagttcagttca

SEQ ID NO: 61769 - DNA, 2099 bp, Bovine  19866881158809
tctggattagttctttatattctggttcttaataggtgagataagtaataaaatagaatattgaagtgcatactctgcccaaggtttacattaagaaaaaaacaagaacaaacacggaatgataaaaaagagaatgattaaaaggaatgcataattgtacttaaaagaacagtttagaatacattgagatcttcctcattgagggatattcctagagaaccaggactagagcaacatggaaggggtcatttgagagactaactgaattaactttggtaattataaaacatactcttattaaagttatatgggtaaacagaaacatgaagaagagaattaaaattgcccataatttctcaacctagagaaaactgctaatggtgttgtaattttccttctaatcatttttccctcctgacaaattataagtctcaataaacttttattcagattttcttacatatagaatgtatttttcctattccattaaaaagtattcaaaggaaaacatacatctaccataggttgcttcatttatttggcttatggagcatataattaccaccattacaaataatgataagataaatagtgaaaccatggttcatattttaaaaatcacaaccttacattaaaaattacatttcacatgacaggctaaaacacacatgacacacatatgtatttgtacatagacccataactgaaacaaaagtgtcaaaagtaattttcatccttaatatttgtgatgaattctaatatatcctattctgtcccataccatcccatttaattctgttctatttaaatttttttaaaaagcaattatggtccactaaattggtttaaaattgttattaatagttttgaacccagtgtcaggaaaacgtgatttactgtatccttgttttgcaaactgtattttatttcatattgagttattatattttagaattaatatatgttaaagaagtataaattctgttccattgctgttgatttgtggaaaaggcagtggcaacccacaccagtacgcttgcctggaaaatcccatggacggaggtgcctggtaggctgcaattcatggggtcgctaagagtcagacacgactgagtggcttcaatttcacttttcactatcatgcattgaagaaggaaatggccaacctgctccagtgttcttgcctggagaaccccagggacgggagcctggtgggctgccgtctatggagtcgcacagagtcggacatgactaaagtgacttagcagcaacagcagcagcagcaggacgattatttaaaaatctttaaattttcagatttatctaagctagtcttgcatatttggttttcagggttaacttaatcattctgtcttaggttgtaattttgacagatgtaccctgtgggctcctcacacctcagtactgctctttaggccttgtcccggcacatacttcctaagaatctacagccaagtgcagtttctgcttctaaatcacatagcagctattcaagcactaaatcttggaatcttttcagtacagtaggcctctaaacagatatgactgttgtctttataaatatggaaaacttggagaaagagacatgcacatataaagaatgtcatgtgaaagttgaaattatattgctataaccaaggaactatcaggaactggagaggtctagaacagatccttgccaatggcctcagaaggagcatggctttggtatctccttgatttcagatttccgacctctagaactgtgagacaatacattacttttgttctaagtgacccagtttgtggtacttagaaattatggcagcaatagcaaactaagacactcttcaactgtatccagtaatttgattaattttactctttaagaaaaacatgaaacctttcatggtttatgctgtacattgtgaagaagtgccccgtaaaatgaattttaggtagttgttttgtaattgcaacacaatataaatattaagctactaggagcactggctaatggaatgagtatactctatattattctcattttaagtaatactcattttcttaaattgagttttcttttaattaagggtcaa

SEQ ID NO: 61770 - DNA, 1618 bp, Bovine  19866881167866
ctgacagtatttacccatatttttaatattctaaccctatttgcttactctaagacactatcaagacactatctagtgtctgttttttatgcaaatttatcttcataatgtcatcctattttcgtagcaatgacatttactttctcttgtattcttggtatagtggaagcatcatttttagtcaataatcaatgtttacatcattatgactactgttcaatttaaagccaagcaaagtgttttttatagttactttttcattgacctgtcactatttttttttaatttgcattattttctctaacccaatccttattttttccccctcaagttccatcagatacggtatgttcctatagaaaattttttactccaaagccctatcacattagattcttttcctccttttctcccagaacttttacttcctcttcccacttgagcaggtacctgtcacactctagactagctgccttcttgcacttcattttgctacttgccagaaaactgatttttgactgactcaccaattaagtgagtttggtattaatgtcagatctgactgtgcctgaaataagaattcagtgaaatgagactgtaaagactataagcttaagaaagtaggtcaaagtaatttctcataagaagacagaagacatttaatcactcaatcaccaccaaatacagagcctcacatttttaggaaagtcataatcaacactcacatcaagtccggttctgctcagtgatgcaagttccttgagttaactaaatttgtctctttttaaacagaaatctcagaactcatttggctgtctggatcagccagatgtaaggtgaattctgcagcctggataggaatttcagaataaggactctgaaagacacatcagtgctgtcatttgcacaggttcctctcttgtccttttcactggtctgtccatataccttttgtagttatttacacactgaggcctgatgttaaacaaaacaacatgttcttcaacaggcattgctgttcctactgaacttctcatttgcttgtcaccctggcaatatgacagggtacctgtctttttattacaatattgaccccaatgcaataggaaagaagagtgaaaatgttttatcatactttgctttctttgcttaatatctgttgcttaaaaaataagatacaaaacagatacagaaccattccatcccttaggcacagaggctaccagcttttcaaagatgtacttttccagaaaatattaaagaattggaagtaaaaaaacagacaagatttcctgtctcaaatacagaaagtaaaaagtttaataaatgtttaattaaatatctagaaaatgtaacactagttatattaaatgaattatttaataaattatttttaaatacaaatttcattaaatttgaaatactttgtaaaagttagatgatttcccttcccaagaatttccaaatatgcatactgattccaacaacagtaacaatactaatagtagctacatgttgggagtgacggctttctagctattttgaaaaacttccaacatgagaaagcctgaaaaaactgtgtaaagaatatttgtatactttctacacaaacctccta

SEQ ID NO: 61771 - DNA, 640 bp, Bovine  19866881205448
taagaaatgtattgtgatatattagtttgaaaattactatttatatcaggctcttgaatacatgcttcttaagcttcagtaaagtaacttttaatcttgctttttactatgttgaaaaaagttgatgatataaaatcagcatcctttcttctccatcttcagcagtagttatttgccctaaggatgtcagtgagaagctatttctaaacctgtctcagtacctaggaatgagccatttgtatttgttctcatctcgaggttataaacacaggcaagtccacagctctctccggaactgctgacagaaggttctgccaccagggggaactgaagttgtaaggttttacagtgcttcacaggcactgtatattcctgataaaataaaagttacttaatgagactaatgctattgaacttggaaattttcacgcaaagttttctgagtaattaatttactaaatatatctaaaaatttcattagtcatttcattctagagaaaaggatttagtgatccctttattcacatagattcctaattttctgtattgataaaatgtatccatcaaaagatttttagtagaaataattaggaggaatcataaaaaaatagatatctcacaggaattattaaaaattata

SEQ ID NO: 61772 - DNA, 1539 bp, Bovine  19866881313813
taagttaaataagcagggtgagaatatgagaggctagatatgttaattagcttgatggttctggttatttttacaatgtatatgatatcaaaacatcaatgatttgtataacttaaatacatacaatttttatttttaaattataccccaataaagctgaggtaaaaaagagaggctgggcttcccaggtgactcagtggtaaagaatccacttgccaatgtaggagactcaggagattcaggttctatttctgggttgggatgatctcctagaagagaaaatggtagtcctccccagtattcttgcctggcaaatcccatggacagaggagcttgggaggctacagtccaaagggttataaaaagtcagacaggatttagtgattgagcatgcacgcaaaatgggaggttgggtgggtggggaatggtgcatggaaacttgccatgtgttgtaagtgtagacaaggacagtgcttgtgagcaatgcttgtgaaaaatggcatttccttatactacttaaagagaagaaataataaataaacaaacacagtcccaataatccaggaataagttctcatcctagaagacagagaaccaagcaatagggtgacattccagcttgctacaagtttgctaaaagctaagaattattttgaaaactatgtatgtctatttgcttttctctttaagaatacaaggaggcttgtatcagcactcaagtgggcagtgagaggcagctataggactcactgttcccatttaataggctaaatcagaccaattaaacaggattgagcaatctttgaggatgagcacatagaacaatacacaaacaacacctaccctaaataaagtaaacagatgcaaacaaattgacttttgaaagaaattctttagcatataagaaagggagaattactctaaaacacttcttgaaatgattttactataataagcagaataatgtattttaaaaatatctagaactgaagcacaggctacttcaaaatatttagcaacacagatgtcttgataacttcaggcggtgttaaggataaagaaactcgtattaaaacccaggtcccaaaatatttaggttacctagaaaccattaaaaaaatataagaaaccaaaaacaaattccaggaaaactttaaaattaaacctttgcagcataaatactaaaagataattgagacatgttcataaggcttatttgttttccttttttccttttctgcaaggtgatagagctgggagcagactgaattattttactttctgatattcaggtattcacaaattctagcactaacactaccatctctgaaaagtttgcccaaacatttatcaggggtgggggaaaattaaaattgagaagtagaaagtagaaatgttcttatggtgagcattcttgtaaatgaatagatgttttggataagtattcttatggtgagcattgttatgagtgaatccaatttatttctacatgttaataagacacaataaaataaatgtcatttaaaaataagatatgta

SEQ ID NO: 61773 - DNA, 1845 bp, Bovine  19866880834256
ctgagagagttaacttacttatgttagcgaaattttaaccccatcctaaatacatctggcccacacttctatgctggtttctccaggtgaatttaaaaaaaaaaagaactgtttatactgtatgtgctgtctgcattgttttctccttctcaatgtaagaaacgatttaaaaggctgtttttgtagggatgcattttaaaaattacctactaatatgatcattaaaattcctaagctctaacagttaaaatttaaaaaaactagaagacgggggggaaggtcaggttgtgttctgtaaaaggaatttatagttctcagtaacaattaacttccacttttaatgtttgtcctttaataaccataaagcaagtatgttgtgtgctcaatacatcatacatagcaaaaatttaaactccatattcaatcttcataaactgttatggtaagcactgttattttcattttacaatgtggaaaactatgcaggggaactgcctaactttctccaagtcttctcaaagtggtagagacaaaattccaattccagtaatatggctcttaaagcctttcatcttaatcactttggtatattgcctacttctaaaggtttcaaaagtaaaaatcagacctccagtcacattcactatatgacttaaatgaaaagtcgagacttaaaattatcacacccaaaaactcatctattttactctaatgtgaaggatggtcttaatgaaggaaagcttgttttatttttcagattatgttcatgcccacacaactgtcacaattaaccagtgacaaaatatttaaaattcaaggtctacaaaaggtattatatactatttacagctgccagtacctgacataataaacactcaaaagatacttgaataaattatttgtaacgcacataaagctgagaaattcagaagcagttgattaaggaactttggaaaacagtacacattaaatatccaataatctttcaaggccctgtaattatatatattagcatattataatatatatactaatacagtatctttaatcaacctacatgtaatgatactagacttgcaattttaaactattccacccagaaactaaaattccagacaacccgttaatatgctatagtaaaattacccaaggtgggggacaagcagcatacctctccgtagattctaaatgttccagtatcttcatctagctcaatagctgtaactccaggaacctttctagcttgctgtatgttactaccatgtgttcctatcgccaggcccatcaaatcttctctcacaacaaattcctcatgaaaagctgctgcaagttgctttgtgcactagtaaaagaggcaaattagtattataaaagataaaaaaaaattttatacacccatgttcatagcattatttacaatagtcaagaggaggaagcaacccaaaggtccactgaatgatgaatggataaacaaaatgtgatatatgcatacaatcagaattattcagccctaaaaaggaaattctgatacatgctacaacatggacaaacattgagaacattatgcttagtgaaataagccagtcacaaaaagataaataccatatgattccacttacaaaaaggttatctaaagtagtcaaatttgtaaaaacaaagtagaatggtgatggcctggagctgggggaaagggaaataggaagtcgtttaaatggacacacagattcaaagatgaaaatgttctgaagattgattgatcaacagtgtgaatatattgctcaatactatgaaatgcacacttagaaaggtcaggaggtaaatgttatgtttttctactacaattta

SEQ ID NO: 61774 - DNA, 1372 bp, Bovine  19866881530202
tacctagttactaaattatgttttaatttatcctatctcaagcccatactagtaacttagatttctttatttataaagtatggccagaaactggtattcactgctatgccagcttcaaaaacacaaactaaatacaatctcttcatcccaaagatatttctaacactaaagagagagaaaagaagataaaaataaacatttcctcaaaacctattgtgacagtatttaatttcttttaaatttacaactatcgctaaaacatgaactttttttttcccctaagaatgggaactaatccccttaatcagttttctcacatgtctcaataaccactaaatttaaaatactaaataaagatactagaatttatattctttatttgggggaaaacacaagaatttgctttggaaagaatgcaaaattgattagtttaacaaaagggatttatttctggtgcacacaatttctccactgtgaatatacatgtgattctctgtacacaagaaatggaattatgttcaagatagtatagacacagcaaacacgtttcttttaagttactaaaaactgtatctacttaaattaacattctaaaactaagtaagtactattaatttgaatagttagtaggtgtaagggaaaaggcatcacactacaataaacaaaaacataacatgcattcctcttaataggaaaaagacactttcaagtatttttctcatttgtactttttaaactgtgggtactagaacccccacaaacatgaggtgctgaatccagatacagtagcaggcaccatgcaaaagctgtccagttttgccaatcatccaaaatcacaagctacaacatagtccctgggatggcaggtcccaactcaaatgtgcagaatctgccaagtggacaaaataatggtcttttcaacagtattttcatgtaaaaaaattgagacacaacattagttcaattagacaggttacattacggtgtgaaggaagaatgcattttcttaatagtagtcttattagttgagaaaacaatttatgcaatgcacatcttgaatgtatatacacacatgtgtacatgtaagtataatatatttagaaagcagacacatgacatttttttttcatgcttatgacctggtggtgtcaacaggtccactcaagttacctggctgtctatcttctgcctgacccctgaaacgacgcctgcggctacgattgcgtcgctggggttttttttcactatcatctgtaattgcaaagttcaccatgaaactattctgacaaaaacaatgcaaaaaacaaagcaaaaaaaaaaaatttcttgccttcaaagatttaaggggaaagaactttttaattaaacagga

SEQ ID NO: 61775 - DNA, 2539 bp, Bovine  19866880196781
tttttcctgtggtcatgtatagatgtgagagttggactgtgaagaaggctgagcgccgaagaactgatgcttttgaactatggtgttggagaagactcttgagagtcccttggactgcaaaagagatccaaccagtccattctgaaggagatcagccctgggatttctttggaaggaatgatgctaaagctgaaactccagtactttggccacctcatgcgaagagttgactcattggaaaagactctgatgctgggaaggattgggggcaggaggagaaggggaccatagaggatgagatggctggatggcatcactgactcgatggacgtgagtctgagtgaactccggaagttggtgacggacagggaggcctggggtgctgcgattcatggggtcgcaaagagtcggacacgactgagtgactgatctaatctgatagtattatataatgggggccttccctagtgcatcagcgttaaagaatcctcttgcaatgcaggagattcgggttcaatccctggtttgggaagatcccctggaggagggcacgggaatccactccagtattcttgcctggcgaattccatggaactgaggagcctagtaggctacaggccataggactgcaaagagtcagacacaactaaagcgactgagcacacacccactacataatggagaaatagaacatagtgtttcattcagtaagttgtccatatatttagtttattacgagaagcaaatgtcttaaagctctttttgcagttatatttccctctaaatgttacttgctactctttactgaaaaggtcatagtatagttaaatcttatttgctagcatctgggagtagtgtttctcaaataagaaaagtgtgcatgggaagaaaaaaaaggtaaagaaatcaaccttcatcctccatatgaaggaaaagaaaaaaaacattttataaactcaaaaatttctacagagtccctaaaatggcttccaaagaaacacaagtcctttttcaaaagttagtttgaagataagacacatttctcagaagttgtgaataattaaccactacctaaaggagctatttttccttgaataaaattgtcaaaatctcagctggtttatgtgtaaaatctctgtcgatggcctgtaatcagttgtgtagcctacaacaaggcttttagcaagcacaatttgaacaagaagtagaaatgttaaaaaatgaaatgcagaagttctttatattagaaccaaaggggaaaagaaagcttctagggaaaagaaaaaaagacacagttgcagaaaataagaatggcaacaaataaattttcttaaaagtgttaaaaacagattttctaccttgacattgatactaaattctaaaacacttcctagttcttaaggtaaatgccatcaagcctcactcagttttctgtacagaataagagacgagtggagagaaaagactgaggtgaagttcaattgaataaggagccttatacagttttgtttttcatttaccatgttatatatggtgttctttgggaatttacattttcacactacattatgtttaatacaagtatgtttctccctgggttttctggattgatgtgcttgaagaaagcagtgagaacccaattgtgttaaataaatacgtttcatatatgtctatggatctgagtaggaaaacaaagtgactcggctagcacaaaagagatcatatttagttactagtctgtagctcaacatgtccaattaaagggattatcattcaagcaaagcagctagcatttgtttaaccagcattaagggagctcctgttccacacgatgttctggaacattgtgtccctcagaggaaaacaacatcgaatttcacagccatagctgccttttgaattttacagttaacaagctaatgcatgtcccgtctcttggaagttattctagaagttaccggcttttcttccctacattttaaaaaaaattcgtgcagagtattttctggtacccagttgcctaagtatgctgtgttacattcgtatagtttagcatgggattcggttggtgttagttagtcctaaaaatataaaataccaaaaattgccaaactatatatagtgatagtgatagtgagtgatagttgctcagtcgtgtccaactctgcaaatccacagactgtagcctgccaggctgctctgcccatggaattcttcaggccagaatattgaagtaggtagccattcccttctccaagggatcttcctgacccagggatcaaacccaggtctcccgcatttcaggcaaattcttactgtcagtagcaattttaaggaaaaaatgacaaaatgaggaaaccataatatgcactgagttaaatactctgcctttcatacatttcaacttttatctatcattacttaatttaggtcagataatctcctaatgaggtgcaaaatgaaaatttaccccaaatctttaactaggcttcaacaattctgtgctctagtctttcacctcagcacctcacctctcagt

SEQ ID NO: 61776 - DNA, 1290 bp, Bovine  19866880368001
aattctaaattatagctgaaagttatgatgactaatgagagtgtatatagatagcagaaaaaatataatgatgatatttattgagccttgctatgtgtcaggcactttcacagtacattaaacccactttattgctagatatacataatgctacttatctgcatcaagattgttgtctcatgttataaagagaaactcagtaccttaagtttctctatagaggatgctgtacctcttgagtgcataccaaattgttactctactctggtactcttgacataaaaggtttgttcagtgcaccccttaaaatgagaataattccctctaactacatttgcttaacattagacccaaaggagtgtttccttatgcctctgacagaatttttagggaaggcagcttcttctatttctatttgcagctcctctgctcaaaaatcagatatacagccatggatcttagtcactagtgattcaacaaaggtcaccatgttgcacttaaactttcctactttcattcattcagggttgtatctttccaaggagattaccaaacttttacctagaaagacctgtggtagagttccacacttacctgaactagtgattacagcagtgcttattgagagctagcttttcaacaggtagaaatttgcaccatttggatttatattgagatcttttattctgacctaagcacctgaattgtcaactatgctagaaaaggattctctggcctaattctgaatttaaatgtagaatttgccttttcccacatctcttatgtgttccctttcggttcttaattttcctgctgatcacttgttattcccttcatgatgcttgatttttcccccctcagatgttaggtaagaggcacgaatattatctgtatctcagcttgaagtttagtattagtggttttctttgcaagtgtgccctttgatattgacatgtcactgcggggatgacattaatgataaaccccaatttattactattttaagtcattttattcatttactacagtctgaagagctaaaaggcacttttacacaatgacaactagtaatttatcttcactgcagcccctaaagagacacatcaatatcaaagttccagggctggttgagagagtagctgtctcacacactacagaggagcctccagagacacttgggcagtttgttggttagcaaacaatgaaaaagatgttacctgaatagaggagaaggttggcagggggagaagttaggatgtgaagtaatttatttggtacaaaatgtgaata

SEQ ID NO: 61777 - DNA, 1338 bp, Bovine  19866880446215
atctaacattctgcgtgcacataccctccctctgtgcccacatgatgccacacagtgagtgctgactggacatctcttcataaacctatatgaagttatgatgttccaaaacattaaaccaaaagcaatattactgcatttggtcacagatgttatatgacccccttcagcctaacacagcaaacactgtctttgctccttgtaaacccctactgtaattaaaattattcctgagatagagcccaccactcttactctggaaacagcgcaatagattaaacaggatgataatgtagaattattttaaccaaccctagatataattttatgatttctcctccaaaaaataactttattccaactaaaatatagtaaattgatgactcaaaatcccataaagaagttcaaacaaagacttttattcctggttaacaaacatagatagactgtacagataactataatatagacagagcagtgttttaagaaatacactactcctcagtactctgacaaacacattgtttcatagggagaaacaattaacaattctagaaaatgattgtacccacatccatttgtatctgaaccaacatctagacttgtcaggtaatatcaggatactcgtttcatgcttgcatcacagaatagcaagagggtttttgactgggtaagataatacctagagtttaattctggtgtatcagaagataaagcactaaattgtccaaaagattataaaatttatgttttcgtaccatgtagacattaaccatatagacattagaccagataatagaatatgtacaatcttgagaacaaaaatataaaaccgagtcactcatttatgcttgttgaagatttttctcaacagagcacataaaaatgactgaggttgcttatagtatgcagacaaaaagatatatagcccagtaataaagtcaggaaatatgttctctattaacagattcactcctcaatccataaattttatgcaagattaaataatctttatttaatgacatgacagaatttattaaaaataaaatacttacaaatcttcacctgttttccttaaaacatatctccacattttcttaggtgagattagtaccagcaataaatgcccctttaatggctctttcatatatgttctaagcttggtctactgataaataaatgttataaaaatcaagttaaattataagaactatagagtatcacacttggattcttttaacattttgaagcctgcatctaacagactataggcattttaacagtctatagctatttttaaaaagtagcttttgaagggttttgttaaatatatctttc

SEQ ID NO: 61778 - DNA, 976 bp, Bovine  19866880697749
attgacattttgaactagatgattctaattttctggtaggctatcctatgccttataagcatactactaaatgctgcatgcttagagaatcagtggtttacatgtatgttccttaaagacagaagaatggaaattcacatgtatggaaatgattttgtatgtaacattagcaggattcaacaaatgaataaatatatataatgattatactcttatctccgatatatttccagagaaatttttaatactcttgctgttgttgtagcttttcttgtaaatgagacagcacctccactatgcctagaacacagattctatgggatctttcacaaagattatttatgcagtaaatattttgtattgctgctgtattctctaaagctatatactgaaatatttcttcaggtgttccaaaagtcatcttatgttccccatttccataggaaagaaaagacaacacaaataacatcatatttcataactttatatagtttctgacccagtaatggaggttatcattcttttcaatgccaaacataccacctaattttttctatcattggcaaacaaaagcagtttgtaatcaaagtgcatgtaatcaaataaataaaacaatttaagtatatttcaaaattcatgtaaatataatattgcttaatgtttattaagagcatatttcttaacaatttatttaaatcttaagagcatataatggttcaaaattagtcagtaatctgaaattttattttcttaatggcttcttcttgactgatactaattggataatttcttataatctggacatattcaaaaaaagttgaagtagcttgatacacatcctctaagattaaaacttactgattgaagaaatcatatataagtggggagaaagggtattttgaggattttcaagagaaagccaaagaaagtagtagaacaaatagagaagagaagaaatagccaccggataaatgtg

SEQ ID NO: 61779 - DNA, 1730 bp, Bovine  19866880766018
tacagcaagtaaataagaagaaaaaagaaacagcagaaaattggaagtttgcatgagggagttcatgcattgaactgacaagaaaaggactttaaatagttatttaactaagtacttaagatggtaccagaacagtttggttttgaggattactcattcagcaagagagtgctccagttccaacattctaaaagttgcgagaattaacatttagcagagatctgcaagttggcatggttaatctcacaaaattacagaaaaatacataaaacagtaggatagagtcagagtcagaccccaaacagacatctacggttgttaaaaggctgaaaatctgtagcagcagatgtatttgtatatttgtcctgtattttattttactacatatggttccatattaccactgaacatgattattgtagttctgctcatcttgttagagttaaggcaataatcccatttataaacattttttcgcctaggtgttccatttaactttatacaatttcctatgactttaattttgtcaaaatgttaggctactgaaagcataaaatatcacagtagaagattttcattttatttcttctgatagactcagcatcagagtttatgaaatcatgtgtatctccatttctcaacagtttcattgaaacgtttttagggcaggtagaatcttacctacagacacacaggtggctacatcccctagaaatgttgatctctccaagctctgatttcagattcttttctcccacaccccctcaccccttgcccttggactctatctgtaactttcagagaaaaagacactttgaaaacataagaactaacagtcgccaaacagtggatctggcttcaggaagcaatagttttcacgttcagaggctgtacaaccttctttccacttgagcagaataggtagtaaggggttgaaaaaacaatgtattgattgtttatttttttacatttttattgatttttattcctgtatgatgaaaaggatagtactcaaaaaggcattggattctggaagtattcatcttacttgatagattttagttgagaaacttctttagagaggctatttattttagccatattcctttggtctgttataactcaaaaacatcactattcatttgtaatatgttagagtcattgaagacatcaaccttggacatgaactttctgtgtgcctcctcttccatcagtaaatgaatagatttgtgcagaactggaacagatcaaacaatatttttagctttttactacatcctcatagttaagtaaaactacccaaaactttgtaaattttgccttatgtgaatcatgctaggcattttaatgaagtcatttcatcttgttgaagataagagattgagtcttaacctctcattctctaaactggtgtgaattgccgagatttaagtaaatagttcacatcttcattctttatactgcttcttttctcttaccctgtccactatctttgtgattgaaaagcccacgctaagaaaatccacttgaaatcaaacaattctttcacatttcttcacagagatatatttttaactaacttcaatgatgtttagtcactaagtcacgtctgattcttttgtgaccccatgaaccatagcctgccaggccccttatgtccatgggatttcccagggaagaatactagattgggttgccatttccttctccagggggtaccttcagtaagt

SEQ ID NO: 61780 - DNA, 1146 bp, Bovine  19866880971134
ttgcctcttgatggaatacacaagatgtgcttaattcccccagcaaggagttgttagggtaagtttgagatgttgccagccagggaaggtcattagagacagctcccgaggtttttgttgggggctggccacagaggcatcttctgcctggcgccatgtaccaaaattccagactcccagaaggaaagcaagtgttcaccgtaaaccatagtgtttgtacaaacagtttagatcttgtgtgccactcttatcagttctgggaatgatggggacactctcaaaatccaggcaaggaccagccctataagcagacctttgaaagaatagcagtggggcctggtgtgttaactcttttttgtacacacttcatattttctttttgcagcagcctatatgtttattattctttgttcctaaagtatgataaaaaaatattggccaatttatggtaaacttacggagtgtttaatgtggccacagggaaaggtcagtttttgaaatttaaaaaacattcaaatttgcttctggcctctgctttaatttagtagtccgtgattgtgatttttttccacctcgtgttttcagtgctcttggtataaaacctaaaatcctctctctgcatacctttcttgctttccctcagggtcttctaacctgccttgtctgccttcatcttttcttgtgtatgcattctcagtcgctaagttgtgtccgactttttgcaacctcgtgccaggctcctctccatggaatttcccaggcaagaatactggagtgcgttgctatttccttctccattggatcctttcttgcctagtactaaagtcacacttgtcttttagatctcaagatgtgtcagtttacagtttttgtaacagtaaaactcctcaattatttttagttttttcattgaactaagttattatactgcctgtgatcaaactttactgtctgctgtatattatatatacataatatatgaggcttttcagtgtagtggtaaagaatctgcccaccagtacaggaggcacaagtgatatgggtttgatcccttggtcaggaagatcccctggaataggaaatggcagtatttccaagaataactccagtattcttgccggaaagaggagccttgggagtacagtt

SEQ ID NO: 61781 - DNA, 1356 bp, Bovine  19866880991916
gatctgtgcagttcaaacacctattatacaagagtcaattgtatattgtggaacttacattgtagttatccttgaaaaacatggcatgtttaactttttcaaatgctagcatttaattgaataggatatatgcacattgcttttgaaatttatatctatttaaaaggtacttaaaaatattaatttccactgggtgttttaaatacttctttggatctttatttactatttcctactcaataaatagatttttcaatcacgagggattgagtactattattaaacaaaattggagactactctaatgatgttataaggaatgaatatgcatcatctgtagtattaagtagaacaccttaaaacaattaatgtgcaaaaccttttagagttgtagtccttgatatagcaaatatgtaataattttgctccctttctcagactgaaaattaagtaaattctagggtcttgaaatgattgtcatgactatttcttagtttcttataaaatacctaattgattttctaacataataaatgcttttatctttagaaaaaaagtgaagacaaacctttaaaattaagtataaaaataaaaaagcaatttaggtatgacaaaagcagtatcaataaaagaagaaaaatgtgttcagctttattgttgagttttgtggaatttgaattcatttttgaattacagcatatttagtactccaccaaatggatcattttcaatacagtcataatgaatattaccatgtactgtatagcaagggaatagagctgagtttgccaaaatttcattcttggaagtgctgccaatgcaaaaatagtttccctcccctggtacaatatttaagaggctttaaaatttttcagagaattatttgaagttactttatagaagaagaaatcagttgtgagtttgaaactgcaccgcattgcttgttcccatctaaaaactctttctgctcccccggctgttctttactttgctaggtcattttatattgtaaaggaactattttgtgaccatctgccacttacatctttggccccaatctcctcttctctgatcactattgattttccaaatggacccaaccataaactaaatgcagcaatcattacattttggttagaaagtgactttgctactgtaagttgtatctggattgctaaagcatcagtcaaaaacaaccaaaaaaatgaaagcatttcccagaggcatgggttttttaattgctacaattaaacctaccattaagtcatattatcatcattagctcatattttctattttttaaaataaattagccacacaaattcccacatttaagtcctaagcaaatacttaaca

SEQ ID NO: 61782 - DNA, 1582 bp, Bovine  19866880993834
atgagcaaaaaaaaaaaaaaaacagagactttattttgcaaacaaaggtccatatagtcaaagctatggtttttctagtagtcatgtatgaatgtgagagttggactataaagaaggctgaggctgaagaattaatacttttgaactgtggtgttgaagaaaactcttgagattcccttggactgcaaggagatccaaccagtccatcccaaaagaaatcagtcctgaatattcactgcaaggactgatgctgaagctgaagctccaatattttgaccacctgatgcgaagaactgactcactggaaaaaatcctgatgctggaacagattgaaggcaggaggaaaaggggatgatagaggatgagatggttggatggcatcactgacttgatggacatgagtttgagtaagctctgggaattggtgatggacagggaagcctgacatgctacagtccaaggcatcacaaagagtcacacaggactgaatgactgaactgaactgaaataaactgaatactgttgaaagtttcaaaacattacctagcaactaagcaatagagaattgagctgataaaaggcaaaggttttcatcatgcattcttgtttgtctcactgacataagagaaaattggtacactattcatttcataacagcaactgaggtacattttttgactctttggttgcaaaatagtatatcaaatgagtttatataagcattagtctggtgttcatgtgtgtgtgtgtatttttttaagttgggcaaaataatatttattttttcaatgttctgagaagttagagttagtcatatagtaggttcacttgcttaatacttattgaatataataaagataagaaaattataatttaaataaagaatataattagtgtattgagtatatatgctttcttctaagcagataaataattatatatatctgctcagagggaaacatagataaattaaatgtaaacacacctcacacttggattgatactaaacatgtgcttgagattatatataagaagaaaagtatgggtaaagatatattgttcggtttgctttatttccttggtcattttttcatatcctgcaggtgtaattttctttcaaatcatattttacactattaaaaattcatttacatgcatttattttattaattatcattattataaaacgctgcagctcaatacttctccagtccacatggatatgaactggattttttagaccatgttctttgaaaacctgataaaaataataacctcttgttttctctctatatttgctttcaaggtgtgtttgccattatgatttacccaattaacatttcatactgatttctcagacattcagagcagagaattacagggctaagttccttgaaagtcaaagaaaaactgagtcactggggattgcaagaacttttatttgatttttctctaaatgtttaaataggttttaaagaaagcattgataaactaacaggtataaaatgtaaaccctttaatatggttgatggagagcaaagtcggcaaataaaacttgcagcatatagaacgccttaagcaa

SEQ ID NO: 61783 - DNA, 1232 bp, Bovine  19866881034204
tgctatctaggttggtcatagcttttctcccaaagagcaagagtcttttaatttcatggctgcagtcaccatctgcagtgattttgaagaccaaaaaaataaagtctcctactgtttccattgtttcctcatccatttgccatgaagtggtgtgactggatgccatgatcttagttttctgaatgttgagtttaaaccaacttttacactctcctctctcattttcatcaagaggctcttaatttcttctttgctttctgccatgagggtggtgtcatctgcatatctgaggttattgatgtttctcctggcagtcttgattccagcttgtgcttcactcagcctggcatttctcatgatgtagtctgcatataagttaaataagcagagtggcaatatacagccttgatgtacttcttttccaatttggaaccagtctgttgttccatgtccagttctaactgttgcttcttgacctgcatacacatttctcaggaggcaggtgaagtgatctggtatttccatctcttgaagaattttccgcagtttttgtgattcacacaaaggctttggtgtagtcaataaaacacatagatgtttttctggaactctcttgctttttcaataacccaatggatggtggcaatttgatctctggttcctctgccttttctaaatccagcttgaacatctggaagttcatggttcaagtactattgaagcctgacttggagaattttgagcactactttgttagcatatgagatgagtgcaattgtgcagctgtttgaacattctttggcattgtctttctttgttatatatccaaataaaaatatctttttcctaaaccaagtttctttgtcctgtgctttaatttctcttcacacaacctggcccaagccttttcagaattcttagcattccctgttctcccttggaagatgggaggttgtgggagaaatgtttctaattctccagggaagaagtctctctgtgtcctgtatctactccctccaacctcatgcccttgagaatcacagattttatcaatatgtttcacacatgcatcactattaatcatctttcgcaagtgtctttttgactttatcatgcccctattttaggggcttgcaatcacttttatctgtcatttgagtcaaattaaaatggataatcatttagatttttaaagagtaatttctcaaatgcacaatatactagttatttca

SEQ ID NO: 61784 - DNA, 1767 bp, Bovine  19866881043114
tggagaatccaaaagggcagaggggcctggtagtctacattccacagggtccccaaagagtcagacaggaatgaagtgacttagcaagcatgcacctactatgaagtttctgtcataaaattacaaatcatcagtttaactgcaaatgaaaaagaaaaacaaaagtattttatcagattatcttgtaaatacagaccatttttattgaaattaaatattttgcattattcatatttatttaaatgtccacacataatatatatccctgtttcatgattatgagaattcataattatatttgtattattgaccatatatcagggctctaaaccaagagtttgggggatgtgtagagttcaatcagatacgaatctagcaagaggattatgatttattaaagaagataagctaggtatgaacctaaatgactatattctacaataggaaatgatgcagtatgattggtagagataaaatggttgtaggatgaggaaatatgagcacatctctaaggtataaaatgcaaactgtcttaagtcccctaaatatttcaaaatagttgtaacagtatttcccctttgagacaataaaaagtgcttcaagtgcttcatgtgcttctatattatatgcacataggaaaccttttactatttcctagatgatatttgtgttataatctagtttacaattcttttgatatgtttggaaataactgggaaaaataattggcaaaatatatttctctctataacagtggcataaaatatgtatgctaatcaccaacagatttaagaaactactccagaaaagaatttgaaacacaaatctctcatgcagctggctgttatattgtgtcatctccctattgaagaaccatcataggtaaatgaagaaaaatttttttatattttagattagccacaagagggaactcacagagacctgttaatgctagcgaaatatattaacaatgataaaaaaaaaaaatgttagtctgcagagttcaaacaaagttcattctctcttactaggttttagtgctgtgatacttgaagatttgatgaaaacaattattttcctatagttcctgaacttgtttcacaaatttaaaagggttttttattgccctattataagatttaattatttgattaattatctctttttaagggagcctcagacggtaaagaatctccctacagtgcaagagacacaggagccatgggttcaatcccttggtcaggaagctgtcctggagaagggaaaagcaactaaatccattattcttacctggagaattccatggacagggagatctgacaggcttatagtccatggggttgcaaagagtaggatatgactgagtgactaacatgaggcaagtattagagatccttaataaacatagttttgaactgactaagctgctttcactgcagtttcactttaggatcttggaagtcatttagtcttttttcacattattctatctatttcttaaataacgacacaaattaattaatattcacacctttgtttcaaaaagtgcttcaatgtcagtgatataaatccagaagtaaatagtagtaattgtactatagtattggcatttttaagtttcaaccatatttggccctaagaagatcttaaatcttattctctctctaaaaaaaaaaaaagaagaagaaatccagagtggaaataagttaaactacaaaactagcacatttttttgtagcattaacctaatcagataataacctattt

SEQ ID NO: 61785 - DNA, 916 bp, Bovine  19866881108030
tgaaaagtgaagtgccaaagactgagcttcatctttgtgtgttaaataatgtgttctattctgcaaaagatttctctttttctatgccaagtaactaaaaaacaattatttcaaaatcatgatacaaggaaactattttagtatagtgttaattgaagctcaatactacttttagttataaaataacacttcatacctgtgcagtattttacactttcacacattatcctcatatttgatttgagtatctttaaatggagtatagctttttaacaaagacaacagtgattctttttttttctatggctgaacatgtcatgagataaaaataaaacttgacatgaagatcagatgtaatccagcaggatatggagtttaaaacatatctttttttctttttttccattgaaagtcaaatctgccacagatatcataacacccaaaggataatgctagaaatgctatgcagaattaaaaattatgtgtatattttgctgggtctcatgttcatgtatagttgcctcatcacattttaaaataggcaaaattccattttgacagatggaccaaagtagtaaatgccaactttcagtgtgtcagaatcatgtacaaaagccttgcttagaaggccaagagaatgaaaatgttccaaaattcatctactttgatattaaaataaaaaactgctacttcagtttaggtgtaatgcatttgggatttaccagttaaccacaccttcaacattatggaaagtatagataacaaaataacaaaaattgcattgatttgatgaatacggggatggcttaggatgcttcagaaagtaaagtgcattacaaaagaaagtactagaatcaaattgaaagggatgctgagaaaggaataaaagcattaaaggaattgttagaatccttga

SEQ ID NO: 61786 - DNA, 866 bp, Bovine  19866881120269
atttaaacctgtttgagaagctgttaagaaaataactgagtgggaaaataaatgaagcttgagacagcaaattactgaagaagaaagtaatgtgtatttcttcaacaaacgagataaatatctgtcatctctactaaagaggtgttctgaaagaaaaaaaaaaaaaaaaactgaattataattgaagtaattcactctcagaagttgtaaacaggtaattcctgtctgtacctatagcagcagggaacaactctccagacactcagattttacagtacagggaatataaatatattattattatacttttgttattgctatcatcattactataatttcaagggatgtggggattggcagaaatgaacagtttgaatttcctgagttctctctgagtaaattaaatttaaattcagcagaaggcactcagtagtcctaggtgttttgacaccttatcttttccctgtttattccattcttagacaaattaatttgtattagtatgaaagcaaagtattctacttccatagtgtcttccagcatgtggattaaagagaagtcaaattattggttacaattgaagtgcaagtgaggctgacatggcttcttggaaatttttacttcatttaatatttcagtagcagtcccacctccaagagtgatccctaagtacttgaaggtcaggtttgcatgccttagcaccaattccaagcttggagcttctcagtttctgttcttgtacttgttctgctttcagttcagtttagtcactcagtcgtatccgactctttgtgaccccatggatcgcagcacccaggcctccctgtccatcaccaactcccggagttcactcatactcacatcca

SEQ ID NO: 61787 - DNA, 2414 bp, Bovine  19866881233529
agctggctgttgctggttgtataaaatccacttttatagcacatcacaatcgatccagaaatgatttgttgtgcacaataagagaagatgacacttaaaatgatttttaaaaaatttttggtcatctcatgaaacacccacttattgagttttttcacctttccagtttgcttcaaatgcagcacgaccatataaaggttgacattgagttcttcagcaacttcttgcgtagttgtaagaggatcagctttgatgatgcctctcaggtggtcattgtcaacttccaattgccagccaatgtgcttctcatcttcaagactcttgtctcctttgcaaaacttcttgaaccaccattgcatatgttattgacactgtggtttctttctgctgttttatgacccattttgtactcagataagaaaattgctcaaatttgctttttgtctaacatcatttccatagtctaaaataaatataaaataaacataaagcaataatcattggtgcctcctaggtggcgctagtggtaaagaaactgcctaccaatgcaggcggtataagagatgtgggtttgatccctgggttaggaagattcccctggggtaggaaatggcaagccattccagtattcttgcctggagaattccatggatagaggagcctagtgggctactgtccatagggtggcaaagagtcagatacaactgaagcaacttagcacgcacacaatgtcattagccaaaaacataaagcgagaaatgtgcattaaaatgatgtataacataaccacagttatttaagaatatattccaatatcaaatgtcaaacttcaacagtgcaaaaactgcaatcacttttgcaccaacctaatatttatatcccacttggcattgagaattacatgaaaaattttgcaagtttcatgaggaaaactgatatcattttaatgttcctatctttgtattaatgaggttgaacttttcatttaatgtctattatccatttgtgtttcctcttgagtgttctctgttcatgttttttgctcatttagctatttgatgcatttgcattttaaaagaggaagtcgttaacgcaaataaatcactaattagtgaacctatgtaggaaatactttctaagcagggggatcttttttgctcttgtctacttttaaaaaatatatatttgatttaaaaaatgtattgagcatctacctagtataaggaactgtgcactctgggaaataaattggaaaacaaaagtttctgattttcaaggaagagactatcgtatggctcaaggttatatgacagtgtcttttgcttctaaaagctcactgatttctcattaagaaattataaaaatgaattgaaatgtgttagagaaattatgagtaataacaaatataagagaataattactcataattctttcactttaatgcattactttaatacttcttagagctttctattttcctcacattttgatacagatgtactctctacgtggtactttgcattttgctcttttctacttcacattagagtttaacctagtcttttgttagtatatgtcattattctaatgactggctgctgctgctaagtcgcttcagttgtgtctgactctgtgcaaccccatagacagcagcccaccaggctctgctgtccctgggattctccaggcaagaacacctggagtgggttgccatttccttctccaatgcatcaaagggaaaagtgaaagggaagtcgctcactcgtgtctgactcttagcgatcccatggactgcagcctaccaggctcctccatctacagaattttccaggcaagagtactggagtgggttgccattgccttctcctctaatgactggatccctctataatttatttaattacactcatatttgagggcatttccatttttccagtataatttctttagatccagtttttatttcttagcaacttaatttttctcacttaacaatgtatggtgggcatattactgaactattcacatttaaaatataaaattctagacaaaactatttaggaagatttaaagattgacaaagaatgattttggggtaagtcatgccactttttgtaggtgataattctttggatagtttccctgtgtattccagatcacaccaccacaactgctacttgcactgtgttgctgtggagagagctgtagactcagtgataagagacctggttcaaacttccctgagtgatcttggctaaattatacttttagagtctctgtttttctgtatataatgtatatcttctaaagcttgccctgtacaatattgttatgaggattgaataaaatcgctaagtgcctactgtaagaatgagctccaaattagtccaagttaatgttagagtcctccctcc

SEQ ID NO: 61788 - DNA, 999 bp, Bovine  19866881241126
cagttctaactgttgcttcctgacctgcatataggtttctcaagaggcaggtcaggtggtctggtattcccatctctttcagaattttccacagtttcttgtgatccacacagtcaaaagctttggcatagtcaataaagcagaaatagatgtttttctggaattctcttgctttttccatgatccagcggatgttggcaatttgatctctggttcttctgccttttctaaaaccagcttgaacatcaggaagttcacagttcatgtattgctgaagcctggcttggagaattttgaacattactagcatgtgagatgagtgcaattgtgcggtagttttagcattctttggtattacctttctttgggattgaaatgaaaactgaccttttccagtcctgtggccactgctgagttttaccaaattttctggcatatggagtgcagcactttcacagcatcatctttcgggatttgaaatagctcaactggaattctgtcacctccactagctttgtttgtagtgatgcttcctaaggcccacttgacttcacagtccaggatgtctggcactaggtaagtgatcacaccatcataattatctgggtaataaactataatggaaaagaatatagaaaagaatatatatatatatatatatatacatatagggagagagagagagaattgtatcactgtactacacaccagaaactattaatagctcaacattgtaaatcaagtatactttaataaataaagataacaaaaggggtggggaggaggcagggggtcttcatcctcacagcttcagtaaaagcaattcctctggccttaatttcagggtatcttgggctgtgttagagctagtttactgaacactgcctacagctttttaaattcttagatctgtagattttttgttccataatgggaaaaccaaagaaaaccactaagtggaaaattaattttcggaatatagcagcaggactctcgaag

SEQ ID NO: 61789 - DNA, 923 bp, Bovine  19866881260154
atttctttgcagaacctggaaaaccagggttttccacagtctagcctccccctgtatagtgactgttaattccaagacacatgattgttagtcagtatctctctatgcagaaagacatcctacaagaaatggagtatcaatatcagaaatcttaattatgaacaatggacatatatgtccacaagaaaagtacttacttggggctcccaggtcccattcaggaacatatttcctgagaatctccagaaaagagtagtatttttcccaaaaaattaggttatagaattcatttcctccctggtttctctctatttcaattacactgaattatttggctatacaaaataaaaggagggaaggagtaatcagtaagcaaatcatcttatggtctggggatggagagaagtaaataaggcatgaatatgccatttaaaaactcataatttatttcacagattcatgtagaaacaattaaccgcaataaaggcaaaaatatgctggaaaaagttgcaaaagtgctcttggaaaatagaaggaaaaaataataccattttggggagtatgagacaacacagtatcacatataacaaaaaagttgcactctcttttctctcccttgtcatttccccagcgatatttaccatggaacagcgtaccttcacatcaggcctttctgaagcaggtggaaattaaatgtagacttaagaacaaatacttgatgaaagtacaatttatcttatttcatagagagtcttacaatcatgtgcaaataaactacttattattaaacattaactttttttattgtagattattcctcatcatagatcataacttttttctaccataggtggtagacagatagataaataaagatagatatttaaaatgagattcgaaactccactaagacttgtgtagtt

SEQ ID NO: 61790 - DNA, 1164 bp, Bovine  19866881388514
cttataatttatgctaatttaacaacccctgaagtctctgattaacacagcagggcatgctgattttaataatttttattccaaaaactagtcatcatttgctgcatgctcagctataatgacattttctaaaggacttcctaaagcttctcaagagagaaattaattttggaaatctccaaagtgaaattttctgggcttgaagaaatgctacctaaagaatggtcattttttaaaaaatagcagtcactgatactctgcccagtggataaatgctagagcaaattccaataatcccttcctcttcctttgtataatctcctcctcttgagtacagatggaacctgtgatttgtttctaacaattgaatatgacagagttgaatggggtggcattcccttgatttgctcacagtatgtgagatgtagtcttagaaggagagagtcttttgatggtcttgatgaaactcactactgtgatgtgagctgcctatggtgagggttgcagagcaggaaagtgagagcagcctctaggagtgaagaacccggcatacagccacagggaaagtgagttctacaaacagcctcttgagtttggaagatgactgtgagctccatgaaaatcctacccttcctgacattttgatgacagccttgaacaggggacccagataagctgtgtccagactcctgacccgttgaaactgtgaagtgaaaatgtctgttattttcaagtgctaaatgtgtggtgatttgttacacagtaattgaaccccaatatactttgtctcatgtattgttgggtatagaagagggtggtaaaatatgcttgttcagtataatgactaagttggaactgcttattgatgtataacacacatacatcaaatcacactaatcataatagtacaactacttgaagttttataaatgaaataaactgctataaccagcatccagtagaagactagaagattatcaccaccccagattttctttccatgtcccttttcagtcactattttccattccccctgcaagggtaaccatttttattttattgtgatttccagcgccattgattggtttcacctattttggagcttatggagatgaaagtatactgtatgtatgctctgtcacaacatatcagcttctttttttt

SEQ ID NO: 61791 - DNA, 773 bp, Bovine  19866881403843
ctctttcctaagcctgccttatctctgggaagtaaatttcttgcccctgctctgttataatttatcttaaattctttaattctttttcagctggtctccttaatcctcttaattacagcttcttcaaagctcatccttatgtactctacttgcactattatcagatcatttcattatcaattatctgtaaaattagttcttaaattattcttggtttttaataacttattgttctcacccatcaacctttccaattctaaggtagtatttttagatacatttcttattctctttctcagagccattaatcaaagaccacactgattttttttttttcttacaaataatgtgaagtgccctgcctcttctcagagtgcaagactaaaaacagtgtttctcaaagttagtgggcctgggaatcacatgagatgtttgtcatagatgtaaatttccacttctgtttctataaattctaactggaaagcctatggtgggactcaagaatctgtaactttttttctgaaacctatgtttttttcttaactttttcgtagtttcattgagatataactacatataacaagaaatttatattttaaataaggatcttacatgattctgatatgggacatatatgaacaattcttaagaaatccaaaaggaaaggaagatggtttccattgaggagtccttaagtcccacgttctgacagactctacaatattatcccggaagcatttcagtgtttcagtcaatagttaaagaatctagag

SEQ ID NO: 61792 - DNA, 1473 bp, Bovine  19866881424551
gtttaagttctaagtttatctggttctgagatatttgatatattctaaatttctaactccccaatccctgcttccaaagaaccctagagtgattaaaatgcttcccactgtttaaatgaacagtagcaaacaccgaaaaaagaaattatatttgggatgtttaaatagtcataagagtcatcttttgccaaatggtgattctcaaactttagtaagcgttaggatctctcagaaagcttgttagaatactgatatcttctgctaacccccattccttcaagagaccatggaaatgtgttttagccattatctggaattgggaaacctattttttctcagctacacttggagaaacagtgtcctaaaatgtgtggctgcttctcaatgaacttcatctgttaaaatggggggacagagtatcttagcatcaatgagcttgtctaaatggatttcgaacacagtggcatgctagttcttcattggacagattctcataattgagcagcttgggtggggagctgatataactattctgaatgtgattgatgctccagctgataaagctgaactctactcactaaagtgctacgctctgggaggttcattatgctggaggctgggactgttgcccaaaactctgtgactataatgaagataggcatgggtctttcatgatgtccaccccctaccccaaatgttgaaaagtagctagcattgagtatttttatacatagcaaaagtaagacagagtcagaaatttctattctcttatatctcagtgacaatattctaatataatttcctgtctaatgttctattaaagtgattgatttcaaattaaacctttggagtagtagctgattatgtgaaagtgtgacagttgaccaggatgccattttttaacagtttgccttctgactgaattaacaacagtcccattccatgcagtattatgtgtgtatctttaccccagtttgcatacctaaaaaatgttatttaatgaataaactggctcatgacagttgttgcttgattacctttttctaaatcttacttgtaaataaggctcagctatgcagcaaccaaaaagttgttatccattaccttgctgaattttggctgattcaagttaattcttcttaaaagaagaattttcttttggaaaatcactcattatgtctattcactttgtatatattggtcaggcttttaaaaccacgtcctccagaaaggagacaaaagaaaatcaaacaggtaaatctaacatgctaaattttgcaggggaaaaacatcattatatgcatacctgatgcatttcataacctgagtgacattctttagacttaccagcacactggcaagctccagaaaccagctgatccaggctatcagaataccaaaacacctgaatgcggtgtctaaaattagactattgaaattctccctggatgtcactttcctttattacaagca

SEQ ID NO: 61793 - DNA, 757 bp, Bovine  19866881425652
caaatgaatattttgtatttttgtttaagttaaaaattaaggattaattcagatgcatttagaatacaattagttttcatcagtattttttatacttttaaagtaaataaaatgcatattattcttaatttaaattgatgtccagtatgttacatctggaatagtatgtagatgatctttgtgtccctccagggagctggagagttagttaaaacatctttgatgatgcatattgattttatttgaaggtttgagttaaatacattaagtaagtagagctaaaaatatacattcatttcattaaatatataatggtgatattagttttaagattccattatttaatagaattttaaaagcatttttttatcctttcactacagatatacataatttactgaccttgatattatgcaaacttgattgaaaactataagaaataaattactagtttttaaggtcataaatgtgcagcttttacatgtgacagatagaacactaatattcagatataatcttgttttcctctaaagattatggtttttataggtcaaatataattacaaatgtcttatattagaactgtaaaatttttgaagaagcaactttttatatgcttggcattagtaagaaaattttgaaagaagcttttctgtaatcttggaatcagttctgatccagccaggatgactatggatgccaataccataggagccctagggacacattctactgggtgcttgctggcattcactgg

SEQ ID NO: 61794 - DNA, 693 bp, Bovine  19866881546009
acatcatattcattgttttacttgcaggttcacacagtgttttttattagaaggtgcttaataaatgctcattaaacaaaaggaaaataaacagagtgtgtacctttcaaacatgtccacatacaagcatatacttggaatacttatttgaggcatcacattctttttttgacatacacttcaatcagatccaatgtactttttcagaaaacagacaaaattctaattcctcaccagagagcagctgatgggagaagtgggaagaatcaatcatcaatctctttcattcactctctctctctctcctacaaactacagcattattgttaatgatgttttgtgcatataaaaggtactttgggaagaaacagatcttcctgatgttgaatataaattaattgtaaaacatgatctgcttctttttttccaagcggatacaatatacgcatgattctgaagctctaaaaggctattctgaaactatctgcagacaaggttgctatggaaaccatcttttttggaatagtacaataaatagtcatctaaaagaacactgaacacagtgcaccttgctctagtaattataggtggtctagaattgaaatatctatatgttttgccttcaggagtgccaccagagcatttctattaccacagcagaatatttttgtaaagaagtgaggtgcaaaatgt

SEQ ID NO: 61795 - DNA, 1220 bp, Bovine  19866881679347
ttttttaatgtcagagctgaggcactagcagttctctagaatttacagatttaagtgttaagagtgttgacattttccaagaacatgccactatttttattcattcagagtaattatgggttcttataaaaattcacacacattacttgcttgaaaaagtaaacaatcttctcttatttcttatcttattgtcaataataataggtttttcctggtaatgttgcttttacaaaagatatattcatattttagaattcatttgtattaatgaaattaatcagttctatttcatatgttagaaatcaaactaataaaataaagcatccacataggcagaaagctgctatttattttaatttttaccatgaatctactgtcctcagaactgagagtaactgcaactgaggcaataagattcttgtgaaggatttgagggttaagactaactctgagggtctctgaatcagactttaccaggcattggaaaaacttatacaaaggacctacataatagatttgaaattttaaaaaattccaatagcgaacaaaagaaatagtattacatgagggcaatgctagtagaaacaagactggttaggaagcccttgcttttatataggggaagaagggtgtcagcatgaagtagatattaatgatgtcaatgaatgtttctaagaggctgactttaaagatatggtgaaaaataaatgggagaagatggaggatggcatcgaaggattttagttggttcattcagggaggaatattgttcatgtgactgaaatatagcagttagagaattatgtttgtgttttatctaaggcctggggggaaaacccagtttattcttttgaatttagacagaggcatgggatgttgatcttgacttgagaaatctagaaaacaagcaaaggcttggctgtttctatagcagacataggtgcaagtgagcacctgctctgcttcttagagactgtgaggtgaaggaatggtgagtgccgttgggaggagctgtggaccaccaagagagagtcatagagaaggaggagccttgggacacccaacagtaaaacctgtagtgtggatagagaggaagaagggcattgaagtagctccaggataaaggacaaaaattgccaacaaaatccttctggtcaagggtaacaatgctggtgatcagattgagaggagatcagggttctcaaatcctaatccctttt

SEQ ID NO: 61796 - DNA, 821 bp, Bovine  19866881947138
tttgaaaacaacacaaagttgaaaggcagagctaactctgttggatgacagaattaagacttcaaaatgctcttgacaaggctgaacactaagatgaaatgcatacaatgaaattaatagacatgctatgaataaaaaagcagactaatgaacaaacaaacaccctgcatgtgtacaagatggcgtgagatcagacttgatagcattattaatggggggaaaaaaacctagaagctttagttgaacattagtcaacattttcatacagctgcaaaaaaaaagtcttaggttgtgtaatacagtaatagtaaaatcaggatagatcatgcctatgtagagaaaaatattcatgcctgggtgtcacactgaagagcaatattaaattttctaagtattcatgaaaggttgacaaataggaaatgcactcttcatatcatataagaatagctgagaaattgcttgctgtggaaagggaactacagtaaattaatatatattttcaactactttagaggactactactcataagaatacttcatcattttaaaacttatattaactgtatgatctcagaaaaggtctttggccctctgtgcctcaattttttaatatctagcaatatcaattctgtagaattattacaagaaatagcaaggattcatgtaaagtatatggtacattacctggaattctgcctgcatcctataaacagtgaatgtttttttctctactgctgtaaaggtagactagagtaaatagatgaagccagcagagtcatgcccgccccccaccccccaccacacacacacaaggcccttaa

SEQ ID NO: 61797 - DNA, 979 bp, Bovine  19866881947370
aaactgtacttagtgttaagtgaacagacataagtagttaaaaaataacattttacatatgaaaaagccatggcaaaggctattttgcactataatagaatggaattggagagcatttgccttgcattttcaatcctccttgtatatataagctgtactctggcttcactccaggatcctatcttgactacagtctgtcttcaaaatggagtcattatgactttcagtgcttttaccagtctattttttctgttttcactcaaatgaaagcagctatctacttcctctactgctacccctggactttacacagatcaatacacatctttctaaccataaacttagagtatttcaacctcagctgagccttcagaactgtttggaatcatttttcttttccctttccaatcccatttgaattttcataatatttatacaaaaacctttattttgaatcctaatgtactttcaataccatcacatcaatagatccttaattcacagagaaagccaagattatcaggtgaaatatcctatgactttgtattccctcttctctattgtgaggttcatccttctcttctgacctggatgctgaggtgctttctcttatctacaaaggtagctgctccacccatgccttagggacaatcttctgctaggtcattaaagcctagatagtcttttcagggatcacgtctcctaagcctacatgcatgcatgctaagttgcttcagtcatgcccgactctttgagaccctgtggactgcagcttgccaggctcctctgtccatatgattctccaggcaagaatactggagtgcgttgtcaagtcttcctccaagcaacctttctgatccagggattgaacctacctctcttgcggtccctgcattgcaggtggattctttacggctgagccactggggaagccccctgagcttacgaggaagctcagatattctcatccttcatctac

SEQ ID NO: 61798 - DNA, 2492 bp, Bovine  19866880347780
cagtgaagctttgtgacttccccctggctgtgttatcagcatctctctgtgcattggtcagcaggatggagatattttctgaacccattcggccagcatatacagtctatctgagtaccaattacctcaagcctcactcataatagaagtcccttgatactagagaaaaatgtttttctgcattttatgcttccttattatccttggtttttgcttatttgttcttttttaacttgagaaatttcaatagcttctttgctttaaaaaagtgttttattcacacagaagggtattattcatagaaagagctatatagaattccattatgttatagttcatcggttagtgtaggcaatttctttgtgttctgatctcggtgtctccttgctttcctggaagggcatgtggtccaggatcacctggtggccagcctccaatgtggctcccaatgagtcttcattgggactcctggtatttatgacttcatgtggtccccttccacactgattaacatcaaatatcatgaaaatgatggagtgtagtttctgggattatgtcacaaagggtagtatggcttctaccttgctttcttggaaatcatttacttcggcaaatgccagtcatgtcatgaagacacttaatcagccctgttgagaagtccacacagtgagaaagtaaggcttcctgccaatagctagcaccaagcatgggagacagccatcctggaattggattccccagctctagtcaaaccttcagatgcctgctgtcccatttgacaaacccatgagagccagaaccatacagctgagccacttttgacttcctgatctttcacaataactgtgtgagacaataagtgtttctaacccatagaaaccctgttagatgatttttaattgttgcttcaagcctctaagcttccgggtaattttcttggggtaaaagggagagcttctgttcttagctccagctgttttacacctcaagtgtctacattaaaaaatcttgggacctccctggctggcagtccagtggttatgactgaagttccactgcaagggaaactggtttgatccctggttgggggactaagatcccacatgccatgtggcacggccaaaataataataatagtaaataaatctctccactatgaggacaaatttacttcccaaagcctttctgctttacgtgtgaaaatattcttcctattaccatgcttttgaccattacaaagcatataatgttagttgaatgacagaggatgagatggttggattgcatcgccgactcgatggacatgagtttgagcaagctccaggagttggtgatggacagggaagcctggtgtgctgcagtctatggggtcgcaaagagtcagacacgactgagcgactaaactgaactaccctgaactgaatgttaactgacagtaattggtacccatgcccctcacttttcttagtaagttctactcttaactctgtaaggcctgaggaagtaatcaatgtggaggaaatttaatttcagcctgctgcaaaggaaaagaaagacacagaatatattgctgtaaagttgattttttttttttttcttagaagaaaataaatttcctctagagaccatttttggtcttttctactatgacattaagccattggtaccatgtattttatattatcttcacaaatttttactctaatcaacagattgagagctaagagtcctgggttcagattttaattttgctactttgtagtctgtgatagaacaaagtaatttttctagtccttagtttgactgtctgtgaaatgaaaccagtaaaatccatttattcattcagcccatatctacatgtttctttgtttgtttttggccatgtgttgcagggcttgcaggatctgtttctggaccagagatggaacccatatccccagcaagggaagggcagagtcctaatcactggactgccagggaattcccagtctgcatgtttatttagtatcttctatatgccagtccctgcacttaaggtgaacaagactggcatgacttttgctgtcatggacttcacatcttacatataacttcacatgacttcatttttctaataagttctggctgggaaaggctctacaaaaggagtcaattcaacacatattttttaacatctatgacattaactctgaggtgctgattctgtagaaccataattaaatgaccccagattaataactatagattgtatgtagctccttatactttgtaaggcactttctaattatcatatgtgagcctctcaaacactgtgattgctcagttattaacctggactatccactcaccctcctctaactttgcctttgttatatattagatttctctattcttacatgcatttccccagggcatttattccacctgtaattaaacagtgaactagggaattcaagtttgcttcccattctagattggaccataatctgact

SEQ ID NO: 61799 - DNA, 1321 bp, Bovine  19866880362189
ccaggtacataatccccattgttcagaggtcttgctctcatggcagactctctcagtcaaagaaatgttgccagtgattagaaaaaaaaaaatcaaaccccaaatttaaaattttcatgtggagtatttttaatattaaccacaaattaacttagcagataattaattcctttgaaaattagctgtattcaacttaatttaaaaaaaatattagaaaatgtgaaacatgggagacgtttgccttaatatcttgtatctcttactattttccctgtcccaattacagaatcataatgagtggatttgtccaaatggaaaatgtgtctgtataataataaaattatatttctctttccttcttgaatagctggcttctttgtttagaaaactgtagtatttactcacttgcattttgtgtttttgctcaagtgtcaatttccctgtaaagtctaactctattgaaatatatttgcctgtggccatgccatctttaaattttccttaatttgcatgcacttcatatctcaatgcaaagcctaaaatgtctgacacaaagtctatacataacaatacttttgattgacaggagggtttattatgcattgatatgacatcatatttatgtataacaatgactttttgactgacaactaagcaatgatagaattctggacaccttctatacatcattttttataagacaaactaaaatatccagataattggctgaatttttcaattttccccaattgcttagcgttgagtatgggaagacacagtgagacagtgcctcattctttgccttttccagtggtgaaagatactttgtcccaacagaacatcacatggttccactcctttttttccttttaatgattttgtgtgttaaaagttggcaactctgatattaaatgaattgatttttaaaaataggcatgctcacaactgatctgtggaatattttcaagaacctgctggtaagaagagaaaatcttaatgagattctgcattttggtctcatgagaaagctcattcaggaggcatggtgtccagtagtacacaccaatgccaatcaattaacacgtcttgctagacatctaccacccggtcagcagtcaacacaagaaggacttagggagagccaccaggcaatatataacaaactgttaaataatgcagtagtcagtaagaatccagaaaaaggtaaagccagagtggactgggaaatatggtggtctgcactgtaagaaactctgtgccatctggacttctgtgctaaccagctggatgacctcaggcaagttgttaactgcttcgtgtt

SEQ ID NO: 61800 - DNA, 1300 bp, Bovine  19866881050508
tttgtattaaacaggcattgttttcattcttggcaccttatttttcatgtacataaagagaacgcaaggctacagcagggcgagacaaagatcaatgctgaatgtattacttggcactggtcagacgcagtttaataagaaaaaaattgatccattaagctaaacctaatttttggccgaaaatggctgaaacctcttctttatattgctagcttcataaagacctataatatttggaagaaacaactcaaggctgagtttaataagattaaatgtattgcaaatatacttaacaagaatctatcaagttgttaatgattgctattaatatcaaacaatttttgtatagaatttttttattagagcaattgtaaaatacagccataagaaatgcaatataaaaaggttttcaggtaatttgtaacagctacaattgcagaactcaaatcttaacctacaacaatatagtaatttattttatcaatcagtttctaacacaagtacaattaaatttgtaaagtatttaagtgctggtcttagccctgtgtagtcaagttccaagggacattgacggtaggcagtagcgcccttacatgtcaggagattataaagtagaggatttgttcttataatacttaaaattattttgaaaatgcaatgctaatttcaaagaaattattttaattcagcctcatctcagatgattaaaaaagcagaagttttcatctcaaatgtcactgaatcatggaactttaaagatagtagggaattcattgacttgtctggttcaatctgcccatctacagatatagaaactatagctacagacggattctgtaaaataatctgccaagtgtgcatacactggaggaatactgaatgtttttattcacaagataaaaatttcagctaatgaaaactgagacaacagaaggtgaaatagacacttgtggccataatcacgatacagcaactgaaaacacatggacaataaaatacctttttacctaaataataaagactttcatttgaatactctaatgctatactttatttatatgtatattcactattacatcacaataaatccagaaacacacacacacactcacctatacacattttgctcagaacttgatcagtacttaaaatggatccatgaaaattagaaaaaattaaagatcatgatttatgtaagcaattatacgaataacattttttaagactatacctaaaaattggggaaggaaaatcatgttctgtctcgttcaaaaaaaaaaaatcccctacagcctgggca

SEQ ID NO: 61801 - DNA, 1319 bp, Bovine  19866881369471
tattgagcaaattactatggcaagtaatttgattgcatgctcctcattgtcagtaacactaataatactccctactaccatgattattgtgaggaccaaatgaagtgtgttcagaaccatgcttgatatagatagcagtgccaggtatcaaatgttgttgccaaagaagaggatcagtaactgagtctgattgtttcctgagaagaggagctggcaagagaagctgaaaaagagtggaaagagaggaagtatgaaatgtaggaaatgatagcatcacaaaatctaaaccaataaagaaaatatcagagggaatagtcatacatttcaaatgctgcagagaaagacatacctaagatttaattacatctagattctatttactctactggactttaatagtctttactcccgcagcaggcacttataagctcactttgttacgttgacttgcttttgtacaagccctcagtcatactcatttacataacgtctgcgcaccattttcttctacgtatggtctcctcaaccagactctaaactcttcaaagctagatttgtattttttgccctaaataataaacttcttattttctactttcctacatctttttgaacacacacagagcacccccaccaacacacacacacacacacaaactaggtaaacaaggacatcagtaaggacccagcctacaaaagtcaataaggacagaggtacaaatgttacatttgtaacagaatttttaaaagacactttatgtaattttgaacataaattgtcctttgaaaattttgttaccaatgctttatccaagagcatacaaatttacatgcttctaagaagagctttgttttgattaattctaaattatattcttgccacaggaaatgataaaacattatctctttggaatgtaataagagctgctcttaatttaccaacagggtatcttacagatgttaccttaaaggaagtttttaaaaaataattttcattgtttacttctattaattaattcagtaagtaaactatttccgattgtttatttttttctgttttattcaattacttcagtaatttctacccagataagtagaaataagtgaatctcttatcttgaaatagatcatttttatggttgcagagattatcaaagttttataaaagtttggcttttagcccaccatatctataatggagcattttcctttttaaatcccaaaaggcaacatttaaattttatatgatgaagtaaatcatccccattacaacacctcctttgtttccttaaagaaacccagaaacaaactttcatagt

SEQ ID NO: 61802 - DNA, 891 bp, Bovine  19866881533593
ctacttgggaaggaaatggcagcccactcctgtattcttgcctagaaagttccatggacagaggagcctggtgggttacagtccacggggtcacaaagaggcgacatgactgagcaactcagcacaagtgcagtattgtctactagtctctatcttatcaatactttgcatcaggagaccagagaaaaggaaggaagtttttgtaagtattctttagtgatctctttacaatttgtgactttggataagctcattgggtaggctgtctttagaccacagatttatatttataagttcagtcataatctcaaatatgtatcatgccagagtttttgatttttaaaaagaattctctctgctatttgtttttacatctgcattcctaaccttagagcacagcccaccatccgaccattctctcacctgaagagccagcagttgtcctaagcccctcaccttccttcattctgtctgttccatcaagaccacaatggcctatttgctaaatatattttgaacttgctgcttatttccgtgcccaccatcattttctatagtcggtccctcattatttcctaactttttcctgttaagcctatgaaatgatcctcctgcctacttctgtcactccatcgttggcactgttattggggcatggttctaaaaatcagctcaagattatgcctgatctgtactaaaaattccctttccttttgctttctctgccataatgctaagggttccctagctcccttatttttgtcagggtgtcccaatattaagtgctcaataaatatttgtgaaatgattagatggatgaacccctgtctcaaagcattaatctataattcaggctgatattttccaactagatttatcataagttgaact

SEQ ID NO: 61803 - DNA, 744 bp, Bovine  19866881698115
agatcttaaagttttccgcctaaccccatctgatacttaaattacttctataacattcttgccaagccattttcataggtatacctcaattgtactgagtccaagacttctctccaatacactgaacaatgcttcctcgacccctcaacctcagagtacttactgctcaaaacactgaagaaacaagttttaaaggttacctgaggtaaccttggcacttgggcttttgtttctgactccctcagagtttatggaaagtaagacttgggtacccaaatcaatagttgaaatttgaaatggcctaagaagtagtggtgtgctgaaatagactacgacccacagttctggtttggctgttaagtggcactctgagttaagtgacatccctttggtatcttgaaatcagtcttgatgggaatatttacaccacagaaattggcaagtggtttaaattgtcatcctaaaatgttcataattgaatatgaaagaagacaacaggtgaaatgcattccagaccctatctgaaagaagcgaaatatgataagagattttggcttcttaaaagaattatggtagtgtagataactgtgaaaaaatgaaatatagaatctttaactagagtattataaccttaactatcaaaacagtttattcttttgagatcagttctttaaattttggggggaaacttgaaactttacttatgtgacttgtagaaaaccactatttcttgcaaatattcta

SEQ ID NO: 61804 - DNA, 939 bp, Bovine  19866881920154
gcttgacacctattttcattcctattctgctctgtgactaaatcttagtttttgaaatgtcaatggatcaaaaggaactgaggagacagttggcaagatgtagggctatgcctgccaaataataaagtaagttttgctttattaaagatgcagtaggttatacagaaagttgctttggtaattaataagcaaaaatagatataatttagttgaatctaataagtgagacagttaccttgtgtttgctacttttaaggggaaggagagaaaaagagaagtataccttattccagatgggcctctgagagggtataaccaaaattatgaaacaaatattcattcacctgactcatatttgtatagaaaagataaaattgccacaataacacaagtttttgtgcgtttttttttaacagcataattttctttctcaggtgataaagcagttcactgaactacaaattacaatgtccattagcaacctgttagccatgtgatatctgagattcagacatatgcaagacttggttccgttgccctggtccccagccaagcctgtggcaaagttacttaaataccaccaactctagtcttgctctgacaggcctggctgtgatttccccccaaataggacacagactaagatatattaactgaggttctggaaaacagaagaggaaaaaagggcacactactaaatatgcactaaacattaaaaaagaaaaaagttttatggaaggaaaaattgagattaatttgagacgtaggatttgttttttctctctacaaaggaaataagtcattttcatgccaatgatgctcgaaggattcctgcaaaggaaaccatcttcgctaggaaaatagactccctgtgttgtgggtgacattgccctctacttcttcccctatttgttgcctttgttttcctcccctgtcatt

SEQ ID NO: 61805 - DNA, 1356 bp, Bovine  19866880368800
acctcatgcaaagagttgactcattggaaaagactgatgctgggagggattgggggcaggaggagaaggggaggacagagggtgagatggctggatgggatcaccgactcgatggatgtgagtctgagtgaactctgggagttggtaatggacagggaggcttggtgtgcggcagttcatggggtcacaaagagctggacacgactgagtgactgaactgaactgaactaaaggatagggagataggacaggaaattaatcaaaaaattaaaaagataataatcttgcagcattcttcaatataaataacctggtattagttccaagcccttaaaaaacaaggttcttaaaattaatcttacttccctacccttaagatattatctaatgagcacatggataaagaacacagatttgagtcatttaacctaggactttaaggtttttgcttcatttcttcatttgctcattcagtaaatgttgacaaattccatatctgaacaggcactgtgctagttgatagataggaaaggataaaatcatgaccacaaatgacacagagcctgtcctcagctacattataatttagtagggaaaacacattatggtaaatacccagttgttttttttttttttaatttgtttgttgttttaaagaaagtggtaagtataatacgggtgattggagagagtgttttacaagtctaggaagaggagaaatccaatttattctgtgttcactgaacacctattctgtgtcaaacacagtgccagcggctgtagatgcaaagataaataaaacatgattcttttcttataagagttcttagtttatcaggattacctcctcctggggtgcagagagtgtcaggaaaggatttctggaagaagtgacattttaagttgcatcttaaaatgtaggtaaattttgacaaggggaagaaggatagagctttccagggagaggcaaaagcaagaacatagcagtgtctgtgatccctttttctggtattatttttattcttctgaaagcttggtatgagaatgacaggaggcataactttgtgatatatgctttacaacaccttgtttttatttatttatttattttttttaaattttattttgtttttaaactttacaaaattgtattagttttgccaaatattgaaatgaatctgccacaggtatacacgtgttctgcatcctgaaccttttaaagcacaaaagataagtgtttttagaaaactatattcttttgaaaacatttttgagtatttttattaatattagcaccatttatattattggcactgttgatcaaattgctcttactttatttctgtatcttggaaa

SEQ ID NO: 61806 - DNA, 1785 bp, Bovine  19866880721453
caggttgtgatgctgttatataaacttttatgtaatgaaaagttgaattttaatttgagtaaaaaaatagatcatataatacacatatctttgcagttcctccttgctaactatttcactgataacagaaaagaaccttgaagaacatttattcattcacatttcttgtttataatttggttagtcagcatttcttcaggaacatttctctcctccagggaaacaaatgagagtagttgggaggatatggcagcactgggtccccaaatcacagctgtattcttttgctgtttgagttactacattcttagaaaacatgttggaatcccaagatagaaccaattaaaagaacatatgatttagctattggacagagaaaatttagataaaatgtttgtcaggatataatactgccaaaaataaatgtaacctggtggggcatagaagggaggtaggatttctagaaaacatgccaaaagaatctccctatataatcttagaaaagaataagcccttgtttttccaagtttcttctatctgggatgatggatgtcctctgactgcacttttaaatatactatgttctcagccaatccagatacagttagaaaataagtgggcaactccagattcagtgactaatagggcaatgaattcattgtatctctcttatcttatagggcaatgaattcactgcatttctctttcttatcttatggtattttacataccctgaaatttagtttctgttatgtatgatctgaatatttgtgtctcaccaaatactaattcatatgctgaaattctcatgctcaatatgaagggatacatttagaatgtatttaatatcctttcaaaagaggcttgagagagctcctttgccccttacattcttcatgtgagaatacaaggaaaagtctgctactgggaagaaggacctcacctaaccatgctggcaccctgacctcaaacatccaacttccagaactgtgagacataaattgctatagtttacaagatacccagtctgggacattttgttatagcatcctgaagggactaactaagacagttcctgcagactgcaactcactggttaaacccacttactcttagcaacaacacagtttacccatccagtcactttctaatctcctaacctgagtattaaatcttgctccctgtacctctagtccctggcatccttctaataaagaaaaagactcagaaaaagaagtgtttgttttttgtttatttgtttgtttgttttttacctgaatgttacctgttctttgaagcacaagctggaatcaagattgctgggagaaatatcaataatctcaaatgagaagatgacaccaccccttatggcagaaagcgaagaattaaagagcttcttgatgaaagtgaaagaggagagtgaaaaatttggtttacagctcaacattcagagaactaagatcatggcatctggtcccattacttcatggaaaatagatgggggaaaccatggaaacattgagagactttatttttttggtctccaaaatcactgcagagggtgactgcagccatgaaattaaaagacacttgctctttggaagaaaagctatgaccaacctagacagcatattaaaaagcagagatgttactttaccaacaaaggtctgtctagtcaaagttatagtttttccagtagtcacgtatggatgtgaaagttggaccataaagaaagctgatggagtctttagggttttctatgtagaggatcatgtcatctgcaaa

SEQ ID NO: 61807 - DNA, 1438 bp, Bovine  19866880794471
gttattataaaatattgtgcagagttccctgtgctatacagtaggtctttgttgcttatctattttatatatagaagtttgtatatgttattcccaaatcctaatttatccctccctcccctttcccctttggtaaccacaagtttgttttctgtttgtgggtctatttctgttttgtatataagctcacttttatcatttttcttagattcttaaccacatattttcagtaggtagcatgctgatctaagttaaggattgcaaattatagctcagaggccaaatgtttccaccaaaccaacagagagcatcgtgtgaaatgctactgtcacacccaaagcagttttcagcacttgtgtgggcacagtctgaattgaaacaccaaactgtcattgtactcaaataattttattgcataactcacttgaaatagattagttttatgggtcattctgataggctacaaaatgacgaatgattcggcatcaaaatctcaacgttctcacatgaatgacttcttaacagctgaaggtgatagttgtatgagtttgatagtgaatcctattttaattatattaaaaggagcaatgcaaaagcatgtaatgatgattttaaaaatgttagccaggcaatagatataaaacaattagaggcccatctgacttgacatttcactttaagtatatctcttcttagcatactaagtagaaaataaaagtagttattaaaattatttgtggtttcaaaatggcacacagctgaaatgtgaaatgtacatgtttggttctttatgagagaatcctcaatctgagcctaaaagcacctcaagtggcaaaccttcctgctttatgttagccttatgggagctcttttttgtctttcctttcatcttcatccttcctatatattaagcgacaatacctattctttttcactcattgaaatgcaccatcttgttttccaaacaatccttaactgagcatcactttggaatttctcagacctgtatttgtttccagcatggtgactttggggaagttatttaaccttatccaacaagccaaggagtctacaaattcaacttctttcaaatttgaaaaataatagttactattccataaggttgtggtcggggggcgggggggcggggagattctatttgctaaatgtatatccctgatatacagcccacccctacaaatatcattagtcaaatcaaccttcacattccctctcgttctcctctcctacacctgctggttttgcacagttgtagcatcttactagccatctgggcttccctgtggctcagtggtaaaattcccaactgccaatgcaggagacataagagactctggtttgatccctagggtgagaagatcccctagagaaggaaatggcaacccactccagtattcctgcctggcaaatcctatgg

SEQ ID NO: 61808 - DNA, 1256 bp, Bovine  19866880852488
agtgtttctttttgattgtatgatttgcattctgttgtgtctcccctattttatactgattttaatttactttgctcttaatttatttcacacaaccaatccagtttaattgcagttctgaaagatgcttccttttaatgattttctttgcatattttactcctttcaattacagttacctgaggaatcatactagaacaaggacgattatagcccttggttgagatgatgttcaatttcaacagtggaagaaatgtgcagagttccttcttgtttttaagctgatagtattttgagagcaaaagaaatattagccaagacaagcaatgaaaattttatataatttaagagcacaatgccttctctacagaattactatggtttgcagcaaattccacatcaaatatgaaatataaaagtagagccgtctattattttgtactaatatacccacactgcttccaaatagaatatatattaattcagacatctgacattgcttgacatcaacacagcatgacctagcttctgagttccttgcttctgtttcttttaaccaaaataaaaatatattttctatattttctcagatgttaataacagggaatttgagagcaaaagatgcccttacttccaagtggttaattagcttacacagatgactagtgggcccagttactattttgcaacactttaatcataatgcttaaaagctaaacatattttctacagttgttgtttctatattacctacaagttttctacatatttaagaagagaattttcagattttaaccaactcaaggaaatagacaataagatcatatatgatacaaagataacatctttcaaaaccatgatttcatttgcttcatttagaaattctctcagcgcaggtaaaaaatatctgtcatgcctatgtatattttaagtgtcccataaaaatacatcatttgaaaatgccttccaaaacttaactattggaaaaattttagatatataccttactgtgtatagtaagataggtaatttctagtacaattgagactaaaatatttataagtatagaaggagttaagagtccttaatacagaaaaccttacttcatttttttaattaatttattttttatcgaaggataattgcatcacagaattttgctgttttctgtcaaacctcaacatgaatcagccataggtatatatatacactcctttttgaaactccattcacatctccctccccatcctacccct

SEQ ID NO: 61809 - DNA, 1768 bp, Bovine  19866880892021
ttcctcggatgatgaaatatatagccattggatcaaggtttctttaagaaattttaccccagattctcaaaatggtattaccactccttcataacaaagtcaggtatgtttcaaatgatctaaaatgataagttcaggtttgttttctgtgtattggtgtataaatcagatgttgtttttaaattatgctacagagttcaagaatattggagaaagtcatttgaggagaaaccgctttggcctttgattctctgcctaaacctgtgaatatgcacacacacacatactcacacaaaactgtgctgtgaaatttaggaatttgtgcaagtattcatccttgcaagcaacattgtgaagacaaaatttaccaagaaaaaaataaaaaaagatttaagaaaagattgatatctttccataaggaatcgagttccagtttccattatagttactatacttttaaccccatgtacaataccatttccagctgaaccattatataaactcggctggagtgtacaagaataactaacaactataatgaagatattgaatcataaagtaaaagctatctcatgttatttggactcattttaggaaggaaaggaaatgtatagtggatttaacaatgctttcacctcagtgcctcaagtgagtctgttattaatgaagaattttgtattgccaagattttactttatattttacttaataacttaattcatatctagtcactgtataccaaatcattagcttcagattggttcctgtccttatcatagctgggagtagaatcttccctgaaaccttttagcattgtacatacatctccttaatggcatatgctgatttaatcctgaagttttaataacttgtgtaattacttaaaactctcagatatttaaagatgtttctgttttttatatgtatatttaaagagtactttgttaatacattatgcacattttgttgaagaaaaatatttattaaatactttttactctcgagtcattataataaaatattttgatatttgatagctttatgttgagtcataaattctttatgtataatatataggaaatgcatattaaattcatagacttgaaagtttccaaattttgcccaattacagtagcctatatatttagtcctattttaatctaatcaatattttcctttttcacaattatagatgaatctgagtgatgatgttataaatttagactcagaattctaccaaaaattggaactttcagcatgcattggaattaagtttttatcttaacaaatatttaacaccacagaattaattttagtagactgagacatttgctcagttttaatgtctcagtggagttaaatctctaaatcaattactaataattgagatacaaatgttctacttaaaatgcagtaatcaaagtgctctttcaattcctcaaggattcaattttagtgatgttatttcaagacatttgatattagtcattatttcttttcatatttacagtcttttcccactggacattcactctgtggaattcttaaaataattgaaaattataaacccagagtaatgacatttaccatttttcatttctatagattttcagtgtggtggagctagacagtttttcctgtaattcttcatgcttaaggatactgaccaaaagttagagttccttgagagattagtgggagcactatgcctagatgaatttcacgagtaaaagagtacaacctttagacatttattttccagaaatag

SEQ ID NO: 61810 - DNA, 1112 bp, Bovine  19866881129785
ttgacattattttaatttagttagtctttaattatattttctaccataatacccctattatgatgacttggaacacagccctgtgcctctggtatttatggttcccatttagctctgcctctcccagagagtcccagtttcaaatattctgccctattgtcctcataaatgcactcacacttatcaaaccatctgtcctaaatttcagtttctaaaataatgctttggcactcttggttggaatttgaaatgcctttttctcatggaaataatattataaatgctggtaaggttcccaggcaagccccaaagctcatttaacccatagttgaatgtaacacagataatattaatgaattatttctcaattaatccaccagcctatacggatttcaaggtggacaggagttagacagcatctcaatattctgggctccaggaggtgataggctaacaacaaaggaggatcaagtactcatgaaaagcaagtcctgctggaggaaaaacacataactgatgttttgtatatgtgagttagacttttcagattataaacaaaaaagatatatctggttccactcaaataatgaaagttcattatatggattgtcagggaagtatggaaagaaagaatggatcagagagagaatcatcagagagctgaagtcataaaaaaatctgaagtgaacctgaggatagaacaatcagcacagttgagtctccagactgagcagcagctgtagagagctggttggctttatgccctcggcagcagtgctctacttatggtgactcagctattctctacattgcctcttgaaacttctcatcattactagactcatgctattttgcattaacaatgctcaagtgaaagaatgttattgttttagacagtctacatctaatgcactgaattccccttcaggccggctgtccactcaaaacactacagctttggggaattccaccaatccttaatatagtcagtggtagtgagggtactaaattagggtggccatttgtcccagacagtcctgttgatacctattttcctggtatcattagtaggatccctttcattctcaaaagtgttctgtttttattacaat

SEQ ID NO: 61811 - DNA, 1360 bp, Bovine  19866881336113
atctccagtaaatgaatacttaaaagctgaacataaaaaattaaaagtaaccatattttcacttattgagttcatctttgaatgtgacagagcaaggctgtccatcagggagacactgactctcaggtaagtgttcactccctgcttcattttctttggaatctattttcagatttttctaactcacccagcttataagggcaaactgaagtgtcagattattgccaagatcttttctggaagaaattgtttaggaagagaaatcccaaaagaggttggaaaattgcctggtgatcagaaagaagactattccagtggtaacatgaaagaataaaattgaatcttgagacgtgcaattttctataaggttgtaagttgtttcttaaagcatatctccctcttgacatttgaaatgtttagctggaactaaaattctggtagtagtaaataactctgaacctcagagtataagagaagattacatttgtagactgctttttagcaaattcacagaaatagcaggagctctggagagttagtgtatatgtagcagcattagctacttatttgtcagcattgtcccctcctcagtatgtgtagtcaaggttgttccgtaatttttcaagaaagatccagcagacaaacatagttaaacataaatgtctaaagatctgaacttgaaacatcaggcaagctttgtcactgaaagtgtcataagagttatgtagttctatgaaaggcggtcagtaaaacagttaaggccaggtcgttaaaataactatcacataaatgatgctgcacaaactcattacctcattcccttgtccttttctgtgtcaacacatttaagaactactggccttgtagaaacagttttaggagggcataagtaacttaacttagaaatagttgcctttgtgaatactcatctaaaaggagtccagtgacatatgtatgaacttgacaatggataagaaaaggaaaacagtgttgacagaggttgtctcttgttattgaaatcaaatacttttttctgcttcttaatttttttttattctctctgtatttcccagattaattatgtattattttctgataataaattattgataatgaatttctgataataaattgttgttagaacccccagcagaagtatgtcattatcttgtcattgacttttaaagacactaatctactaaacatttattagatattcaatatattccttggtccagaaagagtactatactgaaaaatgcaagattgattgggtacagcgtcatcttttgggtaatttacccctctgggaatgtaacagagtataaacaaacatgcacacagagctaaaggttccgat

SEQ ID NO: 61812 - DNA, 852 bp, Bovine  19866881425555
tagatgtggcatgttttattcacttccaggactaacccaggaaaacaaatgtagttttaagccaggtaaatttaggccagttataaaatctaacatttttgcttcttgttgtattacccgtataatggcatttcactgctttacttgaaatatgagaataaggagaaaatatgaaaataaggatgagttgtgttttatttctatgcttatggcatagttctaaaaccctcaaaaaataatcagtgaaattgtttccatgaacaattatggaaaaagctattgaagcttaatgcctctcagtgaagcttccagaatgatgttaatttatggtaagatacatttctgatgagaattattataaaggaagaaaaaaattcatgtgagaattctagaagccctgaaggtctagaagagcattcatttgaaaacttttttctcctttttcttcctccttcaaaattttgaatggaaaatacataaggagtctcatttttacatattgtgtttgagatgagttttctcagataaagcccaactcttttaaactgcaggctcccctttaactatcacagcacagatgacacttgctacttttcttccaattccagcaaatggagagaatctaagttttcagttcagtgcttcaaaatttctatatcctggtacaatattttaattttcaaggactggctatactattggatggtgtttaaaagattttttcctacaagtagcatatttccagtagcaactattttcttcttgagaaaccacattaacgtttattcacaaatgatttaaagtttgaaacttacagtactgtatatccaatgacctatcttcatgtgaaag

SEQ ID NO: 61813 - DNA, 1504 bp, Bovine  19866881655357
gtaaatgggtgcagccaatgtggaaaacattatggaagtctctcaaaaattaaaaatagaactacttatatgaaccaaaaattccatttctgtgtgtttgtccaaagaaaataaaaatactcaaaaagatatatgcacctgcatgtttgatacagcattatttataatggctaagatatggaaaaaacctaagtgtctgttgatggaagagcagataaaaagttgtagtatttataaaatggaatattatttagccataaaaatagtgaaattttgccatttgtgacaaacatgaatggactttgagaacattatgctaagtgaagcgagttagataagtcggatgggaaaagaaatatcttatgattcatatatgtggagtctaaaagaaaaatagaaaaaaatatatcaagtttaaagatacagagaatgaattgaaggttatcagagatgcaagtggaggagtgagaaaaaaatgagtgaagggatgaaaggtaaaaaagaaaacatagcattaaaaagcaaaacactaacacaaattttgtaaacctcaaacaaccaaacggatattactaaatccattcacaaaaagtccttaattttatgtctttctaacaagtttgattagctggtttcctaacccataataaattactagttaaaaaacattaggtttaaatcttatgttttgattttatagtagcacctttgaatatgtggtcccctgtctttattgctgtaatctattttgatattgaagcatatttaaatatggtggtggtgtatctcactatgtatagtgagtacaatttgtagtattctaaatttctaatagaacatttaaaattataatagaacatctaaaattctaatagaacatttcttaatgttctttattcactagattttatttatatgttttgatgtttgaggttttgaaagataaatagagttgtggttggaatttgacagtgtataaggctgtaatctagagaatttaaccagaaacaaaaatactaataaattataaactagaatagaaagagtatggtcagcacattttttggatttgcttttgttcaccattcattttggcagactcataagtgatatatgtaacctcaaaacctcaaaaaccacatactcaaatttaatttgtaatgacagtcagtagaaaaattaaacttatcccaagtttaatttcttacctccagaaaatcagcacctctcctatttccccttaggacactaatgaaatagggcacataaggtattttgtgaactggtaaactttaacatctatccggttattttcttttttgagtcacttccaaacatgtgtctctctagcttcttctgtatactgtagtttgtttcaggtggtcttatatttgtttctgcaacaggaatttaaagaaaggaactcaggttaataaagggtaagatcatgccaaatcaatcattcagacattccactagtcatttcatcatcaattatttaatt

SEQ ID NO: 61814 - DNA, 4047 bp, Bovine  19866880341845
tgattgttctgtgagagacatctacaaactgtgactttttctccactaacaactgacatagactctatgtaagcaaggcttccctggtagctcagatggtaaagcgtctgcctgcaatgcaggagacctgggttcgatccctgggtcgggaagatcccctggagaaggaaatggcaacccactccagtattcttgcctggagaattccatggacagaagagctgggtagtccatgggatcgcaaaaagtcggacacgactgacttcacctcacttcatatgtaagcaaagttagttcttctgtcgtctgttcccatagccctgttaggacgcttttcttgtgttgtatcttgtttcaactctgactctcaaactatccaatgtaacaaacacttatccagtgcctctgtttggcagggactgtgggctgccacagagacttaaggaactctgatgtgtctccgaacctcccgcttggccagcacagtgcagcttgggaagtattagttttgagtactgtttttttttttttttttggcttccctcatgactcagatagtaaagaatctgcctgcaatgcaggagacccgggtttgctctctgggtcaggaagatcccctggaaaagggaatggctatccactctagtactcttgcctggagaattccatggacagaggagcctggcgggctgcagtccatggggtcacacaagaggtggacatgtctgagcaaccaacactttcacttttttcactgtgtttttgggcaagatgattctccgtgtgaagtgtgcaagtctagatacctaggtttctgttatgtgtgttgttcttacatatgtgaccaacaggtcttgtcccctttcacccccttttgtggttgatggttgtataagtcagggtaattgaccctagcagctataacaaacaatcccacaggtctcagtaatatagtacaaaataaaagtttattcctcactcacactgatttgaagtgaatgttcctggtcaagcagctcttctgggcagctgtctactaagacagtgatttgagattcaagtttcttctttcctgcactctaccttgtcatctcgatcagatcctctgcatgcagtcagatgacaacgagagagatgaaaatccacctatctggaactttatcagctcagccagaggtgacacacaacacttctgctcaagatcttttgatgaagactagttacatggttcctgccacatgcactaggagcagagacttgcgggatctggctggaccactgcttgccagcagttactcgtcatcttggaaggagcatgaatttttggctagtcatccctgccaaaacagcactttaggataattaggcatgaaagttatttttccttataaaaattaaaaaaataaaataaattttaaaaaaataatgaaaagtaaaaaaaagaatgattgtttggcttacaagggttttattctgcaaaatccagaagccaacctgttactaagaagatatattcacaaaaaatgtttaagcaatttttaatcccaagatcctctgtaaccctctcaagatctccatagctgcttgtctaggtcaccaccatatgggagctggaaccagaggttacaaatagagaaggaggagaagtgagagatcgaggatgagatggttggatgtcatcaccaactcagtggatatgagtttgagcaaactcagagagatagtgaacagggaagtctggcgtgctgcagtccatggggttgcaaagagtcagacatgacttactgactgaacaaacaaacctttcaaggctgaaagagagcttgatggaaagacaaaaaaacgttttgtgttatcctctgggaggaagattacctttttttctggtcaaggtcctctttcttttcacatttctaggcataacagagcataaggacaggtcacagataaaagtgtgctccctgtaccagaaattctgagctgagaaagacaggtgactatataagacgtttggtactaaaggaagaagcagtttgaagaatcagctagagatgaagatgaaggcctgccctcctctggttctttccctagcccaggaagaactggatttgaggcctctggtgtctaccatactttctttaaagcatgagacaaacatcagaggagttctggtctgagatgtaggtgaggcataacctacaggtaacgacttgtcaatgatatatgttaaattgagtggcaatcagactgcagagaagagtgtaattaaaacttagagatagttctaagacctgtgcaaagacccgaagcagtctgttttggataaaaatgaataataatatttcactcttccatcaaaacatggatgtaaatattcctcaagtctcaaatcctacccaaccagcccctttgtgtagacctaggggagagagggaaggagaagggtgaggttgaaggctgtctggtaagttttatgggataaaccagctaactagtgagaaatgggcctcctagaggtgagggggatcccgcagcacagtatgcaccctccaccttccctggagctaccaagacagagaaaaagagggaggggccagaatagatatttatcaatatctttatttatttgatataaataaatatcaatcaataaatatcaagatatttatcaatatcacagcatcatcaccctcattgctgaaccctggaccactgacttatgggttttgagattctccttgaataagtacaaggctgatccgagataccaggtggggattagcctgtaagtaggagctggaaagctgtagctacaaggggtttaaaagaggagtttagtaggcattacgttaccatcatcagagaatgcaggaacctggcgtggttagtgatgtttgaactaaggttattaaactgtcttctaggccagtgctacaaacttagtgcacgtaagaatcgtcctgggagtggggaagagagtgtactaaagtgcaaagtccctgggtgctaactagaaaagaggcctgggagagaagcagaagtctgcatttttaatgagcagaaccaggtaattctcatatagatgctagaggcatagcggaaaatagctgttgagtcagaggctacagtggatttgacagaaataaaaatgatttgtatcaccatccaggaaaaagtaaaatttttttatttctaaacggaaaacattacttgatataatcttatcatagagctttcaaattttgaatatgtgtatttcattttttggcagtgcacattttacattttaaagcacatctattttttactttttcgggctgattttgcgtcttgagaaatctgaatatcaatttatttttttaggtgcagttgtgttgagtcactgcagatgaacgtttccaacatgacaggggaatcatgggtctttattgaaacaggtggtagaagaacaaccactgatcctataaatgcaaatagtcacgacaagattgttctgtttaactaaaacatgtatatgaattcaaaggtagtagtgattctcattaaattggcctacaatcaactttttagaaactcgtttttaatttgaaatatttctttatgcagggagaatagcacaaaatacttcaaatattagtgtttgtaggactaataaaattctaaacagaataaaatagggacttccttagcagtccagtgttcaggactccagtcttgcaatgcagagggcatgggtttgatccctggtcaagaaactaagatcccatatgcttcagggcatggccatttaaaaaagaagaagaagaaaataacaaaagactctgtgagttgaaagcgatcttgaaagtaaactatcccaggctctcatttgatgcttatcagactgtggacatggaagtaatgcaggccttgggaacgtaagacctgagtttgaaagacccgagctttgccaccggggcagtagttgtgtaaccttagacacgtgacttaagatttctgggccacagtttccccatctgtaaaatggcacattggccactgcaatct

SEQ ID NO: 61815 - DNA, 3149 bp, Bovine  19866880369022
cagcagaaagtgaagaggaactaaagtagcctcttgatgaaagagaaagaggagagtgaaaagctggcttaaaactcaacattcaaagaacgaagatcatggcatctggtcccatcacttcatggcaaatagatggggaaacaatggaaacagtgacagactttacttttttgggctccaaaatcactgcagatggtaactgcagccatgaaagaaaagctctaccaacctagacagcatattaaaaagcagacactactttgcctacaaaggtccttacagtcaaagctatggtttttcctgtggtcatgtattggatgtgagatttgcactataaagaaaactgagccccaaagaactgatgcttttgaactgtggtgttggagaagactcttgagagtcccttggactgcagggagatcaaaccagccaaacctaaagaaaatcagtcttgaatattcattggaaggactgatgatgaagctgaaactccaatagtttgcccacctgatgtgaagaactgactcacttgaaaaagacccctgatgctgggtaagattgaaggcagaaggagaaggggacgacaggatgagatggttggatggcatcaccgacatgatggacatgggtttgagtaagctccgggagttcatgatggacagggaagcctggggtggcaaagagtcggacatgactgatgactgaactgaactgaactactaccttcatccattttttgattcaatttattcaggctctttgagagactcacacacctgtctctatgcctagaaagtcagtctgatgaccagagtcgtgggagggaggaaccttgacattcacagccattctgtcctcttgtgccagtccaccttatcatctcccaaggagactttcgagttgactctgtcaaaagaaaatgctccaataggaaatgaatgcgtggaaatatcccttacaagacttcgactttttaaataaattttgtatgtcattcaagagctaatggaataacaacaaagtataccaatcagctaagtccaaacttcagactaaacatactatgtcaactgctgtttgcatgggactgaggaacatcactctttaactggagagctgagaaaggtaacagttcccacagacatctgattcagaagagacggtgctctcccttttaatttcattatgtatataatatgtatgctaagtcacttcagtcgtgtccgactctgtgcgaccccatagacggcatcccaccaggctcctccatccctgggattctccaggcaagaacactggagtgggttgccatttccttcttcaattcatgaaagtgaaaagtgaaagtgaagtcgctcagtcgtgtccgactctttcacgaccccatggactgtagcctaccaggctcctccaatccatgggattttccaggcaatagtactggagtggggtgccatttccttctccagggatcttcccaacccagggatcgaacccagggtctcccgcattgcaggcagatgctttaccatcagccaccagggaagataaagtgaaagtaaaagtcacatccgactctttgcaaccccatggactatcactctagtccatggaattctccaggttagaatactggagtgggtagccgttcccttttccaggggatcttcccaacccagggattgaacccaggtcttctgcattgcagtcagattctttaccacaagggaagctaatggatatgctaatggaacgccttaactatttgattatttggaaactaattggaagcagtatgtatgttctaaagtacattaaaaggatattgagaaacatgaacttttgaccattaagggactgttttcatctataaaataatgagggttagtctaaatgagcttaagctctgacatcgagagtctctgattatccagcgtgtgtttctctgggccacttaccttttgttcacctattatagcaactttatttgttggcagtacttctggaggctacaggcaatcattactaatgtcatagttacctcaaagtcccaaagctgcttactcgcattggaatacaacgtctgttgctgctgctgctgctaagtcgcttcagtcgtgtccgactctgtgcgaccccatagatggcagcccaataggctcctctgttcctgggatcctccaggcaagaatactggagtgggttgccatttccttctccaatgcatgaaagtaaaaagtgaaagtgaagttgctcagtcgtgtccgactcttagcgaccccatggactgcagcctaccaggctcctccatccatggattttccaggcaagagtactagagtggtgtgccattgccttctccaaatacaatgtctagtactgccaaaactcacatctgccaaagcctatgcgttagctgcctccatggccagagaaaaaaatgaactctgtctccctctgttttccaaatctggtgcaagtgagtattattggtagagcctaaattatatatagaccctggtagcaaaaaagtttgagtaatatagttgggtaaaaaggctttcatcctttgttatacagggaagagcgaaaagggagcaggaagagactgttgccagtggagaattccacacagctggcaaagtgggctttatgaaaaataggttaaatcattggcctaaataagttttttgtcttatcttttgacatattttttcatgttattctttcctgttcattagataaataagcagagagttaactttgtaagggtgcttggtgttctttaatcttacagaaattttagtggaagataaagaattttgctttaatttcatggcttttgaacatttggagatttgtagtttaaaatcttatctctttctctgctatgttgggtacatatatttttagtagggagcttagataatggtaaaaaaatgggagtcttagctattacagaaaaaaggaatgacaagcgataaatctatgtttgttaaaggttaaatgaagttcttggttggttaaggggaagaagaatcattctgctgccttctgctgttgttgataccaaagcatataaagaaattcatcctggttttggtttttagtatacaaaacctgtatctactctggcttagtcttctttg

SEQ ID NO: 61816 - DNA, 1463 bp, Bovine  19866880371191
actgaactgaactgaaagttagtttaaatagggaacaatccaggaattgggagcagtatagaaaatgtagcaaatgcttcactattcccttgataattccttatttttccaaatcatatattgaatgttaaaaaataataaatattctgcttaagaagagacaattttgcaatagattgtgccactttgttacaaaaaaagaagggaagactttttcactgtggatctaagaaccatattggactttttaggactcctcttacactgggctcatgtatttttattagaaacaaagcagacctaataaggacggagggttaactcttgcaccaagtgggatatactctggactgtcaggcatacattaaaaatctgtgttccatactttcatctgcactggcggatataaagcaaaactaatggacctctttaccccacaggaaaaaagtcaagatatataaacttatgattgaatcatccctttgttcttgtctccatccttcaacagctctgtcttctgcactagcaccagtgacctattaaaataaaatacatatccaatcctgtttctcacttccttaaaactcttcagtggctccccactgccattgggataaattccaagctctttgtgaaccaccccttctcatctcttcagactcataaccccactttccacttcaccatggaacttcaacaaccccttgcacagactgttgcctcaggacttcatgcattgcctaatgcttatccctctctagtatttcccctacctctgacctggctgaagactccttcagagttcaccttcagtggcatttccttcagacagccttcttcaccctctcctcacccccccaccccccgccccccaggccagggaagacactccttctctttgttctctttacgccataggcaaacccacacagcacctatgctgcctgtatctgtttacattgctgcctcccttaaatgccttgatccggggccaggtcttactcatctctttttccagcacccagcacagtacccaacacagaacagctgttaagtaaatatttatgtaactgaatcatattgatcatatgaacaaactcccactgggagaacatctgccttgcttgccttatatatctcagaaaagcccttgtttattacactctattaattgagagctgctgtactacatattaaattggatattttagtcctgctttaaaaataaaggttaaattgagtatattcacagctctgttaagattacatagtgcctattagtgcagaaacataggtggtgactacattttacagttgcttgggatgtgtgatgcccggctgcagtccagcatagctttctgtgtttggtggtattttgatgagatgagctaatagcataaaagtagcaagtcactgttggtctgtggaagaggctgagtggcaagccgtctctgctttgatat

SEQ ID NO: 61817 - DNA, 3468 bp, Bovine  19866880373339
cattttttttttgtattttgctagagaaagcatttagattaaacattattgagctcaaaactatatattgtcttcacatacagtatggtttaattgcaatgacaacagattgaggggaacctgaactttggtttcagctttaccacttattcaggcttccctggtggctcagatggtaaagaatctgcctgcaatgaaggagacctgggtacgatccctgggttgggaagaccccctggaggagggcatggcaacccactccagtattcttgcttgaaaaatcccccatggacagaggtgcctggcaggctacatacagtccatggggtcgcaaagagtcggacacaactgagagactaagcacagcactaccatttattatgtgaccataaagaagtcacttaatcctgtgtaaaaacagtggactagaacagacaagagacagcaaatatatgcctaatgtgcctttaacaatttaacaaggctactcaatggtggccctgattcccacagatcctggaatgatcctcaggatcctttccaacgcagaattcaaggcagatactaccagtcattaggactgacacaagctggaatcgttgtgaaagtctaggtccagacaatctacaatatgtggagacaacatgtgaaagtgttgtaagaatggggaccccttccaggccctgagagtgggttcttgtcttgtctaacactcagaaataaatgtctgaggaggcacacatgctgataaagcaagagactttattcagaaggggtaagggaacccacggagaactgctctgcttcatggctcacagtctccagttttatggtgataggattcatttctggttgtctttggccaatcattctgactcagcgtccttcctggtggtgcgtgcattgctcaaccaagacggatgccagtgagaaggattctgggaggtggtaggacacctgcttctccttttgacctttcctgaactctttaggttagtggtggtttgttagttccatgttccttactaatacctcctgtagtaaaataacccactcaaatggttactgtggtggctggccagggtgagaggtttcagtgtatttccccaaacagaagtgctttgtaaactcttctatgttgtacaaatttaaggtgctattattgttatcactgttcattacttttgttacagaaaatttgtgaagattttgttcaggatataggaggtgctgacaagtttgtatgttgccaacaaggcctatagctattgtcctaatgatatacaccaaatgctcttggcatttttaaagtgagagtagacaatgaaagcggtttcaaaatgcagagcaaggatcaccttggactgcctggggaactactggggagacatactgacttgggtttgcagactggcttcatcattcaaggtgtaaatactggttttgccattgaacatctctgagcctcagtttcctcatctacgatgtgggctccatcaatctcctctcaaggttgtggaaaatttaaatgagtttaacacgtatgaaataaaaagtaaaaaccatgattcataagttgtactctgtaaatgttagttcctaagggtggaaaactggtttataatgagtactttgggacttttgactcactttctattttagcaaaagttttgtaatctttaagagtcagaaaacattttcagtcagaaacattattattttagggcaagatgtactcccttggatcaccatcttcctttgaaacaaaggtaagagctggaatataagccctccctctttaagattttcctcctttaccaatgagatgttacaatttcttttttacataaaacaattagaaatgttcgaggaattataactcaatagctactaatgctttgtggatgacattcaataaggggaaaatgtgatgactcaaaataacatacttctaactctgtgctaagatttgaagcatgcttgatgatgtacatgagaataatgcaaagccctctgggaatgtatatgtgacacttttcagaatgatctgtgtcagagttccaagcaccccatatagaaggcttctaatgctcaaaatccaggtaagtctcctatttccaccagaaagattagatttcttttgaaactgtaacctaagcacctttcttttgcctccaccactatgcctcttccttccacctgacgctttgccaagttcattgtcaggacatattccccctcctatttggagtgcaaagacatttaattatcctagaaggaaaatctgagagtacaagctgtacacagcaggttaagattgttaatatataacttagctaaaaatctgtttatttagagtagcttgtttcacaattcttgcttttgtggtagcccatttgggagcaaaacttaccttctccaaaagcaatggtctgctgtagatcaacactgatgaagagtcttaaggtccagaagtatctgttcaatttgtggggtttcctaaggattaagggaaaacattcttgagcattttgttgagtacattttaaaaaatgcctctaaatggatataatcaatccctgaattctaagcctgtggtaagcaatctttttgtggaagaaccaatataagtgaaaatgaaagtcactctccagtgtctgattctgcaacaccatacagtccatagaattctgcaggtcagaatactggagtgggtagccgttcccttctccaggggaagaaccattataaaaacataaaaagtttacagcccccacttcttattttttctacatgaaaatgtcttttttcctctttcctcaaaaaaatggtataaactcagaaaaaattaggaccactttgtagtcaatagctatgaatatctagacccattaaagaagcagccaagtagggatctttttcagtctttttattaaattaaataaaagtgcaaggcatgcggctttaagttagaaagagctcatcacttttctaagggtatatagttttttcttttaatgttgtctcttctaaattattatggtgggccaataacatgattgtatacctgagagtcataggagaatcacttttaaaatgatttcaactgaattcaatatgaagactagtttaaaaatatatttaaatgtgtgtgtatatacatacacacatatacatatatatgcatatacacactaatgtaaacacattgatctatatgtatgtgttgtgtaaatatgtatataagaagcttacctctgaaagttgggataattctaaaataatttttatacatagggaaatagtcatttccaattagtcccttctacttagaaagacttatggaagcaggagtggtaaaagaaaaacagaaactttaaatcctcactactctttgttgctaaaatgtgagacacagaatagatggcttttgttttatcagagcttgtaagtgtatctttggatgtg

SEQ ID NO: 61818 - DNA, 1010 bp, Bovine  19866880521267
tgattttcttctagatgatgaaggtcctgtacctgttttggtttggccctctttgcctttctttctatatgttggctggatatttagtccttcacactgaaatttcacctgtggataagacaagcatcaattccctgtaaatataaaacagaggaatacctaacctgtggccagtgtactttctggaatattcctgaagctctcatcttttcattgactatatagcaaagagaagctcctgatcctgcttattttccttttatggggctctcatagggcatccttattaaatcttataacagtgaataatatcataaaatgtaaccaatttcacttctagttcaaatttcatgtttttagggggtaacttcatcatggtagtaatctagtgatattctcatgggaaaattttgttaattcacagcatttgagaatgaagaacacagaatcgtatttagattagcttgtattttaatgaagggaaaatagggcatctggttctcgaagaatttatagctactttaattgcaaattatgtagaatgatttagcatccctttgttcctgcttaacagttatcgtatccaaaatatttattgagtgccagctaagtgcaaagcattgttaaaagtgctgtgggagttttaaagctactagtagtcttaatagtagcataaaaaacatttaatcatttaacccatttattgagccctttaaatgagcctaggcactcttctaatccctttagatatattatcttgtttgatctttagaagacttgcctacttactgcccatactttatttttttacctctctctcatcttaaactgatttccagccccatctttctgccagaatgctgctgctgctgctgctaaatcacttcagtcatgtctgactctgtgcaaccccatagacggcagcccaccaggctcccccgtccctgggattctccaggcaagaacactggagtgggctgccatttccttctccaatgcgtgaaagtgaa

SEQ ID NO: 61819 - DNA, 1242 bp, Bovine  19866880654827
cagctgtcagtcaggacctcagctaggaacctacacgtagctttcccttggaactgcctgggcttccctccagcagggttgttggatttctaagcgcgggtagccctagaactcggtggaagtttttaatgaccaggcctcagaagtcacacagtctgcccagtttcaaggaataggagcagaggcctcattctctcatggcaggtgcaacaaagtcacgttataggaacagcatgttggatgagagacaatgtggcaactgtctctgggaaataaagtctgcttcaaggatggaataatccatgaccaaaagacatcagcaattggcattagtacttctctcatatatttgaattctcctttgacaacggtgggattgccctttcacaccctcccaaagtcagttaaggcctgatgacgtgctttggtccatgaaatatggatggaagtgcaggaagcacttacagtcaatcctcatgattcctagattccatacttgcaaattcacctacttgctgatatatctttgtaaccctcgcatcaatacatcactttctggctcatgggtggacgtgtatatgcgtagagtggtggaaaaaaccaagccaccaaagacacattcccagataaagtcgaacaaggctaagctctgttttctacttacaggtctcatacattgtccttctcatagtttatttagtggcacatttttcacatttttgtgctttttgttggtgattttgctcttttaaatgcctctcaggcatagtgctgaagtgctataagtgctcctaagagaaaagaaggatgggatgtgccttttggagaagacacagaaacttcaagaatgcataagttacagtgctgttttttgtgagttcagtgttaataaattaacagcatatattagggacttccctggcagtcctgtggttaagactccatactcccaatgcaggggcacgggctcaatgactggttgggaaactaagatcccacacactgcacagtgtggcaaaatagattaataaaagcagagtttgtcagaatggattttaaaaaggctacatattgatgaaaatataaccagaggttcagaggaacctaagtctgtatttcctgtagtaccaatggctcagtattcactagctcaatgtccatggtgagtgtatagaacatacatagctgccatgaataatgagagatggctcaaattcctgctgcaggattctcctgtgcttg

SEQ ID NO: 61820 - DNA, 1353 bp, Bovine  19866880674144
ggagaaattatcaaactagattttttaaaagggaagactcaactatatgctgtttgtaagaaatgacattttaaacgtaaagacacagacagatgcaaaataaagggtgaagtgtattttctgtgcaaacactaagcattagaatgctgatgtggctatgttaatcaaacaaagtagatagggaatattacagaagacacagaaattttgtgttgagagaaggagcattaaatcaagttctaacaattctaaatgcataggctccaaataacaaagtttcaaaaacatagtgcagaaaaatgacagaaccaaagggaaaacaaatctacaacataactggagattttaacatctttctcacttctatgtaaatgtctcactttttttttctgatcataacctcgtgctaagtccacagagctaaaaatgttgacgttcacagccaaattttcataagtcccgctatttattggtgtaaatcttgaataggtaaatggcatgttgaggttctgtttgcctgctgtctctgtaagtcactcagctttctttaaagcctacccactcatttctgagtctatgaaaagaagtctgacttttttcagacttctgtgcttatttcatatgtgccaaagtagcaaaatcatttaaaattcatcagctatttaatctgtttattttaacatttatattatccactagctgtagtttaattttggctttatttgctacttcataagcataacagtaagtataatattttattatttaagtatctttttcttttcattttatgtgtgctctttttacttttgtttaatgcatttttgagcacttactatatttaagacctacattagtttttcataaaataagacccttgacttgttacagagccaggaatttgaaaccctctgttcatccctgcatattggttccatctaccaccaaacaaaatcgttccctcttctcttcccttaaccctttgtatattcttgtgttttagcattatactgtattgtcttcccagttacactacaagcttcttgatggcagaaatcaaattctgtagcacctgtacatgtagtaggcacattctatgaaagtttgagtgctgaaggaagaatggatggatatagtaacgaacaaatgctagtaatcttgtgattaaagttagttaagtctctgacaaggtaatagtaaagtcaattcctaatgtgctcttgaactctgatagtcttataaaacttttttgaagatcagtttacaaagctgccagggtatataagaagacatagtgcaaagcagatgctaagtgggagagaagtttctaccataatctgtgtagatcactaa

SEQ ID NO: 61821 - DNA, 684 bp, Bovine  19866880756719
tcctttcacatttataatcttagttccgtacataagaataaagtatccctagttttactttacacatggaaatattgaggcacagagaggttaagtagcttgtctaaggacacaaaaatggtatgcagtagaaatagcaataattgaggtgttctaatttaatacgatttttttatttctttacattctggtgctgcattttagatatatatgcagaatatttaaatatcaaaattactctgtttctccaaagccaagtatgttttgttgccaaatctgctggccagttttgctggagttattatataacaattaaaatattttgtttgttaataacctgactgtagcttaagtgctttattaggttacactttcataatagtaaagaataacttaatggtctgaaagattacagtatcacttcagatttgaaaccaagggaatataataagtagactttgagagtttctggtttctttttaaaacagttgaggggaaaaaaaaaatctttgctgtgtcttgaaatggaagtactttagccaaaatagacaatattttaatgattggtacgctagaacttctcatagagaagaatggtttttgtgtctgtgtaaatgcattttataatgcattctgtatagggcatgccagattcttgagatgagaaactttgatctcaagctc

SEQ ID NO: 61822 - DNA, 1148 bp, Bovine  19866880774909
gtgggttgtggagacagtggagaactcactggctggaagtgaaagtgtgagtcgcttagtcgtgtctgactctgcaaccctatggactgtggtcaaccaggctcctttctccatgggattctccaggcaaggatactggagtgggtagccattcccttctccaggggatcttccccaacccagggatcaaactcaggtctcctgcattacaggcagactctatactatctgagcctccagggaagcccctctcctactggctaggaagtcaccaagggaagagtttccagccaggcaatcaccatccctggggacatacaaggagtgtggacctacctgcggcctgtattccacccgtctgtggagagatagtggtgggcagctggctaagtttctggaggaactgtccctgtcacctgagtggtagaggtatggggaccctggggagtacactcctgtggcagtggggagatggggtgctaggctcagggtctgtggacccatgagcaaggtcaaggctgcccagagccagtgtggaagtggaccctttgctcagactctggggcattctgcagaaattgagcaagacccacagcttcagaactgatttctccacgcggtaagaaatgaatcttctactctggggtctgcttgctcccactgtgacagtgaaagggacgaaaagaaaaacattctttcctcccaccccaacctctgtggctcaagaactgtcttcttgcttagcttcctcctggccaaggttcgtgagattttgccctggggtccatgtgactggctatttccttgttattactctggggttttttttcacccaataagaattccttgctatatcacggcctgatacacttactacaggatataactgaggaaactttctttaccagctgagctaccagggaagcccaagaatactggagagggtagcctatcccttctccaggggatcttcccgacccaggaatcaaaccagggtctcctgcattgcaggcagattctttaccatatggacatataaatacatccataaatgtatagttactttgcaaagagtcagacatgactgaacgactaacactgggggaaaggtatgtttatttaaagacttcattaaaaaaaaaatttta

SEQ ID NO: 61823 - DNA, 1960 bp, Bovine  19866880868751
agcgatttacctagtcagattccaaaacatccaaacatttttagatttcttcatatttaaaaaaaaaaatttcagctttatcgacataagtaatacaaaaaaaagatatttaaagtgcacattgtgatgacttgttttgtatatacatatagtgaaaggattttctcattctagttaattaacacattcatcatctcacagactttctgattttaattattttcaatagtgctgcaaagaatggcagtttaaaaaatattttggcatttttccaaaggccattttcccagaagtgaaattatgatggcatagacatacatatttctcaacttttaatagtagttccacattttttcccagaacaattgttttagtttacacttcattcagaaatctatgagaatccatttaatcacattctttttcctaatcttaatagacaagaaatggggtcttattattttaatttgcatttctttgattttcagtgtgtctgaacattactctggttgtggcttataaacaggttggaaggagtaagactgggagcagaaagttgagttaggctcttgcagtagtcatgatggcaggtgaagatgacttgggaccaaggtaagggttaatggtagtgaggtttggatatttagcaaagagaactggaaaaactagatgtggattatgaaagagagtaaggaaacccaatgatatctagatttctggcttgggaggtgctatttcttgaggtagaaaataagatgagaagaattttagctggaatggagtagggagatataagtttgggtgtggatattttgagtttgaggtgcctgtgggacacagtgatggagtggtcagaatccgttggatatctggaaggagaggtatgggttagaactagagacatggcctcaagctgaactgtgctttaggaaattaactggaagccatagaagtgtttcctttatttactgaggccttggggcctcatctcgatgagatgaaaattatctttttgtcactggcctatttggaacctcctctgtccatgggattttccaggaaagaatactggagtagttgccatttccttatctaggggatcttcccaacccagggatcaaacccctgcctcctgtgtctcctgcactgcaggtgaattctttacctactaagtcatcagggaagccctagaacctcatttatacttcttcaaatgtccttatctaattttgatttgctactgagcagggcagcttcagccctccccaggagcagtttccagcaattcttagcatgtttggcttaagacagagttgctaccctcctgaatctttacccttgctggggaccctgcacttgatacagctaaaggacaaagcaggcctgaggtttaggttctaaccgtgtgagtagcagtgataaccactagggttctcggccttccccaatcaatagaaattgactagaggccagacaatggcaccccactccagtactcttgcctggaaaatcccatggacggaggagcctggtgggctgcagtccatggggtcgctaagagttggacacgactgagcccttctctttcacttttcactttcatgcactggagaaggaaatggcaacccactccagtgttctcgcctggagaatcccagggatgggggagcctggtgggctccagtccatggggtctcgaagagtcggacacgactgagtgacttcactttcacttttcactttcatgcactggagaaggaaaaggcaacccactccagtgttctcgcatggagaattccagggatgggggagcctggtgggctgccgtctatggggtcgtacagagtcagacacgactgaagcgacttagcagcagcagcagcagagggcagacaagaaattcaggcaaggctttattgggtctcctacagcagcagggggaagcaggaacaaacaacag

SEQ ID NO: 61824 - DNA, 1545 bp, Bovine  19866880948983
actaccctattatttagagactgagaaatatttggatggtggtaatgtgctgctctggaaaaagcagtcgccactgggacttttatcacataattagagggtatgctaaatgtgctcgtgaacagaagctgctgtgcactgctgccttctgttaatgtggaccaggggtcctgaatgttttccctgagtatgtcctccaacagcatctttgcccccttctctcatgtgatgctgcctctggccagcagaaattctgggaagtcctagacataactccagtgccacatggccttgcatgcgtactcagtcatgtccgactctttgtgaccccatggactgtagcccaccaggctcctctattcatgggattatcccagcaagaatcctggagtacatttgccatttcctcctccaggggatcttccccacccagggatggaacccgcatctcctgcaactcctacattggcaggtggattcttttaccatggagccacctgggaaatccaccatatggccttagggactgtaataaaatgaccatctaccaactgggcacctgtgcttttcaagcttgattctggccagccaccttgcatgtaaatcttctgaaaggaggagcaagctggaaagctggacagtggtaggaattgggaagatccctagttaggatgaggaagaagcagagctgttcagctgcttcttggttgactcatttgttcatttatctgtccattccatcgctcagattcctcatattaagagtggtaatactgtgtactctacagggctgtggtaaggattgaatgagttcttgcagataaagtgttaagcaaactatctgacatggagcaaatgctcattaaatggtagttcttgtttttactgtcattttctaatgacttcattcactaatgccatatcctgttcaaagccttggtgaacagaggaaggagatccagccttggcctctgcagctggcagggattcaggagatcagaggtgctctttcgcctccagcaggtgtgcctttctcattgtgagcccagtgatgctactgctgtcccttaacacagcctgctcgcttgccggggcacccccagcttgcctatccaaatctcatctttcttccaggaccaagctgggacccatcttcttcctgattaatgctggcttacaggcgtcacatcttttgagaatccggcagcatttatatacccaatttaactttggatcacatccctccttgtatttttatggttgctttatgcagccttgagagaagatacatgtcttactcaaccttgattcttgaatggttataacagtgcctgacacatgcatatgctcaataaatattgaattggatgaattctaattcaacttaaccaacatttattgagcatgtacttctgggtttctcagcctcatcactggtatcattttggaccagatgattcattgttgtggggccattccgtgcactgtagaatgtttaggagcttcctgggcctttatccactgtatgccaatagcacccgccag

SEQ ID NO: 61825 - DNA, 689 bp, Bovine  19866880992419
ggtggagctgatgttaaagtgagggctctgaggtggagacaacatgacttttaattgtatttcttcagaaacaacttttgagtggagtgtgccctgaagtgcagacactcagagatgtgtcatgtaaatctttggggcccaccagttgtggggccccagcttgaccttcctgggccggtgactggcccctatgctgaacccacggctgtttgctcgtctcactgtgagctgtctcgccttactgagcagcacgcaaaagccgttctgtttcccctgccgctgtctgtctatctcctcatgactctgaatcagctgtcatgggagttgactgtgactgagaaccaaaattaatccactttctctggaaattagttctttcaggcccatgtctgtcacattgctgtgctttctgaggccagtatctttccgtgaagtccttgctttccatgagcgcatttttgcagggctccatggagtgcctgttccactctgtaattgactgggtatatttatgccacttgtaattacctcgaggttgtcgtctgctgaggctgtggcggcggctcctctgggggccctccctgggcattcatacccaagcctccctgcctgtgggatgggaggtcagtgttatctggatggtagggcggggggcgatgtacccagatggttccctgacacaacttcct

SEQ ID NO: 61826 - DNA, 1116 bp, Bovine  19866881005511
taacctagcaaactccagagaatggtcatatcctagagctgaaaaaggctgccttgccaacatgctggttatttgctctgcttcatccctggctaccttcacgtctctaaaaccccagtgtgctttccaaaggtcatgaaatgtgagcacttgcttcctggtgacctgtgcgggccattggaaggggtttttcttaaaccttctccctcttggattagacctggtttataaactgtacatcccagcatgtgtgattcctgcattacaaggtgcgggcagaactagtgttcttgcttagaaggctagaaggtcccgtcagcatgtgggctaggcctggtgggcaggcaccagcgtggccatggaagagcagatggttccagtgatgggagctcctgccacgtgtgggctggccctcctggccacctgcaagtaatgctcccccaacaaggttcttatacagaatcttctgaaagtagacttttccctagtgaaggaagaggagcctacaaagtcaagagacatctgaactcacctagcagttgtgagagaattgtgagagaagtgggagtcttccagccccttctaactgctagagtggtgagtgggaagggacagtctcttacatgtatataatcattctgtgaagcagatagggtggcttcattatgtattcaaatgcagagagctcttcataaaacatgctactgtgtccttttactgtgagtggaaatacagccttcacattaaagaggagtaaaggataaatcaaaatgttattcagccctgaatgtgccaatccataactcttactcaacaatttccttgcagcagaaaccatcactccagctcggaccaaagatgatttggcccagttcttctctgttgctatggggacagagagatgatgatgttagcccttttgacgctaacttacctacattaagagtcaattcccttcatgtcttcatgtttctgttattgataaagtagcccagccttttctgaactactgtttggtttctgtcttatttcccctttggtgcaatgaattccatattcagaataaaacatttcttggagcacttggtatatgccaagcactgggggaggggctct

SEQ ID NO: 61827 - DNA, 1460 bp, Bovine  19866881056750
tgtatccaaattaaacagagggtgaattttctaaaggaaaacggacaccatatcatgggtcacaaaactgtccacaaacatttactcagtgccttaaattgtaaggaattacataagaaaatgaggtttctccctttatgcagctgacaggagtgtttcaaaagcaacaaaatcacatttaaaatattggtaaaacatcaaacaagtgcatttcctcagaaaagcctttcttcttactaccaaaactcaagttgcatcctcaaatcacatcagttattttccttcatagcacttaccacaacatataattaaacactggcttatttacttgtttatgaatatatgcctcccctaccagaccatcaactccataaactcaaagaatatgtctgtttcattcaccactacatatctggaattagcaacatctctttccagcagacaatgaaaaatacagaacatggttaagaaggctgtccttcatacttgctagttatgtcatcaggtaattctttgccctatgaaagttccatcattcttgactccaacttgagaaagtgtcatcctagaatacttccagaaatggtagcaacaaagaatttctaatatcctcaaacacaaaaataatcctactctgaaacatagctgaagtcacttcttttcaaccctcaagtttatattctgaattcataaccatcaacaatgactcctttaaaggtgaccagatgaaatttatcccctgggaaatttaggggcttacagaagtttaagctgtacatggtcacgttcctaccttttcccaagttcagctcctcctgggctttcgatagtttgctagaatgatttcaggaaatctgactataattgttcagattccataataattgttcataattccaaaacaattccatagttgttcaaagactaatggtattagtttttctttaccctggatttacctagtctttgcctgaaaatgctgcccacatatgtgagaggtttttttcatcagatcataaaaagagttacatttcattgatcttcaacagcccctaacagatcattaaatggatatgacaaaattactcattttgcttcaaactggatttctagactaccaaactgatatctgattatgtaatttcaattagcctgaaaaactgagaacaagtgcacttcaatatgagtggcaacaaagggacccacgagaacactgggttggggttaaaattaaaattcatcctgaaagctgaatgaactagacacaggagctgatctgttgccctaagacacagttttgagttttagcctgggacgtgggcccaactctagggatgaccaatgttattgcttcaaataataaaattgctggcaccaagtactagaaaactgtttcatggtgtcacaatctgcagtttgagacccataagaaccgaaccaatgttcaaaggcacttcctt

SEQ ID NO: 61828 - DNA, 2599 bp, Bovine  19866881132587
tggctgcccactccaatattcttgcctggagaattccatggggtcacaaggagttggacatgactgagcgactaacattttcacttcactttgctgcaactaaagatcacttgtgccacaacgaagacccagtgcagccaaataaataaataaaaatatttttttaaaaatagatccaccctggattattctactcacttcccagtgataggcattggtgggaagtgagattgacatcgggttctgtatccctggaagtcacgtccttccctgggtgaatagacagaagagtatgattcatcaaccaccttctgtgtcactgtcttaccgtgtcacagtcaagaggagaaatgtttatgtgtttcctctttctatctcctttcctggaaacttaaacctcaaaaattagaaaacccttccttcccacctatcccaaagatcttctctataacatatccactcacttggctttccttccttctctctgtccccagccatgccccagttctaataatccttacctgtgttagaaaagtcactgcatcaacccctcggaagcttctcagacctgacctctcgcctctacttcttgtgcttttcagccgtgtgatcataccctgagcagtggggaacctgaattctcctgtaaatacttaatgaattttccaacctgatagtatgtctccttggacagtgttcggtcctcatctgtgactgtttagtactagggtacctccttcctttggacctctggcaggaaggagatagatgatcaaaccctgtcagggtttaagacggtctcttccccccttccttgctgatgcccaaagtttcactctaagaatttcctcgtagtttctcttaatatgccagcctttgttaaaaatgcagatgccccgtagggaaatgcgattgatcctttaaattaagctggtcacttcagatcctgctttgagaacacgttttgatagaagagagatagaattatatgggtctgaaaaccagggaggtaattgataaggtgttcaggagtggggggaggagaggacgagacaccaggaacagagactataaactgcccgctttaggagggcccagctaggcagtgttcccagcttctcccaacatgcctgatgcctcatccggggccaacgtgagcctccgcacatcatccacaatctgtaccaggccaccacctttatgataagaatgtaatgcacccctcagctcttccctaaatctacccaagttgactctattttctcttcctatcactcagaatacagatctcagcctcttcccccagattccacgaaaaaacttgattacactcaaaattcatgaggtgtacaatcttccctgaaaatctctagaatcacccgtagggttcatatcatatagcgctcaagttttggcttgaagaatctcccacccagcatttcttcattccaggctttcttctgcactttcctaaattggatcttcttctccatccaggactttttcctgaagaatttctaattctttactatgcacacctttactatgcagagaaaattagcaatgatcatttattacctgagcaattctgtgaagcctatcacgacatcacttctggacaagatataccattatctgctaagaattctgagaaataagacgctttcagtgatgacagtgggatgctgctgctgttggtatcaatggagacacagcttatttcagtgggtgctgcagccctgagcatgtagcaggcacaacaccatgtgcctcacagatattactttatttatttattaaaaatatttatttatttggctgtgccaagtcttagctgcagcatgtgggatctagttccctgaccagggatcgaaccaggccccttgcgttgggagctcggagtcttagccgtggaccatcaggaaagaccatattactttaattcctgcaaggggactttaaggaggaattatcatctcccattttacatatgtttcctgtggtgctagaactggaatttgaatagaaatctgtctcaactctaaaatctgtttttccatgctcacagcagactgtcatcattagtcttttcaagtctcctctctagttttattttttatctttattcacactggggcttccctggtagctcagatggtaaagaatctacctgcagtgcaggagacctgggtttagtccctcaaggggagcggctacacactccagttgttgctgttcattgtctaagtcatgtccaactgtttgtgaccccaagaactgcagcacaccagacttccctgtccttcactatctcctggagtttgttcaaactcatgcccattgagtcagtgatgctatctaaccatctcatcctctgccgcccccttctcctcttgccctcaatctcttccagcctcaggatcttttccaacgagtcagctctttgaattaggtggccaaagtattggggcttcagcttcagcatcagtcctaccaatgaatattcagggttgatttcctttaggattgacttgtttgatctccttgctgtcaagggactctcaagaatcctccagcacacaattcagaagcgttagtt

SEQ ID NO: 61829 - DNA, 1213 bp, Bovine  19866881146657
gcgctggaggcactgtcagaataaataccgcaggttacctattcacagacattgtatgtcttgtatgctttccatgcagtgtatcactacgactgcagcaactggaacagcaggggatttcagatgcagagggtggggagtgggtgcagcgggaagaatacttaagtcctctccttccctttcaacagcgggaaggagtaatctgtcaaatggaccaccacatcatgtgaatcgtaagggggccttggccaagactgcttggttcctgtgcatcagtaatatttctaatttaattaagatattcccaactatgcatttaagggttagaaattaggaacataaaaatacagtgaaggctataataatttattccctgatttgtaattccgggtggttttttccaacttgtagtcaatgaaacttggcataaaactgatggaagaattataaatagataacatctttcaagtccagctgaacagtcacagcaatatagtcagaggatgtgtgaacttggaagaaggctggagagtcaacgtggcatctcagtttgcattctgaaccacgaatccagagctgggtgtggggatcaggaagaagctggcgaaggcccagtcctccactgcctttttatgaagatgatacacggccagccagtgatttttaaattaaacacttggcttctctaggacaaagaactgaatttaaaagtagaattctttctattccattatctttttatttattttctactactacaccatgtatgccaagtattataaatccagaggaagaaaatccaaagcttgacatatgatcctcagattccattatgtttgggaaaactgaactatggagtttgtcacttatgaggcaggaaaagatttacagagatcacctaatctggggtgtcttaaaacagggtctaatgcaaagacctcagagtccataagttccctgaaattacatgcaaagttctatttgtgtgagcatttttctggagaggggttaggattcttaatgaggtctatcgcctcttaaaggttaaaaacttattaaagctaataagctatcaacttcaagtgccttgagcagatcatatttttaaagctaatggaagacataattcttccacttttattggctgattgtttcaatttctaaaatagtctccactgatggtgaatttcccactacaagtcttattataagt

SEQ ID NO: 61830 - DNA, 2730 bp, Bovine  19866881290619
cagcagctactgccctgtagacttgacactcccttcatgaactctgggcatttgtagcaacagagtttctagagtgaggatgaagtaggctggagtttatattcaattctaggaatctcagtcaagaaggctgcatttgatctgaaacatacccataggaagtgtccagggtagggagggcgctcaagtcatgtcataaggaaaataatggaagggatgggagaggctcatcttgaagaggaagtgactcatggggccagcagaggcatcctcaaaacactgaaggctggcacaggataaggaattacactaatgtcaagtacattagtgtagaaagccatggcaacccactccagtattcctgcctggagaatccccatggacagaggagcctggcgggccacagtccatggggtggcaaagagtcagacacgactgaagagacttagcatgcatgcatgtacaataagagattgacctaggaccagttacctgttgtacaacatgcctgttggaaggaattcaactaaaagaggaggaactggctaacatccatagcccttttaatgataaggcctccctgtggaagattttcaagcagaagaaatgcagatttcttcagattggaatttggaccagagtcctcaaatttttgctgccactgggctccaaagctactttcagagaataagaaagattgaccaggagtatgagggtaggacgagagtcagacttcactctgtctgtgtctcctgccccctaatccaggtccctccaggtctgctgcacccactaccttgactccagctcctcagaaaccagatgctccagaaactacttctacaaagccccctgggccactgcctccactttccaccccttcttctaaggatccagactccttttcccctctgcaaggcccagaccctcatctgtatcaccagatgggtgttctcctcaagcagatacaggatatgagagttctccttggtcacctggtcatagagctgagggacttgtctagccacctgaagcttgagaccacaaagggtcctaccaaacatgaataaataattcacttgccatattgcttgactacccccaataaatccagtttttttttctagttttcatctttctgttctatacttatgcataaatggttttacaggttgccccagtgttttgttagagcagcagagataggtgagtataaataaatttgtaccaagttatacctagagtttaactataattgtgtattctgtcttaacatgaagacatatcctgcttgatctagagagttgccttctgtggcccagaccagaatctggtgaatgaaagagaagcaatgagatagatttaatgcagcagtctcaaccaagggcaatctctctccatcctaggggacatttggcaatgtctggagacatttttggttgtcacatggtgaggagggtgtgctgctggtgtctagggatgttattaaacatccagtaatacacagaacagccttccacaacaaaggattatctcgtccaaaatggcgatagtgctgaggttggggaatctcagcttcacgtaggtgttggactctgagatgaacttttgcctcttttacttaattctctcccgctagccttaattcagcaaatattaattacatgctggtgttttctggcctctgctacatgcccaaattgatgctatgttaaatatacctataaaacagtgtttctgtctatagagggtttacgatttgagatggagggatggtaatacgcctacccattaagcaattaaagcagggcatatacaaattccccagaggatcctactgaattatcatgcttgatcacagaaatatgtgataaagcctaacactgctgggcttcccaggtggtaaagaacttgcctgccaatgcaggagacttgggttcgatccctgggtcacgaagatcccctggagaaggaaatggtaacccactccagtattcttgcctgggaaatcccatggacagaggagcctgaagcattacagtccacaggctcacaaagagtcaaacatgaccgagtgactaaacaacaacaatagcactgccagaacagcaattatttaattcatctctgaaatatttttctttaaaaatatacataaattgattttggtaccataataatacttttttctatgcttggactgctactgtgcattctcagccaatgagagctagcttgacatactctacagtaacctttggtcagtgagttagcccttcattttatgacctcagccaggggggactctaccatattatcttaaatcacgttgtgtgaagttattcagtgagcggttttttctgctatttattctgtgtgcagtttggacccacagtgatttacaacgatgtgtatttgattgttccagaaatgccacaaagaaacagaggaatagaatcacgttgaatgttaaaattcaagttttctggtggtttctgtgttctgcttagtcactgactgacttagtcgtgtctgactctttgtgaccccatggactatagcccgccaggctcctctgtccatggagattctccaggcaagaatactggagtgggttgccatgccctcctccgggggtggttcctgctaagtcgcttcagtcgtgtccgactctgtgcgaccccatagacggcagcccaccaggcttccctgtccctgggattctccagg

SEQ ID NO: 61831 - DNA, 1395 bp, Bovine  19866881332282
cactcggtgacacccagtcatgaagcgcgactgcaggcacttaccagtggtctcatactgaattagctcctcagtcctgtctctgtgcttgtaggacggggatgaaaacacccttcttcattatgttgctgtgatagatgacagagtagggccggtattccattactcctggcatgtggtaggtgcttagtaattttaactgttagtagcagttgtctctgaggatgggggaagtcagacttaaactgcagaattatttgtttaggtgttggataggctcccatttttattttcctttcaccccataagcccccagaatctggtccttctgtctgtctgtctctctcttttttttttcttttttaaaaaaatctgtgatccatttccagttctcttacccaggtgccagggatcagagctgtgactcttcacctgctctctcttctcccaccacagatcctttcctttttaaagagtcactattgctggcatcttcaaggaaacagatggggcacaacaattgttcttttaaataaataccaaagataaaaaatttaaataactgttaaagataatgttagatggtaaccttcagagtggtttgttgcccctggtaggaagggctgagttacagggaggatagcccctgaaaatgttcagctctctaggaaatttcttctcagaagataactaagtgttaagttttaagcaccattctgtgattcatttgacttactctgatcatgctgctgcttgaggtaaagattgatggcttagaaaaatgttgcctgtaactttacctttcagcaggcagcttttatctgcttgtgtccctgagaaagagtaaatattgacatgttaagtgaaatagcttcagtttttacacgtggatgtgagggatgagatgcttacgaaatcggaactacctccctctcttctgttcatctagaatttacacggatctgagttgctgttacagaaggcaaacatctgaatgggaataggggttagacagacaacataccaagaactctgatgcccagagtgaatacattcactatttaaatgtagataatattagatcttgttcttctgctttcagaacctatacttctaagtcgtctgaccaaactgatgggagcgcagctgcgaaaaattagttttctcatttataaagtggataagttgtggtctggacatcggaggcatttgggtggtatctagcattcctggagccgctggtgatttgattcctgagttctgttggacagaaactcaccaggtctccctgtgttgtcctgcatgttgattatcattttggctctgaattctcacactttggcaatctcatcaagcaaacctgttgttttcctgtggcctcccatcactttatat

SEQ ID NO: 61832 - DNA, 1307 bp, Bovine  19866881343616
tacagttcttctgtgtattcttgccacctcttcttaatatcttctgcttctgttaggcccataccatttctgtcctttatcgagcccatctttgcatgaaatgttcccttggtatctccaattttcttgaagagatctctagtctttcccattcttttgttttcctctatttctttgcattgatcgctgaggaaggctttcttatctgaaggcattgtgaggtgttaaaaaattagtataattatttttcagtaggtagtacattcacatggttcagaattaaaagtgaataaggaaatcaaggaatacttcttttgtgtagcagtagtatttcagaggcataggatttacttgagtagaagaagcagacaagaagtggacccaaactttaccatttataggggtgggtttttttgtttttgtaattgttgctatttgatattttaaaggtttctttttcagtcatacaggggtcagtcgaagtgtgactgtaataactgcttttatgatgaagactgaccagcttacctttgaagaagcctatgaaaaccttaagactgtcaagccagaggccaagtgagttacttgatacagtaataattctgcttttgtgatgcagttttatttatttaaagaaaatttaactcccatatctgtttgcccttgcaggatgaatgaggggtttgagtggcaactgaaattataccaggcaatgggctgtgaagtggatacctccagtgcagtttataaacaatatcgtttacaaaaggttacagagaagtatccaggtaagtaataattggcagtatgtattcagtcctttttgggcgtccctggtggctcagcctgggtaaaggatctgcccacaatgccggagacctgggttccatccctgggttgggaagatcccctggaggaggtcatcacaacctactccagtattctcgctttcggaaatcccatggactaaggagcctggcgggctatatagtccatggggttgcaaagagtcagacacaactgagcaacgaagcacagcacattcagtcctttgtagatgtggtttactctgagaccagatgcttcaggtgcattatttcacttttgaagcaggtacttttatttcattttgaaaccatggtttagcaagaaatagcttgttcagggtcacatggtttgtaaatggctggctcgaacttgaagtcaggcagtctgtgcctggaagccaagggctgcatcactgtgctgtcccacctcgtcctcgttcctcaacacgggagattttttttaatttctgagattagcat

SEQ ID NO: 61833 - DNA, 1182 bp, Bovine  19866881412170
gatctagctccctcgctagggactgggcacaggccatggctgtgaaagtgccgattcctaaccaccagaccggggagcgcccacgcacagctttttatgtggacatacattttcatatcatttggataaataccaaggagcatgattactggatcacacagtaagagtatgtccagttgtgtaagaaactttcaacctgtcttccaaagtggttatgccattttgcattcctgccagtagtgaatggatattcttgttgctttaagtccttgctgacacttggttgttgccagcatttcagatttaggtattctaatagatgtgtagtggtgtcgcattattttagtttgtagttccctgataacatgtgatgtggagcatcttttcctaaattgtgtttgccatttgtatatctttcctcttctctttccttcctacctcccttactctctcctcctctttcttacatttgtgcaaaagccacttgtttttttattttgaccacatataagatatatgtaccaagatcagaagctttgttctgcccctgtggtttctttgataacttcagcatcttctgtgaaagttctctttgccttcctgtgttgaccagtacctgacacccctgatcacactttttccctgaagccctactgaatggttgctgttttcattctcaaaacctttataccattagggtctctgaaggtgggttagcgtctttcttgttcttcattgctgctttttgatcattcatcttccctaaaaaaatccacatccaggcttaagtttcacattgtctcacatgctctcctccacctgtccctcttatagtcatcttctaatttctggttcactctccctcactttttgaaaaaatttagttcttaacttattgtcacttacttcaacactccttccatcaagatttttggctgatttcagtattctcagagaaagaaagaaagaaaaaaaaagtgaagttgttcagtcatgtctgactctttgcgaccccatggatggtaacctaccaggctcctctgtccatgggattgtccaggaaagagtgctggagtgggttgccattctcttctccaggggatcgaatcccgtctgagccaccagggaagccttctcagagaagatccttcaaacaccttgacctctcatttcctgggtctc

SEQ ID NO: 61834 - DNA, 1735 bp, Bovine  19866881490331
ggccccgtgaagagttgcctctttagaacagaagacgctcctatcattcttatcactcaggaaattccaagagtttttaggagctctagactaggaaccagagacaaaaaccaaacgtctttctatgacgccacagctatgctggtaaatgtttaacaaccaattttcctggggaaaacaatacagatttgtaatgtatgctgatttctttaatgtaaatatcccaccatggctcgtgtccagcttccagcgtgacgtcactaaaggtggagatgggaggaggtatgcacagttggccccacaaactagtgtgagccagctccacacaccactgcctttactctgatttagctctaatactaaaaaaataactgtcttggcctcgctactgaatgcataggtgttggcagaagaacactctgatggttagaaattaaacgtctgttcaacctacgtgagctcctgtatctcgccggtagttgtttcttctctcacagttttatttgcagaatcttcatggagttttattctatgtatgtagacttagtgttcagccaagaattcaagaggaacccttatgcaaatttctgaatctctttccctatatcactgccttctttctggtgctctgccttgagtgttcaagctgtcttgctttcctgaactctagctcttcaactcagggctgctgtgatctcaggtttccccttctgcattgccttctagaaagcgcctccagccaggaaactgtgttaattgcaggtctcgccttgtctcctttctctcagggatcacaggtgctgctctgcctgttgtgcaatgtctgaagcagttgtctcacacattttgttcaattttctagctgtttacagagggagtacaagtctgttatcagttactccagaagccagaagagggagtcatcctgctttcactgcagtaaagcagattcctttcttatagggagatcccacatttctgatttcatattttcctttttcaaaaatggggctcatcttatttctgtttccacagaaactatcagcttgctactgttttaccctaccttgctttagattgtccgtgcagcctggaataagccttctgaagatagcattttcaggcgcactcatctggcttacagattccgagggacagaccttgactgctatcctcaggtgggggccatggggtccaaggatatccacaacagcattggaggagttctttagctcaggagattgtgaagatggcatgaggactaattgaaagtaactgaactcacatccacaaaagagaatcaagtacagtttgttaccttagttcaggataaaataatcagtttaggataaaataatcatttcaggataaaataagacatttgacatctttttaaatattaacttcaattttttttctatgaaaaaagtagggaaaaagtctttagccaagtacacctaagaggcttgtgtctatcctggaaaaatctgggtttctcttttctcgccttgtgcaggaccagctgatcctcctctgagtgtcccaggctgttcttacaccatctgtatctgtgctggaacggaggcttctttttatcagtgcctttcttgccagatgcacaactattttcagcctctgcctaaaattgtcagggtcttgaaaactaaaacgtaatgagatttttctttcttctaatatgatcttccaaacgcccccactggctacgtgtcattgg

SEQ ID NO: 61835 - DNA, 532 bp, Bovine  19866881574234
ccttcctcttctttaattccttcttttgaaccttttcatcgcaatacttcagactgtcacccccaactcaatcataaaatactagtattttacaggattctttcatgtttcctgattgaaatgtttttggcaacgccccagataagtctgtagacttctttttggtcagagtttatatttagcttctctcttaacttactgtagagttttcaccactgcataatgatgacttgctactcttaggaattctgtttcttaatgattatttagttttttcccatctttgcaaaccttcagagtttctgttatagggactttctgtaatttgtaaatcacagaaagtttcccaagatctgtcacagcctaaaaccagttacagtatttgccagctaactcttgctttctttaaaagtgatacaaaataccttatgttgtgtgttaaacagtaattgaacatcacgggcctgaagttcaatgaaagttaaaatcaagtaattagtctgaaagtggattctctaaaatcatgactggg

SEQ ID NO: 61836 - DNA, 2005 bp, Bovine  19866881720285
tcactagctataagactttgagcattcattttctctcagcttcagtttccttatctgtgcatctaagagcttagcagagcccctcacacataatgtttaataagtgacaattgttcctaattgtaataggaatatattttccaaagccaaatatattttcccaagccaaatacagtaggcttatactatataagattatattaggcttatactacttacactacaagtacactctacttgtaagagacagtctactttttccaacaactcagaaaatctacccaaggattgaaataaatctctgctgctgctgctaagtcacgtcagtcgtgtccgactctgtgcgaccccatagacggcagcccaccaggctcccccgaccctgggattctccaggcaagaacactggagtgggttgccatttccttctccaatgcgggaaagtgaaaagtgaaagtgaagtcgctcagtcgtgtccgaattttagcgaccccatggactgcagcctaccaggctcctccgtccatgggatttttccaggcaagagtactggagtggggcgccattgccttctccggaaataaatctctaaaagtatataatttaagagaagttctgcccttggaaaatcaaatgagaacttcagttcaacaaagagaactgagattacactcttggtactgacaatgacggtccaatgaaaaaatgaaggtcagtctgtgtttcccccaaattttaaaggtaatgaatggtgtaaattttaggtttgctaaaggactcattcagggaagtatacaaccccaaattcacactgaagctcaagaacagtataagtactcctctgttaaggtaagaatattactatccttataaggtaaggacaagttttctttaaacactggatgataaagcttctctactcttatttcgaccacattccattcctactcttcctgccacaaagccaaacaaaatatccgtaacaagcaaattcataattgtatccggagaacaatcaggattatacccatttataagcgttaggtgtagatggacagcaacctgaggtcaggtgctagggtgctttgcttctctgccaatatggacatcagcctcgatcaatagtggaagctcagaaaaggtttgtcttctttcagacgaaccaaacgtgtacatacacgcacaaacactatacggcaagcatcgcccacatcgcacactgagaaaaaccttcagccgttttggtggtcacggccatcctgccctaagcttcctaatgacgtcgtattcgccgcaccaaatcatcacctggtactttcccagaggaaacagccaacacgatagtaattctaatcaggcagcattttacactcatgtcgccaggacagacaccgacaggttctgctatactctactaggaccacggacggacacgacgagtgaccctcgcttccccgacaggattcgtccacacctgtcaccgagagggcgcggaagcagggaggaagaaacctggagccacccctggcacagtctcagatcccactcaccccagtcttcatccggccggtgagggagtcccggactaaaaggtgactccatggtgccggcaacgccagccggttcccccgaaacacacgttcccctgcccagtaactcggtgactagtcctgggacggcggcggcgagcggacaaaatactccgtaacgctaacgcgacggtggccgaatggagacaaactgcttccgccgcacgagggccgccagagcctgagctagttttaaacaaatcgctgagctagtatttttcccttttggagttttcgacattttctgttctgctgttttaaggaaaaaagaaagacgcaaatactacgtcggttaaataaaatatattataatattttgagaaatgggggaaaacccattctgaacatcgtcccctttgattccacagtggagatatatcaaaacaaaatttagagactaaaaaagtaactctggt

SEQ ID NO: 61837 - DNA, 820 bp, Bovine  19866881067260
cctttagcacctttaggaatgccacttttcggtagagaggctcaatacttatatgaatcagcttgcaaatagcaagggctattagtttatgtgaagctgcatagtatggaggcgtctgatccataatgctctgcgcatgctgccaatcaccaatctttaacaaggcttccaacaaaccgagtttttggttgtcaggtggcttctccactttctcctcttctttttccttttctttctctcgctcgtcaattttatcagaagacaatacaaccattgtaagttttctaacgatctgcttagcttctacaatttctcgcttgtgttcatccataatgcaattatcagctggaagaagatgtacataaagatcatctaaatcaataaggttaaattgtagaagtactgctgcaactctgtataaagatgaaggagtctctccatttggttcctgataaaacttgaatttgaacccaagaatatgacacagtgtttgcggctcacacatactcatgtaagattctaataaagatataaagaagtcatcttgttccggcctgcactcaaacacttctaaaatgacatccagaactctattgggatccagattaaagcatcctattaaagatttgatattttctaagattaaatcactagtaatatttccagataaatcttgccccaattcagcaatcagcttggcataaccttcattttcttctcttaacaaattaaatttttgctgcttgtaaaagagttttgtcttgattttaactgacttttgattgaattgctgtgattggttgataagccctaacgattc

SEQ ID NO: 61838 - DNA, 3070 bp, Bovine  19866880485757
ttcactgactacactaaagcctttgactgtgtggatcacaacaaactgtggaaaactcttaaagagatgggaataccagaccaccttacgtgcctcctgagaaacctgtatgcaggtcaaaaagcagctgttagaactggacatggaagaatgtactggttcacaattgggaaaagagtatgccaaggctgtatattgtcaccctgtatccagagtacatcatgggaaacaatgggctggatgactcataagctggaaacaagatggctgggagaaatatcaacaacctcagatatgtagctgataccatttcagtggtagaaagtgaagtggaactaaagaacctcttgttggtgatgaaagaggagagtgaaaaagctggcttagaactcaacactcaaaaaactaacatcatggcatctggtcccatcacttcacggcaaatagatgaggaaaaagtggaaacaatggcagattttatttccttgggttccaaaatcactgtggacagtcactgaagccacaaaattaaaagatgtttgtgctttggaaaatgctatgacaaacatagacagcatattaaaaagcagagacatcactttgtcaacaatgatccatgtagtcaaagctattgcttttccagtagtcatgtagagatgtgggagctagaccataaagaaggctgagagccaaagaattgatgctttcaaactttggtgctggagaagactcttgagagtcccttggacagcaaggagatcaaactagacaatactaaaggaaattaaccccgaatgtttattggaaggactgatgctgaaggctgaaactccaatacattggccacctgatgaaaagggctgactcatgggggagaccctgatgctgggaaagattgaaggcagatggagaaggggacaacagaggatgagatggatggatggcatcaccaactctatggtcatcaatctgagcaagatctggagatggtaaaggacagggaagcctggtgtactgcagtccagggggtcgcacagaggcaaacttgactaagcaattaaacaacaacaacacttctgtagggtgaggctcactcctagaacgtccctcctcccctgacacatggggcctgaggcccacgtggaattgtttcaggttttgaagggcagcagcctgaggtcctcggcactgggcacacacactcccctctccccaaaatggagagcatcgctgaacaggcccccctaacaacagtggggatataccacagtcttttctcccccaacggccccaacacctacaaggcactttcaaagtcagtttctgatttgctctttatgatcttgtgaggccagcctgtgtaacgagaacaccttttgcagaaggataagtttatacaaatgcctctggggttgggcctgggctgctcagcccagctggcctgaagcgtggcctctggactcgcagtccagtgctcactttacagcagcatccgcatgcacaacccttacccacctgccccccacctcgccctgcaggagacctagtttcttagaagcagatgaaatcaattggtccttggaaatgtgtcaaccgctgagaccaggagacaagtgccaggaggaaagaaatagttgagattcctgttaaagaacaatgttgggtttgacctgaataacaccagagaaaaaggagaaaataataatgtcagacattacataatctgtggagacgcagaaggaagctggagctggaagaagcacagcgggggagatttcaaaggggtcacctttccccacggaaaggatgagggggtggacagggtcactgacgtacactgagctgttgccatctactaggcggtgggcagtagattgttgccatgacaaccccgtggcctaaagattattgcctccagtctgtggatgggaatactgagagaacgagggtgatttcatcctcccaaagcagcactgagatgcccaagggctcttcctcaaatggggagcaggctgagggcttcagtatggtgtttaagagcaaggactttaatagccaaagcccattaattagtgagtggctaaacaaaatgcagcaaatccatacaatcgaatactacacaacaatcaaggggaaagcacaatctggatggacctcaacattatgctgggacttttctggcgtccagcagttaagactccatgcttccaaggcatggcaagtggatttgatccctggttgggaactaaggtcccacatgccacgtggtacagccaaaaatattatatatatatatatatatatatatatatatatatatataaaataaaattacactaagtcctacattctccaccaaatgatatgaaccctaaaagggagaaagttgggggcaaaaaattctaagctattacaataatttgtggttttccaaagctcaattcaacctgacaaaatcatattcctcagtatataatttctgtcttttgggagaattttaaatataatttttccccttggagaaggtgtggatgatgaaagaaaggttggaagcactgcgctaaatgaaagaagccagacgcaaaagaccatataatgtgtgactccacacgtaggaaatgggaagaaaaggcaaacctacagagaaagaagatgagcagttgcccaaggctgggcgtgggaacagggtgtgactgcaaatgagcaaaaaggacctttctggagtgatgagaatgttctaaatttgaactgtggtgacggttgcacaactctgtaaatttcctcaaagtcactgaattgtactgtaagatgagtgagttttctggtattgaaactatacttcaataaagctatttttaaaaaaataggaagaacacgggcttggggctctgagaggcctagctccggttctggttccctcactcccatggcccaggcagctccctctgggctttcagtgtgctcaactatgaaatggagctgcgaggagagccttgggaagctgggggatgcggtgagccaggcaccaaagagtgagacaggcctagacaacctctcaaccttcaagcct

SEQ ID NO: 61839 - DNA, 1578 bp, Bovine  19866880507454
tgtgcttgctcctagcgactctgatggcctttcgggaaaagcaaattcttgcacagtttttaaagtccctgcccgctgctgctgcctaccagtgagggtggggtggggtggccaggaaataagatcccttgggaagcagggagaggggagcccaaagtccacgagccttactaactattcgtgtttccatcggagatcacccttaaatcacctccctgtctcccatcccagggatctgctggggcaggactacttctccaagccacaggcttgattaaaggaatcaagcctttcatttggggtcctgcctgtctcttaggcttttcctattttgtcataaccatcttttgaatgtgccgtttttatttttttccatccaccccaagcaacggtgaggtaacccggccgagataattgctgaacacctgcaagacgcaggcctggtgccgtgagcacggaagagcccgggtgaggctggagatcagccggccttcccgcccccgcctcctagacacctgcggaggcctgtcgcttgggacgggagggtcgattagggcgcttgtaattgagatggggtgagggagtttacgatggctccagagtgggaaagagggagccggcttagatgacaggaaaccgtctcctccgctcggcggagcagattgagaaagcggcctgggtagtaatggggttagctaatccctgatagtaagaagggaaggagaggccgtcatcataatcacgactaatggattccagatggagaaacagaattgttctcattagcatggttgtgcgcgcgtgacacacacacacacacacactcacacactcacgcacacacccggagagacccattccacccacatccctgactttgataagcactgtcagataagaatagcccacaccgcgaaggtaggtagagagccttgtcaattatttcttccccgttccgcccctccccctccacaatatccgtgcatacgcaatgatttcattaacctcgagactcctgcagatgagttgaaaacccagcttacacggccaattagttggcagcgcgttccgcacgctgtatggaagtacctttctcttccccttaaattccgcctgacttttcggctgtatttcataagtgttaatgtaatgttgctgaaaggaaatatggccaaggcaggaaactttccccccactctctgggatgcagctgttcgtttggtttgggttgttaattcaaaacactcccaggtgcctatttcatattatctcttgtttagaacaaaataaaatgaaactgtcaaaacctttctgcctcgctggggcctgggctcaacagccgggtaaagagaccagggcaaggaagcaactgcccactccccttttctcagtgagtagtgggcaccttccaagtgaggccccccacctgcggccaacctgcctgccctcaccaaggtcttgttgaaggcctgctttggactccattcccaccccaggccctttgctcctagccttcctctccagaacacggtttccacttttcagctctcttgcaaagcctcctgtctgacgctttcc

SEQ ID NO: 61840 - DNA, 1942 bp, Bovine  19866880793054
ttttgatggtaagaagcctggataagttttggaagcaaaaattttggcctgaagactccaaagcatttgttcattcaacaaatatttattattcaattatttgatgccaaagacagcactaggcattgaggatgcaccagtgattccaagacaagataccttggctaacagtttaggtttagtgagagaaaaggacgcgcccaccagataacagaatatatgtgagaagcgctgtgattgggcaagtacagggcattggagaatacagtacccaactcagacctggactaagtggtcaggaagcacatcacagaggaagtggtgcccaagatgaaagataaagaacaagcattaagtagtgtgaaaaagtaagggaaagagtgttacagactgctgctaagtcgcctcggtggtgtctgactctttgcaaccttatggactatagcccaccaggctcctgtgtccatggaattctctaggcaaaaatactggagtgtgttaccgtgccctcctccaagggatcttctcggcccaggaattgaacctgggtctttaatgtctcccgcgtttgcaggcaggttctttaccactagtgtcagctgggaagccctgttactgactgagaaaacagcattacatggctcaacccgaaagagtattggggaactaaaacattcagcatggccaaatgcttgcattagaaccaagtagtctgtagaatctcagtagcattgaatgaaataatgcatgtgtgtgacaccatggactgtagcccgccaggctcctctgtccatgggattctccaggcaaaaaatactggagtgggttgccgtttcctcctccaggggatctttccaacccagggattgaatctgcatctcttatgtctcctgcactggcaggtgggttctttaccactagtgccacctgtgaagcctgaatgaaacgatgatgtacacaaaccacggccaaagcctgccatgaccatggttaatttcaggtggctatactggttggtgcttttaatagctgtgtctgtgtggccagagaatgtgcaagtggaaatgggttggctggccagctagtgttgtgaatggaggccaacccaagacaagtgcatgtccctcaagattaagcctgactctgcagcatcttcttcctacgtccaaccagttgagacataagaggagggtaaagaaaaaaaagaaaaaagaaagaagggggtgaggcccaggatcttaagaaattgtgactgtcatgaaaagagtttcaaattttaagtgttttaaacttgaacaatccttataaaacaaacaaacattaggtaattgacggtaagcataaattcggagtgtaagctacatataaaaagaactctggggacttccctggtggtccagtggttaagaagccacctttcaatgcaagggacacaggtttgatccctggtcacttaacaaagatccaacatgctttggagcagctgggcccttgggccacaactactgagaccatgagttctggaaccttcatgccacaaccagagagaagcccgtgagtcacagcaaagatcctgcaagctgcagccaagacccaccacaaccaaacataaataagtaaatgattttaaaaataaagaaatatttttaagaatggaaaaataaaagactcttgtgttaattatacagtgctgtgtaacaaattagctcagaattcatcaacttaaaacagtaagtatttatcgtctcccaatttctgcagcttagctaactgcctctgcattatcatctctcacaaagctggggtcaagctgtctgccagggctgctgtcaatgttctttggtcactatgtcgtgtgctgtgtcttcatctgaaggccggctggggaggatctgcttccaaggtcacttatgggttgtgacggattcagtttctcagggct

SEQ ID NO: 61841 - DNA, 2627 bp, Bovine  19866880973873
ggatctctctagtacgaccccagccttgaatcctctactgactggctttgaggatgggggatttgcatcctgctgccagctctgagactcactcccagtcttgggtcagtgtccaggtttgcagacaccaatgcaatggaggactggcgtgtgcagcttataggaattcaggagccacctgttagcgggcacctctgtcgtgccaggcaccatactaggcttctgggcatctggcacagcacacacgattttatttgttcttcacccaaatactacaatgagaatcttcctgtttccacggtcatgagaaggagctcagcaacacattcagcatcagtcagcggaaaagtgttggagctgggtttaatgctgattctcttcggttaccttgcacatgagaatcttaaaagagaaaccaagtcccgacacctctccaaggtttaggaaaagctattagggacgaggctggactgggacatctgtccacttgggagaaacagggctgccctgtggggaaccctatgtcccgtggctgctctgccctagggttagggtgctgtgttgtgggagggtactaagtggccctggctccagggctaagagggcctctccttctcttggttccgggagccgtgacttcactgtgtgctaccagctgtggtgagcagtaggggagagtccagtccagtcctgagtgcaacccccagatggttgatcccggaggccaggtgcacgatggatgtcctgtagttaccagagcctggcatttgggggctcttgaatgcaactcactaaggtgatactggaaagtctctcgagtgccttgaggttggttgttgggcatctgaggaggagcgctcagccttaggagcagacagtctggcctctgcagacatcctctgttcacccaggaaggggctgggccaccacactgcatccttctgcctggccgtcccctccgcccctcctccaccttatataatggcacattatacaacattgcaaagcaggtggtatttttaaagacagcaagtgagcatttttttggcctaaatttgggaatgaaacagatggatttttaagactctgagcttttcctatgaatagtaacccttgttctcctctgcttttaaacaccagtttcaagaccacctctagcaaccaatcagcactctatttaattataacaaaattcttagctctgtctgctgctgctcggacaagtggggggcactggatcaatttctggagccaggcagacttgccaacaacaattttctttttcccagagggcctcggaggccggcagcaggttccaagcccttcctctcctgcccgctcggcgtgggctccttgacagcgagtttgaaaagggttacagagaggcagataaatgcccggcttgttgcagccttcctgacagcgccgacccccgcgccagtgagctcatgcccgcctcattacgcgtggtgccagattttttccattaacaggtaattgagtagaaactaaaataagcgaagtttgttcatcccttggattttcttgccggggtttgaaagaaaaacactttagcttcgttagtggaggagtgtccttgaaaacgtatttatgttttccaagtgatttgtcgcttggtaggtgtaatgagcccgttcccctggcctctcccttcttgtttttcttctttaagggccatgatgttcagagaataggagctggtttcctgggcccctggctgtctgacaccctgttttaagagtggatggtgaagtatgctctgttcatggtagagagcttatttttctctcttctctctccctattgcactcgcatggtgtgcgtgcacacacaccctggaaaatcacccatagaagcctgttgatggatcacacagtcttagcctgcaacctacagggcccagctgtcaggtgccctcaggacgactggccccgcccccaggggccccaggctggccccgcccccaagcgtcccaggccagccccgcccccgtctccgtgccctgcgcctgcgcgcaggtgctccaggtggatggcctgcccctctgaggggcattcagaagcaaagcgaggttcggtctccttttctctctttgcggctttcctcatgcgtgcccagcccaagttctaattgcacaatttgctattccaggaacagatgtgtgagccctgaggtctccagtcttcctgtttcccatcttgctgggctcctatctcagctggtctgttttcagcttcatgaagaagattcctcatcactgcccagccccaagttctccgttagggttggagcttcggatgagatgtgtgtgtgtgtttggtacttgaaatacagagaaagagagtaagtagaggcatgtcctccatacttaggagtctccattttacctggaaaacaccagagaatcatggctttatttaccatcatgaaccctttgaaattctgatccgtgctaataaccatcaccctacctcaccccggaaatgtatatgtttgattacaaacaacaggctgcatctggtttcagtagttcatgacccgccgtggccttcaggccatgaatcgccacagcagtcaggtagggccaggaatcaatgtcattaaag

SEQ ID NO: 61842 - DNA, 797 bp, Bovine  19866881042324
caggtgtccacctggggccaagaatattagctctatcccccagccaagttgaagaaactcaggattcattgggtgtttaacaaagtgttcagaaacctttgcatcaatagaagtaaaaaaattagccctagaccgagaagagctctgaagccatcttagacatcattaaagattcaaaaggactaaacagtctccaagtaactcaattgcactataagaaaagaatacttaaaaatattaataagaggctgtggggacattctcaggctagatcttgctggccccaggtcattcttctgggtaggaatcagcctcttctctggtcaagacttccacaggtggggtttgaagcaattccatcagctatggccggggtggcccattcatcagaaatgttccaaccccccccaggaatcttcttggcacaagcacaaggttctagctaattttaaatgtaattaaaatattttcttcctttaaaactaaaatagattttttttaaagaatataaaaatatgcagctcttaataaaaacacacaagtgtgacatgtaaacaaagattaacagacttgcaaaaaggcagcaaaacattacccataatgagaataattcattaaaaccagtctagaactgatgttagaattagcaaagaaagatggacattagtatgattattataactgtattccataggatcaaaacactatagagagatatgtaaaatataaagagaccctagaagcttttgaaaatactacccccacacaattaaatcaaaatatccaggaatacatgt

SEQ ID NO: 61843 - DNA, 1541 bp, Bovine  19866881057334
ttaaggttaattacacagacgacaaagcatcggtgcctcctctccgggatggttggcaaacttgactagactcaaaatgaacctctttgattccatctgcaaaattagatcagatttgataaagtaaagatgtaccctttgaagtattccctatcaacataagtgctaagaacacttgagtgaaggaatttgagcagttttgaaagcagcagcatagaaacttcaatgaggattgcagctaagggcatgcccagaaggcacgggactaactgcgtctatcctgcaggcaataagcaattgctaaagattccagacttctcaaagttcagagttcaacgctcggaaactttgttgagctcatgataggctgggctctgtggtttgcattctgttttcagagggtctcagaatcctggctgctcttctgtttctgtgctgcctctgcatgatggcacgaaacaaggttgttttttttttctctttagcttccacacggaggaggtatgcattaaaccctcagctgttttcctgggtatgatccctccagagctacagggcagaacatcagcgggtgaaaagtgtctgtttatctaaatgaaaagcagaagatctgcatcgaagcccagctccgtcaccatctcactgtgtgaccttgatggagtccttcggtgtgtccaaatcctagcttcttcctccggcttccacttcagctaccagttaccaagtccctcctatgtgccaataatacctgcctctcaactgaactgcacccaaaccccatgctgctgctgctgctgctaagtcgcttcagtcgtgtacgaccctgtgtgaccccatagacagcagtccaccagggtcccccgtccctgggattctccaggcaagaacactggagtgggttgccatttccttctccaacgcatgaaagtgacaagtgaaagtgaagtcgctcagtcgtgtccaactcttagcgaccccatggactataccccaccaggctcctctgtccatgggattttccaggcaagagtactggagtggggtgccattgccttctccacccaaaccccatgattgagcccatactaagtgctggggagaagatgctaaattactgcgtggtccctcctggtctagtggggcacaaagagacttgaactagtgttttaatggaaagtgccaggagtggccacaggaaattgtaccaagtgctgtagacgctcatcgtgcgtgtgtgctaagtcgcttcagtcgtgtctgactctgggaccctatgagctgtagcccaccaggctcctctgtccatgggattctccaggcaaggatacggagtgggttgctatgccctcctccaggggatctatcccacccagggatcaaactgtggttctgcactgcaaacggcttcttgaccagtgagccacctgggaagccctgtgggagctcagaggggggagccattcattctgccagggggcatccagggaaagctcagaagtgagcagagaggactggagctgacgagctggagaacaagaaag

SEQ ID NO: 61844 - DNA, 1068 bp, Bovine  19866881132274
cttggtcttgggtgtctgagtggcttccttaactccttggaccatcaggcgactctgtcagaagcccctccattgagtttagggaactgctaaagtttcacagcacatttgcttttgaaccccaccctcagatacttccccaagacataagggaaaccaagaaacaaggcatctgaagaactgcagagtttttacatgagatcaaagtagcatcaggactttttaatagtgaaacaatgaatcaagagaggaagaatcaaatgagagatggtaaatattccataaagagcaggattagagttctcaggcagggaatacccacagctatctttataccaacttaaatcaggcagaagctctaacaatgaggataaaatgaaataatggatgcattatttctagtgggacttgcattgctatttggcctaattattcgtgatatttcacccatataagaagcttcttcagaggaaagaaataacagtttgtctccttgaaaacaaagaacaaaggcctcagtgctctctagaagctcgcctatcattagaaggggaaagaatctgcccattagcaggaaattctccctagagatcttgaataagatctccccaaataatccctcagtgaactgcaaatgcctgcatggatgaagattcagaagccataggtcttgctgcagaggtgagagaggggcgatgcaagccaaagaaatgttctctctagccttggtctatgatgactggtgtgtgtgtgtgtgtgtgtgtgtgggcacatcatgcacattttaactataaattgggaaaacgggccacaccccaggattgcttcctttaatgccctctagtgtaaaggactaggtttggctaagaatgatagaaaatccacaataacaatggcctgaacaatgtacagattatctgtcactggggaatgggtccttgtagttcagcctggaacagccatctacagttaacagggacaaggccccaagcaagcctcgaccagggaaagagtagttgctctagtgtctgatgtctttctgggtctagggctccacagcatttcctt

SEQ ID NO: 61845 - DNA, 1482 bp, Bovine  19866881136356
cggggtgggtagggagggtcttcagggtcttagatgacccgccctcccagggtctgaaatcagcatcaggaaggaacactcttcagtgctctgtttactgttttcttttttaaatgagtttatgactcatcttgatacatttttccgggacactgcttcctatggctgtaccaaggccaatggcacctagcaaaacagtaacagatgctgcatgtcactggggccatggagcactgatgggcaggagaggctgggacaaagaagcgctgtttcttccttatcaaccacccgccccccaccgaccccgtgattcaactagtcctattttgggggggctatgatccagagtggaagggccagctatggtagtcttcctgcctcaaaaacccatcgcaccaacagtgagcagccacttcagtgctgagatgatgacgtcagggagtgccctagaaccaggcctgcgctcacagccagacttacctgctgagcatctcactactctatcctgtaaacctcctgcaggcacgcaagcatgcacagaagggaaaggtggtgggcggccctccaccggggctggggccacaagggctgtttcccaccttcgctgtaaccctgtgcccagccagcgagggtctccccgcctcccccacgtgcaggggctgttcacggttgggcgctgctcctctgtgcctaagactctgtcccacccccccaacctgggccaagggggcattgtttcctgggggtcagacttctatggatggctacagcactgcccgttggaaatggtaaaaccaagaaagctgcgcagggtttgagttttgttgaagaaatgaggtggttcagagaaaagaggtctgcctgtgagatgcagaaaagaaacacgaccctgcaactgtggtacccaccgtgcaccacctggcctgagtcatgcgcccacaagactgcaaagttatagcttctactagcgccagagtctgacactcaggatgttgttggttttgtcaactatgaacggctgactttttcttcccccttcctctcttctttctctggaatcagatccatttagacagcaagaagagggagagagaagattcccccagccatctacgaaattctgccgattcacagttcctcccgcactcacacaagcattacaattctttgtgcagggaaatgattgaacagggcaggcagggagaggataaatgtgcagcccattttcatccaaattctcacacacacatgaatatacatagaactaacacaaaccatcctgagcccttgggctttattgggtgggttttttgttgttgttgttgtttttgggggtttttttttttttggcccttctatagtacaacaacatagcaagtatcataaccagactgctgagcattaagggtctagggggccaaattcagctgttcttaatgaccctgtctcagtccccaaaaggaggaggggaggggaggcggg

SEQ ID NO: 61846 - DNA, 1003 bp, Bovine  19866881362061
tgagtagcaggccccgaggggccttggtttgcttgccttcacatgaaaggttgttcttgcttgctccctgcaacagcagattgccctttccagccagctccatgcactttgttttaaaggtttaaaaatagaatgaaaaggtcttgtagagttgtgatgaggcacgactccgtcttgtacacacgactgtgcaaagggaaggcagcctgccttgagttgcgtctgaccaggcaacatgagtacttacagtgagactcagatgccctatggatactgttcacacgctgacgtgtgacatccacgttgcctctggacctttcagaacagcctgcagactctcagcctcatctttcctcacctgcccagctcttaggtgcccagtttgagtcatgatgccctcctggctgactcactcatgccttcttcctggtgggttcttggtggagatgcctgccctcctgctgtattcagtggctgaacacttattcttcacactcaacttagggttgtctgccctggaaggcatctacaacaaagccctccctccctgcagggatgaaagagacacaggagaatccagaaattttcagacttgtagagttaaagtatgtctttccagccagcaagatactttcaaattaagacacaacctgaggacaaagaccaaagtggcagcctggccatcacgtgtttgttatgacctctgattggctgtgttcccccttcaagttcttgcatttccacacatatttcaggttaaagggtctaaaatgtgcatgttcagtcctgtctgactttttgcaacgccatggactgtagctggccaggctcctatgtccctgggattttccctgcaagaatactggaatgggtcactatttccacctccagggagtcttcctgacccaggatcaaactcacatctcctgtgcctcctgcattgcaggtggattctgcccaaatatttgggcaccacagcccaggcaagtgacacatcagataa

SEQ ID NO: 61847 - DNA, 1684 bp, Bovine  19866880451099
tatattttcagaaatgtgacttaaataggcctgggacagtgcttacccttataaaaaccatccaaaaatgttcgtaattgttaggataatttcacagggaagtaatagcaggaaattggactatttgctcaaaagtacagtttatttgtaactcagatatttatgtatccagtttgcttataacgtttgaaaattctgagataactattctcttaacactgtggtaggtttgtcattgtctttgatttgtaggccttgggcatctatgtgagcatcagtttgtatctgaaattattatgaatgtatttgcatattagaaatgagcctgtcgaagttccattatttaataaggtcacagcagtaattctgattaatggagctgactcttgacagctctgaggataccgctaagacacttacaagtatacattttcataacagaaaatgcccttcatttccttgcctgtaaagaatgggtaataacatctaccttatggataataatgaaaatgagagaggttcctgaattagctcaatgagaacaagcgagcagagccgagttgcaggtattgggccgtcactgtcactggtctgcatgtcctgttcctgcccctgatccttgcagagggcatgactccagtttataatgtttaaatattctttgaccccctcctccaggtttttttgggagtatttgaaatataaatgtgaaatcttagagtaaccagagtttactgaatagctttagtgatgtttttaatgttatcttcagtaaatactgcttccctgctggctcagatggtaaagtgtctgcctgcaatgcgggagaccggattcaatccctgggttgggaagatcccctggagaaggaaatggcaacccactccagtaatcttgcctggaaaattccatggactgaggagcctggtaggctacagtccatggggtcgcaaagagccagacacgactgagcaacttcactttcacttcactttcactttcagtaaacacagttttgaaagcctgtacgttaaatcagtgcacctgggtagctaaaacgatactgtcataagacaatgcaaggctgtacttcagaaatccaagtgtgtctgtgagagtaatggaaagattccagtcagaaagagaaatttgccatcaccattctgaatttcttaagcttactagaagtgtatatttttaaagtctgtttgtgttttaaatacctcaataagatagaccagtttgacactctaaaagaaatttaaaaactcagccttcagacaaatatcatgtcccaagtaagaggcatactgagggaaagtcactatttagaggaatgacagaggactgagtttcccagttaagctagtgagaggaatgaacagcgttgttacaatgtgggaaaaatgaatcctataagctaaccattatttgtgaagctcattgatgccaataatttactttcataggttacaccgtacacagctttctagctatgcacttttctttgtttttaggcattaagttgccaataatgtagaatcttagccttctggccctgaaagttcatggactctatgatttcaaaaaggtagaaaaagaaataaggaatatgaaacatggggaagtttttgtgttttatttactttgtcaagataatcaaacgcttgagagagcttcctta

SEQ ID NO: 61848 - DNA, 777 bp, Bovine  19866880488583
taatagacatattttcaaactgcttatgtcccaactgtcttagaagtacagactaagaatgctgctgctgctgctgctaagtcactttagttgtgtctgactctgtgcgaccccatagatggcagcccatcaggctcccctatccctgggattcttcaggcaagaacactggagtgggttgccatttccttctccaatgcaggaaagtgaaaagtgaaagtgaagtcgctcagtcgtgtccaactctttgcgaccccatggactgcagccttccaggctcctccatccataggattttccaggcaagagtattggagtggggtgccatcgccttctccgagactaagaatgagggtcccagaattatacttcattccactgctcaatacaaatcttatttacatgagtcacaatcatattatgttctaagttaaagataccaaattttacaatagaaaatgtaaatctagttccattactttaggctagaagatatagtcacacaccacaacaagatggtaaagtatacacagaaggctctctaactaaaagatacatgaataggcaaataatttctacccatagtgttcaacactctacctgaaaccatctttgacaaatcccaggtcatctctccacggcaatttccccatcacttggcctcttagacaggactctgctcatgtcttcccataacttgattaatccgcacattcatctcttggacagcttaactctactgaccattaagctctttctaatgaaaaaccctaatta

SEQ ID NO: 61849 - DNA, 900 bp, Bovine  19866880707373
actgctctattttgagcccccaagtcagtttgttatgaattaatcataaagcaaatatttgaatgaattaattagagaactcaagaagtggaataatttgagctaatccttgacaataggatggtttctcttgatatgaaactgggttactttaaaattcattctaaaacagtccatgcattaaatgttaatcttcttaagatgatgtcaaaacatttagtttgccagtttccaaaggatttaaaaaatcccccagggcctactttgatagtgaagagaaaagatgactgaaaagagtgggaaggagcagaaaagatgaaaaagagggtaagtgatatttgagaacaaagttaaagtaaatgactttaaaagtgatcaaacgctgctggtaaaactggtcaaccacctgtaaaagaatgaaacgaacactttctaacaccatacacaaaaataaactcaaaatgtattaaaaatctaaatgtaagaccagaaactataaaactcttagaggaaaacataggcgaaacactctctgacataaatcacagcaacatcctctatgacccacctcccagagtaatggaaataaaagcaaaaataaacaaatgggacctaattaaacttaaacacttttgcacaatgaaggaaattataaacaaggtgaaaagacagccttcagagtgggagataataataccaaatgaagcaaccaacaaagaatctcacaaatatacaagcagttcatgcagctcaatacaagaaaaataaacgagccaatcaaaaaataggtcaaagaactgaacagacatttctccaaggaagacatacagatggctaacaaatacatgaaaagatgctcaacatcactcattatcagagaaatgcaaatcaaaaccacaa

SEQ ID NO: 61850 - DNA, 2301 bp, Bovine  19866880724661
tgaactgccccagtggctgaaaatgtgattctgaggagttaaggcatgatgtcattattcccaaagcagattctcagggagactgggcactcagcagtctgattcttggagccagaagcagtacatagacctggtgaagaactttaatctcttttgtataatgtagtgacttttttctcaaacggaaatgttaccaaatccatggtttgtcggctcaccacatgactgaccaataatcagactaggtgttgaggcaaggaatagtaactttattcagaaagtcagatatcctagaaggtgatggactagtggcgtagggcaccatcttactgggctctggatgacagtttgtttcatagacagagagggtgaggacgtgagactattaagtaaaaaggccataaatcttgcaaaacatctcctggcttggctagcattggggaagaggatatgctgagttcttcttttctgcagccattcacaggtgagcagggtcagaatgtctccctgtaagctggacaaaggcactttagcttaacattcaggcagaggggcagggttcctgaggcatgccattatatgcttacagctatagacagaatccttttggtgactgtattaacaaaagcaatgaaaagcaaaggttaaagtaaaggaaacagatccaacatatagtcagattttgttcctccctattacagaaacctcatgcgaagagctgactcattggaaaagactgatgctgggagggattggggacaggaggaaaaggggacgacagaggatgagatggctggatggcatcaccgactcgatggacatgagtttgagtgaactccaggagttggtgatggacagggaggcctggcgtgctgcgattcatggggtcgcaaagagtcggacgcaactgagcgactcatctgatctgatcagtatattagtgcaaccactgtagaaaacaattggaaggttccttaaaaaaactaaaaatagagctaccatatgatctaacaattactggatcacactcctgggaatgtatcagaagaaaataaaaacattaattcaaaaagatatgttccctcatgtgggtacacatctaaattgtaacatatataaattgggaaaggagtatgtcaaggctgtatattgtcaccagcttatttagctcttatgcaaaatatatcataagtgtggggctggatgaatcacaagccggaatcaaaattgctgtgagaaatatcaacaacctcagatatgcagatgatacccccctaatggcagaaagcaaagaagaactaaagagcctcttgatgaaagtgaaagagcagagtgaaaatgctggcttagaactaaacattcaaaaaatgaagattatggcatctggtcccatcatttcacagcaaatagatggggaaacaatggaaacagtgatagactgtattttcttggggtccagaatcactgcagatgttgactgcagccatgaaatcaaaagatgcttgctccttggaagaaaagctatgaccaacctagacagcattaaaaagtagagccatcattttgctgacaaaggtctgtatagtcaaggctgtggtttttccagtggtcatgtatggatgtgagagtgggactataaagaaagctgagcaccaaagaattgatgcttttgaactgtggtgatggagaagactcttgagactcccttggacagcaaggagatccaatctgtccatagtaaaggaaatcagtcctgaatattcattgaaaagactgatgctgaaactccaatacttcagccacctaatgtgaagaactgacttatctgaaaggaccctgatgctaggaaagattgaaggcaggaggagaaggggacagcagaggatgagatggttggatgccatcactgactcgatggacatgagtttgagcaagctctgggagctggtgatggacagggaagcctggtgtgctgcagcccatggggttgcagagtcgaacaagactgagtgactgaactactaccctcatgatcattgcagcattatttacagtagccaagacatggaagcaacctaaatgtccatcaacagaagaatgggtaaagatgtagtgtgtgtataatggactactactcagccataaaaaaataaaattttgccatctgcaacaacatggatggatttcaagggtattatgcttatgtaagtcagacagagaaagacaaatattctatgttattacttacatgtgaatgtaaaaaacaagtgaatataacagcaagaaacagacttgtagata

SEQ ID NO: 61851 - DNA, 714 bp, Bovine  19866880907500
cataaattagaataaaagactgagaatatttactttttaaagcagatatttatttactgctctgatctactcattaaaaaaaaattacagtagatctcttctcatataaagatttttttttttttttggtagcatttgttagagccaacttaaaggtaaaatttcttcccttctagaaaatcccaattaaactaaaactaaaaaaatcccaatttagcaagaaaggaatttatgagtgatttgtggtgaaatgcagtcactaatattttacattcaagacaattttgatattacactcaattcaaattattcctgttaatcagcccggatcttatttaatgaaagtctaaatgtctgttcttcgtccacctcacttctctgttttagaatctaaattgctatagctcttagtttggtcctggtaaaaatttcatcattcagagaaagaaagagagggagagagaatggattagctagtaagctgggattctccaacatcttaactgctcagggttattcttttaattcattacacatcatgaatttcatgtaaggtttgcaagaaaccatagaaaaaacttaaaagcaaagcattggtttaaagtttgacactaagaataactcaaggcactgtgatggtccagagaacgaagggaggtttgggaagagtatgagctagggcttactttagtagtcagagctaaatggtatgta

SEQ ID NO: 61852 - DNA, 1666 bp, Bovine  19866881119005
tgctgctgctgctgctaagtcgcttcagtcgtgtccgactctgtgtgaccccagagacggcagccctccaggctcccccgtccctgggattctccaggcaagaacactggagtgggttgccatgtcgttctccaatgcatgaaagtgaaaagtgaaagtgaagtcgctcagtcatgtccgactcttagcgaccccatggactgcagcctaccaggctgctcccatccttgggattttccaggctagagtactggagtggggtgccattgccttctccaaatcaactgtagttcaacttaaaaaaaaagaaaaaagtattacagaagctgctaaacattgtgtgaagttcaaaataagtgtcacaagtttaattttatacatcaaagacatgttaactttgattttaaaagattatatgaaaaagctttcaaaacttagacatcttataaacaaccactacttactgtcatcaatgtcaatatttttttttttttagccctcatagaaaaactttattggaaagcaaggaaaactaccaagatacgaatgaagacaaaaaataaaaaaagttcagacataaagtgtatgaccttggtttaagtggaaatggaaccgtttggtggtttgtagttagtgacctatattttcactttgtgacactgctgctgctacagctaagccgcttcagttgtgtccgactctgtgccaccccagagacggcagcccaccaggctcctctgtccctgggattctccaggcaagaacactggaatgggttgccatttccttctccaaggcatgcatgctaagtcgcttacattgtgtctgattcaatgcgaccctatggacagaagcccaccaggctcctctgtccacaggattctctaggcaagaatactggagtgggttgccatttccttctctacaatgtcaatattttaacatctttaattttccacatgatcagggatgcttacataaacaatagctacaataatcatgtgaaaattacactaatgagcttaactgcaattatcatgtgaaaattatattaatgaactaatggaaacatcctaaaagtattttatactggtggggattttaaggttcgtgggacccttagaaagctcagtgttgttccctcttctctgtgtaggcaaggtggctttgggggttttgaggaaacccaaaaccattttttccagtctctctccaggatagctaggttaagatagtcagaatcatcagtgtgtttgagtcaacccagacatcaaaaatacttagtcattgtatgaaaattagactataattagagaagaaggtcacaaagtagttatcctttttctaaaatgtagatttttattttctcattatagcctactttttcaaaacccaaagatcatctttgaaaaaacaaagaaaaagaacaaagaaagctttcaaaaggtgttccactaagagactgcccttaatcactcactacagatttcaacaaagtaagaacttacatatgctcatttctaagttctttttaaagcatgtgaacagaagccatgatctacatgttctgaagatattcaatcccagggttggtctatgactttataagtgtccctgatctcatgatgctttaaggcttggaggcagcctgacgagtgggatggag

SEQ ID NO: 61853 - DNA, 1789 bp, Bovine  19866881132686
aacatcccccagacagaggagcctggagggccccagtccatggtgtcgcagagttggacatgactgagtgactatcatacacaggctgagagaagcagactgccctctgcatgtggctgggtatcactgaatcctctaagggcctggaaacagtaccaatgatggcccaactgaggaagaacaaaattggtgaattaaaaaaaaaataaagaactcagattgtctttactcacaaatgacaagatattttacacaggaacccccaaagaagctatgaaaaaactacatctggataaggactccagtaaaattgtagcatacaaagtcaatgtataagaagtcaatcacttttctatatcccagcaatgaaaattggaagtttaaatacatatatatataaaatttataatcacaccaaaaattgaaacacttcaggttaagtctgacaatctatgtcaaggatcttacatgtgaaaaactacaaaatactgatgaatgaagtcaaagaagttgtaaataaactgggaaatacttcatgctcatggatgggaaaattcaatatggtaaagatgacagtttttcccaactaaactacagatttaatgtagtcccaactaaaaatccagaaaccattttttttaaggtatcaacacacttaaacatgtttatggaaaagcaaagaactgggaattagcgaacacaacactaaaaggaaagaataaagttggaaaattcacactgccagatttcaagtcttactataaagctatagtaattaagacactggtatcagagaacacttgccaaaacttcaacggtacttcttccattgaccagcaaccccatatttctcctcagagtactgtttctccacctggtcccctcaaactagcttgtcacatttctccatcttactttgttcctctcacttgggtcattttaaatgccccagctttccaatttccatgagaaatgctgccaacccccaacacagcaccctgcttcacttttctgctttgcagatacagtcatcacactgcaatcatccactcatttctttgaccacagaattgcaagttgaaatgcaaacagtaaggtttgttcatagaaagaatccaggcaccagttgcaaagttttcctggaaatacagccaggggaactacacggtctatcatggcggtgtgacactccatcaagagcagctgaaggaaatgagcattagccaaaagatccttcaccaggacgtcagcggaaaacatgtcatactaagataaacatctaaaatcccttcattctgttgacaatatattcactgtatcccatttcctctttttgtcacctatctaatctttccttctaatcttcaaaatctagttctctgcccaaactccctggtctctttcagtctttttcagctgtttcctctgaggatttcatttcctgtgctaatcttttgctctttgctccactggttctattggattgaactgctacacaatgggatgctttctattgttttgcgtgtgagcgtgtgtatgtgtgtgtgtgtgtgcacgcatgcacatttttcagtgctttttcaccttaaagaaaatctcttaaaggccaaaattccatttcacacttcttttcaatccatatacaaatatatttaattgattaatatctgtttctaagcaaacattctgccctaattttagcatgaactgggaaaatcatgtaaatttctgaatataaatgtcatttaatcctacctataatcatagtgaatgtatgttcagcgataag

SEQ ID NO: 61854 - DNA, 1940 bp, Bovine  19866881286579
ttgaagatattttaaagataatatttaataataacatcctatttaaaatgatgctgttaaatgctacactcacatgtcagcaaattgggaaaactcagcagtgaccacagtattggaaaaggtcagtttgtattccaataccaaagaagggcaatgacaaagaatgttcaaactatcttactagctcatttcacaggctagtaaggttatgctgaaaatccttcaaagtaggcttcagcagtacatgaactgggaacttacagatgtacaagctggattcagaaaaggcagaggaaccagagatcaaattgccaatatttgttggatcatagaaaaagcaagggaattccagtaaaacatctgcttcattaactatgtgaaagcgctgtgactatgtgaaagcatcacaataaactgtggaaaagtcttagagatgggaataccagaccaccttacctgtctcctgggaaaccatgagtaggtcaaaaagcaacagttaaagaccttcatggaacaaccgactggttcaaaattggcaaaggatcacgacaaagctgtatgttgttatcctgttcttttaacttacatgtagaatacatcatgtgaaatgccaggctggatgaaatgctaactggaatcaagactgccaggagaaatatcaacaacatcagatatgcagatgatatccatccacacaccagagttaaaacttttatccagaaaaacaagttaaattctcctcctgtgtcgagttattccctcaagaaaaatgaaaaacagtgctttcccagttgtctgttttaacagatttctccagtaataatagcaagtaatttgcatgtaatctaacccatctttaattaagttgttatcccattcactcccttaaaggccaacttgtatctccaaacagatgtgacataattaccagctcgaagattgcttctcaactgagcccactgtatttcccttcctctcttttttacatgctaaaatttccatggcttcttggagaagagttaatgtcactgagcaatttgacgatttcagaaaattgtctccatcaaatctagcaaaacaggatatattttacagagcatttcacttgatatcccagcaatgagaaatttggcattgtaaagactttataggcttttaaatttttatctgaacacaccaaacagacaccaaggttctatttctttattctttctacttctttcttccactaattggaaaaggacatacacatttaatttctattttattcaccaactgcattaattcaaaatggtctctggtgggataaccaacatcaatatctattccatacatcccagcccatgtttccctcatagtcacagagggttgacacagagcaagttactgagcctcaagagtgtcttctcctcacttagagaagaggcaacagacacaagaaaaagaaatgaccctggaagaaagcatagggcaaaaataattgccaccggtcctccttgagtaagggcttgtagtttcatcttcgtaggaggaactaccctgtatgcgccttctggagagaaaagctacagaagagcagagctgctcaggtctcaatgctgttctggaaatactggacaattcaggctttaggggcctccagatagtctcattttatgttgctttttgttttcctggtgacttatgggaaaaactgtttttaaggtgaggtcaaagaaaaagataagagaaactcaaaagaaggagaacaagaagagaggcaaaggagaaagtctggagcaggggctgaggcacaggtatattattttttagttatgtgaatttcatatgaaacccccaaaatattggggctcaggaaacaactaaattaaaacttaaaaggacttctgcttttgattgatattcctcagaaaatatttatcagtgtgtttgccatcaat

SEQ ID NO: 61855 - DNA, 4487 bp, Bovine  19866880378688
tgtgggagacctgggttgggaagatcccctggagaagggaaaggctacccactccagtattctggcctggagacttccagggactgtacagtccatggagtcacaaagagtcagatattactgagtgactttcacttatagaaaaattagaaaatagagataagtcaaaaatcagcactgttattttaataatcagaggaagtgaacatgacaaaataatgttaaaatgaggtgaaaagaacaaatggcaaggttcaaattttaagacttctccctcagtaaaaatacctcttatttacctagaggtttccaatttagagtattttcttatactttctgactgtgaaagcaacagtgaacagagtattttagagtagttttggctggataatggaactgcaggcaatttctgtttcccttctttaccattttttagggagtggggaagtgggagttatctatattactagatttttgataatgaaagtgtttcattggtgtaagagaaaatcagttacttttaggaaacatcagctacaacaaattgcagataaggaagctgaggccctgagaacttaagcaatttgctacaaagtggaagagccaggacttaaaagggctcaaaacttctttccccaaacccacagccttcccacctggatccctttggtggtgcaacacaggactcttaagtgttcaggctgagtctagactcttgggtaaactaagacccaaactattgctaggcaggtgcatatggatgatcctcttgtttggagaagccatgcatttaatgcactgcagctggagttgtgttacatttcctgagaaagcaacctaaacttgaccccagccttttcaaattcccacaccgcagagccgctcctcacaataaacagggcattttacttggctcacccagccacaattcagcttaaaaattgtacaaactcgtaaattttaattctggtattcaaaacacatgtttagctggtgggatttaaaaaaacactccctggcctcatttttgttcagagcaacgcgtggtggttaatccgaaagctttgggtctggctcaccttttaatgccacatagcaattcattttcgttaactatctacactgcaaatcagcactttggaaacacactcactcggacaatcccccttcctcctccagccatttccaactcagagtgagagggggccactgaacattctctgttgtactatacagcacatttgagacctcacactcacccagagtaaagctgctcttcagcccgaattctcacgcttgtttgcactctggccacactgctgggtcggcgtgggttcctggcaagaggcacggtttctctctaatcagccacatgggctccaggactctcctctttgctccccctctccccgctgcattgtctgacacgttcccagggagcatggggcttccctggtggcttagacagtgaagaatccacctgcagtgcaggagacccaggatccatccctgggtcgggaaggtcccctggaggagggcatggcaatccactccagtattcttgcctggagaatcccagagacggaggagcctggagggctatagtccatggggtcgaagaaagttggacacaactgaagcacctgagcatcagagagcatcaggaactttgactctgtgctaaataaaaccaaaccaggaggtttttctagaggaaaattcatagtgaatattctaaggaaaacatgcatgatttgggaggctgagcacaccacagggtccctccatgaacgcaggaaaccacgagccccctgaactgatgggaaggatggctggcctgtgaagagacgaagcaagcatgttctatggaacaggatccatggcaccactggctctgatgtcatctcttttttaatatttatttgggggatcttgtggtggcatttggaatctttagttgcagaatgcaaacttagctgtggtgtgtgagatctagttccccagtattcattcgtgccttcacttccattaacgggacagaccagtcagtcctaaaggaaatcaatcctgaacattcattgtaaggactgatgctgaggctccaatactttggccacctgatgtgaagagctgactcatttgcaaagaccctgatgctgggaaagactgaaggagggaggagaaggggacaacagaggatgagatcactagatggcatcactgactcaagggacatgagtttgactaaactccaggagctggtgatgggcaggcctggtgtgttgtggtccatggggtctcgaagaatcggacacgacggagcaactgaactgaactgatgaaagtcaaggaggccttgaccggtggcctctccacggggtttcccacaagaagagaccataacctgctacacatctcccatggtccgcggatcagagcaggtgagagaattcgtaagctatggtaaatcagtaatggaggccagaactccagattcttactcatcctaagctctgtgctctttagacctttccatctctagacaaaaagcagtgaagtcttgatagtgtgtgatggatggggtgagagctctgaatatccacaacatactggggctgtctttgcagcttgaggccagaacatgagcccagtgatctcagacaaacgcctccctgactcaagggtcgtccatgaggcactgacccaacaaccggcagcttcccaaaccatcaccattaatgacaaactgataacctgttaagcacaaggaaaggtgacagtgaagttaaagggagacctgctcttctctgggcttcccaggtggctgagtgggaaagaactcacctgccattgcaagagccgcctgaggcacaggttcaatccctgggttgggaaggtcccctgcaggagggcatggcaacccaccccagtattcttgcctggagaatcccatggacagaggagcctggcgggctgcagctcacagggctgcagagtcagaaatggctgagcacacacgcaatggctcttcttttggtcaaagatagcttgaacatcacaccgtgctgagcttcagatccagtccttagagctcaggccacactgaatgtgtctgaagcagggctggtgtggacccaactctgtttaccctgctggccaaaggctgccctgggggagccatgctggcgagctgtggtcaggctcacaaagccaccttgtagctctggggctgagcctcaatagtctgtctgttacatcttctaggccattttgatgtgtcatgtggacccagctgccaagcccggcaaccagctcaaatccttcaggcattgcttcttctttctgacgtcatcacatcgaaacacatgacaccacccacaaatacctgggcagccctccaggaatagcttcctcctcccccttcctatcttccactcacagcatacctactgccaaatgataaaaagcagcaagacccctttatgccctgccaggtaaccaagaataaagcccaagaggagtaaggagactaaggatatttctacttttgatcaagctctagacacagagttaaatgattaagaaaaaaaaaaagtgaactatcacaacccaaactctgatatgattctgcaatcagtctgctaagtctgctaagtcacttcagttgtgtccgactctgtgcgaccccatagatggcagccgaccaggctcccctgtccctgggattctccaggcaagaacactggagtgggttgccatttccttctccaatgcatgaaagtgaaaagtgagagtaaagttgctcagtcatgtccgacttttatcgaccccatggactgcagtgcaccaggctcctccgcccatgggattttccaagcaagtaccatggattatttaactctggcaaatcaatgtgctaataaccagaaatttgaagatatatttttcctcttcaaacctaatagcttttaaatttcaatttctccttgccttaaggaatcataaaagggtgagaacaagagctctcccaggctgcacttggataccctggtggggtcacactgtgtccgctgcgtcctgctgcctgtcaggggcctgcctgtcggtacattgcttcaaaactgccactgccaccgaaggcagggaaatgggtcagcagctgccaagtgagtgacaggccagctcactctgccaaggcccagtcactctcttttcagaagatgtacagccaaagtaggccctgcacccagccattggggtcactcaggaaaatctcagctcatttgacttagaatctgataaatgaaacctctggcaagaatgaagacacagccataacagacagtgacccacttgtcttctcttatgctccacagtctccccaggcaaagcaagctcagaaacatctaaactccagcaatttccaaatgggtatctccagagccaacttctctcctgaaagtttgctttccaaagactatttccca

SEQ ID NO: 61856 - DNA, 1160 bp, Bovine  19866880674943
acaaagagggcacatgtgagaatgtggccaaatgcaaactgcctaaaacaaatcagaacgcctaacaacacagggagccagcagagtgctttgaacatactgacacaattataaattcactccatggtgctcaaaactcatcaatacagggtattagagccagaaacattttcaactgatttatttttagagaatttactggagacagatttaaaaattcatatttatactatcaaggacaggaggtacaattagatgaaaacaacttagaaggtatacacacacaactctcaacaaaatattacattgctttgaaatgtttaaaaagtttcaaaacttccccacccacacaaaacagcctagtctctcaaacttctgatcactggtgccaaaaatgcatcaagatggcaaaagcagttggtacacaaatatcacactgcctataaacatgaagtatgcagcagtggctgcaaagtcactaagctaatggctgggaatagtcatttttgccagttcttacatagccatttagcatctcagcaataagagctcagaattttgacctttctcaaaaattcttcattttccctttctccctttttgttaatagcaaagccatgctaaaactacagaggttttctttgaaaagaacagtaagataggagttacaaatgtgacctcctctgaactgacttttcccaagactgggggaagcagtggtcagtagaagggagggaagtttcccacggaattgttagatgctcagtaatgacatgtgaaagcaaaaaaaggggaagggagggacggtgcaaagtgacccatccacctacaaatccatccaggactttaaacagagctaaggaggagagaaacagggctgggtaaatcccacaggattactgtctgagagcaagaggcctgtcccctgcttgaaggacgacagatggccaaggctgggcctaacatagtgggatgggggctgactgcgtgtgggctctggctggttcaactcacaacactccgccacccccatcctgtgcccactgagcagtctcatgcctcagacctgttccatgccctacttctgactttacattccagtcccatttgtctcggagaaggcaatggcaccccactccagtactcttgcctggaaaatc

SEQ ID NO: 61857 - DNA, 2586 bp, Bovine  19866880756560
aatactggagtgggttgccatttccttctccacctaccataagataacccatgagtgagagtaggttggtagcctggctccctccccagctcaatagaagcccctctcccacccctgacaggacagggagctctatggagtgtgagagcaggtggagacctcgtacccagtttctctgctgtgcccttggccgtggggtgcttcagcacggggctgttggaaggggtcccgctgagcctgctgcgcgtgggcagggaggccacaccgggccagaagagctcggcactcttgtccgtctgcgtgctgctgtccttgctgcccgtcttagcgtgggcgctgctggccgacgtgccgggggttgggggcgagagtgtggcggcagagggggtgggcagcaggggggtggatgcgtggtcattgtgctccttccccagcagcagccctgtgggtggaagaacagcttcttcagtaccgtgcctcaagaagcaagacccatcggctcggcagggatacagacgccagcgaagagaacggatgtctgtacaggctggggagcggtggactgggagatcaggactgacacacatacacacctaggtggaactcgtggccaagagtctgcctgccagtgcaggcgatgcaggagacttgggtttgatccctggggttgggaagatcccctgaaaggagggcatggctacccactccactattcttgcctggagaatctcatggacagaggagcctggcgggttacagtgcatggggttccaaagagtcagacatgactgagcttacacacacatgtaaaagaggcagttagtggaaacctgctgtatagcacagggagcccagctccatgctctgtggatgggataggggtcacagtgggaagggggtccaagggggagggacaatatgtatatggatggctgattcactttcctgtagagcagaaactataacattataaggcaactacgttgccaacaaaggtccatcgagtcaaggctatcatttttccagtagtcatgtatggatgtgagagttggactataaagaaagctgaacacagaagaattgatgcttttgaactgtgatgttggcgaagacaagagtcccttggacagcaaggagatccaaccagtccatcctaaaggagatcagtcctgggtgttcattggagggactgatgttgaagttgaaactaatactttggccacctgatgcgaagaactgactcactggaaaagaccctgatcctgggaaagattgaaggtgggaggagaaggggacgacagaggatgagatggttggatggcatcaccaactcaatggacctgagtttgagtaaactctgggaactggtgatggacagggaggcctggcgtgctgcagtccatggggtcgcaaagaatcggacatgactgagcgactgaactgaataccccaattaaaaaccaaaaacaaaaaacctagcatggggcaggggaggagctgtcacataaactggttataatataacaaatgataggatactactattctgaggatgctatggaaagaagggagaagaggtaccttacaggcagagtgtcgaggggcaggggcactcctgcaaggctttctggagacaatgctttctttccatatgcaacccaggagggctagtcctgagcagtggtggcgtgtctaagaaaacctgaaggcttctctgctcctagacacagccctgttggcctgctgctctgcctaacagcccccaactctactcctctctggtaatgaattgtctccccagggcctgggtcaaaacaagcacgcctcctggttacagcaacagagttgtgtacaatattccccagagggctccttgtgatgaagagccatgtcttctaagaggcaggaagccagctgagttcctggggagggcggctcagctcttttcttcccacccatcccaagaccaaagcgttcagggtgggaagagggcggccagctgggcaaaagggaggcgagacgtgccccgtttcttcaatgtctttctgcaagctggacagcacagcaactgttctaatagtgaagtacggccctcattcagaaaagtgccagcacttcacaccagcctacagaaagtgcagtaagcacaatcaagtgtctgttcatttaacgaagttcacacagtctccttggtagggctatttcagggtgcccattcataatgcaacacaactcaatccagtctgtctacagcgatgcttctcaacgtgttcacacacatcaattacttggatatagttaagatgaagattcaagtcagcggggcaccttgagcttctgtttctctaagaagctcccaggtgatgctggtggtgctggcccacagaccacaccttgaggagcaagaagccttcactaggtgcttcccagacatcatctcagttcgtatgaggtaggtcctgttgctctcttttgttttatagaaaaggaaatggccgatattagtgtctcacagtggagaagtagcagaaatggcatttgaagccagaggtgcctgcctttaagtccaccttgtgtccttttcca

SEQ ID NO: 61858 - DNA, 2662 bp, Bovine  19866880769623
cgtagacttggctttggactgttatagttgtagggtgaggatccctctgctcgggaatcctttggaggaggtgggggctcctgggcataaatgagttgtttcctccaacggggttccctatgttcattctccaaaataaacaagtatacataatgttgttgatttttggagatgtaattcttgggatgcccctttgccaagaaggcagggaaccggggagggacctgcctcattgtaggcacttgataatgtagaggaaaggaggggagcggggtgggtgaggtccccgcacaaagtcctaatgcccccttcccccgctcagacctctccctcacgttctggttgtgttctttgtgtctgaatcccaggcccaggcatttagctctggtccgccaaagctgggctctgtggccttaacctgtgtgcgccggtggtggtgggtggtacttgaagtggttccattttagagcgagctgggtaggcctgtggtcctcctggggaacgggccactgatatgtcccttctgtttggcagagaactctcccggccacggaaagtcgcctgaccacaaaggccgcgtcagcaacttactccacaagcctgagttccccgacggggagatgatggaagttctcatctaaccctgggctccctgttgaatttaacagtggaacaccgaggcgcaaggaacgtggcaaagagaaagaaagatcatgaaggttgcggatgggaaatcagggatggtttgagcagataaggatttcagattagtgagaattctttttataaatgttaaaacaaaaacagaagacctacatgactgaagatgaagaggatgccgtggatttttcccgcttacggtggaagagagaagatgcatgtaggtttggaaacaaagaagatctaggaaatgaaattttttcattgtacagaaaaatgtacctctcggggagggtctgtgtacacccacggtctggttataaacagataaacctgagcatggatcttccttggaatacgcccattctccttgcctcttagcttgttttgagaagaacctcctagaaatctctcagtctgtcttgacacaacgtcatttcaactgtgccctccatgatgtgtcctgtgaatgcgtgtgggtgtggcagggaggagaaatgtccagggtgatggagggtttaaaaggccatctccacctctgtacctgattggtttggattttcaggaggttatgggccttcttggcttttctgcaccgagcagtatgcaggatgggagctttctggtcttggggttcacccccgctcacatctctgagttcatctctgtctctgcctcattctctttcattataccttttttccttcatttttttccctcttgtaataagccttgcagggttccttcggtctggggtttgccagagcagtatctgatgggtcatcatgcacagtgactagtgggacaaagccttttggtggcttcctggcagtttcctccgccttggaggagttgggctacagcagttgaccttctgacagtgaacttggtcagctccgatgagacagaggattcatggccactgtgacgtcctgcattaagctcctgccaccacaactttctcccctcacatcagctcttgcgtggagttctgattctccacctcattgctccgttgaggtaggactttcaggattgcgctccaggaaccaagggacacttgacttggtggcatctagaatctcccctggcaccttgtcccggcttgctactgtttgtggcccctgctctgccatccccttgaatccttctggatgtagttggtgagcacacagattctgtggctgtcagcagtcaggtccgccctgctggggacttgcttcgtaacctaataggccagtatcgatacagtgtggttgggttgttcaagggtttagttcgaagcaactggtccaaagtaagacagaaggcaccaggtccaagaagcccggaatgagtgaggccgtggcccccttttgccctgtgttgtagggttttgcatctgacgtctcagatgtcggcttcctttacaaacctggaaggtgctggatcagaggagagaggctagtcaggccatcagatgcccttgtggggttctgatgaatttgctgcctccgggccagcggcatttctgtcaccctgggtcctcatgcccatgatctgagactttctcgcatcccacccaaacgaagccctgaagaccccatcacttcaaaaagttggctggggtagctccttgaagggttggtttttggagtgtaacctgggtgcctgcctgcctgccaagtcgcttcagtcatgtccaactctgtgcaaccctgtggaccatagcccgccaggcttctctgtccatggcgattctccaggcaagaatgctggagtgggttgccctgccaccctcccagggatcttcccaacccagggatcgaacccgtgtcttacgtctcctgccttggcaggcgggctctttaccacgagggccacctgtggggagccctgtaacctgggtgaagcctccccagatccacatggtagaagagggtgatgagtgtgggtggagggaaggaaactgcggctttgcccaggagcttcctcggagctgccggggtcagaataaacagaa

SEQ ID NO: 61859 - DNA, 1005 bp, Bovine  19866880771120
aaatttaaacctttaagcaatttttaacccttaaaaatatttaaaattaaaaaggtgtattaccccctacatttttctttactaatgatttttattttttcctttgaattaattaggcaagtcagatacatcagtgtggaagatttattgttacaagtttgagtgaaataaagatttgttagtgggaggcaaatagagcatttaaatagataaagtttgaattggacatatggttactgaggcattttgatttgtctttttaattgctttgttgttactatcttaaatgatttgcttctggaactcttgggaccaccagtattgcagtaggacctggggagggactggaagtacttggcagggcagcagctgtcttactacattttatatcacatgtccccttgtgcacatgcagttaaatcttacactgtggtgaagggatggtttttataatgctgcagtaaaattggattacttagctctgttcttgtctcatacctaaaataaattgtttcatatttccacataggggaaataagggaatgttttcctttctgtatttctgtgtttaaaaatgtccttttcacatcaggaaatgcccagttctttgtccgctttttctgctcgttttcacagttttttcctcctactcttcttgggctaaaaagatggtcctttttcacgaatatcactgctatcatcattcatagcataattatacaggcatatttaacgctgggtttaatatttaatacagtgacaatgtagggtaatacccataatagcttcagtttcttacttggcaaagagatttcatatttaagtgttagattttctctttggtgaaatcgtaacatatcaaaggaccttggaagaagggattccctttgatgtttggtctcctacttaggtaatacctattgcagtttgagtttatcttgtagtattaatctttggagaagtttgaattaattgatacacagagagggaaactgacttcctaat

SEQ ID NO: 61860 - DNA, 1361 bp, Bovine  19866881301910
atggacctttgttggcaaagtaatggtcaaactcctttgtaaaaatttgtttatatgtctgcttctcttcctgggctgtgagttccctgaggcacagaccaagtttcattcttttcatcttttactgagtatgtttatttcttgcataaatggataattatctctacttacacaaatgaagacccgggttcaggaatactgtgttctgcctagtgtcacaggcagagcctggacgtgagccagatcttctgactccagcccaggactcattctgaggttcagccaaacccacaggatggccctggggactataattagaaagccaactaccctagatcaactttcctcttctgagaagaggagaaaaagcagagacatttcttgggttggttccattaaatctgttaaagagattgagcagtccaggtgtggtagttgagatgcacttttgcttggaggctgggaaataaatgaggcaatgattgaaatcgaaagagcccatggagttttgtttattcagcacacaagtattggtcacctaccatgtcccaagcatggcatgaggtgttgagaatacaactacgaactaaacacagtgcagctctctggaaactatttacctagtctccatatgttgatgtcagcttgcggaaggtggagcctctgatgcctggacattcaccattggtgcatccagctcgtgatgttgggggttaataatatggactaaattgaagtcttgctttctgaagaatccctcagggtctcacttgcaggtaaggaagaggattactatttagatggcaggagggagaggtaagggtcacagaagggcaacaagggttgggggaggggagggaaggctgagtctgactctttcgaggcagagcttgtcctccccaccctcttcctgactgtcctcatcccatctctagattctgctcctgcacttgctgctccctcccttctttggctcacctccctccatctacatttttcagcatcctggcactggtcaagctcctttgtaaaaatttgtttatgtctgcttctcttcctgggctgtgagttccctgaggcacagaccaagtttcattcttttcatcttttgcctagtgtgtttatttcttgcataaatggataagtatctctacttatacaaatgaagacctgggttcaggaatactgtgttctgcctagtgtcacaggcagaacctggacgtgagccagatcttctgactccatccagcccagggctcctccagagttgcggccacacccacaggatggccctggggactataattagaaagccaactaccccagatcaactttctttttctgagaagtagaagccaagg

SEQ ID NO: 61861 - DNA, 3130 bp, Bovine  19866881597210
cgactccatattcttgcctggagaatcccatggacagaggagtctgtgaggtctcagagagtcggatataactgagcatgaacacataggcatccttgctttaactccaaatcagaatgtccctccccattggggtggctgatacggagactgggtacaggaataagcctcaggaggcatagagtttagtctcagccctgtcccttagctcctatggcactgttccttcaaggtttccccttctagaaccatgtgaggctcaggaagatcatacttgtggcagatagccatttgtgtaaaagtttaacgtccagagaaaagctgaaattgtgggcagggctttcctctacactcatgtcccaggcctgcctgtcctccagaactgaagcccaccaacccactgcttcttttctgccttccccaacccccatacccacagccgcttgctaatgtagctctccccatcagaactggggataggtcacatcctagcaatgctgctcttccaggcttgcttacactaaagcacttggccatgctttatggtatgctatcctcacaacgtctttctgagtcaggcagagcaggtgttaatacccccattttataactaggaatccaaactcaaaaatgtggaaaaacttgttcacgaacatagaactaagtggcagaaccgggattcaacaccagatttcttgaacctaacgctgtcttgctgcccttgtagcaaggtaatgcaattgactggggcccctttaatccttcctttccttcctgcctcccttccatttattggaatgctgggaatatgaagagattggttctgtgtcaggggacttaatccaaggtgatgagagctgtctttaacagagatgcagacctcataaagagctctgggggcccagggcagggcgctggcacacccacagctgtgcctacagacagaaacatgtatcttttgaatggacgtgtaagccttatccaaataaccttgcttggggaggcagcaatcatcatgtctacaggaaaacatgcttcaatttgcctgccatgccctagactccattccaacttaatgtgaaaaactcccagggtgagaaagacggcaagtccagtttccaggcttttctcttggaggctgttttgaagagcagccagtcagcatggcactggggatggcttgatgttcctctttggggtgaactaggggggcgattagagctgtgtcaacagctttggatgaagactctggccctctaaccagcaggggagactgggcgagccttgggcagacagattcgggctgggcccagtcagcttctcaaatgcgccctgggtactaaaggggaacagctccagaagtcttccttttccaaggaatcacgcaccgcacagcctttgagaagccacctcacccccactcctgtggctagggtacccagccttcaatgacactgggttctaaggtcatcctgtgagagcagcgctcaccccggggaagacgctgatcagcttcatgtcgtagctctgtcctggtttcctccactgtaaagcaagggcagtgataatacccactctgccctgcagcaaggatgacaggagttcatccaagtgtgttttgcaaattctaaactgtgattatggagatgacggggcttccctggtggctcagatggtaaaaaaaatctgcctgcaatgcaggagagcagggttcaatccctagcttgggaagagcccctagagaagggaatatctacccactccagtgttcttgcctggaaaatcccatggatagagtagcctggtgggctacagtccatggggtcacaaagaattggacatgactgagcgactaacactaacacttcactttcatgaggatgattattgttaatatcaaaattattatggtcactgcctagtttgggcccagagacccatgaattcaggtgagggctgaagacaatctggggtcatggggatgtgctgattaaaatgtgcctgcctgccattggagggctggaaagagaagggggctgctgtcttttcagagagggatttcaagagcaggggtccccaacctctgggctgaggaccggtgcctcctgtcagaccagtggcagcattagattagaaatgaactgcacaataagtgtaatgcacttgaatcatccccaaaccattccctcaaccccctggctatggaaaaattgtcttccatgaaatcagtccctggtgccaaaaagcttggagacagctgcaaatagagcatttccgggttcattttctggaggaagagagatgggatggaagctccaatgtaatgagttccctacccacctccactctgctgagcactgttcagggtcactgtcctgggaacagtgcctgcatgcccagctgacactaattggttctcgtggcatgtttggctgctcagaaaaagcactaaatggcagggcagagcttctgtttctgagtctcccaggatgggacccacagagggaaggagactgaaaaccaacctcacatcccaggatttcccagggctcggcccacttaaccactaggtcagttttcatctacacaacacctaaggctctcaatgtaagaagacctggaaataccaattaattccatctcttatggagcagctttcttgttgttcagttgctcagtcatgtctgactctttacaaccccatggaccgcagcacgccaggcttccccctgtccatcaccaactcccagagcttgcccaaactcatgtccattgagtcggtgatgccatccaaccatctcatcctctgtcgtccccttctcctcctatcttcaatctgtcccagcatcaaggtcttttcgaaagagtcagttcttcacatcaggtggccaaagtcttggagtttcagcttcagcatcagtccttccaatgaatattcaagactgatttcttttaggatggactggttggatctccttgcagtccaaggaactctcaagagtcttctccagcaccatagttcaaaggcatcaattctttggcactcagccttctttatggtccaactttcccatctgtacatgactacggaaagaccatagctaaatccaagtacaatctcctaaaaagg

SEQ ID NO: 61862 - DNA, 847 bp, Bovine  19866881794277
ccagagagggccagtggctctcctgaggctgcactgttgacttgcgatgtggggctgagtttagtatcacagtgaggcagcgcaccagccccctgggccaggagcatggctcgacttcattattggatcacacaaccaactttggggcccttttctcatcacaggtcccgtgggcagcagagcccaccagccacccagcattcctgggctgggttcccacccaaaccctgaagtcagccagggccaatatttggacccaattatgtatttccaaacatccgactcgagaagtgggaggacggagacaggcagccagggttgcttttgtggattctgtagtcagtgacctaaatttcacactggggggagaattttaaaaaaaggaagaactgccacaggtaacactgatacgttagggaaagtgctgaggatatgaaatgcccgactagggtctttgaaaagttgtctgttttaattggacatgtctcttcagaactagctggtggcgggcccatcatgggctgcttttaatcagtgaaattcacatttccccgctgcaactgaacacagaagaaagagcagtggggcgggggccaagggggaggaggatgtgattccaatttgaaataccttaatgtaagagaagggttttatttaaaacagaattgcccagttccttctactttatgccttcgttaggagatttttttcccctaaagagcaggagcccagagtcattctggcccattttctcttctttttctagaatatatgtgtatggtgggtatccttcattccccaaggttcccagcatcagagctcactgttcctggtccaaagggcagtg

SEQ ID NO: 61863 - DNA, 991 bp, Bovine  19866880465549
ggtgcttttgtcttaattaaaatacaaatgaataaatcgtcacatacatatattgaatataccctatagagaagtgctgtcctaggcagaatggaggatagaaatgagtgtcagacatgatccctgacttcacaggtcttagaaagtgatcattttcttcatatatttagcattagacatgtttcataaataattaaattaatagtggtttaagaattccaattgctagttaagaatcatattaagaaaaatagcaactttccagaaatcattatttaatactctttcaagtctaagactattagccttttttcaaaatagaagttaaagtatgttgtcctcacagtgaatttaatgtatgaaaaatttcattcaaatgacattatttctatttaaagttttgatataataatgcagggatccccaatcacgaatcagtattgggccctggcctgttaggaaccagtccacacagcaggaggtgagtggtgggagaaaccgaaaactctgcctcccacactgatctgtggaaaaattgtcttccatgaaaccggtgtctggtgcgaaagaggttggggactgttgcagtaatgtatgaaaccaatgccaacttctgaagaatacctctttttggatcactgaaatgttttaccctgtactggggcctcagtatcagtgagagtgatgtctgattcttcgtctacacttaaaaataccaaatacacatgccacctggacattgtcttgaactaaatcctaaaataaaattaagtgacgtgttcttgtcaaactcaggtctaggtgccgccaggctactggatgggaggcagtcattcctccagatggccctggccctccagcagacatcattttctttgtttaaactgaatccggcatcgtccttccggctgctggacacccaccaagggagagaactctaaaagcagaaatgcagaaagaggatagaagttaagggacgtagccaacagta

SEQ ID NO: 61864 - DNA, 1406 bp, Bovine  19866880760694
tagacttctctttgatgagttaggcgacaaccatgggcaaggaaatccaaagagtactatgagttgtaaatgatgcacaatgcagaagatgggaccaacgagcagaaattgttaccagcgagcatctgcaattcaaagcatcctggattataccacctacattctcacagcaacctatgagataaatacttgatgctgttttgttggtgaagatactgctctttggaaagatgaagtaaattgccatgggcacacaggaatcagaagtggatctggactgatagatgccagaggctgctctcttaatcacaatgatactatataccatttccccaattagagagacgggatgaactgattcaatgggcatgagtttgagcaaactctgggagatagtgaaggacaggggagcctggcgtgcttcagtccatggggttataaagagaaggacacgacttagtgactgaacaacaaaaatgacccgggtggggaagaagtttgagctctgagacaataaaagcagatccaactttgttaaagcacctatagctcaaaacgcaggctggtcttcccggcttgcactctgcagacagcccatattgtgcactggtactttctgtcacacttagacccaggtcatgtgatgacccttccatgccctccagagacaaaagatacactagaatacaatattaaacaactgcctcattttattccaagcagctgcttcccttgatgctacagttagaacagcatttggcttggctcatgagctgttagtgctctgatgggcttcgaaatgccacataaaataaattgatcatatctgagcatatgctctgcaataagcaatgagaaaaccagcctcgatattgacccacaaaattccatttctgggctggctcagtccatttttattgccctgtcatcacgttgcaatatggttgacaatttatatgcttatttagtttaacgacctagcgtaacatttactttggcctccttcagttgatcccacagagatgccaagagtagcagtccctcgcctgtgaggggtctcaagtcacttaatccataaaagagaaggtgcagaaagaggccttgaaatgttgaaatactgagtgaagtcactaatgaagggcttcacaaactaaatggacactgagctggggacagggaggagtgtttgaggagcaaacgctttttactctgttgctcatgttgctgtcttacaacaataagtatgtttgacacaggtgtgacccaaatgcaagtcatagcctccgacaaagttatcacgttgactacagaatacctaaaagggcagaaggtttgggaggcaaaattctaaaatgtgtgccctggatctggaaatccagaaagcattccatcgccactctggagcg

SEQ ID NO: 61865 - DNA, 892 bp, Bovine  19866880984851
gtattcagcctacagattttggttatacgatatatatgttgccacactttgcactcaaaagttttcgaaggaaaacctaatgtcttgtcctccagactgctcctattcctaatttctctatttctaccatctcttccagccacgtaaatttaaagccaccatcctcctcaaatcctccctttcagctgatcaccatttctaatcattttccaaatccgatagattccaccacttcatgtctctgagatggaatgttagcatgaccttataacctaaggcatgccccactcgagtctgctctacccaaatctttgtaatacatcattggaccaatgttctttttcaatctgtcttctagtcactactggccccagtaatagtaaaaccataacccctaacccacatacccttgatcaaatgaccctttgcttactgcttcctctgtccagaagttcatctaactcttcaaaggcttttctccccagaaaactgtctaagatcaccctgatcagatacaccctcccttgaatctccagagcttgatgcttggccatctctcatcctgtgttccttccagttatttgtgaactcgatatgatatcctcctccttctccagatgtcatctcctgaggactgagaatatgtcttactcttgcccagagcttctgcagtacccactgcagaacatacagtatgagcttagtgcattgaaaaatgtatcatttctgaataaataatatactattgattcagctgaaatgtcccactactggacccattgctatcaaacccaagcaaatgtctgccagcctcagaagatatcccagtaagatcgtaaatagcctctcttagaaaccacagtctcattggcccacactatacactgcaggg

SEQ ID NO: 61866 - DNA, 898 bp, Bovine  19866881154827
cccgaaacagatccacagctgaaatctctccacgtccttgcccctgcttctgtgtttctatgatgccccagtcctgcaagtcaatcatgatcaaagttctagagacacatttggtctggctgttttctcttattaccacctcatctatttctgtacattcaagccattcctgtaaccaatgccctggtcccaccctcattggctcagtatcttccgagtggacagtgctgtcacctttgggaatcctgtctctatcctccatgctgtcgacagtgtcatcttcctagtgggagtcctggttatggccctcttatgctccaaaacctttctacagaataaagctcaagctgcttgcctcagtaatcaaaaacttactttacctggcctcagactactcctccaggcccaccatacagctctgtgaccctcctacagtccaaccagatttgaggatccatgaccctggacatatcccgttcatttacccatcatggtgcactttctctcatcattctctttctcctccatttctgctaattaaaatataggccattttccaagactggttcaaatggtctagcttataagaagtcctccgtcatttctctaacccttcccacctttacactcccataggcatttatctggaaacatcaagcacttaccatgttcgctctacaaggcctttgcaatttgtccatttgtatttatctccgacttacactaatagcagccactgagcctcctttatctttgtataattcatgattctagcataggacactatgcaaaatgggcacttaataaatgtatttaccattgaaaaggaatttagcattctagtggggtaatctctaatatgggttctaatacacagtattcagggcctccactgatt

SEQ ID NO: 61867 - DNA, 3330 bp, Bovine  19866881268009
aaccatttatagtttaactgaattccttgagtttgctttaaaaataagtaatagccaattttagtcaatctctaaaactgtaattaaccacataaaactttaaacccctcttttgtatatctgaaaatctatgcagtatcactaagatatatttttcctgcacttgaactctgagtctttaattaacaagtcctactgtatagcatagggaactatattcaatatcctgtataaaccttaatggaagaaatatgaaaatatatgtaatattgtattaatttctgctgtatggcaaagtgatttagttgtatatacatgtatacatgcttcccaggttgatcagtgttaaagaatccacctgccaagcaggagacacaagagacacaggttcaatccctgggttgggaagatcccctggaggaggaaatggcaacccactccagtattcttgcctgggagaatcccgtgaacagaggagcctggtgggctacagtccatgaagtcacaactgcagcagctgagcatgcgcacacccacgtgtatacatatatgtacaaatatatacaactaaaatactttgctgtacagcagaaattaattcaacattataaatcaattttacttcaatacaataaattaaaaaaaaaacggattgagtatggagtggctattaattaagtccagtaattccagtaattcagcacttcccctatagataatgtagaaagggcccatgtcgggagaaggtgattagagctcactgagcatgtttcctctaaaaatgaactagttgatatcttgggtaagtgtgtcctaatccgaatgcaccacacagagtgagtgggtcttgggcttgtagaggcctcagttctccgttcacttgcatatgtaaacagcactgtatttatccccacggtatcagtctactgtcacaaaggggacagcaatgagtaggatggaatttggttttgtccaggcacttccctggtggctcattcagtaaagaatctgcctgcaatgcaggagacttgagtttgatccctgggttgggaagatcctctggaggagggcatggcaacccactccagtattcttgcttggagaatccccatggacagaggagcctggcaggctgcagaccaggggcttgcaaagaattggatgctactgagcaattgaacacaagcacttcctttcagttgcttgctcttcctcttctgaccacagaggggagcattgggatcatttaaagacgcttagcattctctcaggacggacaaaaaggcttgaatgacacaaagtgttagacatctgagtcttttcaggattggttttcctagatgaattcttttacaatatgtgtttacaaaaaaaaaaaaaaaaaaaaaggatgagagggaaaccaaagcttcttttaatggtttggtatgttttctttaatgtgtaatctaaaatagaagcaaaaacatctacctgaactaaggggaaaaaaaatttttttttcaattagattgtagtttatttggggcttcccaggtcgctcagtggatgaaaatctgcctgcagtgcaggagacgccggagatgtgggttcaatccctggtagggaagatcccctggaggaggtcttggcaacccactccagtagtttatttactatactgtgtatagttttaggtatacagcatagtgattcagtcttttttcagctatgcttcatgatatgttattgcaaggtaatgggtataatttcctgcgctgtccagggcatcctgtttcttatctatcttagtaatttttatctcttaattccatacccctaatttgtccttctgccttctctctccctttgttagccacaattttgttttctatgtctatgagtatgtttctgtttttcctgtacatttatttgtatttttttttttttttagattctacatataggtgatatcatacagtatttgcctttctctgtctgacttatttcataagcacactattctctaggcccatccatgttgctgcaaatagcagtgtttcattctttttatggctgagtaatattctattgtgtatatatactacatcttcttaatccaatcatctgttaatgggtgattgggttgcttctatatcttggctatagtaaatgatgctgctatcaacactggggtacatgtacttttttgaattagtgttttcatattttctggatgtatacccaggaatgaaatttttggctcatatggtagttctagttttagttttgtaagcaacctccacactgttttccatagtggccgcaccagtttacattcccagcagcagtgtacaagggttttcatttcctccacatcctctccagcatttgttatttgtaggctttttgatgacagtcattctgaccagtgtgaggggatgtgtcattgtggttttgatgtacatttctctagtaattagtaatgttgagcatcttgttcatgcacttgttagccatctgtatgtctttgatgtttagcagtataattttattggttggtggtattttcttggttgtgctattttctaataccacaatgaggaaagatgtgaaataattttgtttggcctagagcaagaacttgcaaacatactgtattcaataatactctataaacttgcaagcatccttgctcaatagggtgtgaaagaaccctatttttggtattgagtttatgagattttagatatagtttctgaggcttatttaaaattaccatgtttcatttgcagagtatatgatttgctaatttatttgtatttcaaagagactgaatctttaaaaatgtctttgttttggactaacttgcttaagtgtcataacttgtttctgaaattctaatatgtgctggtataatattttatattgtatattagtaaaataaaaatcctgattttccctttttttttttgtagtgaagatagtttactctgtataaacaatatagtaaaactgtagtggcagaataaaattgtaaagttaacccctcagagatatataacatctctttgttcgtaacatctagttgttttcaaagatactgtttactaacgtttttaagtttaacttcaatattttaactgtttgtggctaatcctatgtattcttttgttcaccttcaaaggttatattttttgacacatgtttttctttttaaggttgcattttggacatttgcatttgtcctctctcatcccaatatccacaggaccattatggaaggcatatcatctgtgtttggcacagcaggtactaacactgaattaaattgcataattgcagttacat

SEQ ID NO: 61868 - DNA, 891 bp, Bovine  19866881424853
ttcccatttaaaaatgcaaatcataaagtgctttgataagttacatgatgaatccaatcccccaacccataactactaatgcttatcatttcttgaattccaggaatcattctaaatgatttacatgccttaacttacctactgactctccaccacagtctgtgaggttggtacccatatatccccattttacagagtggaaaactgaggaacaattaagtaactttgacagggtccatgaggaaatggcatgactaggcttcaaactcagggagtttggcactagaattcactctcaataccacagaaatgaagcagatcaaaattagtacaagtctacatttaaggaaatacaatctatttcatgaccacctgaatcccgatcaggataactctaatttattgacaatgaggagacacacacagacacacacacactcacagataccctcttctgcctaggataatcatgttaagaaatctgtgaacaccagatcttaaaaaatcagtactgggcttccctggaggtccagtgattgagaatccacctgccaatacaggggacttgggtttgatccctggtccaggaagattccacatgccaaggggcaactaaacccacgcgctgtaactactgagcccatgcactctagcgcctgagctccgcaacaagagaagccaccacagtgagagagcaggcccttctcaccacaactaagaaagcccttgcacagcaatgaagacccagtaaagctaaagtaaaataaacacacaaattaaaaaaaaaaatcagtactatcctaactgatccatggtatacagattgttctccctcggcaacccaaatatgaagctctccagttttaatctcatctacgtgtgctccatcat

SEQ ID NO: 61869 - DNA, 1734 bp, Bovine  19866881539005
ttctcctctgtgtcctaagctattgctcttgaacttgctcttagcaacaaccggagctacctgcttgcttgttcacttctagtgggagaggacagagggggcctctctcctatgcatagaagaaaatcgtctctcccttgaatctgatttaccaatttaggccaaggatgaacagttgtctccagggaaacaccaggcaccaatctgcttacctacccctcagcttctagaacaacttctaggaaggaagacagaatttccatggttggccaaggctaattataaccattttggtggtggtggtgatggtttagtcgctaagttgtgtctgactcttgcgaccccatggactctagcctgccaggctcatctgtccatgagattctccaggcaagaatactgggagtgggttgccattcccttctccagagaatcttccctacccaggaatcaaacccaggtctcctgcattgcaggcagattctttactgactgaactacaacaaaaaccaaattggtattataaaacatataacaaaggaggagttgaatggatgctgttgagtaagtcataatcacaaatatggattggtttaattatgttcaaacaatggagatgagtgccttaagttaaaactacaatattttgaatatagaatttttaaaggatttgtatgttcactgagtgagattttgttctaaacaggtatctacatttctccaacagaaccatctccaatgaggaaacggtatttattcgatgtaggctgtacgttttcaaaggtcagggaccgtgtctatctttctccatgctctattcttaatgcttagtacagggcctgctacaggtgagatgttcaaaataaataaacattatttaagatgttcttaaataaacagtaagtaacttgcactagaacagggcatcacattgaatagtcagcctgggtaccatattaatttaactctaaaagacatcaaaggcaggttattatagaaccaaactaattcaataaacaaaaaccacctaataagttgctgtgatggtccaagttaaagatgttctctaaccccagcaaatgtccatcataacactgctatggacatatcaagaaatactgatatttttatctttatctttggcttcccagatggctcagtagtaaagaatctgcctgccaatacagaagatgcaggagactcggttcaatccctggggcaggaagatcctttggagaaggaaatgcaacctactccagtattcttgcctggaaaaattcatggacagaggaacccagtgggctacagtccatgggccgcaaagggttggacacgaccgagcacacatgcacactatctttatctttaaaaaagaagtcaaagcacttcaaatcatccttataggaaagttgagcatttgaaacacaaacccagctttcatctggtagctgcaattgtaatatttaattctcatgaggtctcctatcagaaaccactgcagacattcccagaaagacatcacacaatatgatgggccaaccaaagagaatgtggtctcctagatttcctttagtttcgatagtaaagaaaagagggattaagccaaagctttccctctctgagccttcatctttctgcagactttctggataaatgtgacccagctgtcacactgaccttccaggacactggtacttcccgctcccaaatgccatgaagcagtccaagaaagca

SEQ ID NO: 61870 - DNA, 3122 bp, Bovine  19866880373428
tgaaagtttattaagttttcattaatattttattttgtcctgtcagtgagtgctagctagttcatacacttgaaatagcaaatgctaaaaaggttcaaaatatctgatcagcaagagtccctccatctttcccgcagtcccaatcaagtcctctttgaagttccaaactccatggcccctggggcagagaaatctctaagcagagttataaatgtcccaagacctttaggcctgaggtttcacaatatgctataccctattcatcttcctgacggtgaaaacaaatgaaaaattcttggagtgaaagggagctggacagtcatattttttttttaattagtaccatcaaatttctctttgaaacaagttctcaaatcacgctaatcaacaattttttaaaaaatgaagaagtctatttctaagttgttaagcaagaaaagcaaagtgcaaccaatgatgttctgcttgtgttggaatttcaatgaaaatgtcatctcttattctcaaaagacatgcaagtaagtagcacacatcaacctatcttcttagacccagaagttgcactatcctcaaactctagaatgagttgaacacaaattattaatttcatggtaaaaccaacatgaagagatagtgataaaaaagaaatcattatgttgtcttaggtaagtccttcatttgttttcagccgttatttgtctcctggacatccattagccttcatcagtccttgctattttgaaatcaattaagatctgatacataaaagtttactaaaggagaaaatttcagagactgacaaatcatattcttaactgcctctttcccaaacttacccccaatgcagctgtttcactgatagggttggggtccctttagacgggatgtcatggtgtctccagatccaggagatcttgttccaactcaaccactgtgtagccatgagtaagctcttccttctcattctccctcattctcctcatctgacaatctttagttggtgggtctagaattatagagtcactttgtgtaaagtttcgtataaaccaagaggatctatcttaatgctttcccatcaaactctcaaatttacctgcgactctttctatcttccttcctttctccccatgagagtgagcagctttcttcatacctaagatcaactgtttgactgttgcttgggatcacagtctccatcttctaggaaatgggtcttaatcatgactgcacattaaatcactttgtgaacttttattttgctttttttaatatctaccaatctcattccagaaggaaggtttggaggataaagatagtggctgaggcatcagcattttttcttttttttttttaatttttttaaaattttattttatttttaaactttacaatattgtattagttttgccaaacatcgaaatgaatccgccacaggtatacccgtgctccccatcctgaaccctcctccctcctccctccccatagcctccctctgggccgtcccagtgcaccagccccaagcatccagcatcgtgcatcgaccctggactggcgactcgtctcatacatgatattacacatgtatatatggaatttagaaagatggtaacaataaccctgtgtacgagacagcaaaagagacactgatgtatagatcagtcttgtagactctgtgggagagggagagggtggggagatttgggagaatggcattgaaacaaaatgcttttcttatcaggggtcagacagcttcatttaagtgaaaagcaactggtgtttagaagcagtgcttaaaaaattatgggatccgctcttcttcatcctttttcaagattgcacagggatgtgttgacaaatacgtcatgaaattcttagtgaatgaaaacaagcctaagattagaagccaggcttactctatctatagtctcttaaatctgcatctgactcccaggcatcagcctgctgtattccactctgtatctgtatttgactggaagcgttcacaaatggggaagacataaaatatttagagcccatgaagcactcaggactgtcaaaaatgatctatttcacatacatggccatgtgctggcgcttttagggcgaatttgtccatttatgttgaatatacctacagtctttgttctcttggatttcattgagttctgtcataaaactaacaataagctttgagatgcacttgagttctgtttctttttcctttcttttcccccccccagcctttgagtcatgtatatgtgattgagagaggcagattgtgtcttcagaatgagtgagttttaagtatttaaatacggtaaggtttgtctatagtggctcagacagtaaagcgtttgcctacaattgcgggagatctgggttcaatccctgggtggggaagatctcctggagaaggatatagcaccacactccagtattcttgcctggaaaaatcccgtggacagaggagcctggttggctacagtctgtggggtcgcaaagagtcagacacgactgagcgacttcactttcttttctttcactttcttttgtctatggtttagaaaaggaatgactgccaggagtcccctacctcctccctttacgtcttcatgagtttatgtcttactgagttgtcagaaaagcttgtctttactgaaatttaataaagcatagtaagccatcacatgacacagaccaccaaggagcatcactctcacgcggcccttccttactgggtttattacccatcagttgttgctgttcattcactcagctgtgtccgactctttgtgaccccatagactgcagcatgtgaggctttcctgtccttcactatctcctggagtttgctcaaactcatgtccattgagtctgtggtgccatccaaccgtctcattctctattgctcccttctgttcctgccctcaatctttcccagaatcagggtcttttccaatgagacaactctccatcaatagtggatataaatgattttgactgaagagaatcttagcaggaagatattaataaatgtgtgctgctgctgctgctgctaagtcacgtcagtcaagtccgactctgtgtgaccccatagatggcagcccaccaggctcccccat

SEQ ID NO: 61871 - DNA, 1208 bp, Bovine  19866880449561
tgttcttgcctggagaatcccgggacgggggagcctggtgggctgccgtctatggggtcgcacacggccggccacgactgaagtgacttagcatagcatagcatagcataccattctccagaaaagctctaaaaaatgaaacggatacattttactgacaacttcaatttgcatgacctaccaggaaaatattgcctccgaggcaagaaatgagctttcacacgtgatctttaagcccttcccaagtggcaggacgttaagcattcagagaggaatgtcataggaattctaagaccctgtataacctcagatgcctggcttctctcctgcgctgcccctgagaagcctctaggacagagtggaaacagttcttagaggaaatgacccaattgctaagataacagtaatttatgcctctaaatgccccggaaagagatagattaagtgacaacaaaatcttcatcctattttttcttcttcttatccaacccacctcaaaatctatcccgattcacatttttaaaatactgcatgtatcagtcagggtaagttgagttttgtttcagtaacataagagttctgaacctcagaagagtaaaatgaaattttatttctttctcttgcaatgccaccataggcccagggagcccttggagacaggtaacctccttatggtagtccaagacagtctgcttcaatctgatgttacctccatagaactaagtgctttcttttctagcaagggttagttcttaaatgctttcaccagaattaacactttttttttttggtcagaatgaaccacatggtccttcttaacttcaaggatgaggaagcatcattctctacatgccagagataggaaagaagcagatattgtgaacactataatatcgatcataacaacccacttcccagagcaccttctctgcagtagcactttttgcagggctgcaaaagcataaaagcagagaaccctattagtagggcttattgcccaggatcttgctgctacagtctggatgtttccagccttagaactgtggtacatatgctttgtgagggatgggaagaggcacatttgtgtagtgctcaactctgcagagaggcaatatagtctaatgatcaagagtacggattctggggtcagacaacttgcatgtgagtcccagctctgacacttagtaccagtatgatcttagcaaaat

SEQ ID NO: 61872 - DNA, 2421 bp, Bovine  19866880471467
tttcccctgcaatggtgatgcttcttcctgatggggttggagcctccataatgcaaagcagaaccatgctggggactgagtgaaatgatctatgtgatggccttaggccagggcctggcgtagtgcaatgcttgatacctgatggctgctgtcatcatcatcatcattattaccatcatgtcatggaaacaggcttctagaaagctctgtggcaggtcctaggagggaaatcaaagaccaacgtggatgtacagggcagtaaggggatgggagcaggagatgttgagcctggacggacatatatctgagcatgtcttgaggcaagtatgtggggacaggtttttataaaccccagtgtttttcctttccttgcctcgtgcctcagtttccctgtatttgggattaaagaattggagaagcagactttttagttccttctagtactgtcatcctaactctgtcaccctgtcctggggttttgctgaaatgtcacccacccactcttcctgcagggccagaaactcccggtgacaaagtcacgtggtcccagagcagcagatagttccctggatgggaggacagtgtatgtggccaaccagtagccaactgtttgtacagatcaaggctgctgagatgcaaaatagaaacacggcaggggaaaacaggccctgtctctggaagagagatggctccacgatgagcagacccacaggacggtggggagcgctagtagggcgtctgaggtctccgtgtctgtctgctggtgttctcaccagcataaaaaaacggtgggtaacagggggtgtggggctggagattgacagagggccaactcggcatctgagaccctggcttctgctttggacagcaaacttgaccttgcgtgtggttatcaagtggggtattgtccttcccagtgggttggggggcactagggagcatgttttccattaaatgacccctttgtggggtcgtggaaggccgtggtgactgacctcaggttcattcagagcaccagggcccttccagccaccagccctccaacgcacacacacacacacacacacacacagactgctgaagacttgaacttggagaggtcaagaggttagtcctggcccccctgggcaagtagcagggaagtgaaacaaattgacaataccaattgtcagggccaagttcttcaagggcagcatagcctgtgtctgcagggcctgcctcagccttgaacaaaggtgctgggatgtgcctgaggccaggaaaaaaaaaaaaaaagccttcagggtgagacctcttctggagccacagggctccctgatttcaagcctgtgctcggcgtaggagtccgcctgcctctggagaggagcagggtccggcggaggaatgcaatcttgccttgttcgcccagcaccctgtttgtttcccgcacagaacaatgacctctcgtgagcctgtgctttccaacctcaccgagggttactgtgcagccctgattcctcccctgattatcttgaagcctgtcaagctgtaaggttctccctccgctctctgctctttcttcctaatagacatgaaacagtccagtcaataatattttacttgtcttcccactgcgtgtctcttcttctgatcagtttaggcgggtttgactgcagaaagtcagaagggaggttaagatctgaaaagttcagccaaatgttatcagcctcagagatgttgctaagggagaggccccccagcccttggcgaccggagccaataatagctgcgatgcactgatagcgtcaacgcctgtcagagatccaggcgtttgcggttcgtctgtaaacgcaaacacctgtatccagtcaagctatgatggttatcctctctttgcctgtcattcccttcggttccttgaaggggctgccaggatgttctaagctgtgagttgatttataaggtgaaggatctctccgaaactttggcatggacggggaaattgactaaacgcacctctcctccagggggtgacgcggccttttgacaatggtgagtgaaatcgacggtctccttttaattacatttttgaacccatggcaccaacggctgagctgtgggaattgggggcttaggcagacttttattgtctacatggccattccccccaccccccccctcccccgccccttgaaaggactcttggtacttgtttgagatttttctgtgtgatgaattagatcaaagtgactaataaacagtgtctgtggaagctcttcagaacacagtatatgcatatttgagatatttccaagactgaacaggcaaggtccaaactgtgaaataaacttagggtgtaaggagaagacagcttatgtgttgacctcccggcaggggcgagatgtgtggtgggcacccggctttcctcagtgaagcattgag

SEQ ID NO: 61873 - DNA, 1584 bp, Bovine  19866880563791
ttctggactttgctttgggctgaagccatcccctctccaaggatcctcagactccataaaaagctttggaactttattctcgtgaaacactgacctaatctttgcatggagactgctatttacattaaaattggtcacataatgaaaaaaaaaaaaaagtagctcattaatatgctaagaagtgctaatttgaacattgctgaaaagcaattgcaaattccattttgcaacttgcaaatgtgatgcagtgcaaattaaggctgatggactcatcttcagacattcaaacttcatctggatacttccttagcatccaggtctcagctgcatccaccggcttcaagacccaaaggggtgacttctccttcatttgggaagaaagagcgtgcctccagtaatgggagggttccactatgagccatttctacaacgacatctggtgagtccaagtaagggcatcatgaggggtgctgctgaaacgacccataacgaaagaataaaataactcccaatcttcaccaacacaaatcctctgtaagatggagccataccagattcacaacttccagctggatcccagcctccagctctcttccgacaggtgacctgtgatgccctgttgacccaaactggcttgagaaggtagcctgagatgccctctctctgccgaggaaacctgtgggagtcagagccagattggcaagtgtcagccactgttctccctggggagcaccaggggcaactctgtggatgggaaataaatccgaggactatgtcacactcgggagttccttccgtcttcctgccaccctccctgctgtctacacaggcagtggaatcagaacttacatggagtgagggtcccaagtcagcacatacagggccatctgtgtgggcctcagaagacccttaagacagcatagcatcggacaccaacatccttctcctgctaagtgcagcatattcaccttcctccatctttggtcagttattccttcttctgtcgaataccagacgaggtggctggctggctttgggggccgtactatatttttgaagtgtgttatctacaaacatataaaaacttattaaacacagcaagatattccagctctgagaggtaccagtcaggggccccaatactcattgccaaggcttgccaccttggcagggtcagcacaggcggaagccccttgtcgttgccccactccaggtgatttccctggaggatgagcagccccacctgctgtcccttcaagtcaggagcatttagtcctgaccgcatcctcagctaggcctcaactagactttgctctcttgactccctccccactgcttctcaaaaggatgcccatcaaacaaaaggatgaagtaaagagatgaagggacctgggtaaggcaagagcagaaacgttagtatagagccagaaataagcttaatacagagtcaggtgaacatgcagtgccaagagggacatgaaaaacagcttccccggaggcagagcaaacggaaacaagaggcgtgaagaactctgtccagaaaactgaaaagggtcttctgcagctgagggctaagagaagttt

SEQ ID NO: 61874 - DNA, 1787 bp, Bovine  19866880589931
actgaattttttaagtggtggagctgggatttgtcgttgctgttattttttggatatttgtttatttgattgcattgagtcttagttggggcatgcaggatctttgatcttccttgcatcatgtgagatctttagttgcagcttagggagaacacttagccactgcatgagggatttagttccccaatcagggattggacctgggcctcctgcattggaaatgcagaatcttagccactgggccaccagggaagtcccaataaaattgattatgatagaagctaaagttagaagaatactcctcatctccatcatcaaattgcttagtcttaaagcataattattcagattaagctattttgagataatgacttttttttcttttctttttttgaagtggccaaactttgagttaagtgttcttttggtcaacaggtggtaaggttctagcacacactgaagccctccatggccgcccaagcggtggcagctggtggcagctctcctggtctgcacaaaagccttggatccgattatttagggagccgagtatttttgttgatgagcaaaatgaaatcctctgaaagcaaaatcaatcccttgcagagaccccagagcattgatcctggtgcccattgacaggcttgggctgttgagctatttggaatgaccgcacaaaatgagcaagttgttacagttttagagttttggtatctattggcaacccctgcactcatatgattaatcacacattcaaaatgtgcgcgctgtggaaattgactgcaacgcagcagaaacaaagttttcagttatcctcgtataataaattgaagctatatccctaagcagaattgtcttcaggattccaatttgccttgttaaaagtgttgtttatacagtagttagcaaaaacgcaagtaattacatacagaattcattctaagcaattctttattttcccccatcctttattggttttccatcttcattacccaatattttttagtcgatctcagcagaaactggacgggtgagatgtggccaggccatgaggcttggtgactttcctgattcagagagagcatctggtcaaggggacaaggccggtgagactcacacagcggctggaggccttctgccagctacagggctgcgctgacaaggaggaggcagaagcagcgtgcgtgtggtattgcatttcataaaacaacatttacctctggagaaggtttctacggatttatttatttatttttgagcaggagcacagttttgtatacgcggagtggtgtggctggccacatctgtttcggttgctgtaaccggtgggactttatttcataaatatcatctgagccgggaatacagcttttggaatgcaaattatgtttaagtgagtaaacatttcggtggctgggggcccggagcgtaggaagggagaggggcagagggggagagttgcggctcatgaactgggtccaggtggaaggcgggccggggttggaaggttccagctggggagggaaggggacaggagcagccccgaggggaagccctcccagaaaacccccagcttcccagaggctcctgctcactctccccagaacagagacctcatccatatctatcaggagaggcctaattatagagctcggagattttaatggcacagggaaatttaaatgcagtggaaaatatgaatattcctaagccagcagtcaaaatacaaaatgattggcttcagaatcaatgaattataatttcagagcgcgtcctcaaaggtggag

SEQ ID NO: 61875 - DNA, 1308 bp, Bovine  19866880594859
ttgcgtctcttagccttggttcactaccaaagacagaaaacaatacatgctatgagctccgtatttgttagtaattcttattgctgtagtggtcctgattgttaagagctgtcagctattcatcctcaagttcaggtcccaaagagcaggaggggacataaggccgcttcagctctctatcgcacgaagaggaagcgctttcttgctcccccccctaccctccatgcctgtcatgtccagacaaccagacagatgctcaggactgcaaggtgacaaatccactcacaagatacagcttgctaagtggcagtggccttttattccctgacatctctccagaccgttgaagggattagaactggattagtctgagatgagcctggctctgccgttatcacctgtttataggataatgacattatctagtttggcccataagggcctccttccatcggagctttgttctctttgatcttgagtgttgcaggcagcgtatctttaaatctaaacaaacccactgaagcctcaagataagtggtcaaaacatccagtgggaggaaaacagattccccctttccgggctgctcaaggccaacagtaattttaaaactgtgcagactttctttgaacctaaagcttaccttcccattttcaacactggcctcccatgtcccctttcacacatgcagcactttaaagtttgcagacctattttacctttgcttattaactcagttgatgggcagggtgggttctatgcctatggtgcagaggaggacaaaaaacccaggtttgtgaaagcccaggtgtttgccagcactcaggtcatttccaagaccagtactgagactaaacccagcttatctggaaaaattcagcatttattttatccagtgcctgtagccatctaagacctgcctctctgcccaaacagctttcctgaaggctgatctctgcatagaaacatctgtttagacagaggttccaggaggaccttggctgaagttcccttccaaagctctcctaacatccgctctacagtactttattttaaatcatctttattgaagtataattcaatgcagtgagacctgttttaagtgtgctgaccatttgttgcatttggggaaatgcatagagttgtgtaaccacctccacgaccagaatttaggtttccatcactccccaaaggccttcatgttccctgaattcaaactgcatatcccgtctgcagcctctgacaacccctggtctttctgccactatagttatgccttttctagggtcttatgaaaagggatcacctgg

SEQ ID NO: 61876 - DNA, 3051 bp, Bovine  19866880613228
tgcctgaggttcctactgggatggttaggtgaataagtaatagaacaaacacggagtcagctgggcaaaggaaaataaataaaataacagcgtgttcttggttctgagagccctgccacacgagcttgttcccctcaggtcctggagcttcagactctctgatgaaatggggagggcggggggagaagggtattatttggaaacacatgtactcattccttgtgaaagaagtgaagtatttaacatttctccaaggaaaacatctttcattacttgacgtgttctgtggtaatgatttttcagttcaacaaacaagtacttattagcgttcgcacgggaacctatctgaggtggatggcggggccatttttaacgggaactcggcagccagggttaaagggagtctggccggtcactggtggccctggtgccgggacccaggtctgctccagacttctcagagcccgtgcctctggcctgtgggctcaagctggcaagaatcaacaaagttgcttcttcggctttttgcaaacaggacatttgactttctggtatgaacttgatgattccacatgggttggcctggagagatggcacgctcacatgccaggagtttggctgaggatttgatggttaaatggattgttttggttaaaaatgatacagagggaggggaagcggtgaggtgtgtgggtgcagggcaagggggggcgacttcctctcctgaccccaccctatgcacctctccttgcttgagcagctgtggactctgctgcccacggttaaatcctcctgattccaggtggccctgggggcagctgttagggctctcagctctctctctgtgggcgtggagccttatctttaaggcttatttgtccccagttcctagggacccttgagcatgaccttcacccctggtttattttgcccatcttttctcctactagataagagtgtcatccagtccagttgcaatcctggcccacaatggcgttttttctgctttacctgccattcatattttggtgtccatgaaattagacatagtgagagctgcggcactttttcataatcccagtaaacattttccttgaaactggagccccccaccaaactgagaatgagtattgatgggtgatggctttgtgcagatttcatttttggttcagttcccaaatccagctgataatctcagtgtgtcagccccaaatcacatctgattacgggtcatctgccctcatcgcccccaaaagcgtgatctcagcttacatcccaggaggacgtttttctccgcaagtgagaatcctctcttgctctcagatggcacttactcggtggcttccttctgccttgtcagtgtggggaatgtagcggttaacactgtttatacattccaggagtattaagcagttaggttactggaactgtggcagagcttgtgggagcagcattctgggctgtgcctctgtcatcaattactgagcatttcatgaaattccagatgtaataataaagtttatgacgattatattgtcaggaggtacagagcacacacctcattgacaactgaagaaacaggttgagccagcagttagacggtgatgttagcacacgacaaagggtctttcaggaaacataatttgtccctcccgcaagcaatcgtatgcatttttgtgaatggaagcatgcgttttggagccccagctactgtaggaaaagggagagagtaggaaggggatgcccttggctgtacggagcatgtacagcctaccttgtggtcgccctggcccagaaggaactgtgctgaggaggtggcctctgctgttggggaagcaggcatggcagagactcagccactctgcccagaaagagcctcccttcccatggaagtgcagggtgccctggtgaggaaatagaaaaatggatgttctattaaaatcaatagactgtcacggcctgaccggatagcacagacactccagtaggtggcaattggtggacacgcagtgccagggcccttggccgcagtgagacagcgcctgccttgcttcctgcaactgtgtgcagtttcctctccctgtgcatccatgacatttccagaaaattcgtctttaccagagggtttcacttccctgtgctacggcagagcacggcgagcagagtagagcagcggtcaggaagtttcctggcaggtcgtagcctggtccactggaaattaggattgctgtgatcgtttgggtgtttgtataaaggcagatgaatttttaaaaaacaattcatggcagacacaaaatatctgtgacaaagacaaaagcgataaatataagctattgcatgctatgagagaaaattaatgcacttcttttaattcatcaacgaaccaaaaaaattcttctagacatgtccttccttacaggcacatttcctgtagttccagtataggtgagcccatgaaggctgggcattgccctgtgcaaatttcctgtaagaaccctgcttctcagatgctttggtttagttgaagtgtctctctagggcagggatgtgttgctgtttctttcatggagcctggagagggatgcaggggcagagggtcttgtggggttggttctcacctctgctcttgggtagagggagattgcagggggcccacgtccacctgagtgaaccgggcaggcgctgcctttcccactagcgtgcgcccatcccttcattgtggggtcatctgtgccgggggcagtgagggggcacacagatgctgggtatcccatgccctggggcactgaccaccttctctagacagtatccccgccagtaggagcaactgggaaaatatatttccaagagtctccatccgtatccagaatcacgctcccgcatggtctgcttcatgaccaagaggagataggagttccagcctttttttttttttttaattttaattttagatggaacttggctacttgttaaaaaagctcattgatgttttgaatccaaagggatgtggaccacacagcatgctgttgttttttttctccccacccccat

SEQ ID NO: 61877 - DNA, 2134 bp, Bovine  19866880619591
tgtaaattttaaaaaagagaaactgagaagctggaggagagaaacaaagagggcaggagccaaggccattcccctggacgtccacgtaggggagagaagcttccagaattggctgctgtgcccccattatcttgacaactgtcagttagagcttcagtgctctccagggccagccttgattgtgagcggctgatgttgtcattttgttctcggttttgccttgagcgcgctcataagcaggagccaggtagtcaataactgatgtatcagcagttattccccaaattgcctcacaagtctgcgttttccctctttttttaaactaaagattgttttgtaaagtgattagaatgaaaggtgactgctcagggccaggggaaatgccgtgaaacccaggtgagttcccagaatgaaaacccctggttccccgccctccacttctgggattctggaaggggaaggatcagcttctggagggcaacgtggcatctttcctttttcctggcatctggcagagccaggctggggctagggctgcagatgcaagcagggaaggagcagggagaggatgggagtcctggttcgggtgggtgccccacagccatctttaataacaggagcaggccagttagccgagcacagtttgtgaggctttcctgctggcccatttttattcctgcctatcactggacaaactataaaaatagctttagtcttgtagtaaaaaaaaaaaaaaaaaaaaaaaggtagggtgtgtgtctactttctgtgtttgtctgcatccagcccaggttgggaggcctttcagagaagctgttttgtaacacccctggaacctcaccccgtagcctgtagggaaacaggacagaacatagcggtggtatcacgctggaccttctcaggtgttcagtgtgtgtatgtgttctagttatgttccaaattgcggtttctctgtctaaagttaaaaaatgaaaggtgaatacaatatattgtatttggtaacaatgatatggactggtacatcgagacagataatgtgcacttgtaattagactcaatagacaggcagtcatttttaaattcttttgacacatgcataaaatagtcatataataagataagatgacaattttatgttaggttgataaagtgtcctgatacatgcatttaaatgtctgtaagccttaaaaaaaaattcagacagattaattctagtttccagtatttgcagttagtcattaaattaattttcaaatcctactaaacaatggctatgaatatgttttttttcctgtctttcttgagtcttatacctgattgtaaggaatggatacatagatttggtagctttctcttaatttttcaacatttgtaaacatttatgttagacatgggtgtaaaaattcaggttactgtttgtgactagaaacatgctatgcagttttagaagctgagaaaaaacaccagtaatagaacataatcttcttatgaccacttgcctgaacaactgtcatactccacatttaggaatctttattagaaagattacatagtgtccttgaccaaatattgaatattttataagccccatttaaaaaagaagacattttgagcacatacacttgatttgatcagcacttagattcttgggcttagttactttcaattttgtaaattattttagtatttcaacaaaagtggcccgagagacatatggggcagggggagcatttctctaaaggtcacgttacctggactttttgaccctctccttaccttattttctcaagtgtgctaaggtgtggctcttgaagaataatttaaatttgtttgggcttaatgataaattattaattcatactgtcaggacacatgttattaattatgactgtgttttcttcatccagaacagctgttggggaaacagtgtaagttcagattgtcttcgagggttgggagccaaagcaaggaacttaccaactccttgtcatcatcttcctgattcccttgctttgggaataaaggattgcagggggcggagtgaatcggggagagaaactactaattctgggccaagatgggtgctaacaaatgctcattcatgtacctttttagagagcaagcctaactgcca

SEQ ID NO: 61878 - DNA, 942 bp, Bovine  19866880697963
ccaggctcatgggcaccatgatatgacagaaataaaagtaaattatatcacttgtcatcattaagaaaaattttcatctccgttcttcattcgaaaagcactatatttaatgaatgagtactgagtcatgacatgtaaatgactgaaatattggaattatactaaggtcaactaacgtatttttaaaccatgaaattaagggatctattcatgcctgtcgacagtgccactctcagtgattatgatctctgcaaggctgcccctggacactggggaatggtggacagttctacaagatgtggaccagcttctgtggaaactctcctgtgatcaaattgaagaaatctcgctgacctgtttgcccaggttctgcaagcctcaggacactatacatatctaatgaaggaatggctggtcttgtgcaaggcaagccgcattccaaagagcatcttgtagatttatcactcgtgggagagggaacactggctcctgcggttcttccaaaatggtggcccccacaagctgtgcgtcaggaaagcagatctttgtcagctgcattaatctcctctaattttctctaagaaaattaagatgcctcaacatccaaactctgcaaaaattttggtaaaagatggaagagaaaagataaaagatgctaaggtccaccaggaaacctgagatgagaaaagttatggtgaggaactatcttcccaggaccagacactttcaggctaaagtgggcatgttttcatttttgcaccctgcagccattttcaattttttggtaaaataatactccagacttcttttgatgaaggactcctttccattctcggtcatgaagcttaggtaggatttaccctagatgcagcaccaaatttggacactaagtgtcctaagtccatgaacatatgactttaccctgaccacaggaattaatga

SEQ ID NO: 61879 - DNA, 605 bp, Bovine  19866880709295
attcctcccttgtttctggctgtaccttctgcaatcgaactcccactctgccgcagtagcgtgcaacctacactccccgacctcttgcctacccatttgcagatggccacacaggtgggagatgccactgcctttcagggcctgagccattatcctgggataaagtctaatgacttagctgtgggcaccaaacttgttcgtcttgaactcactttgattcccctgggacttacgtggaactcgctgagcaagcgaactgccctaaattaagacatgggtctgtccatgctttccagtgtgtttaggaaggctttactctggattcgtgtccagtccctgatcccagacccactccctgggatggatacattttcaccacatttattattgtttctggttcccgctttccaaattgcccagagacaggagtcacctctctgctcccctcaaccctaagagtattttgagagcagaaggctggctaactttccagtgaacttgtatgtaacaatccctaaccagccgagaatacattcaggaagccaggtcaatatataatctctaacagtcagcctgttaagccaccagtctccttgacagacatt

SEQ ID NO: 61880 - DNA, 1306 bp, Bovine  19866880718664
tgaggaagaaacatgtttaaatgcccccactcaagtttttcattaagggattgcatagctctgtctgaatgtggtcacaggctatgaggccactacagtcttgtgtgaagccagacttgcaaaaagagggaggagaaagacgtgttcaaggagcccatgtcttcagctgagactgcagcctggaagctgaaatgagcggcagaggcagactgcactgctgttctctgattccagcactcagatcaggatacaaacatggaatttcaagctctgcctgcgtagaaaggagcttaaatgtcatttactctgacccctaatttaacgtttctttcctccccaagctttccttcaagtggtcacatagcctgtgttgaacctctggtgatgagaactcacttcccaagtcctatggaagcaataccatttggggttgatgcaccctgttctgggtacattgccacctgtctaaagttctcagtcctctgagctgctcagcactcgcagcctcctcttcctctggaagctcttcaaacacagaaagccagaaatgatggttcccagtgtgggtatattctgagctgaatggttgctattccctcctcacataagcctggtcctgtatatctaaacctgtcccaatctttgctgctgctgctgctaagtcacttcagtcgtgtccgactctgtgtgaccccatagacggcagcccaccaggctcccccatccctgggattctccaggcaagaacactggagtgggttgccattttctcctccaatgcatgaaagtgaaaagtgaaagtgaagtcactcagtcatgtccgactcttcgtgaccccatggactgcagcttaccaggctcctctgtccatgggattttccaggcaagagtactggagtggggtgccattgccttctccgtgtcccaatctttactgaccacaataattttcagtgtgatctgatcagcacagtaggacagggctccttctcatcacctccaatgttctctatactatactcccattaatacaaccacaattgcagtgttggagaagactcttgagagtcccttggactgcaaggagatccaaccagtccattctgaaggagatcagccctgggatttctttggaaggaatgatgctaaagctgaaactccagtattttggccacctcatgcaaagagttgactcattggaaaagactctgatgctgggagggattgggggcaggaggagaaggggatgacagaggatgagatggctggatggcatcactgactcgaggacgtgagtctcagtgaa

SEQ ID NO: 61881 - DNA, 976 bp, Bovine  19866880751621
caattaaggaaaatattagttcttctgaaaggaaaagagctctcttgtgaatttggggcatactggctgtatgtgtgccctagtggtaaatatggattttattaaataaatctgcatcttaacagcagaatctgaggctcagccaccatcatttcccctgtggtaaaccttggaaagacacttcatgtagaaactaaagaggaacaacattatcgcttggcgtggagcacagcccttaccagagccatcactgaaatatgttcacaaccctaaagtttgtttctgatttgcaagcattttcacatttgataagcacctgttgtaaatttacatccactcaggaagtattcttacgataggaagctgtgcattgtaaagcatatttatattcttacccttgtgcagcgttgccgcttaatgctcaggctgatgaaatcactggctatacaggacccaacgggaagtgcagcaccacctaattctcatggcatcatccctgaggaactgcaggtcccttccccctggaaaggattttactggcactgatcaacaagcacttgggttttaagtccattaacttgaagtgtgtgcgtgtgcacgtgtgtgtgtttgtggaggctgtgggggtggaatgacagacaaagagaagcacagacttcacacttccttgagatgtgccattacactacagaatcaagaaaccatccccaaataagtaggagcctcaggccctgagcgccagggaaaagcaggcacaagcctctgatggaacccagatttccaatctggtgccgctgcccacggaagggaacccactggccacattggcccctcggtccctgatgtttctttacaggcccatggagagtgaaaacgccccaggcagtccactgccaggctgccccgggggggcctgcgggctgtgagaatcccctggcttggctcttttggcagatccgtggcagccaacatccat

SEQ ID NO: 61882 - DNA, 1744 bp, Bovine  19866880777616
atgttcatttgcaacagctgcctgcagttgggaaaccagatctgctttgtggcatccttgatcgaagacaatccgtctggggctctgcggcctctcccaccatcgtcctacccctgaggcagtcacgcagttcctgtgggctgtgtacagcccagagtccctgagtatcaaatactccagcactcaagtgacaatcagaagacatggtctgagtggcacggtaacacccccgaaatgccaagcttgcacccaaaccttggctttgactcgcaaagaattaaagtcaacatgtgtctgggcatcaaatcagagagaactgtcaactctttcagcttgtcagttctgcggcactaaaatttccttcttaaaacagtatccaatttcaagtgtaaaggaagagaatggataatacagatgtttcatggattttgaagtatcgagagtctaaaactatcacttttactttatcagccacctcagaaaagttcaaagcatttttcatgaacgttttcatgcaaaatttcacaaaagcagacgggaaagatgagatcctcattttaaaggcaaaaatgaagggacggctagaggtcggcggacccttagcttctttcttctacatgtctttccccaatcccaacggtcagcgttacatttttaaagcactgtccctagacgggccaggctcttctggacctaccaggactggagacctaagccaggcactgaggggacgggtggctttgtgcccagtagaggcagtgacaagccagaatgctctaggtctaaaaacagctgaacagctctggcctatcctgccatgaagaatgtggacctcaatgaagccagataatctgatttttaaagagaagatgtaaatttaatagtttttggataaaattcagtgattttttaatttttgaaaaaaaattcattgcaagcaaaaaaaaaaaaaaatcacatctgtgagccagatactgcccaaggcagctggtttgcaacctcaacctggcatgtactgccactgatggcaatttctatctgtgcttaggaaagagagtgaaaaaagagaactcctattttaaaccacaaatgactgcaaacacatctgcctgctaggggacctacaccctttttctccagtttggagtattttctaagaaagatactgtgacggtttggggccataaacccctgctgtcaccatcttcagacatagtctgaaagggacaagtagatttttaaaatttatttttatagaagtttagttgaattactatgttctgttaattactgctgtacctatatacaatggaatactactcagccataaaaaaggatgaaagaatgccatttgcagcaacctggatgcaactagagattatcatattcatcctactaagtgaactgtgtcagaaagagaaaggtgagtaaatttttatctgcttagaaaagagagaatgtagggttttgggaaggtctgagctctgctgcaaataaagctcctttcttgttcctgtccagtcttccaagaaagtttactatcttcgcctgcttttgctaagatgaagcaagggagtgccccacacctgtgtcgatgtgaagaggaaagagtcactgggcaagtctccaaatgcctgaatgagaaaaagaagtgggagaaagaaggcacacagaactcctcagagatactggaaaggagggttcttggcttccctttgcaggtaggacaggatttgaggggttt

SEQ ID NO: 61883 - DNA, 1084 bp, Bovine  19866880791407
tttagcccctttttatttctgtttatcataattccaattgtatttctcatatttaccttttagtgccttgcccagccaggctgggtgatgagggagccactctggatggagttgcccccattcctggtgccaggtgggaggggctggctgtagggcctgggaggcagcctctgatttcctgtgccctgtccccgggcagtggcgagtagctctccccaaaggtaggccttaggagcccttgaggttcaccctttggaggagaaggggatttctcagcccccagttacagacagactggggagatgtcagtggctcttgccaaaacaagggatcaatccattttatatatagtagagtgtatctgttaatgccacattcctaataatagcacagggaactgtgtttagtagcttgtaataaccaattgtggaaaatactgaatatatatatatattattgaatcactctgctgtacacccaaaattaacacaatattgtaaatcaactatcctttaatttaaaaaaaataaccagttggtagataccatcagaaagttggagggctgatttggattcgtgcttgtaccacagaggaaaaagtagaaagggaagaaaaaaaataacaaaataaaggtaagaggaaaaagaaaaagttggatggttagcaggttatggtcccagtaatcttcctctcaggtcgcccttgcagggatatgtttattcgaggggctggtgcatttctaccaggcactcagggaaagcccacaaggaagggccctcttggcagcatcgctttttccccttaacctgggcccaggacaaaagtgtctgatcaacagtgttggtggtagggctccctactcttatccatccacctgtccaggctgcatctgtaaagtttagaagacacatatataagtgtgtgggatctctctttctcatggaggtcagcacctctcaaatcccaggaatgtagcccttccgggggcttcctggggatgagcctttccctggacccacccccccacccccaaacttctttttgacttttttcccttgcttgcttttccaggaggcccagagg

SEQ ID NO: 61884 - DNA, 1158 bp, Bovine  19866880807100
cggggcttcaaggctttcactgcccagactggaccctctatgtgaacagatatgctgatggaacccactctctgttccagtaagaaaacgacagcaccgacggtagtggaatctggctgcctgggaagctaacaggtcctgctctcagctcaggttcaagaaccttctgggattacacttgccagacttcatctatgcctggcagtggggggcgggcagggagaaagaggtggcaggaggaacctcagtcttcaaagcccagggataggagggaccttcagtggttgtagctgctcctgggatgaaaggcaagctcactttttcccctcttgacaggtctatctgcaaagtttacaaaagagaggaagtgaccaggatgctaggggcgtggtctcaagggctgggatggatccaggccctcccgcccccggcctatactccccggacactgagcatccacagctctgtgccatcacactcaccgccaatctcaccatctgcagctctgttcagtaactacaggatgaacatcatctcaattaacagcgtacctttagggcgtctcgtcgccaactcttccaggacaattgtccacactgtcatcagggcctaatcaactaatgatggctgaaaatgagggaggccaatcccaataaattcgaaggcaagtcatttttctcttttaatgcccctctccctccttcttccttcttcccacggcacaatgcagtaaattaatgtcaccgtggttattacagcaccgctgctatggcaagtattcaagctacggtcctggaatattttacctcagcatttatttgtccataaaataaaacaggatttatgggatgactctccagtttgagggctgcatggacagcagctgggccacatccttacctcctccacaggtaaagatatagggatgctctcgggagcaaaagaaacctggtggacagggtgcctggggctgggaagaacgagttccccaaaggacccactggccatgcctaggggaaaagctccagttaaaagaactgaagatgtgggaatcagttgcaggaaaaggatacagctttttgaggggaggatgcagacaaataacctactcccccagcattccagcatttggtaccctgctgcacaggctccgcagaa

SEQ ID NO: 61885 - DNA, 1033 bp, Bovine  19866880827568
ggcacctggctctgcatgccggcatccagacccgaacacaggctttgctgagatgccctgtgcatcctgctggccatcaaacaaggcctgaccgctccttgtggatggcagcggctccaggcaagccagtggcctcctgcagacatctcgagcaggaggaaacaaacagattaatctctgaaatttgatacccgttccagacacaagtagcaacaaacttagcgacaaagctgtcaaaatatgttccacagcctcattggcaagagatctggacacacgaaagaaattcagcaaaaccaaatcagttgccaaactgggaggtttgacagcgtgctcgggaatacatttagatcaaaacaggaacacatccaaaggagcgagtgtctccataaattattatggaatgattagaaataattagtcagtgatttcaaaatattacatatatttttcagtggtattgaggggacgtgttatataacgtgggattttgtttttacattgggtttttctattttttttttcttactgctctccagcagttttcaaaagataggggccacagatgtaatactccaccatgcaaatcacggtggcttaaaagaatacgtttttaggcaacagaattgcttcgcaaagcttctaaaggaagagaaatggcagaaagagagattcttgttcccttctgggcctttttgtggggcatactccctagttgcttttcctgagttagagtttggtatcaaaggggtttacatttacaaagatttacatttacaaaggcctctagcaggttgttggacaagcccctgatcctgctggggctcacccaagctcacagggaattccgaccagagccaggctggaaccctagcctcctgactttcatgctatttctttggacaggacggacctgggaccaaaagtcacctatggactttctgaagaaacttcattccagagacagatctttggcaacaagtctgttcctagcattcctgccacacatgagaagaattcttgtccaggcaag

SEQ ID NO: 61886 - DNA, 1844 bp, Bovine  19866880835439
tgtctcctccccgcgctttccctctcttccccctttccacagagcctcagttctgtttggttattttcctaccttttttcattattgatcccagacccaggaaatgcacctgatcttctaagccaatcaatgcacgccactcttttaggatctgttattagtccaagagtgacaggtgacctgagtgtgtccaatcagaatgaaggaaacaactcacggcctctggttagagagagagcctgtggttattcccatttacaccaaagagaagaaaagaaagcgagcaccccagctgtcatggcccaccagccagcaatcatgagaacagccaggcagaggagagagccaaagctgagtaaagagagaggcagagagagaaggaagaaagaaaggaaagaaagaaagagaaagacagagagagggagagagagagaaagaacagattcttcttttttaatatttatttatttttaattgattgatgattggtgtacaatattgatttgatttctgtcatacatcaacatgaattaaccataggtgtacatatgtcccctccctcacgaagctccctcccacctcccagattcttgatggaactgttgttagaatatgcatcaaacctacgtaattgtaaaaccacccctccccacaaagcctacttgaaaacacagttggagtcagtacacatgctttctactctagagcaaacagttctaaactaatgatgctgctcacatcattccctgccatagtgatgaactctggcctgtatcattggggtctccaccacccttgactatcttccagacaccttacttgaatcttttgatatttatcatggtgcttgaatgttttttcatagcaaagaggttaagttgggtgtgaagtgttccttgtaccacgtcatgatcaaaagtggggagatgagacctcaactaagaagactgagaatttcaagggaaataagagaaaatagttttcttatccctgtcttaagtcacttgtttgtgttacctgcagggctcctggggatatgtggtttgctgacagatttttaatcagcacacttccaaggagatgtgtcccgtggtgccctgtgtataggagtgtacttgccatctttcagcgagacatctctcctagctggtcccctgaggacacaccaaacggtgtcctggtggctcccctgcagcggcccagggtcagcctgactcagccacggcctgggcttgccctgaagcatccctcccctttctcggagagactttgtgtctgactcgaacacaattctctccttttagatgtactttctgagactctgtggaagcatatttaaaacattacaagcaaatcaaaacatatgataaatcatgaattttcctcctactcccagtggcctcctatagatgcaaactttgacaaagaataagcaagaagtaaaatatttgaggcagacagatggtagccctgaagttacaacttctcctcataactttaaaaccattgaaatcagacacttttttttttttccttcttgcagaagtttggctaaaacagaaggtggacagagtatctgagtacatctcacgtacagtccctgagtttctcgtgtccattttgaccttgatttcttgttggcttttggagacctcacacactctccaagaacagtcagctgggtaaagttcactgcagatcatctttggaaaaacgaattttccaatgaagacagcctcctgtccagtctgcagacagtccttggtcccacaaaagcagaatcgtgccctatttaaaacatggaaacaacagcaaatatggcagcaatggatagcaaagagcag

SEQ ID NO: 61887 - DNA, 983 bp, Bovine  19866880838315
aatgtgattatgatgaatagataagataggacagggtgtttgaaaaatgacttaaggactgcatgtaagtcactggctagagtcccaaaatgcaaattctggttaagttaatgactggaaaatcatgatggccccaactgcatgagcttttgcattatttaaaattgctttataaacaataaataattagcattttgtgttagaatgagttaattatttcttaattatttctataggcattacaatcccaacatcaaaaagtttcagtgtaattgacatgcagacagtcccgcttctgcctggcggtccagcatcataagttactgctcattttgcaagcggtgcgggagtgttcatgtcccattagaggtcagcactttattaaaacgtctggaaacatctagtttgcaggaggcttctttccctaagaagtgtctgtgcattctcctggatggggttttaggaagggaagttgtatgcccatgcccgccttcccctgacaaatgagacttatcatccgggcagttctatgctctcactcaccctctcaggagctggggatctttatgaaaaataaattaataatgcatactaaattatatctgcaagagacatttaggtgtatattgcagtcttcaaagatgattagatttacgttttgttcaaggagacttgtcacccccatcttccaggcacatcttgaactacaagtctgccagtgcagcccgtgcacggctggccatcccatggggtcacagccactgggctccaggtgccaggtgcaccgattaggaccacagccaggagaaccttgaccaagtgacttgactggagcctccaaggggaaagctggaaccttctgtggccagggggccatcagcgtggtctgcaaagggactcctatggctccgtctgcagagcctggtgtgtaatcgaagggcagctccatcctggatacttaacactgagggaaaaaagccact

SEQ ID NO: 61888 - DNA, 1826 bp, Bovine  19866880844852
ccttccttgaactatgatcacaaataccatcccatcttgcaagattcaacttgaatgtggtgtcccccacccctacccaggtatcattagtagtttatccctctggaataacctctgtagtagcgtttctatatgaattgtgatccgtttgtgtgtgtccttgtgaaagtagttggcctttgtagtagagcacctgtactgtgcccgtgcaatggaatcactcacaagattatttatgatcaaaagagagaacgcaaaccaaatgcctgcaaggcaggcttctgacaaaagtcagtgttgctcccttcctccttctgcttctgcatggggaggagggcggattggcaggccacagatgaatgaaatccatcagtctctcacagacttgccttcaagtctttcccaggctggaggagggcttggtgactcattatggatgattctgtaagtcacatattcttgacatcacctctaagtgcaataggtattgacttttgagaacacactcaattttttaaaaaaatcctttttattttgtattgaaatatatctgattaacaatgttgtgatagtttcaggtgaacagggaagggactcagccacacatatacatgtatccattctcccccacactcccctcccatctaggctgccacgtaacgttgagcagagttccctgtgctatggagtagggccttgttggttctccagtttaaatacagcagggtaaggacacactctttgcaagtgtgtgtggatctgcaaggagatccaaccagtccattctaaaggagatcagtcctgggtgttcactggaaggactgatgctaaagctgaaactccaatactttggccagctcatgcgaagagttgactcattggaaaagaccctgatgctgggagggattgggggcaggaggagaaggggatgacagaggatgagatggctggatggcatcaccgactcgatggacgtgagtttgagtgaactctgggagttggtgatggacagggaggcctggtgtgctgcaattcatggggtcgcaaagagtcaggcacgactgagcgactgaactgaactgaaggacacactcattgttcacatgctacctgggaagacccaaatcacaacataattgttctccttactggtttattatgtctcttttctgaaccttagtttctcccactgcagaacagttctcgtgtgttaagagtttcttcccactcagatactttcacagcctatatttggtcttgaagcaattatagaacctggggataaattagcctaaggtatttcctttgcccttcttacgtcctctttaattttgggttgtgcatttattttggggtctatttctttccctcttttcagtgtgatgtatggaaaaacagtgtttaaaagagaccttgtaaaattacacttggatttaagcagaattctatgaaatgtgtgcttaagcattttgggggtaaaaaagaattgaaacgggatattctcttagacttaagtatctgaaactggaaataagttgcaaggaagaaggaagtaagtatccagagaattccagtgcatcctttagggtctggctccctaggacccagaaatggtgcctttttggtgggagggcttgggtgatgttaaaaacgaggaaatgatctgaacaactacaatgattaatactaacactcgtcttcaaagagccatgagctctttagtatctatgaaatatatgaggcttcagttgaagtttttatctgagagatgtatctggggctctatttcatcttcactcagctgaaggcaaccttgagggctgcat

SEQ ID NO: 61889 - DNA, 1023 bp, Bovine  19866880880193
atctcttgaagaaaattgaagatatcgtgagaacatttcattcaagaataggcatgataaaagacagaaacaggaacagaagagattaagaagaggtagcaagaatacactaaagaactgtacaaaaaatgttactagtaataataataataatttttttgagggtacaccaagagtgttatttgaaaaccatgccttggaatgacttagagaaaatgattccattataacacttttaaaagttggcatgtggacattttgtttttctttttattttaattggaggcgaattactttacaatattgtggtggttttgtcatacattcacatgaatcaaccatgggtgtacatgtgttccccatcctgacccttcctcccacctccctccccatcacatctctcagtgtcatcccagtgcaccagccctcagcaccctgcctcatgcatggaacctggaatgactatgtatttcacatatgttaatatacatgtttcaatgctattctctcaaatcatcccaccctcgctttctcccacagagtccaacagtctgttctatacatctgtgtctcttttgctgtgtcgcatatagggtcattgttaccatctttctaaaaatcatatatatgcattaatatactgtattggtgtttttttttctgacttactttgctctgtataataggctccagtttcatccacctcattagaactgattcaaatgcattatttttaatagctgagtaatattccattgtgcatatgtaccacagctttcttctccaatcatctgctgatggacattgaggttgcctccatgtcctggctattgtaaacagttctgctatgaatattggggtacatgtgtctctttcaattctggtttccttggtgtgtatgcccagcagtgggattgctgggtcatatggcagttctatttccagcttttaaaggaatctccacactgttctccatagtggctgtactagtttgctttcccaacaacattgtaagagggtttc

SEQ ID NO: 61890 - DNA, 878 bp, Bovine  19866880891616
tgaccaacttccttcttaaaaatataccataggttagtttaagcaaatattaatatgacgtctatgcgcatacatgtcttgaagaggcccattgagaaaaaataatctgaacttgatggcttaattatgtattggggtcctgcattttagagggtgccagtaagcaccagcctaaaatctagatatgactatttcacatagtatgtatgtgaaagtcgctcagtcttgtctgattctttgcgaccccatggactatacgatccatggaattctccatgccagaatactggagtgggtaacctttcccgtctccaggggatcttcccaacccaaggattaaaaccaggcctcctgcattgcaggcagattctttgccagctgagccagtcaccatagtctccacaaaaatacaaagaaaagcaaatactgcacctcaggaaatgcagagcaaaagcagcatctccaacacatgacgcagcagctcctggaattggggcccgtgagcattacagtcactgggtcccccttcaccatccttcgcccctgatggagctccctggtggagctcagcctctgagcctacaaagtgaacactaatttgaaagtcaaagtcctttttgcaaaagaactgacattctgagataaagttcagacttaatatactgagtcttggcgatactgtatgttgacaggataagctgtctttaatatttctgctttaaaaattaccaacaactgttcaagttcagatcggaacatgttttgctctgcctgaatggtacccaagttagataaagttcaagtctcctcttcagagactcatgacttgcaggcagtgtcgtggagaggcgggggcctgtgtcactcagccctgccgg

SEQ ID NO: 61891 - DNA, 1716 bp, Bovine  19866880895393
ctggcttttcatatctgttctgctgtgacatcatgtagctgtcaccaccccttgagccacatcattgcagaggttcactctgccagcttcacacccccactggtcttgaaggtcctcagaaaccccaaggcaaaacccttccaaagaatccaccacttaagatactacaggacttcccttgctggtacagtagataggaatcctcctgccaatgtacaggaacacaggtttgatccctggtctggcaagatcccatacgccacagagcaataaggcccatgcaccgaaactaactgagcctgtgtgctgtggctactgaagcccacacaccgagagcccgcgctccacaagagaagccaccgcaatgagaagcccccacagtgagaagcccatgcacggcaacagagagtagtccctgctggccacaactagagaaaaaggccacaggcagcaacgaagacccagggcaaccaaaagtaaataatacataatttaaaaaaaggtactacattacccactttcaaggactatgaaatatgtctaggtgtctagatcagcacattttcttagaatccttttccgtgtgatcaatccagtcgaccacacagcccacattttgaggcctctgtaaagggccaaaactatgaaatcagctttcctccaatgaatgctttgccatctgccaccatcagtagaaatgagctacccagagtggccttgaacatggagttctcacaggagcacaaccccaggcacacagggccggctcctggtgagaaggcacaccctcctttgtctccagaaggaagcatcactaacagactttgttccagacgaccttcttctttgaccctggccgtgagatctcttgcgctccagtggtgatcccacatgtatggggggatgggggaaataggacaacatgcatgtatatgtgtgccaagaaccaccccgagtcctgctaaaccatacactggctttatggaacgttccagaagattttcagagagagtctcacaaaagccaagagagctgtgagcatctttgttctcccactggaagctcaactgtatataaggaagagcaaatgttaaatcatttaaagagagctatttttcatcgtttccaggacataaacgtgtttccgtgcatgttattgtaaaatagtgtttctacttacgtccttatacatctgttgtgtttactcatcctctagttctgacttttagaaatagcaataaatctattttttaatcccctctcctgatgactgatgattattcatcgctaaaagggatggagagaggcccatgtgaggagtgatccaccctctggataagctccactttcacaagataaacagggtccagggagattcctcttctgtcctgggtagtttatgcaaatgaaataagaagtcagtggcagctcaaataaatatgaattaccctcaggtggaaaccccgaccacttgttacagtcagtttcagcaaggaggagtcaatggtgacatctacacaaacagtacaattcattcttatactgtgttcctaatacagagatcacaaatggcttcgtgaaaagtcagtcatccctgagcgaaagccaactggatggaggaaggaggaagagaagcctccacttctgggccctgggaagaggggagaagttgtcaaaaccaatgcttagagagttgtgcaagcaaggatagcacaa

SEQ ID NO: 61892 - DNA, 1508 bp, Bovine  19866880902659
tgtttttctggaactcttgttttttaacgactccagcagattttggcaatttgatctctgactcctctgccttttctaaagccagcttgaacatctggaatttcatggttcacatactgttgaagcctggcttggagaattttgagcattacctgctagcgtgtgagatgagtgcaattgtgtggtagtttgaacattctttggcattacctttctttgggattggaatgaaaactgaccttttccagtcctgtggccactgctgagttttccaaatttgctggcatgttgaatgcagcattatcttttaggatttggaatagctcaactggaattccatcacctccactagctttgttcatagtgatgcttcctaaggcccacttgacttagcatttcaggatgtctaccccctttagtaatgttgaatgcaatgggcatatgattgctcttgctcctggctcttcaaagtggaggttgaggttttttggtcttttcatatcttcttgtccagaatttgtcccaacatacatgcagttatttttagcccatatcttatagtttctttgtattttgttgcccaagaagaggtgggtccagctgcaagcactgcagcactgcaggaaagggtcccaggttccagcctgcctcagttgaagaaactgcctccagacccttctgtgggcacatccatcaagatgacctatacttccttttccccaggactttctcagggaggcctggtagcaaatcccgaaacctccagtgtttacagccccaagtgatattctgggctggctcctcctccctccactgctattagtgtcaattaagttcagcctgacaggccacctttgacgaaatgctggaggagcagggacataaacaacgccaaaggcttaggagttgatatatggttgcctttaataaacatttgtttgcatattttttatcatgctaatgaatataattactttaatttatgtcatcaagctatgattctgttctgatccatacgtcacttgaatgtgtggtgttagcattttgcacacactggcaatttgaagaaggggaaggatcagcccctcctacaagaatttggagcaaccttccacaatggatagcgcacttatggcagctaaacccagctccgcagctggggggcccctgctgaggacccccagaagggtgggtaggctttccactgcccagaagaccttctccaagaaacacacatttttacttccctgtaatcactccaaacggaggcctctgagcacttacccctgcacaatgtccaacccagttgggaagaaaagtattaatcatggttttactgattataaaagtaacgcaaatttattttagaaaatatagatcacaaagagtttagacgaagatgagctaaacttctaccctcaaaatacttatggaaaagattttatgtatatagatacagatataaatatatatgaaaatcaaaggtgaagtcgctcagtcatgtccaa

SEQ ID NO: 61893 - DNA, 1667 bp, Bovine  19866880909665
tgctccagcagctgatgcaagagagatttaagggaatattttaatctgaaatctagcggcagggagataagagtggcgtggcgaggctgggctgcaatcgacatatttatcgtccgaggctgaccatccaatgagtgagttctgctcgtcagttcagatggatagctaatcactttctgtgtttatgatttcaatttctgtccttcgtggggttgtggtgaattagcttggtgccattttctaaaatatcaagcatttttatacattaggtatagtgaatggcaaatacttgatgtaaagtctgcagttttactccataaccagattgtaaaatatgaactgaattaatcataactgcgaaagctaatggtacgttttctcttattttatctttagtgcctttcagatcatgttttaaaaccttcccccgtctggcgttgggaacgcagccgcggcttggtggtggatagcaagaggcaaaggtcagaccggaggctgcacaaatattgtgtgctggatttattgttttaattaagagcgtggcagttcatcataaactgtttatggcgtttctgcacagtgcagcattttgaaatcagctgttttaatgaaaacataatgtcatatctgtcaaagttctaaatattttgaaagtgaaatatggaaacaagaactttgattctaggcttaccgagattagctcattgaattgcttttaaatcccttaagagggtcacatcatggggaccgtatggtttcatgtaggtgactggggaaaaaaaaattctaggaggttctcaagctggttatttaatagtgaaaatacaagttgaaggttaatgtatcaagaaaccaaaccattacggttggcgttggggttttagattaaagatgcaataatgggtgtgcagggcctggatgctgagctgtttggggaggcctaattgtgccgagagggagccgggaacctctcagggtaggagagaaatggaggcgcccctgtcctccttttccagcggtgaagctttgacatcgccatgtttgcaactaattatttataatgacctcaaagatgatgaggtttcacagacttttcaggctgagcagtttgcaatcctagtaattccctctcatggtcgccgggcatctgtgtagacatgtcagccattccagttacatttgttagggggtcggataaaatatttgtctaatctggaaattgtatttttagctgtactctcattggaaacagaaattaagcttgtcattagatgccgggccacaggagttgactgaacagggtaatgtatgttatattctgtgctatacttggtcaagtttcatatatatcgtattccacattattttattaactttaatatctacacttcctattaccagacatgcccctcattcaaagcacagaggcacagttctctaatcagaagtgacaggctatatactttctctcagccattacttggtagcctagagcaaagaactctgtttccttgaaaatgttttgaattgggttatttttattgaagtattaaagtaattcttcagattttaggctattatttaagtacttttgggagaatacaataacctccggattctataggctttgttactttaacaatccgagctgctaaatgcatcttttt

SEQ ID NO: 61894 - DNA, 1669 bp, Bovine  19866880930347
ttggagacgggagtggcgtcactgtacatttctgcaggcatcttttgtgattggcttaataaaagacaaccgaacccccatatctgcttccacagtcagtctgttgcaatatgttgtttttgttaaagtctatgaagaaaatctgatctcacacagatatgtggttggaaaagggaggtgtgtgctaatagccttttcacataatggtggatattcttctttgatactacaccaaaacacagacactgggagtttcttaaaggttagttacaataaggaatttgaaaatacatgaactttttatattctgttacatttaaatccaccgggttatcttgatgtttgaattaatcttttaccctttcatgatttggtaacaacaagcattggtcgcttgaatattatctattcaataagctgtgagatcttccaatgttgacacgattcattgtacaatattaaaaaaaaaagtcacattcattagtctctctttaagttctggaaagctgtcaagctcatggtggctgatgtaagtatttcaaaattcttgaaagcttgaattttatcattggcaacaaatactgtcagttattttcctggaagtgacaggattcatttgttcattttccagaaaattctgccaaatagtcaagtttgaataaccagagttctgtgtatcagtgttctctcaagagaaaatggtgctctgtgaagaaaaaaaaaagcagggggtccagcttaggactcctcatataacacagctgcttctccttgcgggagctgtcagcttcaacatgggacaggattgctctgcgtgcatcatttcatcacacagggtatttcaaaggtctgtactcgaagactgagatagaatgaagtgaataactgttactgcctcatcaagtccattctttctttccaaattcaggatcttttaaataatctatgtaatggtacataaatatttttatgtaatggtacataaattatttttatttgtggcaaaagacataacaaagtttaccctcttcaccattgtttttaaattgatgagacatttttattcttttttatttattttttttaactgcatcatgcagcatgtgggtgggaccttaattccccaaccaggggtcgaacctgtgtcccctgcagtggcacagagtcctagccactggatcaccagggacgttcccatgttcactattttttaaatgtgtagtccccattgttgtgcagccatcaccgccatccatctctggaatttccgccacttacaaaactgaaactctagacctgttaaacaaagactccctaccctccctcagtctcctcagcccctggaaaccacctttctactttctgtctccactaatttggctattctgagcattttatataattggaatcatgcagtatttgtctttttagtgactggcttatttcacttaacatgatgtcctcaaggttcgtgtgtggcgtatgatggggtcaggatttccctccttgggaaggctgagtaatattccatggtatcccacgtaagagaggcttttcctctttctgcacggcgtggcagtgagcagcacagggactgtgagagcctcgattatgctaaggcaccagcagtttcactcaccatcagcacgaaatgaaaaggccaaatcat

SEQ ID NO: 61895 - DNA, 3657 bp, Bovine  19866880951212
tccctaaaggtaagaacactccagctgagagacaagtggccaaggaagctgaaagttgtcaggggtgaggtggggtagtgagcccacagcaggctgcagatgctcaggccattttggtggagaaccttccacatgcctgtggctgcatgacctgcaactgaatcccacttctggagacaggcatggaaataagggaatcagcatactacattcagcaggatgctttttgggcaggtggctggaacctgaaatacagggaattccttaacatttataactaaaaggatagcggcagtgctgcctgtaggcccaactgcctcaggtctgggatagggttttcagaccaagccctgtccatttctcatctctgataacaggatggctgcaactgctccagcatctctgcccactctccagtgtagcctggggtagaaggagagaaagcctctgaccagcattcccacagacaacttgcttacatctcattggctctaactgggtcacatgtctaattctaaaccaatcactgtggagaggtgaatgcaaagtactggttgcctgaaacatggtctcatgattcacctctgagcttgtatgggacaacttcaggagaagtaccaagagtgttggtaaagggagtttctcaaaggtaaaactaggaaattgggtaacatttccaagcaaagggtgaatggatataaaggaggaagaacatgaagtgggcacccagggacatggctgtggtcccagctccatcacagagtgtccatgtgagccttggtgaccttctggacccatttcccatccaagatgaccactgaaatccctttcagctctatccctgactcctctcagatcccaggtgaaaattcatgagaacactatgtttagcaagggtggctatgttatacttcaaaggcctcttagaaagtcattcttaaaataaaactttaaaaaaaaagggcaatggatctctcccaaactgtaggaaacatggtcctttgttctttaagagaaacaaaaggctgatggattactaatgaattgtggggtgatggtgatggcaattttttcaacaccaaaagtcagcaaggactttgggtgaaactataagtctgtgatttccaaatctgttgagaataatggtgtgcaagtaatatagaacagaacagaaataataataaatgctcttttaaaataagatttctctggtttgctttcatctggggagatggcactctgagaggggatcttatggcctcagctcctccatcaggtccttggtgcctagagaagatctgaatcctgccggtttcttctgcagacactgtttggtactggaaacaaaggaaacgagccttgtgcttctgcagcttttagtctaacacccatcaatcaataattcctctaagaagagtgtgatgagtttgatgggcactgcccttcttgcgtcaaagggacctaagttagactggagaatccatggtgttctccccagggaagtgccatttaacctgatacggatggaaagagattgaccagagaaagaggagagaggaagccttctgaaatacaaagggaatggaagggaaggagcttgggaattctgaacccaagttagtgtgggtgggtgtgatgagtgtgcagagagagagaaagtgatgggaagggaggtggagacttgggtagaggcagtattgttgaggcccttaccaaccaagcaaaggactctgaagcttatcccaatagtgatgggaagccagagaaaaagtttgttttcttacacctattttttgtgtaggggagtgacttgatcagaatagcattttaaaaagattatattggatggagaaatgcaacctgatttatgttttaaaagactgtgctggcttcttggttgtagaggagcaagagaaaaaggaaggagaccagcaagaggctgcatcaattgttgggatgaaatatgaatggaagagtgtgtataaatcacttatctgataaggtatcactaggctgagcgccgaagaattgatgcttttgaactgtggtgttggagaagactcttgcgagtcccttagactgcaaggagatccaaccagtccattctgaaggagatcagccctgggatttctttggaggaatgatgctgaagctgaaactccaagtactttggccacctcatacgaagagctcactcactggaaaagactctgatgctgggaagaattgagggcaggaggagaaggggacgccagaggatgagatggctggatggcatcactgactcgatggacgtgagtctgagtgaactccgggagtttgtgatggacagggaggcctggcgtgctgcaattcatggggtcgcaaagagtcggacacgactgagcgactgaactgaactgaaactgaactgaaacttgggtctgcttgtctgatgcacagcaaagtcaatccactgacactggggtgtggtgaaggaaagtacaaagtttattgcagggtgacaatcaaggagaaaagacatctacagctcagaagacctgaactcctgatggcttttgaggaaggggttttcaagacaactgtagggatgagagacatggcgtctgtgatcagctcctgtacattcttctgattggctggtggtgaggtagtatggtgagattttgggaatcttaatcatcagttttctgattccaagtggcctgaggtctatgtgctggtggtcagcaagtgtcagcttccttcacctggtgacaaggggtgtggtctcagtttctgcaaaactactcaagtatatgcatcaggatattatctataggttgtgagatggaactaagtgtctttgactttgtttcatggttaaactattattattttgtctttcttaactactttcctttgtttctgtattttcttacttctctagctattaactgattaaattttctcttaggaaagggaaggtgtaggaggctaaagtttttctataaataagaagccatggaccaagggggctgtccccaggaaggtcctgcagaatcctgcttagtttcaaagagaattgtatcaaaaatatataaaaagccattataattcaataataaaagctaactcaattaaaaataggcaaaggatctaaagagactttcctccaaagaaaatacaagtgactgacaagcacacagaaagatgctcagcaacctcagtcactgtgtggttggcacggcttctgtgctcactctatccaactctttgtgaccccatggactgtagcccgccaggctcctctgcccgttgaattttccaggcatgaatactggaaggggttgccatttcctacttcagggggtcttcctgagtcagggattaaacccatgtctcttacattggcaggcagattctttaccactgtgccacctgggaagccccattagtcactagggaaatgcaaatcaaattacagtgctttccaacccaataaattgattatacacttaactctgcccagactccctcagtgattcagagtaccgagaggataaagtccagattccctaaaacattagactgtatggacgctacctctgcctttccaggtctagcttccatcccttccccataaaaccactccataaattcttgataattcgctgg

SEQ ID NO: 61896 - DNA, 2056 bp, Bovine  19866880976658
tttaatttgcacttaaaagtttaatttaatgtagaagaaattacttgttcccttctttgttcaccctggctcacccatgaatgattaaagagaagtttgaggactcctgtttccattttttttttttccccaagaccatctccacagtttcccaagtctgcttcccattgaattctgagcaatgactggctactttagcaattaaaatccaggggcaaagacacagcagcttcgttgggctgagagactccgccattcatcatctcggctgccataaaatagcactagatggaatctttgattttagctttagaagaacataaatcaaaatctaaagcgtggctgtcacaggcatcaccaggattatccattggagaggggcttggagtgcagggcatccgcgtgcattgttcccactgaactcacctcctgatgcatggagaaaactcctagccaagcacttgctgttgtataagtactttatcctaagtgacccataaaaagactctcaaatatgaggtttataactacagtcacagtaattgtatgcttgatatgtctgaatacaaaataaatgggtcgcccggctgggaccctccctatctagtcccctgcccccgtcgcctggtcagctctcttacccatatgcctcctgaggcctggggaagggtgttggcacagtagggcctctgagcaggtgcatccactctgtttctcattattgagatgactgggatgtcaaggatggtgaccgtgaaagcagagatgcagccagagggagtccatccctagggtggtgggggaggtggccttgcacttataaccccaaatccatcttccgtgttcaattaacaggccaaatgagtgtcgctatgccctgtaccagtgaccaagaaaggagaggagagaagctcaagatgacccagatgaaaaatgcagagaaagacctccactgactcctgcattaaaggaagaaaggcccgtggaccaatgagcctccacccagctttccaaaagcatgttaatttcatgtagcagaggaaacagtgatggaacctctcaaaccagatcatgtgactccagccagtgggaggtcagaatgaaaaggtgtatttcctctttgtttctgaggatttgggctaatggcccagaacatcacatgtcagttaggtgactgatagaaaagagaaagcagccataaccctcggccaagggcaagctatcagatgggtgtactgcaaatccaaagaactctccccagctcaaagtacctcaagatctccgactggtccccatggccaggtctggtctcttactctgcctgcagcaccagaggttccaggcttcagagtcagtttttaaacaaacatcccatccaagtgatgggggcacacagaagatagagtgctcctgttgtaaggacatctggactgctaatctgaagtagaagaaagaggtgtcctaatgaggcaacttgtttagtccctaattcaggtccaactcatcacaaccccattggatttcccaggcaagactcctggagtaggttgccatttcctcctccagaggatcttcctgttccagggatcgaacctacatctcctgcattggcaggtgggttctttaccactgagccaccagggaagcctaatggggcaaactaaaaaaaaagtgaaagtttcagtaactcagtcatgtccgaccccatggattgtagcctgccaggctccttggttcatagaattctccaagcaagaatactggagtgagtagccatttccttctccaggggcgactactcctacttaaatctggatagcacacctgccatctgtagagtcacttattaactcaatacacagaacacggaccaaatcaggagtcaactctgtaagatgggatggatctcatccaactgtgctccatcctctccatgggaaccaggtggcagctacataacatgatttctagaccaaattctaaggtgtgactgcataatacaatcccccgggaagctttgtaaaatgcccatgcttgaatccagttaccaaagagt

SEQ ID NO: 61897 - DNA, 1893 bp, Bovine  19866880986412
ctatcggctggacccccggcactcctgctctgtgggtgggcacggccccagccctccggcatgcacccgccttgtccctctggtttgaaggggcggctgtgctgttctacctcagaggatagaaaaggggagaagaaccccaattttcagcattggctccccagctcctggaaaaatgcccagctggataggtgccagagcatcagccccgatgtcagccacccagtgctgctcctggggacccaggccaagccagagaccagcctgggctcatggctgaggagacaaggatgaagagggaaaagcaacacgctgtttcaattctttgtttaaaaattcaccagccctggcaaagggtcagtctctcttccagaaaggacgttaggcgccgttttcctcctggaagccccataaatccccacgtctcctcgatatacaattcaaaaaaggcctcaaaattgccactgctgtcatgctaagcactggaaagttctgcttgaccttttattaacatttttctaaaccaatatgcttttttttttgctacaagcaccctgaggaattatgaaaaatacttttttctgtagtttatcccatatgcacttaataggctcacaaatataataccattataaaaaagaaaaactgccaactcggctaaaaaaattgtcataacactaaattattatataaatataaaaggagtgtgtctgtaaaatattcactcaatgaacatcccaaggtgatggttttgctatgttgtttttattcctgagagatccataacgcatttggatatgccacatgtcaccacatgaatcaggcagttaatgcatgtgctttttagaagcagggatgtcttcccaatagaatgtgctataaaaaaatgtagagatccggctgctttgtctgataggcataatttaatgtcttgcttataatactgcatcttaaggaaaaatacacagtgtcctatgtagttatttacaatatattgctaagtctatgcaaatatgtttccccaagcctgggattatataacaaaggtcaacaatgtttgaaatattttgaagcatattcccaatatgcttagtgtatgatgctaatgtccaatatatgcacatatatcttaatatatttccagatatttctgttcattgttcttgccgtagattcccacagaatactattagaggaaggttttcttctgaagaaagccaaacatcacctatccatcttggaaaaaatttattaaggtggctaattatgcggtccttaatattgcattagtatgaaggttgctcagtgcccctgcagaagagaaaaagatggaagccagttcaataatcctgaaaccagagatttgacacatgtagaatgagcacacacctatgggatcttatttttctgtcacagatttccaaagctggcaatgacacagaggcatcacacccatgtgtgcgcatacacacacacacacacacacacacacacacacacgtgcttgtgatctggtgcacacaaaacaaagacgacaagccacacagtctgcctctcatttctaaatattgcaaattctggccttatttttctgaggggaattttgtgatcccatgtaaatttcattcagaccactttcttaaggaaataaaacctggttagttgcacaaggatcggggggagagccgtaaaaaccatacctccatcagttacccacttcatacatagcagtgtgtgtatgtgaatccaacccttccaattcaccccgccctccccttctgccttgggtccatacatttgttctctacgtctgcgtcgctatttctgctttgcaaataggttcatctgtaccatttttctagattccacatatatgcgttaatatgcaatatt

SEQ ID NO: 61898 - DNA, 1376 bp, Bovine  19866881014438
ccccaaacaaaatgtctaagaatgcaaaagttcgccaatgctagggttttagcaatttttgggagggaaaacatcacacggcttgcttaaatctgtcatgatgcacgccccctcgattcccttcttttttactcagaaaagctcaattgaatcagggaggcttgaccgtctgttagagaaatcgtttccctctccctcgctaggtagatttgttcaggtgtttactcctgaacacccgctgctgtcttctcccagctcaccagtcagaccgtgaaacttgctgggctctggaaaatcattacagtcccccagtcccttggccacacgggcacctgctcttcctctgggccaaagtgccaccattttccactcaaatttcttcaaagctcccaggcaagcatgagctgatcccgaggactcatcacggactcttctgtgaacatgtccctccaccaactgcagtcagccacctgtgaactcacccctcccacctgccttccccacgtgttattggatgagagaggctcatcgggaaaagcaaagacagaaccccaggaccaacagggagaggtgggaaaactcaaatgaggtggtgagaagtgacctaaccacgagtttaggagtgagagatgagacaaaaaagtagagaagagagaaggatggaaatatatattcaagggagagggagggagggaaggagagatggaggaagcactttgccgtggcttccgcagtgggtcccagatctaaccatccatcatcaggtgcggggtggacgatctctgcccctttacctatgaccagcggtgatgtttttccagcgattccacaggagtcaaaaacccaacaaagcgcatcgcgggcgctgtaaagggagcatgctgctcgtgtctgtgaccactgtatgcaaagcttggcattagtcacagccaggctggctgtgacaggcctgaagtgagggagattaatgcgaggctggggcactttattattgtcattctgttctttcagactctgcctctgactttcaattttgctccagaattaattgtctgctccctgcagtatgactgatggagaaggaaacgcatagcccaggcacctggctctggccttgacagtctgaggcccagcagaggatgtattgtgtgcggtcagagcaggggacagacgggcatctctcaaagaatcagcccacgccacaccggccttcaatcagacgtgaccgaagatcacccttggcgaagcatcgtctttgctggtagagtctctcacatcttacccgggttcctgttcaggaccctcccaaggacccagagctcagtcggttggtggagtccttctcagctctcagctctgtgattctcctccttgct

SEQ ID NO: 61899 - DNA, 884 bp, Bovine  19866881049732
tgcagtgatgccacttggaattccaccttccctggcacgttggatgaggaaatgactggaaacctgacagtctatcagtaccagggagtgataatatatatataaaaaaaaaagattccagttatgagtgtaagtttaaaaatgtaactaaaagccctcatcaaagtttaaagagcttcttgcgcttttagcatttgcttattctgatttattgacaatgacacacctaggaaccgtcgtctcagctgaggcagtgaagtaatggacttcagggggagagggaagaagagagagagggggaaaaaaggaaaaaaaaagagagaaggtgcagctcacagaagagagaccgctgattacagcccactaatttgttatgcactccggcaaatcagcagtgattcatatgacaaataaggagaaaaaattaacagctgtcacgttgtgatgtgttaatttcctgacagtctctgcactgaagccaattactgatttaagggcagggagagagagccctgttcaagcttctaattaggcttcttcaagactaaaaggataaaagcaaaaataagagtgagagaatgaggcaggtagctgggctccacaaggctcacatgcttttaaagccccagttaaatagctttaagcttaagtgtgtttaagataagaatttagaaacatttattcacttttatccctgacctggtgctttaggcttttgtggagtaattgggagtcgagtgaggcccagggctcttgttggcctctttctgcacgagtccagcctctcagatgtaatctactaataatacctttgtttagtcgtgtcaacaaccattcatcaccatggtagacaaagggcggtgggcgctctaccagcatctcta

SEQ ID NO: 61900 - DNA, 1166 bp, Bovine  19866881051596
cttgtattctgaaatgcctgctgcagtaaaggaagggtagctgataacattcttttttcattgtcatggatcataaaaactcccacatccctgctggggtgactagagggacctgcttggactagctgacctggaaggaagatggctctgttttaatttctaaacaacatccaaactttgccagttatatatctggaaggaaactatcaaaggttcctagatgctgacacgtggacatattttttgcacaattattgatttattttgtgcattttaagctccatgacaagtcttggggggtgtttatatcccaggaggcaagaggcttctggggccaagatgaccagctatgaccagcttctgctgtgggcacctcactgggcaaggctggctcagggcctctgtgagcatccctctacagagcatcatctgcgaagagctgtgtgtgctgctcctgctaattcaccgagcgctcggctcagcccaaccaggagctatgcactaaccttcattactacattcatattaaaagacaacgctgcgtctttcaatcatgtacttccctctaattaaggcatattcacttttttcccctaattaggtattctttgttgcataatgtttgctctaatcttttggaatctttctcaatatccagtcattacaggctcccctcgaattcaaccaaagcatgttattttttctgctaattatatcctcatttacagattggcgcctcttctgattggctcggtacaccagttgctatgacttcattagttgcgtctcctgaccctgttatttcttgtgacaggacttgctccttgtgtcctgtggctccagatcccagggtcacttctcgccagggctgaaatagtgtcaaacacacagaggtttagagggtggacaccactgctgcagttgctaattactacacacagccaccgtacaaattaccaatgctgctgggccatcccttcctctttttttttttttcttttttaaaatgaatgttttaaaggtgtcattaacaggttagtttcatttttaaaaacctgcctgatttttaaaaaagctaagcacgtctgtctccctgcgatggttcccaaagaaagtatcttccaagcaccaaacctcacaaccttcagttttgtatggggctgcca

SEQ ID NO: 61901 - DNA, 822 bp, Bovine  19866881068041
tgggggtgggtgtggaaaaggccattcgatttttttctaggtcttgtcagtttacctgtgaagcaagttatttaattttatatactagctcaaagtcacagtcagtatctcaaggacctgaggggtttctcggagccttcctaattttgtgcaaccagcccctggcttccatctccacaaggtgagcatcaagataaatgagtgaatagagacatgacatcggaaagccctgaatagacccagtggtcaggagacattaatcctgaggtgtgccatctcctttctccgaggagctaacgccgtcacccttcctgaccaccgcacttcatttgtctggttaatctcccagaacttgggccttacgattcaccccagaagtgagttctgctctggtgggcctttgcttctctgagttttcaggatggcacagatcactgatatctcttctccttcctagacatcaggcttctctggaactgtatgatccttcatgtcatctggggtcatctctcccctatgttatttgaccttaaacagcccagtagctgaggtcaatgccatgtacaaagggcctaatttagtaagcattctctgacacctactgcatgccgagttctaagcaacatgatgtagggattacagaggtgatgaaaacgtggcgtctgcccttttgaagtttatgcttggttaagggagacactagctctttcacctggcagaacatgttctgcagttgaggttgacactgggcaagcacagcagacgggggcttgctgcagcagatgggatggcgggggggcactgatcaatagctgggacagg

SEQ ID NO: 61902 - DNA, 3281 bp, Bovine  19866881163933
gaagaaaaccaaaaggagcccaggaaaaataaacagtccccaaatacccatctctgggagggagaagaacattcaggccaaagaattgtcttagagattgtgttgaagtccactcaagtaagctctcaacatccctcatgacatacaatcatactaggacagctagtgctatcaggatttcaggattcagaagaacaggcaggaaacttggactcatcgaggtcatcaaggagggtgatcagatcaagaggtgttcagaggcaagagacagtggtcttgcccaggacgcaggcaccccctctctccatctgtggggtaaatatatgtgcatgtgtgtttgctaagttatttcagttgtgtctagctctttgcgaccctatggactatagccctccaggctcctctgtccatgggattctccaggcaagaatactggagcaggatgccatgcccgcctccaggggatcttcccaacccagggatcgtatccatatgtcctgcattgcaggcagattctttgccactagggccacctgggaagcccataaatgcctcctggttggcatagcacaggacccacaatcctccaaaacgtggccatactggcaaggatagcattcaagaaggcaaaatcatcatgtcctttaatcaaagcttaaatgatctcttttgcagtagccatgtgatgtgagatgtgagagtcggaccataatgaaggctgagtgctgaagaattgatgcttttgaattgtggtgctggagaagattcttgagtctcttggactgcacaaagatccaaccagtcaatcctaaaggaaatcaaccctgaacatccactggaaggactgatactaaagctgaagctccaatactttggccacctgatacggagagctgcctcattagaaaagaccctgctgctgggaaagaatggaggcaaaaggagaagagggtggcagatgagacagttagataacatcaccaactcaatggacatgaatctgagcaaattccaggagatagtgaaggaaggcaagacctggcttgctgtagtccatgggatcacaaagcatttgacatgacttagtgactgaacaacaaatgatctcctaggatatggttgaattcagatgcccaaaaagagcatgccctataagccagaggtacgggactttcaattccctcctggctcttagaagctactgacaccttccccaacttcaacaaccccactttctgggtgaggtggctccacttcctgtacctgagcattctgcttcctggtggaaggtgggaacaacaacaggtgtgtttatgccatagactgtccttagaagtctagtagcattcacagagggaacaagctcaagggtggacatgaagttacctccacatacaacccttcccatgtcaggctgcatggtagccggccagggatctctggccccagcacacaccccacccagaactacctttgtacctccctccttcctgcacagcacaccagcctttaaccttttctgaagctcagagacatcgctgggacttccacacaactgctgtcaaaacatcgagccgccaactataaactttattgtgatgtcttgcttttcgggaataattactcggtacctaaaatgttagcctatttactgcttgtgcaaaaagatgacaataaaatcaatgttgcacaattccccagagcccatcaaagtcttttgcaatgttaatggatcggtgagtctaagaggtgtgatctcatgctggcctgagtggacgcttgactccagtgagggaacattctacctcttatcagcccacgaaccctcatctgccaaattcagtcattctgaaaagttggctccatccctggggtgagtgaatgggtggaaggcaagggcggagggtgacagcagattgataagtacatgaaatcacaaatcctgtgagctggccagcacttagaaggactgatgggtccaaccccattatctcaagacaaggacacagttccagagagggagaatggtccacccatgaaaccagacccagactcatatcttctagtttctggtctaaaaggctactcaccactctgctcttggattggaactttttttggggggggtggggatccccttgtggccttctctcttagatcacaggcatgtctagagcaaagaaatgccttcagccgggaggataggttcttctgtgctcctagtcatgtgaatgatacacgagccagcaaggcttggacgctcagagaagtttgggggaaaccgcataaaaagttccattctgggcagtcagtgtatgctggcaaatcaaaggttctgagaagtctcaccaaaatcatcatgttcacttcgctcacccagcatttctagaatgtctccaagccaggcacttggatggaaggagaggtgcggagtatcgggaggagaatttactgcggcacactgccttcagcctactcccagtggcacacagggctgttggtggctgcagagaggcaggaatggggtgggaaaggcttaatggaacagaggcaggtgatggcaagggacgagaagagtgatgcaaacagactgcagtgtatctttgcagccacagcatagacccagggcaaccggggctctcttaccccagcatgcggtgggggatgacagtaggggggcagctaggttggatggaaaccaggagaggggcacagagcagatgtctgaagagacaaaaaacagctatgcagagcagcccccaagtctgcccccccagtgtaagatcgcttctgactgacagggtatcaagggacatcagaaagcagagaatgagacacaaaaggccatgtggaagggacaagtcctgcctttgcactggtgctctggccattctgagctgcccactcggggccaactgtggggcctctctgtacatgtaggggcctgcactgccccgggcatgaccacagtggtcactagggctacatggagtggccattctgcagcaggctctgtgctatgaaaatgcaacctctttaggtactaaatcctatccagaggccagtcccgtggaagagggacatacctgaggtcttgccgaggtgacattacgctctccctttggcttccaagccagtgatttgtttcctcttgcagctacatcaagggaacgagctgatcacttccagaaagagcctctctactgggccctgggcctctctgtttcacccctcaaagcccactcacaacagtttatggggatttcctgcagctcttccca

SEQ ID NO: 61903 - DNA, 778 bp, Bovine  19866881170152
tgggcattggatgcattctgatggccagagaatcaactgcagactcttcaaacatagcttccaagtttgcttctctaattttcaacttgtggtaacgtgggaaatcctacacccccttgctggctagggagccagcccttccaccccaaaaccatctctggatccttgacatcagctgtcaacatctcagactgggccttgggactttgccgtgtgggatgtcttttgttagtgattccacacaccatggtttgggtggatttagggcagtctataagggttgaggaaactgttgatggagattaaagagcctgcccccattaggcaaccagtccatgcctagccaagaagaaagctaaaagagtcacctctcctattgcatgttctaaccactagactgagctcctgttgcttgacaaaaaggatttgcttttaattaaaataggagcataaattatttttatccctgtattattgggcggtaagtaaattcacagtaactcactggatttttaaaaatctattttaaatataaacacactgccatattttctgtgggtttgaaagcttatgttaagtttgcaaataagtcaactccataaagataacatctttccctaaaaaatgtgttgtaatctaatggcatgctatggaaaattaacatcttattaacaacatacatgaaccatccctcagttaaaaaggttcagagtcgacttgagttcctcactcggccctgaggccaggatgactgacacggcaacctctaaaccatctc

SEQ ID NO: 61904 - DNA, 1226 bp, Bovine  19866881192051
ccatcctaaaggacatcagtcctgaatattcattggaagaactgatgctgaagctgaaactccaatactttggccacctgatgtgaagaactgactcactggagaagaccctgatgctgggaaagattgaaggcgggaggagaaggggatgacagaggatgagatggttggatggtatctccgactcagtggacatgagtttgagtaaactctgggaattggtgatggtgggctgccgtctatggggtcacacagagtcggacacgactgaagtgacttagcagcagcagcagcagcagcagcagcagcagggaagcctgacatgctgcagtccatggggttgcaaagagttggacacgactgagccactgaactgaactgaggttctcccttcatttaatgggccacattctcctctacctctttgggcttcatctctttctttgcatgtcactgccatgccccagggacccagcatctcacactacagttggagcagagcctccacctgtttcgggccagtgtgcttctcaatctaccctaacgtgccatccacaagctagcacgctagtcttagtgtgcaaacgctaccttagtctaaaagtcatggactagaggctgtgctcaacaggacacatattcgttgtaaaagagaggatcttctagttttttgggggagtgggtgtcaacattttgtagatgcatgtatcagaagacttgatgatgctggatttgtcgtcttgcgtgccaatacttatctggagcaagggaaggtacccccttctagtttgtccaggccaggccactccccgctgggtacacccgacccaccccattcgtgaatgtcacccgccatctgtctgaaggcactcttattgcagcccctacatgagtcccttcacccttgttttcaaggaattgaaactcatacattctgcataaaactgaaggacaactattaagataaaagagggcagttaagctccttcagtgctttagtaaaccaggaacagccctccgcctccgtttccctgtctgcggaatggggctctgacccttttctctggagtcagatgagacacaatgaagaaatgcattttttgttttaatgctttgagttccttggagagcaggtaacatcaaaattcaaggtgttattattagagagtaagaaattttgttctatgctaattaaactcacaccttaccactttacacacagggga

SEQ ID NO: 61905 - DNA, 1343 bp, Bovine  19866881195647
tcatatagggtctttcctgcccactaaatcaaggtgtgctggagggccagtgggtggcactagcagctatccaccctggtattttccagccccatttcctgacagagttgactaaaagtgaacttgaaccctgatttactgccacgatcacaaaggacctgaactgtgtttaccaagctgtgtcctaatggtgccctttgagaaagcaggcaggcgcccatcattctgaaggacttccttctttcaaccctgcagggaacactctccagtgtgggggactgaggcctccccagatgctctgctctctgatggggctcccacccagcctagcacatgcacaccactctgtggccaacacagccggccagaggagggctggcagcctggcctgcagaggcttgaatattgcgtgtacttgacttttatgtaactggccaacgtggcatgtctaactatacaaatggaagttttatgatgataagatcagttgttactggaatatttatgtgacaagctgacagatataaaactacaaagcttgcttttatgcctcccatcctttcagagaggaaaaaaaataaatactgagatgatgggtcactttgaagagaatttatgatccaaattacctaatacctggtaaacttctaatatgcaagatgaagtctctgtatgctattaaaaagaaaaatttcatttcctaagactgcagcacatgaattcttcctggagaggaatctgaggctcttgccttctcctgccccagataaacatcccgactctgccacgaggaagagtcttcacgtgactgcattgcccaaggatcaaccccgcctgttgcaaaacatcggtccatccttagaggaaaacctaaaccctgaaatgaatatttgttgaaagcctgggtgataaagcccggccttcccttgccattgcagagttcgtggcatcaaactggaaaagatgagagggagtctgcaggagtcctgggtgatgggagagtgaccgctgccaacatctttccaaagatgcactgagaacccagcatcttacctggtacccactgggaccacttttcccaatcagatggggttggaagttgataccaggctgatgctgggctgtctgcaattaaacattagcaacctgacaacttaaccttgcctgttggcttcgggtgaaccttgttaccaacttccggggagcacagccaattcccggagcacttctcttatgccaaagcagtgggatgtggcatcccacggatcccgcctcctttcatgctcacatcttctccatagatagacatattagctgtacccacctgtggagggaaaagtcag

SEQ ID NO: 61906 - DNA, 2489 bp, Bovine  19866881224513
atattaattaacatgttggaaatgttttctttattaatgagaaattccccccattcctatttaaattaatttgtatagtttaaaattaatttatcgtggcctttgatgacctcaaatctactaagacaaaactggagtattgtactaactgttaaaccattcattaaacattttatgcaaatagtgtttgtttataaacaaattaactgcaaggattttcaaaacaggtgctgtgttgtgaatgcgtactaaatgatgtggtactgaaagaattaattagaccttcagatgtaattagttgcaataatttgcgtgattagcggcttggttaagaagtaagacacacacattgtaatgcatgggagagtcactgcagtggttttgtctttcatagggtgaggataagccttctccatgtttaggaaatttttcaaaaaaattgctgacatagctggagttaattgccaagtgtcctgtgggggagaacgtggtggtggttgttttttctccctctttctcccttggcttcttcccgtgtgtagccatcggctgcacggctgtttgtttgcacctttatgaatttttaaaagagaaagttgttaaccccagatctttgcatccccagaggaaatgacgacacttaacactttgagggttaaaagacagaacgcaattattataaggcaaaggaaacatgtcccgcatttcaagatgggctgttatcgctcagggaatagctgcagtcatttttttgatgtcgcagtggaagtgtctcgcctcttcttggcagaagatgggcggccacggtgagcagtttcatctgatgggctgcggaaaccgggactcgtcactgccgatgctttgtttacatggatgctggcgttctgggggcaagggcactgagatgcctggaccacagtattcagctaagttattctctagggccatgttgctgggacatggttctccaagttttggggacgcacagacccctgccttttctgctggggggctttatgacatgatctagctttggagaatcctggtgaaaaacagatcataattatttcattcattcattcaaagatatcctttgagtattctagggacacagtagtgattgatacagataagattattttctgatggttcttggtgtagggcagagacaaacagatgatatttcagttaatttcagtgatgaggaaatacgaagaaaataaaacacgataatccaatggaaagtgacccaggggagtgaagagggacaaagtctatacaagttttcagagtttttaagtgggtcccagttccttcaatttctttccaatctattttaatatgaaactgctttgattataatacacatgaatttctttatgtgtggctgtattaaatgacacaatatacccatagataacttcaatgggacctcctggcaaagtaggtgctcactaaatgacttctgaatgtgaatctgaatcctgcttgatcagacgcctgtggacacggttgggattttgacaagctctagagaggaactgggatggtgctcctcactcaagcatgcagttccttttgcagcccctccgagcagctgttactctgtgtccttccgtaggcaatggtggcctcccatgccgaagaggcagggtcgaggtagcaggtgattggtgacgggtcgcttgaggtctacataagcctgttaggtaaacgtgtgtgtgtctatgtgtgcgacatgccttcctcttcctgaagcctggtaaataacagaaagacttgaaaggcttgggttttacaatttactaaaaggctcctttaccaagggtttgttagctcctgcacgaccttgctgaatgacctctggaagggctgggatgatatctgagttcccttctgactcaagagatcagcgattctccttgacctgggagagatggaggatttagagatgaaaacttgtgagtttccagaggaccagagctttctctcctctgagtttcttggtggtgtttgattctgttcatcctcattttcagctggtgtttgccaagcagtctttaaaataggccctttttggacgatgtttgaacttgagcaaaattaacatttgcgtgtcatcagtagctgcagtgcatcattctgggcagtgaaggatgaaaagtcaaagaatgtgggccgcttgattaaaatgaacaatcagggcaagttctgaaagatggatacggagagccggcctgttaatttatgtggactcgattccaattgcacaggcacatttttttcccctttgaaacttttaagaaattaggttttaaagctgaaccggtgcaccactcaacttaaaatagaaaagaatttgattttatgcggtgcctttcccatcctggcactctctaatattgcatatcaagagctcctgactgtaaagtggcggggaggcggtgctggtttgaatgacttctgagaaggtgatgaacaacacagcc

SEQ ID NO: 61907 - DNA, 1554 bp, Bovine  19866881226789
ctggacccttcctggttctgtttcgcctcatgctaaagctcttgacaaaagtctatccctaatagcatcttgaatgtgctggatatttcttttatagtcttgttccgctcaccattcacaaaatcccaatcagttgtgagatattcacaatttcctttacctgttaaaagacttggagaagtagaaaccaggtcaactttgtttatctccctcaactgaccaggtaattttttatttatcccatggagcacctattaatattctaattgatccgtggaatttactttgggaaatgatttaagttcactatgaatttattctttgctttaaaaatgaggattaacatctcttgatcatttacttttttaagagacaatgtgttaatttgcatggaccagctactttaatccttataaaaatcctgggattcagggattggtattgagtccctgtctcaataaggaaagcaggacttggagagtaacttgcccagggtcacaaggcaagggtactatacagccagggtttggttcagaaaggtctgctgcagagccgaagcacagtgccaccacattcttctgagtccgaatgggcagttccagctcattttcacattgacctgaaacccaaagttctgcttaacaggcttgggacacacggtggaatggctgaattatattatgaaatatatcatagcacggccctgacagcatgttcctcctctgcttctagaggccactcaggatatactgagtgtctttcatcactgcatgcatttgttcatattttcagaaatagctagggcaagtgatgacaaatgcatgccgcagtatggatgttgcatcattgtgggcaccgaagtcctgccatcttttcgtggctgttcagcatcaccttcatggatatgggtagtgcgtggagactgtttggtggccttaaccttaaatagtttctttaatctcttaaatgattatagtacacattagactttcattttggcttttgatgtgtcgtcctttttatcaggctatgtagaatacgacttttagtctcaatgtgtgtcttatatacatgttcagaaaacacattatgttatcgggtgctggaaagaaaaaaaagctgctagtgatcttaactacatccaactgtctttatgagatgcaatcaaccatgtatgaattccctctatccatcattagttgagtgtcaaaaatatatgcaaaagaaaatggaacctgggtaggaaggtagtgaagaggtttttacaaattagattatttgagtaagcgattcctcagacagaaggatatcgtccaaagggccctttatttattattcacttcctttggcacactaaagaatattgtcagggcagcaagagcacgtccttgggttgaattaaaaggatggctgtcaggcttagaacccggtccacacctgatgcaacagaccgcaagggcagcatctctaggactcagtcggagagtccatgcccatcggtggctgggtgattgatctgaccttctacctctggagggggctgagcaagctctg

SEQ ID NO: 61908 - DNA, 745 bp, Bovine  19866881337187
atacatttaataaatggcaaataacatcaaagacaacatattacatgtgaaatgtagcatgtgtgaagctgaaaatgattttcctgagtgctgggctctaatcaagttctccagtgttgcattaacatgggtccttaagcttcatagatcctcttgatatttcttagacatttaagaaatggaatagactcagccatatcctagcttcgaatgcacgcaactaatttccccctgaaacccaagaacatcttccaaaccatgatacggattcctggattcacaccgacaaaagaaataagagctctgtggaggcgaacaagacccgagtttcccattgaacaccagtgtcccaatttccaagtgcacaccctcctcctaactcatctctgaaaaatagacctgtcaagtccttggcattttgttccggtttgtctgatagtggttttactattttttatctgtggaactgcaagacacatttttctgtcttcaaagttattggatgttcctttctttgctaatgttggcaaaacatgaatgctcaagggaggtgcatggggaagtttgtatggacgatgtgtttctttcaaagctcatggaaaaagaatgcatttactgggttcctttgaccagcctcaggctctctgagattagttttagatgtatagaatatggccaggcattgcccatgtggttctgggctctgcacttgcaggaaaatgtcctttcccccaggcagggtttt

SEQ ID NO: 61909 - DNA, 888 bp, Bovine  19866881396051
cgaggagcagcccagctcctggagaccctgaggcctacagaagcccctgcccagctggcagactccctgccccctcttcccattgcaatttgcctgttggtccttcatctccaggatcccttctcggtaccacgtgactgggtgttccactgcgggacagccaagtttatatgctgtcaggcactttatatcccccataactctgcctcccaagccctcctgtgcatgtgtttaatttttacaatcaagaagacgaatggggagagtgacagcccagacaccctggaggggtgggctccggccctgccttggcagaacctgggcatgaattccatcagtgacccgaggctgtattttctgcataacaccccagtggtttttaaatctccttaaacttttgatggctgagataaaggagaaggcggaggctgtataaatatggagccactatttgggcagagctgcccatacctctgtgggggttggggtgttgggaggctactttgcattgtcacttggagttcattcccagctcccttcccatgcccacacgctcttccatctggcacccagtgggcagaacggtgggagcacccatctcccccatgcccttatctttccaagacacaccctgtgatgacagcagtgacaaggatgaagaaaggacacataaaaagaaaatattccataagaataaatgcatctcttttcaatggtgttattttattcatcataaccaagaatctaataaaagcaatacccttgttatgaaaatacagctataagccaagtcccctagatgccacttccacttggatggcagcccaatgaccctcctgcaaggcaatgctgcagcccctgcaccagagcaattgtctaaaactgcag

SEQ ID NO: 61910 - DNA, 1456 bp, Bovine  19866881414822
ccaccctggaggtaccatgatgggcattatgtcacaaccacagaatgaagcctagggcagctgcggacagggcatttaccccttccctgggccttggagcgagcttcccaaacacccagtttgggtggcagcagaagtggtcctgagtagatggaaatgtcctcaggatccatcttgcagtagtccctgggagctaagaaagctaacatgtttgtgaaacagaaaagcagagcaagagatccctatggcttcccttggaaatagttctttcagctcaagacactttcaggcttccaacaacacacagccccctcatacccacccctctgtcccctggggaagtaagccttaacacgcagagatctagcccgaggtcttgtagtttgagcccaagggacaagacgtctcctagcctggcctgagtactctgcaagagcttcctttcttcctgtgaccttccaggggatttttgaaccactgatcatgagtcacagcagaaaggtgagtttcccttacttcttcttggctgtgattaatgtatgaattgttggcattgtggctgtttttttcataaaaaaaaaaaaattataacagctgcaaagggaacatactatgcccacccgcagtctggctaccgtcatctcacataaccagatcagtttatttggttaaagcaatgtgaactgtaaccctgaataatttattgaactattgaaccacttggaaaataattgaagcttgagcctagttttacataacagatttaaactggagggaaatgtattagcaagatctcaacctctagaaagagaaaaggcagccagggagctgacagtccttatcataacatacagttgtataaagcatttctaaccagccactgtctttggcgatgactcaagagcatcccctatcccactccagctgggcctgaccacagaggaaagggagctgaaatgtgagaggaagaggggcactgccaaaatgagaagggaccccagaatttgaggagttggggcacagggaatgtctctcatccatagcattccatctggacaatgacctataatctaagggtctcctgaagatggcctagggaatgttagttgtgcacaagtaagatgggctccttttacagggaaaggaggtgtcagctccacctggttctgtgccttgacgagacaatgtctggtatgccatgtgtacatctgggcccatgtattaaaagggcatcaataaactaaggaacccaataaatagcattcagagtggaggaggagttccaactgcacgcaagcacaatcagtggaggaacacactctcttctcattgcaaaactttcctcatagtacaagtattttgatacatatactatagttaagaaaatatagaaaatacagataaatctgaaatcacaatctcaaaggcagaggtgtatatccttcaaggttttaca

SEQ ID NO: 61911 - DNA, 818 bp, Bovine  19866881448882
cccgcctcactcccgtcaaccactctctttaactcaaatgcccatcaatgtccctgctaaatgggagtcttaggcacatctcatcttatcataatgtcacgaaacccatagaattacaaatcaggtttaaggcagaaactgtgacagccaaatctaagtacaccaaaagtacattaagcatccgtcttcatttagcatccctattctggcccacctctcagctcagacccactccgtgcagagctcagcttgacacagtcttaagatccattttcgagtggactgaaatataaatgacagttcaccctgcacacgaacacagaaaactgtataaaatatttaaataaagacagcaaagaacagaggattgctgcaaagcctttggcagacccagccttggggaatttagcagcttgagattcattacaaatttcatctttaatgttatttttagttcaatattttgtagcactcagaagtaaatcttggtactactgtctcctctcccctggcttcctctcttctgttgtctgatccttcagttttactgaaacctaatacgttttcaataaaattgatttgtgacgtcgtaatgctgtgtgttgccatctcccattccttgatgtaatggggagaggacgattgcatgatttggcaaagtgaggcaggttgctcttggtggaataaattggagtgaacttggaaaccaccctgcagcaacacggaaactttgcatgtattcttgcctcttatgctctgccattttgaaggtctagcctccagtgtcactcctgagtgcaaagtaacctgtcctctcg

SEQ ID NO: 61912 - DNA, 689 bp, Bovine  19866881488495
cttccctgggatgatggatttatgttgatgctttggtgaaaaacttggcatacagtggttgtccagtgatgctgacccctcctgcagccctgtgagaagggcagccaccgggtcagacttcttgaagacaaaagcttataaaacaggatgaggtgggatgccccagaggatactgcaagcaggtgctgtgagtgggacaaggagaaagaaggcggggaggtgcggaaggcagggcagggcacaggcctcctaacttcctgggaagagtgggcatatgcagggcgagtaaggtggattctccaggcctttctgggagctaattaaaggaatgggtttagtgaggagcctcgctgatatttctattttccctgttagtagtgactggaatttgtaccatccaggtcagatggaaaatagaagcctggaaaatctgacactctcattgatttgctcaccttgccatcgctacttgagagaggaagcactgtgactgcaaaattgcaattaggagccagcctgttaagggttcctcacatgagctcccgtgctgtgtagctcccaggcctaccttgtctcctttcctgaggaggtagattcattcatagttctgaatgaagcagggaatgcaaacgtgtcacacctcctcatggtaaggctcacatgctgtctggcactttgctctcattttt

SEQ ID NO: 61913 - DNA, 702 bp, Bovine  19866881603898
tctgatgttctcttggccttatagcttcctttctccctgcaccgccaagccgagtgttatcagcacagctctgggaagcagcttcaaatgaaaggtgctgtgttgccacaaagctttcagatgatggagtggccggtgctgaaagacacatcgagatagcaggaatcctgagaatgttctctgtaagattaaacagcaagaacaggtcaaaccagggacccacaagcaatcatgcagggagaggagaaatagacatgcgtgatgtcctcagtgatgacagagtcagagagctgtaccttcggaccctggggaggatcttctcagtttagagatgagtaaactgagcttccctggatttcagctaggctctgcacctgtctaggttcctgaagggatgttgtcagaggcttgcaggtgacctgaaggctttaactcttcttctcaagaagtgtaccctaggcgggcaggtggggagacactgacagaacgggactatctaagtgggtgttccagccatccatcactctcccagccctctcagatgcagggaagaccaggtcctgtcccagcactgtgagacagtgctccactctctcgagctccacttgggcccatttcaaattctggtgatactcggctggagttcaggaggaattcaggaaggagggcaggaacagagtgggcaggtgccatgtctggcag

SEQ ID NO: 61914 - DNA, 616 bp, Bovine  19866881939691
cctcctgcattgggcaaggctgcagggctgtggtgcatgttgacagaaatgacttgcagagaaatgggtgagatctaacacaatttgggttttcatctgttcaaaccaacagtcaactggataattaactgattcaagaagtgggagattgacagcaattttgaaaagcacagcaactgacagaagccaggctcagatgaatggaaagggaacaagctttgttgaacacttcccaagctattacagagaagatgcttaaaataattctagaaagctctccactgccaggccaagacccagccctctggatcatctgaaagactgttgattcttgagggagcttttatccgtatccaatgtgcccctccttggaaaacaaatgtattacaacagacttaaccatggagcagcaggtggtaggggaaattagctaagatgttacacaggaaattctgagccttataggtccaccaaaaaatgaccaatgagaggtaatcttcatagttgttatcatcactatggagacccactggaggatgctcaagccccgctgctgaggagggaccaccacaggacagccagctccgatccttccctgaggtgtgttttctgtgca

SEQ ID NO: 61915 - DNA, 1579 bp, Bovine  19866880508231
tcctgggataaagacatctttaagtcttccccaaatgacaatatatatatatatatatccaaattatttggtaataaaactattttgtttggcaaaacatttagtaaagctctaagaaaggcaagcctgcaaaataatgcccaaactactcagtatggtatcttcacctctctcctctgctggacgttgcctcccagttccagttactgtcagcagagttaataagaaaaagagggatttgatttcctcagaaattaaggagagtctacactcttaaaatgctgctgctgctgctgctaagttgcttcagtcgtgtccgactctgtgcgaccccatagacagcagcccactaggctcctctgtccctgggattctccaggcaagattactggagtgggttgccatttccttctccaatgcatgaaagtgaaaagtgaaaatgaagtcgttcagtcatgtccaaccctcagcgaccccatggactgtagcccactaggctcctccgtccatggaattttccaggcaagagtactggagtggggtgccattgccttctctgccacacagtcaaagacacatataaatgtcatcaggctgtttgttctttgacgatagcacaggtttctaattttggctgatattttaagaggacacactggattatattacagattcatgaagattgtgtgtgtgtttagttgctaagtcgtgtctgactgtttgctaccctttgggctgtagcccactaggctcctctgtccgtgggatatcccaggcaagcattctggagtgagtttccatttccttctccagggaatcttcctgacccaggattgaatctgtgtctcctgcattgcaggaggatactttacctgctgagccattggggaagccatgctatggggataacagatggaaaagcctatctaacttatcaagcctaagtgttgttcatgtctcaggcacacacatggaggaaaggctggaattgtgtcactgacagtttcaccaagaagtacagaagtttacaagattgagagttgaagctcattaatgttctttgacttttttttttttaatactcaaaggacctgaagatagtttgataatgagactgttcttcatttccagattgaaattagacatgattaggaatgctgaagtactgggcaggtcaattgtgcaccattattagagccatttaatgcattttaatggtggttgataaggtacaaaatgctacgtaagccaaaagaagaagttttattccatgatatgtaagcatagatatggatgagcccacatttgcattttttatgcattagttcaaaaaattaaacatattctttgagatatgagtggtagaatatgtaatttctgagcaatgagcattgctgatgccagcatatcaagctccttagacactgattgtcctttaacagtgaattcaagaaaagatgtcttcagcattttgtgttgctgaagaatcatgctctgagttataaagtcaattgcttgtgtgactagcctgttctacttattttctcaaatttattaataaatatggaataatagctca

SEQ ID NO: 61916 - DNA, 1281 bp, Bovine  19866880516934
cttttattattagcagcctgagttttttggggagtagacaggatatgaaaagatctgcaaaaccagaagtgatatatttttggtttttgtttagcacggagaattggaaatggaatatatttattgcttaagtgatgccatgcttttcaaagaaagaataagtttatttcctccaagtcacagtggaggagcattatgtaatattggctcagtgggtaaaaaatccaactgcaatacaggagagagaggagatgcgagttcgatccttggtttgggaagatcccttagagaaggaaatggcaacccactccagtattcttgcctggagaatcccatgggcagaggagcctggcgggctacagtccatggggtcacaaagagtcggacatgactgagcgactaaacacacacacacacacacacacacacagatacagaatcattttaagaaaattggttttcttcccttctctctcctttgttgttgtgttcagtctgttcataaggggttaatccttatttccagcccataaaggtcaatcagctaaaccatgggttctctactgtcctgctttgggtcgggttggacagcagctgtggtctgagagctcacccacggaagcatatgctcacaattgccctccagggtcatggctctgacaactgcattcagactgttcacatgtgccaagcgcagtccagcctttaacatattaagaagtaaccaaatcattagggtttcatacttcactggcaccatgcaggttacggacttttctcaaagggtaaaagcttctgctgctttctttagttcagtaataaatatttataggattaccagcccattgtcgatgggataaccaaatgcattctaatgcaaaactactggctgcttatctagctgtttgacagaaagcaattacatgaccatttctcttttttgtgcccttctgttacagctccctggatcactcatgatgggctctcagtaggtgttattattatttttttttcaacttttccaggcatttgttgtaatcaaggttagatgcattcactgttgtggggtataccataagtactaggatatatattattactggtttatgtcctgatacgaaaacatttttttttccaacaccatagaaaatcttacttaaaatccagagaattctctaggcaagaatacaggagtggatagccattctctttgccaggggatcttctcgactcagggattgaaccagaattctccctcactgcaggcagattctttactat

SEQ ID NO: 61917 - DNA, 1088 bp, Bovine  19866880517631
ccaagcagagttgacacataagctgggtcttggacacgtaggagttagctggagcaggggggcagtcaaggggagagcaggtatgaaggggcacaaaccaccccagtactttaacagggctatgctgagggcttggaaggtggggagagaaggggacaagaggaagctaggggagtgagcaagtggatctctgggatgttaaggtcttcttttgcacaagatacctggcacaatgaggactgctttcatggcatgtggttattttttccccagaaggctgagcagacaggaaagctctgacataataatcacatcatctctttacacactgaaaagggaaagaaagaaatattgctacccattgattctcatgctttacttgtaataggacttgtcttattatgggcattttgatacatttaagcttattaaaaggtaaaggaaaacaatgtctgaaataacaggttcattaagcaagaaaatgagaaccataaacaaggcaaaggatattaaactattttgcttttcattgaacttgcgaattctgtagaaggcaatgctgggcttagtgagaagtaattcaaaaagtaaattattttagtaatggactggtcgactgacactattttctagctgtactgcactaaacgtcatttaactgttctaatgaatgtttatgccacaggtacaactgacaagcagttctctatgtgtatgtatgtgtgtgtgtgctcagtcatgtctcagtcgtgtccttctctttgtgacgccgtggactgtatgtagcctgccaggttgctctgcccataggattctccaggcaagaatactggagtagagtgccattcccttctctaggggatcttcctgacccagggatctaaccagtgtgtatgtactctgtctcctgaattagcaggagggttctttaccactagtgccacctgggaagccctaagagctctctgtctgtaaataaaataagccagcataatagatggatcaatgcacaatgcaacactgtattatgcttggtgatgtgctaaagtaaagtaaagtcactcagtcatgtcaactctttgccaccc

SEQ ID NO: 61918 - DNA, 1949 bp, Bovine  19866880591777
acatcttaacaggaaaaacccaagccatctcatacccatgctatctgaaaaatggatgacagcgctgaaatctttatttttgagataagaaaactttgtggagaaagataatacattaagctttgtgtgtatgtgggtgtgtgtgcacaacagaaagtgaacttgctctttatgattccctttatgtgctctctgtgtatcccggtgttttctttcatagcacttctaacattggtaatttgatgtttattttggatacattatatctcaagacaagctatccactcttttttttttttaattctctcctatattaccaatgtctctagtcgatggtttggaataagatgaaagtgaaagtgaaagtcgctcaatcgtgtctgactctttgcgaccccatggactatacagtttatggaattctccaggccagaatactggagtaggtagcctatcacttctccagcggatcttcccgacccaggaatcgaaccagggtctcctgcattgcaggcagattctttaccaactgaactatcagggaagtctcatagtccatggtttggaataagataaatttgctaaatcaatgttgcaccagtgaatgagtgaatgagttttgactgttattgggtggaaataatattcagcaagcatctaccatgacaaacactctactaggtaattatgcctatttatctcctttaatcttccttatgattctgaaagattcatattatcagctcccttctaaagatgaagaaatggaagttcacagagattatctgaaccatctctgtctgtttgggtccaaggttactattacttggacaatgacagactttctctgatgctgccctgagtgaaaacagatgccaactcagtgtaaatgtgacttttataagaagttcggtaattctgggatgcactctcatgaggaactgaattctctggcactggaattatggagtctgcctgaccacctgtcaggaacatataatagagaagacaggaaaggaagttgaattggaaaaactctaatgttcctctccgtgctcaaactttaatttactgtctagccatatgctgaagtggcagaataatacagttcttccccccatttggcatttctccctttttcttttccttttaaagcagatggttgctattgtgcttgttgccccaggagaaggatacgcagaacaacaattggaaagtctgctatcttttggcttttctgttttcaaaagcctaagcctttaggggaagctggaagcttaggggcacagatgaaatatgtgaaagaaaaaaaaaaaaaaaagatcacagctccccgactggtttgaaaaggataatccagactagtgaattagaattagatgaacaaagtgtagactgcttaatgaccagcgaggtacttacttgatacctcaggagaaagataccctgcagcttccttcttggggtagatccacgtggaagcagaaccaccccaaaaagggcttaaggggcttgagaatacaagagaccacatccgttttcaggtaaaattgtgaggagataggaaaacccagcaaaatgttgtctgtgaggagcgtccaggcatgctagctgaagaaggcactgggtggccccaggttgaaagggacacagccccaagcaggtgttgaactggtgactactggaggcagccggctaagtggcttctttaaggcaaactgtctcttgaaaggagagctgagtggttcaccactaaggcttccgtgaccgccaatgttcttttttttttttaatgtaatgaattcttagaatagtgtggttatggatatgggggtaggttcctgagcagagttctgaagaaggggaacagaagaggcgaagggattataatactgacaagaagcgcctgggttaagtgagcagccaagcatgggaacaggttatcctaa

SEQ ID NO: 61919 - DNA, 1788 bp, Bovine  19866880596631
tactgtgacctagcttacttgacacataaaatgaaccatcccagatcttgttcctgtgttctggtggcctttggggaaatcactagtggaactgtattattgatttccttctatgtgaagtacagttctttatatctcaacaggcagaactataatacaaactagtttaaggaaaaaaaggagggggtgggtgtgagtgactcagtggctcaaactgccaaggattctagcttctagatcaagttcccctgatatgaggcgccctccctgttttgtctccattttcatgcacgtgctcttggcttaaaatcttcacagaatgtttttcttctcaggacttccatgggaaatcctgcacctgcatctcattggctcagttgggtcacatgcctgcccctcaacaaatcactgcagcaaaggcagtgaatgcactgattggcttagactgggtcagggagcctacactggagctgatcttcacccaagccaagtgggctgtagtgcagagaaagaacaattcccccgtgggaatcagttgtttgcaggaggaggatgacaggttgacggaagggctggaacatcacatgactactccagcctcacatttaaagctctcctctccttgcctgtcccattgccctcctttcagtctttgccttccttatcctcatctgtgcctcaaccattttctatccctttaaaaacctggttcttgctttgctaattttgcaactcccaattcgtcctaagaaagcagatgcctcagaagcaggctgcctcagagagcagttttgcgcctgattctgtacgtgtgatcattgcccagggacagtctggtacgagcctatcagtcagtgcagtgcgtatgttcctggcgtgggtggatggctcagagtgacttagtactaactggtgctgggaagaaggcaagttatgcctgttctgtttgtccaatagccagagatctgcaggagggactttggaagggaaactgggagcttacctgtgagttgtagctgactagaagacatctcacactagaaggattaacattaggggcaaagctacttgcaaacccttttttatttttggtcctaattgtgtgggtgtgggtgtatattttaagacagctttattgagatttaattcacatatcatacagttcactcatttaaagtgaagaattttttttaaaaagcgtattttcagggttgtgaaactatcactgaaatctaattaagaatatttttatcatccctgaaagaaacttcatacctattagcagtgactgtccatgttcctcttcccctgggcctctggcaaccatactttctgaccccacagatttgagtattctgaacatttaatataaatggaatcatgcaatctgtagccttttctgattggcttcttgcacttagcataatgttttcaagcttcatacatgttgttgcctatgtccatgtgtcatttcctttttattgccacctaatcatccattgtatggatgtaccgcagctgatggacatatgggttacttccactttgggacttttatgaataatgctactgtgaacatttgtgtaagtttttgtgtgtatgtgtattttcattcctggtggggtatatacctaggaaggattgtaattgctgggtcatagggaaactctgtgcctaactaggcaggaagtttgcaaagcagctgcacaattttgcattgttaccggcattgcataaccttgccaaagcttgctgttgtctatgtttttgattatggccattctagtg

SEQ ID NO: 61920 - DNA, 1728 bp, Bovine  19866880637628
tggtgatatttacctgtatgttattctctctgaaactctagacatctggctttgacctgtctgcacttttaattggaatgaatatgaaactctcttttcaaacatctcaggagttttcctacttcctattcaaagtgacattttcttcccctggtggtaacttattattctgctgtttgctatacttttacccactgtccttgtgcttcactttttacaaaagcacttttttctttccctgaaccacacagtatacggatgcattttacaatttatctttttttcctacagaacaatttttgtttcagatctcaggagcatcttagatctaagagaggatgatcacaaaaacttgattatttcccatcctttctcttattatatcatccacaaagtacaagaaagcatagaacatgcctccatttatccttcctgtttatcaatttcagattttgtcagtacaataaaagtatgatattcatgtttattttttattctgtgttttctatttaagatgcctctattataaaaatgatctgtcatttatgtatcagtcttagctcacagaagttagtatcctaagtacaaattaggttctgaaaactatttaatatacatatttttctaatatttccttgatctcctttatttgagtctgtctctctgccctcattcttagaatgttattcctcttttcctcaaccgccagcctgcgttatgttacattggccaaaaagtttgtttgggtttttccataaggtgttatggaaaacaaaacttttggccaactcagtatttcatgggagtcacgactgtttctttttttactgctgaactcctctttcccatcttctttctctttcagactctctaagttctaaagtatatatctctcaggagttcccttcacacaataaggcaaatacccttatctcccagaaatatgattttttccccccaaaggaaactcaatagatgaaagtatacaaggaaggggtgtaagcactgttctgttgggagaactgtctcctgggctctgtggctgtgatgggagagctgctgtgccctcaagagctatgaaatcaatgaaaataacagctcgagatattctttctcgaggtaacttgagtcagcccacaggtctcattcatcccatcaccaggcaaaggatatgctcttgtcactgtccttggcaagaggtccaaaagatactggagtgcgcgtgtgtgtgtgtgtgtgtgtgtttgcgcgcgcacgtgtgtgtgggcatgtatttaagcccatccctgctctcatcccagtcctggcaagaagcctgtgctctcatggtgctcatctccatgtttatttctccacatgatggatactcagtatttttaaccagctgtttcctccccacatgaatatttcctgcgctgacttttccctctgcccgggagatctttaatagtttcctctgattgctcttgtatctctcctatgtttccccagtcaaagctgcctctgtatttgcagtcaaaccacacatatctttccatcctaaagtaacagcgcactccctcccctctcctttccctttgtcttggtggactgattcatttcagaattcctgtgattgctttacagtgtcagagaacatagaatattattcatgaaacaagaaacagggacagacagatatatgtaaaaaaattaattaccccaaatgttttatgtagagagagggta

SEQ ID NO: 61921 - DNA, 823 bp, Bovine  19866880686959
aaacactttaggctagaaaatgaatatcctttctgcagataagtgtgaccatttaacaactgaagccacagaatgtctgattgaaaggtgtcctcttcacatttcacattctgggtgtgacactattttagcggtagtcaaaccctcatttgcagttaagtgtgaaagtgattgaacccccatctcctgcatggcaggcaggttctttactaagccaccagggaaacccatttggagtaaaactcagtgctatctcctgatcaaatgttcttttgctacggcaattttaaagtagaattgaaaccataatactataactgtggccatagcgtccttgctaattttgtcattagacacagcttcagtagcaggtgttaatttctaggtaaatttcagctaggcttcttgaaggatgattcctaacagctgctatcctctacgcttattttttttttttccgagaattccagttcccaggccaaagggagcagctttccatgtgtctattagtgttccgatgccagttcttcaggatgatattaatctctatgccacagattcatgtattttttaatctacttcaagaacaaaaaggatataatggcccattaggagacattaaatcctgatcatttcgttaatgttctcgctaatatgtgttctataaagttgctcacttttataaccaagattctagtgtcatgggttaatgagccacatagcttctaatgctgtacatctgccatcaatccattatcaggaaaggactcatccatcgccgtagcagaggattagaaatcctgcaggggtaataacccccatt

SEQ ID NO: 61922 - DNA, 830 bp, Bovine  19866880734528
gagtacgacatgactgaacgactttacttcacttctgaactaaatgcacatgcatttattacacgagttaaagctaagctgctttttctcagttagtaaatagttatggctaggcaagtttgttttttagtgttagtgacacacatgattgaaatgatagttaatgcacatttacagatcatctaacatcaagaccacaggtcatcctctactgaaactcatcttaaatttccttgtgaatcttgatttcagttacactatgcatctcacactcacagtcacgttgtttgctttcgttgtaaacattcactgagccttcttccccacagataatcatctctccacagaattcagtaatgaaggccagtacagccaagccatattatatcagaaagaacaactgaaataattttttcttctcctaacagttttacagtgtttatatgaaaacacaagttaaaaataagacttaccaccacaatatatcgaggtctgtactgaatggttccaaacaaacccaatatgacgacaattatatgtagaaaattgccaagaatgggcgcccactggaagccaaggaagtcaaagatctgcctctctaatgctgagagctgcaacaaagcaaagagagtccatgagtatataacttgtgcaccatcagaccacattaatgttggcttcatggttggagaaggcagcaaagtcaatttcaattgcacttatggacactgttatcactaagattgtgacacccatttcatgtaccgctttattcaatgtctctcagaaaatacactaaaattacttgaatatcaggacttcaattataa

SEQ ID NO: 61923 - DNA, 1701 bp, Bovine  19866880762596
cctccccatcccatccctctgggtcatcccagtgccccagccccgagcatcctgtatcatgcatcgaacctggactggcgattcatttcacatgtgataatatacatgtttcaatgccattctcccaaatcatcccaccctcgccctctcccacaatgtccaaaagaccgttctatacatctgtgtctcttttgctgtctcggcatacaggcctttgaaagaccctacatagggctttcctggtggctgagtggtaaagaatccacctgccaatttaggggacacatgagtttcatccctggtccaggaagatcccacttgcagcagggtaactaagcccgtgcaccaccactactgagcctgtgctctagagcccgtgctccacaacaagagaagccgctgaaatgagaagcccacgcaccacaaccagagaaaagcccctgatgcagtgaagacctagcaaagccactgaaatgagaagcccacacaccacaaccagagaaaagcccccgatgcagtgaagacctaacacagccgaaaataaataaaattttaaaaagagaaactctacaatattaacacaatttaaaattgtagtttaaattatgggctgattctcaattcagtaccaagtgatttgcagaaatagccacctgcttgctcaggatagaaaatgtggtgtcatcattggttcctttctttcctctttcttcccccacatacaaacaagcattaaaaactattcattctacacttctagtggtcttttcatccccaccaactcgtgcaagactataacactggccacatttgcagcttctccatcaagaggtagaaccgactgtattgcccccatcctcgaatctgggttggtctttggccagtgtgatactgcagaagtgagatttgaggtaatacattcaaaactagggctcaagagaccttgcagttttcactagtatgctcttggaaccctgtgactgccttgagaagatccgttttatcctcacaatgacatacaagaagcaggtactactattatccccgctttaaagatgaagaacctggagcacagggagggtaaataacttggctgaggtcacagagctcaatattgatcatcaagaccaatcactgcctagaatcagacccaggtgttctgactctagaacctacagtcttaaaagccacacttcttggcagagattaaatgctgtggtcaaccaaggatgaatagtatctccttgctattggtcagaggaggagcatggacctatcacgttaggtaacattttccagagttgcaattacttgttcaaaactatgtctttctcaagcagagcaagaagaggacccccttatattccagggatatttttatgtatccctggaaaggtactgggcatagagcagatgtttgagagaactatttccctttcagaattcttacattaaaggtcctttaatttgagaaggtaccataactttttcaaatacaggatcgtggtatttatttagtgagttttcctcttcattctggttgctaaggaagttcttaattatcatgcttagttattgcaggttttctcaaccagtagattttgatctctctgattctttattatttcctttgttttattgatagctgtttttggtctttttatttttgtgcttttattattagcagcctgagttttttgg

SEQ ID NO: 61924 - DNA, 1266 bp, Bovine  19866880780546
gtaaagaacctgcctggaatgcaggagaggcagaagtcatgggttccatcaccaggccagggacgtgccctggagaagggcatgacaacgtacttcagtatccttgcctggagaatcccatggacaggagactggcgggctacagtccacatggtcataaagagtcggacatgactgaagtgactaatttgtaaaatgtgagtaacaataaccttctatgcttgtaatattatatgaaacaacccatataaaatatttagcataaagaaattcagtggttttctttccagctaattttttatcttaatcaaaataatataaatacgacatagaaaataaaacaattgctaaagacttttaaagaaaaagcagtcctttctattttgagttaaagctatcttaggattttgtttttcttagaaaaattatatacactaaaaaataatactgtcgtcatttaagtaaaggtttactccttcaataaaccagtctgaatacaaacttcatacttgtttttaataaatgaaaacaaattatggtttgtgcaaactgttacataagaaatgccatactatggtatgaaaaattggtctatttctaaaataaaaaatggggacatatctggcaaattatattgcttgttgatccataaacttgcatagatcaaataccccaatacaagagttaaatatctaatactatatttctaaggaaaaattacactatctggaaatattgaaactgtgatctgtcaagatctagaggcttaagtataattctgctttgaaataaatatttataataaccacctgatcctaaaaaattccaaatacattacaattagctttcaggctctctcagaaactgattaagctttctatagaagcaataaactaaaactccatttgcattattaaatttagtaatagaaagagagcttctatgtaacaaaatcttatttactgacacacataaactgtaaaactgtttacttcaatctgttcttggtttaggagctaacagattttaacctatgaaatttcatttacaggatattcctacgaattaaataatatccaattcataatatatgtgctatgttaccaagtgtgaatattaatctcagtagttattagtgaaattattagtgaatctcagtaactatttaatagaaagcagtgatcaagaccatcctcaagaaaaacaaatgcaaaaaggcacaatggttgtctgaggaagccttacaaatagctgagaaaagaagag

SEQ ID NO: 61925 - DNA, 928 bp, Bovine  19866880800533
ctgatcttctgagaaaataaagtgtgtaatgactagcagtttttctttgatgtgatggggattcatgacagcaccattttacgggtcaggaaagtgaatctggtctgttttaacagagaaactcctaggaggataaaagcagaagacatgagatttctacttccagaccttttaatgaatcatcctgagaattttagcaagtcacctttcccctccaacttttcctcgacattatgcaatactaacttttgttactacacttgcctttaccatcacgtgccatcaatttcatctacctaatattaatattagaggcttcctgagggtggggactgtgtcctcaacttttcttgtgttttctaggttttggtacaaagcactacatgaaatattgcacagtgccttttttttacccttaggaaaaatatgttgaccctgcacattgttaaagctgttaaatattagaatttggatgctaaaatgaatctcaaagattgactaggaaatcccgtcatggtagaactgacaaagctgggagccaagcatcaatgtcacttctaaatcctgtatctagttagcagacaactatagcccgaatctaggtcactagaagatttgcttctttatgctgttttagcaacagcagagataatttaggtggacatttaagagcaactcaaatacacaaacaaaaatattttaaaatctctcattttagttttaaagaactgtgttttaaaaagtccagtcccattacttcatggcaaatagtggggggcgggggagtggaagcagtgacagactttattttcttgggctctaaaatcactgtggatggtgactgcagccatgaaaggaaaaaatgcttgctccttgggggaaaaaagctagacaaaccagttcagttcagttcagtcactcagtcgtg

SEQ ID NO: 61926 - DNA, 1362 bp, Bovine  19866880821349
aaatagtgcatgtataaaatattcatgcaatattttaaattaggttcccatgattattgcaaatctctgtaaacatactaaaaacattaaactgtatcctttaaaagggtgacccttcttacacataaattgcatctcatgaaagcttttgaaaaacaaaactcacatgcagaactgaccacacagatacagcattccaggcaagcccctctgactacagctcacagacgcccacgaagaacagggttagaatggattaattctctgagctggaagaggtgtggttttttcattcatttcagaaaagtaaagtagtttatgaaaaagacagagaacatatttagaaaatgaacttagaaaaacatagaaaataaatttaccatgaccaaagaagaaagggagggagaagaataaattaggagtttggaattaataacaaactactatatataaagcagacatacaacaaagaattactgtatagtacagggaactatatgcaattttataataacctataaggaaaaggagtctgcaaaagaaaaaaatatattcacagacacacatatacatgtacaattgagtcactttgctgtacacctgaaactatcacatattgtaagcaactatacttcaattaaaaaaaaaattagttcatgacaaagatagaaatctccaaaggaaacagggtctctattctctttttgctccttttaattctttgttccttctttccacttttttatctggagaggagtggaataaatgagcatgttttagtgtcttgtctactggctttttaagctatgcctatttttattatttttataatcagccctctagggattacaacttatcatgatcaaccttgaattcatattacatataatgtaaaaaattttaattgactttttaaaaatttaagagagaagataatcttttatattaaccctttattcttccctgtatcaaggttatttactccttattgtagatataaatatccatctggcatcatttcatttcagtctgaaaaactctctttagcatatttgatagtgtgaatctgccaacaattatttctcttatcttttgtttacctgaaaatatttttatataaccattattttagtgatttcttttattttttttcataaaatttgttgttgtttaatctctgtcatgtctgactcttttgcaaccccagggactgtagcccgccaagctcctctgtccatgggatttcccaggcaagaacactggactgggttgccatttccttctccaatatagaattttagatagacagtattacacagtttttgtgtttcagcacctcaaaggttttttttttcccacctc

SEQ ID NO: 61927 - DNA, 2630 bp, Bovine  19866880923400
ttacttttaattcctatgcattttccagttttactagatatacatttaggtgaaaatcataagtgccttatattctagattcaacaggtggctgaggtaaatccatcctacagtatatacatgcaattgagctattatggaggaagtaggaatatcattttctctctaatctctatagtctactgccaaaaggtgcccagatgctatcatgatataaaatccattagattaactgatccacttaatttgattagttatgatagtgtatatgtgtgtgatctttacattctacatggctctacttgaaccacttaaaccagccaattgaaattgtgatcaacaaggggctgccagtcagaattacccaggaatgttttgatagattcttgagtttctgagtctcgctctctggggaacttcatgactgggtatgaaatgaggtccagagaacagtgtgtgaaaacctcctccaggtaaccctttgtgtagccagctgaagaaatcatattgtgatgaagtgtaaggtgacagagtcgatcactccatgctgctactatagagcgtaaagccatcacacccactggctcaagtcccctgactgctggtcaatttcagacagccccatcagttacagagagttctggagcaagggaatgaaggacacaggtgcagtcacaccatgaaaaagcacaaagaacaaatattttgcaggcatatcaataacaaccttgaaggtgaattgtagcaaaagattcttccttcatcaaaatacatgatcctgtctcagacctcctcctccacaaacatcaccacgctaccaactcaaacccctgctctgcttatctcccatcatcaggttgaaactgcctaagtagatactgcacttcagtgacctgcgtcacttaagcctcattttctaacttaagagaatgatacatcattgaaaagagcttacagttatttgaggccataaggcataaataaaataggtattaaaataacaggagacataagagatgtgagttcggtccctgggttggaaagatgccctgaaggaggaagtggcaacccactccagtattcttgcctggagaattccatggacagagaagcctggtgggctacaaagtccaaagggtcacaaagagttggacacaactgaagcgatttagcacacattagaataacagcttatctgtaacaagtgtctgtgtgtatacatatatatatatatttaaaaatcttgtctaaagaataaaaaaaaacaaacttctctatttatttaaactagttgaatagacatagtcaatattgagtatttataacgatagcagacaaagccatactcaaaaatgtgagcagtctctctactgacttctctgttctatttaattcagaattatgaagttctctacggcagtgcatattaaaatttccttacagcaagggtcttttgtctctaactttgttaaataagattccccatgtagaaaaattctatccattccatagtaataaggttgcttttagatggatgaacccagaaaaattgagttgtatccctaagcacttcataattgctgaataacaggacctgactgctccaagacaaaaccctgatctcattaggacctgctgtttcagtacagagaagacaattatatgtgaagggtactatgcttttggaaatgctaattaattatacattatttattggaaatacaatgctctcttcgtactgtaggtaaaacagaggaagtaagtgcgaatttgagtagctgagacttgcgaaattgtaaggagctagagtcctgtgtttcaagtctgggctccttggctgaattgcatacaagtctactatgtctgaagtccagtctttcccctttatctttttgaaaaatatttatttattttggactgcactgggtcttcgttgctgcatgggctttctctagttgcagtgcgagggcttctcattgtgctggcttttcttgtttcagaacatgggctctagtgctcagggtttcagtaattgtggcgcatgggcttagttgctccacagcatgcgcaaccttcctggacaagggatagaatggtgttccctgcattaacaggcagattctcaaccactagaccaccaggaaagccctttccattatctttaattgaccatcaaaatctaagaatggaagggaaagaagaacggttatttggtaggttttagccaagcaaagggcttcccatgtggctcagcataaagaatccatctgccaatgcaggagacacaggagacatggattcgatccctgggttgggataatccccaggaggagaaaatggcaaaacactccagtattcttgcctggaaaatcccatggacagtggagcctggcgggctacagtccatgcaattacaaagagttggacacgattgagcacaagcatgatactctttggaaaaaaaaaaaaagccaaactaagctgatccaggtagtttagttttccttttacagcaaaaattacagggaaataatagataaataaataacagtaaatagtgtgtaaacagtttcccaccccaaaccagtacagtaaagaagtcgaagcaggcaggggcggtttcagacaaa

SEQ ID NO: 61928 - DNA, 706 bp, Bovine  19866880963202
acaacactctgttgcagacatctggtatgatcattttctttctttaaaccatctttgttcagtggaggcaggagaataagagttggggattaacttatacaaattactacataaaaaataatcaacaagaacttactgtctagcccagagaactctactaaatattctgtaataacctacatgggaaagaacctgaaaaacaataatatatgtgtatgtataactgaaccatgttgctgcacacctgaaactaacacaatactgtaaatcaactatactccagtataaaatttgaaaaaatttaaaaggtatttttaaaaatctttgctctactttaggctcaatttgattccataaacattaattatcagcaggataccaagaacttggctagacatttgggatgcatatataaataagtaccttatcttgcatttaaaaagtgtgtgagctaccacaagtcttggaatggaagggtgtacaccataaataaatacgcccacatgcagaatacacagattcaattttctaggagaaaagttatgtctaatttagtctttctttccaatatgcaagtatagaaaattgagttgataaatcatgtaaaatcctaagtgaagaaaactgcaattgctttcaagcttcctagtacagatatttccatgggggtgtgtgttaaccctcgtctatcaagtccagatagggg

SEQ ID NO: 61929 - DNA, 2418 bp, Bovine  19866881062752
aataaactcttgtaatagccacaaactgatctgcctgcttctggcaccccccagtcagattaatcttcctggaacactgcatgtcaggagagcaagaatgtctgaggggaaagatatttcattctgcctttatttcatggtccttagtactggcttgatacaaaaaagaaaggagagtgtagccactagacagttactgaggagctagggagacttttatatacatatacatatagttatacttatatataacattatatatacctttatatataattacatataatagtttatttgtatatttggttatatatatgtacagttgtgcatgcatgttaagctgtttcagtaatgtccaactctctgtgacaccatggactacaaacctccaggcttctctacccatgtgattctccaggcaagaatactggagaggtttgccacaccctcctcgaggggttctttccaacccagggaccaaacccacgtctcttatgactcctgcattagcaggcaggttctttggttaccactagcaccacctgggaagccccatatatgtacaattatatatatatatataattttatatttatatatataggcaagtgtgtgtatatatatatacacacacacacacacagtaagttccctacatacgaaagagttctgttctaagagcgagatcataagttcaatttgtttgttagtccaacaaagttagcctaggtacccaactaacacaattagctacatagtactgtactgtaaaatgtttataacacttttcacacaaataatacataaaaacaaacaaaaaataaaacatttttaatcttacagtacagtaccttacagtgtaccaggtacatcactgctgcctttatgcttgcttccagatattctaggcttgaaataagcatactctactattgtcctctgcaaaggactgtacagtaaagtacacaaaagtaaaatcacttgtagacgacgcacacatgtgacaatggacaccagacatgtaaactatcttatgagtttggacatgtgaatgcacatttgcatctttgaaagtttacaagttgaaggtttgtatgtagggagcttagtgtatattcatacatttgagcatggacatgtatgtagggaaactcacaatagaagaagtctgtagacaaaggagatatgatgacagtgagatggaaaggattggatcaagagcagtttgagactatgaccaaggacaggaggcaggaatcttatttcctaagacagagtgaaagtgacactcctgtcaatatattggctcaactggtccctcgcatatctactgataaaaatgctgccttgtcagctgcaaaccctgtctgaatcttgaccagcttttcatcttcagtgaaggttggacacagatcctttgattgacattaatttctgagcgagatcaaagaaatcataaaattcacacctgaagggcacctttagttggggctggattttgtcccactgtttaccttctgggtccttttggtgtgcagtatggaaggtaactaagaagactaacaaatcgatactggagataatgatgttttcctaattcaagaactgccctgaccttggacttgtgtgaaggagtaaataaaatgcacatttcagggaaggcagagcattcaatctcagttataaagaaggaggcaaaattcaatgaaaaagtgggttctgaatttcttttcattaaaatcagcattgtagtgtaagcaaaacactctttcttctcatattaatatctgcttcccaacagagtaagtaaaacaacaaaaacaaccataaaccaagactggaacaacagctgatctgtgcagaaaagtaaaatgctttccctgtatgaatgcatgttcataattcaacagcaaacaaacaaacaaaaatgtgtctctgttgactgcggctcaagttggtggcaatggttgttctatgcaaataaacgaatgaaaccgtgaaatgcgaacatcttcaataacatccgcctgcaaatgttctgaacactcagtgtttgaatccagtgcagctaagtacaaatgttaacacttctgccttaaatggagtggagtactgagtcttccaagtctgacacagcgagtgatgtgaggcagagcagtctgtggtacgtgcatctttttcttctcagaatgaaggctgaaatatggagacacttgaaggaaatctattccttcgccaaaataatgctggtatttgtcatttgcttccaggctcgaacacctgctaagtttaatcttttaaagaactgaaaagcatgggctggcaaggatcaaaattatactaacagagaaacagaggcgctatggtacttaacagtcttctaagagcctgcatctcccttaaaatttctgaaccaag

SEQ ID NO: 61930 - DNA, 1317 bp, Bovine  19866881123524
ctaagtgaccattgctgtcctttatttcctagactgacccccatagttctgaggggttttgtgctatttgaaaaagaaggcagaggcctcttcaattccttagcatgttctgcgtcaccttggaaactaattgtgtatatcagaaattccactctccaatctcaagctcatcaaatgctacagtcctgccccaagtacagcatgcgatgccaactgcctgtcagaaatgcaggtgggtcctcagtgtattgaagataattattgccttttagatattgtaaatggttaagtgcttattaaaattaattacagagaattatcttacctggcagggccagggaatgggatattctggctagtggttcaattgaaagaaagagaaaataaaagatgattgtgctcctgagattcagtctgggtgtgtgtgaggggactggatttttccagcatgttctctttcatcaagaagaccatcacaggataccatcagatatttaagtagcagcaaaatatttttcaggattgttgtcaactttggtttaaacgatcctccaaattctttgtcaggaagatctcctggaggaggaaatggaagcctgctccagtatccttgatgggagaattccatggacagaggagcctggtggttacagtccgtgggattcctccactgtgcctctcacctgcttgtccacctatcttgcttttacagcctcctccactagttcattttctttatctcatctcttaaatagtattgtccctaggactttgtcttcagccctattttgatatctcttctgctctcaacttgtgtgacataatcctttcatagagcttcaattataaaacaaaaaaatttcaaatctgatttgatctccatttgtgacctctctctgcaatgagaatccctaatgcaatcacatactttagctaaacagcacagacattattgccaccctcaacactctgtctccacttagatttcataaatcaattgatacgtcataatcacctggtcattcaacttagaaaacatttccatatacatcaaaatggatttgttactaactcttgtcagattctcctccaaaatgcacttcaaaccctattccctgtcttgctttccagtgataactggcctagcttgggctttggtttctttaccctgagtttattctaaaagttaaggcatatgctgatcttgctgactcctgtctcttttgtttcttagctatcttacatcctgcttccagcccatcttaatgatataatccctgagatagggctccccaaactcagactaaagtccaaatt

SEQ ID NO: 61931 - DNA, 2036 bp, Bovine  19866881250342
tccccctaagtatgtgtggtacttcccaatctcctctgtcatccaccgccaacatgaggcccacaggcacgctcaggatccatttcaagaactggaaactcaggggtggccgagaggaaggaggaggaaggtggtcggggacccagtctgccaatgaaacccccgtgttttctctcttccctgtgttctcctcctcccccacaggaaagaggtgtcagacttccattcttgtaggcacgtctttacagagctatttccttggaactttccttcctcagatcgagggaagcaaagtacctcttgccccatcccttccaatctctgctctcctgacaaggtgatcgttctcccttcctgtcaccttgttaactgcatgtaggacttggtgggaggaggagtatagactgagttctgtggagccaacccatcccagcaaaactttaaatggggatagctggccccgcagctgacaggtctatgagagacggatgtagggctacctgtacccacttttattctcaagtgtgcagcaggaaggcaacatactgttctgtactaaccgcctcaagtcccagtgtactggaaaaattggtaccagggtgtcaggctgctgtaaaggctcctacctccagtgagggttttccttccaggcaagcctaggcccatcattagtgagatttatgacaacatgtgggaaaggattttaatatcctctccatatggggaatatagagtttaaactcaccagagctcaagggagcaaaatggactcatgaagactgatacttgggtgagattttctattgttgtttagtcaccaaatcatgtctgactcttttgcaaccctatagaatgtagtccaccaggcttctctgtccgtgggatttcccaggcaagaatactggaatagggttgccatttccttctccaggggatctcctgatgcagggatcaaacctgcatgtcctgcattgtcaggcagattctttaacactgagccaccagggaagccctgagacttttttgtgagtctctattattatgccatttagtttagaaaaaaatcatattaaaaagtcttcagtcctcatttttagtcactgacttaaaaagtaccctcctttttattcagtttcattaactttctattccttgccatggagaaaattgaatttaataagctttaattttttatttctgaagcacctctttggttcactcacttttgaaaattgatcaataacaatcactttaaataaatcactgagacttccctcattctttccttttaacacagcaagttcaagaacattaatttctctttgcttatccttttactcaagtgggaaattttatttttttctaagcgtccttgctatttcgcggtcatacgacattcagacacttgtcctgagaggtttgattgagtgcctaatgaaatcagtacaaaggatatcttcaaaactgtatacaagttcccctgttctctgaaactagaggcttactaggaaacccttcataaggtaaaatgctgtaaagtgaagaagctatcaccttaggacacgtcttgctaacagtggctcaagattgccttgccttgctaagtcactttagtcagttccgactctgtgtgaccccatagacggcagcccaccaggctccctcgtccctgggattctccaggcaagaacactggagtgggctgccatttccttctccaatgcatgaaagtgaaaagtgaaagggaagtcgctcagtcgtgtccgactcttcgcgaccccatggactgcagcctcccaggctcctctgtccatgggattttccaggcaagagtactggagtgggatgccatcaccttctccatgctcaagataaatcaagataaagcacaggtgctcacaggcgtggttcaaagctctggcagctagatgccgagaggctcagtatggtcccctggaagggagtgtggcagagccatgctcactgctcggggtacccactgcctctacaacagctcttgttcttgtgctcagtca

SEQ ID NO: 61932 - DNA, 1225 bp, Bovine  19866881346816
ctcctctccagtagggttatatttctgccttattgtggttttcaacagctgctaccacaggctatcctacaaacagtctgaataccactccttactcagtctgagtgttctctcttgcctaattaccctacaaggcttccaagatgaataaaaacatgttcaaggactgcccccttgccatgctcagaattctctaacgaagctattcatggtggcatggcttggcggtgtttctccgtcaggtttgccaagtgggtagaccaggggcattcatgtgggtcatctattcattaggaagaaagcactttctatgctttgattagtctcttctagtcccctaaaccacgtggataaaaggcacctttcttctttcctcagctgggttcccaacttcttctgccatcctttttatcaaaggaaaatctacaggttgtatttcaaagactaggcattatttttcggtgctaagcagaaaagtaattaaagtccattacacaaaagctcggtttctctttcgcttctctttagaagctgtatcagtaacaaggaaaatataatcatgaattttaaactatcattttaaccaactatatcctctgttagagttgcggagtggcccatgtttgagccccgcagggatgtcaatattgtccactggaaatttgatagcgatttctggcttttgccctagtgccaggcgcacagaaagcacttaatgaatattcgtcacctaaagatgtgaatcctgtcccctgcattgtttcagaggtgagaaaagctaacagtacatctccagagaacatgtcacagagtttattttcttcttagtaaacaaatgcagtagaggaaaataatgatggttgggtttagtctgatcacaagaaaacagtatctagtacatctttgtcagaagattgatgttttgttttgctcatcatccctggggtttcttttttacagtggggatggtacacagaggtttggactcttcacccctcccgcttgtgcctctgaagaagcctggggtttcttttttacagaagggatggtacacagaggtttggactcttcacccctcccgcttgtgcctctgaagaagcctggggtttcttttttacagtagggatgggacacagaggtctggactcttcactcctcccgcttgtgcctctgaagaagccatggcatggtaacacgttcatgtcgcacatcacttgagctgctg

SEQ ID NO: 61933 - DNA, 1859 bp, Bovine  19866881384987
tggtttggtcccttgctgtctaagggactctcaagagtcttccacagttcaaaagcatcagttcttcagtcagtgccctctgcaaacgctattattgctacattgactcagtgattaaaatgcatgtgtcctaggcagattggactggtataggagttattggtagactattgtgacctgtttcaagaggcaatcaggttttcttccccttagacatggttgggaccgaggatgctggttgttgaggacctttcgctgagcaatggaaagggtggtgggaagagtgtatctcttaaagtatggagaacttgagatctggggtgggaagcagtccagagaaaaagatagcagaattcttctagttttgtatgctttaaagggaagctgacacagactttgatatgactgctcatcaagacgatgacacgatcatgattgcagtgattacaacagcttgccttttcacagctcttgacaaatttaaaaaactccttattactgaaaaagtcatatctctggtaaaatcaagataggaaagggcatgtcttttgtcatccttaggatgctgctttcagggagatttgaaggaaagacctgttttgtgggaggtaacagggcccagaggacaggaagaagattctggaaggcagaggggtacttccaggtgttgagtagccatgagcacttggacaagcccctgagtcccacagaaacacagattcctcatcctttaaaatgatagtgtcacgcaagtgtatgttctttggtttttgtctcgtcacaacaaagatttggagtgacggacattaaagcccccttggcgtgtcacagctctcagatcttggatagaccgtgttatagctctcaggtctcgaatggaccatgttatagctcttaggcaaatcagtgttacagctcagtgttacagctctattttatttagaagatagcaggaaaacccatctctgaggcttgagggcacgttgatccaaagacacgaggagaagagcaccccagcacgcaggagagagagagagctagctctggctcctctttttatatgtttatctctccctgggcctgtcttatgtaaattgggccagccaggagtgttgtttgttttacctgaggtcctcactctggtcctcggaccttcttttgtctattttcgcgggcttttcccttccttgtcttttagccaccgccattttggactccttttccctattctacctacctaacaatagcacccacttcacaggctgtgaaaaggtgaaataaaatggggtgaacaagatgccttctaccaggcactcaatacacagagtcctttagtaccgtagcttcccggatccattaggcatcctgccctctgaatcactgtgggccctctctaaatgcactgtgagcctaggcgtgcttctgcttcacagatggggatgctgaaggccacaaaggtcaaaggacttgatgaagaccataaagctctctcacacatccactttaggaagccgcctcatgagtagtggggcctggagaggaggctgtgcctgaattcaagttcatgtcactgaaatgctaaaatgtcatcatctcaatgtggaatgaagtgctcgtatatgtgactgcacaagaaaatgcatggttaatattttccccactgggcttacatgtggtttgcatagcagattttgcacattttgtcattatctgtatttgaaaatagaatgtttctcgataaattatcccattatctaaccaattttatcatgaccagttttttgtttgtttctcatttcccatctaaatgtttcattctttggatgtggcatgtctcttcttactatgcaatgctaaat

SEQ ID NO: 61934 - DNA, 1047 bp, Bovine  19866880498565
ggtggtgtcatctgcatatctgaggttattaatatttctcccagcaatcttgattccagcttgtgcttcttcccagcccagcgtttctcatgatgtacgctgcatataagttaaataagcagggtgacaatatacagccgtgacatactcatcacagcattgaaatgaaaggatatcatggagaagagtgaccatgacctaaggactttactctgcttctcgggaaaggatattttcagctatttgggatggttttatcatgttaggtgggagtatgcctcttttattttctctgtttagacagtaagtacaatttaaaatgagtgtgggtgccaagttgacaacgggtggtctatgacggtcttttttaatatgccaacttggctaggctacagtttccaggtcattaatcactaaactaaggtattttactgatgtgattaaaatccattaaatcttaggtaatctagatggccctgattcagtttcttgagaagtcttccaagtagagccaaagtttccctgaaaaaaaaaacgtccccagagaaggttcagcccatacctaagatttccagtttgcccttcctgacagcctgccttcttgacttcagacttgccttagccaacccgtgcaattcatctcatactggttctgcttctctggttgaccctgacctatacaatcctttaccatgccacatgatacaacaaagaaagactctctttccaccaagtagccaagggttcagattcaaggttatagggttaaggcttgtatacactatttaccaaaggagaacatgccaaatagcaaaaacaacacagaaatcaatcctctttaccacaggggcaatgagaaaaacaaatgagttcaacataaaaattttcactttaggtttatcaattagcaccatttcatatgaaatagcctgttcttctgagaaaggcatccacctactgcaaaccaccccaggataattaagatcacaaccatatcctcagacactttatgatcaaaacatatgctcagaaatacaggctttattt

SEQ ID NO: 61935 - DNA, 902 bp, Bovine  19866880608395
atcagaacagcaggagaagctcactatgtctgtctcagaacttggtgctgctaaaatgcaggaacaacaggtaagtgtcttacttcttaccttgttttttaatgaatcaaccagatgtcagaagagtcatttggcctcttactttaattgtctcactgtatacattgtctttagacgtgcaattacagtgtgtgattgagttggtttaatctacttccctattttcttttcctctcctgttctggggcctggaggtcaggaatgattccttgaccaggctgtgcatcaggagggcagctcctggttgtatggaagcactgcaggagtgaaaaagaaaacccagtgttctgttacttagtgacaatcaggtgggctcttttttactcataaacctcttctaatttatgttcagagttttagaataataaaagtgtcttggtgactggtaaaagctttaattagagaaactggaatagttaatgtaatttagtgtttgtatatacttattaatcacataagtatatatgagtgtttgtgtattagagtttgtatacgtatcatcaaatagtacatattacataattaaatgaaagttcagaaccctgccagctgtgatgtgaaacaagctctgaaaatcgacttctttctctctagcaactaacaccagatgtctttttcacatccaaacgaatttaaatcttcaaatggataaggataccctttgtattgaaacactgtaggaaaaaagctatatgtatagtagtgtcaaagtcactcatattagtattaagacattgataatgtacctattatcagagtagattccatcctggttatggttcagtaggttgagcacagctactttattactaattgttcattacccaggttcattttccatt

SEQ ID NO: 61936 - DNA, 807 bp, Bovine  19866880666277
atactatatatatatacctatatacatatatgtatatacactactacactactaaaaacaactactttcaaggcactagaggttaaccagaaggaaaactggaagataattgccatctggaaaaagcgaatgagaataatgggtgagtttgctgtttttaaggctttttatcagagtgtaggggcttccctggtggctcagaggttaaagcatctgcctgcaatgcgggagacctgggttcgatccctgggtcaggaagatcccctggagaaggaaatggcaacccactccagtattcttgcccggagaatcccatggacagaggagcctggtgggctacagtccacggggtcgcaaagagtcggatacaactgagcactttcacttcaaagggacttcggtggttcagacggtaaagcatctgcctacaatgtgggagacccaggttcaatccctggatcgggaagatatcctggagaaggaaatggcaacccactccagtattcttgcctggaaaatcacatggacggtggaacctggtaggctacagtcccatggggtcgcaaagaatcggacacaactgagcaacttcactttcacatcagagtgtaagttccagtagatgctcagcaaaaaggctagatttgaagaaacagtcttagctgctgttaagttagacaacagaattaaggatgacaatggcagctggaaactgaggaggaatattctaggaaggagaaaggaagtatacaaattctatgtattaaactatgcttaaatctctgggctgacaactaaactacacat

SEQ ID NO: 61937 - DNA, 1347 bp, Bovine  19866880738777
cctgttcacaaccattaacctcaatttcctccttgtttacctctttttactgggctagctagcactgtccactgctagtgttaaccaaccaatttctcataatctctctagtcactctcacatctatttatttaagaactgtacagtgctttatgaggtcttcctggggcttccctggtgacttagatggtaaagaatctacttgcaattcagaagacctgggttcaatctctaggttgggaagatcccctggaaaaggaaatggcaacccactgtaatattctagtctggagaattccatggacagaagaactgcagtccatggggttgcaaagagtcaggcaccactgagcaactaatactttacttttatgagatcttataggtatactactccctgcctttcctcatcaactgccagctttgtcacgtttttggttttaattatgattaatctagaaaccatttagtcctctcccagataattaaaagaaggtaattagtccaagtttcaaaagggagactatccacagtttgaaaaaagagcaaaggtacatttcatttgatataggacaaaagttctgcatacctctactgttttaggacaacttagaacaactcttgtctttttagactttgctaccagaaacagaaatgaaactgaggagactttgtatctgagatggaatcttatctactttgtctattagtcatccttcagagatgggacattcttacttttggcttcttctgttctgagtcactgcactttggagagtggagaaccaatcgaaatcgctgtggcggttacactgcaaggctcaacatagtcttctgttaaactgacaacaaacttgtgttgtgtgtcggcactaaaataaaatagcaatatgagaaaaatttagtgtaatagcaaagggacaaataacttgtgttattggctgagaccacagcaacattagaaagctgcaattgaaaaggcactttgagaaaaggtgtcatcaggccagccccgctgtggaggttaatctctcccaggcccagctacagaagccggaagtctacaaagggcttgtgcccaccccccaaaaaaatcaatttctaatttaaaacaaaatcatttttgactaacagggattcagaacccattactttttgctgtgtagtctgctgacatttcagcactttctgttgtgcacaatgaatcctaatagtcattttataatgttactagaccaatcaatttaaccaagagaaagctgttacaattctgcagtttccaggcacagttcactcatggttttatttttttcattactcttttttttccttcccccttttttgagg

SEQ ID NO: 61938 - DNA, 1658 bp, Bovine  19866880753966
ctgtgtaatactactggacttttacttaataaattatggtgtgagcaaacattacgaaaatttctgatccacacaaaacaagcccagtgactctgatgggtttatgtcatttgaatcctggtcaagggcctcgtggaattcataatggatccagtaatactccatcaacttgttctagtctagggattgcctctccttctgggaagtttaaacattctagtttttagaatattactctttgaataaattatttttcttcattttaatttccacattgtttatggtcataggcaagacaaaacgaaagtatcacgagattgcggtgagcttcgtgatagtcagaaggaagggactggtagagtagtaagagatgcacatcatgataacatttctctctaaaaaataaaatgttccaagaggaattgtgctaatggtgggagcatattttactagagagaaaaacatatgcatgtgtgtttattttcattaaaatttcttttactccatatttgccttgttgactttataatgaaattatatgaggacagagaccaattctcccacatgcattatagtactattcctcatatactctgagtacataataaataccataacagtcgaaaacgagaaacacaaatgcattttgaagcaaactggtgatattttaatcccttatgttcatttttagtactcagaaacattttagttatgcaagtcttgttttagcacactttttatttctacagatactctggttcttagtcatagtctgtggctttattagcagtttcatgagtctgactcttatttccccaactccagatataaacttttgaggataagaaccacaactccagagttgttttggcaggacacagaacaggtcttcagtaaaatttttaaattatatatcaataaaaaaataagaaaaagtttctactgccatgaattgtatttcaactcatgctaaatttatatgctttttgtgtgtgatccattcccccttctgtgctctctatagctcattcatgtttattcttttcagtttattgaagtcagagtgtgatgactggacacttggaacatcaccgtccagcaaaaagtgccaagactccactaacagtggagcaagtagaagggataagaagacagttgggtttcagtcacagatggaagatgatgccctgtggacaagtcagaagaaagatgcatgtcgatcccaaagaggtgagctcagcatctgcagtagcaaaatgggaagctttgggggccaggttgctagtggttgctagccatcaactccagatggtttcctgtaaccctggagcaagagttaaacgtgttacaaaccagcatgcacctgcaaggccacaggtggcacgtctcctggatcagtgaattgcatcaacagttctcagaggactcacgagaaactgtctaatgtgtccctctttttgcaagcagccaactgtaagaattattcagcagtaaatatggtcatcaattcagttcagttcagttcagtcgctcagtcgtgtccgactctttgcgaccccatgaatctcagcacaccaggcctccctgtccatcaccaactcccggagcttactcaaactcaagtctatcgagtcggtgatgccatcgagccatctcat

SEQ ID NO: 61939 - DNA, 1077 bp, Bovine  19866881250396
actaggacggtggagtcccgatttctcagctagtgtatcgggctgttgctgcatcccaagatttgactcttctgaaaacctgaggaaaactttgctatgtggaaaggatactggcataattatcactagaagactacatggtcttagcttatgggactgactgcttttgagggaccagctgcttttattacaggggtaacaaatgctccttagagggatctggtattcctagagcagacttcaacagttcatcaacctttctggtagaaatatgtgagaatggaccaactactctactctctgcttcctcttccagaatcatccccaggtgtgacagaggtgaccatcatagaaaagccacctgctgaacgtcatatgatttcttcatgggaacaagtaagtgtcaacctgttgaatcctcacctcccaacaaagagtggtcaacttaaatgtccctgagaaggaaagactggacaggaaacttttttcttatctcaggccacagccttcaagttagagttcatctttctctctgtttctgttcagggcttttaacgctccccttgcattccataccatctccccaacacagagcatctcctctgagcccgtcttaaagaggcagtggaacatttgaagttgtatatatacacggcaaagctgaaaatccagcaaggaaagaaggaattaaatattcataagcatgctgggcagaacgtggttaagtgttgcagagaagtactaaccagattaatagcgaatgctttccaaccctcctctaaactttcattcattcgtttattcagtaaaagatttaacctcctaaaatgggccaggcattgtgcttgatgttgagtcctagagattcaagggtaatcaataaagaacacagtttcctacctcttgatcttgtctgagacatagtataagtcatcccaagtataattacaaagcagatcaagctctgtgaaataaaggttaagggagcattgtcaggaggcctgacctagtctggaggttgcagaatatttttcccaaagaagttatgagaagtttttaaccagatagatgagatat

SEQ ID NO: 61940 - DNA, 1314 bp, Bovine  19866880221645
aaaagacgcttactgcttggaaggaaagttatgaccaaccctaggtagcatattcgaaagcagagacattactttgccaacaaaggttcgtctagtcaaggctatggtttttcctgtggtcatgtatggatgtgagagttgaactgtgaagaaggctgagcgccaaagaattgatgcttttgaactgtggtgttggagaagactcttgagagtcccttggactgcaaggagatccaaccagtccattctgaaggagatcagccctgggatttctttggaaggaatgatgctaaagctgaaactccagtactttggccacctcatgtgaagagttgactcattggaaaagactctgatgctgggagggattgggggcaggaggagaaggggacgacggaggatgagatggctggatggcatcactgactcgatggacgtgggtctgggtgaactccaggagttggtggtggacaggggggcctggtgtgctgcgattcatggggtcgcaaagagtcagacacgactgagcgactggtctgatctgatctgatacataaaataaaatgcacagttcttaaaggtattgttaaatggcataaacttgtgtaaataccaccccaatcaagaaaacaaatgtttctatcttgacaaaaagttccgtgggcctctctccaatcaatcctcctgtccctttcaacataatctatcttttaacttaaatcatgagttaacaacatattggagtattagaaaaagaaaaaagaagagaatcttcataagtgatcatgagttacacagtcaaaaatttgtgtcaaaacttcaaattaattactatggctatgttgttttatataataccctatcttcaagtgacctttttatttttaaaatgattaatattaacctgaagaataaataaaatatataccctagtcacaaattcaggtggaaatatgatcactttctagccagactggatcagataccatgtggtatctcatttcagtttgggactttttcactatgtagatttacttaccacatgactgacttagtattgtgtattagctataataattactttaaaattcatttttatttgttcatgatatagttaagtaaaataataactgtggactactattccactttaaaagttactgtctgtatgaaactgtgggacttcattaggagtaatccactgtttcctttgtccttttgtgctttctttattcctctgaatgtgattcacaggtaaagacatgggtagtaatctacttgtttgatgttgatatatataaatatactcaaggg

SEQ ID NO: 61941 - DNA, 1317 bp, Bovine  19866880374308
ccattctgaaggagatcagccctgggatttctttggaaggaatgatgctaaagctgaaactccaggactttggccacctcatgcaaagagttgactcattggaaaagactctgatgttgggagggattgggggcaagaggagaaggggacgacagaggatgagatggctggatggcatcactgactcaatgaacgtgagtctgagtgaactccgggagttggtgatggacagggaggcctggcgtgctgcgattcatggggtcgcaaagagtcggacacgactgagtgactgatctgatctgatctgatgcattagtactagataatcataagttaataaacatcagggaactcactgtaccccccagagctaggcaccttaaactctttggggaaacagcttccataaatctaacagtcaatgggtcagcctctctggcagaagtctaagaggttatttatcacttcctagatcccataaggactaaggggtcaaactcccttttagtgatgtcactgttggagaaatgtgtcctttcttaggttaaaaaaaatagtcttcctcagcagccatacagcccaacactgtacctgcagtataagtatttcatacagccactctgagatccttcttacattaaatggctcattcacaaccatagccaggctaaaaaggatgcaggtcagatttcatccagtggaattaacactgggacaagaaaatgtctatataaggctaagttgtccctggggtcctaatagaaaactatttcaggattgttttcagggattctcccctacccccaccccagtctgggcagtaagatacatttaatcacccctttccccaacaagttttattaattcatccattcttgagttatacacaagttcaagttatatttcaaaggactaacttatcccccaaaatttaaccctgaaagtcttaatatgggatgtttttccaaaaaattaaacctgatttttgtgtgtgtgtggacacataactagtatctacaatacattagttttattgtctgtgggatgtgaatttctcatgaatataaactatggtttgaaaaagcagagtttatgattgaagacacttaggaaaacatgaagaaagagaggtttgtttgtttgtttgttttttactagaaccaaaaggtctggttcacctttgctagtaaaaacaggctaatccatttccctttctgctgaactcaacagcactcctaacaggtaagcccacagaagagaacccttgctcatcagtatagtaatgatagtaattagtagtagcagtagcatatacag

SEQ ID NO: 61942 - DNA, 1682 bp, Bovine  19866880394242
ttgggccctgctgttaagagccacttattggaaaagaccctgctgctgggaaagatttaaggcaaaaggagaaaagggtggcaaaggatgagatggttagatgacatcactgattcaatggacatgaatttgagcaaactctgagagatagtgaatgataggggagcctggcatgctgcagtccatgggctcacaaagagtcaggcatgacttagcaagtgaacaacaacaacgaattaagatcctctggcaaagaaagaaacctagcctttcagcaaagatcagattaacggtgctaacacttacttattttttaagattacctcaaagtagccaccgttaaaacaatgaaaagaggaatgggtagaccatagaataagctaatttaagagctaggtccataaaagaactttggcatcatttttgacacataactggatatgaatagtacaaaagcctaaaagttgtttttttttttaggaaattgcattactaaagaaaccataaatctgccttgcaaaagccatttactgtgttctcaaggagtttctgggaatgctagtctccaaggtcctcttcagtcttgatcctggtgaatggtggacatggaagaacctcccaaagagtgaacccaggggtctgcaggcataaccaaaggcatccagatgggttcatcagggaatgtcttccatggtcagggcaaaagtttctgtctggagaggaaactattaaggattacaggttgctacgtgtttcccattctttcatttttcacatggaagtttgtattctattcctgatccaccattacagattgggttgaaagtggggatcaagtgaatattttttggtttataagtcattggactgtatgtagtcacatctggacaagaaagaaaaggctctactttccccagagagagtagactttgaactggctatggaaatgaataggcccacagatggctcctgttggagagaggttgagctgtatgggaagaagggtgcactgagacatcccggtggtatgagggattggccgaatctctttgtttacctttacctgaactaatacagtcttgcttgaggttctgatttctttattcagaaacctatctcctgcataccgacagctttcaaatttgtatgcccaaccaggattctcttttatattctaaacctatattatatgaatagtagacagctttgcatggatttatcactggtaaaaccttagtcaccagatgtccaagactgaaatgatttcatttctccttaaacatgtaccccattggtgatagattgcaataaatggtcacaaactcatcctgtccctctacacacacctctttgcaactactgagctgctgccctagagactgtgttccacagcaggagaagccatcacaatgagaagcctgctcacagcagctagagaaacccgtgcagccaataaataaaaaatgcagcagaagtaatgatgtggcaattatgagcctagacctcaagagccttgcaggctttgctatcagtctcttggaaagcttctaccattatgtgaagaaacttgggctagtctctttaaggatgagaggctacgtggagaaagatgcccagctgacatccagcaccaaccaccaaccaccaacagacggcaacataatggcaaggcccaggaaggc

SEQ ID NO: 61943 - DNA, 2489 bp, Bovine  19866880447400
ctgcggcggagccgggagggcttgctgcgctccctcccgcgtccgtcccgtcctgttgtttttcaattaattttcttaccacattgttcttcagttgctaagtcacatctgactctttgcaacccttgggacctagggcatatatagcagtatgtatatcttaccacatataaattttaactcctgctttccaatgtttaaattttgaatttttttcttttctattactaaccagtcttaacaccaaagaatctgaattgttttgaaagaaaatgctttctgaatttttatttagtgttttcaaaaaataagatcagataaagatttcatgtcattttatttgtttttccccaaacagaattctccataagaccctaattttgacaacgtggcttgttaactattgtgctttttaggcatttaattgccctatgctgattccatcttagttctgagaatgatggagggaggcatgtaaagtgtggatcatccctggtaggttgcggaccagccagatgcatattaatgagtacgtcattggctggggcagggggtgtgtctattggtccacaaacgctggttttttccctgcttctgtttttcctccccaaccaggaaagccactcaaatacacagggaactatctagaaagctgattgtgtatttagatgaccctatacatggaatttattcaagcaaacaatgcagtgacatgcacaggctcctatgtgagaggctagaaatagaatttactagagggaaaaacccaagccttttagattttaaatctaaaatctaatggggggtggggactcaaaatacaatattacattggacaccaaaaggaaaaagatatgcttgcttgttatctgcagtatttttttactgctcttagcagcttgttcctaggtatacaaaccttctcaatactcagtcattgctccaaaagggtatgttatacctcacatgatcaaccccgaaagaagaaacaattggtttagtcagagagaagtatttagaaaacgttctttggctgtatggtcacacttctcatgttttcaagcttttcactcttggcactgctcttccatgataaaatatgataatttccatcttaaaacaactacttgcttgtgtaggaaaaggaaatggagccctcaaggctactttttatctccctaactccatccaagaaaaaccagtcatcagcagttttgtcttcacttgaaaagctaagcgttggaaaggtctgcacttaaggggtgaaaggactaagactggcttgggacatagaaaagatggtgttccggggacacaggtacaggaccaaccccgccatcccctccccagcttgctgtgagccctttaggctatttgccagacaaaatacaaccaacaaagacctgtttgcttagagttacaggaaccaatgtggatgcagtctgggtttgaatgccagctcttccacttgtataacttcaacctgcctctgcaacagctttctcagccataaaatagggatggaaatatctacaacacacaagttttatgaggtcccagtacattaacacaggttaagagcttagaaaagtatatggtaatttttgggcaagcatcagactcaataaatgtttgttattatcaccaatatcaagatataagcttcccagggaattacagtaatcatcccattgatagtaggaggaggctttattcaactatggttaaattacagccttaaatattctattcgctttcaattccttcttcaggcccagaacacaaatagtgttccttaaaaaatccttctcaaaagacaaacactgcatgacctcatttatatgtggaatttaaaatagtttatctcacagaagcagagaacagaatgcagtacccacagggtgggggtggaaggggagatgtgggcaaagggtataaagttgaaaaaaaccttctctccatatattaaatcatttttgtttgagttactggaatatgttagttttttctggatttagttatgtttcattgagatatgtttatgacatctaataagaaatcagatttttaaaaataaggtattacaggtattctcctctggaaataattctctcctctttcaattacttataacacaaagtattttggaaaaggacacaaggacggttacctatattcttccccctgttctgttaaaatctactcatttgtcttagaacctgctatctcagcatttttcaagctgttagaagattataaaatatattactttttaaaaaactgaaacagactaggaactattagtaaggaagaagtcttgttttgtgagactttatttgtttccatatacatcagtatgtatgaagatatgtgtatactggagttgtgatgtaatacatttcttaccgggaatcctgaccacaattgatgaacattatccgaggagctggcataatgccttggttctacttaaattgggattatcttga

SEQ ID NO: 61944 - DNA, 4025 bp, Bovine  19866880469697
attttctacaagctctggaagttccaatttataatttttggaaccagtatttcaagggatggttgggtggtaaggcttgagccagtaacacttggcgactgaaaactgtttccaaaagggaaaaatgcagttggagctccgggcacagctgtggctccctgtgtctggggacaagctggtggtggggcggctggctctggaggagccaggtgctttctctagggaggacgaccgggagggagaaaggcgcactgaggggaccagtgggaaaggctctctttcctccttccggctctggagtctcacatgagactcacgcaaccccactgagaaggtgggggtgcgcgctgctccgtaggccttgcttcctgaccctgctgtgcgcactccaaggtaagtcccttacctttccagggccggtttcctcgtctataacatgactactatggtccctttacctaggaatcccatttacccgtgggctggtaatggaagagtgtgggtctccggcagggtgttggaaccactcacagttcctctagcacacaggagagacggccggctgggccagaaccagccccacccagggcctgcgggcgcccccaagctgcagctctgcgctaggttgtttgcacacagaggccatgtccgcttaaataatagcagccttgcagctgagaacttgatttgacacgcttacataacagtagctttgcagtctgagaacttagaattgacaaagtctaaatgtttaaaactctggtaaatcagaaatatgttttctcacattcaccaaacttaagattcaatatatttaggaggtaagcatccttcctaaaatcttcttttcactacccagaaacaaagtgtctactaaggtaaacttcagccctgcctgcatttgtggaattagtaactttcatcgagtggaatctgatttgacaagtttggccataattgtaattattacctcgacttctaaattcctctcaatctttctttgtatatatacaagcatgtatgcatgcacacacaaattttcttccctgttggcttggcaatagttgtcatgaagttgatgttggaaaaaaaaaaaagaacatccgcttaaaagacccactccatacttaagagctgcatttcaaatgctatacaagacttggcacaagttaaaacagcaaaaaacctttaattttagtcagcgacatgactgtaccttctataaggagtcttagttaccatagctgctgtcctctacttaataagatctctaccaagcctcctagaatatttcagaaacaaaaaacttgctaaaaccaaaaacttgatggtgtattccttccctgctcagtgagtcacggatttgacctcctccaagatcacgtatgcaacggaattttgaatcacgaatccaaagattaatgaatcaaacactgcttaagggcaacgtatgcgtccgaactcctccctacctcttctctaacatgttagatccagctggcagtctagacagcacggaaaaggctgtgtgtacttagagaaatgaggtatcactgatccacgaccacatctatcagtgccaccatggcttgctcaagaaagttcacatctccacagcttatactcacaaatttccccaatcatctccgaaaacaaaacattctatcagtttaaggtctgtcagtgttacagacttgatgagtatgactcaggccagcaaattaccatgctgctactgctgctaagtcgcttcagtcatgtccgactctgtgcgaccctatggactgcagcctaccaggcttctctgtccatgggattctccaggcaagaacactggagtgggttgccatttctttctccaagaaattatcgtgaatgccctcttattctttgttatctgttaaataatttcatccatcaaccagctttaaagacatctgtattcagcacaggaaagtggaaacaacaaaaatcttatttttctttttttggtacctagcttaccttatctgaacagtgtagacatgattgatgggtttgggttcccactccaaaatggtcttgaaattagttgacttccaagttatattatatgctaccactacatctgtagtgcctttaaacaacagagaaacagttattaatgtttacatgaacttctcagcatacaattttatgttaatggtataaaacattcccactccgtaacatcatcataaacctcacattaatattttcctaaccacaaaagctttaactcaattatcataagaaaaaaaatcagcaatattttcctaaacccagagtttcctcatggcaagacgacctggtgatctaaggaaacacacaaggatcttgaagtccttgtttgaaattattcatggggaaagccctgtgagaacgaccgaagcacagctcaggagccttcagtggcccagggtatccacggaccaactggagaagggggaagggcaggattccaggtttaacttagcagggaaagccggctaggatgggtttctgtaaaatatgttaaagggcaaagcccacacgtgtcagaaaagttaggactgcatccaataaaaaaaaacaaatcttgacttttttcacttttatctaatccccatgaataatttcagtcactatactgaaacttccacagacacccaggcagacaataagcatgtacactgtcggctgtattcggttaggataccttattgttaaggtcttctttgccagttctcaggttagtctctgcctgcgtctcacatagaacaggcttacagggcatgcaaaatgtggcgcctgctccaatccaaacgacattttggaaggactgactaacccaatctaaaacactgacgatcaagagaagaccgagagccgtttctcattaaggaaagttcacatacaatgaaggataacattcaaacattgcctgtcgacccctgcaggtgcggagccttgtcccatcactttcaaggtgtcggctccctgggaaactaaagcgagattcccaaaggcacttaggcaacaatggatgcccagagcaagcatctcgagcagaaggggtggcgggtccctggcgagccgcacctcggggcggggagagcccgcggtcagccagacctgtcttccctcctcccggtggctcgccccagggctctgcgaggcgggtgccactcaccggcgactccggccccctggatgaggactaagccgaatagaagagcccgagcgactgcggcctgggggcagggcacccggggcccgttgggggtcgccatgtcccggagctgacggcgaggtctcaaaaattccgctgagccccggaggctggagaggtgaggatgctgcgaggttgggctggaggcacctggggctgcgggatgaaccgggagggatgcggggagcccagagtttgtgggagctcgtccccgccgcgctttaaagagcggagctcacgtttgcgcctccgcctgcgctgagtccgcccccacctctcctcctgactccccgccctcggcccgccttcgtcgcctcgggggcggccctcagcgagtccacaccccgccccgcctcctgcgagtaggaaactccgggaccctgcaaggactgattcacccgtgattcaacccgtcgccgagcgtgagtgtccttcggctgctggccggtccaggtgctgagggcaaccagggtcccagctgctcagatcccctgacgccccagcttcctgaccccgggatcacctatccagatgtcctgcctgagtgtgcggcaggtctgtggggaaggaataaagggaggttggatgggagtttgggggaggaagagagggattccctcccttccatttggcgatgcaatgtccaggccggtgggagcgcagcacctaccaaggttaatagaaagtagtggccgggggctcctctctggccccagagagcatttctggggcgctttgcccacgtcgggcgagcttagaatctgcagccaagtaacagcatgacgaggagcagagc

SEQ ID NO: 61945 - DNA, 1685 bp, Bovine  19866880578680
agaagctaatataatagaaatgttgtttgttgttgactacattgtcctgaaagtttgctcaaatgaatcactatagatatttgaccaggtagacctgtggttaaacaggaagtgtaaaatcagcaactcacagactctgtgcataccctggaagtgtgcctactaaatcttattcagtgtatgtcagactccttacatttcagttttcccagaagatgactttgggatgaaatattagagctctttcaactggaacagaacattcttctatttgttatacccataatgctttaacttcctgcattttactagtgttctccacctgagttctccctatccacctaaaaaagcaaacccagcaataattcagccccctgaggtacattatgaaaaacatgtgcagtaggatgactgtatgctaaggtgggtgcccggggtaaaagcccgagttttatttcccgaggtctcactgctactctgtcatgtgaaggatggttcacgctaccttttactatgcttcagtgtttccaatcaaggagaggcaagtggacaatgtatctggcaggtactttcataacggcattttgggaatgtagaggattataggaggaatgctgcttgatgcttgctgtgccctatttcagcttgggcacaagttctaaaagtcctgatgatgaactgtgacctggaggcagtgatctgggatgctttcgtgagcttaaacgttagatttgggattctccctaaattatagatgtttgtacccattcatcagtcttgaaaacatccttggagctgtaactgtttgtgggtagattttctttctgctctgaagcttttggcttcccctgcgattgttctattctctcacctcgcccaacaaatattttggtgtagggtatgagagaaaaactattctatgagagaaaaaggtgataaatggcaaccagtggcactgcctggacagggtatagaatggattctcatcagtaacacagggaaacgttagagctggttggtcttccagcagaaggagaagaggaagatgaaggggagcggggcacagaggcattactgaaacctgcaggtgagagtcagccctctgacctgaaggcaactctaagtaagactgataaagactgtggcatgctttgttccaggggctgccctggtgactcagtggtagagaatctgcctgccaagctttgatccctggggttgagaagatcccctggagaaggaaatggcaacccactccaatattcttgcctgggaaatcccatggacagaggagcctggcaggctatagtccatggggtcgaaaaagagtcagacacaaattagcaagtaaaacaatagcaatagtgatttgttccaagaggctgcttaattgaaataatgaagtcagggctggaaaggggaaagaatctactgcagtctctttctggcaaacgataactctgtatgcgagacagcaaaagagacacagatgtatagaacaatcttttggactctgtgggagagggtgagggtgggatgatttgggagaatggcattgaaaatgtataatatcatgtgtgaaatgaatcgccagtccaggttcgatgcatgatacaggatgcttggggctggggcattggggtgacccagagggatggtatggggagggaggtagaaggggggtt

SEQ ID NO: 61946 - DNA, 1871 bp, Bovine  19866880615090
aatagaatgtattattatatagactctatgactgcattgactatattcaacatagaacagaatgtgataaacagaatataatgatataataagtagactagtaaataattgagtcttgatggaaaattgtcacttctcccacatagtcatgacaaatcatctatagtttaagaaaggtatttaaaaaaatgattcagagcacagacccagtagtcaaactgctgtctggctcaaaaatccagctgtgtgactttgtgctggtcatccaacctccctttgcctcagtggccttatctgtaagaacaaagacaattacagagcgcccccccccaccgcccaccaccaaaggttgctgagaggacctgaagtgctcagtgtagcaaagacctcctcaggattgcttgtggaagtcagtgttggaacacagcaccccagccagaaaacagttaccttgttggatgcaaatcacaatgttccatttctcttccttcctttcctcagccctagattaggaaactggaaaaacaaatgcttttacacaacaaacacggagtgtgatgtcactgatgagattgtgaaaaatgtgagagagacatatttggcgagagtcctttcctaccccgcagacactagcagttccacagtggagcctccgtttaccaactccccggagttcacaccctacctagagagtaagtagctcaatttgtagtaactgttcattcttgttttcataaacttctaaatattctgtgagcttgtgacccttaggaatgattacattaaaaaaaagtttatccataaacacatcttgttttctcagaaagtagtacgtgccacagccctcttcgctcattctggatgtggtaggaggctcatgggacgtgaactttggagttgataaaaatgtcatcaagtagctttctccaccagtctgtccccagaccctaccagtaactggctggatagggggcagagagtaggaaattcacaaaggctggcagttccagtatttccccatatatattggtgaccaaaaagttccataagatcttatggaaaagcccaaatgaaatttttgactgacccaatatttaggagattttatacatcttctgaattttgtgtcccatcatcagaccagaagtcccaattagggtttttcacagaaggttacaaatccatggggcaagttcggtttccctcccatcccatcattgggctgctgacctttttccttgcttgaccaggatttgagtcctgtgatgtgctggcacttgccaggccagctcccatcctgcttccttcatgctggtcttgaaaacagaatgcttttctccctagcctttgctaagggagtacaaaggattcctgccaagtaggagatgcagaattttcatcatggctatggttctgaactaagtattttaaataaacaaacatgtagcacattgagaagagtgacatcagcggctctagtagaagatttagaatgaaagtgttgtgttgtaaaaaaaaaaaaaaaagaaagtgttgtgttattggtgtttttatgtttaccctgctgataccccacggggagcttctccaggcaggggtggagagaagggggcagagaaacaggcagccccctttccccttagtgtgtactctgagggtagaaacagggggcagcctcacccaggtgaatcggacgacctaccctgagccatctgccagagcctgtcttcaaactccttagtgcttttagtcgggtgcctctcccagttctgagcttagaccccacccatgaccacctatagtaactacaggttcattgatacttattctccctcccatgggcagcatcctcatgatttctttttatagtt

SEQ ID NO: 61947 - DNA, 1187 bp, Bovine  19866880682676
acttcaagagatgtcttagggatatgtctgcttgccagaaacctggaagcagcttcctaatttgttcctgtggcctttttttttttgttttgctatcagtaggcaggtgtgcaacttctgtgtgtaaataaataattgaaaatggcaagcactcacggaatacatactatgtgctagaccttgttctatattcccctgaaaacatttaatcctcttaacaaccacaagtggatgatgcgaactagagcgcagagatgttgggtagcatacccccgacacaggcatgcaaccaacattacgtcacttacaagaaatggacctctgactcattcaggcccatcaggaaaacatttactttgagctatactttgtgcttccttccaaaagattcaaaataataaagtggtgctctcaggagacatatcattaaaaagacccaaggatgtggcaggatgggttagtagaaagaggctgggttcctgttaatgctgcccccacagactggctcaacagccccactgagtaatgtcacttcacactaacacccgctctcaggttctcgctagagatgcttcatgtttgtgcaggacttcagagtgaaccaggcaccctcctgctatcatcttacttgatgtgcttctcacctcaactcagtgaaataatcaccatgggtacattattcccatttcacagagaattcttattttttgaagagaaaggaaagagattaaagtgtaattttaggcaacagaaaagttggattatttctttgatttactctgagagttgtccaagaatgttaattgcagttttacacagaaagcatattttccctccttaactcaagccggaagccagcccagtccactccacgtccttcatcagcgaagggcagctattagtccgcctatgaaactgaagcgggcccttcttctggtggcggaactgtgaacccgagcttctgttgactcttcagaaaggtaaacagtttccctctgcacaggaggaaaggcgtttgccaaaagccctgccgtgaatagtcagctttatttctggagtgccttcctcacaaaatcctgatatttattaactcaaaataaaacaagaactatgaaaacaaacctgagacactggatgatgaataaataacactggtgttcatactttcctagggactgaaagaaata

SEQ ID NO: 61948 - DNA, 950 bp, Bovine  19866880761520
ttattattgtcattcatgtatttaactcctgttggccttcattttttcttgcattttcttgcattccatctgggatcattttcctcttgtctaaagaaccccccttcagcatttcttttaatatggggtctgctaacaacaatttttttctgatgcctttatgtttgaaggatattttcattgtgtttagacttctaagttgttgataatttctttcagcacttcaagatgtcattctattttcttcttgcttctgtggtttctgttgagaacttagttatcattgttgtagttcctttgaagatactatgcttttttatctggctcttcttatggcttattctttgtcattcggcagttttactatgatgtgactggtaatgtctttatcccacttggggtttgatattattcatctattttgaaaagttctcagacattatctgttcaaacaatgcttttgcctccatttcctctctcatctatttctgtacttctgaacgtccagtttcacttagaaatttgccagctcccatgtgtctctttcattcttttctctaattccttttttccctttggccctttggtctgaatattatctgtggatctatcgtgcagtaataatcttacttatttctatctaatttgctattaaactcatctgttgagttcttaattttgatcattatatttttcagttctggaatttatgcataattctctttttatggattttatttctctggtaagagtatcttttcatcttttttaaaaaacatattaatcccctctattatgactcaaatatttgtgtcacctatgaccttatttctattttctttctttctgtgatctgattccttggtatatctagtaagttttactgaatgccagacattttgtatgaaaaattgtaggggctgcagatgatgctattcttctctagagaa

SEQ ID NO: 61949 - DNA, 1267 bp, Bovine  19866880766972
tttaatttttaatcaagtaaaaaaataaatatcagattctacatgtataccaaattggaaagaaatggaccatttcaacctaatacactgcctccttgcctgaagctgaagctgatttaattcaccatgacaaatgtagatgtatttattacatgtacactcatgctttgtatgaaagaaatccattcttttacttagtcttttttttccatgttctatatccagtttgagctgtgaaatgtctaagttcatagcagtagcaagttgatgatgtgcataatgggttattgtccataaatggaatactatgatttttttttaatgaagtattttgggtggtaaaccacaaactgggtggtattgagattaccacttgtttgcatagtatataaaaattttattggcctattgattgacatgtgtttcagacattaggaagagtcagttaatttcttgttgatatgccagaacctttacaggaactttgtttttccccttaatttgtgttggtttgattctttgtataatgaccttcatctggtattatgtttttcggtgatgagaacctttatagcatgttcaaaggaaactaagctagacaaagaaaaggtcagctggcccaagatgcctatctgtaattggagttaagtgagaatatgatttttcaagccaagtcaaataagaagcaattagctcacagtcgtctgttgcttcttgttttccaagattaatgaaatcatacttggagccatttgtttaagtgtgttcagttcctgttcctctgtcgaccaatcctctgtagcacattaaaataataccagtgttacttttttccaatgtctatttcccctccatacatgtactataaatttagcaactttcatagagatacagttggtattgtgtgtgcatttagcagctctgataaagctcagagcccacagtgaggagtgactgtacgtgaacattctcccacgtatctggtttcttagacctgaggaactgctttcccagctgcgagtgaaactaccagctgtgccactgacacactggataggcgacaggctatagctgcttccatccccaaatgaggtatttgatttaaatgttatggtttctgattcacattttgagtgcccttaaaatctatgtcaaaattatgctgtgtattatcagaatttttgtatttatttttgaattatcagctttgtattttttttcctccactttgggggattctccaaagcttgaaaacagtttttctttt

SEQ ID NO: 61950 - DNA, 1682 bp, Bovine  19866880807922
tccttattcccccaagggattgtaatgggaaagacagccaacaaacacaagttgaaatcaagtaaaatattgatgaaattaggtctgtgaaatcagtgggaagtgccataaaagtacagaggaagcactgaacattaccccagccactcttagactcattgcccacatttcatcactggttatgcaaaggaaatgcaacctcttctacttaactccacgcatgtgtgtttgaaggagaaaccatcagaatattcctgctggagaacaatgaggtccctaaactgcaaatattttatacgccaactgcagagcattattggatgcctatggatgaataaaataaagtgagccttagtttacgacctaatctcacttccatgctttgagagaaggaagtgtggttgtggaaagaaagctcctggggtcagagagcagatctgcattgtgagatgacacaagcaggttcacgcaggccagctaagcacgggatcttcgtctgtgaatgcatgtctgtgaggtcccccccccaaatctcaaataagtggattggtcaggccagcctgactatcattatagcttaggaacttttctaacttctgaatttcctaggtgtatcatataggagaaaactttggtaactgctgagctccactttattgaaggggataaaaatattgttttaataatttgtctctgtgcaaaaattatcaacagtgaaattttaggaatgtactttgtgtagagcagcattggaaatcatttggccacaggctgatcaaccaggaaaaaaactttactatgcaatgttaatttaccatagccagttttcttcctcttcttcttgaaaatggtaaatttttttagcattttctgaatcttagaaaatgtcattctatattcactcaaaaacccatgctaacacccaacaaattcttcttccctgcctagtaactttagtgaatatgcaaaatatatattcatctaatttaccaacctttatggcaacttttgtatcacaatataacattgaacataatttttcttatcgaattgctgatcttgacattgtttaaagcctttcatgatttcaggagagtcggtggctccaaatacaatccaaatacaactccaaatacaattacagtgcagacagagcaacaattccttgcatcttgtatggcagtggtccccagccttttaggcaccaggggatgattttgtggaggacaattttccgctgattggggtcgtaggtgctttcgggatgactcaagcacattgcatttattgtgcattttatttctactattattacatcagctccacctcagatcatcaggcatgagaccctggaggtggggaccactgttgtaaggcattaggttgaatgcaacatttcctcccagctgttttcaaagaatcacaacccaggtggccaaagatctgttaggaaaaatgcctcaggccaaagactgcaaaaaggagacttgcatggcttggttttgcaaatataagctttgtgggttttagagttggaagagagctcaaagaggaaaccagcaagtgcagctttcagtttctaggaaggaaggactctgctaaaccctggacgtgctatttcagttcaaggataggagaaaattaaattttgcaaagttgatgtcttttaaagtgagtttaat

SEQ ID NO: 61951 - DNA, 1708 bp, Bovine  19866880815121
aagattggtttggaaaaaattgtactgagaacatggcaaaggttaaaaatggtggcgcaggaagtctaccatcaccagattttcttttcaatatttataacttcccagctcaatgtgaaaagtgcagaaaagcataaagtaaaaaataatccttctaatctcatcaatctgtcaacattttggtgtattatatatacatttatatttcactataaaatatgttcatgtatgcacatatataattctgagagcttacatatacatattataaagttcttttcagttatatttttgtgtgttgtaaaaagtttttaaaattcatgatttttaattactgcatatatttaatcctatggatatatcataattcatccaactattcctttattgttgaaaattcaggctgactcattttttttctttttgctattctaaatcatgctgttatgaacattttgtatataaatctgtgacccctaaggctttcattttgcattaaactatgttccagagttcttgctgagtgagaggttagaagaaacagcttcaaggacttaataaggaagttgtagaaagtttaataaaacaactgtcctgaattggggatgggccatgtggccttttatttcgcttttttgttcttgtctggaaacagtgatttcccactctaagagttggggcagcaggccgagcccagctctcacggcaccagtgagataccctgtctgcgtcccctctgcagccagtggatgggctgtgacttgcccgatgtttctgcctaggtccgaccaggatctagtggtgcagagaggcaaggccaaggagaatctgttctggtggcagaggaaccactggcagaatctggcatccaggaccgggggccagctacaccattcactgtccagcggtggtggtggcactgcccctccaaaccagccctgaggttctagctgctcggctcccccgcttgtccctccatgcttactaatcctccttcattagctttcccagtaactctcagcactctcaacagtctttcactgaattctttttctgtttcagccagccagagaggatttttatggttcgttaacaaagaacctgatcggtctggaaaaagacaaaggttttgagagcagcaaactcagagtgagagaaggaacagttcacgtcagaacagtcgcaggatttccgcgggcagggctccgagcgctggcccgtgtgcacaggaagaggcagagtgagacatgggtgaggatgcagaggtggaaaaggtcagggtgagtgctctggcatagggaaaggacactctcaagtcctcatctcaggagcagaggagggcaggagcagtggaataaaagcctcagaaaactggagagagaagcatctgagagtaatcaagaggataagggagaaaatgcagtcagagggcaggtggtctgtaacacgtagaggatatcgtcagaggaccggaaggccgggggcgggagtacagcctgagcaaaggcagtgctgagtgttggtgctcactggaggtggacagccaagaggaactggatgcagagcagatgggatgacgtgtctgcttggctcacactgtggtacactgcatttcttcttttttatgtatatttaatcatctgagtagtaacagttcaataggaacatgtaaacatcaagacccacatgaaataaccaaagaaagcca

SEQ ID NO: 61952 - DNA, 998 bp, Bovine  19866880822965
ttgccctaggacatcgcccacatgtccacctgtctcctatgtgtaatgtgctcctcaagtgtacctgcttacgtcattctgcctgggacctgggtattcactgtctgccaactgcacagctgggtcttagtaatagtagacactgctaagcctgtgataaccagaatcattgtgtgtgccagtgaggaaataaaataagcagacccacagcaaacggctcctaatatctcaattaattctagtgacaaagaaatggtgagtctgaattcggtctcaaactctcataaccagtttatatcttgggtgttttgaacccagtctgtttagaaggtttgttcacagaaactgaactataatccttagaaaataaatattaattttaaaagtcatttagaaatagtaatattttatacaaccaatgtatatcagccatgaatataagctctggaccacgttcccaagtctctaagataacaaaaaatagactgtgaggtttagatcactgtgccttttgtgcccgtcttacaggtgggaaaaagtaaaatccagagaaaccaaatggcttacatagctgcatccatgcacacacaacacatacattgcttctcactggaaggagcacgtgccacttttccatgaccacttttgattttaagacttggctaattcacaaggcctcaaaatccagtctgctttgctcttggattaactgtgctatttgaactaaaggcttaacttgttcttaatcatcttttggaaatgctgacttagagaattagtgcctggcccaacaggccccaggcacagatgaagcaaagacccagcacacacacttttccagcaacacagagtgcttggatgggagatctgggaaccagattgtcagggcgcctgtgttagagtcagcaaaccagggttagagatcaaagcaaagacaaggataatggaggttatctggggagtcatcagatatgatacgatcagagccaagactttag

SEQ ID NO: 61953 - DNA, 3824 bp, Bovine  19866880895208
agtccttactgcttgtgcccaaggtggatcttctcattgccttgcctttgagatgactcagctctcacttaacagagcattctatcaggaatcttgaaatatgggtagggaatcactgacttttttatatattagataatttgattattttatgtactgtgtatctcctccataaagacagggatacatgtctgctttactcacagtcgtgtcccaaacatctagaccagcatcaggcacacagaaagtgcacaacgtgtactggattaaactgaacagtctctactaattctcagctattattactctatggatagattgtcatctgcattgaattaaccacagttctctccaaagagctataccaaagatccagcaaaccacttcttcagttttcagagcctcagaattgagaattcctgtccccaaccacagcgtcctgtgtcccttcccacaaccatagggctgtctaagctgattctccaagtttgctccaagaatgccccttctgggagacagtaataaacttttctgcaaaaggaggcaggaggaagaggccccttgattaaaatatttttggaaattttttattaaacaaaattaagggagaattattttgcttttttttcccactgtaacacttctcaggatctatgttatattgtcacagtgactctcccatattgtataatatgtagggtttctggaacttatttgcttttaattatgagattttctgagaaattctaaactgcagtgaaatggtcttctaatttccaagcacaatggactcttaatataaacatggatatgataaaaagcctcatggaacagttgtaagaactaaaaaaaacaatccacaggcagcacactgaacagtacctgacatatgatcaacactcagtaaatgctggctattgtccatgtaacttcctacatggttaccttaatctgaagaactcacagcaattttctcatgtcattttataaatggacaaaccaaagcatagaggaaaaaaatttgttgtaagataaatataagaaatattaacccagtgaagcagtgaaaatatagttttcccacaagtcttaacataataccttatagttatgcttatcacagttgtgttccccttgacctagggaaagacataaaatgccaaaataaatagggtccatcttctctgaagtaccagttttgcttcaagatttggggatcaaaaaatgaataacttaatttgtaagtaaatttaaataaatatatattttttaaaagaaaatttttcagaataaaatgaaaacttatgaaattcaaagaaaaacgtgaacactcaaaatatttcctgctgcaggaggcagctttgagcagagccccagcagccctgcaccatcctcgcccttcccctgacatgaggggtacactgacagaaggcctgagaggcactgccccaaactgagccctatgcacaaacgaagcagggagaacagaacatgtgctatcaaatatgattcacgattcaaatatatttcaatatcttattctcttcacactctgagaaaccatctgataatgtgattgttttgtaaaactcttcagataatggaaggattttatagctgttgcatagatttaataagcaaaagactagctagcatgaactaagttcaacccaaaccactgttcaatttaattcagcacaatattcctctgcttaaagtgcatgtaattgccaatttatatagttgccaaaaccaaagatttgttaaatagagttctgccaacaaatagagtatgaaaaagtttatccccaactaccatacaccaagaatgaatgaaacccatcactaatcaatcatgtatcctattcattccaagagcttctttcaactgtatgattattcaatgagtaaaatcaaacctacttatgttagtgtttctctgtatcttttcactataaagtttttaaaaatccttacaaagtgaagagaacatgtaaaatgaaattgacattatcttaaacagtattagattgttattccctactcttttataaagagtagggaataacaatggagagttcctttatggagactgattcttaaatagcactgattttcctgaaactctccaaatgctctcttctacttaaagttcttattgaagggatgaacaatatatagcactgctttgtgggtgtgggtttcaattaaagacattatactgtagaaattcactctgcaactttctttttttcaagttgagatttttgagatgcatacggccacatatagacagatctattgccactgacttaaagaaagcactgagcattcatgatagaagttgtttctagggagctgagaaggggacaaagacagggtgaggcagacaaaaagcatgtaagctgtgttaagtattgaagtattgccattcctgacaaaatggcaacaattgttaattgtggatgattacttccttgtgcttttctgaatttttaaatatctcaaatttaagtaaacgcactgggttagccaaaaagttcattccagttttcccctaacatcttatgaaaaaccagaatgaactttttagccaacccaatactaaagattttaaaacacattcttcttttgttacctaataaaaaaacattttcctttttttttttttttttttttgagcagggggctgctcgggatctttgctgcagtgtgtgggctcttcacagaggcatgtgagcttttctccagctgcagcccatgggcttcttgtcatagtgtgagagttttcctgttgtgctgggactcaatacgtgtgaatttttcctattttttataagaaaacctgggtttactgtagagcacagggaactctgctcagtgttatgcggcagtctggatgggaaaggagtctgggggagaatggatacatatacatgtatggctgagtccctctgctgttcaccagaaactatcacaacattgtgatataatcggctatatcccaatacaagtaaaaaaaaaaaaaaaaatctgggtctacaagatggcagagcccttgattcagcttccctccttccgtcctttcctagctgctggtgaatacggtagtaaaaaggcaaagatctatcttccgtttacactccagagtggtagacttgacaatgaacaaattaaataagcaatgatctgatattttagaaagtgataaataccatagaaaggtacagagacagaacactagaggtaggggtggtcaagaaggcatcactgcaaaggtaacagctgagaggctgagaaagagaaggtgtgagccatgtggcaatctaggaataaaaacattccaggcagaggatcaggaaaagccataaatatgctaagtaaaacattttgacctttaaactgattggttagaaatgatgtattttaaggacaggagccaaccaaaactgtatagattgatactggtaaggatatgctgtaagtcccacctctgtggggaactctctacatcctttcagtgtctatgctgagagctttgtaccttccttctgtttaacaaatcctattcactcgcaaaaaaacaaacattccaggcaaagggaaagcaagtgcaaagaccctgaggtgggagtgtgcgcagagtgctcaaaacagcaaggaggccagagaagccggaatgaaataagcaaggggcgtgtagcaggaaatgacgtcagatgtgtactatgcaagatggcgaaggttatcgtgggggaggtggcagaagggaagctcagtcgcacaggaaattgtaaagtcaccgtaaatttttgtaaagtctg

SEQ ID NO: 61954 - DNA, 935 bp, Bovine  19866880935289
tattcctcattgctttagcaaaagaagtgtcctctccgttttcccagggaagattgtccagtgctagcttttcttgatcacacataataaatttattctaatatttttacctccttgaatcattggcatttttcctcaatactatgtcaaggcagttccagcatccccatctcatttatgttaatagtaggctcttaatgcacaagcttcaaagagtcatcttagcagcactatgtgagatgggctccttgtgttcttgccagaacactgagctctaagtcatggaggagtgctcccatgtcaataaactatactccaccgagctttatatccccaccaaccaccaccatccctgatccagtatcctcaagatccttgtacacgtgtcctcctgaaatattcatattcaccaggtcctgaaatttctttggcatgtaggctacttcctcccagaataggaactgtatttctgctctgggactatgctgagctcttaccatagttaccagtctgaaggcaatgagggaaataggtcagatcttgagggaaaaaagtataaccttaagaggaatctgcctcagttgagattttttttttcaagtgtctccagacaagggaatgttgatttcatttaccaagttcaagaactagcgaagagagggttggcaccagttgccactaaggaaaaaaccagtctatcccatttactatagatctgtgagaagttggttctgctccacagtacattggggcatggacatcttataatcctggtaagatttgtgcaatgtgggaaattaaaaaaaaaaggatataggacttccttggtggtccagtggttaagaatcgtcctgccaacgcgggagacatgggttcaatccctggttcaggggagattccacccgccacagtgcccatgtgccacaaccactgag

SEQ ID NO: 61955 - DNA, 1002 bp, Bovine  19866880986145
ctcctgttagtctgaggctctgggagtacagtacaattggaaattgttgtattccaaggtactcaataaataatttgtgaataaatgggttcttggctgtccaggaaggaaaagacaagaaccaccctaaaaatgggctttcccggtggctcagactgtaaagaatctgcctgtaatgcaggaggcccaggttcgatccctgggtcaagaagatcccctggagaaaagaatggcaacccactccagtattgttgcctggagaattccatggacagagaagcctagcaggctacagtccatggggtcgcaaagagtgggtcacgactgagagactaacactttcactttttcaccttaaaaatagagagagccctcaaaggctaattgatggagaatgagctaaagatttgtttgagctgttccctcaaatccaaaatctgcttctgaagcattttctgctatgccattatactttacagtgagtataaggaaacatgcaatggatcttccagagttactgatgcagcaaccaaagtcttgaatggtttcatttctgccttgatctccaaacttaatctgtttgccttctctttggctccttatctcttacctcatatcctgcttataggcttatatatagtgtgcttcatatttggtaaatctcctctcaacgtgatcttggcttgcctttccaaccattactcacattttaagtatcatgtggtgcatatattctacatgccaggcacacaggacttctctaactcaggcctataggacttaaccatttagtcctcattcaagcctcacaataatgttataagagatttcctttccttggtcccacttcacagttgataaaatgaagacttaaagaggttaagtaacttgacaaagaaacagaacaaatggcaaagctgagatgtgagagaagaaagtctgatatcagaaatcaagtttctaattgcataccactttatagtttctccagactacatctgt

SEQ ID NO: 61956 - DNA, 1328 bp, Bovine  19866881022604
caaaggattcagggaatcctgaattgaatactggcatctataccccattgactaccctgccaggctcctctgttcacggaattctccaggcaaaaatactggaataggtagcccattcccttttccaggagatcttcgcaacccagggattgaacccaagtctccttcactgcaggtggattctttaccatctgagccactaggaaagccccgggacacccatacacgtattctaaggcatgtggaatttacacattcagagatctgtggttggggccttactcccatgcagacaaccttcttagttttcctagagacaggagtcagaaaatatctgcataaaacattcttcctctcctacaaatcctcttaagtcaggaatcaaggatgtcaaagaaaaaaaaaaccttcaaaatttgggagcatttaaaaattttaagtactgtcatttaaaaagttatcttaaatgttttaagaaattttctgataaaatactacatgccaagaaacaaaatttcaagaaaaaattttttactgacattcaaattggtattatcacaaggaataaacccttcatttacagataaaagttaatatcacaactgttatttttgtttttaaattcaaagtcatctattacagcaattaataatataatatgtacaaagactataaaaaatatacacaaagcactaacttcagaaactgaaggaaatgccttataatttttgtttaataaacattcacaacattattccctgaaatgctttgatattttcctcacattatctcattaatatcagacatccaatttggtgacttaagtttccattacagaatttaatatacagcacatctcccttttttttttttttctttttggccatgtcacacagcacgtaggatcttagttcccaaccaggaaccagatcactggccctgcagtggaatcacagagtcttaaccactggaccaccaagggtgtcccataattttccatttacttgtctctgacattctataagctgccagctctgctagggtctctcctgttcactaataggtacatccttatctctgcctatggcacaagggagacaatcaatcaatatctactaaataaatgaacaaagacataatctgacttacgttatttatacctaattagaatctatttcttgcttaagataatgcttaaatatgacacaagttagtatttcatacaaaaaaggaggaagatgaaaagtacctttcaatgagcgtcccattttgaatcatccaaacgtcacagaatgttcgagacaccagcataacagcaataagtatca

SEQ ID NO: 61957 - DNA, 1519 bp, Bovine  19866881084583
caaatgatctctcagagaatggagacaccacccaggttcagacgatgctcatggccctagaaggtatgaccaaaacaaacggattccatacaaccatttacattggagctaagtacgcagaaaaacaagatgttctgatgaaggaaaattaaaagctggccaaagtgtaaccggtttgtagatgggagccaacaaatgggccaggcgagtagggaagacagcctgtaagacgaggaggcatctttgtgatccctaaatgcaaactgacaaacctttggatcagaccacaattagtctacaaatgggcaccaacaaaggagccaggcaggcaggaatgttagcactgggtacccaaagggacatctagaagctaacattacaacccgtgggcaactccacaatttttctacatgtaggtaccaacaaagtcgcttcccagaaaggaatgagtgtatggacttgggcagcaagagtacgtgctgctcccacagaacctgtcattcacaatggaagccaaggaacaggaaccaatgactcggaaatcagtgacagcgattatcaggcagaatacccagatgaatattcgtagtgagtactaagatgacgaccccagagattaccaatgtggtgagcaaggcactgattattagattcacagaggagctctgtgtttagcctattgcttttattcaatgagaaacaagctagccttgagtaatttttatcttgccgtccgaaaacactattatgttcattgtacctaacggaaatattgccttacgtgcattcctttttctgcctcttccctaaatagttgccttttagtattgtgacagttaaatcctacagcataaccaataactcgcatatgaagtgaaaaggaataatgtgaaaggggagtactcctgtacagtcaattcttttattaaacatctacacatttttacagtactctacttaaaccggtattttcaaacaataggaagcttttttctttacacttcagtatctggtttccacatggaagactaaactcacgcctatagctaactgtaggctaagttgtctgtgcacactcagtcgtgtctgactctgcaaccccgtggactgcagcccaccaggctcctctatctatgggattttccaagcaagaatactggactgggttgccatttccttctccatgggatgttcctgacccagggattgaattcaggtctcctgtgtctcctgcattggtaggtgggttctttaccactgagccactaactaactggtctttgccaactaaatttaagatgtgggactttagaaatttacatatcaatgattctacagtattgtttactcatttttaaataaagtcctgatccgtgtgtatgtgtggggggcgggggggacagaacagacctgtgtgaatagcagcttagtcaagaaaataaattagcaaagcctcccagagccctactcatgctgtttatgaccactaaccaccccccaccccaagggtaaccactgt

SEQ ID NO: 61958 - DNA, 1046 bp, Bovine  19866881109726
cccatccttcctcctcctcacccatttctctcctctcctgaagtggtggtccctgcagtattcatagagccccagggtgggggtctatgaagcagtgaaagagggacatggaaagaacctgaatttactgacactgtgagggaacagcaactcagctttagggccctaaaggaccatgtggccaacacatcggtatatcaaaggttccactgctttcgtctttctaatccgtctatgtgtatcttagcttgattttcatgtatatgtattttatcacagtaaatatttgtaatgcatctcaatagcatcttcatagaataagttggtgtctggatgtgtacacagagttctaggggagacaggcttgtacattacactgtgacaagacattcacagggtctggcttgacttgctacgggacctaccattctgaaaggtgcaatagtattttactgtgctttatacatgcttgcttgatgtgatccaagtgaaagctaaacacactctaaaatgtatgccgagtgtcttaagaagagctttaaatatagggtttactacaagaagactacaatctcccccgaataatgaaaggttttcttaacaccatttataagacattaaacatagatggtctaattagtccctttacttctactggtacatttattaggaagaggggcaaaaattagaagtacttttctaagcgagtactgtgaacatttaaattataaaacagcctgctgacttacaaaaatactgctttgtgtaaatttgactaagggttattaaaatttcctaaattatcgacagaaaaataaaatacatatctagttttccaccggtttgaaagactcaggaggaaaaaaatctgaaattcaaacaatcacagtatataatttttctgatttttaaaggaatatttatagcttgaaagtgaaaggctggtgaaatacataaaaattagggaggcagtccttttcctatttcaggaaaattatagttcttgggagaagacattgaaaattagctctcagttgacacatatg

SEQ ID NO: 61959 - DNA, 1309 bp, Bovine  19866881177723
tgcagttgctttactctacttttctttttattgagataaaatttacataaaataaaatgaactattttaaaatgtacaattcagtagcgtttagtacatagacagaattaagtagcacctgtattaggttccaaaacattttcataaagagttgctttattttaatgcctgagtatcatgaaaccacttagagtgttttacttttttttttttaaattgaaacgtagtgttttccagcagcctctggagactaaatgctatctttgtcatagtctgccttttaaatttctcatttccctccccccgaatcattgggtaaaacttacatttttaggctggcttttcctctttggtagcttgcttttcagtggtttctttttctcctggcctcctggtgtaattcttatattttgtagcatgaatacagcaaagcctcctggtcgtggatttctttttctagtgttagaaaaatcaactgtggaaagcttatcacttctctatatatggagcatgacatttgagattccacttataccaggagatgtaagcccagggtccttgctacaggatgaaaagggcaaactctgattttctctaagacacatggacaaataattataaaaatattcttccaaaggaccttataatcagggatgaggaaacttaggactaccctagatttactgagaaaaataaataaaaccctaaaaatttcaaacactgctgtggcttacagaataagatattttagcattattgcttagagcagtgaaaagggcccatttaggttagagagcttgagagctctgttaaaaacagcaagacattccctgctgataagacctctaaattatagaacgaacatatcgtgactgatcattccttttaagaaatgtgaatagcagatttataagtttcatatggttatgatgtcaaaatttccatattctgccgtaaagaatgaaatctgcagagggatcacctataaaattgcaaagggcagcaaattccatttgtgagcagaataccgttttgcattcttggttttcctgaagtcacacttaagccatttatgcaaatctttgacaaagcaacttttaaaaaatatttatagttgacagttcgtggaaacacatttgtgcttatgggctaaataattacttttctctaaagacaggtgtctcgtgctcaaatcagttgtgtccacatcttaaaagctccagatgctatatttcaaaagatttgcttatacaatacagtattttgtagataagtcttgttaggaagtcagtgcccagggctcagggga

SEQ ID NO: 61960 - DNA, 1337 bp, Bovine  19866881279194
cagcaagggaaaaaaaaattctttttaggagcttacttaagcaaatacaacaggggagataatttcctgtagtcatgaagacagcgtatcagtattctgctggagagtctgtgtgtagcttcagagagggtagccagggagcagtgatgtttaagtggagacaaaggccagaagattcaagatacagagagaactggctggaggtcttgagcaagatggagaaggatgggcgtgggagaagtaggcagaggacagatcaggaaggtattgaaggctgcgaggagtttggcctcaaaagagtaacaatggtgatctgaggtcctgaaaaattctttcatacttattttctgaaaaataagtgaagtattgagatgacttaaaaatagaaattcttgagtgagttatctgataccttatccccaaaaatgacattaagtaggtggacccattttccagtcattctggataaataagcccctattatattataatgcttgttcaagtaaaattcttattacttaggggaggaatgtggtcaccataacaggaaaacatttttccactcttttttgtgtgtttagaattggccactctattagtttccatttctttctccaattttgcattttaaaatgcttggatcctgatcacagattttaaaaatattttgacctcacccagtcttttttctcaaaaagttttcaaagcaactgcattgtaaagtgatgcaagcactctttactttcagcttgaagcaggtataggtatgaattataggcattacagtcatacctcgaagatactatgagttcagttccagatcactgccataacgcaaatgttgcaataaagcaagtcacacaacttttttggtttcccagtgcatataaaggttatgtttatactacactgtagtctctgaagtgtgcactagcagtatgtctaaaaccacagtgcacatacattacttaaaaaaatactttattgctgagaaatgctggccaacatctgagcctttagtgaatcataatctttttgctggtggagggtcttgctttgacgtggatggctgcatactgatcaaggtggtgactgctgaaagctggggtggctttggcaatttcgtaaaataaaacaatgaaatctgccacacagattgactcttcctttcatgaacagtctctctgtagcatgcaatgctgtctgacagcattttgcccacagaagttttcaaattgaggtcaattctctcaaaccctgctgctgttttttcaactcagtttatgtgatttttgaaatcttttgctttcatttcaacattcttcacagcatcttaa

SEQ ID NO: 61961 - DNA, 1118 bp, Bovine  19866881339506
taatcctctataaaaaaaaaaacttgtaaaccttttattactgtacatacaatctgtacataaaggaaattatccaaggaaaactgctgagtagttttcagttcagcaagacagaaattttatacataggttcatgtaaaagaaattagggaaggatcatgaataaaatatcacttatctgcctgagagagggccttgacagaagtcaggaattatataattgctttgaattcaagccagtccttcctgtttaaaaaggatactcccttttcttttgaaaatgttaaccatttccaccactaccccccaattttatctgctgaaaagcttttgcaatccatcgtagcccaatggtatgttatagtctgtcactaatttctcaattaaagctataaaatatgaacatctattggcagaattttgcctcaatccagctccctgtgttgtttgtgccctggtgtctgccttgctttcagcccacttccaactaatgctggacctgatgagggacaagcgagtcccaggcttgtcttctaaagctggtttgagtctcagctgtctgatctttcataggtcacttaattgctctgcatttcagccaggttaaagtgggataattatgcagaatgccacacttaggctctgcacctggcaagtagtagcatccctgtgagtatcgagatctttcccttcccttctcaagctagagggcaaggactgaacctaagtgactcccgagactgcacccagcactagcaatcggtgcttctgagtatatggtgtgaggaaaacaagaggaaaaactactggattactaggacttaaaggcctccatgtaaacatttcagagtgttgaaaatacaatgaaaacaaaaaaagaccaagaagtcaggaaatcgtcaccttgaccattgggcccagagaacaggaaaactaaaagattcggtttcctcaactgaaagtagaatcagccaggaagctttggaaaacaatgtttggctagcctgacagtgatctttaacgatgatgcaaagaaggcacagcttaaccattcagattaaaaaaaataataataagtactgattttatctatgtatttatttatttaaaagaattat

SEQ ID NO: 61962 - DNA, 736 bp, Bovine  19866881427287
cctgtccctcttctatccattgcggagatcttcttctgcctgatgatcatacttggaagcaatcttgttcttgacctcggccgaaagcccataggaagggcccttgttgaagtgggtcatgatgattcgcgcggcgggaagaggttgagttcgggtccgggggtttcttgcactcggtttccccgctcctgaccccgaagagtggccgcactacaagatgctcggagctcgctctcctgggcggcgcaggagtcgccgggaagcggcggcgggacgcgcgcggtgcctcggctactcggtcgaacgaggtcccccagacgctcccgctcggctctggagtcccgcacgaactctacttcatttttttgcacatgatgtctgtttttaccagcctcggttgttgaaaagactgttacttggcacacttgtcaaaaatcagttgacaaaaatcaaagtatgtaattattacttctggacattttgtataccattgatctatgtgtttatcctatatcagccccatgctgtcttgacttctgtagctttgtagtaatttccatatgaattttaggattagtttgtcagtttctgcaaagaaaccagcttggatcttcataagaattgtgttgaatttgtagttcagtttggggagtattgccatcttagcaatattaagttttctaatccatgaaaataggatgtttgttcactttttaaggtcttctctatttcctgt

SEQ ID NO: 61963 - DNA, 2349 bp, Bovine  19866881531482
tcctatttttccccgataaaatttaactcacaactctcaaaaaaaaaaaaaaaaagtattttattttttaaatagaaaatccatggtcatggtccaaaacccaaaagataagagaaggatatttagtgacaaatcttctgctgcctcatcctcaaccagtgttctccccagtacttttcttcattgttactagtttcttttattccgaccagagattgtgtgtgtgtgtatgagtgtgtgagtgtacgagtgtgtcttaatttaggctaccctagaaacagaccttgacataaggattgaaatgcggctatttatctgggaagtgctcccaggaaacttctgcagggactggggcatgaagactggggagggaaggcagccaataaagggaagatcatgttgtaaatcccaccatagacaaacagaacataagttcactggggaactctgggagccagcataggacacgtggcccactattatttctcccaaagggaaatgaagctggtgttttataaccaactgcattgtttgaggtctgtggggtgtgggcaaccagccatgtggccaggctcaatgaacccgggtgggcagaaaaagttcttggtcagcgcaagagctggcactttggagcatgcaggtatggcctgaaatgttaaggagcaggaggtatctgtatagcctctgctacaacattctcctaaaaacatttagaaagaagttgaccaaacatttgcagcaattttggctcagtccctcaaatgccaggcttccacagggcctggtctgaaggctgttggcattcatgggagcatcaaatgaagctttccagggtgtggctcccatcagtgattcctggttctcgttctcaccttgctgctgctgctgctgctaagtcgcttcagtcatgtcccactctgtgcgaccccgtagacagcagcccaccaggcttccacgtccctgggattctccaggcaagaacactggagtgggttgccatttccttctccaatgcataaaagtgaaaagtaaaagtgaagtcgctcagtcgtgtccgactctagcgaccccatggactgcagcctaccaggctcctccgtccatgggattttccaggcaaaagtactggagtggggtgccattgcgttctcaccttaatcacagtcaaattctaacccaatgatagaagccatctgcactgacaggcctcggatatcatgtagcactacctcctgctctcttgacctgggagcaccctttccttcctctttcttgcctgatgccacttattctccagattcaggtgaatagaaagaattaattttcctttggggttagtagggggctcactgaggcattttagcccagagtctgagagacactatgctctcaggaatgattatctttccacctccccatctgtcagatgccttggggaatattccttgtcaccctcgagctcaactgggagtccactctgctcactgtcctagcaccctgggcttacctactggaatggtctgcttgcccgtctgtctcccccagtggtaccaggagcttctttagggcaggaagcaggctttgctcacctctgaatccctgtggttggcagtagggctcagtaaatgcttctgagtagaattcacctgagggcactgcaccacgccccttctttgcagcatttgtaggcatcctgagggagaaattgctgcacacagggtggcccttgcatgtgtgttaggtggccttatgtaaggtacacatatgtaacggaggttgctgtctccttcctggggagagacctgtagacctgctccttaatttgcatgcaagattgtttctgctctttcttttttgtatttgtttaatggataggcaggccctctgtccataaatatttccggagtccctactatgtgttgggcgctgttctaggggacggagatagaggggtgccacatgaccgaaagagagtctacctcaaagaacttactctcctgtggaagatgtagaattcatttggactagccttctgttgccgtcagaatctgaagaatctggaagaaggggagctcctctgggactgggtgatgaaaatctcaggcagttgtaagtaaaggcaagggaggcagacaccccagtaggaggagggaaccaaaggaggtcaaggacagctgtcatttagaagcatactgagcatgtctgtgttcagcatatggatgtcataaagagataaaagccccagtccgttcctgtaaagatctgctgtctatggtgggaaagtcacattaatcctgaggattatctactggtggggaccatctaggcaacaatttttaaagactttca

SEQ ID NO: 61964 - DNA, 847 bp, Bovine  19866881545564
ttatgtaacttgctctgagcctgcttttcgatttatattttaaggattaaacaagcaaagggaagtaagaaattcgaggcagcccactgcaaatttcatctgcctgagaagtggggtgccagatttttaaaaattatttgcaagactgggttaaaaatatcaagcctatataataaatcatcttcaaatcacttttgttaccaatcattttataacttttgaatttggcattttggggagaggaaaggagagaacctgatttgatcttaactggatgcttattgtttttgtctctaggacacccagagacctgttttctaaatctgagtggtttattctatcttttccaaagttgggtaaaatgactatggtttctttactagctcccctaaagagataagtacaatgtaggaaaatggtataggctgtgtgttttctgcttccagggtccttcctgtgtgtttataatttgaattccttcaactacacccagattccaaatgcagacttgctgtgccccaggctaccagttcccccaaggtaagagctttcaaacgttttccttatccattaacaaaacttattgggtacttggtgagagtctcttactcttctccataagaagcaggccttggggggcaaggccagatggtcaacacaccttttttctcagtgagaatagaaaacaggtccttctcgagaacatcactcagcaagctgctttcacagtcttattcatccctatcgactagggcaatccctggcacagaggagggctcctgtaattaaagctctcagggtgaagcagtagttgccctgccgtgattaatggctcacatgtgagcca

SEQ ID NO: 61965 - DNA, 1001 bp, Bovine  19866881626833
aatacactgttagcctttcacttcctgtgtgtcatgaacgggaatctgttttagcttgatccatattttctccctctcagtcccagcttccctccatgtgttgttcatcgttttgtatgacacctccttaatcacaacagttttattagttactgaagctcaaatggttaggtttgtcagtgagctccagtgaaggtaatttactgcaggtcacagatatggtctgaatgaataattaataagaaggaaccagcagctttgggtgctttagtgtgaaacttctaaagttaggtaacttgtatttcagattgcttccaagtatgatcatcaggcagaagaagatctccgcaattggatagaagaggtgacaggcatgagcattggcgccaacttccagctgggcttgaaagatggcattatcctctgcgagtaagtcttggccctgacgtggctgctcttccagtcctcccagggtcacctcccagggtcacctctgtcatgccctctttcccagtccagggtggcaaaccttgatattctgcaaatgtttttaatgctttcctttactgatgttgaaaggaccaactttacattccagtcctggtttgttccaataagtatgctgtcacttaatgcttttcttttcagactcataaacaagctacagccaggctcagtgaagaaggtcaatgagtcctcattaaactggcctcaggtaacagccaaaccagcaacccctgattctagttggttactctttatgcagcaagaacttgattacagtttttagacattttagtggaaatctgtgtacatgactatatttagttctctgatagtgttacttttcaaatgtttccataattacttagaattagttctgtgactcttagatatttagcttagaagttttcctattctgtatttagtctgtgtactctcaggagtcgacacagcttacacagagaaagacaacctagaccacaagagaataaggggaa

SEQ ID NO: 61966 - DNA, 853 bp, Bovine  19866882026992
aaatgctttaaaaatttgtgctgccattaattcccaattcagccttcactccctcaacaagaataactagaattccagtgtcttctctttattattttgactccaataagatgtcactttttagatccatgcttgccctcaagacttgacctgagtatgcaactgggcttcccaggtggctcagatgataaagaatctgcctgcaatacaggagacctggatttgatccatgggttgggaagaatctctggagaaggaaatggcaatccactccaatattcttgcctggagaacatggacagaggagcctgacaggctacagtccatggggtcacaaagaatcgaatacagctgagcaactaacactgactgactgaaatcttcaacaattcagatttctgctcaaaagagcaacaaaaacaattctaaagtatcattacgaatccacatgtaaaactttccccgtttactaaaagcacatacctatgcccaaatggctggactctgtcaaactctgaccaagtcaccaacacagaggtgggaatgggagggtggggaaactaacattgtgtgagaacagaaaagttgggaaaaatccaacctttccttatttggcaggccagaaataccacgagaacagctgttttcctggtgttttggtttccactggcattcataaccaaatgtgcatggaaataaaaaccagggagaagaaaaaccccgaggcacaaaagccccacagttttctgtcttttgagctgagatttaggtcagtttgcccgtttctcactattaagcatgaatgcacacacaggcacatgcaactacttccccgacaccatccaggagacac

SEQ ID NO: 61967 - DNA, 1572 bp, Bovine  19866880240148
catcaggcccccaagaccgggaggcaccttccggcctgtgtgccttcttccagtttgcagggtctgccaagtgctgccctgcaggatccctctcacacactctccgcttctcatcctgcttttagggggaccagaagcaagaagacacacagtactgtcaggaaattgaagaaaggccctcagggctgcctggagcagaaagggagaggcggagcccggcatgagatgaagctggagaggaaagcgggaccaggggctcagcagtttagagatgttagaccttctgccgagagcacagaaaagccttccaagtgtcacaagcaaatgggtgacacgattagacttgcctgttgaggtccttgtagctatagtgtagaaaagcagaggggcccagagttgatgaggaggggcagggtggggccagaaggcctggcctgagggaacgacagtggacacaggaaaggtgaccggactttagaactacttaggaggttatgatatgtgagttataaaggatatcggagaaggcaatggcaccccactccagtactcttgcctggaaaatcccatggacggaggagcctggtgggctgcagtccatgtggtcgctaagagtcggacatgactgagcgacttcactttcacttttcactttcatgcattggagaaggaaatggcaacccactccagagttcttgcctggagcatcccagggacgggggagcctggtaggctaccgtctatggggtcacacagagtcggacacgactgaagtgacttagcatagcatcaagatttaattgcttgttagaacataccttaaaactctacagaaaaaaaaaaaaacaaaaaacaactccattgaggaaaataacagaatcctgagtctccacaacttgtcatccacactgaccagaattcattaaaaaccgttagacctgggaaacgggaaaatacccataatcaaaagaaaaaaacagtcagtagaagatgattaatggatgattcagatgttagaattagcagatatggacttaaaatatttactataagtatgtttttaaaatacattggaaaagatggatgtgtgggggacaatatggtatattttagttgaaatatcaaagacctaaatgggaattctaaaactgaaaaatacaaaatatgaaatgaataattcattggatggattaacagaagactcagtactgctgaaaaaataatcagtgaacttgtagatctccaaacattattcaaactgacaaataaagagtaaatattgcatgactccatttaataaaattctagaaaatgtaacctaatctatggtgctaaaaagcagatcagcagctgcctgggatgatgtgggagtgatagggaggacaagagggccaattataaaggagtgcaagaaaatttttgacggtgacaggcaagtttattatcttgattatgatgatggctcctggtgtgtgtgtgtgtgtatgttaaacttatcaagttgaatattttaaatatgtataacttactgaatgtcaatcatgcctcagtaaagctgtttttaaattaaat

SEQ ID NO: 61968 - DNA, 2470 bp, Bovine  19866880540085
tctccccaacacaccaataatcaaggatgcagtggcttatgatgggaacaaggaaagctttggaagactgaagttgtgaaagaatgggctacaacttctttttcccaatcatgcctgatgacctgacattataaaactcctagaagcactagataaaatataacaaacttaaaaataatatactgtttgcacttccctggtggtccagtggttaaggatctgcgtgccaatgcaggggacacgggtttgatccctggtccaggaagatcccccatgccatggggcaactaagcctgtgtaccacaactgctgaccccacgagtacctagaatctgtgctttgcaacaagagaagccatcgcaatgagatgcctgcacaccacaactagagagtagcccctgctcgctgcaactagaaaaagctggagtgcagtagtgaaggcccagtgttcagttcagtttagtcactcagtcgtgtccgactctttgcaaccccacgaactgcagcacgtcaggcctccctgtccatcaccaactcccggagtccacccaaacccatgtccattgagtcagtgatgaaatacaaccatctcatcctctgtcgtccccttctcctcctgccctcaatcttttccagcatcagggtcttttcaaatgagtcagctctttgcatcaggtggccacagtattggagtttcagcttcaacatcagtcctaccaatgaatatacaggactgatctcctttaggatggactggttggatctccttgcagtccaagggactctcaagagtcttctccaacaccacagttcaaaagcatcaattctttggcgctcagccttctttatagtccaactctcacatccatacgtgaccactagaaaaaccatagccttgactagatggacctttgttgacaaaataatgtctctgttttttaatatgctgtctaggggtcattcaatattataaattagcactgtagctctgtaatagcattgagaagtcatttaatgacatgaaataattttcagatgaagaaattaaagccattgtttttcaataagtctttttctaaaaggagaaatgggagtcttttcttaacagaaattagttttcctttgtaagatgtttataaattcaaatattttgcatattgatataaaatatttttaaaataattgaaaatttacctatgatgaggaattgcttcacaatttcttcaagtaggcaaatacccttttgactttataatgtgatctgagtttacaaaatgacaacagttttctaaatttaatagatttctctctgtctgcctccacgatccccacccccaccatatattctctaccctgcctctctgcccccagggctggtcctacagatgcatcaccagggcttctttaaatttacatttctagctgagtttggccagtggtgggtcagagtaaggaggagaaaggatgggttatttcttcttctaccccctcaaggccctggctccttgattttggtcttattctccctctaaaattatagttcctttcagtaacttctgtggctccaattttcatcagactcctactgtttcctctcctgctttttcagacccagatcttcttcttctttttttttcccatacaagaatgtatgtttattgcaaagaaagagagagagaaggagagtccaagagagattagaagcctagtatataaggttaagaatttaaaagcatcttacattttgccctaatagcaacagatttaataggaacaaagacttgtgttactttctggtatcagctctctgtaaacttgatgagaaaattttgtgaaatatagtatggaggaagaaagcttgaggggtcttcattgcagatcatgcaggcaccactacatgtgactcctaacatggggattgtcagtggctgggccagaagacaacttcccttctgactggatgggcactttaagatttccatattgtctctaatataacaaatgagttgcatgaaatctgccttgcatatcaagtggccccccaaatataataccattgatgagattgcattgcattactgctttcacagtctcacactaggcagggactctgaggctgagatttgatcttgatggttctagtctataccttccactgtgctttcttagcacgcttcaatattccttattggtttctttcctcatctctgtaatttctttcttcactaaataatttttaaaacctcaccttagttaccttgcattttcggcaggaatctgatgaatgcagtaacacaactcaggaatggaatcagagagatgaagtttctattaaacagctaatgagtgatagccagtagaaacagacctgggggcaagtgtagctacattttgtgtattttatcttcattctgtgaggcccttggtatagactttccgataaaacctgacagtagttcctgattattct

SEQ ID NO: 61969 - DNA, 2095 bp, Bovine  19866880917942
ccccagctggccttcctcctgcttcagggttcctctgggcctccactcaccctgctgagccctcatcctggtgtgccagaggcaatgcggattccagtctgaggctgggctaggagaccccacaggctggccactctactctggggaggtggagagggagggagagcagcagggttcctcttcacctgcaaataggaacacagggtgtttcttggcggctgcaaggatgatgatgaaacccccaggatattgagtcattgtgctggccagctgatagcgagcactgacccccgcgcaattgcacaggggtcagagagctggagaaacgtctctcaggtccacggcccaagcagcccatgggatttcctaacctgagccatccctctccccttccttctctctctccctcctggctccctctctccctccctccctctccctcctggtcctctccctctgccctgaccactgccttggggtcacctggagaggccgctgcttcttgccacccggcctcctcccccatagtgtctgccctcctggcgccagtcttgggcatggagtttgtcctgggcctggtggggaacagcctggccttcttcatcttctgcttgcgcacgcggccctggacgtccaacaccgtgttcctggtcagcctggtggtcgccgacttcctcctgatcctcaacctgccccttcgcgtggattactacttcttccacgagatctggcgctttggggacaccgcctgcaaagtcaacctgttcatgatcgccaccaaccgcacggccagcgtggtcttcctcacggccgtggcgctcaaccgctacttgaaggtggcgtggccacaccatgcgctgagcagggcctcagctgggggcgctgcccgcgtggccgggggtctctggggggcactcctgctcctcaacgggcacctgctcctgaccacccactccagccggtcctgcctcagttaccagctgggcacgagaccctcggcctcactcagctggcaccaggccctgttcgtggtggaattcttcctgccgctggcgctcatcctctttgccgtcgtgagcatcacgcgcaccatccgccgccgcggcctggacgggcaggcgggcccgcggagggccgtgcgcgtcctcgccgccgtggtgggcgtctacaccgtctgcttcctgcctagcgtggccttcggcgtcgcttccgtcgtggccttccgcctgcgtgcctgccacgccctggatatctgctcgcagctcttccacggctccctggccttcacctacctcaacagcgtgctagaccccgtgctctactgtttctccagccccagcttcttccgccaggggcgggccctgctgggcctcacccagggctggcaaggctcagacagcgacaagagcacctaccgtgcctggcgcagggcgcgctctgggaaggtggcggccacagggaagctgcaggtggacgtctcagaggaggactgaccaggaaggcccctcccagaactggggctctgctgcgggtgcctcgggacagaggaatgcctggctctgggctggagggccagggttcgtccttggacggttgccagcaagggtccctcaaccagccagacaaaggacctctgcaggagccaggtgggtggcagggagagaagagggtctgggcttggagtcgtgtgtctgatgttgtggggatgatgttccgacagcacggagcaccatggcaggtggaaacagccagggcctgccaactcagcagaaggccacagccgccttgtcccaggtcagagccagggaactgtgagagcagaagtcttgttttagaaattttgttgtgactcagttgccaggtcatgtccaactgtttgcgaccccaaggactgcagcacagcaggcttccctgttcttcactatctcccggagtttgctcaaactcatgtgcattgagtcagtgatgccatccaaccatctcatcctctgtcactctcttctattgccctcattctttcctagcatcagggtcttttccaaaattggacagctgttttttctatgatctccattggctttttttttcaatacta

SEQ ID NO: 61970 - DNA, 1250 bp, Bovine  19866881061551
atataccgaggaaacaccaaaatgtatattggcatatttcatgggaccatggtttgcacaaagctagtaacaggtctgaatgcagcttagcccgcactgctgtggaatactcaacaaacccagaacaccacagaagcacatcagaggaacctaacacctaaactgagcgtccaagcggaaggtaaggatgggcatctattcactctgaggctaccttatcctgctctccatgcaaggctgactcccacacctcccaccagatgctgccagcacagttcctgggggagtagggggtggagtggggaataagccctgctggagaaaactcaccgtagcagctctcacaggctcgcccgaggagagggttttgtggctggaatgtggttcccacagctccattcacagcaccaggtttgccattgctggtggatatttggttgggatttggtttgctgctttcaatgaaatataaagtgaagtgataaaaatgacttgtgtaacaaggtagaaggctctacatttcattactgatttatcttaaccacacataaacatgtgaatgtttgatgaagaagaaatttaaatgaacccaaaccatttatctttacaaaccgaggctatgtaaaaaccaatctcataagcatgacactcacaaaataagtagtcatgtatcttcctcatccagacataatttccttaggatactgtttgaaattttggaaaatgcaagttattaaatattacttatcatgacaaaataatttctggattaaataaattaggcagtgtgcagtgtttagggaaaaccactgcccattcctgccactagagtgacagctgctgaccctacgcattggctctcgagggaactgcacaaaagctgcatgtcaacagtgacactgtggataccagctgggcttactgggagaggtaaacgcatttcaggagactgtgaccactcatcatttctattatgcttgaatttttatgaagatgattacagagcacttgaaattagaaaaaccaataagtgtatccaaggcatttcttttttaagaggaaaaaggtaacatctatcagatttccagaagccataattcctcagaatcatgtagcctggactgttttggtatgtactgtgccaacatggttcgctttttcccatctggggtagcctaactgccctgcgtatcagtcacgcccaagaacactgtccacctaggtgtacacactatgtcctcaagtacagt

SEQ ID NO: 61971 - DNA, 870 bp, Bovine  19866881388917
tggtgcttttagatctgaagactttgttctttagggggttttgtttttgcggtttctatttagtggtgtagtaactgtatattacattagtaacactgcattgctgtgctattctggccatctgaagctaaatgccaccaatgcattttaaattcccagctgcacaccctataaattgaaaccatgacatataacaatctgggtgtgagtgaagttttgccaaaacaaatgccagtgacactaacagctttaattatcatgtttgggatttaatatatcaactcatattgataagtaaaaatttccttcagaataattttagaaagatgcaacaacataaaagacaggatactggctcacattatatacttcatagtctattataaagagtctactttcataatttttaaaaaatgactgctatagaaagctatttatgaacttcacaaatagaaatttccccatttcaaagagactgtaagcttaaataaaaatagcaattccataaagacaaagaaagtacacaatagtagacataattacctagtatttaaaatgcaagtaagatcatgtacattatcaggaagaataaagattgaaaacccaaaaagcaaatcctcccgctttgcttggtaatggttgtttctatattagagatctgtatcaaattcaggctcaataattagtaagataaccagaaaaatacccaagatctaaaggagaacaacaagcttaaaaagcagagatcagaagtatctagttcaaatggtcagaaaagctgcgcataaattaaacctggaactcagagagaggtgaagaggatgaattcatactgccaaagtttataacaaaaatctgggacttcccaat

SEQ ID NO: 61972 - DNA, 1029 bp, Bovine  19866881426598
atactgatactaaatggtcactttcacttaaaaaaattgtaaagcactacatgtgagctacaaacatttatgtacgtagacacagtacatcaaaaaagcacaaaagtcaagacaggtggatcagaatattgaactgttttctccaaaatgttttgttttaaatcattttgtgcccactcagtgaacagtcattcctgcttgtctcagttcacaaacacaagggggtgacttaaaaatgagacagcccagttaactgaccagccaagccaatccaacctaacggcagggctcagagctgggaagttctctggtctataacattgctgtatcagctgttaaattaaacaagcagcagaagaaataataagccccaaatttcaaacagcatcttaccagggtgatgtctcgagaagctgcagctgcactcatatgcaaactaggttgccttacagaactgctacaatcaagggctcgagcaaatgtcccaacagcactggataaaagaggaaaggttaaggcacggttgttcttttatcttgaaagaaaaaaaaatctgggtagtaaatgaacaattgtaatagccaaacaagttctttgatgtttaagaatcaaatatcagattaaaaagtatcttctttacaatttaagaaatgacaagccaattcactatacatataggtcattataattaagaagtttgtgtggcattaacaagggaaagatctatagtgaaatttcatgtagttaacaatctggtacacaactgtgtttcaaaaatgagatatacattagatgcagagtttgactactactgtaaagcaagttgtgaccacctttttatcccaaatggtgaaagtggagtaatgtttttcccttgaaatgagatatcatcaactgtagcaacctattacaactgcagttatatgttcctttaaggaatatgtaacagatttccatttaaggaaagaaaaacaattatcacaatactgatttaaatttaatgatttacaaggcgttcccaaatataga

SEQ ID NO: 61973 - DNA, 1745 bp, Bovine  19866880179633
tgttcattttgtagacgtaatatttcacatcaagattagcttagatgcaaagatatttttgtccaggttatgaaatcaacttatgtgttactgtttgctcacaaatgtgggtttattctaacctgaagataattctaaaaaacacagcaagcaaggatctgccttgcgtcttttcttgcccttctgagtcttcctgttcctgtctaaagcagcttcattcttctttttcaagttatttcctagtgcctgcagcactcgtccttggcttcctggtttcgtccatgcctggaacagcaacttttcccactttccagggtgaggctacacagtgggcctgctttgttccagaaggcaggttcactggtctcaatgcctgatgtttccccaggttccctctaagagacgtgttgtgcagcagtggataaaatggctacactccagacgtttccctcttgcaatgtgtttgccttcgtgtgttcatttaaattttgaatcaaaatatatacaaggacttccctgggggtccagtggctaagacttggtgctcccaatgcaaggggcctaggttccactcctagtcggggaactagatcccacatgccgcaagcgagttctcatgccacatctaaaggaagattgaagattgcacgtgccgcaactaagacctggcacagccaaataaataataaatattttttaaaaaactatatacacagagtccatttttcctaatttgaaacacccttgaaaagaaaaaaaaagaactagtggaagagaaaaacaaaatctcatccatcttttcttaactttcaaaaagtcttgtcctcatttattttttattctcaaattacagatgttggatgctgaccaggcaaatcaggagaaaccagattcttcaaatctagggaattgaagttgggcctcagcttcacctacattagttgtgtgatttgggatcaagcttgctaagcctcctatttgtaaaatgagaatgaagatagtacctcctcatagaggtataggtagaactgaatgaaataatggcaccccactccagtactcttgcctggaaaattccatggacggaggagcctggtgggcctgcagtccatggggtcgctgagggtcagacatgactgagcgacttccttttcacttttcactttcatgcattggagaaggaaatggcaacccactccagcgttcttgcctggagaatcccagagacgggggagcctggtgggctgctgtctatggggtcgcacagagtcggacacgactgaagcgacacagcagcagcagcagatacctattatgtttacactaactaggttgtagtaaaaacaaagatgacatcaggtattcaggcctaaatgaacctacaatagtgaaatcaaaaaagcaaagaaaggagccaagccaaacatgagcctgagggttgattagagacccaaatatgcactcttcagctaatatgcagggacatccttggctgagaaagaaaacctgtggtcagtggggcatgcagcttcacttcttccacttgtctttcagtgtgtcattactgcaaattaaataattcagttgaaagctaaaacatttgctgcactggctgaagaacctctagactgcaatatgtgacatacttaattgaatcctcttccactaaaagtcagaatataatggagttcaaacctgagcctctcaggcctcccctgccccatttaagaaggatgagtgtatag

SEQ ID NO: 61974 - DNA, 1403 bp, Bovine  19866880378449
aatgatgtaggctaagacccgaacacacacaatattgaccagtttaaacattgattgaatagaaaaagtgagagactatatacttacaatttcatctgtgaaataatattaaaggatcagcatttgactagattactgagtacttttctgggaagaagcaattactagtgataataaataagacggcactcagtgttctgtggggttctgatgtcagtggaaaatgaattattggatgatcagatcacattattattggaaggacttaagttacttcttgtgttgattttaatcaaacctttctgtttgaattagattaatgaggatattcctgaaacaaagataaagttcacatctgtggagaatcctgagagtgacagcgagttttcagatatctcctattcatgtcaagtgagctcaaaagtcccttatgagctgcaaaaaggacaagcacttattacctttgaaaaagaagaaggtatgactaatgttcaaaaacttgaccgtgttacctttagaaagcactgggacttccaaagagtttttgtagatatttggccattgctttagaatttttatatcatttcgtctcatcctcacaggggtgccctgaggtagatatgattatccctgttttacagaccagaaaacaagactctgagatgttgagtgatttgaacatgatcactagcgcagaatatgagtgctctagaaagcaaacccgtgttgtgatgtccaatagcagcatttttatactcctcctgctacctgcaaatgataatactagtaataatgtttcaaggtagcaaagcagagagttctgacagacatgatctcattttatactcacatgactctgtaaaagtaataagatagagatactatttacatcattaagaaaccagattcacagatgtttaagtgatttacctaagtgcacaaggcatgagggagaaggcaatggcaccccactccagtactcttgcctggaaaatcccatggatggaggagcctggtaggctgcagtccatggggtcgctaagagtcggatacgactgagcaacttcactttcacttttcactttcatgcattggagagggaaatggcaacccactccagtgttcttgcctggagaatcccaaggacgggggagcctggtgggcttccgactatggggtcgcacagagtcggacacgactgaagcgacttagcagcagcagcagcacaaggcatgagaatgaaaagagctctggagtcaaagacttggagtgggacctgatgtttgccatggtgtggaaccctcttgagaactggggacaccttaatgaggagaatctagctttgaatgccagatttgcctctttttttttttttttttaacaaaacaaaacagcactttatt

SEQ ID NO: 61975 - DNA, 1498 bp, Bovine  19866880524998
tccacactgttaatgcaaagggttcatcacattctgtagagttagtccacatgagacaaatgtgagtttgtacttctgaaggtcaatgtccaatatcctgttcccccaggtctcatgtaccaagaggcaggatcagtttcaagtctcttgggtcagacagatttcctggataggatattgctgtctgtcttcatacactactggacacaaacctgaccacctttaggttttcagacttatttgaggagaagagaacatgatcgaaagagtcaaagggggtaagaaataagatttagcaggaatcacatgttattgtattttccattcatttttctttggggagagattttaattgtcatgtgttctagtgaaaaagaagttttacagaccccctctagtacataagaccagagaacatttttaatatctacttccagctatcagacagaagtgtaagcagctctcatgcttttaacaatgaattgttaggggtcttttaaaaaacaccaggagttatggtcaccctgtctttacttcttttattccttactatatgtgatgataagccattgcctatagaatgatctaatgtgtacttatgtccatgtctgttaattaatggagaaaacattcttctttacagagtggagtcaatatacatcacaggttagcctcagaaagtggtgtttggctttctggaatttggttctgctctaaatcaagacttcagtgtaaaaagtttaaatttccgtaggtggctttgcattagtcagaactgaaatagagcctgttacttatgagaggttgtgaagagcaactaattcaagacacctgggagttttgcccaacataaatcagctagttaatggaaaaactagcaccatgatatgttacattttctttgcgtgtaatacatcagggtacctttgtcatccctatatctggataatcccaaatggaactagactcagaagagtagacttgggatgcacttgagcctatgaacactaggtggcatctatttctttgtgtgcttgatcagtagatggatagtgcttcagttagacttgtgcattgagaaaggaatggacaaaaacgttcaatctgtgatctttgttcttttgtagatttgtgggagttaaaatggcacctgtgactcataaaccagggttagtattataggtgagaggtagcaagttcttggtagatataaagactccttttaaggacagcagtatctaagaaatattatttacctaaccttctcaccttggacatgagatatctaggggattttaaaagcttctgactttatgacgataataaaaaggattggctgagaatgaatgtacctgtttaatggaatgagaattactatactacgtaaacttgaatgataacaagtgaaggtgtggtggaggaaggcatggtagtccactacagtattcttgcctggagaatccctggacagaggagccggcaggctacagtccatcgg

SEQ ID NO: 61976 - DNA, 1257 bp, Bovine  19866880609509
cactgaagcaacaagccattattgcccatttaatgcctttgacacaaactgccaggcctactggatccagatgaggaagatcccttgaagattggatcccacagctatttctaaaactttataagccaagccataaggaaagcttgctgaacacagtccaacatttgttcatatttttttaattgaaatatagttgattttcagagttgtgtcttgtgcatttttaagtttagtttttgtggtgaagtctagcatagatttgctttgttgaagtttagatcttaaaactattaaaaagtaatgctcattccgtcaatggtgtttgttgcagaattacagattttattagacactagtgtaacaccagtttatattgactatcagcttcataacttcagaactggattagaaataaaagtatcagcagtcaataagcaaggaaaaggtgagtatctgccatttttaaaaactgtttaacatgtttagaattcttgatttagaaaagaaatactgttaaacattttagtaatggagaaagactctgggttgatacagcaataataatgcagaaacttctaaaaatgtctgtgctgaaatcatttaaaacccaaaagaaaattttttaattatataaaaaaaaacctatgggtttaatgttgtctcaggttttatgtgcaagtccagaaaatagaggtaagtctagtttaataattggatagattaattgtactaatacactggtgaattacttaggtatgtgtagaaacaaattaagggatggtgcaaccgtaaatcataacaaaaactattaggcagtttgagaacttggagaatagtggagagtctaaactgaaatactaacaagatttgtaggtcatgtagacaggattgatgctttgaagtgtctaaatagcttcaacgtagttggctgggagcatgccagtcctgccagtcctctgcacagtgccgtacatccaaccttcatcaatagcttgaacattgacaatggcatctccatctttgaaggatacctcatctgcatcagcagccatatagtcatacatggcacggaagattttctgtgggtaaggacaaaaaagggaaatgttagatttgcaacaattaacctaaacaactaattttaaagtctcttatgacaccagaaatttaagttgcatgaaacagaatgtgcaactaccaccaaaactaaaaagactaggagaaaatatttgcaaatcgtatatctaataaggatta

SEQ ID NO: 61977 - DNA, 1006 bp, Bovine  19866880617499
tgggttgccatttccttctccaatgcgtgaaagtgaaaagtgaagtcgcttagtcgtgtccgaccctcagagaccccatggactgcagcctgctaggctcctccatccatgggattttccaggcaagagtactggagtggggtgccattgtcttctccccaatttattactgttaacattatacaaaatagaagttttggtttaaaaaaaagatcagcacacctgtaaccattatttcacatatcaaaaaaggaggaggacttgagttacttactccagcagtggatggatgggatgggatggaggataccgttgtctgctgggtagcaactgaagatgatcgttgctgtgggagctctgtggttcttgcatgtttgtaacctgaaaggaaaggggaaaatagcattaggagaaaacgtgactagatatcatttactctgtgtttagcaactgagcagcagtgtctttccccctaatttaaaaagaatgatttccaagaaaggaggaatgaaaattaaatagctaactgcatgtacctctccgcaattttagactcattagaagaaaaggtccagatttttttctgtttctactcaaagcatctcttacagtaacatccagtgaactggctcccatggctatcgaggtcagggccatccacttgtacctgttgaggctgcagagaagaagacgcccccgtcactgtaggtagagaggtgggcagcttctgaatgctcagacttctcctcaccaccactgatgctcagcccactggctgatcgagactgctcccggctccggcgctgagcttgtgctgaaggaggtaagatccatcagagagcaggcagaaatgaaattttcctaggagtaatccctaatggtaattgaatctcagttggtttttgttcattataaaacagttttttgtagatttccatggattaaaccctcaaaactctataatagaaggtggtcctcattttccagtgagagttaatcacccaag

SEQ ID NO: 61978 - DNA, 3112 bp, Bovine  19866880647273
tttcttattgtacacagtctttgatgcctatatgccttgtctttgtcctcttgtcctggactgtaagctttttgagagcagagatagttgattgatcctcttctatgtatgcactgttccaaaaatgcccactgcttgctcccagccaagagggcagacaggtgatacactgtttttctgttttgttttgtttagctcatgtgactggaacagtctttatgatttacaaggtcaggctgaggatgcccaggggaggccacttctacagaggcctggccctcatcccgggtttctgccgggcagtctgcccagctctcactgctcacctcactctggagcttgtatgcatgaagggcccgatccagatccacggtttttgtggtcggagccactctgcctctgatgctgtgcacgtagtcatagtggtagacagcctggacgcagagagaagcagagtgagtggactgcactgtggccgcaggggtaaaagaaactaagtaaatgcaaatccaagtctcttaatataaagatggcagcctgctccctttgcctcagaactctatctcgaatactgggccttgtccaatggaatagggccagtgtgtggatcccacactgagaaagtggaagagtcagctcaggcatatgaagaggaagagtggatgttttaccaccatgagttccacaacaaaaggttttcacattctgactcactggtgggatttaatatttgcttattaacctgtggggttagtaaaaagggggcagcctgctctgtaccactgtgctactacacaggtgctttccatccattttcccgctgtccacataaggaagctgaggctcaggggattaagtgcctctctcaagtctatcggattacatgtgctagaggcctcatcagtaactgcagagaccctcttctctccatctgatcatgcatgcacatgtgctaagtcgtgtccaactctttgaatgctatggactgtctatgggattctccaggcaagaatactggagtgggttgccatgcccgcctccagggcatcttcccttaccaccgtgagcactaaatgaattagaaagctgagaccatgaggcaaggatacaaaaagcaacctgggaagctctaaaacaccaaggatttcataaactttgattatttacaacgccaccccaggaaatgaatagaacacatcaggttttaggaaatcagagaagaatcttcagtactttctaaggcaccgacaccggtctcccattgagaaacggcctggcctgccccgtctttggttctccccacttccgctggtgcggtggccctgttctcctctccctgaagtaacttctccgtgggcacttacatcgcttagttgtttcccgcttttgacagcctgaacgtagacaggagtgtcagtaaccagcttgtaattgttccttgttttcagcacgtgagctttgtacttgatctgtcaaaaggaagaaggaaaataagcctgtgttagaccattcattatatttgaaattgttggttttcacatagagcctggttgcttttagctcatggcatgcacatacattggccctgaatttcataacaatcagcataatcaatgcttatagtcacatggatcatctagagtcttctaggaggcttgacagctgccttcctagaaatatttaagctttcttactaaaatcttgattatagtattaccttgcctagcaaatcctctccttacaaatagatcctgtctatagcataacagactcctaataaatgagatgttttttataataggaattatgtgctcattaatatatccaaaatcgttcagaaggtggcgagaagaaccaggggtcccttctgcaccaggggaccatgggacagctcatctgcattgtctgcactcctgagaaatggcggctctgctcttcagcatcttcctccagttcggccatcctcagcaccacttcagacacagttgggtgtgacagtgtctgtacttgacgtcctctccccttgcctctagaccacacagggaaggaagcatacttgaaacaaccaaaaaccaaaaaacaaggtaaactcacatcgttgcgtagatcgtaagcatgcttggcgtggagaatctcaggagtgtcccagacgtagcaaccaatgcctttcagccaggtgaggtcatccttgtacacaatctgggggttgcaacagatggagggggtcggaacaagaaaacttgactgtaactttaacacgaaagacacagacacactctagacccaggatgactttgcggaatgaaaacaagacactatgccctgaggccatgggtgctcttcagacttcagcatgcagagccctgcttctagggacagctcaaattcccggtagacccctgggtgtacaggaaagtgattctggaagagggcggagctgaagaaccaagtgagtcagtctctcttggatgtggggcgtgtgtggggctggggaagaggaccttcataagcagtggacttacgtcactgatctggtctgtgaccttcctgacgtgactgttgacttgcaagtcggggtggcaaatccactcgtggaggtgaaggcggtagtcgatctcactgactttcttctgagaatccttagcggtaaccatctctaccatgtcaggcactatgtggattttcatcttgttcttctcataaacagatctgtacaggcgctgtggagataacgtaaccagttaaacagggaactatgcaagggtcatggcaacacgtgcctttcttagaccccacagaggtcaggggcatcacttagagcaaccggttgggggcaggatggggactggatgtttctgacactttctacagattcataggggtggggaaaggcagtatgggctgacacagctctcagcttcttcacatgtgcacagtcagtgccatgcacattgctgaaaagaatgatgttctgacttatagttggtggttctgttacttggcttttgaaaccagcctttaggatcacttacgtcgatgttaaacttgccaactcggaggcaccgtgctgtgttcggatcatcttcaacacttctgggtaaagtgtaaagag

SEQ ID NO: 61979 - DNA, 1987 bp, Bovine  19866880678541
tcccaagaagtgattgtgagaacctttatataattatttagagtacatatattttattgctttctaatttaaaaaatctgattttagcagttgtcatcaaaatctttctcagatgtatgacatttgcttgtttacaaaggcttatttatttaccatgagtagggataaaaataaaagagcttaaatatttcccaacactccttgaattcacaaatacacaaatttccatcagccagacatatcagaacccatctgacaaggagtactggaactctttgatatgtattctgtacaacctgtgctagacatcacaggtttcatttctgaaagattcagtagtttgtttgggaaaatgccactcagagaactgaaagagcatctgtctggatccagaattagtatcttactctccatatgtattgttactaggaattgtctcgaggaatgtagcagagtgtttttcaaaatgttctttttgtaatttagtaactgtttagtcttaaaatgagactttgagggtatggaaatgaagtgtgatagtaaatattctttcaacaaaatgaattatttacaagaattatcacaatgaattataacaagaaagtctatttcatgttatttcccctgctctttagaatatgaaggacatgttaggtattcttactccatgtatggtaaggtggctcagacagtaaagcatctgcctgcaatgcaggagacccacgttccatccctgggtcaggaagatatcctggagaaggaaatggcaaccaactccagtactcttgcctggaaaatcccatggacagaggagcctgataggttacagaccatggggtctcaaaaagtcagacacgactgagctacttcacttcacttactccatgtgatgaataagagcaattcccatcaccaaaggatacccacacaagttatgtacaagggatgcagcctggaatgctctaaacccaagaggaattttccaagctcacagaagcagtttcagtactagtcctcccctctttcccttagagagattcagagactcggggcagtgctactggggatgcaaggaccaaaaagaggtgacactccttccgaggtaagaactggaaagtatcctgaactacatctgctcccaagaaacagtccatgttcacagtaacactgtcttatgcttgcacatcatctttgtgagcacagcaatgcatccaacaaaccatgtctctaaggcaaggtgctagcttttcacaggagaggcagcagagtgttgagatcctggactctggagctagacttcctgggttccaatcttgggtctgtgttcattggctctgcaatttggggcacatagagttccctatgtgtcactgtacatgggagtcaaccagagaaatcacttacttcaagaggtagaaaacaggacagaggggcagtctagcaaagaaaacaaatagggacacgaccaaagtagtatgcaaaaagtgatgtgttaaaatagaactataaggcaaatacctatccccaagaaggtgggcattagggcatatttgcatctagaacactagggtgatggtaaaaccactctaaggtaacaaagcaaagtaagtgtcccagaagacacagggatggagtctgaaggaagacacaggaatatttataagtcccatatagactctactgtgcttctcatcttctgagttatctccaaaattttaaaatatacaagtaaataacttaaatactatattaatttatattacatactatatgtatatatatatatatatatatatatacacatatatatatatctcacacatcaacttactacatacacttgggtttagaactacaacaccaggtaagcttactctactaaacttcattagtcagtaagtccatattgacaaagatagatcaaaattgctagcatagtaatcatactggcaaagtatatattcttccccaaacatcatacaaatca

SEQ ID NO: 61980 - DNA, 2593 bp, Bovine  19866880708940
aatgtcaaacaattggggaaataatagcctaggatatattcataagattaaatgtaacatgattaaaaatgaaaaactagaaaagacataaaaaatattttccattatccgtgagggtaaatttttaatgatttttatcatcttcattatactttgtgtatttttcaggaataagcatcctttacttttaagtatcaactaaatatcattaatgctattcactatacagttttggctttctgccttccaagcatatgatgggattgaatatcctagttcctttacagtttgggtggagccatatatgtaactctagttcagttgtgaatggaaggaacatatttggaccaagaatttcactgtcagttcgagactcttcaaaactctttttctctggtattgcatccagcaataaagctggtggtcactgagtgcctaccatgggcattccttttgacccatcatggacatgtagcatgaacagtaagtgaatttttgtggttttaggtctctaaaacttagagataatttatcacattaacatcacatattctaacacaattaatacagaaattggcattcttgagtattgctgtatgtgtgtgtgcgcgtgtgtgtgtgtgcgcgtgcgcacacgctcagttgttcagtcatgtcctactctttgcagccccatggactgtagcccaacaggcttctctgtccatgggattttccaggcaaaaatactgtattgggttgacatttcctcctccaaaggatcttgtaggaaaacaaaaaagaaaaagataatccacaacacaatctaaaacacttggctttggctcagagtccaagcagcagatgattagaaaagagagattagaatggtagcatatattatgtagtgggaaaacatttggtaaaaccatcacacatgatagcttggaagacagataatgtacctattagcttgaagttctgtgtttttttttaaagacagtatgaaaaccagaattagtagcatatgtctcagtgagtttaacaaagtaatataagaaagaaatgagcttaaaaaagaattggccaggttgaaagcaagaaaaatggggagtaaagtccaaaactatgggaacttgcagagttggacgtacaatccttttcattcttaaataataaaactgaaaagacctttgagtaaaacaggctgattagatcttctgcaaggataaaatcaatgatcatatcaagatttaaatctgaacaaattaaggtccctcagagtaaaaatagcaattaaggttgtagaattcaataaacactttcaattagacaaactaattcagggaaaagaaactataagtggcctgatagactcaaatcaagtgaagacagggagagaagaagggagccaaaagagcagagaattacagctgtttcgcttcctgggtcagaaagtttccctgaagaagggataggctatacactccagtattcttggccttccctggtggctcagacagtaaagaatctgcctgcaatgagggagacctgagttccaatccctgggttgggaagatcccctggaggagggcatggcaacccactccaatattcttgcctggagaatccccatggacagagcgggtgtcaaagagtcggacacaactgagcacaactaaaaacagacatctaggaaaacaaaaccaaaaccaaagttatggctattagcatatgtaaactgactggactttagtctattttaatagagaaaaagcctattaagtttttttaaatataccagctaaccagccaccggcccaggtaaagaaactataactgttcaaaactttaagaaattggtaccaaacatttatcatagaaagtgtaccaagtgaggaagcttttcagcctccaagaaaaatatattatgaatgtccattctagatatggcccaggagaataatgaaaaaagaagaaggtccaggacctatgagaacaatgagcaagagacaaatttccagggagtcacagtcgcatcaaaaactccataggatttcacgatggctctggcccagtgacggctttgtgcctcccattctttccttttccaaatgcaagagagcagttatcttattctggtcctactactgtctatggggaggatgggggggtctctcagacttgatatagaaatttccacatatcaccaagagtttttgcaccttgagtttgatgttatgaatgggtgaaatttgaggattttttaccttggagatgggatgagtgtattttgtgtgtgaagaggagtgatccaaatatcgataaccagtaggacagcacagactacccttattcgtattctgggctcagctatttatctggttcttctcatttttataagacagaattttcttagtcaccttatgtttcagtgaggccatgtgacttcctggccagtgagatgtgagaggaaataacacaggtcactttcgggtcacagcatttaatttctggtgcaagactttccagacttcagcttcccaaccttgatgattctggaagcgtgcctcaagatggggcctgaagtgatcaggacagagtcccttaatct

SEQ ID NO: 61981 - DNA, 893 bp, Bovine  19866880760455
atatgtgataatactaatatcaacatcatagagatgttaaaaggattaaatgaagttataattgcatctattcaactatttttgactaaagaactcagcggtttcatatgaattgacctaatactttggagaaggcaatggcaccccactccagtactcttgcctggaaaatcccatggatggaggggcctagtaggctgcagaccatggggttgctaagagtcggacacgactaagcgaattcactttcacttttccctttcatgcatcggagaatgaaatggcaacccactccagtgttcttgcctggagaatcccaaggacgggggagcctggtgggccactgtctatggggtcgcacagagtcgaacacgactgaagcgacttagcagcagcagcaatactttgaagcactcataatagtgtctgacatatagtgattgctcagtaactgttagctattattttttttattaatcttgtccaccatactatatccctcctgacttgctcatatcttcaatgaaagggtctaaaatagccctgtctaatttccttaaagtgaattgaaatatataatgactgcccatgttgagccaattcacattaaggctaaaacaatattccaaaagcatttaatgaaaagtcctcttcatgcattattctcatatgtctttttatctcttttttcatacctgtagtacaaatacaaagaaggttaccgtaagcaactgggccaccacgtgggcttccgcacccttcaagatgaccccaaattggtgtggtctatccatgctgccaagattcagagtgacagagaatacaggaaagattatgagaagtctaaagggattcacaatacaccgctgacatgatgtccatcgttcaggcca

SEQ ID NO: 61982 - DNA, 1108 bp, Bovine  19866880761114
tagcagtttgaggcaacagcagtggtattgctcattgcgataaatgtatgctgctcctggaacatttcttggtgcacatttcaaggaacagtctcataaaataattagcaagaggaaaaagatctggaaaacattgctcactatagttagtcttttaagattaactatgcataattagcatagtaaaagttctctaatgtcttctaacaaagaaacctgtttaacccaatgtttccccaatttacctgaccttagagcccttttatcatgtaatatctattagaaacacctaacagatctgtgatcttcataagacttccttgggattgctgtactaatgtgaaaatgcaataaatacaatttaaaatttttttcagtgataaatgatatttttaacaacatggcaaattacttcaatcctctatcgatgaaaactttgggccttttgttaccacattttatgggaattataagatacagcagtatttatggatttgcagacccatgactatttcagactgcatgtcctgcaagtaaccagagactacacactttttaagtttaaatagttctttgccttttgcaagctagcaagccctgtctgtcttcagttctcaactttaaaaagttatgtagtaataactgttggatccttcactttcagtgacactgagaaagcaaatcatagttttgttcctcaatttagagccattacctgtactaatgatgtcttctggaagctcatctccacagtatctgaaagagaatttttaaaaaggagaggtcacatgaataattataatatagctcttgcaagtgactaactgataattgatgtactttaaatttctcctaagaggtgcgtgggtgcgtgtgtgctcagtcgtacctgactctttgcaaccccatggactataacccgccaggctcctctgtccatggaaattttccaggcaagaatactggagtgggatgccattgcctactccagttcctctaagtactggctctgctgctgctaagtcgcttcagtcgtgtccaactctgtgcgaccctgtagacggcagccccccaggctcccccgtccctgggattctccaggcaagaa

SEQ ID NO: 61983 - DNA, 1870 bp, Bovine  19866880782216
atattctttaaaataggcttttaatagctgcatagtgtttcttttgactagaaagagcatttattaacatttattttggagaaggcaatagcaccccactccagtactcttgcctggaaaatcccatggatggaggagcctggtaggctgcagtccatgggatcgcgaagagtcggacacgactgagcgacttcactttcccttttcactttcatgcattggagaaggaaatggcaacctactccagcgttcttgcctggagaatcccagggacgggggagcctggtgagctgccatctatggggctgcacagagttggacacgactgaagcgacttagcagcagcagcagcaacatttatttacagaaagcctgtagctggatgtttgcgcagtttctctttctctgggttagcttcttttcctgttgacacagagtgaacatccaatgaactggctgacagaagatactcatttcaattactcctgtcctaacaacctgaaatattttatcattttttgttacttttctgggtcatttttcaacatacttcctctgctggtttgcctaatacaacgagcctgttttctataaaagcaacaaccagaatcgtactttattattgattctatttgtatcttgaccctaaatttttcaatcttgctgaagagttcctgcctttttcctcctcacagaatgtttacaagtctgatctccagtggctgaggggcattggctgggtccctattgggtctgtggatgtggtcaagtgcaagagagctgcagagatactgagtgataacctctaccgtcagcctccagacacgctgaaattcaccagtgtgcctgattccctggagcaggtgctggccaagaacaacgccatcaacatgaacaaggtgagctccagctgcctcaagcttctccaagatgcaaaaagaggttctgagacattaatcactagtggagttaaaattgtccatgcaagtgtggggtctgtttaccacctaaatgacatacttgaaatcctctaagtaatttctattatcctcggttgtaaccctgataactatcattaagactcaaacctcagttgaatatatcttagtctgatttattttttcctaattaggtcaataacattcctgctttaattgactttttgtaattctgtttcaaatggtcttctataacatgttctttcttttctatcaacatattctttgatagcgcttatacacagaggcctgggacaaagacaagactcaaattcacataatgcctgatactccagagatcatgctggcaaggcagaacaaactcaactacagtgaggtaggggaaaatcttgtggggccatacttgtggttgtcattgtagttgttttctacacttacttttatgaagaatcttggatctcagctgtcctggagggtataactctgtgatatgaacactcagcccatccaacctttcatctgtagttgaatatcatatgctataggattccaggggaaaactgaagtcacgttatcttttccatttatggtctttactggtgtgagtcagtgcaactggagagtatttttggcatttccaaggggtagtatgaccaaatgtaatactgatatattatttatatgaaaacattatttgctgtttatctgaaattcaagttgagcttggcatgctatcttcctatttgttaaatctggcagcccaaccaagggggcctctaataatacatacccctttcccacctggatcctgagtggaattagaaggaaagcaaagcaatgaaactagaagtcaaaatctcacatcttttattactaaagttagtttcaagggcacgtttgtatagagccaa

SEQ ID NO: 61984 - DNA, 1126 bp, Bovine  19866880810417
tcatccacttgtaggaaaggcccaatgtatgtaaactaaagtaagtcactaatatgatctttctacataaaacacagtgtattaccatattcccaaatagtgggccttgaattttagagcagtggtctgttctccaagaatcccctgaggtaccagggaaggatgatggttttattctgcaaggtacaagccacaagccaggagctggttaagggtgcaagcttgggctagtctgtcttcttctcatagtcgtataagggtgaattgtaatgataaatgtcatatgcatttcttgagttaaaatgctatataaagccaggccatgattctcactgggagaacttaagtttatgagtcactctttccatcagcactgtgacaattttatataagtacctccaagcctgcagctatactctaacaaattccacatgaatggctctctctctgttcttggtggatcagctttcactgtagtactgtgtcttaacagttataaaaatttaataaacattcaatttttcatttccctcaaagctagattttagaaaaatcctatgcaaatacataaggctttgtttccaaaaggccaggaaagttcttttcaaagatttagttcagtgaaaatgtcccttcagactgaccacatacttgcagtaaaatcgacaactcacatcactgatgatgtccctggaggccttggctgccacaattgggatggcatcacttcgcaagtcgtagcctttcttctttgcttcttcatgggcgagtttgtacagattctaaatttgagccaaaaaaaaaaaaaaatcagttagatgttgacattcacacccaaatattaacagagaactaaaacaattcactaagttctacacaggtaggtgcctgtgatcatctcactgttgagagtcctatgctttgtgacttttttggcaaagttgagtcttaaaaatgatacggaacatggtacctttgtttttcatttttaaagttatgttacattaactgtatataggtattattcattgttttaaaattttgagttttaacaaggaatcagtttggaaagctgaaacaaatgggtctaggggcaagagggacaggaggaaaactattcaatcta

SEQ ID NO: 61985 - DNA, 3317 bp, Bovine  19866880811997
tctttgatagtttattctgtttgagcacaacctcgagaatctctctgcccccaagccggaagctatggaggattgcttaggttgccagtgtcgctcaggtgtggtaggaaggctggtatcatggtgatattggcagaaggggcaaattggactcatttaatatgtatgatggtttgcaccctgaatttaggatggtatgttttaaaatggagaaatgcatgggtgaacctatggttgatttgtgttggtgtttggtagaaaccaacatagtactgtaaagcaattatccttcaattaaaaataaataaatttaaaaaactgagaaatggagctgaaaacactcacaaatacagttgtcaaatattgaggttagaaaattttaacatgccaacaatgtgaatctccactagtgggtatcctgtacaccttagaaagtaaatcttaaataccaaaatgctgcaaattttacagagaattatgagaagagatgaataacttctatatgaggaaaaatctgcaaagccttgacaaaaccccaagtgccaaatgtgtttacgacgctctgtaagggaagggagaagcatgaagaaaacttataaaacagagacgggcaaacaaaggcttgctaacattcttactgccatcatcaatctttttctctagggctgatggtttgtatgtaagacatgtacattcatctacctacaacaaacggtgcagagcgtgggacagtgtatctctgtccatgggatacactgcttgccacgctgtgctggggaaaatgaactcctgatatttaggaaaaaacagattttgcttttttttggcaaagcaatggtatgattgccatttaagattcttagctactttatagacaaacaaaaagagttgattgctattggcagcttacagaagcagagaaagtattttttgaaaaaaaaaaaaacatatttggtgcgtaaatatgctaaagcagaggtaccaattgcaagtttgcaaacattgagaatggcttttaatacttatgctaggagatgtaaaagcactggagttcttaaagtttttattgtatgaaaaggaagaaatgagcagatttcgatatcaaccagtcaatggagaaaaccatacaatgctgggataatcaaatcggtgaaggactgtgaggaccttgaaaacataacaaaggctgaacctaagttcttgctggttatttctcacaaagtctcttccttttcctggaagggcatactgtctctccagttaacacatgaagttcacttcctttgtatggctgcacatcagccattgcagtggccagagaggaaataatgtttaaaaatttttaaattttattttgtgacactggtgggagctcgggaactatgttgaaaattaagtgctgggggagtcccaaaggaaatgcctctcttgattctgcttttggaaattgcagctgatcagtatgatgatgctgcattgccaatatgttttctggactctgtgtgacatgtatttcctcaaaaagatgaatgcttctaataaaaatgaaagaagaactggcacaaccagaatatcagccaaagtacattattagggagtcttcagagtctccagggtgaaaatgcatttaataataatttaacaaatatttattcaacacctactttattttagacactgtgcacacagtgacaaataagacagagaaggccatggctttattagagcttatattctagtggaggaagattgacaataaataagtaaatacttaagtaatttaaatgttgtgttaagtgttttattcctcttataagacagggaaagtatttttccctctaaccattctgttcttggctgagaccaccataataaaaaatagattaataagagaaaagcaaatagtttaataacttgtgtatctcacatatactcaggaaagacccagggaaattgagccccagccaccaatttaaataccatattcagctaaagataaaagagacctgttgagggacaaggggagtgggggcaggcagttatgggagatttccaagaaaagcactgtaaataagggtgaaaagtgaaagtgaagtcgctcagtcgtgtctgactctttgcaaccccatggactgtagcctaccaggctcctctgtccatgggattttccaggcaatagtcctggagtggattgccatttccttctccaggggatcttcccaacccaaggatcaaacccaggtctcgcgcattgtagacagacgctttactgtctgagccaccagggaagtcgaatgtttgtcatataaggtttaactgggcaccttctccactgacaagattatcttgtgatttagtcatccttgtattcctggtacagaggagactcttacaaatggatatttcctttataaatgtaactttcccttaaaaaaatttaacttctgtcttattttcagagcttctacgctgctctttctcaaaaattatcagctcaaaaataatctttatgccaaagagtcatgttctggaatgtcttactcttctctccttcacttagtgccttaaaacaggtgtttattttttccttgatttcaagggttaggaatgggggcgggtttggctggacaggcatttctgatccacatggtatcagccgggatgctgggcaatcctggcttctttttcttgctatgtggggtctcgtcattggacttagcatgagtgactccatctttgacccagtctgattactttaacagatttctcacaaagcagttgtcatactttttacatggtgtctgtctgccaaaaatcacaaggttagaatagttaagggtgatcctggcagtggtaaaatgtcatttttcatgtatttgattggtcaaatcaatatcagtgcccacctaaattcaagaaagggttgagaaataaataggtctcttagtaggtgagtggcaaagtcacatagaagaagagcaggtctacccatctgtggaaaatacaataggctatatgcttgaaggacatgaaccataggagggtgagagtggtgggaaagatggaaatgtttttagttagggtagtagccatgagaaagagagggagaagagcattccagttagagtgcagtaggttctagtttgagtaaacctctatagaaatggtcagtttacattcacataatgctccatcaacagtattgatactagaagttggcaagctgagacagaaattcaactagtcttattcatccaccttgtctggatatttgcttcattcagcacatccttagtcatttacattcttcctttctg

SEQ ID NO: 61986 - DNA, 1004 bp, Bovine  19866880857370
gagtagattttatgtaaatgagacatttgcattcatagtgactggaaaaatgagttctaaatcatggagcctacttggcacctcattttcttgtattgtagtgttgcactaatgcctgcagccaatgcacctgggtcgtcatgtttgactgagctgaagtcattaaacaaatatgtgaactgtctctttttagattaatgacatatgcatccactctttacgttttgggcaaataaaatttcctctgcagcaatgggtaatttgtaatttaggtgaaatctcaccatttaaaaaatctcaccatttaaatatacttcctttcccaaatagccagttcactagtatcagggacacatggggaaagttgctgatgctggtgtggcacgagctcttcttatcagcataaacagtgattaaatctgattcagtaaattatttgcttgatttgttgggatattttccttgccaggattgtcttctccactcttctctcatttataatactcataatagcaactatacttatgaacttgttctgtgctacacattgttctaagaccttgacatgttttaactaaatttaatctcaccatccttttaatatggcagatactatttaatccttctttcacaggtgcatatattagagctcagcaatgtaaagcaatgtgtttaaggccactagtgacagagctagaatttgaaggcaggcaatttgttccagagttcatactcttaaaatatatatatatatagaactatgctgcctctccattttgttcaatctcaaactttcttcaaggctcagtttattgtcacttcctcccattctgtctctcctgttcagtgcacctcccctccatcaattcctatagcattattttatttcattaattgttatttaaggaactctcctttatcattgttaattaactgattcatatgtatcagttatgtgtatcagtttatgtgtaccttctgtccgaagattgaactccatgtat

SEQ ID NO: 61987 - DNA, 3444 bp, Bovine  19866880871613
tttgggccatttctgagtcctcttctcacttatatgcaatctgctagcattaggcattccccctcagctcctggtgcatacctcaatcagacacaaccccaaattgtaactatttatccgtagacatagagtctgaggacctcaatgagacacaaccccaaattgtaactatttatctgtagacatagagtctgagaacgtttattcccctcattcctagcccaagctttcaatgtatgtttgttaaataaaaaagttaaagtgactgcatctgatagaaattttcaaagcttttcatgatataattttcaaagccctgagtgctatcaaagacccctatctctttgatcactaatattgcactttcattctgggtatcacttcttcctgcagagtttctaaacatctcctcacattagagtgactgcttgcccatgtgtgttacctggctgctcagcttggctgccttcttggccatttcaatgtcggggcgaccaagcatgctaagtccgtggctgccttccttgcggtgcttggctctgtactccacctgaatcgaagaaaaacaaaatggacaacgtgttccaggtggccggggccttgtacttactacttactcacggtgcatgggtggtctggcaacgtttaaaccatccacctacctcgctggcttgtttggcagcctgcgtggccttcttgatgtctggccgatcagccactgtggtgtaatggcaggttttctttcgcatcttttttgtaagcgaccttcatttggagaaagaaaacatttgctcatttgagaaacagactttctttctgaaaggaacctttctgattaaaaccaaatcaatcccaccaccatatattttaaaccactagatatagaaattagggtggccactctctgggcccagcccaccacgcaccagtgtgggaccccctggtgcaggtgggccccagagagtgagaagagggactcacgttactctgcttcttggccacgtccatggcgtgtttcacatctgggggctccagcatgatggagtagttggatttgcctttctccttgacaaacttcttcttgtaatttgtctgaaaagagccagaatttcttaggtggggaggggaagccaggaacagaattgttttacttgaagaactgtgagaagatcaaggaaaatccatggttcccattttggtgtcattttggaactggggtgtcttgtctgtattctagttcttctctgtcatttctgtcctggagcctaacattgggccacacaccaatctttcaagaatgatgacaagcaaagcaaactctttcattcatctttttaaaataaagggaaccttacatggctcataaatacaaattattaaatatatgatttattgtaaatacacgataaaataataaatacatgatcattaaagcattatccataaggatgtagtgggcagagatgtgggagatatgaagacgtgattttgattctctaaaattgttcagcagtttaaggagaagagagatgatgagaaagacagattttcactatcaaagcttcctccctttattaccactagggtagtgatatctttagtgccagagaagacatcctatggtaaaacccatatctgccacagttgccaaaactggaaagtcactagatattgagtctttattattactatttttggttgcatcgtgtggcatgcaggatcttagttccccgaccagggatcgaactctgcattgggagcacggagtcttagccactggaccaccaggaagttcctattgaactgtcttttaagccagtgttcaaagtccacatataggtactggctgtaagagaaagtgacgtaaaagaaagtctgtgtgagcaaaaacatgactttcagtcttttgctggatgctaaagtaaagtggcattgctgtggccaagagtcctggggctggtcacttacatcactgacgttcttggtcacttctttgacgtgaatagtgtcccgggtctctggcagcgtcgtgtaccgaaccctgcgccaagtgcttcttcacatacgacttgtacttgttctgggagagcacagagagcttgttacaacgccggcctggggcatcagcccaggacagaaggcgagcatatgggctgccgggggggtacctcggacaccaggctgctgactgtctttgccaggaggatctgtggcgtgtcaggtacggcatggcagcttcctctttccttgacgtgtttctctttgtatttcagctacaggggtgagaaaaaggcatttcttcagctcctctgagtctcctgcatattttttatcaagctcctgagttactaaatagagctggtaaagtagtgtcattgacatagaaacattaaactcagtgtaagatttgatatttagaaatcttgggaaataccaaaacaggattttctttatctcgtgcaagctggggctttagtaacaatcagaatgaacattatgatgaatctttatatacgcagctttacttcagagcactttgaaatgtcattggaccctcccccaagccctgggaggcattattagtccttctttccagctgaggaaacaggaagcataggaagagtatgaccccacgaaaatgaatatgttcccttatagagtccagccaggccctcagatccccagttctggctgggagggctggcacgtggagcctctgcatcaggcccggccacctgactgttacagcttcctgctgctgccaccctgctctgccaagtcactgctgtggactggggtcagcagccctccgcagtccacagggtgcccagggtgcccctggggactgggctgcagaagacagccctgtatgaggctaggcctctgggaggggaccgcatgcttacatcactttcgattatagaattcttcagggccagcaccatgtctttatcatccgtgacggaaagcttgcaacccttgaggtactctcggtccagcttgtattcaaactgtaacagaagaaagtcagaggaagctggaaaacggtgccaggcacaggagcaagatggtatctggttaaatttctagggagtcttcttcttgagggcactatgaggatttgctgccaggatgggggcaaaggtttcccggctgggtccactgcaagctgggctcctcctcgccagccccaaggccaggacaaagctttcctggtcctcccctgcctccctcaagagccattagtgtttgggctcagccatgtgagaccaagctgtgtggccaggtctacttcctgagcttgcctttcacacttcacaaccctcctgtccttcttggatctcaaatgagctagggagtgacagtggtaattatggataatgagggacgtttctgccctgggtacgtcatgcagttctgtctctcttatctcacatcgctctg

SEQ ID NO: 61988 - DNA, 2808 bp, Bovine  19866880876760
ggaatgatactctcaataagagggatatcaaaattttgcaaatatagtttttagaagcctccaaagtattatacctataaattgaacattaccaaagttctcttaaatgtatgctctatctacattcttaggtaagaagagggaaggtcagaggttcttcctgagtcttttgggccttgattgttttcagcttgaaataacacaaatgcctaaagaggtattttggggtggcaaattttactcctgtacattgggaataaattagtgagtgttaagtatattgtaaaaattaggccctagaaaaacacaaaaacaatatatttatcaactccaaggaaacaaaaaagtatagatgaaggaaaattatgaataataatgatgttctgaattctgagtaatagtagtaaaaagtcactctgtcatgtctgactctttgtgaccccacggactatacagactatggaattctccaggccagaatactggtgtgggtagccattcatttctctagggattttcctgacccaagaactgaaccagggtcttctgcattgcaagtggtttctttaccaattgagctatcagggaaggcccctgattctgaatagtgacttaaacttgtcataactgtattagaaaggcagaatagaggaagagagtatgcacatgtggtggagaaaggcagggtggtgaaagagaacaagatcctcatccttcaagtggaagtcaataattaataaataaaatttttaatccaaaaaaaaaatatatacaggtacactagctgcatatatgccataccagcctacactatttgtgtacttaggggtaaatgccagaagaataacctaaacatgctgaagtgattgtttctgggtagtagtaaacagtagaggagaacagttcatggaaaacattatgaaataatggtgtgtaatacacactgcacaataatgtgcaataaatattatggaaatgggacactttaagatatttacatgttgtagaagcagaattctaaggtggtctccaggatctcttctctccaatactacacactatggaatttcctcttttgagtgtggtcatgatgccaagcagggccctgtgtggctcccaggcatggaggccattttgcaccaaacttcttgtaggcaagtctccagccaccatgaccttctctcagtttcaaaaggcagaacaattggtaatcatacttccttacaattgtgctcatttcacatgctagtaaggtaatgttcaaaatccttcaagctaggtttcaacagtatgtgaaccaagaacctccagtcgtacaagctggatttagaaaaggcagaggaaccagagatcaaattgacaacatctgttggatcatagaaaaagcaagggaattccagaaaaacatctgcttaattgactatgctaaagcctttgactgtgtggatcacaacaaactatggaaaattctaaaagagatgggaataccagaccacctgacctgcctcttgagaaaactatatgcaggtcaggaagcaacagttggaaccggacatggaacaacggactggttccaaattgggaaaggagtataacaaggctgtatattgtcaccttctttgtgtaacttatatgcagaatacattgtgtgaaatgctgggctggataaatcacaagccggaatcaagattgccaggagaaatatcaacaatctcagatatgcagatgataccactctaatgacagaaagaaaagagaaactaaagaacctctgatgaaagtgaaagaggagagcaaaaaagctgtcttaaaactcaacattcaaaaaacaaagataatggcagttggtcccatcgtttcatggcaaatagatgaggaaaaagtagaaacagtgacagattttattttcttggcctccaaaatcactgatgatggtgactgcagtcatgaaattaaaagacacttgcttcttggaagaaaagctataaccaacgtagacagcatattaaaaagcagagacattactttgccaacaaaggtccgtctagtcaaaggcatggcttttccagtattcatttatggatgtgagagttggaccataaagaaagctaagtgccgaagaattgaagaattgatgcttttgaactgtggtgttagagaaaactcttgagagtcccttggactgcaagatcaaaccagtccatcctaaatgaaatcaatcctgaatattcattagaagaactgatgctgaaactgaagacccagtactttggtcacctgatgcaaagagctgaccattagaaaagatcctgatgctgggaaagattgaaggcaggaggagaagggtgacagaggacaagatggttggcatcactgattcaatggacatgggtttgagcaagctccaggagatggtgaaggacagggaagcctggtgtgctgcagtccatggggtcagaaagagtcggacaggactgggcgactacacaactgcaagataaagaaagaaaatattgtactctgtaacttgtgggtgttgtataggaacattgagctcagtctgcacagagatgcagttcccattaatgcattttaagagacaaaaggcatctatggggcatctctgaaaattcttccccttctaatttccaggcaaaggaatttttttgcagatggttttccttgagcattctttctttagggtgatggaaatccatagtcagttttctcattcaaagcagactttccccaaggccacacacaaagcaagcctgccagacctgaagactgccgccaaacaccttccag

SEQ ID NO: 61989 - DNA, 1583 bp, Bovine  19866880893151
tttaggatacctttggtggttgtacatatgcctttcagcaatgccaaacatggaattccaatcttttagaagatacaagtagtaacgtcagggtgacaagaaatgggaattatgaagacaaaaagttcagatgtctaacgataagcaaatatgatttttttaagtttttatttttaaatgccaatgcagtatttttattacaaattaatggaatggtataaatacttgaaacaaagatatgaaatcacccacaaaaagtagtggaatctctaagaatagtaaaatgtaacaagaacttttcgatttaaaacacttttaatgtgtttttaaatcaagttcatattattagcaagctaaaaacaagttgaaaccttgaagactttgctggttttgaaaatagtgaggcctgtatttctaacctcaggtgaatcctgtgatgcggagaatgacacctgagcaggtggtattatgagctccccttcttgggattacttcctgggaaaggcttcctcaggattgacagcttcctggtgtggccactggtccaggagagcccatctgtgtgggccccgcccattctgactttgctgtcttgctggcactctaggtggaatacatcaaaggccaaaggagagggcacgggcacggcgccgcatcttatgacacccctatgatgaggcagcttaagaaaactaatgtgctcatcagtgatgtaagaccagcaccagcaagcccgtatctctgtcttcctctttctcttgtctaccttcttagccttggtcaggggactgaccaagttgcactctttttctgttggtcttgtgttggaatgtgtagaatgctgtggaaatttgtcaggggatatacttttgcacacacccatcttttcctgcacgaaacattccccctggaacatacctccagagtaggaagggtagagtagttttgagatggtctactaacttctttaggctgctgacactgatcaaaggatgaagtaaaaatagactgggcatcttatctccaaccagagaaatagagtctccgctgatgactgtcgttggcatttaatacatttaagactggttatttactatggtcttgcagttcagacatactccaaatcaacagtataaactgctcaaaatgttttcggttgtagctttcaccctatgtcttatagtctcaatagcaagaaatgttctaattcttgaacctgctcttcagtctttagaagcgtcaatattattatcctgttcaagtctctgcaaagaagtagaactggatgttagatctttgtattcaattgaactttgaaaaaatcgattgaaaacttccttcccacactctctgagcccgctaggattatggacactgatgttgccatttgcaacatggcactgcgcagttgcatctcaggtttccctggtaaataagagaaagaaggcttttctattccacatcccgcatgaatgtgggtttactgtgaaagtgaaagtaaagttgttgctcagccgactctttgcgaccccatggactgtagcctaccacgcttctctgtccatggggattttccaggcaag

SEQ ID NO: 61990 - DNA, 1662 bp, Bovine  19866880910215
atgcatgagagcttctgtttggatgaggatggtaactacttagttttgctcatatgatggctggaaaaatttttctacagactagcttttggttccatacagttcaagacttgctttttcctctgttgcccacatacttctaagtgctgggtgctgtatggacaggcatattttaacatgacttctgggctgggcccctatagtttggctcagggggcaatacaagtgtttctggaagtcattcctagaatgggatagctaggaataacttaactatataaagaaacaactatgagctacgtaaatgtatcccattaacccaaattaaatgcttctcaactcaacttcctcttagctggatctgaaaaatgcctgttaaccacttaggtgcccactaggttcctctgtccatggaagtctccaggcaagaatattggagtgggctgctatgcccttcttcaggggactagggctgctgcctaacagaaatgcaagggggcgttggttgaacattcggtgactccaaatcactcattttttagcttgttttttcttcatggccttcatgggcccttcatgggcccttcacggccccttctgccttcatgttctttttcaaagaatttatgtatttctaagcagaaatctttcaaactgaagattgaacagaaaacccaagtgataaaatagatacatgtagacctaccttgatcaaagcaggggctggggcataaagcaccagctacttggcctcctctttcacttgtggtaagtctctgagtaagcttccagaagccctcagagttccctctgaacaaaactggaaaacactggtatagaacaatgattcctaggtaaagaattgtaaaatctgagttcttatttgcatttctactggtagacaatagcaaatcattaattgctctgagccttaatttttgcatttgtaaaaagttgacaataatatattgccttgttcagcctacatcaaagtgaggctatgagaatgaaataggtcataaatgtgaaaactcttagcctttctaataaaacgattctttagattattgacatcacaaaatcgaaatagtaacagcttgaaagagttatctctgatactctatgtccttgataatataccaagtatcaggtacgggccacccactccctgttcataatgacaaggacactgtgagaatgagtgtgacattttccaacatgtcctgggatgcaaaacccatggcagtgacataaaggatgatgactaagcatagcaagaaaggaatgtaaagtcacaatggcctgtaggctctcctggcactggcaaatttttgctggggttagcaaagtaagatgatattgtttatatggtatgatatgcagaaaagaaatgtttggaagtgacacattgatctcattttcatttagtgcccaagtgtatctgacttgtagaatccacactgtaaaatgacaggatataagaggatttaaatgaaagcagaagaaaatagggcagagaaaagtgaatacagagtatttggcctatttatcttgaaaaaaaaaaatggaagaaggaaggacatcaagtctgccatcaagtccatttggtacctaaatcattttagagaaatgaaatttcattcattcttaaagagacagaat

SEQ ID NO: 61991 - DNA, 682 bp, Bovine  19866880925379
ctactgggtataggcagtatagtttcttttatctccgaagaggtactcacatcactcctatttttggcatttgtctttgccagaactatgtccatggcgtcaggaatgctggtgaacttgtttctatctggaggctggcgatatttcttctcactgatgatttctgaagcccgtttgttcttttctgcctccaaagaacccaagggactccatcctatgcctttcagccactcaaggtcagacttatacaaattctgtgaaaatacaaagcatgccatcaaaattccatcctcatccggacccttgactcaaacaattatatgcattacaaaaaaaggtatgttttagacattcaataataatttgtctatgtagtttctgtctcttaatgattaaatgatcactcatatgagatatgaagtactatacacatatactatgagatttagtagaaactgacctcactttgtaggtcataagcttttttagcatggatcacatcattctgatcaggcagacatgtccacccatgcaggtagtttttgtagtccacatcactgaccaaggcctgacattttttggccagtaccactcccaacatgtccacggggctgctgaactttgttttccacttctcaaagtccttcttggattctctttcactctgcattttggctacatt

SEQ ID NO: 61992 - DNA, 1107 bp, Bovine  19866880980980
tttcatatccttaaaaaaaatctgttatttatttttgctacacttatctgacttaaagatctataagttgtagtcaaaagagtcttactgacattactaaaatacatgtactcctcctcattgacaagatctgatccccatgacaccctatgaaggagggaagatattttatggattaaaaaaatgagggactgaaggattaagaaatttgcctatagtcacacagaaagatatggccaaaagcagaactgaaactgttaagtggtatctttcttttacactgaacagcctctccaagcataaatttgattacctaaaacacccaaaggcttcatagtggcttcttgtaaagtagggtaggtagaactactaagcgaaacctgtgagaacaaattggaatttccaaggattatttagttattgctaatccattgaattaaacactatgcttgcactcggcagacagacatctccagggtctgtccttcttggtttctgcccctcctttgaaaaggtcaagtgcactaatggcttgccttcagtcttcatcagctaagcataaaaatcttactggaagaagagtccctgacctatcgaatagtgaacccaattgtactgttaatgtgtgtggaatccacaagttggccacaatgcttgctgaaccacagcccaggcacacgccttgacttttatggcacttgaataatgatgttgcactttaaagggtatgagggggttttaaaaattctggtcttataccaagttttttccacttcatgtaaaaggagtattttccatctatctacgtgaaagggtacaggaggaagcatagggaaagacaagggaaattcttcttgtctatgctttttctatcttgaaacatgacctactccttgagatgttggacatacttaaataaccccatcagaattcgcaattgccagaacttgctgtctactaaaagccagactttctcgataaaagagctgtctcgaaaaatgaatggaatctacaaagttactagtcattttcattaatctaagtctccagacaaaatttcaaaaacacttagataagcactgtaacaaaatcccatacagaaatttt

SEQ ID NO: 61993 - DNA, 1647 bp, Bovine  19866880988551
gaatttttatgcagatggttttcccttgagcattctttctttagggtgatggaaatccatagtcagttttctcattcaaagcagactttcccccaaggccacacacaaaagcaagcctgccagcctgaagactgccgccaaacacttactctccctacctccaagatgccttctctaagccaatttcatctgggggaaggaagagaacagtactagagtacaaaatctgcacaatagaaatagcacttacagctggctgagttattttgcatatgtgcatctgccccaaattaagaatacttgtgaatggaataccacaagtgtctttgaagttcattacagttgagagttatgcactaagggggtcttttccttgtttacatagcctgttatggtctcacagagacagagggaagtggagtaaccactctggtttacattataggatggttcgcagagatgaaaggattcagtgcactgagtcatgctgcctgtgttattatcaccagggcagatatctcatagagtaaatcaagttaatctgccagagccttgggttatgtatgtgggaattattatacaagataatttcacgttcctgggaaggttcaagtttgcagaggactgcatgacctctttgtctatttcaaatctatggtttttataaggtctctggcacattttctctctttttccttttgaaagagtttaattttgtctctacatttatttaatgaacacttttcttatatttagtataaaaaggatattatgaacctatatttaggaagatctcaacagaaaaggcaatcaccactgactaggagagaatgacaaaatcatatgtcaggcaagtcaagaaaatatggatttaaagatacttgaaatttaattgttttaaacagcatgcaggccaaacaaaatcgcatacaggtaacactttgtttaatgagtctatagatgtgagaaacatggaaccagagcagagggcctatggagacaaagtatgagataaatgtagatgaatccaaggaaattttgtaaccataactactgtagttgggtaatttggtttcatcattttttggtagtcattacaattgagttgggaactccatttgtaatgcatacatttttaaagacctttgtagggaattccctggcagactagtggttaggacttggcattttcactgcagggggtccaagttcaatccctggttaggaatcctataagttgcacactgcagccaccaaaaaaaaaaaaaaatttgtagagatgaccctctgagttctatgttcttttcagtccgatatcatccttaaaaccttccacaatagtccgaatcttctatcctttaaatatgtctacagctttctactaaacccctcaatgaccaatttcatctgagaaaatagaaaatttctataatttagtagaaagtcttctcctcttgaaaggatagcagaagaattccttcaagcttccagatatgttctccccagcctggaaagctgccttaaatatagtgtgtatttaccctaagcattttgcaaaagttaacaaagtcttcttagaacatctttctgtcttaatttttttttccaccaagctacccacaaaggcaggttaaaatttataagcat

SEQ ID NO: 61994 - DNA, 1227 bp, Bovine  19866881014255
attggggaaaaaagaaatatttcagaaggggaaagatttttataagaggcttttaatataaatgggcaattatataaaaatactgacttttatacttagatactgtgttggagatacattatattatatttgatgtaaatttagtaaatgatatgcatgtaaaaacttaaaatatatgaatgttacttccttaaagacatgaatagtctggcaaaatagatttttgagaaatggattcatgacttttatgcttacagaggttttattgttcataatgcattgtggttttttttttctttttgggtgaagaatgaatcattttcatttggcaatgactctgaatatttttgcaagagtgattgtactttttaaatcatttgtgacgctcaactgaataaagggtggtgataaaaataaaaattagaaccatgattcttctttttctagaagaagaagacaatagtataaattatgaagactgagttttgctgtaagtgatacatagaaggagagttctcaagcagatagaaagtttgaacatggaagaaaatactttactgtgtttaagatgtttatattgaatagctgtgaggtacaaaatcttctcagcaaaattcaccttaaatgtcacactcagcatgagaaaatctaggattagtaggccagaagcttatacaattttggaaactttaagaaatagtagaagattaaaaaatacataatgagaaccaaagatggtatttatttggaatgagaagagaaattttaaaaaattataaaataaaaaaacagaaataccacaagtatagctatatccagaaaaaacttcatattttaaattataactgcctgacacatctttataatacaattttatttacattttagctgattagtttctgattgctttttcatgtgaaatgattttgtaatattttctgtgtaggggatgtgaagataatccagtgtttcttttaacatggttgattaaaatttgcttgatagtttgatagctgggatgcttaagtattgatactgttgtttagttgctaacccgtgtttgactctttgcaaacccatggactggagcccaccaggctcttctgtccctgggattcccagggaagaatactggagtgggttgccatttctttctccaggggatcttcctgagccagggatccagctcgagtctcctgcattggcaggtggactgtttactgctaa

SEQ ID NO: 61995 - DNA, 1172 bp, Bovine  19866881016906
catggaccacatcatcttggggtcatccttaatgtttctggctccaatgtggtggccaagctgcatgcgaaaaccttccttgtacttgtactaaaggaggggaaaaaaaaaacacatatcttcgtcttttgaagattaacttatgttactacctttgtggtgaattacaaagcacagtaactccaaatattttcataaggctagatagccacagatttaagtgcttttttttttttttgataggaaaaattaaaggctaaatccggctacagattccatacataataaatatacccttgagtttatcctcgtcccatgctgcgtccctgggatcatttcactatttttaatttgtcacttggaagagtctattcaatttaaaattaaactgagacttttttgaagtgaaaattgcaatctaatcagtacaaacaagggataaagtcttacttcactggcaatttcccgggatgctttagctgctttgattggtatggcatcaacaggaagatcgtaaccttttttcctcaactcctcataacccattcggtagaatttctgttaagaaatgaaaatcactttgaaaaaaactgtttcccattaacatctgcagcataatgaatccaatgtgctaaatattttaagagttcttgagaatagcttctgagctctagaatactcaaatgtactagaaattgtgcccattgattgctaataatcttgttttaaactctaaagctcttcaattacttagaccaacaaagttaaatgtcagctgttcccaaatatttatgagaatgagacagaataaattggtagataaatgaaatatcatcaaggtgctgttttccaattaactttgactctttcactagaagtttttgttagaaatgagcaatgtctttgccatctcaacactagagtctatttcaccatatagggctgtccaaaagtaggatccacatttttaggcaagaaacaaagcacttcatagtttttacaatgtaagattttttttttttaggaaagtttaaatatcaaattttaaaagtttaagtgaaataatttctttcttcagatttgttacataattaaatgagaatagaatttaagtgcacttcatttagaaaccagagttgtttaaagtacctagttgaccttggacttgtttt

SEQ ID NO: 61996 - DNA, 598 bp, Bovine  19866881033220
ttctgtgttcttctgtttaaatgtctttcaaaatctgtttctaatgtgaatattttgtggattcccaagaaataccaaaattttaaaatttcccatagaattcaagcattgaaatgtataatgtagtattttataatataatataaaacaaaattttatatctttaggggactatcattatacttctgtttaatggtctatcacttaaaatttcagaatttgtacaagtccgaccttcagtggctcagaggcattggctggttacctagtggttctcttgaggatgagaagaacaagagagcttcccagattttgagtgaccacgtttaccgtcagcacccagatcaattcaagttttccagccttatggactccatcccgatggttttggcaaaaaacaatgctattaccatgaaccatgtaagtcctttccttaacttgaggtggctgttaatttttgtatgtgtgtgtaaacactgaaatctgtttctataaaagaaaaattacattcggttcttttgcttggccttaaagtggtttttaagtgggcttccctggtagctcagatggtagagaatctgcctgcaatgcatgagtc

SEQ ID NO: 61997 - DNA, 1268 bp, Bovine  19866881043126
ttttgtatagatactggtggatgtgaacagaaagaaagaagatttgtttctccaaactacttctggacagcctgctcaaataactccctcatattacccatttgggggcactgtttttctttaaattcatactacaagttttatacttgatactttggtttgccttctacgtctacattcatgaaaacattgtgaacacctcaaaggcaagaactgtgcttctgggctgtcctccagtataggattgtccaccgtttcccaaacttcagtcattgtgtgccattcccacatgttctgccataaaattttgtgacaatactacttgtacttcatattttactttgtcaacttgatttcttgtctacataaatatatatcttaaagtttaaacttatttacactttttattttaaaatttataatcctatctaagtgggcaaaatcagtgtttttctagcacacattaaaacaaatgtaactttttaaaaatgcttgtccatgtactacataaatttatcccaggaaccacctaggcatgctgcacttcaagaaacaatagaattctctgtgcccactggatctctgtaagtgtttatacattaactgatactgataagatattgaaaagaaaatccagatctgtgcttaaatatatgaagtgtggaaataagcagagaagtaagtcatcaaattgttgtcaaagttgttcttgaatttggaattttaaagcaagacactagtaacaacgcccttcattctactcaaatataattcctggggaattatgttaaagattagtacagttttatctctctgactgtctgtgaattagtgtttgttaaggccgagcaaagaggagctctcacatcactggcaatgtccctggaagccttggcatgctgaatcccaatggcatctgctttcaggtcatagccagtcatcttgacatcttcccaagcttgctgatattgtttctgcaaatggagattgcaatgacacagttaatctgaagagggggctactgactactgaactactacagtagttcagtacaatagttcaatacaggctactgaacactgtattcagtgttcaagaatacacgttaacagttacactgaaaaactgaccttcccttaagatttataaaatagactggtttcatactgaacttaaattctagtacattttaatgacatttagtaaaattctcttcccggatctttttttttttttttaagaagagaatttaaaagacaacaaatcat

SEQ ID NO: 61998 - DNA, 773 bp, Bovine  19866881068283
gaggcttgtctactcaaaactatacccatagcctccccctcacttccccagctttgtcacaatatctaaattattctatgagtcacttttggtggtgtggggggcatcaagacacaatgttacacaaatgttacatgatgttaagcactaaaagtctttgacaactaagcatgggttagcaatttcaagaggatggagacaaatgggccacaggaaaaggttgtttaatggaggagagaaggtgagggaggaagcagagctgagtgctgcctgggaggagaggtataggaagaaacaatcgaatttcacaacccccctggatttgtcagtgatggtgggtgatgcgaagtcatgaggaagatggagctagggcaggaagcaagtcagtatcatatggaactggggcctctaccatgtatttatgagagtttatgtcttatgtgtttttattactacatttacatcttggttcccagaaatgtaaatagagataaagaggctgaagtgttttttttccttcttcttttttttttttaagcatcagaagttaactgtttggcaaatgattatttggtatgcacttaatagcaccatagtgtccaattcagcccatttgaatgaatagtatttccccaggagaactttattcactctggcttgatggcattaggaaataattttagcttctaggcaatatatacttctttccctcctcactccatctcatttattgctgtaaatactaaggcaaggatttaagcacagaacccggg

SEQ ID NO: 61999 - DNA, 2185 bp, Bovine  19866881089033
tctaacctgctgctcacgtatttttgatatggtcattgggaactaaggacgccatcaggatcacagtcaatgttattcattcaaaggcaagagaaacaaagctatgatttttggtttatgcaaaccacaaattctaacatgcctaatcatacaatggaaaaatagcgagtaatattcagctgtgaattagcacaatgacattctacctacaagattatcaaagcattctttaaaagtaaaataaagcagaaaaaaaagttcctctttgtcaaactttacatttacccatgaacctccacattgagattatttgtggtttcaatacatatacacaataaggtatttcatattgcatcatcatgttttctcaaacatctaaacaaaataccatatctgtcaagaattaatcctaacttcaccaactccaacaaatttttaaagatatatcacacttaattcaaaataaatgtcaatattttctttgcggggggggttaattacacaattaacatttccatcagtatgaatgccttttattttaccttgttttgtttttttaagcatttagtccactggcttgatcctgaagccatgaatgaagccaaaaaccctgcctcatggctttagttactgctgaaaatgcaactgtattttctgtttcacaaaatctgtcacatggttgaacacatgccaccaaactgccatgacttagcactgcactgtggcatgctcttctcattcattaaactgacttcccattgtcttaaggaaagagcatagacattaaagacaaatgttatatttctataagtagacgtttttaaaccttctgctgtttacagccaagattcagattcttggctctggggtccagactactctcacataaacttgtttcagaacatgtgctctacatttgtttcctaggatgcaaatggcttgggcatgtgctgactaaaattcttcacaccaaggggatttaggtagattcctatagtttggcaaacattctgctatgatatttgggtaaagatcataaagtaatgtttttatcatcttcctgacacctaaccattggacagcttttcagattgtttccagccaattttattaaaatactgaatcaagcttcacactagaatgaatgtgtataatattgagctcagacaatatcttttggatacatcaaggataaatttccacatccacttaaatatattaattgatgaggatgagctttctgcctaaaagaactctgatgcaagagggcagagccacacatatagtcaaaatcgatgagtgataggcttcccttcagggatgctgtatgtgaggaaacttggagggaaaaagcaataatattgctttctgttaacatcccagctacttctttccaaactgctttctctcggcaggtttgtgtcagaaatccaagagaaatgaaaaatgattagttgccaaaattaatttttctgatactgttcagggggccatgaaaataaaaccatgtcttcattgcccaaatattagaatttaaagaactatcagccagaatcacaataaaatgaaacttgtttggaaagtgtattacaattccttttaaaaggaccaactgctcacctttggctgacttaaaatgaaattccatggagcagtgaccaagatggcagagtgggaagaccctaagctcacctcctcccatgggcagaccaaaattacagttgtttacaaagcagttattgatgagaacaacctgaagactagaagatcttctacaagtaaaaatataaaggaacgtaaaatgagtagtagaggcagacacacagcatcgtcaagacccataccaccaggtagcccacacacagaaaaaggaggataattacaattgcagagcttctctccaaagagcaagggatctgagccccacatcaggctcccaagcccaggggtcctgctcctggaagatgagcccacagaacatctggcattgaagtccagtggggcttaatttggggaaagccagtgggctgttggaaacagagactccactcctgaaggacacatacaaaatctcgcacactccagcccctggggcagaagcagtaatgtgaaaggagcctgggtcagacccacttgctgaacttgcagagcctcctggagaggaaggaagcaactgggactcaca

SEQ ID NO: 62000 - DNA, 893 bp, Bovine  19866881101487
ttttgagtttatttttgtatatgaagggaatgctctaaatctcactcctttcacatggttaaaatgaaagcaaaagatataaacacctttctctttcatcatgaaaaactaatatttcaagctatgttgaacattcttaccactctcaagggattcattaagcattttaaaatatagtgtatatataatttgtgatagtgtatgtttacctctctatgctaagaattttaactggaagatgatagatggcctaaaggcaatatttagggaatccatgaattctctgaaaggtaaaggtgtgaaaaacctccattttttctgaagagataatccaaatattttatcagattctcaaatgtaactataattaatggtatatttttccttagatctaggtcaatactaattactaaagtcaataaagagcaaggttcactatactaagatttttatctctgactcatgatttttctttcaaaattaggccactttttgaaacttaattttagaagttactcttccattagaaaatatgaaaatatcttaatgttttccaaatgatgctaaaaattatactcaatattctactaaatatgagcacataagtctttcaaagtgaaatggtaatcaagtacaaataatttctctcctgaaacatgagaggcacaaaaacttggggaatcattctacttttaaagttctgctcagcagtttgttgttatgaacctgatgcaatccttttacatctctatccttggccatattacctgggacacaatactaaaaataagacagattgagaaaagcactcacatcactctggtttttggctgtcttcaatgagtgcagcatcttggggtcatcattaatactgagagctccaatcatcttcc

SEQ ID NO: 62001 - DNA, 3386 bp, Bovine  19866881164577
ttagtacttgcttcaaatttgttcgtgagtttcctttagtctctcatcagtaaaatgaaataaaaatggctattgaaaaatttttatgatggctagatagggtagtatgtgtagtatgtcctgggtggagcctggcacataataactgcttaataaactaatttcttccctttacattcaagtcaccatgaaaattagttttatttaatctatgcttaaaatagcctgtttatttgatttatgctaaaaataaccacatttacaagaactgaaataattcttaaattcatccatctcaaaactgtaagagaacaataaaaaaacattttttaacctactgtctccagccccactaaatatctttgcagccccacatatctttgcagaataggaaacagtttcttacccaattgttctcatcaaggtcaagaattacctggttcattcaagatgaatgttgatttcttacatgcttctgtgtatcttcattcaaaaaaaaaaaaagagggtggagttgcctttaatttgagaacattggaaattttaagtactcattttcaagtcctgaccacattcattattttactcctgttaattacttttgcctatcatgtagccctgaagaagaggcacatcaaatataaatgaagaggactcagtttccttttgtctagcactataaaaaggcccaaggacaagcctgatcataagtatttgactgatcttggcttcagtcaattttgaatgaacaatttttctcttggccacagagcttctctgttggattagcttttcccagatgttctgcctcaccctagacagatgctgttagtttctatgccaaagggtaatgatgcttttaagcctctcccttttattaaaattaggtcagatgaagtaggatttctttcttttttttttcagactgctgagaggaaattaggctatttttttttacttctcaaattttcagctggatttatttcttttaaattgcataattatgttaattccctaaagactgtctttgaagattagattttagaatggcccatgtgaatttcttctcaacccattaccaatgataccttcacgtcatacttagtaaacaaaataaaaaagcaaccatatcttcttttttttgtcttaaactcacatttacctgttctagttctcttggaatgtttgaacttactagacattctttaaaacgtagacttgatgacactaaaagtgttttccttgaagcctggcctctttttccattgttgaaagaataaaatgtttggcctgaagccacaaaatgattcaagcacattttttcccacttatacataagggcaaacttgagaatttatcgttcaaaggaaaaatataaagtataagagtatttgactctctagttacaaaataaacatttctagaaatttttaagaacaaatgccctcccttgggattttatctcaaatacattaaatttattcttgtctactttagcttttccttataaaaagttgcaacataagagaatgtgaattgtcacacattaataatccacattaaaaacattcaattacatccttctcaaactctaaaagttattttaaaattattactaattaagaattaaattcttgtaatggttcacaagttaaaaaagactaaatactacaggtagagatgacttaatgcagtggttctcaagctgcgttcccattggaatacctatgttctaacttctgtgtatgtctgtcttgccacagaaactgaatagtgggtattttgccaattcataaagaaattattataatttcatcagttttgtccttttgactcataaatccctggttcctgctacccctctgtctgctagcaattgccagcaatcaacaaaatgaatagagagcaaatagtgttaacaaagatattcagaaacagtggatgatccttagcttagcactgttggaatacaggtacatgctcatggcagtaatgttgttattatatcatattctctgctggtaaaattgatcctaattcaaacttgcagttaaataaacagacatttttggtaatttcatgaaaagaacaaatgctgagcaaattcaagcacatttcagagttaataatgagtacaatttgaaggagttaaacctgctaaaagtaaaacttcaagttcaacaaataacttgcacactgtgtaagtaagaagtaaaagaaagaggtcttgtaaaaaatttttttttaatttaaaggctgaacatactagtttttgttctgtatccaaaagtagtcttcctttcatcacagtcttcctttgatggaaatattaacatatttttagaatgaaagtgggcactgtgtctaaaagttactacttctttcctcagaacctctatcgccaggccatggaagaagccaagaaagaaggatatgacttaagaagtgacgccattcctatcgtggctgccaaggcctcccgggagattgcaagtgacgtaagagctgatcacatgcttccatctgttaccaacagcccagccacctgcatagggcatcacactcttggaacacagctgagagtctctgtagtcatcatccacccacctgccttcattgcatagtcaaataaattgaggctttgagacagtcagtcacctgtccaagtttcatagagatacactgggttgtggttcctttgatgctcttttggtccttgcttagtaggactgagtaccttgagcaaagttaagtgggcatatgttgagctactcataaattctcatgagctctcctcaggctacactcaaggcaaagatgccaggaaagaaacaggtttaactgagttcttccccttgacttgagaatggacataaaatagcaaaaatgttaaatatttctttgctgtggggtccacaaaaatcaatattcctttaccctaaaaatgaatatgtgaggttcctgtacaacttaaatattaatccaagagtagcaaaattgtccattttggtaggtttttcttttaaatcataataaaattgaataaccatttaccactttcagtatatagtccataagtatatttacactgttgtacaacagactttcaaaactttttcatcttgcaaaactgaaacgctatgctcattaccaacaagaattgcccattttaaaactactccttgccaattattatgcagaatgccttaaaagaagaaaagtaatgacccattataaacacatccctccaatatgttctcagttcggtctgcccacatgactgacttctgagaaactgctgtcactgtaactgaagttcattctttcaatgttcacttttctatcacattttttttgtggttaaaacatatgatttgctggcataa

SEQ ID NO: 62002 - DNA, 1774 bp, Bovine  19866881184349
aagaagtgttgtgtactatagttacagttttaattttttttttaagacacttgtgggctgctttaaaaaattcacctgtgtttcctcctgcagctgaaatacaaagaagtttaccagagaactaagtccaactgtaccattgagccagatgctgttcatatcaaagcagccaaggatgcctacaaagtcaacaccaatgtaagtccccaaacctaacaggggttcatcagcttctgcaggacacatgggctctttgggcatcacttcaggcagttgtgttctagtgactccagatcaagggctgggccctggagcatgagtgataacgctgacctctaaatggttctcaccagggaaaggtgggaaaaaacaagggtggcccatggatattgtacccactcagccgctgtgccaggagactgagaaatgggagtttaattctgaaatgaaggttacatttttgaaagtgtctccagtctttttgttcttctcctgcctcaaaccctggagcctccttcttctgaaaaaagagaactcttgagctgcttgatgctgtcaggacttgacctagaccttcctcctgctcacatctctctgtgccgattcttctttgtgtgtgatggggcatcttaaagcctcaaccacagggacttttttgtgcatttagataagtattgacttcttcaaaatgtatgtggttatataatgaaaggttataaaatccaagctgtgaccactagtgccacagagaattgtatttattagggcaaacaaactgaaaatgctttaggggctgacagggagcttacaggtgtcctgagaatggaccgagagataagtagcagcatagatttgggacaaagcaaatgcagtaaaatgtacattgtagaatctaggtgctgggtatatggatattctctgtaagattcatgcaacttttttttttttttttgcaactcttcatatgcttgaacattttcacaatggaaaaaacttgatcaaaattaatacatgaaagcatgtgtatcttattgtacacaaatgataccttgaccaagaaaaaggggagacaaagagagtgaagacacgtggctggtcgtgagggcaagggcactcacatgaaactacatacattctcttcctcagattcagcctgaggtggccagttctccagctcaaatgcaagcctagcaagtacacatgccctctgaagccaggctgcctgggtttgaaccccagctccactgctcactagctgtctcacctggacagcttgcttaggccctctagacagttcctcagctgctgatttcatgaagttgtgatgaagattaaatgagttaatatttataaagcactttgagaagtgcctggcagaaaataaaaagtatttaataatttttttaaagttgtctgaatttagttagaagttaaaagtacttgactcaaaataattaaactgccctggcagagttagtttgaaaaatcatttcatctggaacctttaaaaattattagcttctattttgaggccaacgggtcccataggatgacaaaactagttgcataagttgtatagaaattttaattggggctctcttcttgcataaagaaccatgatttgttaaaatgcaagctgagtccctctgtgctgcgtgtggtggttgtgaattcaggccacttaatgaactgacctgtttctatcttgttaaaaacagctggactacaagaagaagtatgaagccaccaaagcctactggaaatggacccctga

SEQ ID NO: 62003 - DNA, 2396 bp, Bovine  19866881184825
aaccaaataaatatttgatgaatcaacgtactgatggatgaatgctgtcatcactgttgccattgctagagccacccctaggagtttcagtgggagggggagaaacagggaaggcttagcctctgtgagcccagctggtcattttttcaccttgagcctggaatttctagcgtcacccatttttgctccttttaaatttcagggccctggggccttatctcggccttctcactaattattgcagaaggatcttaggtcttaacatggttaaatctgaaataaaaactgtccaaaagaagccacagtagcacttactaaatttgcctgatcatgtgaatcacagttttctgtactttttcataaatgtagcaaatcaatagctttagggttcaggcctggacatccatatttttcatcagttcgggttattgttataatcagaaagcttaaggaaatggatgcagaattgcttttttttttttccagtgagagagaatgggctgctccacataagggatctaacttatagatgtttatgaatacccgatgctcatgtttgaagtgccaaaacttattttatatgaaaaatataataaataattttcaatgatttatacatttctgccttcataaacagtgcacggatatatttaacatttttctaggcaactcagagtcaatagtgtgaacccatttgtttatctaccaaagaactcctgagcaccagcctcagtcaaggctttggggtagggattccacagttgcttttagtattctttatgatgcccataaagccatggagttctttaaaatattaatctatttgttacccaaaatgcaaggagatcaaaccagtcaatcctaaaggaaatcaaccctgaattttcattggaaggactgatgctaaagctgaagctccaatactttggccacctgatatgaagagctgactcactggaaaagaccccgatgctgggagattgatggcaggaggaaaagagggggacagaggatgacatagttggacggcatcaccaactcactggacatgaatttgggcaaactccatgagacagtgaagcatagggaagcctggcatgctgcagtccagcaaagaattggacacaactcagtgactgaacaaccaccaccaaaatgatgagttttccaccacagaatctagctatgtatatcaaaatatatggatataatttctactcagagtattaagatttaatggctaccttgttcctcttagctgagatgaagcttatagaggatttattaatagagtttatggcccactgcatttttcaaatggtctcaacaatatcctcctccgctacatgcttttctgcaatgtgaccttcccatttgttcacccagaggaggcctatgtctcttcaccccttgaatctaggtgtgcatactgtgcccagcaacataatgcaacagtgactctgtgtcagttctagaagtagcccttaatgggtctgggtcttctaccccagcctcttaggacacgtccaccacgctgtgagacaaccaaaccacaaaggccacgtatagaggttcctgtctgtacctgagtgccctgagtagctgagtgcccagccaagccatgatcaggcgccagcgctgggagcaaacaattcgtggttgttgcagctctcctgggctgcagctgtctgctagcacacgtaatagagcattgactcagctatgcccagtctgctcacagaatgctgagccaaaaaggatgactgctgtctcaaactgctacaatttagattgattgttacacaggtatagataattggtcctgggtttgttaaatcacactagaaagaggccaaggtgagaggggctgcaaagccaccccagtacttacatcactgacttcatctttgaccttccggacatgcagcaacatgggcgtgtcgtgaattgtggtgtagcctctgggtttcgctttgttgtattccaacttatacagtatctgaaagagatgtcaaggcagaaagagccaactttatgcatctcaatttatcttggaatatatgtaaaaatataaagggaacatggttgctattgtcattgagtatatacaaaggagagagagtcccataaactcatcaggttttcatgctttctgcaaacgctcccgtgcttctacaatgtggtgtctgctaatttggctgggatgattctttactctaaaagaagagtcctgagcagagtaggacattcagtgtccctacctccctcccactaaatggcagtagaatcttccaaacagataaccatctaaaatgcccttccacatttgcaaatacccccaaggtcaagaaaccactcagagctccctgtacttacatcactgatttgtttgttga

SEQ ID NO: 62004 - DNA, 2296 bp, Bovine  19866881192915
gtgttggtggatctatggatgtttattctcacagtcaatgaaaatgttgtagaagaacacttaataatataaaattttgttcacaatatattaagtaagagagcatgttacaaagtgatatgaggcatgattccatttttgtaagaaaaaataaaggacatgcacaaagaaatataattttaagaaatgtaatgaagggtttattgaccatcctgaagtggtgagatgcaagtaatttttatgttattttttcttatcagaagtttcaattttcccccaataactatgtttttccttttgtaataaggaaaaaagtacatagagtaatttaatgtgaatctgtgagccaccagaattggctaaaagctgtctagcagcctacaccaagacatgaacattttcaggtccctgtttcactgtgcccataaaagaaaaacaaatccaattgcctggggagaaacacagctctttccagaactaagacctatgaaaaatttattttgtgggtttctttaaggggtcatgggtggtataagagacaatgtatttatttcacagcatcctgagagaaaatacagtcctgagttttatagggctctttttcatattgttttacaacatatgttgatgagagatagttaatgcacatccagaaaaaacagatttatctaggagaccaatatgatgccatccaattacatagttaatttatcaggcttaatctggtgaagatttttcaatagctaaaggaatagatagattgcatattcttcagtcttctactgaggaacaaaaattcaaggttattatccctggcaagtaacaggggtttgcaatttgatctcatctgttaccttgtgtagcttatcctttgtctgttggctgagcaaaataatctggcaaaagggacacctgtcacctcttaatgaaagttaggagccagacaaggagacctgcctgactggagactctgggcaaagcatggtcaggataatccacagaatataaatcttgaaccactttagctcatgctcaaataggcagataaatcaggctcaaatattttcttgtaggacactgacacgatacatgtggcccatgtggttttataagcaagcacgacaaaatacctcatttgttaagactaaacagaaccaaataataacagctatgttaagaatccacagaacactgacttgagtgatataggtttcttagtgtatagatcaggacaaaatgattgtatatctggtttaaaagaaatgtgtgcttaggtaactgagtgagttgaattacttaattatgattcaattaggtaagagaggacatttacctaaaagagttacttttttcagaatgacttctttatggttcttctttttgatattaattagttgctatggtagccattaaaatgattcccagttctttactgtgttatctgcagtgaagaggacacattctctctgagacctcctagtaattgtggagtatttgctgtaaccattagggagattatcatgtggtatattttccatctctctgtttctgccactcaaaaacatgtttatattatactgggaattctgtgctttgttctgaccgaaaagataaactcctgatgtagtaggctttacactgtttcccatgtcccagtcaggtttacacaaaggcagaagtacagggcttgctaattttgcccctggtcaaaggaatgtacggagaagaatatggcgtctttttttggcagcaggttttcttgcatagattctctatagggctgtcctcactgcataccagctaagtactgtgattgtgcttcttgcaaaaataaaaatgcttgccctgttgattgattgaactatggactactgcaacgcttggaaattcaatgaatttcttcatggcaattatggttacagtgcttaagtgttaccaggtgtattaaaaatccagatgttggatgaggcagtctggcatagggcagtcagaggccccttgatcatctgaggagttacatattttctgccagtttcacttaaaattttattgatgaaaagggggagagctggtaagatatgcatttgagttagaatttggcaaatcatacttgtttaaaatatatagatataagcctcctatcgtatacttcttgtgactggtctggattactgcaccaggcttctaatcggtctctctgttttctaccttgttctctctctttttaaaacaatgtccttttttccccataatttcatttatttctagttgccctgggtctttgttgctgcacgga

SEQ ID NO: 62005 - DNA, 1622 bp, Bovine  19866881197341
tcaaggatggagcttggctgtagaactatgatatagtagaaatccctagatttcagagacaatcccaaggtcaaacccagctcctctatgtctaagctgagtgatcttcagaaaggtatataaggcctcacacttgtcatttttttgaggggggaggataatcatacccaattcaagttttttaaaaaactttatgcttgtctctttcttttagctgaggtgaaattggtatttaactttattgagtatttttttgtagagatcaaccataacatatgtatagtgcctgagtcatggaaggaactcaacaaattttatgatgtttcctattgttattttcacagtgggtgctctgttgatgagtatggtatagaataagctttctggagttttaataccccaaactttgcagtttgctatctgagagccaatttcgtactctgcactgagcacacaatttcattgccctgatatttggaagacattcaggcaggtgtgggagaactcagaaaagttcaattcaacttcaaatgttcatattaagggcctacctactggatgaagaaattagccgaatatcaataagcagactgccagaattctggaggaaagcagcaattatctattttgtgtaataaaactgaaggcagcagtaacagctcactttccaaagtgggatttccacaagcaactaatttgagatgtgcaccgacactgccatgcacagtgtttctcagacttctgagcaaaatgtgaacagctgtatgttttttacatgatggataaagagacaccaatggcttgagtcagctctgctgaggagaacgtgcagacaaaagtattgcatttgtggacgtctccaggtcactgctcagaagaatgtgtgctttacccccagagaacttgttttaggctgtgcttccccatgcacacagaaatgtggggtcagggttaagaagagcatgcaggtccagctaggattcgagctttattgaaggcctgcataagaatcaggcccatcacctacctctcccttctctggaaaccctccaggacatttctcactttatgagcccaggatgaggaaggtatgactcaggcaactggccacagctgaagactcaccttgctcacgttcagggcattattctttgctaggacaatctctggggtgtctgtaatgcttgtgaacttgagctggactgcaggctggcggtacttcctttcactcaggatttctccggctctcttcgcatgctcgacccccacagagtcaatgggcacccacccaatgcctcttagccactcaagatcagccttgtaaatagcctgaaaacgaaataatgtcaaatatttgtagaaattacctccacaacctgatgtttcatgatttagcatagacagatggcgtgtaattttgcatctcacttgtgtaaatttctgaaaagacacagtactgttttactttgatgcagaacatctagttcaacactttgtccctgaaggtagtcaattcctactgttttaaagacctatgaaatctctaataatacgtgatttcattgatacaaaaccactttaagaaaatttctgcctgcctcccaatacaaagtgtttattct

SEQ ID NO: 62006 - DNA, 1857 bp, Bovine  19866881205280
ctgctgatggacatctaggttgcttccgtgtcctggctattataaacagtgctgcgatgaacattggggtacacgtgtctctttcccttctggtttcctcagtgtgtatgcccagcagtgggattgctggatcataaggcagttctatttccagtttttgaaggaatctccacactgttctccatagtggctgtactagtttgcattcccaccaacagtgtaagagggttcccttttctccacaccctctccagcattcattatttgtagacttttggatggcagccattctgactggtgtgaaatggtacctcatagtggttttgatttgcatttctctgctaatgagtgatgttgagcatcttttcatgtgtttgttagccatctgtatgtcttctttggagaaatgtctatttagttctttggcccatttctttaaaaacataaacacgactgagtgactgaacagaactaaactgaatttaaaatcaaaccatattagactagtacaaggtagtaccatttatatacattttaagtgaaagggcttccctgatagctcagttggtaaagaatccacctgcaatgcaggagaccccagttcaatttctgagtcagaagatcggctggaaaagagataggctacccactccagtgttcttgggcttcctttgtgactcaactggtaaagaatccacctgcaatgctaagtacttaataaatttccaaacaatactttaaatgtggttaaaaaaaatttttttaacttacatgggaatgatttccataaatttcaggatcaataaaaatatagtggggctttttagcttagttctctcagtcttatttatttaaaaacaaatgatctgaaaaaattatgtgaaatatgcttcaagtcctcatggtaaacttatgatgtataaacctgataatataaacctgttatattattttttgaacacttgaattacttcataataaaaaccataagatataattacatgtcagaataaatccataaactacattttgagataccaacaaattgaaaagctatgctttttcaggagcaatttgttttcaaacatttcatcagaccttttaaacagcttctgaatttaccttaacactcacgtgtaagtgagagctaaacatttgattcaagtaagtattattcttcagttaataatccaaatcctggaagcctcactcatagattagatgctagaattgccaaaggagcctttaaactttccaaatatataaaacactcttgactgaccttaatgacattagaagagtcaaacttcgacagagtatttaatatttaattataccaggtatcatgctggacccttattttggaatgcttatgttggcaataaagaccatctctatcagtgggattaggagaactggatacactggctgatttacaaaccagttttgcaattgcttttacaaatgctagttttacaaatgtccttccccaacttcaataaacacaatgaactcagagctgtaattagaacctggccttttatcttttcgtgggaactattaattattcttatttttcatgaaacaactttccaaagaaaaagaattaaggaaaaaatatattgtctcacagaaagattgataatccctaaaaagtctgtagctgtatttaagtcaaaggtcagttcagatggaaatttcaacttattttccaatttcttctcttttaaaaagccatgtgacttaaagctattcctttgatacagcaagaaaatggaaggtctcaaatgatgagagtagatgataataatcataattatgataaaagcaccatcaaggtactctccaggaagatat

SEQ ID NO: 62007 - DNA, 803 bp, Bovine  19866881255087
aaaagaaaatggactaattgatctgttgtaagataaagtgtaaagaggatttttgcattgactatgaggtaagatcaaggacctctaattagcttccaacttccctgactttattctaattctataaataataaagtgctgtctattagcagtgtttcagcaccaaaaatacattgccaaactcatctcatcataatgccactaattatttacatcttggcctccttgaggttaaggtcatccttttactcatcttgatacccctgtcatgaagcacaaggtttacttaataaatactgtggattagtggcataggaaaaccaaagtatcacattggccaaaaatttcattcgggtttttccataccatcttacagaaaaaccacagagaactttttggccaatctactagtatgacctgtactcctctagtaataaagtttaccctttttctttccttcactgactgccaccacaatcattacccactaaatttatacccagtctcttacattgaattcttgtcctaaagaatttaacatgcctgtggaacccctgcacatactattaaggagtcatatggaatctgctttagattttgaaagaacttttgatgcccccaatattttcaccacaaaaaaaaaattttttttttaaagactttaatcttttgcttgctgctgaggaggagacactgtggtgaaacagaaagacattagactggggattggatattaataatagcccttaatttactctgaatccaactccctttctctgcccgggcttcgtgtctccatctgt

SEQ ID NO: 62008 - DNA, 742 bp, Bovine  19866881267795
acactttgttcctattcaacaacaaaagagtctagctattatttgtttagaacctgtaagagaaaacatagctaagtactctatttagttttattttttggataaaattaaaattctcatcagaaaattatctagactttttgagactcattcagtgtaatatggctcaaaaaaaccatataatctggtaggagggcctgatagtattttctgtcatgtatgttttattgtttaaagtgttatggtttgggtttttctgttaaaaaagtttccagtaataagtgggatatttgaatcctgtaatttgtttttagaatatttatttggtatagcttattttagaatttataaaattaaatgatgcgaaactaatgctgtataagttggagacaccaaatctatttgctgttactgtattagacaatggctttgttttctttgacatgatctagtagatttgaatactcaaatttgatataaatattacactgtaattaccaatgtgaaaaggataaatatttgcacataatgaaattgttttatttttataaaaacagacagaaaattcccaattaaatatgaagataagtggcatggaaagaaaatcaagtggaaaaagagattcttttttggcacaaacaaaggatacaaaagacagtatgaaaccaccagctaaagtatgtttttccaaagtgtatttaatagtactcttaatattaatatatataccagcttgagaaca

SEQ ID NO: 62009 - DNA, 782 bp, Bovine  19866881270524
cgaaaatagaagttttgggttgctttaattcttctattctcttttttcagtaggagagatactttatagtgatattcacagatgtgttaggctccattccataagaatgctaatggtgttgtcttaacaaactgacttggatgggactggagtaaccccatgcacgaaggatgcctgctgctttagttgttactgtagacctctccataatgcatacagttatgagttgataaggagactgtataatgaacaggggagcagcctgggtaaaccaagctatatagcaaaataggcaaatagttttgcataaaaattatgcatccattttgagcttgtatctaaaatgcatagaagactggcttttagtaatatttgaaaacagctgtactggttctgttctgcccctggggtccttttatgactatccctgcaggaaaacttcaataataagggagaaaatgaaaatatttgcattttgaattaagttttgccatcattttgtctgtctcgcttctttatccttactcatatgcatttttttttctttttttgcaaacatcaaagccagaattgattagaacaagaattctgtggtcacacaacacatgctaaatcaacacttttgtctgggagttggacatttatctttccaagccaggcaaacacctaattgtctccacattgtgagaagtgtaaaggccatcatgacgatggggcagaaagtttacccaattcaatttatttaacacctcataacactctggagttttcttcactgccca

SEQ ID NO: 62010 - DNA, 887 bp, Bovine  19866881334093
caaatacttgaaggttatggggtagcagtttccctggagctgtctaacaggaaggcattagtgtctctgagtatgatatgtgtcaatttggggagcctgtggactagttcagtgggcagggaaatcctcatttccttgaaactccaggagcctgtgcctttgtgtgggcaaaaagtacattgtagacgttttgttgtgattctggtggcggcagaaggagactgaaaggggaagactaggagctggagccgcttggtgccctacccttatgctcttcaagcctgctgctggacagaagggaaatgtcctgaatttcacaactttctctccctaacctccaccactttttactcaggttttgactccagaaaccatcatttgcagacagcaaaactgaaaagatggctccctaagtcttcacaggaatttctaatagtggaatattaagagcttgtctaatccactgcttttcaaatacactagataagtgaaaactggcctggcattagaagacacacagctcaaggccgctttgattatgtatataaagagactgaacatactgtcagttgagtttttcccttttaattaggtaaagtttcccagcatttgagattatgtgtgggttagttatctttgtcccttgagttaaatcagcaccatagatatgtgtacatgtgactgacgaggtggggtgagtgatgtggcaggtgagaggacagaaatgaatctgttcaaatagctctactgggaaatcagtgcaaagcactgtttcctgaatgaaggtcatctttattgaacataaaaacccaagttcaaatccattttgttgaaaaagacaacaatataaaaatattaaaaatgaacagccccagtatgtgtatgta

SEQ ID NO: 62011 - DNA, 1081 bp, Bovine  19866881368497
ctgcaatgattttggagccccaaaaataaagtctgtcactgtttccattgtttccccatctatttgccatgaagtgatgggaccagatgccatgatcttagttttctgaatgttgagctttaagccaacttttttcactctcactttcatcaagaggctcattaccattttttaacatttgcttaaagtagcttaatgataagctcctcatttatccccaaataattaattagcagtaaggataagagggcttccctggtggctcaatggtaaagaatccacctgccagtgcgggagacacgggttaattcctggtccagcaagatcccacatgctgcagagcagccaagcccatgtgccacaatgactgagcctgagcccgagcccaggaactgcagctattgaagcccgtgtgccctagagtctgtgctccacaagagaagacactgccatgaaaagcccattactctgcatggatgcagataatccaagcaatagtagatttagatgtttagccttaaaattataatcacaagtaccctgtgctccataaaataaataggcaataattgaaagaagatctcagaagtgacttttttcttaagctgccatcatgtacagtgtgctttatgattcatagtataactactgtgagtctgtccactgatttgcagttcttataagcaaacttgtgttttccctcaacagaaactctaccagaaagactgggatgaggccaagcagaaaggctatgacttgagagcagatgccattgaaatcaagcatgccaaagcctccagagaaattgccagcgaggtacagctccttctagttccttgtgggttttctactctatacaacaaattgggaaaggatttttcaagaattttgctttggtttgatttgcttttaaattcgtgtgctaaaaactctattttaaaatattaaaatggggtgaaaaacactaaggtgaacataggtgaagtctatgtgtaaatcgcttctaagttgtttataagtagaagtgaaatatcatgaagaatctgtacgaaattactcagggaacatttaggagccagta

SEQ ID NO: 62012 - DNA, 1191 bp, Bovine  19866881432487
taaaacaaattttcaatgttttcatgtttgaagaactactttagttaacacattgaatatgtttatattctgttcatgaccatttcctgagtgtcaattgagtgtattgcaatataattaattacagagctaccaaaatatttgcatagtttaaaaaaataaaacaaaaaaatgtttcactgcaaagtatcaacttgctacattaaattattttaacaacagccagaacaaacacattttcaaagcaggacaattttaaatacagagttgataacatttcaggttatcattataagttctcctagacagttggcatgcatgtgtgctaagttgcttcagtcacatctgactctttgtgaccctatggactgtagcttaccagctcctctgtccatgggattctccaggcaagaatactggagtgaattgccatgccctcctccaagggatcttcctgacccaagaacccaagtctcttgtgtctcctgcattggcagcaggttctttaccactagcaccacttgggaggccccccagacagtttacttactggcaaataagctctcaaagacagagcttttgaatagtgaggaaaacattggatttcagaccacattcagccttgacattcttgaggaccccaaattccttggagtgcaaatagcttggcttcaaaaagaatgagaaagctgaacatacttgccagggacatcaacatacttgccagacatcaaggacaacaggagacctgctgggaaggtggtctctcttacctgcctctatccttacttcagaaaagaagacaagtatcttgcagacacagcttactgagcaggatcactctccgaaacactggaggagaagctgcttctcctggtacattgactcctgcagcagctgggccaggagaacaggcatttccatgagcctcatggcttagacagtaaaaaagccacctgcaaagcagaagacctgggttcaatctctgggttggggaagatccccttggaggagggcatggcaacccactccagtattcttgcctggagcatccgcatagacagaggaacctggtgggctacggtccatggggtcacaaagagtcattgtgaccggttttcagtgtcttctgcaggtttacagaatccagaaaactgacccattctttactcctggagaccctgtgtatga

SEQ ID NO: 62013 - DNA, 815 bp, Bovine  19866881471136
tttaaggtagtaggtttgcttagctcccaaaatcatgtaatatatcattacatgtactctgtgtgtgtatgtgtgtttttcaattttcaaacttctctcacatgtattgccattgaggactgaagaaaatttccatttatacaattccaagcatcactgagtggtcttacattcttatgggtatggtcccacaatgtgacagggacagtacaggattattttggaaaggatagcaattgaaactgtaattgctgatggggaatgactgcatgttagctggtgtatttttgtttagtttcttaggaaatgtgctgaatgtcaggataagatcttggaatacctcattgaagatgtctgccatatgcttggcatgattgacagaaacagaatcagctggcatccacccaatcccacgtaaccattccaagtcagccttgtaaatagcctgtgaaaataagaccaggaagaagtcagtaagtctggtcacatttgttctattcattggtctgatggagaaatgcaatttaagaatgacatactcaagcaccagacaagtaacttaagtaaattaatgatgcggcagcataataaactggggcccatgtttgctatttaaaggggtttagccttaatttcggagaaggcaatggcaaccaactccagtactctcgcctggaaaatcccaaggatggaggagcctggtaggctgcagtccattgggttgctaagagttggacacgactgagcaacttcactttcacttttcctttcatgcattgggagaaggaaatggcaacctacttccagtgttcttg

SEQ ID NO: 62014 - DNA, 733 bp, Bovine  19866881488829
attttatataagaataatatatcttcccgtatcaataattgtgaagtggaaagtggtcttgtttcatttgcaatcaataaacagccaattattggagaagaaagtgctctaaagtatatagatggcaaacaacaggctattatggatctcttttcttcagctatagaaagttataattaggtttaaataggtaaatatggtagatttaacagacgcattactattctctccctcccaaaagcccactgtgtgtgctgtgctgtgcttagtcgctcagtcacgtccaactctttgtgaccccatggactacagcctgtcaggctcctctttccatggggattctccaggcaaaaatactggaatgggttgatatgccctcctccaggggaatctacccaacccagggattgaaccctggtcttctgcattgcaggtggattctttaaaacttcagttcagttcagtcactcagtgtgaactgattcatgcgaccccatgaatcacagcacaccagacctcccagtccatcaccaactcccagagttcacccagactcacgtccatcgagttagtgatgccatccagccatttcatcctctgccgtccccttctcctcctgcccccaatccctcccagcatcacagtcttttccaatgagtcatgtcttcgtatgaggtggccaaagtattgcagtttcagctttagcatcattccctccaaagaaatcccaggg

SEQ ID NO: 62015 - DNA, 1275 bp, Bovine  19866881507201
acgaaaagggttggtaattggtatgcagagagcagttctgtgttatctgcctttccctgggtctgagctataaatcagttatcactaacttgcccatgagcaagcgaaggggaagatgacagacaagatgctttggagacccatggcccaggctccataagcagctttgtgaagtaagatgaaacaaacctcctctccctcttctttcaatgtcacttccaggcattccagcggttcaccctcctgtctcaagctcatgcccaagcccaaacacactctgggctagtgatctttgcccagggaagtcctaaatgatttggctatggcttggtctttcatcctaactctcactgcacttccaaatcaggttactaagttctcctgagggttatacaatctacgactcagttaataggggcactatgtgcccaagaggactcctaatggaaaatgcatccatatggaaatgcaatccgaagcatcgaggaacacagaccacgcattatgataaccttagttcattcagtaaatcagcaaaagtgtatgtcacagtaaattaaaaatgactaaacactagccttttttgcccattttgaataatattctttaatgaccttaaatgaaacagaaaattaaaaatctgtgagatgaagagaaaggcaaattgaaatacttattcaaatgtggtatgaaggcagcaagaagttaataatcatttctatatttagtgcactgatggaaaaaatgagttgttacaagttctttataatattacaatgtgaatgctatttttaaggttatttttcattcaaaggcagaatccaagagataaataagaaaggtaatatatagaaaagaaatgactcagtgtgtgggccaggtgagaacttggtacatatgtaagatacttaaatttttccagatttgactattgcaatgatgtcttacttaggggttagcagtcttagataccagtccataaatgaagggagggctgtaaatgctacacatagttttacaaaggaaatttgatttgaaagtcacaattcctaaagaaaacgtcaacaggtttgaacttaaaacctaccagaatgaactttcctatatccaaactgagccactgaaatgaaaacactaagaaatcatcacactgttcttttggctaagaggccactttggtattgtaaatgttttcatatacttgtacagtcctgttgatagcttatggtgaacagtgtcaaattcatgatatccgaagaagatttagcttcagga

SEQ ID NO: 62016 - DNA, 1129 bp, Bovine  19866881524657
aactataggggttaaatattaaagcagaatttagtgattccattcacttgcattagcaaatacttgtgcagcagcatttgcctgtgaaaatacactcttatgagatacatactattcatttaaaaatgcacgactgtttgtacattatgtatagattaagtctttaatttataaatttcagtcttcgttagttgcatgagtttttctgtagcctcttgtgaatacctttgtttaatagaaacataattttgtatatattgaatactgagatatcagtatggataatagacgtgcttcatgggattgctgcagatatttgtaggattctgtatctacaaataaaacaacaaaaagttttgtacttagttaatagttaaacatgagtttattttctaaagtaagcagaacaaatacgagaaatgagaaagtgttacatgacaaccttgctgttcatttccataaccttttttttccccccttttggtttgaaagaggggattagccaccagaaatagtgcctcgttacatttctctttaatggggagttagcttgagtattttcattataacttggatcataagaaacctagagcttatctgctctccacctatacctaaagcaaacttgggagaaatctgaaaactgttctttaaaatatgtatgttttattcagtttaaaaaaatagggtgtatgtaattaaaacatttctaattttaccaactggtattagtgcctgcctttcccatatttgtttcatctttttaacatatatctcacttgttttctaaatagaatgagtaatctcagttttagacttaattcagaagtaacccctacttgaaaaagcacacattcattaacaacttatgggaaagtttaatccttgtgtcttggttagctttatattcagaaggggactgccacccagtcacgataaaagttggtttcattttcatgatccattatcattacattgtaaatattttggggtctaagtttggtatttatatgctgaggatggttttaaaagaaaatctgggaccattgaacctgaaggattgtagctttgaatttaaacacttataattttggtttaatttgtcatttattccccaagttctatgtga

SEQ ID NO: 62017 - DNA, 1171 bp, Bovine  19866881562303
attatttgcagaaggaattcctataggaactttataatgcacatccatacttgctaccttggatcactgtcttagtgcttatgtgattacagggaaatataatgggtttagaattttcctaagggtactgggccagaatttttctgttaaggtaattggtgagcaaacatgatgaagctgggctttgacctaattagcatcctctccaaccattccagaaaaccagccaatgaaagttccttctgaggcccagtcaggacatctggtttatgagaacactgtacataaagaccaaggttactttcatggctcagtttcataaatttttctcctttgaggtcttgtagctgctgaaatctgaagcttcttttaaattgtaaccaaaattaaacttagtatgaacaaaaacctttggggttctcagtggagcttatttattgtccaaactagaatagtcaggttgaaaaatcaataactattcatttaaagatgactttagaaaagtcaagtgtacagccctatttacgaagtagtcattttatataatcagaagtatgaagggcttgtcatataatttttgataatttaaaaaatacttctttagtggaaaactcttcaacggttattaccttgatagaaataatgcttattagtggtccttgaaaaaccctattttaaaataaaataatagctgcctgaagcagaaactgtggcccattcataatgtctgacagttcctctttaacctaaaaaaagagatttgagaaaatctgaccatgtatgatttgaggggggaggtgttcaataagtgaaacatatcaaattttaagaaaaaatcactaactagatgtctgggtctatatctctaacgtgtatttattgcttaatagagatctctgcttttctgcaaatccattgaaggtttgtattaataattggtaatttcttgttcacagcatgaatatcgtaaagactatgaaaagtcaaaaactatctacacagcacctctcgacatgctcccactcactcatgctaagaaatctcaggcaattgccagcgatgtggactataagcacctcttacacaattatagctacccgcccgacagcgttaatgtggaccttgccaagaaggcttatgcactgcagagcgatgtgagtaaccagatttt

SEQ ID NO: 62018 - DNA, 1044 bp, Bovine  19866881602701
aattctcctgcaagaatactgatttccttctgcaggggatctttccgactcaaggattaaacctagatttcctgcattgcaggcagattctttactgcttgagcaaccagggaagccccttgagagtactctgaaaagcaaggagatcaaactactcaattctaaaggaaattaaccctgaatattcattggaaggactaatgctgaagctgaaattccaatactttggccacctgatacaaacagcagactcattggaaacgaccctgatgctgggaaagattgagggcaggagaaacaaggggcaacagaagatgagatggatggatggtatcaacaacacaatggacatgacttggagcaaacttggggagaagtgaaggacatggaaggctggcgtgctgcagtctttggggttgcaaagagtcagacatgacttagccactaaacaacaacttcaaaatttgatattcttacaattaagcttacaattctatatttagttaccttttaagaatataaaatcaagtcttagatgcctatttcccagattttccatgaaaccatttccctgatctttcaagaccttaataaagggattcagtttaggaacatttggtgcatttcaagatagcccgacacactatgaaatatggccatgtacaatctttttgacatttaaaatacagtacaatataccagtatcttagttctaaactcaaaattatgtttgctgcatgaaatctaaatgtaagtacagaaaactcaattcaagataaaagtactacaaacctctttgttttgagtacttctttctggtgttcagttagtattctttcctttgtttcttttacttctggaggtataaacacaaagtcagtagacttttcttcttccaaaggcatttcaccctttgcttttggagttgaagaatctagtttcaactggaaattaaaacagtaaatgcacattttgagtttctaaattattttccaatacatcaatcaatctctctttggcactctgataatggtttttgatgat

SEQ ID NO: 62019 - DNA, 791 bp, Bovine  19866881653371
acactcatacatatctgttctatgaactgatgacttgaagatatgtataaaatacataatgtatataaaatgcataacttcttgttatctttgtttctcgagttcttgtggccctgaaatttctattaaatatacactgaattattttcctgatgacattttttattttccttgctagcgtctgtacacagaagcctgggacaaagacaagacccaggtccacatcatgccagacacaccagaaattacgttggcaagaacgaacaaagtcaactacagtgaggtgggaacagatgctaattctatgacatttgcatggcgtttcatatttcaattaatctgttcatggtgatgtaatataaataaccaatttgtaaagaatgccattttttgctccatgtgagaaccaaatactcgtgcatttctcaatttccatcctaagcatcaatcttgaagtagcacaaattaccatttaggcagtgtaaattttaagaactgataattaaagcagtaaccagaagattaactagactctcttcttttattaatttaagttaggaaattggcaatataccaaaatacatttatctcttccttatcaggagacatgagagatgcaggtttgatccctgggtcaggaagattccctggaggagggcatggcaacccactccaatattcttgcctggagagtctcatggacagaggagcctggtgggctacagtccatggagtcgcaaagaatcaggcacgactgaagcgacttagcacatagcacatatgttacatag

SEQ ID NO: 62020 - DNA, 1899 bp, Bovine  19866881692019
ctatacaaaactgcttacgagaaacagaaaggtcattacattgggtgtcgcaatgccaaggaagaccctaaactggtctgggcggcaaatgtgttgaagatgcagaatgacaggctgtacaaaaaggcatacaatgaccacaaggccaggatcaccatcccggtggacatggtgtccatcaacgctgccaaagaaggccaggcgttagcaagcgatgtggactatcgccagtacctacaccagtggtcttgctttcctgaccagaacgatgtgatccaagccaggaaagcctatgacctgcagagtgatgtaagttgttgctgtggtgcctgggggtgggggggtggtgactattccccaggaagccagccttctaccgctttgcccggtcactccttccagtgttcaggaatgctttccctgcctgagcactcccctgggatattttactaagtttgttaatcacaagtcttacttctgggcttattcagaaagttttcatcttcattgttagtgctactaccagaatttttctatagattttgttaatgtattcattgtttgtagcttattaaatattggtgtcatcgtgtttcttcagttgaagaatgacaggggctgtctttttaaaagattagcagcatgctctaagctcactcatttcccttaactttttattcttcacaacattatgtttcattagtttgcccaaagtatttttagatttacttatattttctaaccattcgatcttttgaaaatgatgaattctattaggatatttgtttcttgtatagaatgaatttcttcttttaattggagaaggcaatggcaccccactccagcatcaggatatttgtttcttgtatagaatgaattctttcttttaattatctgaacttcccttaagcttcaggagatattttaatataatagatgagtttgttatagaagaggtatacccatcatttgaaacaattgccatttggtgaatttagtccagtttctagataaatgcagtctcttcattaacctgaatcacactggtgtattaaagaatgcatatcaatcaagttcttaatgataaagggaaaaaaattaaaaaaaaaaagaatgataaagggaagcttcaaaacctatgtacatcctcttcaagaatccttctagattttgtgtatctgtcatacttcacacactaaaacatataaccttcttcactaaggtagaaatttccctgcattttgactcctcttactccttattttagcttgatatttgtatcctattaatattgatatactatttctgaagaacacaacggtttttttttaatgaaattcataactggtgtttcacataaagcaattttatctggttaactacttacatattcctgagaaaacatgtggagatagccgaggaaatgcaaatcccagttcaaaaggaagtgctgtcctgaaaaagaaaacccaagtgggattgaaattgtgcaactagggactgagttcttaattatccctttaaaaatatttattaaacctaccatgtaccatgtcttgtgctgaacactaaaggcacaatggtgaataaagaagaacaagacaaagttcctgactgaaggaagttcacgttgatgataaaggaacagatgtcaactaatgaatatcagcaaaaatgggatggctgaaaaagagtggtcattgcactatgaaaaagtgaggtgggaaaagcttctctggggaaatgctgatttgagataagaaaagagaataggagttggttgtgaggaaaacactgtgaggccattcctgcagaatgaccaacatcatacacaaagcggagtgtatataaagcacagactgaaaggccagtgggtcagaacatagggtcaaagggaag

SEQ ID NO: 62021 - DNA, 1938 bp, Bovine  19866881859277
tgaaaatacagctgccagcttaatgatatactctctaggaaagtatgcctgttacatttgaattgctttaattggtattaaaatgaaaattcccaaatgcagtacaatataccataaagtgggcaaaaatcagtattaatggaaacgcctcttaaataattatttcagtactttatcattccatatacctcacagtcagagcttctatttgttctactttcgttgatcctaacctgctatttggaggtaggttcttaaaactctttgatgttcttctcccaggtgaaatataaacaagatttgacctggcttaaaggcattggttgctatgcctatgatactcccgactttactctggctgaaaagaacaagactctctacagcaaggtatgtatttactcagggataatggccacatccatgcagtgtactccactgcccccagagagcactagaactgaggaaacagcttctcgtatttccatctctgtccttgcttctacaccctaaagtgggaacatactgcattattcactctactcaggaatattttagtactgacctcactgacaacagtaatcatttatttgtatcattccttggaatttgataaaaggccatctcagtacaactccttcctcatggcttttccagaatttccttcctagtaatatgtctctggatgatttgatacggcagcagatataaagtgagattattttaattcacaaacatgtgacttgaagcaaataacttttttatggcctcattttcctacttacaaaataaagcagtcagattggtttcctttgagttctaaaatagaagtcagcaaatttctctgaaaggtgccagagagtaaatagtttagattttgtggaccatgttcattctgtcacatattctttgttacaatccctaaagattattaaaaaaaattgtctagttcatgggctatttaaaaacaggtagtggtctagatgctagcatattcttactctaaaatattataattatctgattaattcctggaaaactaattaaagggttaaaaactgccttcacgtacacatggaaataccttcaaagtaaaataattatcactataaatattgaaacaaagaagaaactgatttgaatttttacccaatatgggaatagatccatttgacatctattcaatgaaagtatgtatttgggggccagttttcaaggcattggggtggtatgcccttcattgctttgggaaatagagtacattcaataattacttgttaactctatgaatgaattaatcacacatgtctcactcttaagataatcacaacctgctatcaagtaaccatgtttctgttttatctagtataagtataaagaggtatttgaaaggacaaagtcaaatttcaagtatgttgctgattgtccaatcaataggcatttcaagtttgcaactcaactgatgaatgaggtacgtatgacctgatccagtttaacctattaacttaccttagtactctataagtgacattcgattaaaactcaacacataaaatgacaggaaagcctttgagtctttgggaagacacttatgatatccctgttttatgggctctgccaaaagcaggaataagaacaaatgaagggcctgtgcagagtggagtgagggcccacagccagcgtggcctctgccgacactggcatggggcagcacagccctttgggtgcttctcagctgaactcccttcagcaggattctgtatagagttgggagacccataagttcaaagttaatttagtatcccttaccaaggcccagaaatggcagccgtaatcgggtagttgtgattcacacattcaaatatattgccatagttactcacacattgcacaagaaagtgtccattttgcattcaagatattcctctgtcttctacccag

SEQ ID NO: 62022 - DNA, 724 bp, Bovine  19866881940339
tccaggcaatgcttggccttctgattctctcctcagtaaagaggtgggctttccaggtggcactagtggtaaagaacccgcctgccagtgcaggagatgtaagagatgtgggtttgatccctgggtctggaagatcccttggaggaggaaatggcaacccaccctagtattcttgcctgggaaatcccatggacagaggggcctggcgggctacagtccatagggtcgcaaagagctggacatgattgaagtgacttagcacaccagaaagatgtatttttcgtatttctttcaatataaactcttaacattacaaggtgtctctgggaaataattaagtgtgctttgaaaacaatgacatcagtacatccagaagaggtttgaccttcagtttcctcaccctgggaagttcaatgacattgccattgctcaaagcacttaatgaatcccccttctcccccagcaggtaatccctctgcagggctggtgtgtttatattacaagttttaccaggtactggctgctgtgcctggataacatgaagtctggagcctgcagtgccccttctgttcatctgcctcctaccctaaggcagtgatggttggtagacacaatcatcgttgatgggtctaatttctctcagtgtctagttgattgtctagtggtaacatatgcaaacaaatgtactgagtttctcacgttccatagtatcaactctctaaga

SEQ ID NO: 62023 - DNA, 5578 bp, Bovine  19866880378719
atatcccagggctgatctccttcgaacggactggttggatctccttgccgtccaagggactctcaagagtcttctccaacaccacagttcaaaagcatcaattcttcagtgctcagccttcttcacagtccaactctcacatccatacatgaccacaggaaaaaccatagccttgactagacgaacctttgttggcaaagtaatgtctctgcttttgagtatgctatctaggttggtcataactttccttccaaggagtaagcgtcttttaatttcatgtttctgtctttgcctagactactttttaaatctaaaaatactaaccaatctttttatacatagcaaaaaggaaagggcctggcctgtggcatacattcagtaagtatatgctgaaaaaaatgcataatatgatgaaagttgcagtatagatgtgtcaatttggtttcataaacatacactggccatatacacagttatccagtggttaagatgctgtgtttccactgcagggggcttgggtttgatttctggtccaggaactaagatcccacatactgtgcaatggggccaaaaaacagaaggaaaaaaaaaaatactaggtgttttgaatactaaacttgaataacatgtgccttgacctacagtttacacataatagcctgatatagaaaaatacttccataaaactaaattttaactacagttctgtttaaagtttagaagttgtacttgaataaattacatactttaaacagcacttgctctggtgcttaataagagcaatgcatttttctaatggttaaatgttcaatcaatttggcaccagtcttactgaatcttacttcaatacgtctcttaattccatcccatgttcaccattccccatgatactgtcttttttcatagtgtccttacttgttattggcattgttttcttattttctaatatttctaccctagactttctgctataatatcatcaaattgactgataatcagaatacctgcacttgagatttctctttgatcacaaacttaatgtggctttgaacttatcattttccctgcctcatccccttccctcttctcttcctctcttggattcccaaattttggtaaatatcatcaattattgctattttccctgccagaaatgtggacatctttgtcaagtaaaggattctccaatgtgtttcctgctccgtagtgtctcttctgtcatttggtttatttcttgcacagactaatgggaaagttctatcataagtgtctggagaattcacttccctgcaccaatataccatttacattctcttagagtgatctttgtaatattcaaatctgactgtgctccttaggcataaatttcccccacaggatacagcttcaattccttagttctgcatcctctagatctttatcatctcatcaagccatcttctctctactgtgtattctgactgtatttgtggattacagctaactgaatatgtagtgcattcttgtgcttgtacactgtcttctgattgtaataccctgccccttctttcttctaactttaactcgtccttctagaagttataaatatgagccgtccaaactggaatagaatgtgacacaaaataatatgttccctttcacttcaagcattttagtatctgctgaaagatcaaactacttcaaatatattcttgattcatcaactggcaaaattcattaatctcttaatatactataacagtcataataggagtaattaataatttaatatttacccagaaacttttttctgaactagaattcactttttaaacatttagctgaaattaactgcaattagtaatacagtggttggtatgtgagggcaatataaactgataacaaaaatgatgactaaaacatgcaggtgtctatatgaccttaaactccattatcctagacaagtagaggtaaaacaaatttttttacagcatattcagtaaacatcaattgtgctcaaagccccagaaatagacttgttctgagtcaaaaatgaagtaagctgaaagagaaaataccttaacaagataaacactaatagaacgaagtaatcaggctctttcatttatcccaagagtatgtgtatatttatgcatacataatcagttcaacccaacaaatgtgtactggctgctagacaaaatttatagacaatccagagagagaactttgcaaatctgagaggtagatgtcactggtctcctgtctcagtgtctggggtgagttgaacagaggcctatatactccctaaatatgaatgtgtagtcagtccacttgcctatgcaaagaatgaagtctaacgcatattgaatagatcacattacattttaattaaagcatgtttatactgcttatattttcattcttaatatttatgtatcagagttttcaatatttatgtcagtgcatttatttatttttcttaacaatttataacagtataacttaatgtatccaatgacaatattaccaagaaaggagtgtatgaaatcaaaccacattttcacttagattcccatcctgaccaatgcttcatcactaatgaagcattagcgatgcttcatctttttctttttttggccccgtcatggagcatgtgggatctcagttccctgactagggataaaacccatgcctctgcagtggaagttcagtgatgcttaatcttaatttttaatagattttagttggaagtggctcctcacatgtcacttctggtccctgtcactttgcttttagtcatggcttttattattgtttcacaatgaactgtttatacccctcattatttttattacaagtaatcagtgaatcaccatcaacagtacaaaccataccatagaaatataaaggagaatctacattttcacagtattttacaaatttcaataaagacatctttagattattgttttatctgtgaaatccaatcaaagtagtattattgttcaaacacaacttcaagttgccctctctgttcaaattgttgtgccctaagatcttcatgacccagataaccatgatggtgtgatcactcacctacagccagacatcctggaatgcaaagtcaagtgggccttaggaagcatcactatgaacaaagctagtggaggtgataggattccagacgagcagtttcaaatcctaaaagatgatgctataaaagtgctgcgtgcaatatgccagagaatttcaaaaactcagcagtggccacaggactggaaaaggtcaattttcattccaatcccaaagaaaggtaatgcaaaagaatgctcaaactaccacacaattgccctcatctcacacactagtaaaatgatgctcaaatttctccaagcctggcttcagcagtacatgaaccatggactggcagatgttcaagatggatttagaaaaggcagaggaaccagagatcaaattgccaacatttcttggattatagaaaaagcaagagaattccagaaaaacatatacttctgctttattgattacactaaagcctttgactgtgtagatcacaacaaactgtggaaaattcttcaagagatgggactagtagatcaccttacctgcctcctgagaaatctgtatgcagattaagaaggaacagttagaactggacatggaacaaaagactggttccaaattgggaaaggagtacgtcaaggctgtatgttgttaccctgcttatttaacttacatgcagagtacatcatgagaaacactgggctggatgaagcacaatctggaatcaagattgccgggagaaatatcaataacctcagatatgcagatgacaccacacttatagcagaaagtgaagaggaactaaagagcctgttgatgaaagtgaaagaggagacagaaaaatctggcttaaaactcaaaattcaggaaattaagatcatggcatccgatcccatcacttcatggcatataaatggggaaattgtggaaatagtgacagactttattttatgggctccaaaaatcactgcagatggtgactgcagccatgaaattaaaagatgcttgctccttggaagaaaagttatcaccaacctagacagcttattaaaaagtagacctttgccaacaaaggtccatctagtcaaggctatggtttttccagtggtcatatataggtgtgagagttggactataaagaaagctgagcactgaagaattgacggcttttgaactgtggtgttggagaagactcttgagagtcccttggactgcaaggagatcctaccagtccatcctaaaggaaatcagttctgaatattccttggaagaactaatgttgaagctgaaactccaatactttggccacctgatgtgaagagctgactcatttgaaaagaccctgatgcctggaaagactgaaggcaggaggagaatgggatgacagaggatgagatggttggatggcatcagcgactcaatgaacatgagtttgagcaagctccaggagttggtgatagacagggacgcctagtgtattggagtccatgggttcacaaagagctggacacaactgagcgactgaatggaagactgtttaatcagaaattttagcaatatcagagacattcaaactatcaggatatcacaaatgtgcttggcatcccatcttttgttcatgctattttcctaagtaatgttggccatttccttatgcattttcctctactctaaagctgtgtagttgcttcctacctggcagcaggctgaaagttttcttattctcattcaatctctcttttctgctgctgaatcccttggaaaagacagtgtccaattgtcatataaacaaagaattttctctcatctcgccttttcaccaggggggcaactcctgggaaaactctgtcaaggaagccatggtgtcctaagaactgaacctaagttttgagccatccaaaggctcctagccagctaagacattatcttcactcaggactctctccccagactgccctttctgcctgtcagggctcactgtcccctcatatctaccatacctgaggcaccctgtaccatataagctgctatgggtatccaagcctctctactcagggtgctctgccacctttccttccttatttttaatttgtaggaatatgtagaaagctacagaaaaactattccttttctgtcttcaagagagtgtggtaagcgggcctgtaatggcccacttatctttgagatttttctcaaggattttcccagctgagaagacagttggcttagagaggaggaattttcaacaattttgcttatttcccttttttttttttttccttctcacagcagaaggaatgtcattggcttcatttttttcttgtcaatgattcaataatattttttgtataatgactgtatgtgtggaaaaaatacagtctgggaatttccatgttctgggaatatactggtgaataaaagagaccaaggctctgcactcataaatcttacagtctcaaaactaatagaaaaacaaatcaggttaatcgtctctcctgaccactgaatactg

SEQ ID NO: 62024 - DNA, 1410 bp, Bovine  19866880457785
tgctgtctgacgtgaaagattttaactattcggaacatctttctccaaaatatcagaggcaaagaaagaaagagaaatttaacgtttcaaaaaaaaaaacggagttaaaatggagactgaagattataattatgacagattttcattttgattttaaccaatgatgtgttatttagtcaagactttaatttaaaatacagtattttgcacctaacggatcttaggttctgtgaaaatgtcagtgcaatctaccaggagaaaaaaggaagatagcacctgctgtaatcattctttttttttttttttttctcctacattttccctccaaagttcaaagacccctctgtctttgatggtattgtaagaaaaacaggcggagatgctctctgcctgtattttttattttttttaccttgcctgctagccattcggtgttttgatctgtgtttccatctgagctttctaatatagcgaccctggcatctaatccatccagtttattatctattgaaatacttactgcctgaagtgaatttattttggcagcaatgacttctgatagagatgtattttgtattattttttgtgaaagacaggtgagtctaaagattccaaactctccctgatgacaatccttggccttttctcatggcaaacttcgggaaaaaagaaaaaaacaccctgtacatacttagtttttatttgtcattataaacttgctttgtccaaaagctagaactctctgaggctgaaaataaaaaatagtaacatgcataaaaaagtcatgttattagaacaaaaaagaagcagattctcacaactcgcaggggcacatttttcctcttccattcatactcttagtgttgagttctttttaacctttagaatttaatttgtgaaagattatggctgcatcaagctttgcagaaactgtacttctgaagtgttagcatgttttgtattttgatggtttactttctgttacatgaaatagaggagaccatgagggatggaatcgtgtaaaaagaatatccgaaaggtcaaacagcaaaatttattttgctcttttacataatacatattgcaccttaaaacttccagttctgcctttttgaattacactgcaaaaggtaactgtggtattctttaaactaaatcctcttttacatataacttgaaaactgatttgttaatggatgcttccacttagatgtccactgcttaatttttttttccccctgagcatttggttgtattgtggataggcatttcttctgtgtgacaactggtaggataggacatgccttatatttagttggtatgccccatatttacttttgctgcatattctgtgactctttggtataaccatgacatgccatttggaaggtgtaggatgggctttctttt

SEQ ID NO: 62025 - DNA, 939 bp, Bovine  19866880693954
tgctactgtctctattcttcacaccaagaacacaatctgttatttttatctcatactctttttttcatcgtgggtaaatgtaggctgattccataagccatcatttgattatgtgccttataatcatcagcattcagattttatccattgggaatgtgaaaaacctgtgggaaggatttaaaatactaaaataaaacctctttgagtttgcaatcagcaagagcttaattaaaatcaatggggaaatttttaaaaaatggttaatgtaaactgttacttttgttcttctaggatatctatttcacttttcttttgttcaaaaagaatttctgaaaagtatactatacgactagcccaataatagacaccaatttgcattattaaacaagcgaagattttcatccaaaagtcacataacaacaaaagtggccttcattctcaaggaaagtccaaacctggaaccacggtgctcttgagttgccctacttgaatcgcagaagtttgactgtggctgtaagaattattccttgctagttacaagtttcctttctcatgtttccacatggctcttcttctgcaataaagtacgtattttattacatccatatttgcctccaaaagaaaaaagcaaaaaaaaaaagcagatgttttcaagaccattttattggataaatgttggctaaacaaagccaaaacaaatcctgccattgagctcttctgaacttctgggcaaaggtcattgtgctctggtgttcatgttccctgtatgcattcatccttcagagtctgttaccccctttaggggtgcaggataccatatggtttgcagaggaagtagtaagcaagttacaggtagtgaatcactattttctaaaacatgtctgattttaatagttatttgggaaaactttaaaacagagattcctaggtctccccaaa

SEQ ID NO: 62026 - DNA, 982 bp, Bovine  19866880706202
ctcctttgtgattacttacccccacatctcctacacctattttaacacttaacatattgtaaggaaggagaagggcatggcaacccactccagtattcttgcctggagaatcccatggacagaagagcctggcaggctacagtccacagggtcaaaagagtcggatactactgaagtgacttagcatgcacacatgttgtatggaaattttttatttatgattatggatttctctttcccattatgccacaataagtctgtattttttgtttcccctctattagtactttgtctagtgtgctttaagagcttagtaaatatttatgaattcacatattagggttaaatacatatcattaagtaaataatcccaattcttagagtatgaaatatatttaataaaatttgatgactttgtgcaaataactgaccttctgtgatgtgatgtggtgtgcaaaaccagtattttacgttctttatataaatgaagaaaatgtgttaatactaaattctgttagaccaatggttaaagtgcaaattcactgttctggcacatatttgtttatatcacataagggcacagcactaatacactttgaagtgattattgctgtggtagaatactaaaaaaaaaaaaaaaaaaatacaatacagtgtgacatgggagagtgaaaatccaaatgaaagcagaatctgcatattgtttttacgttgtacctgccagtcaagctaaaattttatgaagaactgagaagctattttcactcatgtacattgtatcatgtaggtcatattcttttatgtaaatctcttccacttgggtgtttaaatttcaatataaatgtagttttaaagaatatggcttatatttctttctctccttaattcattctgagttttggagcgcgaatgttttgcagaccatgacacctacaaggggcattgtttgaggaggtgttaaaacatgagctgtgtgtgtttt

SEQ ID NO: 62027 - DNA, 3106 bp, Bovine  19866880728184
ggaagctggtgggggaagggggtgaaaattgagttcacttcaccaatagccagtgatttagtcaaccgtccctgatggctcagacgctaaagcgtctgcctgcgatgtgggagacctgggttcgatccctgggttgggaaaatcccctggagaaggaaatggcaatccactccagcactcttgcctggaaaatcccatggatggaggagcctgataggctacagtccatgtggttgcaaagagtccgacacgactgagcaacttcacttcacttcacttcaaacaaccccagaagaatggggtttagagagcttccttgtctttaactgagacaggtgctgggagaatggtgtgatcagagagcatggaaatgacacacttccacgtactttgccctgtttatttcttccatttggctgagtctgagttacaccctttacaataaactgataatctagtgagtaaaatgtttttcttgagttctgtaaaccattctcgcaaattaatcacacccaaggagagaatctttggaacctccaatctatagcctgtggtcagaagctcacaacctggacttgtgattgacatctgaagtaaattggggcaggggtagatgaccctcttataggactacagtgaatctgatgtgttggaatccgatgctgtctatgggtagaaagtgtctgggttgagctgaattattggacacccagctatgttgtagaagtgcttgctggtatggggaaaaccccttacactggaattttaattggtgagcagaatagttgtcatcctcatgagtattttcttacttgtgtattattcttgttgaattgcttgactgagtaatgaagctttcataaagtgaataatttcctccatcctttgcattaggatcattttgccaacaagaagatagtgttctaatcatcttctaactaggggctagcaaatcttaccccacaatatgagtcttgaattatcaacacattgatatttaaaaggagcaaataattcagatgtggaaaagccagtaactttgcctaattaaagacaagcatgttgtagaaactaatgtgttattctttaaggccaccatggtgattacttacagggtctaaatagttccctggagcccagtaagtagtaatatatctttagaagtttgctaaactatcaaaaagcattggcattcagaaaaatctgttttgttacttgcccaaatacaaaatatgcaagcactttgcagttttgtatttactgtggttaatggccacatatcggggtttgtttaatttgtttaaagagtaaataaaatgcaatgtctactttaaagaaaaaatcatgacttatggccattgaaatgctctttcaaccaccacctgaagcccaaacctctccaaagccctttagcccccagatggccagtaccttaggtctagtcccatgaggaataacaggggtcatgacatggcctgttcactaaggccaaagaacaggtgcaaggcctacatttctggctgcttggagccctgttatttttatgaatagtcagtgcatcaggaactctacagggatccaagcctttccttgagcccaatcaaaggattagtgtggtttaggcagaggttgcatctgtgtggaaaattgtccatgctgagttctattagaaggtgctgttgagtgagatttgttactaatcacaaggcaaaattacagtctcttgaaatgagaagccagtaaacaaaattataaaagtcattttaattattaaatgacagtgttacaaatgatatgccatttatcattgccataatgaaatacaataaacagaaaaaaatccatatgacccattcactgtaatttaattttgcctaatatattattttaatgattttttaaaaatgtgactaattaacaaattgctaattctcttagccagcaatatctatattttaattcggatgtaccatttttactaaccagtgctttgtgctgactgaagaaacactgaaaactctgaaaggtcttctttacaaggttcaagttatcagtgcctaatgatgctaagtgatgaattgctccaattttaatagaacaatcagggcctagtgtttccattatccttgtccagacacttcccatccatgttattgttgtgctgattagcagcattatttgtaaagactttgtaaattgtaaatcagagataacaggtgattctttcttgttatttgaaaactgaacgtgtttgataatttttcaagtttgtaaaaactattgaaatgtcaatatcattttacaaaaagaatgatgagctgctcaaatcagagcaactgaatgcaaaaatggcctttttcctaacacccttgaaaactgaacaagtactaatattacctggtaatagctgtttggattaaatttgtttatgtttaaaatttgatctatgtgtctgtctgtcatctatccattatctatctatcatctatctttttaagttcctgagataagacttttgaccatgtacacaaattttcaggacagtgtaatttaaaatgtaaaatgacctattactgattaatacttgctatatccatgcttttcaaagaaaaggggccattataaatataattcatgttcctaaacctttcatatttaagtagaacatgccttaaaataaatatgccctattctactcttaatcttctagtaaacacttattaaatgcctactacctgccagactaaaatcatttctacaagatgaaaatgcttaacaattaattacctaaaggaatatgcaaaacaaatctgtttttttttttattacaactggatgacttattatccaaaagaaaataactttagtaaaaataactgttctgatttatattaatagaattttatcagataatctaagagattaaattcagtaacttctcactgctggatgtgtgtgagagagaggtatatctcactgggagacatacccagtaaaaagaagagtgtcaagtggtagctgctgcatgctcctgaatctccctaaaatactgcatttcattgtcaatctaagacttctatttttggtggtgataatagtgtagtgg

SEQ ID NO: 62028 - DNA, 2068 bp, Bovine  19866880762274
tgaaaaacacttgaatcagaaattttcagaatttgtctttgacaactttatcagatagataacaaatttggtaacattcaagagaaaaaaggtattgatccagagattatggaagtttttatttaaagtctatatatgtcagtgatgtttttgaaataattatggaaacccagggaatttatttggggtttatgccagacatattttccctgccaaccattaaccctcaggcaatatctcactcctaggtcattactataattagaagacaaacatttaaaaacaacagaggtgcatttgtgtatacattttttgtacttaggagatattatcataattggtgtgtatagaggatttcggggaattttcgattaactcatcactcacgaaaatcagttgattagattatctttcattttcaattcacattattataattaacttgttcttgtaagtactgttggggtaatgtaagaacattagaagctgttttcaattataagcttgtatattgtagcaaagtagattagaagcttactattaaattgaaaacacatcttattaggaacatctaattctgatgaagaaaagtgcaatgtgccatttgtactcttcatgtggaggtacagatgttaaagggaaaagggcttgttcttgttgagtatttcgtctcatgtatcccagtaagaacatctgatcttggactctgtttagctattgcaacagctgttgggtctctgattgggtttgaagccctccctctgaattttactaagacagtttgcagaatgaagtcagcagaagccaccacacaagttttccttttaaattgttccacaaggctgagagctgagtgattgctacacatacgatctctcatgtcttcccagcaaattaaccccccacaaccggcttcttaccattcagtctgtgattttgttgttgccttctgttgggtaatttttagcttttccctggcattcagcctagtgttatctgtgagtatgctggtacatctgtttgtattcagaatttattttacatcatctttaatattagtaacagtatcttcaaattgaaattttattaataataagtatttgttgcttagtgaaatagcttgcctagtataaatagtatgagtgtttggggccaatctgactactgaaagtattgaatctgatgataccctgaaaagaaaccttgtgtttagaatctgatctgctcagattttatttgacctctaactgttttaagattctacaatcataatgtatgaaggaaaaccaggaattgagaagaaagttgagaaaatgactaatggccaagaaaccacatctattggacgagaaagtaggtctagtagacaactacaagaagcacagtgggctggaaaaagcttggtcgctgtagttacatgtgcagaaaatagaggcaggaagcattacataaataaagaggctatcaaagatgtttcaaaactcccattgcaggagatttgagatggtttacaattttggttttgttctcgatttttttcatttattccttacataaacgggtcttggtatctctgttttggcaagttaagttcctgccctataccttcccatttaaaataatcccaaatctgggacttccctaggagtccagtggttaagactctgcactcccactgcagggaccaccagtttgatccctgttcagggaactaagatcccacataactcaaggtgcagccaaaaaataaaatagaaaataaaatgatggagaattttaaaaaataaataaataaataaccccaaatcccaggatcagtgaagtcaggctatagcttgtgctccgtgtctacagagaagaaagcaagtttattatagcaaagactatcagatttaaagtaagatgaactcaactagaattctggctccactccttactatgcacaggatcgtggataagacactcaaattctcaattttttttttttcaaatacaaaatggaagtgatatcagataatttgtagggcatttagcaaatgattgatagtgcattagaattataaaaaac

SEQ ID NO: 62029 - DNA, 805 bp, Bovine  19866880764606
ataaattacctttcccttttagatctattttaaaagagaattgcagacctgacagctgacagggaggcagggggtagaagaaatcagagtagagaagaatgttggcctggaaagaagcttcacctcccctgaaaatgagctctgctttgaggcttggcttaggaaaatttgggggattaaatcaatagatggggctggaacgaggaaatcaagaaacaattaaaataacagctgcttcccatcctttccactctttggctttttcttatccgctcttgatgatgagttttgtagccctagttggctacagagcagaacaaactaaaacagtcaccatggattttttttcttccaaaacatttttcagtacaaataactttaggatccacacatctcaaacattaaattaacaatcttttgtcctctgctgccaccaagatcccccagttgtatagaaatgaggattggaaaatattacaggtggacctctcaggcaacttgaacttctgaaaaacagtagctacaacagatgtttctttcatatgatctgtgtttgatctcctaaaaaatattcactaccattggcaaagggtgagaaaatgtgtataattcaaggggaaaacatagaaaacaaaggaaatatcccatgataccctacaacaattgctagaaatttcactgatcaaaatatgggtttatgttacagcaaataatctttattttagatgtctaatatccaaagatacttaaattttcagacaaaggcaggcagcagccattttcaataaaaccacaccatttcaat

SEQ ID NO: 62030 - DNA, 1036 bp, Bovine  19866880924784
ccataaatttgagcatcatttacagatctcttctctccacccccccaaaaaaataccccacatatttaacatatgtctctttcatttagatcctaagttaaaggagaaccatgtgctctagcaatgctctgtgttgcctcagggcttggtgaatttaatcatttatttggatccacagataattgcctagtcaataaactttgatgtgggaatgtaaatgattgcatttgaagactgcatttgaagagttgataattacgcctaaattttaggatttctgtgaatactttaaaatatctgctggaacagaatgatttttttttttttaacttgcaactttactctcctaattagtttccattggaaaaaatagtgaattctggattcactattcacaaaaacagattttgctccatctctacttagagaatcattttgctacttgaatgccagggcgtgatttaggtggaaatgaagctcaagaaatgcacacatggacagcctatgacctaagctgataaaaataatcaactacataacagctgtcttttatgttaagcaagtcttctggggatggtgatcaatggaaaaatatctttctaagcggaggcctcctaaaaggaggacagagtacaggtatgttagcatttgtatcaatactgtggtgagtgtaaggcattttcacgcaatttgtgagaattcataataatgactaccagtgtaactacaaccatacattgaacaattttatcctgctgctgctactgctgctaagtcacttcagtcgtgtccgactctgtgtgaccccatagtaggctctctcattttattttcacaaccaaatgatgagttaaccatgagctgctcacctggcagaggcaagatttgagagattaatctgtcttcaatcattcagcttaaagtggtagctgctgctgctgctgctgctaagtcgattcagtcatgtctgaccctgtgcgaccccataaacgtcagcccaccaggctccccatcccgggattctcgaggcaagaca

SEQ ID NO: 62031 - DNA, 3498 bp, Bovine  19866880929318
aaaaacaaaaagacaatctagttacaaatggctagacacttggaaaaacatgtcctaaagagaatgcccatgcttcgataaatatcattgttcattaagaaaatggctgcttaaatcacaatactatacctatcaacacccactacaatggcttcaatttttgtaattgaaaggagttatgacaatgtggagcaaatgggctatcatctactactgattggaaaataaacaggtaataccatttaggaaaatgctcagtatctactgaacataactatacactataattaatacctaacaattcagttattgggcataaactcaacagtacattcattatgtataccaaaatcatgaattgaaaaaaaaatagtattctcaatatcataaaactacaaacaaccctaattctatcaaaaatagaattgacaaataaaatatggtattttccataaaatggaacactacacaatactaaaaaaaatagttactactacacatagaaacatcagtctcacaaatattatattgaattaagtgaaatattaaaaatattctctattgttccaacaatgtaatgttaaaagcaattgaagctaatctacagtttgccttcagtggagttatggttaggaagaaatgtggaacactcttctatattttgatctggattgaggctatcaaggtatgtttactttgcaaagatctatcaaattgcaaatgaatgatttgtatatttaaaatatgattttaaagatactgtcttttgccttccatcctttgatttcctactggttcctcccacttgctgaacccatggagaagccagaagggagagagcaaatcattgcagtgagtagaatatcagggtgctagagccctgagcaaggccagaaatacatctaaagtggccagagcagaataactagctcaggggcagttccaaatgcacattggagcttagattataacaatggaaaactggaaatagattgaatgtccatgatcaagtgaataagtaaattacatctaaaataactatacgatggtatatcatatatcattgcaaattagaagtgcatgagtcaggaataatgaacaaactaaagcacaaaatgaaacttcagaaagaaaatacagggtgacatcaattttctgtatttttaaaacatatacgactgtgtgtgtttgttagttgctcagctgtgtccaactctttagcattagaagtaaaatgcttaagaaaattaatatcaaattcagaatagctattttttcctggagaagagtgaaatgtgggcaaagtttttacttgtctttgtaatattttgtgtcctaagctatgagacagttatctacgtgtttattgcatcactctttacaccttggtgaatatctaaagtatttcacaataaaacacaataaaaaattctgagctcatagaatatctgttttatagggcattacttgaattgggaataaaaaaaaataatcattcccatagggttaattttgacccatcaatgaagggtgagtggaccccatcaacacagcacatcctttgacatgtttactcctagattaagggcagggtctggatgccctgtttgtgggcagctgtgtgcagctgtgggcttcccaggcggcactagtggtaaagaacttgcctgccaggttccaaatgtaagagattaggatttgagccctgggtcaggaagatcctctgaaggagggcaaagcaacccactccagtattcttgcctggagaatcccatggacagaggaacctggtgaggctacagtccataaggtcacaaagagtcggaccccactgaagtgacttagcatgcaacacacacacacacacacacacgactgaagcaacttagcagcagcagcatgtgcagttgtggaagtgatttgcgataatagagtcatccatggcttttgaacacagcagagataactggtccacaaagagatttaatcctcagctttgactcatcagcctaatgctctctaaaactgaattcactttagtaaatgtatatatgcttcatgatgctttctactgtgatgtttatatctatttatataactgttagagatatctactatcaaatgactacttctgatttgtattccttgaaagttacttaatattttttttttctttttgaggaagacctttaggtattcttgctttctactcatttaaaggtttaaaatttacttctttagatcatatctttatccttataataatgcctaatagagctgtccttattttgcaagcataacaaagactatatgttgtgtaatcctggaggctttctgatgagtactgcataagttgaggtccatttaacaaatatgatctcatgcactgtcagcatatgtgtactcactataattaaaatgcaataacaagaaatgcatggcaaatgagttttaaacctctaccgacatatgaaataacttctccctcccagggtcaattgaaccacatttctcacttcttttaccctatgtctccacatagatctataatagtaagggggaaaaaaattccctttctcattacagagaaacactgtaataatttaatttcattgctcaagctaaggacttttaaatatcacaatttctatggcaatcccctttccatttattgtactggagaatatctttttattcaaactgcatccataatatcaagtgcaagaaaattgcagctaaaccaatcacagcatggtaactcctgaattaatattcttaaacaatgaacataatttcagaaatgcttccatgtttctctcaacatggaaggaatcaattcagtgtgtcttgtgacctctaaacctaaagatttaaagtggaaaatttcaggatcccaacacttggcctcaaaatttattaacaaaacacctggactttggatatttttctttgattaaggttggcatttgttcagctaagcatttagctataaggaaagcttcttacctcagactgctgtttgcctggcatgtgcaaatagtttctcctccacaaacacctacagcagctaatacattccactgtctagaataatctgaagattggatttatttagataatggtgtactttgttacgtgaaaagcactttcatttacatagatagaattttccataaagttttcattcaaatatttgatatcatatagatacatctttaatttgaatggacagaagaaatcatctgtttcctttgagaaataacaagacagttaaacatttttttttttggtgttattggacattatacattatttacttaccctaacaaggaacttcttgtggtttttattttttttgtctttcttttttttttaaatgtggccttcgcaagaaaccctcagtgcccagagcatatttttcatcatctggaagccagagccagagtgggagcccaaccaagattggaaccaaaagtgaagtcctcaccttcagcacca

SEQ ID NO: 62032 - DNA, 959 bp, Bovine  19866880944651
atgccctagaggaggaaatggtaacccactccagtgttcttacttggagaatcccatggacagagatgtatgaggagctacagtccatggggttgcaaagagtcagacaactgaacaactgagcacagattaaaaaaaaaaaaaaaaaaaagacaacaaattaagacatctgtttaaattgaataactagtggatagcagaactaaggttaaaacctcagcaatctgtctgcaaaggccactctcttctacaatattctgccaacttgattagccatagttgaaaacagaattccagaactaggacacaatccagaataaattaaccaaattatagaaatgaagagaaggaaaatatgaaagagagatgagaaacagaagatagagtaaggtggcataacatacatctaattgaatttctaaaggagagactagagaaaatgcggggaagataatattcaaatagataattttcagaagttcttcaaatgaataaaaaagatgaagccatctattcaggagtcacaagcaattccaaagaggactgaaaaaaagaaaaactcacacacagacacttgctagtaaaaatgcagaccaccaaagaaaagtattattcaagaataaaggtgaaataaaggcatgtacaactaaaaagaaacttgaagtgtgtaacaacagagaaattcagcagaggaaattacagaggagttgaaaaatgatcctagaatattgtagttctaaagaataagtgggaaagtcaagtttaaaaaatggaatatatgttaggtaatctatacaagcattgattatataagtcagtaatgaaagtgaaagtcactcagttgtccccgactcttgcaaccccatggactatacagtccatggcattctccaggccagaatactgaagcaggtagcctttcccttctctcaggaatcttcctaacccagggatcaaac

SEQ ID NO: 62033 - DNA, 1045 bp, Bovine  19866880965167
acgtcttaatgctgacagcaaaaatgctatttgcatcataatcatatttgcctctcccttccttcattgagctcacgggtacccacagtactattagaagagcttaagaataaatccagtctttccttgagtttccattatatgtataaaatcacaacaggtacttgatgatttgcatttgatactaacagaatgcaaattgatctcaaagcattaaaatgctctggaaaaaaggtgaggttcaaatactaactaaaatttcccattcatgccaattcaaagaaaaccaacagtatctctcgaatgcagatacctataaaaacaaatacgctatgcagagataagaatagcaggtgaaagccaaatatgaatataggaaaacataaggggcattttccttagtaacatacatgtggattccatggaaatgagtgtatcaactgaatgggcaagactagcagcccataggaaactaccttccctgtcctgagattgtcagtttcccataaagtcacttacaataagttaaaagccaataagttaaatgcttgtccttttgtactcctggcccgagagtttcctaataaatttgacaatacggtaggtagcctttttgacaacattttactgttttggtccaagtgtattgacaacctgtactaatttcttgaaaagcacacaagaaaaagtattttgacagcttcaacctactgtctgatgatggaaattaagataattatgttgacctttctgttggaagttctggtgggaaatgatatctttagacaatctatattaacccatctgaaacacaagggaaaaacctctaaatttttctcaacctgaagatttcacttggttttcccaaactatctagaattataacagtgatgtattcagagaaacgtgatctcttgaattgcaatttctaccctttgtttcttttctacacttttagtttctttcaaattgtttccttgagttcatttcaattagcacggttaatagcatgccatcaactgtaaataaattaaagcagcaactg

SEQ ID NO: 62034 - DNA, 1790 bp, Bovine  19866881002606
aattttgtataattttgtagagaagcaaattgacttcccagattacctcactatataattttaatggtaatagacctacaacatgtaactagaaccttcatatttatttatctgatttcccatgaaactaagagtctattgcttttttagggattgtggttctaatgctacttgtccccagtcaaccacaaagaaagctttattatctgcctgttggggaaacttgtgcatcagatccctgactctgatgatattttcttctcttcacactgtgtgaaaagctgggatatagctactgtcggcctgtttgcttctctcccattcatacaagatttaccctcaggaatggctgacttcatttctgatttgttctcatctcccagaattcagttgctttaagctaccttttggactaaccttctgaccagggcacttggcaatattccagtctgtaatctcctctccattggtaggtctgctttctgagaagccagggagaaggaaattttgactgtctttggagctaaagtataataccagatcagatatgttaggtattaaatgcatagaaattataagctgctgctgctaagacacttcagtcgtgtctgactctgtgcaaccccatagacagcagcccaccaggcttccctgtccctgggattctccaggcaagaacactggagtgggctgccatttccttctccaaggcatgaaagtgaaaagtgaaagtgaagtcgctcggttgtgtccaactctgtgagaccccatggactgccgcctaccaggctcctccatccatggaattttccaggcaagagtactggagtagggtgccattgccttctccgaattataagctacaagtgttcaaaggctaccattttaaaaacagaagtgtatggaaggtaaccaaaatgaatcttgacaagaatcgtggtaaaagtcacagagcttaaattagatatagatttgacatgaagaagatgggaattgtaatagaaaaaatagcacattcaaaaattaatgataaaagaaatatatatcaactggtaattttagccttttattgggcctttggaatggaattcttgaggcaagaatactggactgggttggcattctttctccagggaatcttccagatccagggatcgaatccaggtctcctgtattgtgagcagattctttactgtctgagctatcagggaagcccataagatatgcaagtactattaactattattaattgtattattattattatcattgttataatcactgttaacctttcttctgagatatgcatctaaaatgattagaaacttattgctgtttgaaaaataatagagaattttgaaaacatctcacagatgatgatgttcttttaagaatctgaaaaatcgtgatggctcaagggtctattatttttagaactcatttggggcaggccaaatatgtcctacactgtattttcatatatagtattctcctaattacatatattgttatgaaaaaaaaaaacaacccgtgtttctttagtgtcatttaataaaattaaaccaatcaatcaataaatctcatcttaggtgggatattgctgtgccagtctgcagactgccattgtgaagtgcatcatgggactggaatgagtacatggtccccttggcttacatcatcccatatcttaagctgtttaatccataaagcccagaacatggtgaaatacttttattaaccatacttttggtaggggaaagagaattacggcttgtcctttgtgggtatga

SEQ ID NO: 62035 - DNA, 698 bp, Bovine  19866881059529
tgatattttccaggaaaaaatacttaagtgggttgccatttccttctccagtggatcttcctgacccaggaatgaacctgcatctcctgcattgctcgcagattctttacctacagagccaccagggacatataattaaacatggtcttcttgtgcactttgatccttgtgtatattcttgtcagttgttcaaagtggttgaatttgactctaaatagtttcactgtcttaatacattattctgtgtggcaaaaataaaactggactagaattatctaggccaaatgatacagtggatttctaggaagcctaaggcagattggctattttgcattgagaagaagccattggagagtgatagtttaagaaaaattttgttgtgaaatatttgattggggaaacatttttgaaatgttcagtttaacacattaaggtactattatgcgccctccaaatagatttcctggagattgtctgccaccttcaacacatttactgaatttcaacttgaaagtttattgttgtcaggggatagatgtaacctgaattaaaggtgtaatgttagtaaataattttctaacaacttacaaaaattagaactgaaattttaagctttgttactattggaggtagtattaaagtaaaagtgaaagtctctcagtcgtgtccaattcttttgaccccaggactatagagtc

SEQ ID NO: 62036 - DNA, 811 bp, Bovine  19866881080717
tatttggaattctctgcatcttctattcttgccactgtcaaatggatcattacattttcaacacttaattatcttttcacctaaattgtgtcttatttaacttgatcatttaaactgctaatgtgactttttaacatttgtcttggctttatataaatgaattgctattctctaacttgacttttgcttaacatatgaaatctgaaatttataaagaggaaaagggaaaagtgggaatttcaaaaaatagtatttgctaatgagaaccattttcagtaacttagccgctagactttggcacattccttggactaggcattgggtcactcccatttttcatagcttgtcacacaattaactaaatcattaaaatggaactagtccattgtgacaaactgaaatgactaaaagcttgcctaaggcattgcactgcacggctgtttaagaaaattccatctctcctgaattggtgatggataatgtgacaaaaatattccgattaaattctaactttggaatacttaataaattagtaatggcattagaagtgccacttctattcacctgtcaaggaggagggctgtgatgctgatctttttgccctctttgtctgctttcatgagagctgcttgcagctgagggggtcatatcttatgaaggtataagatgacagcaaggtaagagatgaggtttccctgtcatgcctctgtacttactcatttcttcccttcagatttggagacactgaagaacacaatgcttttctttgacagatggaaaccttccttctctcttcttcatcatcattttc

SEQ ID NO: 62037 - DNA, 1232 bp, Bovine  19866881370371
ctcctgtgaagtctctttttaggttactaaactagtctagcttccctggtgacacagcagtaaagaactctcctgcaatgtatgagacaaggcaggagccatgggttcaattcctgggtcaggaagttccccttgagaaggaaatggcaacccactccagtattcttgcctgtaaaatcccatggacagcccatggggttgcaaaagagtagggcacaacttagtgactcaaaaaaaaaagacaacaaaaagcccctcctcagtccaaaggtgggtgaaccatcatttcactttggacagtcagtgaagacagggactggaaaacttgtaggtagtaagcctgtaggcttgctctgatgctatccttgggaaactagtcatattgtgagcccacactgattcatcccccaaatttggttgaatctaaagagctgatggaaacttatgtgattggccagtaacacagaaaaaggatgaagctgcacctagattgaattatgtcagcaccctcccagctgcacagcccttaaaaaattcgaaccacacaatcatcagtattttacaaagctgaatgctacatgtctcttttgacaatgaggactcggttaaaactacattttggcactctgagagatgaataaaaatctacttaaacgtggtgtttctaatactcagtgtcacgttttaccggttggcacacatttatcacttcatttcccagtgcagtaaacaactcgtaactgactggttactttgattgacagcagccttgggcatttcttagcactcatgttacagtattgcatagagtcaaacttccatggtaattggcttccacaacaacaacaataatagaaataatcatttcagagttaatttaaaggagccaaaagaagtcagtcaaatatgaggacgataaattatgaggatttctcatttaagtaagtaacaggtttaatggctttctctaagtactgagatcattcaattgaacatctgctttccagctgtgcatattgatatattactaggtttttattcccctctaccctaaatgtatccataagtttttaggagtttcactacctgactttttgacaaaggcttgattgtgaatgatataaaaatgtcaaaaattctggaggccatattatgcccaaggtattatttttcaattgactccaaagacagatgtccatgaacaattaaaccattctccaatcacacccttg

SEQ ID NO: 62038 - DNA, 1899 bp, Bovine  19866881557614
tgcttgttaatagtttagtctgtgcctaataaatgaattttgcagatcttggaaatagtgcctgatagcaatcatgtaggatagtccagagttaactattttcctttaatgtgaagcaagaagtggctaatggaaacaacacaatcttctctggccttggaaattatccagcatgttcccataatcacagaataattaaaaatgatggtggtatcatggaatatttgtgcaagggacaaaaaagatgcaggtgcagtaataataatatggtgacagagtcccaaaaggaaaaaggcgagagcattttccagcctagagtatcatcagtcagtaaatggatgtcctttctggcataaaattaatagcctgggatttcactcagtaattggctattacataagacttcaccatttactgataggtaattcagaagtccctaaagttctttgtcagtcctctatagatgcaggcaatggagcatgtactctttctcaatcccccccccttttttttaaagctgtccatacatatctgaataattcttagtgtttgtatcaatgtggataatttcaatgtcaggtaacagaggagtggggtactgttgataatctctttcttaccagaagtcatgagaagctgcttattaagtgtgctatttctctcatatagtaagtcctcaaatgagtttccaaggttagttaattctagatttgaacaatgtcaaggggccagatttttccattttgacccatcatcctcagcctcttaacctctgttctgatacttgtcccctcctagacatgaggaacccacatatcatggtataataattacctgacacttattttaaaattctttctcagatttgagatataaatgattcgtaacattgtgtaaatttaaggtgtacaatgtaatatcctgatatatgtatatattgtgaaatgattaccatgagaagattagttaacacactcatcaaaccacatagtatgacattttctttcttttttttttttttgatatggtaagagctcttaagatttactctctcagaaactttcaagtatacaatatattattgttaactatagtcattatgttgttcattacatccccaggactaattcatcttatagctagaagtttgtatcctttgactttcttcatacatttgcctcccgcttcccctggaaaacaccaatttgctttctgtttctatgagctcccccccttttatgatttcatgtatgagaaagattgttcactatttgtcttctctgactgttttatttcacttagcacaatgttctcaagttccatccacattctcacaaacagcaggattttcttctttttatggctaaataatattccattgtctatatatgtgtatgtgtgtatgtccatgtcttggctgttgtagagaatgttacaataaatatggagtacagatatctcttccagatagtaactttatttctttcaaataaataccccgaagtagaattgctgaatctatagtaaatctattttcaagtttttgagaaaacttcatactgttttccatagtggttttaccaatttacaattccaccaggcatgcaaaaaatttccttttaatccacatcctccatggcacttgttatctcttacatttgttatgttaaccatcataatgtgaagttacaacttgatgtaatttttgatttgcatttcctgatcatttgtaatgtgaacatttttgcatgtatctgtttgccattttactatcttctttgaaaaaaaaaaagtctattcaggtcctttgcccatatttggttgtatcatttgtggtgactccagctttgttcttctcttttaggatactttggctacgtggaatcttttccggttcca

SEQ ID NO: 62039 - DNA, 678 bp, Bovine  19866881559877
aaattgagaagaaatttcgattgctctaattagttaataagtcgattgagatcctttgtgagctgactaggattccttttcctttactgtttaaacatataattttggatgttaaaaaattttaaagaaagacaatttcaatgtttttaactgctacttacttcactttgtaatcatgctgtattttgatgaatggatggactttttactgctggtttacgagaaccgaatttcaattatatcagaaaataatacatcttcatttagaaggcatttcatgtaggaaaaattaagttttccctgatctatatctaggcatatttttttttctgtttgtacatagataagattctctgaggcgctcatgaatattttggtggctcccatgggggtctgacatttcaatatttcctgtcacgcttgagaaggaagcatttcgcaaaattaaaggcactgataagcaaatccttcattaataaaacagactattaagtttgcagctcctgtacttaaaatttccctattttatctaaaattaatttgcaggtaccatgaaacttttttgaagtctgcagaaaagagagatgaagttaagggcaagattaaaaaaaaaaaaatggcttcatctatagtacatctctgctccacagatcattttcttctttatttaataattaa

SEQ ID NO: 62040 - DNA, 1531 bp, Bovine  19866881786272
ttgatttgtgacgtagttctttataggctcaaatatatccaaactaagattaatgttgcacaataaaaggagaatgttatgctaccagaatgttttattcaatatcagtagcatcagaaaaatgttgtagttcatttatgtgagtatgtataaaaatattttttggcaaggacttctattttagatgtgggaatactgcagcttgtttgaacatatttgtgaattatatgtgtcccacaacaataggggcttccctgatagctcagttggtaaagaatccacctgcaatgaggagaccctagtttgattcctgggtcagggagatcccctggagaatagaatgactagccactccagtattcttgcctggagaattccatgcaccagaggagcctggtgggctatggtccatggagtcacaaagagtcagacatgactgaagtgacagcacgatgcagcctgtgcagcaccttatttcagtactcatggtttatcagcaagtgccttgatgcttttgtctcgaaaggaaaaaggtaactattctgcatacggaacaactggaaaatgagtggcaggataccactgtttgctctttatccacatataaaaatgaaaactatgtccactacacatgtgtttaattcactattagaggaagttattacaaggctggaaatataaagcagagacctaccaaaactatctcatctatgtaagagcaaattttagtaataatattcagctttaaaaaaaagaaagaattctaaatcaggatattgggatagtcctcaccaattagaactcttccaagccaacggggatggatgtatgatcactctgtttttcagccgcaagtctgctgtgctcttaatgcacaagtcagctgttgacatcacttataacttctactgaatgcttccatttgacttcagttattcaattttcttcagctttcttcaagtatttatatattcagttcattagagatggatggattgacatttactttgtatattttcccattatatattcttagttaaatcttttctgtttgtatttgtcctgttaccctcactggactcactctctgtgttcttaaggactatagcctcttttgtaaatctcagcacataaatattgttgatttactaactacatggctctaatttaatgtttgcttgaaattaatttacatttaatgaatataccatttaatgctaaacatttaatgaactaacaattcacttcttataaagatcccttattccaggataggagttaaagaaaaacccagtattttctctgggccatttataatctaagacttaggccttatattgccaagtctatttttaagatgtctcatttattcatttgaagtgacagctactatagatattttcctaatattttttgatagttttaggtccagttagtttgagctgtttagaattctcagtagtttcccttcaaacacaaatgtcatattaaaaagaaaacaaagactaaactactcaagtcattccctatt

SEQ ID NO: 62041 - DNA, 669 bp, Bovine  19866882017019
ctagaaatacaattttaaaaaaactatccgaaataaaagtctaaaatatttcttccatcaataaataaaaacagaatatttagtaaatgtgtatgggagattaacatgctagttaatagcacattattttaagtaagatttgaaagtgtatagcacagtatttatacataggcattgttcaattatgcttttcttttttactcttcctttcataatgtatctgaatttataatgcagttttgggaaaatattccagagaaagaattgcacaagattcagtctaaaatcatttgtcatatcagatactgaaaaggccaaatttcttagtgttagaggaaagatgctattctaataaaatcacattgtcagatatagatcttatcagaaaaggaaagaataaacatcaggattcctggaaatacagtctacaagaatcagaagtctatgctgaaagaaagaataaaacgttcagtaagaacttccaaggtaaaactctttactcattgatctgtcttagtccaatactatgaaatgcccgattacttagtatccgtttcaaagttaaatgcctctcttgaggggaatgcaaggttttcactgaaatagctagatgctaagtaagaaagagtctttcagttaatacacttttccatgtgcttatataaggca

SEQ ID NO: 62042 - DNA, 2224 bp, Bovine  19866880379112
ttaattttcattgtttttccctgttaagtttcacatggcctcagagaagtcaagaggactttaccaatgagcttttaatggcacttctaatgcctcagcttgttttgtgacatattatccatttccccgcctcgtttctaagaccgtatatgtccagcaacagctgaggaagtctcaacatctcccatgacgtagggcacctcttagattgattagggcattgtcaacttcaagagaaagaaaccaaccccaaacttacttcagaagatcatagctgacgagcctgagtgtggtgctgctttccggcttgcagctagatttgaggtttccatgtcagtcccactcctgttgcttccttcagtgggactgatgccacgttagggcccgtgtggtgtactgcgcctcccatggctccactccaggtctctgcccatgatggtacactggctgcagcacaagctcttggattaaagtccattcagaaacgggaagctccattctccctgctgctgcagaattcccgagacccattctgattgccttcgtttctgaacccccgaccaggcctggagaatgtggcttgctgaacccagtactggacctctcctcaatccgggtagacccagagtgggagaaagtggcttcaaacaaaaatcagttcttttattgaagaaccaaaaaggtcagcaatacctcggtagtgctcatattgaaactctcagatatgggctgaattccaaaattcatatgctgaaaccctaaccctcagtagcctcaaaataggactgtatttgagatagggattaagttaaaataaagttattagagtaaaccctaacccaatgtacctggtgtccttacaagaagaggaagtttagacaaagagagaaaaaaatagccaagtatttaagacactactatttcccaggaacttaaataagtatcccagacagtgcagacatcatctcctttctaagcatcttgccttttatattaagatttttgtcattctttttaatcccccctcaaagacaatagcagcttgaattcttcagagcttgtacaattaatacagaaaagagctgaatctcacagtcatgaaagcaaacgattgaaagtcagtttttcccactttctatttggtttttgttcatttgaacttagatcatgcaaatattgcacaaaatgtaatctttgggagagaatttaaaagctcgacagtataataaaaattctctgcgcctgagatctttgattcaatgaaagatcacttcagttggggtgcttgttgttttatcagcagtatgaagaaaatgtttttagctgacacaataaaaaaaatgccattaaaaaataaataatgcatagtatttgaatccttctttcaagaaaaataaaaacatcctgtttcagttatttcagcagctcttctaactgctgaatgcttgcttctccaacttgtctcttctccctcctcccagaaatttgtctggttcatgaaattctttcctggtccatgttcacactgctattgtgttctattaaatgtgggatatcattacagcacgtgtcagtcatcagaaaaaacccaactccgaggctctgtatgtgtgtacgctagctcaataaattttagacaacagatgtagccgcaggttccaccttctgccactttcccagttcaataagaggtccagatggttcgctttgccctggtgtcttgaatcttggtatgaagatgctgactctggtgatctttctctggaaccttcctttgacccataggtccatggcaagctaagtgtcaatggagactgccttgcacgtatctggccatttggaatcctgggtcccttaacagttaaaaagcatcttgaagtctctcttagcattctgcatggagaaactgtcgaattacattttctcctctgcttttgaatgtttctacgcgctgcctaaggaagcccagggctgggagaaaggtcatcggggcatcagctctgcctcaggaagagccggagcccatctactaggaagacaggagaatccagctggaacttagagtttcccagctcggtcaagagaaaccaaggcaaccaacagtggtgttgacaaaagaatttaagatattaaaaaataaaagttaaggtcctaaattgtgtgtcctatgggataaacgcagttttgtttccattctctggaaaatgctcactctttaaggatt

SEQ ID NO: 62043 - DNA, 651 bp, Bovine  19866880388470
tcttgtgtgaatttgttttgaactttttatcatttttcaatatctttccgaatagatcctagtatacaccagacttctcagttatctaattttggaatcaggtttattttcctcccaaatgtcaacttcactagtgatgtatggcatttgggagaacagctggagtaaaacaaagctcaaagtctccaacattccagatgtcaaatagctgtctcttcatttacaggaatctgaacagcaagtgtgtaatgaaagttttagggaagactctcagacatggggaaacagaatatcaaagtgagaaaacaggtgttggactaattttgaaaaaagaagaagaagaaggtaaaacaccacagtaccaagtaaatcctctgcaatctgttgagcagctaatcccagaaaaggaaaaaataaaagcaggcaatttccaagcatcacagtatttgcaactgaagtttgtgtctaatttatgttgcttctataactacaagtgtagcaaaggtttaaggtattttttaagtgttcaaatgcccacagcaccaattcagcagccgcagctagagatgtgtctccagcatcagactagaagagcagcagagacgttcctcttctctcacttctcggtcttccttccttgcttttctttct

SEQ ID NO: 62044 - DNA, 797 bp, Bovine  19866880486237
agtcgaacacgactgagtgactgatctgatctgatctgatctgaaacaacacaccctcccctcgccaaagcatgcatctctgccacagcctttggaaacacataactggatccattgtgctgtcaggaaaagaaatatatggcgggaaccataatttatccagcgggagaagaactacacgtttgttctcgtgtgctctaatcacagcaccagagaaagaccaaagtgactttttggtacggtaaaggattagaagaatgtgtaataatttctcataaaagtacaagaaagctgatattaaagacctttaaaggataaatctcagcatgttgcacttttatgtatgcaagtgatagagagacaggtacagagccggaagagacgagaatccatgaggctggtactttgattagaggaagggctactggaatccaggcaggcacccatcccttcccctttcaatttcgtctttaaaagtcatacaggtcaggccagccccattcaccagtcctcaactacaaagagttgggagacggtgcctcaagacagcccatctttttcaatcattttgaaggaaacttcagtgataaaagcagatctgtgagtgggtacattttaattcacagttaacaaaagaacccatcttcactgtggatggccaaacaccagcccattaaaagccagtgtcagtgcaatgggggaacgttaagcatcactgcatgtgcaagtagaaccgactggtaaaaagtaaattgaacacaaagacactgacgctttgcaaaagtggaacaaaaaat

SEQ ID NO: 62045 - DNA, 2022 bp, Bovine  19866880499901
cctttattgagcccatctttgcatgaatgttcccttggcatctctaattttctttaagagatctctaagtcttccccattctattgttttcctctatttctttgcattgatcgctgaggaaggctttcttatctcttcgtgctattctttggaactctgccatcaaatgcttatatctttccttttctcctttgcttttcacttcttcttcttttcatagctatttgtaaggcctccccagacagccattttgctttgttgcatttttcttggggatggtcttgatccctgtctcctgtacagtgtcacgaacttcagtccatagttcatcaggtactctatctatcagatctagggcccttaaatctatttctcatttccactgtataatcataaggggtttgatttaggtcatacctgaatggtctagtggttttccctactttcttcaatttaagtctgaatttggcaataaggagtttatgatctgagccacagtaagctcctggtcttgtttttgctgactgtatagagcttctccatctttggctgcaaagaatataatcaatctgatttcggtgttgaccatcttttgatgtccatgtgtagagtcttctcttgtgttctctaagctcaggctgctataacaaaatatgtagaccaggtggcttccacagcagagttttctctctcacatttttagaggctgggaagtccaggatgaagtgcctgcagacccctcttcctggcttgcagacagcagccttcttgctaggtgctcacatgccagagagggagacagggctctggtctctctttctcttctcctaaaagcactaatcttattcacaaggggtccacggtcataatctcctctaagtctaatcatctcccaaaggtccaaagatcaccacactggggagaggagaggaacttagcttgtgaattttgaagggacacattcagtccacaacactgtccttattaaaagcgtaataattaaaatgaaaggagtgtccgtttgaaatggaacacatgtaacagtactcttctacttggacatctggctataaaacaaaatcctgtcacacactgaaatagaacgttatagccacagctgcacaaaggcaggaattaacccaaaggcctttgtgactccatggacatagcccaccaggctcttctgtccatgcgattctccagacaagagtactggagtgggtagccagtccattctccaggggatcttccccatgcagggattgaacccaggtctcctgcattgtaggcagattctttaccatctgagccaccaggaaagcccaaaagctgcccacttcaatacattcagagcagagatccactctcactcaaacacgaacacctcatgccttgctctctgcatcccgttcaaccaattattgttgttatttctatgattattaagttcttctgaacagaaagtccagaggtttctgcagtctgccagagcaggtgcccaagttcatcaaaggtcgttctctcactgggtgccaccaagcaccagggcagaggctgaaatggcacgtgtccaaaatctttaccaaaaataacttgagctttggccccgtgggctgctgctctcagtgggactgtcacagaaacacgtgcagccttggccccgcgaggcgaggccgcgccaacgaggaggatagggctgcagattggccacctgggaagctcagtcagtcctcattaccctttgcttattgagaagtgcttcctccaaggctgaatgaaatttccaggaggcccttggcccctttgactactaatgtgtcatgaagagttcagctgagcctagcaaccacagaacaccaacacctctcagcgcagggtgtatccgccagtccggtcaggcctgagagcgcgctggggttgggagcgggatcttcactgactttctgagctgcctcctcctccaggtaataactgcaggcgtcagagacctccagggtggagaggctgcaacacagagaagct

SEQ ID NO: 62046 - DNA, 1561 bp, Bovine  19866880560619
ttatatctccgactggttactactgaagaaacgatttacaggaaaagttgaactacacctggctatttatctgcagccatcgtggcataaacgttggatgtacagtgagctgtgctaagaaatgatttatctccacgtgctattgattctctcgtgagtcaggaaaggtgcaattgagcagagtgatgtgtgatttatgaagaggtatcaaagaatagaaatcggatgtctccatagctgggtccatttgatttcccctcttgctgcgttgaacacagatacatttcacaactgaatcaggtacctactgcgggtactgggtcccagctaactattcagaaaggcagatttaattgtcaacaagaacagtttatcattgctaagatcctttaaattgtgcttgtcaacccagaagtgttctttgcaaacgctgtgaggttcatctcctcgttcacagtacaagctcggcgtcctctcagcgtgagtcttttcagtcggaagtccttgctgcaggacttgtcacatccccagatattttagtctcttgtttcatctccttgaatctttgctgatttgatgtatgtgtgtaattagtaattattaatatataacacataaagtgtatcatgttagtgatatgatatgagttcctgagccaaaaccatccaacaaagctgtgtgttttcttaactctcagagactgtgcagagcaatatgtgcttgctgttttaagttgctgagcttgggggtaatttgttacacagtgatagatactttactggccattgcaaaccctgctttggcctttgacattcctagcctctgctctcttttcttaccatctctttctctctctccctttctttatttcttgttctatagcccttggcattcctttgttcattacttgtgtttattgtctcgctctctccttctaaaaggtaagtttcacaaagatccaggttttgatttgtgttgttaagtattatagcttcagtgcctggtatagagggtctcagtgaatgtctattgaaagagtaaataagtacaagaggcatgcaactgtcctgcttaattatggtttagagaagagtttcatattcaggtttttggctttgtttcatctagctttggtcccaactcagatctaccccagactcggaacattttagaagtttaggttcagagaactaagagataagattcccgctgtttgagggaattttttaaaaatgtcattaaaaatctgattcttttttctaggtggttataaattttggtaaatttgcctgctggggaaagagggatgaaacaaatggccttctgtttaaatgactttcacttgagtttaatttcatttgtgcatagcttcagtatgaagttggtttcggattcttttgataagtagcaaagctgaagaaatggtggcaatcacagtgggctgtatgtgtgtatgggggggggtggggggcacccaaggcttcggtctttctcttttttccttattgattccagcttttcatcttgtctgcctttccaaagagacgctaaatttttgttt

SEQ ID NO: 62047 - DNA, 1575 bp, Bovine  19866880586121
catagagagtgaacagcatcaagagcaccagggccatggcttcattttggcgcataagctggatggagagacgacgccaccaaaaaagacagtcctgcggctctgactcattctcctgatttatctaatttaccttgaaggttaatgtattctaaactaattccgagattaataaccacttaaagacacatgagagacatttcactctctgcgagcactgagtcataacctcgctcattgcctctccaatgactttgggagttatctgatgagacttaaagggagatttgattgcaggatatggggacggacaggtgcaatgcataaagggctttaggacttattcctgttaataataaaaacaagcttgtaatttgattttcagtactaggatccttggaagcaaatatttattttcggggtggaaatcatttttatttatcaagcgagataattgaatatgccgttatgcaaaaagggaaagattgctcttaggataaaaagtgacacgcatgtttttatttcacctcatttcatttatttagtccaaaccagcagcccgttgctgagagatccctgcgtgtgggcatcttaaatacaggttcatcaagagtgttttctctctcctatttccatcagttggacatagtatttaccaatcttgtgtggttcacatcatttgggcatcgttaaagctgaggtatttcttgttgtgaatttattgagtgctgtctgactctttgcgatcccatggactgtatcctgccaggctcctctgtccatgggatttcccaggcaaggacactgaagtgacttgccatttcctcctccaggggatgtttctgacccagggatcaaacccacgtctcctgcattggcaggcagaattctttaccactgagccaccagggaagccccccagcccaataaagggcaagatcctgtcaacaaagctttctcttctacagaaggcaggcagaaaaggggacgacagaggaggtggttggatggcatcacccactccatggacaagtctgagcaagctctaggggatggtgaaggacagggaagcctcgtgtgctgcagtccatggggttgcaagagtcagacatgcctgagagcctggacacagctccttgtggtatttcccctccactttcctcgaccttcttttttcatcattgatctccttttccattgatctaactcaacttgcaattcccaagtttaaagtgaacgctgatacgtagtcagtgagattatatgggaggggaagaagtggcggggaagcactgttagggtttatagttatcggagcgaatggaatgaaaaccagtacttccctcacctccgcttcgagctgtgatctgcagctacttaagagaacagaattgaatttaggcttttggacaaatccccttctcttccttctcctcatcatccctagttcagcatacatgagagatttcctagactgtttctcttttgctacttagagctcttccacgagggaggtgactttattgtctcccagtttacaaagaaagccttcattttctgtttccctgcaaacgt

SEQ ID NO: 62048 - DNA, 1274 bp, Bovine  19866880589887
ccatcgagtcagtgatgccatccagccctggaaaaactgaggtcatacataatcttaaatgaaaaattaatgaaaaaaggaggtctgctttccctttttctctatccacttctattattgtgttacctaccttcatatcctggtaataataaatacaaaagctaaaaataaatgttccatcacattcttgatctttttaaatgtggataaactttttggtttggaggaagtcctttctatacagaaattgctatcccagaaaactgactctgtgaccactttccaggatgcctagggggaaaaaaatcagataaaggaaaacatatttaattagtttttcttccaggcaaggagagaatacaaagcaaaggaaatagactttatgtcctcttactattttggtggaaataaggcataatggaaaaagtaacatcacagaagtggaaattcctttgagaaaagtgatgacagattcataagaatgatgagttacagctgatgctccagaatgtcagggtacattctgagctctatgtgcagaataatggactttatgagctgactgcacgtcgtgatgtatgtgtgcccagtctgttccagcacttcgttttgctttgtttttaaagaataaaatgacacacaagtcttttccttccattattagaaggaaatttcaagaccaccatatcaaaaaaggacaccaggcttcctttttgttagattttaactaatatgactttcagatttcagaaataatacatgctcattgtagaaaatttggaaaatgcagaaaatcattatagagaaaggaaatactgatttacactattactcaatcactgtaacatttatatataatgtacttgtatgtatttacatatgtcatatatgtgtgtgtctaatataaattcaattcataaaatcataaacacactcttctaagcactgatggcaatttttttaaaaaataaagtaattcattgaataccataattaaattgcttcattttattattgtaagtaatgtaataatacattaatatataataattgagaatttaattgtttactatcttatcacaaatttactgaaatggaattgctgagtcataggttagatttctttttatatgtatagtatgtttctccacttttatttggagacatccaaatttggccagacatcctggaatgcgaagtcaagtgggccttagaaagcatcactatgaacaaagctagggaggtaatgcaattccaattgagctattccaaat

SEQ ID NO: 62049 - DNA, 1065 bp, Bovine  19866880637445
gaaaagttcccgtggacagagaagcctggcggtccatgtgggcgcacagagtcggacacgacttagtgactcaacaacaacaattctacagcaggaaggtgtgtttggggggtggggcgggggggtgaaggtaagttaggattgttttctgttctgccagaatctaatttctgtaatcgcatcaattttccctcttctccaggcaactccagaagttggtgatggacagggaggcctggtgtgctgcagtccatggggtcgcaaactgaactgagcgactgaactgaactgaactgaaccaggcatctctccaccccagccatatcatgtatcctcatcatatataagcctcatttctcacattctagtcctatttttatttattctctaaaacaagtcaaatattctctttgtctggggagttaatatcaataccaagcattagccgaaaactttctgcatgcagaatgctaattcctttttgtgcattatctcaactaacctacccacagccccataaaacagaggctatcattcttcccatttcacaacgaggaaatagaccttagtgaggttcctcactgggtgttagttactcaagagcatgaaactagagagacaagccagtattccaaccttggtttgcctgattctggagaaaaagctcttaaccattcctccaggattttcccagaaaagctggtctcctagagacattcaaacttctgctgagggtcgagccgtctgttagaagttgattttcatgcttatcataatctataaagagacatttagttgtaaccatatgctctttcatctggacaacgactttaccgtctagctatttcagtgtgacatttgcatttgtgattttaagttccctggcaccaagcattggccaagagtgaaaattttaatggagtatctctgcaattggggtctgaagaccctattccgggactgcaagcccagcagtttgtaagatgtgttttcttttaaaagaactccaccctctccttaagtgacaaagtattcaggatccctgaccgcagctcagaaactcaa

SEQ ID NO: 62050 - DNA, 1268 bp, Bovine  19866880645263
tagacattctgggaagctacagtactccttcatttcctcatctgatccttttgcttaatttctacatctgatgggttttgctcttgaaaacccacttgctaatttgtatttactttctcttcctccctgcgtttcttccttccaacctcgcttgttcctctgagagcctacttcccaataaatcctttagcctgaaagtgttgattcagcttatttttctacagaactgggctaataaaattggaaagtggctttttgatgaagaatattgttttgctgcagctgataaggatataatcaaaagttatgtgctatttggcatcagactgcccctgaattgacatatgtgcccttctcttcaccttcttatgccttctcacttaagattctggtgctcagtgtaatgtggtgagttgttgaaaaggagcagatgagaaaaagcatgcccaggacactttctcaaggtctttggaccctctcagagtggccgctcttaataaatatgtaggatgtgtgtgagcccccgactccttgctgtcgtgcattatttactattgatgagaactgtgcactggtcctttacggagcatatcaggtcattgcttttgattcccttatgctccaaagggcatttaaaacaaagctcaatattcaagttgaatgttgatgctttgggagaggagagtggtgtcctcaagtacagcaggcttgccatgagatgaattgctggggtgttgagcaaccttatttttagcacttttattctgcttgtcctaagagacagagtgccttactagtttatcatgttgttggacacctaacatatatttataattgtgttcttagagctctcattcgtgtcagcaagtattgatcagtcacatttatctggcctatatttccatgcattcaaactggggaggatacaaatgtagtctgatataaagcttattcttaaatggtttagcatggagggactgggggaaggcctgtgacacacatgaggtgatcacacaacccagacctgagcacaggaaaaatacaagaagaaacgaaaactattatttttttttttttttgcatgaacaaagcatatcatgagtgctacccagcagtcacagtgagaagaaatctctgaggactcaaatctttgaggactttgagacttcttaaagaaatagtagtaataaacaactgttccctacaaggggaaacatatagtgtgggtcttaggaaataagttagagtaatggaaaatgcattcacag

SEQ ID NO: 62051 - DNA, 2259 bp, Bovine  19866880665021
gctggctgaagccgagagtatttcttccccaacatggggcacgtcctcgactgtcacagacacctccccacctcccaagcattctaacaatgacagtgttagcccaaagcaaggcggctagaaatccctcttccataaaagcctcagtgacttgatggttgaggagataataaggcatggggaactagccagttctgccgcctctacagagagcagctgctgctccacctgtgggagtgctctgttcatctgtgggagctccgctgagagggccatccagggtagacccaggcccagcgtttctggtctgaacacaccttggttcggggtgagattacctcactcatcacctcgagggcagaagcgtgggacaactgcgtgggggtgtgactcgtttgcagggccttcccatcagctccctgcgggctcatgttcatcgcttctcccaggacctggtcctcagaggccccacacctgccgctcttgacggagtaggagggcaccttattgcctttgtagcatcttggttttgtgttaatggcagctgtaacaccaaaaattcacccatcatttatacttaccccttgtcctgccgcacacggccggcggtaaatgcgcagaatgaggatgtgtaaggacccggttgtgtaaaagttagagcttgtgcactgttaccttagtgccccgttcctgcatggttatgtgcttttaaagacctccatatgtggttacaacaccagttacaaacaccagtcactagctaaaagctattcaaatcctgcagacaataccatctaagctgcctgagggatttcttttcttccttctatgatttttcaaaggccttctagaatggttcagactcaaggcaaataggtaatataaaactttcaggaaaacctgtattctgagtaatacttgatgctatcatcctccatgtatttatattggctccaacaaactattatttaacctggaactagaatcatgtattttgaaaggctgaaagcatgactcactatttacatcaaggcctatttaaacaccagcgttttatagcatttcatcaattccttctccccaccccattccaaatcagataaaatgaaagcaaaataccatttccgtaaactgtggtctctttttttaaagacagttttctgctttttcattacattaagttttcactatcgtttgaactcaaatgtcatttcatgctaatgactaaatctttatagtaactatggcaattaaaaaaaaagcagagtctcttcccatcaaaacgaattctgccttcaaatgcattttttctcccttactcacccagagagacccaccgtcttcatcactggcactgataatccaacgtaattaggcccagtggacataatgcctggggcccagactgtaacttaggagcccacgaaaacattttcaattctttcaaaatcagaaagaaaaaaaaaaaaatactgaatgtactaacccagccctgagttacatttctctttatgccaaggcaatcataaactatactttgtcatatttgtcttatggaggaaaggctcaagaaggcgaaagtgctcgaggaccgtgaaaatgtctacacaagcagtgtggttcagggagactgtggaagtcacttagaatcaacccacacaacagaattcagtcaaaaccgtacaaatgcaacgctacgcagttacatggcgtcgagcggccactctgagcctccgttttctcgtaggacgagtcacaggagtactgagccccgtggtacctcaggccgggcggggaaggcgcggcgtttgctctcatgcagccttttggcccagcagccccagcggcttgttcttgtgcagcagctgatacaatcgtcaggacagcacagggccaccggggggagcagggactctgcacttagcaagtgtggtctcggccagtgtccctcctgggaggcggcgtacacaagggcgcctcagccacgagcctccctggggtgaaccggcgagccctgagggagctcaggagggagaagagagcctgccgccctacagccatcaggcggcagccattcctccggggagccctgaggaaagggagctcaggggagaggagagcctgcagccctacagccatcagacggttgccattcctccggggagccctgaggaaagggagctcaggggagaggagagcctgcagccctacagccatcagacggctgccattcctccggggagccctgaggaaagggag

SEQ ID NO: 62052 - DNA, 1996 bp, Bovine  19866880674740
tttgtgttgaatattgtgattatatgattctttcaggctgatcagtgtaggcgtgtaagaagcgccagttctctcaaaatatcttttgaactttattcatctaactatggttttctttttcttttaaaagtttctttcttttaatggctctaaattaatctcagtagtcatttttatttgatgatctatcatgcatattgacacagtcatctttccaaaagtcagatttccagaattcaggaaactttaaaaagcctcaagcttattctaccaacatcttgtatgtttttgaaggattaattgataacctcatgtgatcatttaagaactttttttttttttctgtcctaaaaaccatccagaaattccaagaacttccagtagattttgtctccttgatattttatttctctctatggaagtttagggaagagagaagaaaaatctttggagggatacattgtaattttcttttcaagatggttggtactgatgcaatacctggcccctgacagtaatatctgctagacttacatctgctctgaagctggtgtgtgcctacaggaccccaagcatctcaaaccacaaacaagatgtcaggcagacactcggggatccttgtctcttcaaaatgcatcatttaagtggttaagagcttggagggtgccctccccaagcctcagttttgcttctatgtctttttgttcattgaacaatgtaacagagaacccacagttatgataagcctgagaaccacccgtgtccactggagaccgaatgactgtcagaaagattttcatcctcgttaggctcctactgtgccgaaaagtaacaggcagatattcctgttttgctacagttctaatgactttcttgagatggttctctctcttttcctctgtcttgctctctcaaaagtttgaagatgtcagattcgctttctttaggacttttaaagagcagtcagtattttgtagatagactcatttgtgccgtgttagagtccacgtataagtggtatcatacgatgctcgtctttctgactgccttcaccgagcaggcagtctctggttgcatccgtgtggttgcagatggcatcatttccttcttttttgtgactgggcaatgttccactgtcaatgtctactgcatcttcatccatttgtctgtcggtggacatttaggttattgtacagctgagactggcacaacgttgctaattattgttaatttgtttttaataaatgaatgatatagttagtaataatttattagttattgttattcagttgcaaagttgtgtccgactctttctgacctgatggactgcagcatgccgggcttctgtgtccttcactgtctcctggagtttgttcaaattcatgtccattgagtcagggatgctttctaatcatccatcttctggcatccccttcttctcccatcttcagtctttcccagcatcaggctcttttccaatgagtcaacccttcacatcaggtggccaaagtattggagcctcagcttcagcttgagtcctttcagtgaatatttagggtttatttcctttaggatggactggtgtgatctccttgcagtccatgggactctccagcatcttctccagcactgtaatttgaaaacatcacttctttggcacttagccttcttggtggtccagttctcacctctgtatatgactactggaaaaattagctatagtttaatttaaaaaaatagaatggaataaaagggccattactttgattttttaaaaggtattacttcttgctttgttccattattgagcagagaactgtaaaatggctcctaacaaggatgtaggggactagatgagcagtctccagcagcaatagtcaaaagcatcttgcttatactaaggcaatggtattctgtttgcctgctcacatcctgtctccctgggcaagtgaccagtctcccaggaagaaatagaccccaaacagcaacaccactt

SEQ ID NO: 62053 - DNA, 1146 bp, Bovine  19866880695078
ccctcaactccttaagtcgctgcaagaacgggaaaggcctcaatgcattgaatggtccacagatacactcggattgttcaacaacaattgccagttcaactctgtgctaataaatacttttagtgggacctgaaaagaaccacggtgtcagtgttctatccttctttgctaaccagtcagcagagggttcagcatccagtcccctctggagtttacatctgattttccacaaaaacccctaaactcaacattttcttgaatgtttcgctgtgtggtgcctattgtcgtctgcccacacccttttctagctcccattttcctgttcaatatgaaatttttgtttcaatggaagctgactcccaacatcagagtcctggaacaaggcaaagaacagttgatggcaacatgtaccttactatttttcccccttaagaagaaaatctcaaaagcccaagatgacagccaccatgaagaaagcagcagtaacagacactgttacttttaaaaatcaacaaaagacacattttcacagtacacaagtagaatcacagagctgaagcaagaaacaaaaaggaaacagttctaaaacttagagatgcttgtgaggacatcatgcttgtagatgaggactgcttaatgatatcagactggcaatcttcccatcaggcactcttgaggaaaaacatgagaaatgctggaagaagcaaaaaaaactttgcatgaagaaactgacaccttagaatgcaaagtggaatcaattcagcaggtgtgagcagatctgagagttgagttatatgcaacctctgggagcaacacaagccctgaagctgatgaaagctaagcattttataatactttaagaatgcgtttttaataagcttgagtagtgtttaaaataatttcccttcttcaaatgatatggaaagcaaaacttaaatttttttcacttacttaatggaaactcatggaaatttaagaggatgagatggttggatggcatcaccaactcgatggacatgagtctgagcaagctctgggagttagtgatggacagggaagcccagcgtgctgcagtccatagggtcgcaaagagctggacaagactaacgactgaagtgaactggatggaaatttgcctatttaaca

SEQ ID NO: 62054 - DNA, 1249 bp, Bovine  19866880702491
ctaatgtaattgatttagaatcctaagaaaacccgtttttccctttttttgtgtgagacatgttgatgtaagaccaaaagcagtaactagtcatctctttggaggacagaggtgacctgatgaaagaggaaagtgataaggagagagtgggaaaaaatacaaaacgcgatctgtacctaaacatccacttctgagatttaatttattcttttggagctttatttcccccaagtggtcgtcttcaaggacagaattcattcaaattcagatacacatgcaaagaatcagtatgtataccatgggcctgagtacctctgtaaaataaacaagaaacatagagctattaacaagtaagatgaagcaagaattacagacacaaaagcatcgtcctctttttaaaatgtttacactgggttttcttaagcactgaaaaccttgaaagggctttaagatgcttcctggagccatttgtctaattggatgtcgaggaattcgatgacttcttaaagaatacattaattcaaagaaaactgaaagtcatttgtaattataatgagtaggtttctctgcctcctttcagaattgatgatgagcttgctggcacagttcctccttgtatgcatctttatctctcttttaaatctccttcactatcagctatttattttaccaaaggtaatcactgcttttttaatcaccgcttgactacagcgggatttgaaagaagcttgtttggactggaaacaccacgcgctgcaggtggtggctcaagcttgggccgcttgccctttgtcttcccccttggcttccccttggcttccacgggaactcccctgtgctcctggaagggtccaggtgcccttgaaaagaaggtgttttctgcatccctgggaagagtgttctaatatgtcaattagggtccatgggttggtttcctgccaacttactctcttcatttttgagagagggctattggaatctctgactgtgattatggatttatttcttctttcaactctatcagctttgtttcctgtatttcaaacctctggtgctaggtgcataaatatttagaatatttaggttgaaggtcagctccccattgagagccaaattccaggttgtatgttattacctacttctgttccaagaacctttgctgaaactgtggagagtaccaaaacccatacacactatgttttttcctatctatacatatctatataaagtctatttataacttatgcac

SEQ ID NO: 62055 - DNA, 587 bp, Bovine  19866880814980
atttaatctctaggtcagcaaatacccaaagattatcccagaataattgctctaataatcgtgattttataaactggtgatcagtttaactgagtataatgatttatgaataactatttgaagaggtaaaaacaaggcaatgtaggatttcattttgcagcatatccaaacatgctttttccttattaaccatgcagcaccaaatgttcactgttaacatatttcattcaacatcttagtgtataaattattgatggaatcattttaatagttccttagttaaaattcaagtatgagtttcatttttagggcataaagtgcttgttctggataaaagcatctaggttgtcaatttctcctgtaactactggctttttgtgtagttttacgcagttttagccaacttggctcagttctatattctctgtgttgcgttcagtggctcagtcatttttgactctgcgacaccctggactgtagcccaccagactcctctgtccgtggaagtttccgggcaagagtactggagtgggtagccatttcctcctccagctatattccccaagtaccagagaagatgtgctgcg

SEQ ID NO: 62056 - DNA, 1505 bp, Bovine  19866880822894
gtgctagattggggggttccaatggtactgtcaggatttggtttgcttctctgaacctcttgatctgcttcttctgtgtggcctccactcccaatgcttctgggctctgtccatctagactctatttcagccaaacctttggcccagtagtcatcaaaagtaacatgtgtcttagtgcaccaacttaggtcacgtgtccaggtctaaagccatcagtgtgtttgaaagaaggcagtgtacaaggctgcacacctgtgctggtggttgcacctcaggtaacagcagtgaccctagcggaagaggcttatttacatgctctggaagcaagcaaaaatgggtacatatgaagttccaagtgttcaaattgagttaaaagcagggattgaaataacgatttttctgtatcagacttatctctagtgaaaccgcattgtgtgtggctgtgtgtctgacttacacaagttgtgcaccgtgcaactctacaggcactatttacgttgtgcctctctgcgaattactactttctcttcagcagtaggtttccaaatgattttttaaattatttcatcctcttttggtgagagatttaaacttaaaacatcattttcattgaatgacaacatgatgacagagctgatggtttactgtataacaaagagagttctccttgtcagaagatttgatttttgatggtcccaatttagtctcagttcctctgtgacacattctagggtgattctcttctttaattgacacccatcaaaccaagatggctcaaagccagtgttcccagggagaaagattcctataatcttagagttgaaaacctttgaatgtcatcaggtcagagaacccactaaataaatagatgaatcttttcctcaatagctctgagcaaagatcacccagccttcactcggtcacctccagggcacaagcactgtcagatttctgactccatctttgcctctgtggacagtacaagtgattgtaaagattttttggaaatcaactagtaacctccctccccctgacatctgctcttcagaaggggtatgttgttgttcagtcactaagtcatatccgactcttaataaccccatggactgcagcatgccaggctcctctgtcctctacagcctcctggagtttgctattgagtcagtgatgctatccaaccatctcatcctctgctgcctacttctccttttgcttttaatctttgccagcatcaggggcttttccaatgagtcaggtcttcacgtcaggtggccaaagtactggagcttcagcacccagtccttccaatattcagggttgatttcctttaggattgactggtttgctctcctttcagtccaaaggcactctcaagagtcttctccagcaccacagttcaaaagcttcagttctttggtgctcagtcttctttagggcccaactctcacatccatcaggactactggaaagatcatagctttgactatagggacctttgtggcaaa

SEQ ID NO: 62057 - DNA, 847 bp, Bovine  19866880902365
gagcactgaccggacactgtctatttttctcctggttgtggtcttggtggacacgccaaagaaaaatgtaagtttaaaagtggtagtttcccagcccacatttaattctattttttttttctgctgaatttctgctgtaggttgaagtcaatgttgtcaggaggccagattgggatacagatttagcacacggataacattttgtcagcaaggtcaaagcactgtctgtggaaaatgaaatctgattgctttacacagtcttctgaatcccggttatgggcaaggtacagagtctgtgagtggaagtgaatcctgaaactttgctgttgtttaatcactcagtcgtgtctgactctctgcaaccccatggactgcagcacgccaggcctccctgtccgtcactttctccggagcctgctcaaactcgtgtccattcggtcggtgatgccatccaaccatctcatgctctgccatccccttctcctcctgccttcaatctttcccagcagcagggtctttcccaatgagtcggctcttcacatcaggtgaccaaagtattggagcttcagcatcagtccttctaatcagtcctgaaactcgtctctccttaaatcaccacgttctttggacaatgagggaaaaggaagaaaaagtccacccacaagtgacaaatgatcgacaccgcttgcttgctgagggaagctgactaatctgtcacctctgaaatgatttctaggtgttacaaaatgagctcgcccatatttcacgcttgcaaggacaggaggcagtaaattctgagcaagcttcgttgccctgtaataagttgctcacatcgtcttcactctgg

SEQ ID NO: 62058 - DNA, 1965 bp, Bovine  19866880911328
tccttgggactctgggccgctgcccaccccctggcctgcatgtcagagcgcacttctccatggcagctcgcctggactgaaggccaggtcaagtgtctttgattaggggaatttatgtcattatttgcttgcatcaagcagagctgagaaaggtgagtttgtgttcgtgtttttattctgctagtggaaggcagaattcccaaggtgagaagcgaagtaggagaccttccgagcggccgtggctacccccacggtgcactccggggccgtggagcggtctggggctgtccagagggcagtgtgccagtgggctcctgtgtgcttccgtgggaagtgccgtctaaaaaacgtgagaccctcttattttagtgtgataattcctttgtgaaagggtctcttagagcgtgggtgtcccaaatgacaagtgggttttaccctctattcgagaattttgagtgcatttttcattgctgctcacttctgatatacagaaacaactccagaatttagaagatgcctgtgaggacatcatgcttgcagatgacgactgcttaatgataccttatcagattggcgatgttttcattagtcattctcaagaagaaacacaagaaatgttagaagaagccaaggtatgttgaaatctctccctggagggtgaagtttacctcttaaattagggttttatgtcattataaagaatgtgtaattataggtgtagggaaaagaagggatgctagctaacatttcatggatccttccgatgtccgaggtcttctctgaatgcttgtaaacatgattttgtttaatctcaaggatgactctgtggcatatttgtgggaatcccagtttagagttgaagaagaacagagtcttaggttatgggactcacccagagtgacaaaggggatgatccctgagcccagaagctgtggcctaaattaatagttttcagaaagtacagaatatcgtaaaacagaaaatgacgaccactcgtagccccaccacccagagttaatcgtccgtggcagacagtttcatgtatttctttcatgttctcttcctctgggtatttttgcgtcacattttggccagttcacatcctagtgggagtactttattgttccactcagtgttcatttatccagcaggtcttctccaggagcctgttggggccacatgtgcgttaaaagcatcacttttgacggccgttcagtgtcgtgttagaggactttgattcagctcactgtcctctccttacagtaatttgttttcactgtttttctgtaggaatattgtggtgaacattcttattaaatctttgttcacctttaggaagtttctttaaggaaacaatcagagaagtgtaattactgggtcagaatatggattcattgacaacatttgggcttgttaaaaattcaggttattgagtccagcgccaagaattccttattcgtgaggcctggaaggggcgcccccggtgacctgggggcccccgctttgagaaccactggctagatttctaacatgttaacattgctgatactagacattcttcttttattccagatgttaacgggtatgtgtattatttgtgtgattccattttttctttgtcatatttaggaaaaatccttttgaccctggccaggaagggatttctgacattgcatgcattttgtgtggcaaagcttctctgtcataagtgagactcattacggctctttcagagtctgactccaggggcctcatagttaggaaacctgccagattttgataagttgttactcgtaattattggtgggagtgtgaatctttatcacttcctctagttccatagttatttttgtgggaagttggaagaggctgtgtcagaaggcaggcccgtggtaaactgtttacctaaaatgtttatatatcattctttctttattgggatatgatcatttattttatcctact

SEQ ID NO: 62059 - DNA, 803 bp, Bovine  19866881047962
aggagggctttgcagaattattcagaataatgaaagaggaggaaggtgtcaacttggcatccatcaagctggaagatatgacttccccaggggagacttcgtgtctgtatctctgaaaggagccctctattcaatgcacgtgtccagtaacaagagcagttacagcacaggagaggcagaagactctcaagtaatcagaatccaaaatccttagggatttgtcttgaattgtaccttgcagtgaactgagtgccaaaggttgggtgtcggtaattaaatccctttagaataagtaactgcagtctcagcattccagatgttggggtcattccaacatcattcaaattatacacatatatccccccaataacatttcctatttttttaagtcttcacaaaataagggtccacagcctgttcccctgttctgttgaaaacttaatcagtcccagtagctgaattttttcatatttatttcatcatagtaattctccttaaaatgaatcactgtctttttgttctactctctgcaagacagaggataattagccaacatcgactgcttaaaatccttcatgtatttgaaaactattaattagtcaacccacagcccacttttctccaacattaataatctcagtgtcttttatcttctttgaaagtcttattctgcagtcatttttgtgactcacttctgaattaagttaacctctccaaagcttgttgaatgaaccagtgaaatgaatggaatgatccgtgatggcaggatggcagcctgcaagggaataggagatttttatttt

SEQ ID NO: 62060 - DNA, 1111 bp, Bovine  19866881252893
ggctgtcgtctatggggtcgcacagagtcagacacgactgaagcgacttagcagcagcagcattgtggatcaaagtaggaaattttgtccttaattagtatgaaatgagcttaactcggaacatcattaagctgacatgctatacgtttccggattaatcacattttcctgtgtctgtagattcagaaatcagaaatattatattaataggattctgaagctcaggcctagtaaggtgacagggagataccctgccagtaatgaacaaaaggcaacattcataaaaatgtctcttttaatatcaggaggtgtgctagagagggaaagatagttactctgggaaagtgtatggtcatgactggaaaaattaaaagaggaaacacaatctcattttctttgggaatatgtaaagtaaggcattttattgggaaaagatttagtcaaatttacattttactcattagaaatttttcctagaaatgatattaaaggaatggaaagcatcctataaactgaatgggtcaaatattttaccagaaaagactcaaactcagttcaacattttgccaatttaaggtgtggtgggaagagtcaaatttttactcatctccctgagttgatttgcctggctcgtttcttgggaattgtgcagacaaccaatgtccaagttaaattcattgctttattcgagactttgagtgatggcaaaaaatattacggtagcattcgttacatgtctcattaaaagttaggcatctcatactgattcacgatccatcagccttttacatgactctttagggttctctcactgtggggttagcactgacttgatttgggtcccttagaccactagcttcaatgaagggcaaaaggtaagagacacagaaaccttttcctattagccaataggctagaataaggaaagataaaatgcaaagcatatatttttctataagatactctctgtttttttttctttttgctaaagtaaaaccccttctgggttcttgtcaggtggaacatgtctgttgatctgaaacttttcacttctaaatactgtacataaattatgtgattggggagtttactggcattcatttgatccagt

SEQ ID NO: 62061 - DNA, 706 bp, Bovine  19866881260301
ccgaggtttaggtgaaataaaaggttatttttacttcttgcctttatacacttttctaacttcaaaagttttacatcaagatgtcttatgtttcattatatgggggaaaaaacagtttaagaaaagagaggagaggactttctttacataccactctgctctctctcaactccggtggccagtaagtcaggctctccgaggctgatgtcattgacccgcgtccccacacactccatctggaggactttgcaccactcgtcagcctcaagatctgcggagacgccagagatgagcgcggctgcccggcgcctgccggggagcacagagccgcggcccccaccccgccaacacacctgactcgcaagcgaaggtcttggaggtgtcatcacggaagtaaatcccgatggcgtgcttcttggtgctttttggcagccgagctacgctcttcacgttgttgagttctgtaacctgaaaaatgaaccacagtgagctagagcacagaaagaaagctcccactgacaccgagcagaagggagcaggcccgtcccaggggaacacaaagggggcctgccagaagaagagcgtgtccggcgattatttcagtgttgccctcagagccctagcaaggaggttaacacattgcctccccttgtcagatttctctgaagctaacaggcgccacagcctcagagcttcacagacgtag

SEQ ID NO: 62062 - DNA, 1296 bp, Bovine  19866881281653
gaaatactgtcgggaacttggcactggccttcgattcagaaagtgctcttctagtgtgaactggagaccctgtggaatgagactgcagttgttcgggtctatttaagtcttcacatttatgcattccgtcttccaaggactgggaggtcctcataacaccgccagtcggttaatgagatgtaactgagaatagaggccgtggtgttgaagcctaacctcgcctcatccgggcagatccgtaaaatcttggtgactggctgtgtcctactctttgcagccccatggactgtagcccgccaggctcctctgtccacagaattctccaggcaagaatactggagtgggttgccatttcctgctccaggggaccttcccgacccagggatcgaacctgcagctcctgtgtctcctgcagaagttggcggctgctttgcctccagcgccgcctgggaagcccagtcaagaagataggcatttgctaataaagagagttttatgattttagggaaatctgtgatgtccaaattcaaatcttgtctctatatttgactttttctgaatgtgcaattgacagaaatagctacaatctctattatgggtagttctaaaatagtcaaagataatctgtataatggaagctgtcatgtttctcaggagtagcaatagaaaccataaaattatttgctaactttgagtccaccgtgaccaaatcattttttaaaacatatgaaatcagacattctaaaggctgtcacaaaatgccaccaagtctaaattttcttttgcttaagggcgctagtgacaggccacagtgccacatatgggttttgagtttggaagtctgccatcagcaaggctagggctgcctgtggatctgctgcctcagactggaaaaaattgaattgtaaagagcattgttctccagtctcaccttccattgaaatggtgactgctcttctgagttagtgccaaggaaacgttagccgcactgacattctcatgtatatggtaccagaacacagaagaaactagatgagtggttctcaatctagcacggttttccccacctggagacacatggcaatgtgtagagacattgttgcttgtcataattttgggagggggtcttactggaatataatagagactgtggatgctgctaagcaggctccctggatggcagagtgataaagaatctgcctgaaattcaggagatgatccctgggtcgggaaaatcccctggagaaggaaatggcaaccccctccagtattctagcctgggaaatcccatggaca

SEQ ID NO: 62063 - DNA, 1175 bp, Bovine  19866881412514
aattcccatctggcattttcccagtgggaaagcctagggaacagactgaccgtctctttagaggccatcacttctgaggcccatttagcagatgccacgctgtattagagttatgcccttatttccttgtcatgcccctctgcatcacgaggtcctgggacgagcagatgctcagcacaggcagctgaatgaaggagtaaagaaacacacacatggttggatactatcaaatgcaatgctcagggttcacactgaagatattcacacaccttcagaaacactggagatacagagaaacccatgtagccagaaacccaagaccatatgggtgaagaatgatcttttattttaaaacgtttttggaaggtacatggaagaaaataaaagctttcttaaaagggagggagaggggagatggtgtaagaaattgtgaccctggtaaataatataaagggtgctgggaaaggtgacttcttaatgtaacaggtcacactgagtccaagcactgatttaaccaagtggggatataataaaatacgatggcccatagttaagcagaaccataatattaataactgaggaatatggtataaacaaataacaaataattaagagccgttttattgtcagtactgtcaaacaattgaaacactcagaaggaaaataaatcacaagaatccgcaaaagggtaaattcagggaggtgcagggcacacggtatctacaatagaaaaccacagccatcaaagggggaacacaaagtcgatacctatagagcaggtttcaagtatgctaattttttttttttaaagaaagaaaaggggaaaaaagaaaaagagtattgcagagtgtcccagggaccacacaggtaggcaggacgcggagctgcttgccggcacgtttccccgggcgccctctgcccatccgggtgggtctgcggctgacacggctcacgccaggcccgtcagtgctcagatgggtaggtgggaaaagtctctgttcgatgaagcttcagagggctggtgacaccttttccaaaagagattttaaaatcagcagttgcaaccacaaccaggttagctcatcgcaagtttctgtataacagacataaataacgtaggatacagaacgcttttcccccagaggctactcccaaggatagcaaaggagagtaaa

SEQ ID NO: 62064 - DNA, 843 bp, Bovine  19866881476654
agagcaaggagggtttacagcccaaaagaaaaaatatatacatactgagtgccataagcttgtcatggctccgtgcgtgggtgttagtcactcagtcgtgtctgactcttcgagaccccatggactgtagccctagactcctctgtccatgggattctccaggccagaatactggagtgggttgccaggccctcctccagtggatttttctgacccagggatggaacccgctctcccacattgcaggcatgttccttaccatctgagccaccagggaagcctattgtgggtccatatattctgatatatcatagactccctctatcatgaactattatttatgagatgaatataaaaaatactaaagtgattctagacataaagcatatgttacgtaagtgctaattttgattttggtacctaatttggggtggtcaacaatatgatttattattttttttgcctctgggttgaactcgatggacaaaaaggaaaaaacaaaacctaccagggcaggaagatgcctttcattcctgatcaaggctcagcagagcagcactgcagagcatattgccagcttacaagggccataacgagctcagccttctgctaataagtgggaggcagagattagttatctggctttgcttttgagccaaaacctaagtccatggcacattaatttgacacagagcacagctttccattagaaatcagtgtgaggtccacgctgtggaacggcagcagtacattaacctgagctgccctgcctccggtgtgtcacgggccccataattgagcacggcaccagcatttctataagaggggaatcgacgtgagggc

SEQ ID NO: 62065 - DNA, 1029 bp, Bovine  19866881480393
gagcctggtgggctgccgactctggggtcgcacggagtcggacacgactgaagtgtcttagcagcagcagcagcagcaaggtaaaggagtaggcacaaatatctgatgagtttatagtatgactttgtggaaatagatgtaatttgaaatgcaattaaaagaacccgtgaatgaaatgagaagagaatggaaaatgatgccttctgcagaacaccagttgtgcataacaatgtcatggataaatgcccatctgataaagaggttttaattaaactaaataatttattacccattatacttcaatgaattaaaaataatataagatgctttatttctctgaaacaggattgtgtgccataaattcagcacattgtgtgttctcaagcgagaaaaatgtccaggttaataaaatgtaggagaaataataattaattttgttatattttaacctttgacacattcatctgaatacattcccctggggtggagctagattccattttttcttgaaagggaatcacatgaaaacaagttatttataggaaaattttaaaaattaaatatgggctggtaaaataattaattcaataaggtagctattaactctgtatttcatatatatgcatgtgaacattcccttatatatatgaaatttcctgtacattttatatatatatacacacatatagccacacatatgtattattcatatacttatgtagataaatgaacatatatttatatagattcatgaaagctgctgcatatgctatgtcagttttatccacctttatttttaaatgcctaaatatttataattgttagatatccaataaaaggcttatacaaaaaagacataagtgaaacatgaaaggcaaattaaaaggaaacaaatactgaaatttttctttctaatttttctccttgcccttcttctccctaaagaaaaccacggttgataatttcttgggattcattcagaaaatacaatgttcaaactggcatataatgttacgtctattcttatct

SEQ ID NO: 62066 - DNA, 755 bp, Bovine  19866881524959
cctgctacccatcaaagtgaattttttaagatgaccgcctggtgttagtcctttgctgaaatcctttcttttcaaaggctctgagaccattgctctaagggtaaagtgagttaagcccatacttctttttaacgtggatttcaaagctgtgaatcacatttgcccagcgcatctccttgctttcgctctctacgattcgtgccgcagtcctgtgataccaactgtaggaactccacccagcgtctggctccaggctcagggcacagttctttcccccaaacctgagccttgacagcgcatccatcagtgcacttactggatgggcacagtccacaagctgaattcatcttggagcccctattgtctggtagggactttggtatcctagaaacattaacagttgtcgaattgctttaataggacatcagaagttacccattcattcttaagctgatgttcccaaaacctcacaggtgctggggtggagagggttgacaagagaggtagcagaatggattttgaatattcaagctctgacacttatattaaaaatctgtcagtgagagggaatgagaagcatcttagtttcatgtactccactgtgactttaaatgattccctcgtcaagggaaagcatgtgtggaattacttaggataagacgattaaaaaaaaaaatgtcaaccattactgagaagttaattttgctttcaaatccttggttaacttttgagttgattttgatatgttcatttgt

SEQ ID NO: 62067 - DNA, 1209 bp, Bovine  19866881557240
cctgttagatgaacacgatttccaagagcaagtctgtaagtacattgattcttccttttccctctactccatagccaatgaatattaaagatctacataacagtatgaaaatgacaatgtgaaccaaatcagattccaggcaactctacttctgccatgcctctgtcacaatcataccccagcagaaccaaagaactcacgttcttactcacagcaagttgcaggggcgtgacttccacttggctctgacttaaagaaaacctttgggagccaacatacatcatttccctaagcaggcacagaaaggtagcttagcaaactaaagactggatttactggattaagcacctggcttaaggagatttaaatccgacttaatgatattgccagtccctggagccactggttcaaatcctaactcaagcttttgctcttcatcagaaaatgccagcaaatttgcattattttgtagatcaggggaaaacctcagaaacattttcatgtctcctcgtcacagggtaaaaatgaatttcctaacgacaagccacttccctatagaggatggtgttaatgccagcaggccttattttggctcagaactcattctgttcccaagagagaatttctgcaacactggacaaagcattttgtcttccccattcctctcactcagcccttctgggcctttgttcaaatgtcatcttcacagtgaagcaattactttaaaccttcttaaaataaaattgcgtcacctccatttccatccattttctccctgcttcatcttcactgctctgactaccgtctcacgtgttacacagtttatgtattttagcctctctgtggctcagtgagtagagaatctacctgcggtgcaggagacacagattcaatccctggaccaggaagatcccctggaaaaggagacggcagcccactccagtattcttgctgggaaatcccatggacagaggagcctggtgtgctacagtccaaagagtcgtacatgactgagaaattaagcacacacatccccatctagaataaagctcagtgagtatcaagactacctgtgttcagcagtacaaccagagcctaaaacaagggttaaatacagagagagtcaatgtattcctgctgaacaatcacacaaatctcagcaaacggctttggtcttccaaggcccacaggtgcctctcacctctgctc

SEQ ID NO: 62068 - DNA, 710 bp, Bovine  19866881651938
ttgtaacattagctctctatttcttagaagcaaataaaaaaggtggggggtggactataattgctttaggcttcctaggtggcgcctggggtacagagtattcctgtgaatacaggagactcaagagacatgggttcgatccctgggttgcgaagaccccctgaagtaggaaatggcaacccactacagtattcttgcctggcaaattccatgacagaggagcctggagggctacagtccatggagttgcaaagagtcagacacgactgagtgcacataactgctttataatatgtgtgactttctgctatgaaacatgaatcagccatatggatacacatatccccttcctcttgagcctccctcctaaccccaaaacccacccttctagatcatcacaacaatcccttgtgaaccaaatacagcggggtatatgactttcctttatctgtggatgggagtcaggaaagagaggacggcggggctacaagagcttatgcgtatgtgcatacttgtgtttctcctaccacaccagcaactgcattctccccacttgattccaagcctcattaactctgattttctcattcatctcaaattgctatatttatcataatagtttatcccagctgaggtattctccttatggggaaaataaaggccctgatctttgtcacggcatgggaaagtataagatgcaggctgtaaaa

SEQ ID NO: 62069 - DNA, 904 bp, Bovine  19866881837681
cagtttaatcttgagtgaaattgacataacatcataattgttttaaacataaaatgatttaatgaatgtgagattcttatactatgcataataaatatgctattattgttataattagataatttacatttctgtagatacatcataaatatctccttgtagttcagaagccatgacctagtctttgaaaaatccttatttatagccaatactttaatattatatatcttacttaatgggaaaagatatttatttctctgggaaaaatgtttttaaataatccattaaatattaacttagatttttatttatttgaatacattacgaagaactgcaattctccagaagttatagcttagactttactagtaaacgaagagcacgtacacacacatacgcactcaaatgtgcacaactgcattatgattcaatgtacttggtttacaatctaagcactaacacaaagaaacgtgtgaagtcagagtccagacttaatttttttaatggattttcagatagtgaccctaaaatcctttaatgaaggatgtgtatcaagccaagtcatacacatttgtgttagggaataattagattcatgaataaataattcaaaataatgacttatgaattgatgtgcattgtaaacaagctgaaattgtggtcactctcctagaattgacttccctggtggctcagctggtaaagcgtctgcctataatgtgggagacctgtgttcaatctttgggttgggaagatctcctggagaaggaaatgggaacccactccagtattcttgcctggagaatcccatggacggtggaacctggtaggctacagtccatggggtcgcaaagagtcagacacgagtgacttcactttcactttcctagaaggaaaattaagg

SEQ ID NO: 62070 - DNA, 1184 bp, Bovine  19866880379917
atttccttctccggggatcttcctgactcagggatctaacctgatctcctgtattgtaggcagattctttacttgctgagccaccagggaagtataaaagaatctcccttggtgcttcaaaagctaaaatgttccagtccatacacatgtagctattatttttcaaattcttttcccattgaggttattacagagtattgagcagagttccctgtgctctacagtaggtcctcgttgattttctgttttaaatatagcgtgtaatgcagtgacttttaatggagtttggcagcaaacttaccaatatcagcatacctgtaacaggagacttggtggtactaaactcatttgtgcaaacatctcagcctctggctatggagacgtgtgctgagagacacttggctatgcagaatacagaaaacatttaaactaatcacagtacctctgaggattttgtcctttgtaacgcttttactcatggcacaatcaaaacacaaaattgatatttcttgtggtggtttgtgctcttagcaaagtcctctgtttatcttccttatggttgatatttcatccccctacccaaatacttacgctctcttagccaaaccccagttctttacacactcaaagcagtgaattacttgttaaaacatttcagataaacagatataatcacatctctgtttggacttcatgctggagggagtgtgcagagaccctggctatttcatattgcggagaccccacttttttcatactgctacctttgatgccagtaaatcaaccatttacaatactgcttctgccaagaaatcccccaggcccttgtgaggatatatgaaaagactgaacaaatatcagcattttatcctcattcctgtcctcaaagcctttgcaaacttacacaagctctttttcatggtgtcttccacacagaggatgtctgaaatctactgaaaccattcctggtactgatactttagtctgggagttggatagcaaacattgcatctcttaaatgttttgataaagcaatagaaataaaacagaagcttaaatgaagcccaaactaaggtcctagtcagcatcaatttggatgtatttctcttactttccacagttggttctttcctacactctaagacacaggcttatctgagttatcagttttgtagaatgataaa

SEQ ID NO: 62071 - DNA, 2492 bp, Bovine  19866880450237
ttcttggatggatttaataatatcttaaataagatcccagcaaaaagggaaacagaaacattgaaggatctttcttgtctactaatgtctgagatttctgtctctcatttccttgctctaaaaaaaagagacaaaataactccaacacaagtgaagagaaactaaagaatctaaaaggtgaattacgggtgaaagaggagagtgaaaaagctgggttaaactcagcattcaaaaaactaagatcatggcatctggtcccatcacttcatggtaaatagaaggggaaacgtggaaacagtgatagattttgttttcttgggctccaaaatcactgcggacagtgactggagctatgaaattaaaagacacttgctccttggaaggaaagctatgacaaacctagacagcatattaaaaaacagagacatcattttgccaacaaaagtctgcatagtcaaagttatggcttttgcagcagtcatgcatggatgtgagagttggaccacaaagaaggctgagaactgaagaattaatgcttttgaattgtggtgccagagaagactcttgagagtcccttggactccaaggagatcaaaccaggcaatcctaacggaaatcaatcctgaatattcattggaaggactgatgttgaagctgaagttccaatactttggccagctgatgcaaagagccaactctttggaaaagacctgatgctgggaaagattgagggcaggaggagaagagggtgacaggagatgagatggttggatggcatcacagactcaatgaacatgaatttgaacaaactctgggagatagggaaggacagggaagcctggtgtgctgcagtccatggggtcacaaggagtcggacacaactgagtgactgaacaacaacaactccaccacaccacaaaagtgtgttaggagacaaggaactttggcacaggagtattgctaggaatttctggaagatctctagcccttggaggaccctttattccaaaggcagcttcatatagaaatgtttggatagaaagtcacagtacagctcaacattattcaaaaaagagatcctgtacttaatgatgataagggaaatgataagagtgaatgttattcattttcttgagtctaaggagagcttgtggatctgagccagtggacacagctctgctaccctcacttccctgctgatctcatcactggggcctgggcatcacaggctgtgggtaccagaacaccacttcctacagactgaaaggaaggtaccatcattgtttggcaacaagaggccaaacagaagcttggagaaggcatggtgagggtggtggtccacaggaggggccttcacctgagcacctgcctcaggaggctgacccgccttccctgtcccagtaggagtgaatgttgcccttacccgggtcctcagaggccctctcagtcaccccctagggaccaggtttcttttccacacctactatagatgggtatccccatttttaatccaacacacccagtgattagaaacactagcaacttcctgccacacctgccccatgggagggccctggagaagcctcatgcagttagctcacctctccttcctgtttaaaatttattaagttttattatttaataaaaatattgctaaatagtaaggaaaaaaatagatgttgtgaagtctttttcaggaggtagtgacccagcactcggctggtttgacctgagtgacctgggattctaatcactaattggctttgtgattttagacaagattttccatctataaaatgaacaggttaactggattatctgtaagataccatcaagcccccaaattctcttctatttgtaaatagtggatatcaggatcccatattagagattttgtttttatatgaatttcatgttcaatatttatgtgagggataaaaaacataataaaaaagcgatcaagattattttttataagaatggaaacttcaggaataatcaaatcacagtgaccaaacaaaaagcaaacaagcaagcaaacaaaaaaccctttgtatatatctatacctgcatttttgttgtgtatggattatttgtgttactcactcagtcatgtccaactctttgtgaccccatggcctgaagtccaccagagttctctgttcatgggattctccaggcaagaatactggagtgagttgtcattcccttctccaggggatcttcctggatcagggattgaacacaggtttcctgcactgcaggcagattctttatcatctgagccatcaggaaactgatgcagttataaattgatgcaagattgggaataaacatttttttgagcaaatatttcattccaggaatgtgttcagagcattcttcttgacagtaagactgtaaagataatggcattccctttatagaccaagaaacttaggtgtggcaagttgaaacaaattaccctgtgatgccatagtgctaagacacaa

SEQ ID NO: 62072 - DNA, 1725 bp, Bovine  19866880475028
tattttctttgctgcaagtggccctagctacaaagctctaccaaaaagcacataggggaactaaattccaaattccaaagcaattattccttctttgtgactaaacaaaaggctacgacgttagttacacagaattttccacttgagaaagtgaaattgagcttttaacctccactggcctgagggcctagctttgtaaccagtctgctcccattgatgttatgttgcctagagacaaatcaatcatatatgtttgcatgtgtgcaagagggagatggtccttaatgctgtggaatgtcagcactcctgactttccaggaaaatggttgtattctctggttccatcagaatcacattcatgtaaaaatctcaaatgtctccccttgtcagaaaatgagcttattacacccccctcagtgtttctctcctttagcaagtagaaaaatctcaaaagaaaccttttggctatatccaaatcccaatttgcctcatttgtatttttgtccatcgatacaaggtgatgaaactgaactctagaacatatcttgcataaggccacgttttagtttgtgtgtatactgtcttttctttatcctacaagtcggtgtccttcctcttagaaaggaagatcaagcaaagcttagcataacacctttaataaaggataaacttaccctacagggtgattatgcaatgccttctcctgtataaacaaaaacaacaataaatatgtatctatatatctagatagatagacaaatacagacatcaatatatatctgatttacccagagtttaccttagatctttacctattatttggctacataggcaagaactcttgttattaaaatatctaaattgtctacttttattgataagaatcttaagggattggcctaaaatcccataacagagtaagaataaagcaggattggaaagtaatttttactatagtttatgtaatatttgtcttgctgatcaatctcacttgtcgggagttaatcaagtacctaccataagagcaaataaataattgaatatggaaaaagatcaccttaatttagaaaaaatagtcatagaaatttagctattattttggtgatgaacacacacatagatatgatagatggataagtagatagagacaaacagataaaagtataaatcatatgattgctataacatgctataattaattccctgcctctttaggagataagatccattagacagagagatggcctatagaagccgaggaatttagcagaaactctttttcagccccaagatgattctctaaattaaacttccacaatagactgcatggtttgctttgcaacagttcactaagaagcacaagtaataaagacagaaccagtggtcaaatcacaagtgacaatgagatgctgtatcatttcaaagcaaatttgtgctgtttttaacatttttccagtcacacttcttggtttaatctcttgaattcagacacatcatgttgacaattccacaaaccttgttcaggtagtagataatcttattgaacagcagatattttgttttctgcatttgatcttctagtttaatgaagtgtgacatattatctgagtgatgtcaagtctgtgaaatgtaaggtgatatttttctatttaatggcaaatgaagtggcattatgtggagtgtttacctgcaacttttccccctccaaacaagattactggcttg

SEQ ID NO: 62073 - DNA, 1442 bp, Bovine  19866880616833
ctcccccagcttaccacacctagcccagaatctttgaaattatttccggtgatagttctcttcctggaccaggccaccttttaggcaattacgggagatgtaaaagtttttcctgaatctgctgggtcttgattgtcttcagctcaaaatagtccacgtgccaaagctagcacattttggagagacttgttctgaccccctgcactgtcttcattccctaaaagatctgattagcctttaggtttaccaggctgtcacaaaactctgtttaatgtaagactgaacactggttctcaataaatgctgcaaaagcatcacatagtgtagcagactctatggatgtctctctcagttctctggggagccctttgaaggctgctgtggttactgatgacagtgactcagtattgaaaacctttcggcacccggaaccacctcatccagaagggcttgtgggttccatagccatttcacgaatggtagaggtaccagatacccactatcttgcctccaggtgggagatagcagcctggtatgatcttaccaaatcagaatgaggctgggtgtaccagaagtcaatcccttgtttagcatctctgcttttcatcttattcctatctcttctgctggtcactcccaagagtactcccttaaaaaaataacttccagaaaaatcttactattaggctctgttgtttagagaactagacataagacatgtggcaatttaacctatagaattatctccctttcctatatttcaaattgcctgggttcaattttgaaatacataggtcctttatagtgattaagattgccgcttgtgttatttgattcaattttcccctttttctgcgctcttctttcactggtggaagaatactgtggttatgtatcataaaaattacaaagaatttcataagctgttgaatgtggaaagaaaatgttcttattattggtatatttggggaaattcctaaaagagcatgacatatagcctagtcacaattaatgataatctcctcctttctttctatatgttttataaataattttataatcacttttctggcagcttctcactgtgttttttatgtatttgtcattttaccagactggacgtacaacagatatgaaaacagaacctgattttttttactcccatcttacatggatatcattaatttataaagacattgttttgctttttttaaaaaaaaaagacaaacagctggcttgatagaaaatctgccctgatctccagagaacagggagttcagacatgatataaattgacagagggtgaaaaagtaatcttcaggcagataagttagtgcggccaggatgggcaggacatgatggcatttgccagagagaggagaacacaggctgtacagccacacagcgctcttggaaaaggtgatgttgggaatgatactaat

SEQ ID NO: 62074 - DNA, 1367 bp, Bovine  19866880619484
tggtgtaaacagagtcccagcatttgcttttctaacaagttcccagatgagctgatgtggctggtctgggaaccacactttgagaaccaccgtcctagcatcacactgcttctcactcaactatgaagtgaaaagactgataaagaggatgaatagacttaagcagcaaaatagttgtaattttagtcaattcaactaaatgagtctcagagatgccatcttgcattttgcatcctttttatccatttgatggtcacatgataaaatctgggaaaggctaaaacaaggcaatcatttatggcaatgttacttccagtgcaaatatttcctggagattcttcctaagatctttggattcattttcctttttaaaaggtaactgcaaactcttcaagttttcctgtgtggcttgagttcctttcacagttcccctaagtcatttttaatacagagatttggataatacagctgtgtaatttatctttccaagggccaagtaccacctcacttctgtgccaatgactcagcatcgaaaagtaatttactaagatgattatgatctggtacactcatttcttttctcgggaaaattgaaatatctatcagccagagtgtgtttttcttatcctcttcccccaaataattttcacctatccaattcacaatctgtgattgctcaacctgtaaaataatacttactcaaacctgttcattatctgagaaggaaatgaatgaccttgaaggaaaacttggataagtcctgctctgtcctacaaaacttttcatgtgggtcatatcccaggcctatttcatcagaaggccaatggtcaggcaccaaccccatccatttgctggtcattagcctgtatagggcttccctggtgcctcagatgtaaagaatctgctgcaatgcaggggacttgggttccatcgttgagttgggaagatcccctggagaagggaatggctacccactctagtcttcttgcctggagaattccatggacagaggagcctggcaggctacagttcatggggtcacaaagagttggacacagatgagtgactaacactttcacttttacttcagcctgtatgtggaagtcaattgagattgtcattgtgccaaacaggtggcctcattgcaattaatgccagttactgttttttatcatgttattttgggatctatttgctgcaaaagtgacagattaaataggaagaaataggacttctttaaagtgggtagaactaagtggtcttctgaggaagtctggaaaatatttaaatggaaaaaaataattatgaattggtagcacgtgaacttgttcccttcttaaatatgacaattctcagacagtcttcaa

SEQ ID NO: 62075 - DNA, 2054 bp, Bovine  19866880683514
aaaactcgattacaaaagaaagatacttgttctagaatgaaggaggtcatggtatgtataattgttgttcctttaaactgcattttactgattgtcacaaagtgggcatttctctcttaataatccattatgttatcagtaagacagttctaacttgcccagtattcttagaatcaaaataagaatactggagagaaatggaaaccaggtaattaattcacagacttccaacctgggttatttggcaagtaccacttttttgtctcaagttctcaactgagcataatcctaaaagaggaaaaaaaagaaaagtttgctgaagagtcatgacccatggaagcttcatggaaaatgtagctaactcatacagagcctgctaatgacagcctgaagcacatcttttgttggaagtgtgtgtgcatttttctgtgtggttgcaaataagcaccaaggtctacatgatcattattgattaactatatatttcccccactcaggttttaatgaataatcataattagaaggactccaatgccccgagatgtctactgcttcgaaggtaaatcttcatcagattctgcatgtcactgataaaatccactcagccccaaacctttattaactgctttaagactccagcagcttctttatacgttagacacttctctgactgtacctttagctgacagtataaacacattcattttgctgtcacatcaattgatcttagctaattaggagcgttttaggggccttaatttgataaggacgtgtgaatgcgtttttcccccgcagcaggtttgctgtttgctggggtattaggggagtgttaattaggcacagttcttctgtcgggttgatggtttttaaacaacattcaccaaacggaaactcaaacggtcagagcagaaactgggattgtggccgttggtgtggtttgtcagatcaggttagttacctctggaatcggaatctgacagaggtgagcatgttgtgtacccttccagcaccaaatctgacttttccttcagcaaatgttccttatggtggaggtcttcctctccgcatttcagaacgtctctggaggaggctttctcccttcagtcactgtcattctctcgcaacccaacagtatccagtttggtgctcatcccggcccttcttagttttaaaagccgaaagcacagcttttgaaaattcactggccctgaagtacatgcagaaaatcttttgaacagtttgggtcctgggatttctttgttcagtctcttctgctgaaggcaaagcggggctggctggctggctttgggtcagccaggagcagtgaagcaaagggaaacaaacaacagagcagctgagattcctgcttggagcttgtttgtagatggagctcatacagtgtcttttgtttatttgtgagactttacttagggaatgcataaaaaggaacttgaagtaagtaaccatttaagaaaccgaggaaaagggatgtctgataacagcattttcaattttaaggctgagagaagtgctcatttatatactgtgagtttttctgcaaagatacagttgctttcttaaggcatatacattgtgttccctttgtttctcttgtagctttacactgaccatttacacatttgtcttccatcctgcttgtgatcaatctataaataataagttcaaataaaacaatctctgaatgtcctccagtaataaccatttgattctgcaaatcaaaccttgaatgttagcctcattaccaaaagaccagttgaattattaaaaccttcattgaaaatacctgctgttatctgctgtttataactatctttgagtcctagactatatgtgcctaaaataaatgaaggaagcccttaagagagtgcctggctctctgaaaaaaatcttgataaagtggaaaaaatatcgtatttggagactccatccatctgttggttataaacgtgttcacacggtctttgtgacttaactgtcttctatgtaagatgataatgcctgtcttctgacatacttaacgggatctttttttt

SEQ ID NO: 62076 - DNA, 3597 bp, Bovine  19866880711356
gtacagcatttaatttgactcatgctcttcatctgaatttacaacattctttgtttatgcaaacaatttggcaaaaaacccctacattgtctagttacacatatcatattcttgtatattgttacttacttcttagattggtttgtttcatatgtacatatggcatgtcttcctgtttagagcctaaatgatcttgaggtcaaggactgagcatattcattcccaaaggacccatcccaattgctttcacatagtgggtaccaagggatttccctggtggtcctgcagttaagatttcgtgcttccactgtagggggcatgagttccactcctggttggggaactaagatcccgcatgccacacggtgaggccagaaacaaacataaatgagcaccagtaccaccacactgcaaactccaagggcattgttcacattatgctggtgatgctcccctggtggtgtatgatccacggtaagcacacaggggatatttgttgacttgaggcaactatggaagtctggtgcaatgaaaaaaaaaattcttttgttttgtttctgtgatctagggtaaaggaaagtacctgaaccttagttaaactcagtgctgctgctttgaatatgtgctctttgaattctaaaatatagagcaaaatcatactagattctatttctgagtgcaaagtaatctccatatttgcattctagtactaactgaagacctgaatgaggaactctgccaaccactcagacaaagaaacagaaaccttaagaaggttgctcaaagttagaaaagtctttttcatggagcgaagtttatgtggccagcttcaacattactgagttggtctccctgccctaatgatcagcttggatctagtgagaattagatttaatacagattcaactgggcttcctgggtagctcagctggtaaagaatctgcttgcaatgcaggagaccgtggttagattcctgggttgtgaagttcccctggggaagggataggctgcccactccaatattcttgggcttccctggtggctcagagagtaaagaatctgcctgcaatgcaggaggcctgggtttaatccctgggttgggaagatctcctgggttgggaagatcctggaggagggcatagcaacccactccagtattcttgcctgggagaatccccatggactgcagcctgcaaggctcctctgtccatggggattcaaagagtcacacttgacggagcaactacgcacagcacagcacagactcaatggaataaatactgcatctgggcagagaagaaaatgcagaggtttctgaatagggggattcgtccattttttcttccagctgttttttggagctttagaagtttatttctttggtaggaaatgagatgctttcctctatggatccccaaaatgtaaagtgcctattaaataatactacagatattctctgaacagatagcacatgttaaaactgcaaatggccacctgtaaccatggatttctgtgatcaaatcattagtgaccaatggctttctaggaaaaaagcggtatgttcaaagttgactttataattcagggaaggtactataatccagaaaggtaagagggaaaagggaccatttggtggagaaaggccctgtttcttgattttgcagagtgctaataatgttggctcagtttgactgcacaaggttggacagagacaatactgtagcactgctgattggctttgaggagaagtttctgaaaagaaatgaatatgtagaagtaaatggaaacctcgacaaaacttgattataataaatcagctgtctggacttgaaaacaaaattccacctgatcattctctttttcctttgtcctttccccctttctgctttctctctcatctctttttcccctttatgtaatatgcttctgtgagaatactattttcatcttcaaatacagcattttcaagaaaatgtggaatttttaaaatacaataagctgatttgcaatcggtgaatgcacaccagtatggaaggaatggctttgaatggtgctgacattccactgatgtgaacggacgcatgcaggagcccggggtctttgtagactctggcaggacaaggataagtaacaaaataaagaaagactctccatgaacagtgtgatctgcgaagatgagacagagatcctgggatgtgagtggctgtgaaatatccctaatgaactctctcacttcgtctcctctgagctcccttccagagcacagaggactacaaagcaagccatcacgcttgaaagtgcggctactaggaagaagaaagacaaaagtctgaagttgaagagaggttctgaattagtgattaagccgctgcatcccacatgcagcggcttccttccgttcctggggaaagtgttttattaaacacaccgtactcctttgcagtgtccttcattaactttcttttgcactaatatggttactggaaacaagcagatgagttttctgtttatccacatactatgtaaacagcttctacaggcaggtgagacaaacagcagggtcctatctgaagagttttgttacatttatattgaatccaacaaaaaaacactggctacattcagggctgcggaagctatttactaaagatgtgagctggagggagcttggtgccagaatatactaggtgtgaatatggttttacctgtttatcctcccattactcacccttccacctctctcttccaaatttatttggtttcttctctagaggttcttacacaaagataacataattaattaattggatcagtttaaggtggaaatgcttaaacagataatttagattcatgtaactaaaaactgaaaaatagaaataaactgccggccaccaccaccaccacaacagtcaaactaggaacttcactggttttaccatcttttgatagttgtgtccaaggtacttggggagagggtttttcaaatgtaaattttaagcgtgaagaatgattgatttggatcagctttcatggagcagcacatgcattgagccaggcactcccacacaaagagccgctctctgggcagagaacagccccagaaccaggagcaggggtgaattactcattccagagaacacacagttgccagtgttcctgccttttagaaatcaagtgtctgatggtggaaaactaacaaaactcacaggcacaatgcactttatttttacagcacacacatgcacaagcgcacataccataatttagaaaatgaattgttcttgataaatgaataccttacaaacttttgccaattctcaatgaattaaacactgtagagcctcaacattgaattctataaaattactgaaaataattttgtctctctctttgatgatgctaagtcctgtgaaagctttgtagcatttattagctatgggagctgggatgctttctcatctgtgaaatgggaataatcgtagtttttgctgcatctctacactgtaagcattaagcaggattactgacttagcaccatgcctgacacaacataagcagtcaaaacatgctgctgctaagtcgcttcagtcgtgtcca

SEQ ID NO: 62077 - DNA, 1050 bp, Bovine  19866880715318
tgttaagcaggaaaattatatcctgcaaaattagctgtcaaaatgtgagcttgtggttttggagtagtcgtacatcaggaaaacgaaaagaagatctttattaatgagctggattaaataaataaaaaggttattgtaggcgacatgctgctctgttgctacaatatgtctcctgatttcccagcagtcagataatatttaccaaattgaatcacgattagatatgacaattacttgttttcagggacatcatatcacttaaatatgatatttttacctatgctccccttttgaactaggtacaaatgaaatgcatgtacttttactttgttatttaattacagtgattatgggtaaatattttgatcagagaaacatttggaaagtatttgagtgggaaatatttcatatacaatcaccccaccagtgttgaaatcagaaagcagaagctcagagaagagcagagaatttagaaagagaattagaaattgagaaccttctgaataaatcaagaaatcttgaaatcagctatttcactagacattactttgcaacgagtacaattaactttatgtcattattcttctgatgtacaccacttacttctttgacttataattacctatgtatatggtcgtcctctcccaagccaggctgaaaactccatttctgaactatagcagatattcagtaaatttaaaaataaatgatgaagtagaaggggatactgaataaagcagatgatgagaaataaggctcataagattggttgtatagataactaatcacattggtaaagaatctgcctacagtgcaggaaacacaggagctgctgctgctgctgctaagtcgcttcagtcgtgcccaactcttgcgaccccatagatggaaacccactagactcccccatccctgggattctccaggcaagaacactggagtgggttgccatttccttctccaatgcatgaaagcgaaaagtgaaaatgaagtcgctcagtcctgcccaactactttgtgaccccatggactgcagcctgccagactcct

SEQ ID NO: 62078 - DNA, 2700 bp, Bovine  19866880800306
gattgaattggaatctcctgtgtctcctgcattggcagtcagattctttaccactgagccacctgggaagccatatatattataatgtaatggggctgcagatactccatgagtagtttgcttctatttttgttcacatgtgtgtttataagagcatatgaaaaagtgatttttattgatcaagtaagattcatttttctaagagatgattagttgccagttccacagaaatctgtttatacagtgtagctgaagtcataatcatattttcaatcagttgactcagagcccagaagtttcagtcctttggtgaaatgcccaagttaaatggccatttaatgaaaattcatgactgaaagcacaagggatttggcaaagtagagattgacagtgacactcttgtatacataaaagaggtagaataaaaagatactttgtggttggctttctacctcaacagaattttagtttcaagtggaaggacaaccagtgctttccaggatataaaggaaccatcatctcactctcctaagtaaagtcattgtttaacatacacagataagacatcactagatacacagacacaccaacagaggaaatgatttcatgttctgacctgaggaaacaagcgcacatagcctcttatttttatttcattttatgtgacttggctgatacattctctttaacactgtaaccagtgagtcttctctgtctttcacaaatcccttggctaggttggcaagagtgatgacatagcttaagtgacttctctgaagcaaccaagattgccttcatttggggtatttttattttttagttgtctgaatggccaatgtccaggaatcaatcatatcaccatgtggccaacctaatatagtaattattccaaaataggatttgcatgataggttcattagtaaccagtcaacaaataacccatcttttcagactcattcccaaggtgaaggtagtgcttgcagatttctgaaaacattgctatttgaaagctctattaagatttattgattaattcacttcagttcttaatttgaaggaatatttgtattcaaatttactgactactgtgcagtgtatgaattttctccacttactttcttttagtttatttggtggttgtctattagtttattaaatttaccaaattgaacaatttagaaaacttttatatatttttttctttaattagaacattcctgttacaaacttaatgcttatatcttctcaaaatttacatgttgaagcccaaatgtaacacgatttagagatagagcctgaaaggagatgaaaaaggtacaatgaagtcataaaggtaaaacactaatctgataggtctgaagccctaagttgaggaagagacccagagctctctcttggccatgtgaggccatctgtaggccaggaagagaggtctctctggaaaacagcactttggtcttggttttaccagtctaaggcaatggcaccccactccagtactcttgcctggaaaatcccattgacagaggagcctggtaggctgcagtccatgaggtcgctaagagtaggacacgactgagagacttcactttgacttttcacgttcatgcattggagaaggaaatggcaactcactccagtgttcttgcctggagaatcccaaggacagaggagcctggtaggaggccatctatgaggtcgcacagagtcagacatgactgaagcgacttagcagcagtagcagcagcagaactgtgagaaataaactttccattgtttaagacacccggtctatggcattttgttatggcactccaagttgaataatgggcttcccaggtggcactagtggtaaagaaaccaccctggccaatgcaggagctgtaggagatgtggattcgatctctgggtccagaagattccctggaaaagggcatggcaacccactccagtattcttgcctggagaatcccatggccagagaaggctggtgggctagagtctgctgaataggacagtcctgtaaataaggttttacctgtcttcttagattttgatgtattcttaacttcctttgatcagcacatagtttgtaatatctgatttatatgcctctttgttaatgagagttatttagaatagaggttttaacatttgtaattaaattacttttgttaatttaaaatttgttcatttaatttaaaaattgtttgcataatacatataggattatgtttaatttaaaaattatatttatataatacatttacatttcctaaatgtattcatacatttaggaaagagaaatcataagggcagagctaaataatctattacaaagtaaacatgcccgtgtaaccatgcccattgttataacagcattgccaccacacagtactgcgagcatcccagaagaaactcgcattccaaagcatcctccactctccttccaagaatagtcactattctgacttctaacaccataaattagctttgtctgtttttgaagttcatagaacttgaatcataagatatatatttgcatgtgtctagcttcttttgactgatattcattattgctctaaattgtcctgttaattttcattgctttgtagctttcaattaagggaattaaaaaaatattcattctcatgttgacagggtatttctgttgtctccttttggggaactatttcaaat

SEQ ID NO: 62079 - DNA, 1362 bp, Bovine  19866880897627
acttacaagtcagacactgggaggggagcttatacacattgaaattgtattcaactcagtggtaaaatagctcagtgaaagcaaataaacaaaaaccattctctagacttgtttgaccaacaaataacccagagttgctgaattcagaatcatttttggtagtttagataaaacaaaggtggtattcgggctagatggaatattttagtaacaatcttccctaattagagcaaaattcctgcttagagagctgttgagagcctgagattttgaggtgtttgtctttgtttcattgttaatttcagagttgggttctctctgatatttaatcacttactccttggtttagtcagaattagttaaattgtgctacggtaataagtaatcccatcgtagacgcttaagtttatttaagtttattaagtttattgacacagaagtttacttatcattcatgctgtgtggttcacattggtcagttagagctctgttggcgttcctaagcacaccaggtagatagaggctgcaccacgttgtagctcttgaatctgaaacatgggacctctttagtcctgatgataggggaagagggaaaaattagaaaattgaccatgcctcagactaggagtattaatgaaccacatccgttcatatttgattaggtaaaattgagactagtagagaagcagattgaatacttggtgaatattactacatctcttatttctctcactttggtaattttaaaattagtgctctaagattcagtatttatttccaatataggtaatgaacctataattcatcattatgaaccctaaattcatcaacatttgtgattaaaataattaaatttactctttcctcaaagatagtggggacttcctggtggctcagacggtaaagagtctgcctacaatgcaggagacccaggttcaatccctgggtcaggaagatctcctggagaaggaaacggcaacccactccagtatttttgcctggaatatcccatggacagaggagactggtgtgctacagtccatggggtggcagagtcggacacgactgagcgacttctttcactttcactttcaaagatactgggctttctcatcgactttgctttataacacaatccagttttctgaggtttccatttaataaaagttttttttttttttttaatttatgtatttatattagctgtactgggtcttcgctgtgcatgtgggatctagttctctgaccatggatcaaacccaggccccctgcactgggagatcagagtcttacccaagagaccaccaaggaagtccctccatttaatgtttgaatcatatttatctattactaacttataca

SEQ ID NO: 62080 - DNA, 1037 bp, Bovine  19866880924495
ttttgacattgaataaaacaatataaaccctatcttcactctccaatttttataatagtaatttgtttaacttaagcctaaagtttgctgatccctgtcactgtacagttgttatgttttccaaaacaatttgagttggcagtggaaccacttaaggaggtaattctaaagaacccagataaatacaggttgtcacagaaaaggtgcctgctatgggccaggtactgttctggggactgcatttatgctatttcacttaataaatttaaaaataaaaaagggaaaatccacgacacaagggattctcctcatactcttttctgaattggagcttttctcttggtgatctccctggtggctcagaccgtaaagaatctacctgcagtgcaggagacccaggtgtgatcctactcacccttcaactctctgttcaaatgcctctttctcagggaaaacctgctggaccaggaagatttatgaaatgaatatgtggacacaaacatttaacagtttaccataggccagtcacgtgcactatgatctttggtccttctgtcaactgatcagcctgcaaggagtagccagtctttggcatgtgagggctgtaacgtgctcaatattgttctagggcagtgccgaacgtgggacctcctgtacttctggtaaacaaagaaggatgttttcaatttctacagagcaaacaggattattgtgcactgtctacctggattacaaatggtctagaattatctaggaagaggtgtattttatttccccatacatgaacactgacagggaaagatgttggatcttttatttttctttctcagtgcttgactctgtattgaacttaaagaaatctaatagatatgaaatgctttaatataaaaaagtcaaaataatataaaatgatttttattaataaatgtttgataaatgacttaaagatgatgcttaaggaatatcttgagatttttctaaactctgtgtgcaacacaaaatttgaattttgacagaaaaagatgaccataacttaa

SEQ ID NO: 62081 - DNA, 752 bp, Bovine  19866880973843
aatgaaggctgagcatagaagaactgaagcttttgaagtgtggtgctgaaaaacactcttgagagtccctggacagcaaagagatcaaaccagtcaattctaaaggaaatcaaacctgaatattcattggaaggactgatgctgaagctgaagtttcaatactttggccacctgatgcgaactgacttactgggaaagaccctgactcaggaaagattgagggcaagaggagaagggggtggcagaggatgagatgcttagataacatcactgactcaatggacaagagtttgagcaaacttcgggagatagtgaaggacagggaagcctagtgtgcttaagttcatagcatcttcaagttggacatgacttaactactgaacaacaaaaaaggaaaagaatctgaaaaagaacagatatatacatacgtataacagaatcactttgccatacgcctgaaagtaacacaacattgtaaatcaactatacctcaattaaaaaaaaatttgtttaatttcaagttttttatttaaatgaactacttgaatattcatccttaaagatctgatcacagtttaatgctgtaacatttaattaccttcatttttgggccactataaatcaaaagattgtaattcaaatgtatactaatttattcttgaccttgaagttaattactaccatcagaggctttaattattgttggcaaagtgggaatatatcaaaagaagacttgcgaaacaagaaataga

SEQ ID NO: 62082 - DNA, 1561 bp, Bovine  19866880980626
taaattccttttggaattgctgaaataaatatggagttactcagttttctggatttggacttgtctgggttccaagagccaagttctttctgactgtgcaaacatgtgagacttcgggtaagccatgaaacttttaacaccgaatgttcacaaaagtctgcacatatttggaatctttttggagtcaaccttaggaatatttttgaagccagatgacataattaccctcactttttagtcaaccacacccgattattgaacaacaaaaatgttattagtcataccgcaaatcctctgtatagcccaaagtggtttcgatttatacatagcaaaaacttgggatactttcaaaggacaaatatctgaccccttatgcatattaaaaataatatcccaaagtctaggaagacagtttctagaaaagcactccaacaattagagagcaatgtcagtgtcattttaatagtggcctccaaggtggccgctttaaatgacttcactcatttggatgtttggctccagaaatgtttatataatcaatttaagaatccatcttataatgaagataatgacaatgtgtcattaatttcaatagtaatgttacattttgtttatatgttattgacttctgtgatttttctttctaattgaaatataccttgtggtaaaggacccagatctcatgtgcgaagcctgaagaattttagcacacgtattaatatgttctttgtaatgagcatcaaggtcaagacatagagcatttcaagcccctgacaaagctccctaggttccccactccaggctgactgacctgacctccaatcgcaatagataaatttagtttacttttgaacttcatataaatagaattacagaactgtactcttttgtattggatttctttcatttaatttcatatccagagatgtacccatggtcttgtgtgtaacactatttagttctttttcttgctttgaatattacattctatggttagaccacaatgcactggcccattccactgttggtagaagtttggattatttatgttggggttgttatggataaagctggaatgagcacactgatatgtgcctctgggtggagttaagtcctcatttccatttggtatgtttccaggagacaaattgctgtgtcatacctattttaactttcataggcactgccagaaatattttcaaagtgtttatactaatttacaccctggtgtttgttaaatgacataaaaggaaaaaccgtttaagcagttgaccttcctggattcatcagtgtttctttacatgagctgttctttttttgaaggaaagcttagagatattaaaacaaaatctctgccatattattttcctctttgctttcctggactatttctaacccattaaatttgtaaagtctctgtcttctttcttgctatgttctccagagacacaaggtgattccttgatagcgctttactgttgatttgtgtgtcttgtatttgcacttggggtgaactgctggcaagagagtgggcctactctctcacctactgcctgtgtgg

SEQ ID NO: 62083 - DNA, 730 bp, Bovine  19866881059978
tccgagactctcttccttttacagaaaacctcagcaaagcactaggtcatgtaaactaatagttctgtagacgccaataccttcaaactgggagcgatgatgaaacaagaaagaataaagggaagcacagagactcctatttactgagttcctattctctgtgttagacttgaagtctttaataattattgtagaaaacttctcttcaattagtttgaatttcaagagtaattagtttaagccaaagagatttacgcagttttaacctatgaagaaacttttcccaacaaaactattatcccaaactttgtgaataatcatggttttgctacaccaaattaatagttttctatgcaatttatgtgctaatttcaatttcaatttcactgtcaatcccatctgttattgcttcaattctgaattaatgaggcaagttagagctggaaaatgtcacatcatctgagggcattgttcttttctaaggtcatataaaatgaaagagtacttctgtcataattcaacaatccatcccattttatagagttgcaacacgttggagctggaaagtttataatatcatcaaatctagatttataggtaaagaaactgaggtcccaagaggcaaagtgattcactcaagtttttgtagccattgttcctcatccattgcttctagctttacaagtctagacttaaccctttcattcatctggacgcctatgttctgcta

SEQ ID NO: 62084 - DNA, 970 bp, Bovine  19866881116944
ggaaatcccatggacagaggagtctagtgggcttagttacgtggtagaaaaagagtcagataagactttgtgattaaataacaacaacctggatgccatacttctttgtggatggaaatcctggaaactacgttggctgaaatctctgtgctttcataaaagcctatggtgatcttaaaaatttgctataaggcagcatgaaccccatatttagggattgggggagctgaagtaatattatttgtttctcagataagggaattaagccatgcacaagacaaattataggcaacataaacctatatttgtctcaaatctctacacattttacatgaaaatttttttttttcagcaaaatttgtcagggaaatttccaggtttgccgaattttggaagtcactgcctttggcaacacttgcttcaagtactctttaactgatatttcataagatgatgtgcatatatcctgttgattaaaatcacttaatttcttctttatgtttctggaccactgccaaaaataataattactaaatttaataagccacatataagacttgcagtaactggtagaacaagttgagatcctatacaacgtgacttggatagaacagattatagtgggttgtaccctcttctccatttaagaaataaaaactataaacagaagataaataggacaatagcatatatagaagtgggagccagtatgaagacttaactcaaggaactaaataacacaagtacgattgaaacacagaagcatcagaggtagcagagctgaatgaagttacagtggggagccggggtcagagcatgcatagtcttgagagaaagtcatgataattgtggctttctcctaagggcaatgtgaagtaaaaaaagaaatttaagtcaagcagtggcatgatgagaactgcatttttaaatggtcactcttgctgctgtgtagagaatacgttagagggaa

SEQ ID NO: 62085 - DNA, 748 bp, Bovine  19866881154816
tctgtatgttctgtgttctattctggagtaacttgaaacaagatctttaaaacttgattattttgttcttattctcaaaaaggtatttagctgattttaactctgttaataaaggaaggttttgtaacagcgaggttcaagtaaaacaatttaaaggaaaagaaaaaaatgtgtgtaaaggcttctctccaaaaatgactataagggaatttttgtgttttatgaagcagttagttatagctttgagaagataagtgaattttctatagtaaggttataaaaaataatacagtagatgaataaggtgagttaatgtgcacaaaataagtagctattagcagttttacaaataacaaaaatgatgattaaaaggttatcagtaacttgtccaaagtcacacagctctagtcagtagtagcactgagatttgagctgcctgtcattttttttgctaatggaatatccccattggaaaattatttcatcattgtctgactaaggacaatgaaatgatttttatatttacatgtggctagattctttcctggagaatcccagggatgggggagcctggtgggctgccatctatggggtcgcagagagtcagacatgactgaagtgacttagcaggagcagaaaatttatctaagaaaagcaccaactcaacttccctacatggaattattttgagaactgaaatcatcctaattattcttgacaagtgctcctcaattgtaagaaaagaaaa

SEQ ID NO: 62086 - DNA, 1097 bp, Bovine  19866881208794
tataaacttataattaaaagaatatatcctaatcctttagcaagtaattatattgagtgttattcacccttcatgagaaatcccttaaagatctaaagggtgacagcctcatcaagttcttattgcctcccttgatgcatttccatttttggaagtctcctctcaatttctgcttgacatacaggaacaaaaaaaaaggaattcaaaggaaggtaccttgcaagaagaacttcattaaatcattatcaaattggaaaattatatacccaaatatcccacacatgtataataagatgacagatacatgtgtttgcatgtttggatgagatacacagtcttggcaagtataaatatgcataattttctcatacaacataattagagaaaattaagtatctagccaattagtctttggaacaattttcttcatattttctttctcctgagctcaaacgttcttgataacctgccttccttttctggagtctaaccctcatatgctccccttttccgctctcctctatcttccttcacattgtatgccttgcttgcagggccacctctttcctcctcctcctctggttctgttcattttcccagacccttccaagtctcagataccgggcaagactccagctgtttgtgggtggaaaaagcaattacatagaaactctgatagaaacacagaagactccctgtctgatgtcatggatggccccagacctccgctggttctctgcatctgtttgtccctcagtcacaaagaagagaagatgtgatcactctagccagaatttggttaccatggagtccttctattccagtccactggcttaaaggaagcccagtatagctgaagcacttccttcagagtatctccctatctcctgagaaggcagaagcttgcaggttttggaaagccagcatttaaggctaagcttttcatgcacatcagtcccaagagtggagcaacagtgggaagcccagccatgttcctacaagcctgagctatattgcaggccctggaaaacccccatttgcaagttaaaggtatactcctgggttgagctccttgtgttaaatagcaaattcccatt

SEQ ID NO: 62087 - DNA, 1047 bp, Bovine  19866881359577
aagaaattttgtttgcgactcagaattacttttatcttattcaaatcaatgtaaaataaatgttttttaaatgcaactgccctctggagcacacttaaggagaacacacagcaccatttgggagagaagacaattatctgaaatacatgtctcattatccaactgcacagccacactgatgaactattaacactccctgcaactcttacagctgtaggaaagataaaccatgaatggcttcctcagcagcaagtgcaatttcagggggcaatgattttgccaggtcattttcactaatggccttccggaagaagattcttgaacatggcatgttgaaagcagatttgatccaaacatgctgtggctctcaggatgtcaagccctttgtaaatgcaaggcactcaagacagcctcacatgatcaaaaatgacaccagcatcaattaatgccaacaactgcaattaggaaaccacagatgagtagggacatgagaggctctaatttcccttttcctgggatctctgttcctggtgacacctgtcatgtttcattgacgtgaatacttttggagactagtcaccatcttcctgaaaattgcatttctgaccagagctccccaggcatggtgtcaatttatcttcatttgcaatgggtccctggacagattgtgagtgctcccagagatggagcttttacatttgaagaacagtacagagcaatgactagctgcagccttgtattttaatacaggttcatgggaaaaatatgattagttggtacaaagtcataggtgccaagaataaaatatggcagtgatgcttagaaagacccttcttgccctgttcaggaaatcagggtcaaggaaatagatctatatcttggatctgtaatataagggatttagaaacagttaatataatttcaaacccatgctaagaatgctgtttggaaaaatgaagtgaatataatcaaatagaatatctattatctgcttttaaattttaaaaatgtagatctggtctgtgacaacaaatatgtccagtttta

SEQ ID NO: 62088 - DNA, 781 bp, Bovine  19866881366025
caaccatttcttgtctttttctcacttaagagaagaaatattatttgcttttactgagtaactaaaagatgaggtgaaaaagagtcagtggagtatttccactgaaaactctgtccaacgctgtggttgatagtaataaatggtctcagggcctcctatactgggccccatctgttacagtggcacactgcctaactgccagatggtgtactagcttcacagggacaaaggcgccagaaagatggctttagaagacactggtaacaccatacccttgggtctcccacctcggttacagctcacccatgttggccctcctgtcacctcacaccactcacataatttctagaaataagtggttccaaacacttacgaagtcacttccttcagctgtctactggtttctgatcttaaaaaggctgaaacagaatactaaagtggggtaaagagaagttgagagtattcaaacacttcaagttgccaacatacataacaagtgcctaaggaccactaaaatcatatgatgtgtcaaactccattaagtaaggctagaatgtgtagggaccacttgtgaaatttaaccagtctcaaaaagaagagagaagcactgctacacaggaggaccagtttcttttacactcacccaaaacggaaaaaaaaaaaaaaaaatgtagctctagtgactcaaaaatcaaaacaaaacttttctcaatggaagaaaaattcatttattagtagtttaaatattcttcaaaacttgttctaaataaacaagaatgag

SEQ ID NO: 62089 - DNA, 676 bp, Bovine  19866881545976
ttgatgaacaatccctttgtgctatataggcaaatatttggaagaagtggaaaactggggtccctgagattttgggttcttcttctgcagcatagatcaaagtcttcttcttcattacctcatttatttttcctaagttttaagtaagaggaaaactggataagtttatcactgattgacgtgggctctctctctgccactggagcagctcagaaagcttcggcctccagatgtctcctagggttctgtaatgcacgcttttctcctcttcccatccagtccccgcatcctggaagtcccacagagtttcctcctctgacttctgggatgcactggcgcatggcaggaacaaaaccgtcactgacactgggctgcagccgcttcaatctggacactggggaacgtggatgtcagcactgagccccattctctgatgctaaacagccctttctgtcttttcataaattcttaggttgaggaggaattggaggctgaagttaggttgttcacgtgtgtgcttgtctcagccagaatggcatctggcaccaagcctactcttcagtcagatgatattgttttctgttacacacatgcgcacacacacacaaacacacacccagggagcatgagatcatcattcaggccatttgtctctatgcctgaaagttacattgca

SEQ ID NO: 62090 - DNA, 1315 bp, Bovine  19866881751705
cttattagctgttggacactgggaactaaatctatttactaaacttaattactaaacctaattagtatcaatttggctaagtgtcaattttctcatctgtaagatagtcaagactaactacctacgtgtgttgttgagaagattccaagagaaaatatgtctaagttgtctagagtgacttgcacaggatcacttcagaaggcagctgttattatgacatgcaggaatcaaccctgtcctcaggatgcatggcagactgccccaaaaggtcccttagaccacatgccggacacatgcttcttgaaaacccctgacatagacttttatggtgtttgttgcatagcttggtgaatgctccaacattcacccactcagtcagcctcctacagggcagctgcttcccgcccccccccacctgttctatgttttagtcagagcatgtatgtacagtgttcaagagcttaacgtgttcaaagtcatccaccctgtatttctaaagaaagtcttttgatatatttgtgtgtttcttgggtttgttttatttgtgggatgcagtgggactcctgatgcttgactgcaagtttctttagaccttatgtctgctgctctctaaaacaaatccagttttacacagaccttttcatagcacagtttgcttctctgaatatctcctaaataattaaatacaatattttataaatattaaaaaattttggctttaaattctttctctgtggattagtaatctatctaaatctcaactctcgataccttgttctaccaacaaagttgatgtccaataggtatttgttgatggattgattttgctgagcgactgaactcccaggcctcttacagtgtcttatgcacagctgtgtaaactcttgaacgaaactgaagcttgtcacactccagcagtaataaggaatgagttagccaagtgcctcttctctgacatgtcgtccatcaaacagccttaatatcttgctggcctaaaaggagcttcaggagaataagcacactatggcaaaacccaaaatcacttactcaaaaggttaaacaatgaaagtaaccaatgtatgtgtctattgataaggggaagagagagagagaggagatcactttcaaactgcaagtgaaaactagacacaattttgtgaagttcccatgggtttcagtttcatcagtgtataattccaaatcaacaatgctagggggcagatggccttacattagatcctcgatatgctccagagtttaacaagcaaccttacaccgttagacagacatgctgggtgcaggaggaatggctcca

SEQ ID NO: 62091 - DNA, 1436 bp, Bovine  19866881917923
aaaaccccactctattgggttgcaaaagggaagatctgaccctggcatcaccctagttaatattcaggcagtgtataccacaggctttccaggtggcgctaatggtaaagaacccgcctgtcactgcaggagacaaaagagacgcggatttgatccctggtgtcaggaggatcccctggagaagaagatggcaacccattccagtattcttgcccagagaattccacagaagagaagccgggcaagctacagaccatcgggtcacaaagagtcagacataactgagcaacttagcacaacacaatgtacaccacatgtgtaattttaaactaaacaatggcaaagcctatttatttacagacactcaagatgatctcttaagattcattctgtccaagatagagaagggtatggggtgttccctccagggtagagtatcctatggggctgcaatatcatcactaccagctttcttgcatttgtaggggttgttctgccttctttcagagtgaatgagtatagggacaagtgaaaaataataataataatacataagtcagagatgaatgttactagaatctaaagaatgtaattgagacaccatccacaagcacagagaagctgaagttgacttatctacagagctcattcacaggaagtaaatgaggtctagaggaggattatttggagagtttcttgttgaccagagctaaattatttgtctttaagtggcaagaggatgggggcttcccaggtggctcagtggtaaagaatccacttgccagtgcaggagacgtgggtttaatccctgggttgggaagatcccctggaggggggcatggcaatgaagccagccctctccaattccaccgttcaatctcttacccagtccactacacataattcctctctctgtggagaatatgattgggcctaaataatgtatgccacagattccacagtatagcaaaatacattataatatctgataatgtgtgcatatcactcgatggaaaaacaacatgaaatatgagatatttataaaaacaccaaaaccattccaaattactgggtgttatagagtaattgtttttcttcctttgtaaattatctgggatgaggacaagtcaaatgatctccacatgtgtcctgaagaaataaacaaacttacttactttccttgactggttctcattttgttatctcttatagaggtgcattctttaaagaaaaataatgatttggctgtgtggccattgtcaaaatcacttgtaaacactcttccataatggaaaagaatcaaccttgaaataaactaaaacagctattttttcttgactgaaagtactgcctaagaaagaattttaatttactttcaactatcaaagatatgttttaattatagcacagaagagcaaagaacaacaaaaatcaat

SEQ ID NO: 62092 - DNA, 1061 bp, Bovine  19866880361843
tagacaaattatgagaattcactggagtacaataccataatgctatgaatagaaagtttgatttacgatgaaagcttggaagagagacctagtgaaaactggcaaacattgactcagagggggttggggggggtagtgtgaggaggacataattatagactgaaaatatttgaaggcgctgttgcccactaagaggaaacaatattcacgttttatcttttccgtcttgtctttggcattttcattcactcctgcagatttttagggtgttttccaaagctttcgccctccagtgcacctgctgacggaatattttcagctggttatcttactattattgttttgaaatcgtattcgatcccctaaaaacttttttttcccacactcaatttgcctgattttaccagtagaagtttaatttcctaagcttgggctgcttctaacgccagcatcgtacacctagtaagaatcacacaactcaatcacgtccaattagtccttaagtcttgttgacttttcctttacgcggtctttaatttctgtcaatgttctttgagtctctgccagagctgccattttagttcaggtcatggatatagtataacaagcttcaacatctccatttgtttgctccttctccaagccgtcttgcgcatttaattgttacttgcacactctttacccattgagggacaaatatagtgttcttaatataggagacattaaaaaaaatatatatatatatatataggttcagtggagtaacactgtataaaccatatagtgacaaaagaccaaagtgaccaaaatttttttctctcagaaaacaatcctctgtgtacactgtgtgtgtgtgtgcgtgtgtgtgtgtgtgtgtgtgtgtgtattcctgtgtatacttatgcatgctgtcatggaagtgaatcccttgagaggttgtgatagctccagaaataaaatgctgaaatacctaaacagtagacttttgacatgttgcaaactatgagggaagaaaggagctaggtaattgcaaactttaggtgtggggaaagcatgagcta

SEQ ID NO: 62093 - DNA, 1245 bp, Bovine  19866880451889
gaccgtgttgcttcctacctttaaattttactgagtccctcttgttctgaaaactccagttgtcttcatacccactgcccttcctgctcttattctgcccttttgtcctgttatctgttcccatacctctcattgcactctgcttcaacccagctgagggctttgttgtggctgtcgtgtcatgctcagagaaaattcattcttctgcctgaaactcaggtttccctctttgacctgcagctaactccttgccacctttcagctttgtttagtcactgctacattcagtgtcttcaatagacttcctgaatcagcctagattatgagttaccataacatcctgcatttcttttttttgttgttgtcttagtacttaaccatgctgttctaggatttcctagttaaggaactgtgtcccccttatactgagttcatggagaactggattgtgtctgtcttggtatcttaccatagcctagcaacatgcctggcatgtactatgcaatgactaagtaagtcctaatagacaaataaatgaatgtatagtctttcaatttccatttctccatgttgctacttgtggcttggctggtaaagaatctgcctgcagtgcagggagacctgggttcaatccctgggttgggaagaccccctggagaaggaaaaggctacccactccagtattctggcctgaagaattccatggactatatagtccatggggtcacaaagagtcagacacaactgagtgactttcactttcattcacttatacaactttgggcataaatgagaaagatatgagctttctatttctttcctgctctccactccctgttctaataggaaagggaaatgtggattaggcagaatgcttgatcattaagggaaattctacacattggcaggaaatgttaagatattctttcctaacaggtcaatcttgaagaaacaggcttgatcagtagaaagaggtgactttttataaagttaattattaaaaatttgtagtgtactgcatatatgttataatttcaattatatcaatatatgtgttcatatttaatgcagaggaaaaataccagaaaaaaataaggaaaatttcaattaagcatctcttggtgtttttattttcttttattttctcatgtttttctgtatagtcaaatttttaaaggattaatgaaaacaaaaatatttgaaaagaaacttaaatttttatttgtaccagttgcaagaagagaa

SEQ ID NO: 62094 - DNA, 764 bp, Bovine  19866880824138
atagaagtcaatagcaattacttgcaaagtgtcattttgaagtttctgagcccaatcaaacttatgggtatataaaggggtttctttgtatataaatgtaaatatgttttaaaactggaactattgaaaatatttgaagaaaatataatgactctgtccctttcatcctaaaatttggccttagaaatcataattcttcatatgctgcatgaaaaataaaaatagaacaaaattgaaatgctcactaaaaccttaagtatgctttcagttcatcagctgtatcctgacaagtgaatgttaatttgtacaactttcattgtagggtagtattttatgaaagattttaaaaatcaataatcagtattaattcaattatggagggattaagtgtatttatactgtggttcttacaaacatattgatttccctatattagtagaggattttactatcattaatgggatttcaggttcagttcagttcagttgctcagttgtatctgactctttgcaaccccatgaacctcagcaggccaggcctccctgtccatcaccaacccccggagtccacccaaacccatgtccactgagtcagtgatgccatccaacaatcttatcctctgtcattcccttctcctcctgccctcaatctttcccagcatcagggtcttttccaatgagtcagctcttcgcatcaagtggccaaagtattaggagtttcagcttcagcatcagtccttctactgaacacccaggactgatctc

SEQ ID NO: 62095 - DNA, 375 bp, Bovine  19866880827380
aattggtctctaagtggcaatgcctctgagagagaagaagccctgagtggtcctgaacaaaactgtgacatggctgagactatctgtaaagagatggccccagaatcccactgtttagggaaaacccattgtcagttgcctggaatagaaagtgagaccctgggggcatggacatctaaaagggagctctctccatcagcttgagaaagtgaaaaatagttgtcattgcttacgaggagagaataggtaatgggataaggttgagcccaaaagggagacagtgtcgatgtaagtgctggggaactgcgtggctgaaagtgcaagtgaaaatgtccctgggatttctggggcagggaggggcatggggaggaggtt

SEQ ID NO: 62096 - DNA, 2406 bp, Bovine  19866880858303
cttggcttccctgtccttcactatctcctggactttgctcagactcatgtctgttgagtcagtgatgccatccaaccatctcatcctttgtcacctccttatccttttgccctcaatctttcccagcatcaggatcttttccagtgagtcagctctttgcatcaggtggcctaagtattgaagcttcagcttcagcatcagtccttccaatgtatattcagggttgatgtcctttaggattgactgttttgatcttcttgctgtctaagggtcttctccagcatcacagtttgaaagcaagaatttctttatatgttaacaaagtgaatccctctgggaaaatgtccccctttcctttcaaaagaaaatgagcttttggttttagggtcctctgtcctagtagacggagaaggtgatggcaccccactccagtactcttgcctggaaaatcccatggacgaaggagcctggtgggctgcagtccatggagtcgcgaagagttggacacgactgagtgacttcaatttcacttttcactttcctgcattggagaaggaaatagcaacccactccagtgttcttgcctggagaatcccagggacggtggagcctggtgggctgctgtctatggggttgcacagagtcggacacaactgaagtgacttagcagtagcagtcctagtagagtcttaaccctgcaaactcaggggaaggaactatggttaagaggtgcctcatccagacatgtatctttgatctcatctgtgtcctctgctcttcttttgtttgctgattgaacagtaatctcaacactgtcacattcatgttgccatttgcatcaattattaaagccagacccgctcctatggttggtcctagtttataagtctcttctatcctaattagtcttctccaagtacaagtcatatatggcattcaaataaacccagttttcaggtgtggtgtgatcaacacaatcccaggtttggattatcacctcctttgttcaattaattctacctaaaacctaatcggtttttctggaggatccaccacattcatgactcacattgactttaccttcccctaaactgcctgagtcattttcagacatcatatgtattgtctcccttttcccaaacctgtgccactggcttttgaactttagagcaaatcccaagatttactactattagatttagttgattgttccagctggccaagatccttttatcccattgctacagcctgtcaagatctttttggattttaattctttcatcctggctagtcactcaatcatctgtaaaccatgctttgataatcattccttctatatctgcagatcagtactggaaaatgctaaactggatagtactggttttcagtatacttttatggacttaaaaatattcataacccaaaagttgagagttatgttctatttggggggaatttttaggtcataagccagggaggtaaccttacaggtaatctcaagtaaccctgaaagaactactttgaggaggtaagagagggagccaggttatataaaagttttgcaacaaagagcaggtattctaaacattaaaaaaaaaaatattaattaaagaaaccagatatcccaagttaaagaatttagcacttttctgtgtatgggtagatgaaagagtctaggctctctgaaagcattcccttgacatgcatcttagctatctggggctagtatcccgtgtttttacatgctgagtttcctcagggctcactgtggggaggggtgcagtctgatggctagatggcaagtattctttccctaggtgagtttcctcaggctcaccggctcactatccatagtggctgcaattgctgatgaccgtgacatccttgtttaccgatacaacaggaaatattccatttcttactttggctacaattgtttaaacctattatcaatccacatgattatctttacttataggccatctttctccatttatccaacaggaactcctgagaaattgtcaaatgctttcctaaagtccgtctagagcagggttaccaggtttcacagatttagcagcatcgtgacttcataaaggtgtgcaaaatattcttcctgactctcccaattcactccccaccccattttgtgcttctggaacctgtcttctgtgttctctatttccttgattccattgtctgacattatagaatgggattaaggtatgaatttcaccatccctctcttcacagctgcaagtaatcagtggcttacattaaatataagtggtttagcttctctttggtctttccagtggactcctccagctaaagatacagctacaactctctccaggttctcatacatgttaccctccttgccctttgaaacttaagggtcagaga

SEQ ID NO: 62097 - DNA, 1441 bp, Bovine  19866880945341
ttaaaaaaacactcaatcctccgacatttacaagcttttataaaagtgtagtgatcttggtagaaaacatcctgactggtaatatagtgaacagatgagctcaccgctggtatgcaaagctgccgaattagctggttaaacaggctgctgagataattacattgtctgttttgtgacacattacaccggtgcacttgggattaacctgttctcttgtgtctacttctgatcagttttttagacagccttttatctgatgaaggagtacagacatcaaaagagaagggggcgtgtatgaaaagaaaggaatcacataaagctgaagagttaaattttctatttaaatttctgagcatatagccatttccataattttagttgctctctagagacctctgctggaaatgataggtatagattttcctttccagtttgttgtgttttactgtggccaatatatcataaacacagtaactaaagaatggagtatcaatgtcatgtcatacctatgacacattagttgtaaaaccatactcaggaaaggacaatttgcattgtaagagtttcaaaaggcaccctgatgctagaagtacactttgatagtcaatcaacacacatttatgcatttattaggcttccccagtggcttagtggtaaagaatcctcctgcaatgcaggagacgtgggttcagtccctaggttggggaagatcccctggaggagggcatggcaacccactccaggatttttgcctggagaatcccatagacagaggaaccaggcaggctagagtccatgggattacaaagagtcggacatgactgagcgactaagcgtgagctatgatgtgctttagcaagcatgactttcagtttgtttattatttccatattgttttaatgctgttgaagaccaaatagaatcatttattttgaaaatgaatgtggtaccttacagccaccagggaagcccctataaaaacaacaactgcaaaagctatccctaaagatttttatgggcttttagttccttatcattatcctgaagaggaaaaattatttagaccttctgattatgtgggaatgtggtacaaataagatttcatcatcagctgataattcagatagtgaacaattaagagaataaatagaaaaacctacccattaagagcccctggcaacttaaattgaatttaaccaactatggatcctctggctatcaggaaatgcaatttaaagcaggtataatagattttaacaactaaaatttgtttgtcacactgtaccaactaagatattagttaaatggggcaagaaatttcccttcatgttaatgaacatcaaatttatctcctgctgtccttttttttgttgttttttgtttttctttctaaaataactgcttgacttggtaagccagcattcaaatgaggttcgagcaa

SEQ ID NO: 62098 - DNA, 1958 bp, Bovine  19866880957752
tggtacaagatgttaagtaacttggtttaggtcacccagctagtaggtggtattgtcaaaatctactagctggacgactactaggtcttcggatctgatactctgacactacccaaaacactttttacagtatgtctcatcattaaatgatgaataaaaatgcagaaatatccttcaaggttgagttaagaaactggaaatatttgtggttatgtattttgtttcctccattgaaaaatagattgtgtttcacagttttaaatcataacaattccattagcattcagcttttgctgtgaaagggtttggatctttgccataatatgccctttaaagtgaaatttggccaagttgtagcctaggagcaatagtggggcagaattgatctattaaaatgaaattgccagacttgagtggtctagcaaccataacatattatgctgactgcatagattccaaagttccttttaatgccaataaagcactaatttttcatgttcaaagattttcacaatagtttacctaatttctttcacttattttggagagcatgtaataataccagcttgtaaaccacaggtagaaaaagaggcttacttcacatccccataatctctatctaacccaaatttacaagaatttaagatagggaatatgtaggctgaagtgtagcttatggaattactgtcttatttggcaatttaggattcttggttataagtgacaggaactcagaagaacttgagcacaaaatgtattgattcctctacatgtaaatgtgggggatgtttgctttgaggtatgcctgaatacagattatctaacaatattgtcaggaacttgattcactttagccctcagctctgttttcctaatgtctatgaaggcaatattcaaattatggaaggatggtaaatattctgaatttcagttcagtcagttcagttgctcacttgtgtccaactctttgcgaccccattgaccactgcaccccaggcttccctttccatcaccaactcccggagcctactcaaactcatgtccatcacatcagtgatgccatccaaccgtctcatcctctattgtccccttctattcccaccttcaatctttcccagcatcagggtcttttccaatgagtcagttcttcgcatcaggtagccaaagtattggagtttcagcttcaccgtcagtcctcccagtgagtattcaggactgatctcctttaggatggactggttggatctccttgcagtccatgggactctcaagagtctttccaacaccacatttcgaaagcatcaaatttttggtgctcagccttctttatggttcaactctcacatccatacatgactactggaaaaaccgtatctatgcctatatgaacttctgttggcaaactgatgtctctgctcttaatacactatctaggtttgttatagctttccttccaaggagaaagtgtataataatttcatggctgcggtcaccatctgcagtgattttggagcccaaatgaaatctgtcactgtttccatttttttcctcttccatttgccatgaagtgatgggaccagatgccacaattttagttttttgaatgttcagtttcaagccagctttttcactctcctgcttcacactcatgaaaaggctctttagtttttcttctctttcttccattagtatggtatcatctgcatatctgaagttgttgacatttccaccagcaatcttgattccagcttgtgcttcatcaagctcggcatttcatatgatgttctgtgcatatagtttaaataagtatggtgacagtatatagccttgctgtactcccttcccaattttgaaccagtctgttgttccatgttcagttctaactgttgcttctggggctgcatacaggtttctcagcaggcaggtaaggggggcctgggttttcccatctctttcag

SEQ ID NO: 62099 - DNA, 1334 bp, Bovine  19866880999552
cccggatcgatggatgtgagtctgagtgaactccgggagttggtgatggacagggaggcctggcgtgctgtgattcatggggtcgctaatagtccgacacgactgagctactgaactgaactgaactgaactgaaatatcttgtaaaagtggagttgaacagtatttgtttatacctaatgtatactggaatgcagttttgaggttacttaatatatgtcctacaaacaagaccataccttttcttccctctgcactacacagtaggttcttcatagttatctcttttataaatagtagtgtgtatatttggagaaaatcataattccaaaagatacatgcaccccattgttcattgtggcactatttacggtagtcaggacatggaaacaacctatgttctccttatttgtggtagctctgtcctctaaaattggcttaaatattaaacctctattcctagaggaaataaagggataagttcctacaatcgtcacattttcaataactgattaatacataaccttgctttgtttctgtttaaaagcactttatttactattatcattgattcattaacattgacctcacagcttaaggcactgtaagtcttgcttgagtgaaccttatctaatacacatccagaagatacaatcacagacgtcttgtacttaggaacaatagacaatacttcatcactgggtgatggagttcattttaaacactgaatcacaacaaaaagcacaaacacgcaaccaaaaaaagtgttacactaaagagactacagaaatgacacatttccagtatgaaagcgtcactttgttctactcactgggacatatgcttgctgtcactgctctgggcttgtgtatgaatgaccacgaaactgtgtgatctgtgggttacaaataaatttttgtgagtaggtgaactcacaaaggcagaatctgagaacaaagagactcaactgtaaatgcaaacaaaccatacaaaactcattttcatctcgtggccacttacattcctatccacactgaggaatcaatgaacctaatctttatactaggagttaggtgatcaattattagtgtaatgatcaacctcgcttccagtctgtaccctttaaattataatgcattttctactgaagttttagggataaactaactgaaatataaattttaaggttattatatcacaaaatgaaatcattcagaaggataacaaaataaatgttagtaataatatatgatagtagggccaaaattggaaatgggaaagaattggaagatggtttcgtgtgcatgccagactttcgtttcaacataactgttt

SEQ ID NO: 62100 - DNA, 1158 bp, Bovine  19866881076864
gcttagggaagaagtgggggacagaggagaggagagaggattacagggggccatgaagaaactttgtgggggtgatggatacattcgttatcttgattgtggtgatggtttcattggtgtataaatatattgaaacatcaaattgtatattttcaataagttctgtttactgtatatccattatatctcaataaagctgctaaagattagtaaaaaaaaaaaaaaagattaagcagtactacatagaaactctaaaatagaaaaatttttttaaaacacaaagggaaaatagaagggaaaaaagctactgaaatttgtaggaagagacaaaaggaaaccaagaatgaagccagtgtttcaaggaggattgagcagttaaaattaacatgacacagagataagagtaaagactgtccaatgtatttggcaaagaaaaaatctactacatattcaggaaagggtggtgggttgggagccagaatgtcagaggctgaagggaggcttacttgaggcaaggatgatggcagcatcctgagaccacttgtttaaaaagctcaacaatgaaaatgagagaaagaagatggtagctagaggggacagcagagcaaacttttggtgaaatgtgaaggcagaagaaaataaaagtggaatgaagcagaaactaaagattctagagatgaaggcaaaacatgtggtaacaggtttcttgaggaatttggaagggatgggatctaagccacaggtgccagagtgagtcttgggaaggagaaatttataattgttaactcctgacagtcctccctaaacaatgggttacagaacaccttaagtggattttttttaaactttgggggaaaaaaaaaaaaaactattattttgccagcagatttcttagaaaacttggatgactggacatttctgacatttcttaaaaccaatcatgataaaagaagatatcatatgaatcatcacctctgacccccccaaactgtgacctttccaggctgtaatctactgaccacagcccataggtcgttgtcccaagtgacataatagtaacttctgcttcattagcctcagtatcttgctgcttcaggaagattactctgagtcagatgttttagaggaacagagagcaggaggagagtcagggataag

SEQ ID NO: 62101 - DNA, 1042 bp, Bovine  19866881107703
aatcctcctgcaatgcaagagacttaagagacacggttttgatccctgggtcaggaagatcccctggagaagggaactgttacctactccagtattcttgcttgcagaatcccatggacagaggagcctagtgggctacggtccatggggtcacaaagagtcagacacaactgagtgatttacagctatttgcatagcatttatattgtattaagtattataagtaacctagagatgatttagtgtatactggaagatgtacatagtttgtatgcaaattctgcaccatttactataaaggacttgagcacttaagcatccgtggattttggtttggggtgggaggcagccctggaatgatctgctgcgtatacggaaagatgactaaaatatttgggattgtgagatagttattttaggcaaaaggagtaggaaaaacaagtaagagaagaaagggagcttttagttttctcaaaaactaacaaagtcccaccttagtcagggagtatcaggttagagcagttctgaaaggatcacctggccctcaacccttgggaattctcagccctgtggtgtttgcttttgtctcccaatagaggtgtggtatgaaggggtcacacaggaggtgagcaagacgttaaatgctccacttccccacagtaaagaaacacttcttcagtcaaaccaggtgagctgaataactggatatgcttctccatgaagctaatacatttttatcaaacacttcaacaattcttattccctgactgaagcatttttggctattaatgattacaggaggatgaaactagtcaaaacacccccaagaaagaaaatggcaaagagaattatagtttatgttttctataagagagataattcatagtacactatacttgaatgagtaagagatttgcagcttggtataaaaacagaataacatggtaaacttggagtttggtttttttgtttgttttagctttttttttagtcagactggtttaccaagcattggtagtatagaatcaaccgataatatttg

SEQ ID NO: 62102 - DNA, 1064 bp, Bovine  19866881116714
taaatatggtatatgggtgcattttgttcctggatttatcttccgctggatatggtaagtgaaccttgataaatatgtagcaggtatccgcagcagttgtgagagtcaatttggcttgaaagtctaccattgctatccactttctgaaacagtacatagatcagtgtggttaaacacagagatattataatgcaaaagggattaacaaattccctccctgttttgcacttagaaagtattgaatgtacttaggaagagcgataattggtttattattctgaaagttaaggaaagtcagttctttaaggcattttattttatttatggaagaagacttttcattaggaacttcagcttccaggcataactagaataaatgaggtttttccctttgtttgttaattgacaaactgatgaaagctttaaagactctcacacaatgtgtaaaacttttaattatatgaagctctaaagttgtttatgctgacttgaaaatgataaaggctgaataatgggatattataaaaaatgttctacaggaaattaacaagattatttgttttgcctgactttttttagagtcttgtatataggactctgtatcagaatataggagtctctgtccaaagagcatttcctatacttaagaaaacctcaggagatcaccaagtgtctttgtgcctcagctcacctattttcaaagtagacatttttagcaaattaataattattagattaaatttattatggaaataactacaaagggaatttagggaaaaaagtttgttatataattttttccaatacagtatattttgaatggtattacaatagtaaaaaaaagaactccatttatctcaaatatctctgattgtatgattaaacagtttttcttctgaaattagtagaaactaaagatatagattgggcaaaccatattgtatgtttgagactagcaaaaaggaaggctaaagtcagtgaatgttttccagaatttattttgctgattatagcatttgaactatttacaaatccttttttaataatcagttctattttcttta

SEQ ID NO: 62103 - DNA, 982 bp, Bovine  19866881139628
atgaaaaaaaaaaaaaaatgtagtagatcctttcaaagtaatattacttactttagttgtgctcagagccaaatcaaagtccaggattgggttatcaactcattccagtcatgatattaagtagggaaaaggtcatgccagaccctttataactcttaagtcatggaactcagaatgcagtcaactgccaccagaaggatcaaatgggcaaggggtgtgctatctttagcaaatgcattctggtctctaagaccacactccattttttgcacttgaactagttcttaactgtagtgtaaacctggagacaaaggtgattatgatgtattagtactacatgtttgcatttccagtaatgattcagacatcttattgctgaggttttgcattcattgcaaagatatttcataaatttttttccttgataaagggagaatagatttagtttacagattctagatcctttaaattgccagatagaatgcgtgcaatatactataggttgttctaaaaaggttcagtttaattgtatcaaaagccataattcagcagtgggcctaatactataattaaaggaggttcaaggtactatgtggtatgcatttaaaggattaatctactttaaagagatgttcctttgatcccagtgaagagttgagttgctatgcctcacatctggataaggatctatactcagaaacgtcaaagtgtgaacatgtgctggggcatgggccatatttcacagccttacaaaatacaagaatgtcggggattccactcctccttggggattcatcttctaggatcacaggaccccttacagttactgtctcctcactgcaggccttcacttgtgatgagaggggaggatggttatattaagacccactatgaagccagtgagaaagcaacatggcaatgtggagaaaggccaattgtctgcattttcacgtcatccccgcctgctgatgtgttatctgac

SEQ ID NO: 62104 - DNA, 701 bp, Bovine  19866881165411
tattttcttacagttctagaggtctgaagtccaaaatgtcttccactgggctgaagtcaaggtggcagcagggccatattccttctgggtgttccagagttgactcatttctttgctttttccagcttgcagaggtaacttatatttcttggcttcacaccccttgttctgtcttcaaggacaacaacacaatagtgaatctctccgccacccccccctgccctctcctttataaatttcctgtgcctacactgggcccatctgggtaactcaaactactctccctgtctcaagatcttaacctagtcacacctgtaaagccccttttgtcgcgtcacatcacatattccctggaggttctagagattaggatatggacatctttgggagccatcattaagcctaccacagtaaaaattaatggggtgtctacagtataatgcttattctaaagaagatacttagtcttcaaaatttcataggaaatcaaaatatttactgttcactagaccaattaaccccaaccaggtcagaattgttagagtcaattcgaatgaaaatctttcccattcaactccacaaatgcgttttgggtgcaagtattacacaggaatgttgagaaaatccaacagttcattgggtaaaaggagttgtcaaggtaatttctttctaggctgtggatttctccgcagatgttgcag

SEQ ID NO: 62105 - DNA, 1116 bp, Bovine  19866881351523
agcaggtcaggaaaggggttatggttaccactgcaagatgaaagataagcagccaggcagttagaagccaaagcattttatctagaagagcaggtctggccttgtttccatcttgataagaattagattggagagcttgtttgtctgtagactaggatggggtggccgggctgaataaaggggacagggaagtcaggggcttagttatggagttgtggcaaaccactaatgtagtgataagtccttcttttgtgttgtacgtctacctgaactttgaaattgttagacttgtctgtttagataacatggctgtgtttctttcaaatgtgcagacttaaatatctagaaagtttaagtgacctgaacaggcttattatcctcgtttaaaatattaagacaatggctaactggttaagccactgactcaaaacttgaaggaaatgacattaactcctcttttttttttttaattattttattttttaactttacagtattgtattggttttgccatgtatcaacatgaatccgccacaggtagatcaactaaactttaaattaactcctcttttaaaaattttttttcagcagttttatcaatttttattggaggatattgttttacaatgttgtgttggtttctgctgtataacagtgcaaatcagccataagtatatatgtttcccctttctcttgcgtcttcctacccctccaggtcatcacagagcgccaggcgggctccctgtattatacagcagcttccctctagctatctattttacacatggttgtgtatatatgtcaatgttattaactccttttaaatggtatgcttacctttattctgaagcatatgcacaaaatactctggattacatttaaagttatgtttttatcccacttcaaacccccaacagattacaattataagagcttctactttctgatgatttaactgcttgaacagatttttaaaatataattattaaaatcaaaaacttctgaagtcatcaagtttcattctcggtgtatttaaaaaagagacatggctgcaggttttcctggggttttacttgctactgctcttagtatctcagtttcgaaagaaataagaaa

SEQ ID NO: 62106 - DNA, 1279 bp, Bovine  19866881380111
agttcattaccaaattgatctctgaagctcctcttgtgtcactttgcatatttattttagagaatattttgaggttcaatattgatatacactgaagacagaaaaattcaagaattcatgtaagtaaaaagaagtgaaacaacttttacacctattatctgtgaattcaactctagatatactaaatagtttcttacgtttcttgccaatatttttctgtaaaaagttattcagtgtttaaagcagagtgtctttatgtatgtgtgtatatttaatgttgaattttttaatcacttatatgctgtgctatagtagtaatgcaatgtgattctcattgttctttatttgaattattatatgtactttgataagcatattgtaaaatattaagaaatccaaccagtccagcctaaaggaaatctgtcctgaaactccaatatattggccacctatgtgaagagctgactcctttgaaaagaccttgatgcagggaaggaggttggaaagattgaaggagggaggagaaggggacgacagaagatgagatggttggatagcatcactgatgcaatggacatgagtttgagtaaactccgggagttggtgatggacagggaggcctggcgtgctgcagtgcatggggttgcagttgagcgactgaactgaactgatgatagcatcagttaagagagacatatttaaaatactaacgcatactcagcactgctaaagcagataggttgccagttaattatgataacttgactttttgatgagtaaaatctcacattctgtggaaatggagtttgggtatgtgtgtgcagttagctggaaggatagtaggaagcaaaataacccattttaagaatgctatctaaaacttcaagggaagtctgtgttctattcccccacttcaaataaaaacaaaaggggggagtgggagatgcgaaggttttgaggggagggaggtcacccagcagtcatagattataaactctggaagtgaagttgataaggtatgggcaggagagtgtcttttagaaacctgacaaataaggcacaatcctacaaatgaaccataaacccatagaaaaattcaggtttttaaccaatttttctctgacctaagaaactgtgagacaaaaaagttctataaggcagaagcctgccttggagagaagccagggtcagtcaactgtagcaaagcttattgttgttttcataaggtagatggatgtggatccaccagtgaatgaggaaggcatagtcaaaggtggtg

SEQ ID NO: 62107 - DNA, 806 bp, Bovine  19866881691881
cttttcatatactaatcccagcaaagattattataagaaggcatcaattttaagcaaaactgtatgactgaagcgaaaggtgttgttttcatatttgtgagaagtgtaaatgtctaacttttttgaagcattccattcccattgctctcaggccttagcatatgactggatgggtggaaggatttttttttttaacttatttcatttgttgctgaagtttaagtctcaccaatttacgtgcaacttagtatgttactgggaacagggaagcaaaattgaaaattagaacattcatcaattctttagaaacaaatgagacaagtggtagatttcctgaggtagaaaaacatgaagagtcaagggaagcacaatttttgatgttgaaaagacaattgtggagtggacagcagataaacagcattttcccctgctggctccactgcagaagtaacttgatcactctgtacaacctggcaagaagcttcaggcaggagcaaagaactatcccaggcaagtagggggtggggtgtggaagttgttagattggcttaccaaacccttccctaacagccaagaaggaagtggattacctatggctatgactaaggaacttatggccaacaagaccagttgcctgcacagaattctgccaagttcagtagcttcagctttcgtgatggttttacacaagtttggaaaacaggtgggaatatatgggggggaaagtccaggaggtagatttcattttaaacagtaaaggaagataagcaagatttccccagtgcaggagaaggataaattaggag

SEQ ID NO: 62108 - DNA, 1671 bp, Bovine  19866880126314
aaaagaatacatttgaatcagttctaaggagatggatgaaactggagcctattatacagagtgaagtaagccagaaagaaaaacaccaatacagtatactaacgcatatatatggaatttagaaatatggtaacaataaacctgtatacgagacagcaaaagagacactgatgtatagaacagtcttttggactctgtgggagagggagagggtaggatgatttgggagaatggcattgaaacatgtataatatcatatatgaaacgagtcgccagtccagattcgatgcatgatactggatgcttggggctggtgcactgggacgacccagagggatggtatggggagggaggagggttcaggatggggaacatgtgtatacctgtggcggatccatgttgatattggcataaccaatacaatattgtaaagttaaaaaataaaataaaattttaaaaaagtatgtatatttaaatataagtaactttcacttaattaacaaaccttatggctattggggaaatgacttatttgagaaggaatgccccatcttagtgcatactgccaagcgaactgagaatgcaaatggtatgaatcacatttgacccagtaacctctaccttaagtgtagggcatctctggtaattaaattattatttaaattatttaaggatgagacaatggcaccccactccagtactcttgcctggaaaatcccatgggcggaggagcctggtgggctgcagttcatggagttgctaggagtcggacacgactgagtgacttcactttcacttttcactttcatgcattggagaaggaaatggcaacccactccagtgttgttgcctggagaatcccagggacgggggagcctggtctgctgacgtctatggggtcacacagagttggacacgaccgaagcgatttagctggcaggcaaggatgaggaggtttgtccctattgcattgtttcttagcagcatagttctgtgtctaaatccccacggaccactatcattgtgttagttttgctaaaaacttttggaatttttatttcatttggtactatagcaaccaaatggtcatttctgaaatgctattttgccaccttagtggttcatattttaataaaattcaattacatgttttagctttccaatgtctccctgatgttataagttaataataaaaagtatcaaatagtctaattttcttcaaagccagtaatattccactgactctaaaactgtttcattaagggttgatgttctgagctctctaggaggtagagataaaagggcaaaagaacttagtagcagttcagttcatccaagccccctagtagagagagacatattaggaagacaagaatctcccaaatgatgtctaaggatacatctcttacctcagctattgaagtacctcaaacctgggacaatcccaaatttattctgagaattgactatgaccatcaacatatcaaaaatgggtgacaacattgcagccatgttggggagcaatttggaagttcctcaaaataatatttttactcagtggctcagtggtaaagaatctgcctgcaatgcaggagacacaagttcaatccctgggtagggaagattccctggagtaggaaatggcaatccactccagtaattttgcccaga

SEQ ID NO: 62109 - DNA, 1250 bp, Bovine  19866880375369
gatgccaggggaactgaccaaggatgataagggctgtgtggtgggaggaaggggtgtctgaaggatcgttttggagactcacaggcaacagtcatgaaaggttacaggacaggacgatggacaagatcagggcactgccagggaggttggccatgagctggacacctatggtcttggatgggtcagttaatatctgcaggagtccacgtgaaaagccagagtgagaggcaggggctgggtcttcagtgatggttggaagcatgctgtggcaacagggagaaggaagctggtccattcatcttgctggaacttgaaagaacaggagcttctgtaagaagactgaagagaggcaatagggaatagaaacattccaaaatcaaataaaaactttttttttttttaaaaaggccagagtttatttctatttaaaccattaaaatatccaagtcccaaggatttccaggtttaagatgatattacagtcaggtggcaaccgttggttgtttttctttctaaagccttacaaggatcctgagcaattctcctccttgaaaatttttcttgtatgaaagctgataccttgtttgcttcacacaagtacatcagtccagtgaggatgaaaaacacaatgccggtagcaatcattgttgttaccagggcgaagggtggatgatcagaggacaaagtgatgaaaacaccgccgagtagcagtgctaacgtcacagcgtagaacaaatagaagcacaaccagcatctacgcgagacctcttcttgcgagattctttgaaaccaggtccactgactgttagctggaaaagctgggatcatgatgagttttagctgagtggactgaagaggagtcttgagttcaccaggcttcccagggccacttgggagggcagaactctaggtctcccttctcctccccatgctccccaggaccagaaaacaggtggactttcctcgtactttgcaccatcctgtcctcctctttctgactccatctacagttgaggtaggaatctctcctctacactgtgggagagttctgtaagctcatttctccaagcttagttagttgttggtatgctaaaaaaaaaaaaggcattaaaagaatttggaaaatattttctcaagatagcctggcaagtctgatataaattagagctgatgaagcaaacttaatctggccagctaaaggaattttgattgattgtaaaggcaatatgaagagccacgactgttataaa

SEQ ID NO: 62110 - DNA, 1147 bp, Bovine  19866880380963
ttagaaggaaagactgtttgaaggatctcattattgcctgcttttaataacacctcttagtggccttggatcaccaacatcaccagaagcgtgctcatattcaattccattcaacccatgtggtttcctctttagtactgatggggactgagtaagtatgaaattataatgttgacaataatttcccttgttctttttggcaggcacaatcagggtctgatattcaggttatactgccagcagcatttttcaattagcatttaatactccccgacaaaatgctcaacctttcgctggcactgaacccagtgtttcagtgaaaaattgctcagaagcaaaggccttttctttcattgatctccttgttcccctacagtttctgtacttggaatactctcagctttcagggacactgtagatctcaaaaatgttattttctagtttgtgcttgctttatttgtagtgcttactgctctgattttaaaagttgacaggcattgccttgcaagtcctggaaaaatccattatgaaggtgttaggaatagacattcacacagactcactgtaccatcattaatgcatcctccatgaagagctccatgtttttcacctatcttactgtgattagtgagtcagactctaacagaagccaggactttttgcaaagatgttattaaaatttctaaattttcaaagcttgtattcagaggacaccactcttacgagttattttttctaattcaagtaaactattctgctgagtaaaaaggagtttcatcatatgaagtgtgtgtttagacttagattctgccttagacactttgactataataccagtttaaatgtgaaacattcaacttaaaaatagatttttttttccaaaaaataattggtttttgtcttttttttctatcaaactttttatatgatatagagaagctaatcaatagggagctgagtaaattgtggttaaatgtccttagaattctgttcacatcatcttagtgccaacaaaatgaaattagagtaatccagggcattggaataaatccaagaatgacaacagggactccatgcaatgccttgccttacctctgcagaaatcatgattccaaaagctaagctgggtttcaaagggtaataatat

SEQ ID NO: 62111 - DNA, 1227 bp, Bovine  19866880535493
aggactgtcatcctggtgaggcagagagctcctctccatacaccggggcccagacatcaaggtgcatgtgtgacctcgtggttcctcacatttgattctttgacggatccaaagagccaccaagaaagaaaacgggctcccgtggtgatggagccaagttgggcgaggggtgctcctgcgtccccgaaccatccaaggcagcgtgtgaaagggcgcgctttttaccttccgccctcggggacgtgggttcccacacccattcctaccgggaggaagcagctgcaggcctgacttcatgctgtttggcatgaaggcaacggaatggaaaagagaagcgctggaaccaagtcaggccctcgaggctccgacagcagggctgagatctgtcacatcccttggtcacgtggatgagccgagccccagttaaggatagcattcgctcccctccctccttattctcccttcttactgactgaggagccttggaagatgggtttaacctctccacacctgagcctcctcctctgcaaagccaggaggagaacagctatctcagagaattgttgagaattaaatgtgataagacacgtcaagtggggtagtccacagctgagacccaaccaataaaaggcccaataaatggtcccctggctctccgttctctggggatggtcctctctccttctctgtttcctgggctctctaggacttccctggtggctcacatggtaaagcgtctgcttagaatgcaggagacccagattcaatccctgggtcaggaagatctcctggagaaggaaatggcaacccactccagtattcttgcctggaaaatcccatggatggaggagcctggtgggctacagtccatggggtcacagagagttggacatgatgagcatcttcactttctagggctcattcccccatttcgttctacactgggacccagcgactgccctgacattttgtccctcgccagcacaacacgtgttcacgtcctcacaaagaggagagaaggaagatagaggtcagaaggccttcccaccacaggaggcttccgctgaaatacagcctgaaaactggatggaaggtctctccgtggactcgggtggggtggctggggactccagcccaagcaggcttaaaagaagtgtgcaacaggactgaatcactttgctacacacctgaaactaacatgacatgacagatcaactgcacttcaat

SEQ ID NO: 62112 - DNA, 1256 bp, Bovine  19866880688652
gggtagaactgagcaaacctggatttatgtggagtactaaagttttgcaaatttcccgattttgatattcattgggtaacttcactgaagtttatttaaagtaatttcaagagtgtcaaattcatattcatgcataactgcaaaagcatattacaaagaagtctatattttgttttttaaactattttccccttgaatttaagatattcatttaaagacctatactttattgaataacaggattttgagggaaatggtacaaggaaaatacacatggtttctaaggtgcctcttgatttcagaattattgaaatgtaaaaaatcaggcttcttagaatcaaggaaatagtgttccactgagaatagacaggtaattatactctttatttttaaccatgaaatacataatagtttcctatattatacttcatttgtttctggcttggtcttctttgacctacttagtctctgggatatatttataacactcttatttttctaggtctgcccttctacctttctgacatatgtaggtccttaagaactgattctgtctattttgtactatgaaaaagtaaaactttattgatggcaatgaacacttattttgcatttagatattaaaacttaacatcttattttaattaatttaaaaaatatgtctgagtgtggcaaattctatgtaaaatacttttcactctaaaattcctgtagtccaaaaattgaagcaaataaattttaacttaattttgtgtctaaagtttgaacaagtcatactgagtcatcagtggagtcatcaaagacctcatattttgccttcttttaagtcttatggatagacaaacaggaaaaatttcattcattattttttactccccaaacttttcctgcatctcatatttttaaaaagttttattgagatatatttcacatatcataaaattacactattcagatttacaacgatttttggtaaatttactgagtgatgagccatcataataaatcagctttaaataattttcataatatcaataaaatcctttatgcctttacagtcaatcttcattccccatccaggcaaccactattctactttctgtctttatagatagatttgctttttctctacattttatataaaagaataatatagtattacatgattttttggtgtctgtcttttacttagcattatgttttcaagattcttctatgtttgagctcatgtcaattattcactaaacagtattctg

SEQ ID NO: 62113 - DNA, 5051 bp, Bovine  19866880714020
aggaggatgtactttgcccaagtgctccaaagcagaagccctagctttgtccttctggaacacacatcacagctggggaaataagcatgcagcaaccagcaatatttccaagttgcacacatagagtccaggttacctgcgcactctaaaggaaacagagttaaagagcttttaaaagagttatgagaaggatctaaacataaatgaccacaatctacattttcacagcacactgtagtttgtgaagtcctttttcttttaaagaatttttttgatgtgaaccatttttaaagtctttattggatttgttacatcattgcttctgttttatgtttcatctttttggctgtgaggcttgtgggattttagctccctgaccagggatcaaacccacatcccctgcattggaaggcaaagtcttaattgctggactgccaggaaagtcccagtttgtgaagttctttaacatgcctccttactggtttctcaaggcaaccggttgtactctggttgtacaagaacttttaatgaacagtcaaggaaacagtgactctcagagggccagtgacttgcttaatctggactcagggatgaagctcagttcagagtcgacaatctagggtcagaatcctgcagtactttcctccatatttgcatgggttggtgaaaggagaagaaagtcaagcaaggaaagaagtaagtatgaggacaagactaaatggggtatgaccatgaccatatgtcctcaggcaagtctccctccaatccagcctagttagatagtgaggccctgccccagccaaaggttccttgaggtttagcatatggttacataggattttagatgagaatgtaaaaaaggcaggggggacaggggtaaatgcacaacgtccagggctaactgtcttcctgtagtgtctgctgaacaaaatgaatggggaaaacacaaacaaggagtagaatttataagtttataaaacataaggagtttataaaacataaggagtagaatttatgttaacttcccatcaatttctcaaaaatattttactatggaacatttcaaaggtatataaaagcagggagagccccattcattttcttttttaaaaatgtatttatttatttatttagctttggctgtgctgggtcttcattgctatgcacaggttttctctagtttcagtgagtggtggctactgttcattgtggcgcttgggtttctcatttctcttattgtgaagcacaggctctaggaagctcggatttcagcagttgcagcttgaggactctagagcacaggctcagtagttgtggtgctcgggtttggttgccccatgccacgtggaatcttcttggaccaaggatcgaacctgtgtcctctgcattggcagctggattcttaaccactggatcaccagggaagccctcatttatattctcacttataatctgatttgtttttgaaaccatttgaagcaacttgaagagattcatacagcaaactataataggatggcaagttagtggatgagaaaaaggaaaatattgatatgaaatgtaaatggtgtcttgaagtaaaattaatatacaaagtgtatgtgggaaggttctaaagtactcttgtactttacaagagtacaatgggaaatttaattctaagtttaaccttcaatgtaaagggtaagaagcaattagctacagattcatgatcacatctcctgagatgcccggctctctctctactaacactagagaacaattcttctgttagctttgcctcatactcactgtcttagcttgagctgctgtagcaaaataccctagactggggtggtttaaatgacagacacgtattcctcacagttctgatggctcacaagttccacgtcaaggtgacagcttggctgggctccagtgcagactctcttcctggcttgcagacggccaccttcttgatgtgtccttggagggtggaaagagagtgattgttctcttttatgttcttttctaagggcactaatcccatcatgaggtttccatccttatgagctctgaaaggcccatctacaaataaccttcacactggaggttacacttcaacatctgaatttgggggtggagggatacgattcagttcatagcaacgatacactggggaatgagattaacggtacgtttgaaaacttcctttgttttattgagctatctcttataatttctcatgtaaaccaatgacatgtttctactggcccagcttactttagtaacagattttaaactttctagtgtaaatttttttaaaacattttgaaggtatgaagtattgttatttatttttagtatcacctccttggtggcacttgaaatgtggattagtgattattaactttcatgtgtcatagaccaatttgagactctggtgaaagctgtcaatgcagacacacattaaactctgtatacaatttcagggaatcacagacctcctgaagtctcagcactctaagagtaaataactctgcaatatacagtaatagataggcctttagacatattatataaatattgtttactgtaactgagcatttgacatggattgagaaccagccagttggatttaatgctcttggcaagcataggaatgcagttattccatgcagcagattaaacaaatgcttcaataacttggagaacaggaaagctgcaggcacatttaacaaaatacaatgctaatatttcaaagttggaggggatgtctgtgttagccagacccaagtcttgtgcccaagattctcaagttccttggggaacatcacaaatctccagctaccaccatttcatggtcccaggagaggacgccccaaacatggacataatcctcaactccctcttcacccccttccccccatcattaccattgctcaactgagaccaggctgtaatgtgagaaactggagctaaacaaggtacaaatataatacagacttacaaagaaaaagctctaagaaactcggtattgaaaaaacatgttagaaatgacaataaatttcacattttaaaaagctgacaaaataccagaaacagcacattagtcagaaaattaaggtcatttaaaaactaactgcctgacagatctctgaaatactttgcccctacatgtttaggtgtgtgttctttggtggcctcgtcacacgatagtgatcttagagtcatttttctctagatagcatagaaagataatccagtctgtctggcataagctgattggaattgttttcatttttactgattgttcaaaaaaaaaaaaaacttcttttgggcttcacagcttattgctgataatgtaaaattttagggtttctctctcctgttttgttcgaccgtgagctttaaaatttggaaggattttccccgaacttgcttcaggtttatttgaaaccctgtttcccttcacttgtcatagacacagagagacctatttacactatgatatgatctctggtcctgagccatcctttgactgtgccaggtgagtcggccagtggaaaatagagtattactggaagttattaccacactgaacagctggcgggaacctaattgtacaaagagagtgcaagcaacatatatattccagcaacaacaaaacaagtatatccctctctgtatgcctgctctctgaactcgtaagtcgcagctcaacctcgtgagagttttttgctcttctctctcccaggcggctcaggggtaaagaattcaccctgcagtgcatgaaacgcaggttcaatctctgggtcaggaagatcctctggagaaggaaatggctacttgctccagtattcttgcctgagaaatcccatggacctggcagtctacatacagtccataggatcacaaagagtcagacatgattctgaactaaacagtgaacagctctccgcctactccaagggctgccgatatatggctgtggccatttttgtaacacctccatagaaccttctaataagtatccttagggttcaggctcaagacagccaagacagaaagaagaggaaaatttttctcctcctgatgatgttggttaaccttaataggaattactcattttctattgaaaggagaagagatgttctttactctttacagaaaggttgctctccatttcctttgctttctttgggcttgcatcattttctttttttttttttcagttgatacagttttcagttggtacagtcagtttcttgtatgaacaaattaaaatgtctcctttattggagatgatataattgactataataactcatgaaatgtttgggaagttagagttaagctgttggcctaaatttagtttgttattaaggtgttctaataacaattagaacaaaccaattctaaaaagacatttgggggacagtttaagagattgttaaatcaaagtggtgtgtatgtgaaatatcatcatcctatgttttctaatatgtcctcaacgttttttctaagaaaatttttctatattttccatagttctctaacacagaaccagttgatcctgaatcgatgtttttcagtgaattttgagagaaacaatctttgctttctgtcattatgtagctttccccttcaaagaacacagaaatattaaacaatgaatatttgatatggcaccaatcattgaaccttataagttattggtcttgttctcaaaagcacttctgtgctttatgtgctggtttcaaatgttgaaaatgtccatgtggacttttacattgttctgcaccctaggacctcctgctcaaaaaccaagataagaaaagaatgctcttcagagcattacggctcattagggtgccgtccaaaatctcatacatgcctgataaagttagtggaatgtcagggcctctgctatgattaaaggatctaaatgtgacttgtcaagtagctcaaatattagctctaatccccatttgcacagagctctgagttgtggctttgtagacacaaagctgtatgtatagaatatcccttgttacagtccaaattttcca

SEQ ID NO: 62114 - DNA, 1143 bp, Bovine  19866880743371
aattttgaatagtagcaggaagtaagcattttatctcagtactttaatagatacagcattatattcatctttttcacagaggcaataatatctgtgaactgatcactttgtagtgaaatacccatagcatggagatagtctagttaaatattctcagctaaatagatatagttccttcactccccagaggcttttctcattacttcattggtcactgaactatttttctgtttatagtcatattcccagaggattacctgaccttggaattaaacacctgacttgcacaggtgggtgtttgaggtgacttttcaaacagtcctgtattctggttggaactttaagcacagaaaataagcataatatcatgttctcagtaagagacaaggtcaccatccttttccaagtcatcaaaagttcagaggtaatacctttaaaacaaaatcacccaactagtaatatctttagcactagaataaagctaatctgtttattccatagccagttgttgctctattggctttctgctttatagaaaagcaaaaaccagagaggagaaaaatgaggaaggaaaataccaagagaagcaataaaagctaaatgattatgctttagatgacagaatttcaagatggttttataatttcttttcatccttcattcttcagaattacagacataaatttggattaatttattatttccacattattatctaacctactctgtcaatgttgtagttgaattaactcaaatcatgagccactctaataaacagaaaattacattggctaagagcaattccatggtattgaactagtgaacttatctgtccttggagaaataatttatattttctgtgccacattttacctacctagcctagaaaatctctaggtttccttctggccctataagcttatgagtccatgaattttctgaggagaaaggataaattttcccttcatgggcaggggattcagttgttatttttattatcataaatgcaaaagaagacagttttcatatttgagaggaagctttgtattgaattacataaagtaaatgttttaaaaataaattcttccattgattcccttcttgcatttttccttctgttgttagctttctttgcaatagatg

SEQ ID NO: 62115 - DNA, 1174 bp, Bovine  19866880761714
aaatgaaatagacaaaattctttaacatatcaatgcaaaaaaaaaatgatgaattcagaatgcctgaatcaagtaaagacattcctaagttccttttcagaaatgagcagaacggaagaatactgacagtaaagaaaagattcctttcagccctcactcaaaactcttctccctgtaattgacactatcagttacttgctgggaaaactcgtgattgttcagaattttgtttgttttctttctagaacttacaggcttagagtaccttctttgctaagaactttttttttttttttaacatctacgcagtagaaaactttctatttgtagctaaatagatagatgcaaaaagacttatatttatataaaagaagacgacagatgtttcctgggagtttgttgtatgttaacttgctgtgaatgtgtgcgttgaagaagtacaagtgttaagaaattgatgtacaaaatgagaacattcttcccacaaacactgcctgagaaaggcagctaccaccagcctttgtttagaaaccaacttttacattacccttaattactcacccctgcacttgtaaattgagggtccctgcagaacacacagtgtttcttaaacttaattaccttttccttcatgagaaacgtcaccacccaaaaaggcagtttcttaaggaggggaacttctaaaacaggccccgtctctccaaataccactcccttgttccccagcacctctgcgtctcactgatacccagaggcattatgtcctggctccaacacgtctcatcagtaagacaggaagttcttcagtggctactgaagagcaaatctttaaacatcctctgcctagtcttgtgggagaaggaggaggttaactagcaatcccaaagggattctgcattgttagctactagaaaaaatcatcttcagaataataaagcttgctgctgctgctaagtcacttcagtcgtgtccgactctgtgcgaccccatagacagcagcccaccaggctcccccgtccctgggattcttcaggcaagaacactggagtgggttgccattgtccttctccaatgtgtgaaagtgaaaagtgaaagtgaagtcccttagtcgtgtctgactcatagcgaactcaggtttgcagtctaccaggctcctccattccacggggttttc

SEQ ID NO: 62116 - DNA, 1061 bp, Bovine  19866880827560
atagcaacccaccaaccaatgaaaccaagacacttgtttaccaacatagcaattgggatgtttaagaaagcaaaatagaaattccaaatcctctaataagttcacagctaaaaacaaatgagatgttagaatcttcagcatatatttagcacattacactgaacactgtaactcactttgaacagtatttatcctcttaagtaaatttgaatctgctgttgtatctctgcatggaaaaaaaatgaaggcacaagggtttgggtttctatggaaacctgtactttgattactgatggatttcaagtgtataatttttcgtcccactggtacaatgttcgggggaaataaagggaaagaagactgcaaaattatcaggaatatttccttagatgctaatattttcagaaccatagattgaaagatgctggaagacacttcaaattaatttttaactttaatcaataaatagttattgagttcctattagatgccaagaactgtcccagtggctattgcagttaataaaagagataaaatttcataaaaaagctttggatataactttaccaagaaacttgagcaataattaggtgtttgagttttgagttatttgaattttgttattttttcttacctgtattcataaacttttaataaatgaattcttgagatagactttgaaaagtatgtgttttcttggaaaataattttttaattaagcaagtagagagtttgtttctgtgttcatcctttgctgaaggggatcctttgttctttttgttggtctcctgacaaaggttttaggacacagtcctcagtggtttcaataacatcatttgcaggtgtgacatgttgagccaggtgcttctaagaaggaatgacaacttagaaaacaatactttttggttcatttacctaatttctatttagcataaaatgtctgatggtttccatggaaaagacaagcaaagaccagtattaacataggatctggtacaaataacacgcaatagctgaaactactacttactagtagcatataaatacatgtttgttcaatt

SEQ ID NO: 62117 - DNA, 1279 bp, Bovine  19866880834501
ttcatattccttgcttgatatcccatgaattgattttgcaatcaaacctctgtgtttagagttacatttaatttcaagtaatgatggttttatttagaagaaataatagatattattaataatacaaatagagtctatagacatctaaacactcgagggccatttttttccattgtcaattatatctatatcatccctaattccttgtcagtaatacttgctttatttttcccaacctaaagtcagcaagtaaaaaaacaggaaactaattttaaaagattaaaattgctcaccaaaggaaagcatattaaaatataaagaattagagaggtgacacggagaaggcaatggcaacccactccagtactcttgcctggcaaatcccatggacggaggagcctggtgggctgcagtccatggggtcactaggcgtccgacacgactgagcaacttcactttcacttttcactttcatgcattggagaaggcaatggcaacccactccagtgttcttgcctagataatcccagggacaggggagcttcgtgggctgccatctctggggtcgcatagagtcggacacgaactgaagcgacttcgccagcagcaaccttgtatttattaattccaaaaatcacttttattcttttatttattttttctgaattaaatgaagaaagaaatgttcttctgccactgaaatccaatatttgagtttggtatttagtgcattagcttttcccttttcattcagtatgttttgtttttccctcttcattctggggtcaatttcttctgtaaatgaaaacattccccgtccatttcatcaccccatctcctacctcctaccacttatccagtgaaagattattgtttcaaaagcagaattttcttttctttggcaccatttgagactgtatcttgttggtttaaatttttattgccttcggacacaaagtaaacttgttaacagaaatgttaaacattcaaagtgtgagactatttgtaagatttttaagatctctgaaaatagtttcaagttttattcagttagaaaagcaaaatattccactgaaagatttggaatattctactaaaaaacaactgagcatctctgtaattcccataatataatttctttgaacacagatctgacttaaaatgattttttagtttgtcatctatgtagtgactaacaagattgtttggagcaacacataaactaatatcaaccttcacattagaaatcagtattaaaattgctttttaaaatgttgga

SEQ ID NO: 62118 - DNA, 985 bp, Bovine  19866880851589
cttggagagcctagcgaaagtaaagtgaagtgaaagtgagagagtcactcagttctgtctgacttctttgtgaccccatggactatatagccatgtcagactcctctgtccatggaattctccaggcaagaatactggagtgggtagacacattcccgtctccaggggatcttctcgacccagggctcaaacatgagtctcctgaattgcaggcagattctttaccgtctgagtcactgaagtttcaccgattgacatttcagtgtccatattttataagtgggaaagttggaagctgtttactcaaaaaatgttcttccacccttttgtttgtttttgttttattttttgggaaggagacctccttctaaatcctaaatgcctcttcatgtggaacctctgagctatgatgtctacaatcacccaagggtgcttgtgcacattttcttagatcgactttgtgctgtgtgcagggaagatagtaatggacccatggaggaaactgaggctcagaatggtgaagtgacttgtccaaggttgcgaagagttggacacgactgaacgactgaactgaactgaactgaactgaggctctaatctagtctactgcttcttataggatgtttctgcctctggagcatcctattgctttatcagtcagttgtctctactgatttatcatttaggtaaagtttgatttcaagcctaattatcttctgctcctcactgtgtcctagcctgggtcatcccattgagcaagtatccttagcttatattgaatgtttcggaaggcctctccccacctgtgttggaggcttgatgtcagtgcctactgcataggatcagacaccaaacctattttggctcagagggaccgtggactccatttggtctccattgatcactttatggatagggaatggaggtccaaagagcttttgtgatttctcaagtgtgagcagctcgttagaggtaacgctcagtt

SEQ ID NO: 62119 - DNA, 1628 bp, Bovine  19866880859309
tctccttttctcttttttttaatataaatacttttctaaattctaatttcatattagaaaacactagattattcccttattttaccagattataaaaagagcaaaataacaaaaaaatgattggcaggaaaggcatttggtctctctcccactgtaaacagaagccaagttcattatcttcacctcctttgtcttctgtggcaaaataaaatgaattttgtctgacaatcaagtgtttcccatgcaattgctctccttcctctcaagtgcatattttagttttcttacataaaataacaggactttaatttccttcttctcataaggcacactgtagtctatctcatcaagcctcacaagttccttgccgaggaagatgaaaactatttttatattacagatgataaaaaatgtagagattcttgaaaaacagcacgcaatctttccaaaatgtaaatcgatgcaaaattaggaacaagagttcagttccacgctgtgcaggcctgtgcaattctcgatgagtttcctccaattttaataagcaatcacctagggatcttgttaaaatgtggcttctgattcactccaggacagcaggcactgagatttaaatttttaacgagctcctcggtgatgtcagaatggctggtccctggacattctttgagtagcaaggctgggttgcttcccaacagctagtcacacagaacctgtctcagttcattggaagagaaaggggctgaaattacaatcagaaagttgggactcatccagaaagcagcatctctttctctgagccatagcttaatttaaaaaaaaaaaaaaaatctggcttgctcaaaggaggatccaagaatccttgctctaaagcattagtatctcacacattgaattggtaggaatttgaggtcaatgttagcaaccctttacttctgttagactcgctcagaatgtctgaaggggtcagacataaaacattctccaaacttaggttaataatctaatgatttagactcaagaaagggatgattattttttgtttttttttaacaagatctttcttgttgacatgagcaaaagacaaaacaacacttctaactaatggttactagttccttcctttccaagatgatgccaaatgcatgcactcttctcttgcttcctcccacatactcagcctattgtgtgcttctgatgggacacacacgctccagtaagtctggaacttggttgtcgagaacactgtatgaagattatctctttaaacgctgtactgtcaacttggcctcccccactatcttatttttggcgcttccttgtgctttctagactgtgggctttttattttctgttcagaacataaaagccgactttaggagacaagagggaaattcacacgccatatttcaaatcagaatttgaaaggaaaactttttgaggttggaaaaatctaaatgctctcccaaggaagatagtcattcctaaatatgaaacacttaaaaaagtttacgtagaaaacagtatttcctgtttcatatgcagtgttctaagtacttgagaaaagaaagactattggaagttacttggttaccaagagaagatataactacacagtcatttgggacatt

SEQ ID NO: 62120 - DNA, 699 bp, Bovine  19866880860099
acttacatcactctgaggacatcagaagatggaaccaaatagccagccaactccttgggttttactatatacatggatttatgactgaaacaaaacttggaaatagcaaatatatccatgccaggataatttaagaaagtgaaaataggagttcaaggattcaagttacccagaaaacaacagtcagatgagctgccttcatttgaggtttatgaactaggaaagaatgcaactcaaccgaagactttcaccaggaaactctggcttccaagatgcaggtctggcaactcctcccctgtcccctcccctgtctgaagttgtgtcagactctgcacaacttctgatgctgtgaaagggcagcctgctatgcccccagcatcctgagtccagcctcaaaggggagaccagagtggggacaggggaaaggacagaagttactgttgtctgaaaccatcgtttggggaagatatttatactgctctaaatcactgaaaaagcactgacatgcgaatcagaatcaaccaaagaactgatggtctacagggatgatgaaaattcagaatgtaataagagctcagcactgcattccccttcccttgcccccaacccccaaaagtatgataaacctgaaagataacaccgagggcaggaaagaaattcaacagtgatggtagacgtctgcagctctgtgtgtgcgta

SEQ ID NO: 62121 - DNA, 1157 bp, Bovine  19866880862034
cctggcgtgctgcgattctggggtcgcaaagagtcggacatgactgagtgactgatctgatctgatctgatggacacggaggcctggcatgctgcagtccatggggtcgcagagagtcggacacgactgagcaactgaactgaatcagaatgtaacaaataataactgctttgcccacatcagggcagcaactgagttatgagggtgtgacacaggggaagcagtctgcaggaagtttgaagaaagggcatcctttctcggaatgtagtcactgggggatagtgcagagtggtgcctccctggcagctgacctatgaaatctctgttcagtagttttttagagctttctgagtctgcatgtgattcttgggagacccatctgtgagcagctcctcacaaataaatagctgaactttatatcatttttatggttgatggtgaaataaatcataggtctgggaagagtgtgagcttgaaagttggagttcttaaaaatcgtacttcctctggggaggataaatgctgtggttcttttgttgtgctaatgacagcctgtcactgtctgtctgccggagtcgcgctcactgaataaatgctggtaattgctaattacttcaagaaactgactcatagcctgcgagtgacttgcatatcaatgttgcaggtcccttgtgctggttttcctttgagagctgacgtcttgttatcagagtctgcacactgatttcttcaacttcctgtgggttaggattggttcaagtgtgactttttgcagggatatcattaccaggaaatttaacatgtaggcagtggggttaatgttcattgtttctggccatttcagtctgcagatcatgttttttttcattccataaataatggagacaatgaaaagcttttgattaaatctccagtgtgctaggcattaggggctgatgtaagtggctacccacatttgctgggtccatcagtgtctttgacttctcagaaactgtatcagcctaccacagtttgatggctgtgttagacccagctgcctggaggagggcatggccacccactctagtattcttgcctggagaatcccatggacagaggagcctggtgggttacagtccataggatcacagaggggacacaaataagcaactagcgtg

SEQ ID NO: 62122 - DNA, 2362 bp, Bovine  19866880863576
gtaaacttatctctggggagaaagataataaatatttctgcaagatcgaagtcagttttatctcgttgagagagacacgtgttcttcataggagttaaaaaacgtgaaaacaggtgtgaatggcctgtatttgtgcatccatatgtgtttatgtgtatttatctattatgaattcttaaagatcattgctttcttaatggctattttaaatgtttatggtgaagtgaggatggtcatgccagatgttatatagggggtgattgaggtatgaaatacaggcttatttataccatctgacatatttacatatgctagtaaaactagagaatctggctcatttattcaacatatatttcctgagagttgggcctgatttaccatcttatacaaaacagatgtagttcttgcccctagagaactgccagtgtcttagtcaactgttcaagaataaattgagaaatacgtaatcatgctgtaatatttcataagatagaagtctggactgaacctgtagtgatgtttcactttatattggagtttttcatttgtttttgttttaagctgaactctttgcatccactgtgtttctttcctgggcacaaaaaagaagtaacatgattatcctcctccttgagtcttggtttgcccagaacttattacagcaggtggagcagtgacctcagtgatcagggcattccggttggtagataagactcttccccgtattcacagacaagggttcctgtggttgttggatcttaagtgcgtttaaaactataaggagctgtttgttgctttgatgaccagcatgtgaactgttctatcagaaactgtagggaggatcaccccaacacccctaatcctgaatattcttgcctgagtctcagcgagggggtcacaagagccatggcaagaaaaagagtatgcacatagtaagggcaagagggaactggggctcttaatgtatttggagaagacatgtggggacacatacatattgaaagacaccattaataaagcatattttattaggaatgaaacatgcaaatggtcacagaggacaagcggtgagtgtggaaagcgttgcaaatggggaagctgtattccaggtttaaaagtatagaaggagacagattcatggtggcagtcagggtgggtacaagtagcagactcactgggaataccagtaggccaggctgatctttagactgtttggacttagtagactctgtatttatataggttgttttgcaatgatcccctaatagaatttactaaatgcaaaaaagttaaccagctggtaactttggactcaactaaaattaattttataagtcttagtataagctggcattcagaaagaattaagttgcaggcagtggtccaatttttgctgattttctgtacttagttcagaaaatagacagtttccattggtcactataaaggcccctttgtagtttttgacatcattttcaaatctaacaactgccatacttcaagtgtcttctttgcttgatcttggcaaagatactaatcttggcatgagaaaaaaggtttggttatatcttcacttgtggtgtctgtagtaaacaggagatccagttctactataggataggtgtacagggaaaccagagctagcttttcaaaggtatatttgtatcctttaaactacatatacgaaaaagtctcatttccccttatttagtaggatcatgatatttacttttatttaataggatctttatgtatttgagaagcagctgtgcttgaaaaagtattgctctttcctccagaggaaaaggagaatttaagttgtcttctgtgtgctggcaatagtatgcctcataattcttttgtttgagaggatctttgtaagcaacttaattattgccttccatcctgcagggaagagaatgggggttctgtttacggattcagtaaatgtaaacagccacagcctggtcctaagggttccgagtcccccaattccttcctggaccaggaaagccggagacggagattcaccatcgcggattctgatcagctgcctggctattccgtggaaaccaacattctgccggcaaagatgagagagaaaacgccatcttacggtacgctgcggggtgtttgtcctcttcccctcccccttccttatttgggactgttggatgaatttggcagacttgcagggtaatctgaggaaaacataaacctcaatgaaattccaagtatgagacctttattcatctctccaaagccaaggctggttgagtcatcacaccgcctggcatccaggcccagtggggtgagatcatgtttcggttttaactttcagtgcctgcatttcaacttgcag

SEQ ID NO: 62123 - DNA, 1850 bp, Bovine  19866880891110
acttctttttagatagaattctaatacaatccaaactttcctctgttatcccacaaaacaccattgtgcattcaaatattagggtgtggcctcaagcagaagatttcaagctttactatgagctccagaataattttggagtaactctaagaaagactggttcactgagtcagggtagggtccacaaatctgaatgttgaataaagcactaaactgaaaactccgaattaaaatatgacttcatccaaatattatcacagttactggtgtgtctaacttgagtagcccattcagtcaagatgactggcccaatgttcttcaccaaatgaatcttgtgtttagtaaaatgatatagataacctttgataaagccttatcaatcagtgagtcttataggagaaagtaagacaacagtgataaagctaatgttatgctgctgctgctgctgctaagtcgcttcagtcatgtccaactctgtgtgaccccatagacggcagcccaacaggctcccccatccctgggattctccaggcaagaacactggagtgggttgccatttccttctccgatgcatgaaagtgaaaagtgaaagtgaagtctctcagtcgtgtctgactcttagcgaccccgtggactgcagcctaccaggctcctccatccatgggattttccaggcaagagtactggagtggggtgccattacctcctgccaactcctcatcgatatggcaagcccattcctaaaccctttggttactatttttaaagcagtttcttgacattttaatcaaagtagtaagtcaagaaatgacatactttgcatttgtattaattatataattaataattatatattaattatatcattataatcaatcatatattaattataataatataatatatattaattatatatattatattaatacaaactatattatccctagctaaactaaaagcggaagcctagtttgtcaaatcaactacatcattcttaaaagttggctctcagtgttttttacaagacatctctggagagccaatttaagatggaaaagtattttaattccatgacaaaagacccaaaatgagaatagctcacaaaattaccatgcttgactacattaatacatattttatgaatggggtcaaagtggctatgcttgcaattctttgacttaaaaggaaaacagtcccagttatgagtgtgtgagtgagagagagagcatgcatgtgcatgatgtaggtgtgcctctatgcatgtgtagtactaaaggatatctaagttgaaaatgaatcccaccattcataagtagcagaaaaaataattatgtttctttaaattgactacagtctgggaaaagaaaatattgtttacttggaaatatgtttattcccacaaaatatttggctactagtaataactgacctgaatagacatttctccaaagaagatatatggatggccaacaggcacatggaaagatgctcaacatcactaattattagaaaactgcaaagtaaaactacaatgaggtatcatttcacataaatcagaatgatcatcaaagtctgcaaacaataaatgctggggaaggcatggagaaaaaggaaccctcctcctacactgttggtgagaatgtaaattggtacagccactatggagaatagtatgagtttcctttaaaaaactaaaagtagagttatcatacaagcctgcaatcccactcctgggcacatattcagacaaaactctaattcaaaatatacacggcactccaatgtttattgcagcactatttatagtaacataaaacatgcaagtaatctaaatgtacattaagaga

SEQ ID NO: 62124 - DNA, 1120 bp, Bovine  19866880990542
agaaggaaatggcaacccactccaggactcttgcctggagaatcccatggacggaggagctgggcaggctacagtccatggggtcgcaaaagaggtcggacacgactgagcagcttcactttcactaagctaaatttaatccatatctgggatttttatgtctcttctctataaagttacatgaaattccaaagtattttctatgttttagtgtgttttactaattctacataaaattcacgtgattctgaatcccaggaagggaaaaaccaaatatacataatattgtaaaaaattaaagtctgtaattcatttctgaaacttttccattaaaataaattttaaaaccacttgtgacctttgaagattattattggccatctaccaaattagtattttaaatggcaatacaagggaaattgattttgttgttttttaaatcaggaacttaagcacttctcaaatttcctagagggaaaacacagtatttgaaatctccttactaagaaagttcataatcttctcagtggcaatcctcacactggctgtgaaaatccaataatcaatgttacagtcagtaaagtttgcttgaaaggactaaaaagagagaaattaggaaaaaataataaatgaatataacacaatctttgccagatagcaatttcaaggttaaaacataactcagctcatttctcttatcctgaaaagtttattgctaactttttgctaactcacatgttagaaagtggtctattctgaaaatcaataactttggtattgaacacttttggtaacatagcacttctcattttacaaaaggcattattataaactgacttatttaatgacagaacctgatttcagtagcagatattattcccatgattcctgcacagaaagaacatctgctatctggttaagtgaacccacagcttagatagacttaaatgactcaagttgactttgatttatgaatttacaaatgcacttaattgatagtgtcaactacaaattggcacttgccacctacctctacaaggattaaatcatgtgctactgcagctgctgattttcaacaccctctggaagagttcagggggtggaaagcagaaatgaggca

SEQ ID NO: 62125 - DNA, 1595 bp, Bovine  19866881084869
acagcctctaaatcacaagcagtatcacagaggtgaaccagacacttaaaagtcttttgaggagaggtgctgtaccagttccagccatatgtaaatttatggacatatacctctttgtatgatattccaattgaaagataatattttgatgaagtccacagaagattgagtgagtaatttaggtgcagaagggggccacccaatagtcattctgtgttgcaaagctgccgtgtctaaatgaagtttgaggatggatctcctcttcggtctaatatttgatatttgattggggttttccaattggcttcaccatccaattttttttttgagggggggagtatagttatatataagagaaatagagtcctagaaatgtggagtgactgcctacctagggttttgtaatatgtcacaaaaatggaagcccccaaaactagattttaacaactcataggaaatggactgaggtggatcagtcattcctctagcacccagagctgctgtctcagtgaacaagaaaacgatctcgtttctatgtgttgtgagacaggaagccttctctacatcttcacccttgcacacatcaccacagaccacagagaaaacgaagaagaaatggattctacattttgaataatacttctgtttctcgtgctgtgagaagacttcgctgccctgttttgatatttctttaccttgaatccaaaaggggacgcctgccccagggagatgatgaacatctcatcataaagcccaggattttattccaccatgtcctttaatgtccttgcatgatgcggatgtgactttttgcactgcatgatgtttgggggcaaatgttaatgtcaaaacgataccttcaatctcattgtactctcatctcccctcttggaacaaactgaaaaaaaagaggcatgactcatttctcctactttctgtgtttgaggatgacttttcagataaaaataaaaacagaagaaaatatgtctagtaaaatgacatgggaaacagtggaaatgttctgttcctgttcgttttctgccctgcaatgttgcttggtcaaaataaaagttccctgggaagtattgcgtggctgggcttttatcgtctacaaagattagggcgccctctggtggcatcttcaaaataattgcttctagacgatttttaaataaaagaattttattgagaaatctatttcaacaataactcaggtggccttctccagtggtcttcagctgacaggttttctcaatgcagatatatttatacttttcaaaattgttgatgcaaacaatttaactcgtcattgttatgtacccacatcttgtttagagaatcttaaaaatctgcagattacaaaaattacaaccagtagcacataagctccttaaaacacataagatatgttcgtgaaaaagggacaatgaaaatattgaagtagcatcataaatcgcctttattctgatccactgatgaaaggaggttagtttgtgttgaacttaacacctccttgactgctgtatacacaaagtgttttattttttttcctccctccctccaaattttcactttacatgcctgagtctcatcct

SEQ ID NO: 62126 - DNA, 1407 bp, Bovine  19866881104405
atatcatccaagggtttgcaagtctccccatccctgcaacccaaaagtatgctggagcatgtaagaaatactgtcccctactcccgattacagttttagtttggtgcagttgatcactgaaaccttaacagtacatactacgaacatttcagatgcaagcccagatgaatcacactggctctaccagaagcggctgcatgggtattcatttctgaggtcctgaactctggaaggacacgcagattatacttaaaactaatgggacttgattatggtagggtgaagaacaacaaatggggacccacctctgcagggtgtggctgcccttcctcctgctctgcattgttctgggtggtgggatgtggccacatcattcccagggttaaacatatacccagttctgggaaagcttccatcttcaacagtccacagtgatcattcagtggaatgtggttttaaaaataatttaacaaggtaaaattttagtttttaatagttaccacttaaaaatcccagccagtttttctgcttctatcctccctgcctgcttccctttgatttctgagtatggggatctcttcgaagatctttacagcttttactgtaatcaatttcacatcgttcactatatgttttagcaattggaagttctgtaatatcaattctttttgcatcactgaaggtgttcctgtttctccttcgtcttaaaaaaaaaaagccttagaatggatattgcaaaagtattttattagctgctgtatagcactggaactctgctcaatatttcgtaataacctaaatgggaaaagaatttgaaaacagatacttgcgtatgcaaaactgaatcactttgttgaacacctgaaactaataagacattgttaatcacttacacttcaatataaaataaaaattaaaaaagcattttattaaggtagcatgtatatagatacctttttcctattttctgttttaaaactagttaccttgagatagtatgtaatgttccagttctgctatagaaattccagcttctaaaatcatgttataacgaatcaaggagaaaaggaacatttatgaccattatgactaatgacaaaagaaaagaaaagtacaaatgcctagaagcaaccatagaaattcagggagaacgcaaaggaactaaggaaaagctctctcattaaaagtagctgtggtaggcttcctggaagtggtaaatgcagtgaaatcaatcttttgtaatgacataattgtcatcagaatatctgaaaacagtcttatgggttaaggaaggtaattgggcttcccaggtggctcagccgtaacgaatctgcctacagtgcaggagatgtgagttcaacccctgggtcaggaagatcctctggagaaggaaatggcaatccactc

SEQ ID NO: 62127 - DNA, 1423 bp, Bovine  19866881178901
atgaggggtgttcagaaatgactgcctttaatgtttgtcaagtctaagtctcacttgtggctctgtttctaaacgttggagtaatgagttaatatgtttgtgactcactctagggtatgtacatcaaatcgacctatgatggattgcacgtgattactggaaccacagaaaatgtaagtgcatatccatttaatgcaaaagctattgtaccttcaagcagatttgacagcgtccctattcctttcatttaactatgtgtatgttgttctattatctgtaagggagtgtgggcgcctgttttgtttatttctgttgctagtgtgctgctcatcaccagctgtcatcaatgtattatttaaattgtcctttattgctctcattcacacactttgcccagcttttgccatcctgtgttattttttttgcgctcttggaagtgttaacccataaatacaaaagcagtgatctctttgttgttgagaatcactcttataagagctggaattggtgaccatatgtgttaaatatagtgtttttttttttaaagtggaatttatatgtgtcaccaaagcaactattttcgggtttttgcatgacgaagtttctttttatagagctgtatttcataatacttgcatgatactgaaatttagtttttccccccttaatcatttgaatagaaaaagcagggccatttctgttgtgaggaacttgtactctgttatcatcctttagaaaattctgctacataaaaggttttcccttagttcctcaaacattttgaatttgtgaaaagtagagctaattgaatgctttctttatgccacctacaatacagctagcttttgaatgacattgatacagagcttgaaatgtcagaaaaacttctctgcatctgtgtaaaaatagcatgtgtctatggaattaattgctatttaatcaaataagacaagaggatgtaattcaagacacaagaaacttggtgactacttttgttcatcgttgttgttttagtcgctgagtcatgtcggactcttgtcgaccccatggactatagccctctaggctcctctgtccaaggaattctccaggcaagaatgttggagtgggttgcagattccttcgccaggggatcttcctgacctagggattgaacctgggtctcctcactggtgggcagattctttaccactgagccaccagggaaatacttttctgatctgatggaaatatgtgtcgaagtttgagcttcagctgctaggtctgttgataaaataaaatggcatgatctttgatgagagtttgtgacacatttgatttttataataagaaagaaagtggcactgtaaggcattcaatgaattacaaataagttgtgtggttctggcagacaagtgagggaagctggtagtgtctttaagca

SEQ ID NO: 62128 - DNA, 856 bp, Bovine  19866881260208
tctgactctctatgaccccatggactctcctttctggattttataggcaagcatactggagtggttgccatttctttctccaggggatctttccaacccagggatcaaacccgggtctcctgcattgcagacagactctttactatctgagccatcagggaagcccaccaattttaaaggccatctattcctggtggaatatccatgagctgaaggaaggcagtgtgtcctccgctgggctttgtattctagtgaacaagaaataaaaccattacattaagctaaaaaagaagtgacagggatgttggaatgatatgcatgaaacacctaatattgggggaaacagaattctagattaggatctcttcttcaatgtgctgaagtcattaatcttgcgtagacaaaaaggctgcggcaacacagacttctagaagatttatggatttctaattggaatgtctctatatctatatgattatgtgcaaaatacatagagcttggtttatataatgaagtgtccctcggtcacagtgatcataatttcctcctttcctccctccctccttgtactgacctcaacccctgagttcctggtccacttctaatagattctaatgctggactttaaaaagctctgtaatttttatgtcatccctggtaggtacacccagtcctaaaagctgcatacctgatggttagtcctatccaccgtattggctgtggaggggtggtctctggtgttctgacgaattcgagtggagttttgctgctcaatggtggaggaagttgggatacagaactctctgaagcatcgtttgaagttttcatccagaaatgcataaaggacggggttcag

SEQ ID NO: 62129 - DNA, 1099 bp, Bovine  19866881328398
tcattctcccttactggtggtgtttcatttgaattattacttttacttgtggaagctctagtagtgtgtatatgtatataatgtacatccaacaaacggcatttattcaccactctaaacttttcaaggccccgattttagttattttgatctgaaaatctaaaaaataaaaaataatgcatatccatactgggacattatatttgagaaatggagattattggaggcaaacagaagacttcatagaaggaaacactaaaacactcatcttgcatcctttttttttttttttctcatccaacagtttcatgggcgatatccacatatggccatataactacagccaataggatctgagacagtaaattcatttagtccaatctgtgacagctgtctttctgaaacattgcccttaggtagctggtgcatatttgtgccttgttagattccagaatgaagacagattgtaagattgagactattgacagccatggactcaggaatattcttacaagggaagttggaaccctgttttctaccgtgtcttcacagaaaactatgatgtatttgattcgtttaatcagtgcagtcaatagttcaaagtggagagctttttggcatggaccatctaactcgattgtctgtatagattaaataaaatgtgtggactgccaaatctctaactgtatttcatgccaaagagaacctgtcaaaaagaagaattgtcttagagaagctacttagaagactgacattttacaaaggaaatcttgacatttagcaaagatcaaaaagaccaacatattggtgatgacattatagaaacataatcttcaggaaaatattctcgggtcattgttaatatatcatgtccaaggaactacacagaagtgaaaagtagatcacccatttttctccacggtcttttgagtctttcaagtttgagattaagcttactggctccatattttcttaaagagtttaaacttttgaaaatcaacaaaaaacagctgtcattttgttgtgttgattcaaaaggtgtaagtattatgagaaagagtttaaaaaaaaagagagaggaagtttgatgtaaagagca

SEQ ID NO: 62130 - DNA, 1649 bp, Bovine  19866881439220
ccacaatcagagacaaaatccttgacagactgagccagacaggcgactcgagaagcaaatttaatacttccctgggcactctacatgtgatgaaacaaatgttgaataattgtaacttttctaaagcctgaatacaggtgagatacttctttcaacattgccacatcaccagctactgtgccataaaaactcacatactgtttggaaaacacttgtttctggtctctcaccatactgaatgcccctccaacacacgtttcagtcaagaaccactgcccagcacagtacttggcaaaaataaaaaggtgttaaataaatgcatgtttgactcagtgttgacagagggttttatgatgaaagaagttaatttgaaaatataaatgtagctatgaaaattaaaaacatgctataatgcttgatattctagttcatacgtaaagtccaatataagtatttaagctagaagaaatgtgaaatatatgactttgatcatagagtgttaaacatgaaatgttatcaaagtttgtctctacctgttaaacttatggtgatttgtattttactttttatattcctcagattctaaaaaaaaaatgaatgtacaatggtataaggaaaaatacaaaaaacaaaaataaaagaggagaaattttcaaaagtaatagataatcctgaaaagtgataaaatactgcattaaagagctttttcaccaaaagataattcaagatcatgtttgcagtttccctatttaaaatgctgttacatacattaatctgtgactaaaaaggttgttagccccaagtgattttagtcccagttgaaagataattctatattgatttaatagctcttggtgcactacaagcctaaaatttcaaattttaaaaattaatgggacttatctgctttgccaaataactagtctattcatgatttatattttctcctaacaagtgctgttgaattctctacaggggaaggaaaaataccaaaaatctctctgcctgaaaatactttttaaaagatgtcaacacattgttttttgtttccaataaaaatcccaggtcaatatgatagttaaattataaaggattatatactttttgggtggaaaacagttattataaatacacagttttacataagccaagatctccaggcactaattgcattaccttcatatttccttcaattggtcctaaaagattttggacagctactgttgcagaaattaattgaatgccaaaatatttagatatcagcaggtgctatgacacattaaaggggataaacagggaatgctcatcaacagttctgacaaatggaattttaaattgagtcttcacagatcttaattaaatctctggtgcaaaactcaggagcaatgagaacgttcttatttcaacttcctacacagtatcctaatgtataattctctccaacatgttgtgctaatattaaacgcagtaaatggttctatctacaggacacatacacacactgccagtaaaaaaattcaaactatccaggcattatacttgcatagcaacaagcacccaaatatttcaagtatacaacattaagctttttttatccttgacaactgttctaaagctcaattccctttaaaataaggataagggcttcc

SEQ ID NO: 62131 - DNA, 1133 bp, Bovine  19866881560216
accaagcttctagtataactgtatacttcacataccacagtcagggaaaattttattctatgataaactaaaaaagagggcataatcctgattgcttcttattcttataatacaatttcaatgttttccttcaactagatgtcctaaacaaagataatttcatcattaattcttgatatagccataatttttaaatatatgataatttaaaaaaattattttttgccaacataagcaaatgtaatgtacactgttaattttacatttttctttgttgtgttttatatttgacagatattttcttatgaaatctgactcactttttctaagtacacttgtttctgagtcttctttggcagtcattcttacaggttctattaagctatagtccacaattaaacacaataaaaatgtgtagtttggtggcataccttgtctggacctgaacaagctaagcccttggctcagttttgcttgtcccttcatgtatggtgactgaggtatttggctctaatcagtaattctgttttatgatcaagtctgtttctggtgacagtagtggtgaaatctgactttaaattatacagctgacatgtggtagatatcaaaaattaggtctctcaggaagaagctgacaagaagtccgaaatctatttccctattagtctttatttgtgtatttgtgtttatcttaaaattctaatatttttgacatatgacaaccaagaattaaaatgtttttgttatttttccaaccattggtagaatcttctctgattatgtgatttgtgtttctacctatctaaacttgtctatcaagaacagcttttgaacaaaaataaactaaatttctaacttttaatgatcaacttttgttgattgccatgtaaacactttcaataataagatgattccaaattagtgtctcttcaggaccctttaaatgaggctaaagaaagaatattgctacagattaaaaaaaaaaaaaactttaaaaatgtaagagctttttctgctaaattcaaaagaaaaccacaatattacttagaatttcaacaaatgaagcttctttaaaagatctaatgggctcaatttatgtctttgtgtctttaaatgtttatattcttaagagg

SEQ ID NO: 62132 - DNA, 1332 bp, Bovine  19866880526631
agaaggcgatggcaccccactccagtactcttgcctggaaaatcccatggacagaggagcctggtgggctgcagtccatggggtcgcacagagtcagacacgactgagcgacttcactttcacttttcacttttatgcactggagaaggaaatggccacccactccagtgttcttgcctggagaatcccagggacgggggagcctggtgggctgccgtctatggggtcgcacagagtcggacatgactgaagcgacttaacagcagcagcagcagtgctcatataatacttatgtaatcaaaatatatattttttttttgaaaatatgtaccatgaggtactttagttattttcagtattcatccccaaaatatttttaaaatgtaagtaggacacacacatagaaggaaaaggttatatatcagcagaacaaaagaaaaagattagtatccataataaaaatcttagcttgtctactttaggtgcaaataatcacaagtgtgattggctctccaggtggtgctagtggtaaagaatctgcctaccaatgcaggttagaagaaagagacacgggttcgatccctgggtcgtgaagatctcccgggggagggcatggcaacccaccccagtaatcttgcctggagaatcccatggacagaggagcctggcgggctacagtccacaaggtcgcacagaatcagacacaactgaagtgacttagcatgcacacacgatctgtgctataacagatgaggttacatgaaagcacaacattataaaaattattttttgaaatggcagagatttctgtagctgtattgagcacgtagaggggaacaattgtcttcaggagaccagacacctgtaaacaataggaatctacagcagcttttgttatctttctgtcttttgttgctcagaagaaaatgactgagaggaacactgcctacatgaagtacttactatagggcaggaactatgcaaaaataagactatgcgtggagatctggaacagataatttgttcccaaatgaaaagcagacagaagacacagtggaagcagagagaaaccagtaaagctggaaaaagagaaaagtcacaaggggacccatttaaccctaatttctgtggttttcctgatgaagatgtggtgctaatggtttcagagttaatcagagaaccgtgtgtcttaaatctcggctctaagccagatgaaaaaagacatcccacttaagtggtgttttaggggcacaaaggctgaaagaaaaaaaaaaaagatttgcatagtaatgattctatcttcgctttaaagctccacggcatttttagagt

SEQ ID NO: 62133 - DNA, 1425 bp, Bovine  19866880619393
ggtccgaaaaaatctgtataataataagctggaaatgtttcccttatcttttgagaagattcacaattttttagactctcagtgtcttcatattgaccctaaatccacttggttttctctatggtgagtacctagcaattaaaaggagcccaagtatctactgtaaagatagtgagaaatttcttagttttgaggttgatgggttccaaaagtacatccccaagaatgtataggacttttcttttttctttttcttcttaatattaaacctcatgaagaaacgagacagtctcttgagaagatggagctttttgtttttataatcaagatttcagttgtagtgttggaggcacttttactaagattaattaagctatttgcagagttagctatcggagaggattgtattggttccttattcagcatccatgttcttccttcttttctatcaaagtgcaattttgtgaaagtattatccggataccatggagctacatgtttggggataactgatgcctccccagctccaacagtgagtctagtccactgaagggtaatcccattcctttggccagtggtgactcagaaatgagatatagaagctcccaggggagcctcttggacacattttcttactcctaggagagatccacaggacagaaaagtctgtcatctgtaatttgaggacgcaagctccgaaactgccaaaatcatcttgcaaccagcttgagaataaagccaacaacagtggagagatggagtgaactgataatatcattagccactgacttaaccaatctcacaaccctcctgacttctgggccttttaatatgtgaactaatttctattctgtagtattctgcctagtctggtttgagatctctgtcactaataattgaaaacatccttctttttttttttatcttcacaccaaataaagttgagaaggacaaggcctggggagcacacatctctacataacttgctctttgaatcctcaagaggatcacagtgcagctcgaatacataacgatcttattaaagctatagaaactcagtttggtgacactgaaataaccaagcacagtgattctcatctgcttgatgaatagatgaatttcttgaatgttaacaaagttttcccccaaaagatattatttaaaaaataaattttcacattacactgataaatctgagaaccaagcagctttttaaaacattgatttatttacttttattttccattttacgtactttgtgtggctcctgatgagtggccctagattattcatgactgcttctactgtgcggaggtatattttaagaaaaacaagtcaccagccactctttctgcactttgaacacacacatcgctagagtggatacgttcaaatggaaaaattagaactcacgtgcagttcagg

SEQ ID NO: 62134 - DNA, 1966 bp, Bovine  19866880368384
ttctagcagggaagagatgaatcatctctgtgatccggcctaattcacatgtgaggtctgtcattaaagaagtagaatagacattaatcatcaacactggcatgccagtgaagacttaaaatcagcatttcttcatgtgtcgattttactgtaagaaatatttgtccaggagctgtaattaatgaaactctctgcaggtttaaggtgctcataatatccttccaatttttgagaaattgcaggtttctttaacataggaatcaacagtcattcacacccagagccaatgctaatttcagaggcaaagatagcctaaggttaatgtctccaatctgttttgttcatctgcttcaacttaaatcttaactacaacctgagagtagaaaggagaaaaaagagaataaggaagagagataaggaaagagggagaaaggaaggtgaggaaggaggaggggatggagggagatggacacatccaagtacctcagtttgtttatccttgtgtttccctaagaaaaagtgatctaggaaccaaaccaaagtgaactctgagtctttggcttctgtaaggaaatcagaatgctcacatgttgtcgagttgaattgacatcttttctagagtcagattccaaattatggaaaagaaattttaaataaacttgagaaaaataaattagcatgttagtcagattagatatttttggtaagtggaaataacaaccatggatgcacttatttcagaacaatttttaggatgaaatgttgagcttccattataatctctatctgtttatatccccaccactttctaacattttccccactcccaatcaccatgcacccttctccttcctttttacaaacatccatagaaaaggttagctctcaaccaaagctgagaaaataaatatctactttgaccccttccatcttcctttctggtcacacctcttgggcctgtttggctgtccttggcagggcccagtcatgactgaggccatcagggcaaacttgaagtccaaaaaataaggctccttccctgattcatcagagctgtcctttcttttatagactgataccatttacagggaaaaaaaagtactgagaaattatttcctgctaaggtatacgtaactattgatacgtcatgtactaccttactccatctgctatttatcagaagaatgtatattttttaaaagctgtaaagaaaagtaaagcaatgaaagcaaatctcaaatatcaaatatggaataccagagactgtggaattgagtggaaaattacatatatatatatgtgtgtatatgcatgctaagtcgcttcagttctgtacagctctttgcaatcctatggattgtaacccaccaggttccactgtccatgggactctccaggcaagaatactggagtgggtagccacttcctcctccagaggatattcccgaccctgggatccaacccactggcaggtgggttctttaccactagtgccacctagtaagccccatatacatataatatataatacatagggagagtacagatgctgtcagctaatgtgatatagaaaatgctaattcattgagtgcccactgcttcaggaccaacctgggtcaacccccaaataaacggtagtgagtaaagcagaaatacttttcatcctaagcagcacagtttttcaagagcaaaacctatatcaatattattagataaatgtaattttctttctataaatgataagaacagtgttttgaagaatagttgctagagctgctgcaccagatccttgctcaaaattcccaaccctaacttttagcagaagtcaatataaatctttaagtctttaatggtccagagataagaaatgaagttatagggagagacaaacaaacaaaatacagatggaaccacctgggaccaagagggtgaggaatctgacctccaacagaccccaagtctcatt

SEQ ID NO: 62135 - DNA, 867 bp, Bovine  19866880381794
ttttgcacatagtataatccccagtgctttgtacacggcagatctcaataaattttggttgactgagtgggggcaaaggtaacagaagaagttaaggggatttatgttaacatggttcccatagattagtttatataataacatgagaggctgtttagcacaggaatttcctgtctttagcttttccatatgctgtagattgagcaagtcatttttactgacttcagtttgcatgtctattattagcctttcttaactggagctcctcatatgaactacagaacacagaaaataatttcagtgactattttcttgattcttcccgggatgatatataagtagtgtcattcttaatacatagggggaaaatattggttgaatgaatcatttcataggagtaaaagaagatgggaatgaagaaatatgaaagcaccttgaagttggaaatgggtgaggtcggtccagaccaagagaaaaagcattagcaaagatgggaaagtaaccgggggtaagtaggctggatgcatgcagaatgggcacaaagacttcaatgaagacatttggaggagagtgtgaaagccagtgtgaagagtctctatactaacgtgaaaaactgtactgagctgtatctgccatagcagaattagaccatgctgacaggctctgctgcagctcagtgcttggatgcaagtctcagatctcatttagcagtttgggtgaccttaggcaatttccctaacctccctgtacttcatcacctctttgtactttgtaacatgggggatagtatcaccacctgtctgtattatcattagattcaactgctagtagcaaagtagcaataacaaaataatactaaacaagata

SEQ ID NO: 62136 - DNA, 1141 bp, Bovine  19866880441406
tctgaccagtgtcattttgattgctttaagtacggttagttttcagttccaaggtcactttgttcccgtttccttgaggccagttctcaggattgtgtgagacggaacagtttatatcatggctacagttttatcattatgtagtttacttcttccacctgctgggggtttcagtatctgtaagacagccacaggagatggctcagggctattgtctatatagcccttgagaaggaaccaaagggcctcgattttgcttgataactaaactgtcattatttcgtcctgtttgactcttttcttttgcttctacattttctcacttctcaggttaaacttattctttgactgaagtttttttacagacaaaaggcaggtggaggacatggggggaagggccatagagtcctgctccatttcacaggctataaaaatgttaaccagtaggggtcccctcaaatcacacccaaggaaatcactgcaagatagatctacactaaaggccttgcacaagggggaaaaaaaaaatgtttttccatatcttagaatgaggtcccaataacatccctgacttccaccttgagtcataatgcatcatttggtagaatagaaaggcagatcccagaagtggaggtgctttgctacaggaacattagctggtattgtcagaaataatggcccagtcacagggtgatgagttgagccagttatttctgacacattaagtgtttgatttccatgcctcctttattctaagatgcatgattcatgttaccaaacacagagctggactcctgactcctctccctttgaaggctatgctaatttgatactttcttaccagacgctccgcaccaacgtgggttactgagaatgctgatgatttatttctcaggaaagctctgaaaaggaggacagtcgcccatctgtctgagaatttttcagggcaaagtcctgtcggcagtctcaaggataaatggactgacctgtaaagggccccatcgtccacagccactgattgatgggaacaggctgaactgggagagaggaatttgaaaagtttcatttagactgtgactcgaaggcagggaaccgctgtatggaaggcttcagggtttgtttgtttgttttttttcccagt

SEQ ID NO: 62137 - DNA, 1095 bp, Bovine  19866880746624
ttctttccagccagttccctaccctttctgtgtctcatttcctcatggaaaaagaaacactagtctttccatcatactgatgttgtgggaattaagtgagataatataggtaagacacttggaggttctgaacctcgaggtggttgattgcaaaaacccctgtcagacacatactaaattctcagtcgatatcgcctattattgtaggtgagaagagggtttccttcatgtgtttggcgaaaatttttcactctgatgtcaggaaaatatcttctgtggacacaatagatgagattttgtactttccttcaaatcattttaaagagctgtgtccttgagaggctcatcagtctgagaagatgaagagatgttttagtaccaattctcaatgttcatagatatattttggctataaatggttgaaatatatcataatgaacaaaagtatcggtatttgtcctcaaggtttttatgttcagtgtattcaaagcttcaaaaatatgtttttatttgctgaacatagctacaaaatataactccaagtagttagagcaaatgattacatttacctgaaatagttcagttcctattgaccactaattgtcatataacagaggaactttggaattagttttcaaatttgcacagaggagggcaaacatttttatctttatttgttttcagtgtcactgaatgacagctgtcacagcaaggctgaaggcctcttgtcaattagcaggcagagttttggttggcaccatggggtacagaataatggggggacttttaaaaattaaagtacacctgtaaccacacattcagagaaggcaatggcaccccactccagtacccttgcctggaaaatcccatggatggaggagcctggtgggctgcagtccatggggtcactaagagtcggatatgactgagagacttcactttcacttttcacttgcatgcattggagaaggcaatggcaacccactccagtgttcttgccttgagaatcccatggatggaggagcctggtgggcctgcagtccatggggtcgctaagagtcggacacgactgagagacttcactttcacttttca

SEQ ID NO: 62138 - DNA, 1406 bp, Bovine  19866880761602
tgtgtttagtgcctataaaaacaaaaactgaaggataagaccccctccagacagcgtaaccttgaagatgcgtatctaggttattcgtagcctaagagaaaacatacactaatcaccccttcctccagacaggccataaatttttccatatcaatctgagtgtaacctcaggtttactgattattggctaattgtttgactgtttgagcacatgagcacatagcacgtgaaatgatggggttattgggattgtattttccttggtttatgtaagtctcaaggaatttggagtggtgggttcagatacgtacacatggagtataaaagctgttcacaaatgctggtcggggtccttggctaagaggagactctgccttgggcccgccagtgtaataaactgcactccactatctgcattgtccttctgagtgagtttgtttcccggaatgcgtggctacaagagtttctcttaaaggaaactggatctaaaggatgtattataaactgagaaaacagttaactttaatattgagattgggtttctctttaataaagatgttgattccacagaaatgaagacccaggtaagtaaataataatggaatgaagttaagaactacaaggatgctatcctggaaggtgtggggaccagtggagtagacatttggctccatgtgctctgtgtgttgtgtgactctgaggtcccctatgttggtttcatctgtgttgaatgactctgcagtcacgtgtgctggtttcatctgcttgggatgatggatgatttccctttcaacttcagcattctcaaatcctaagttttacacattatcggtttctgagtttgtattcaaaatttgtgcgtaggaaatatgttttatagtagatgggtgatagataatgcttgcaatcaatcacaattttgtgaatgatatttacccatttttgtattatggtcaggcactacatatatacatgccactgattaaataaagaggattctagtcctaggtgagttcttgcgagcttgaattttcaatgatctgtaaaagtatgcaaattggtcctcatttttccctgaacaaggattaaattagtatgtattgtaaataacacctcacagagcaaaaccaggctgaacaaatagcaacatttggaaatagaagcaagagatgatgaaatgaaatgcagcatgaaaaaatgctcagaaactctaccaaaaagaacataaaacagcaaatcagcaatttttataatgcattaaggaaatgaaaggaaatcgtgagaccatttgtgcattttggcccaaagaatagaaattgttgagttcctctaagcctggtcttatagtatttagtataaatacttacagtataaagtgtgtgggaccagattaaagagacataggt

SEQ ID NO: 62139 - DNA, 1762 bp, Bovine  19866880903431
actatatggagtggggatttgaacccagataaagtagtgcttctttttgctcactatagtatattaaaatgtgctggtaatattcactcctcctttctccaaaatgtggctaggcctttgtttgtgtggataattaattacattcatttgtcttgtctcaaagcagaagtgcccaaacttctgataatcctctctgggcttttttttcaaaacctcgaaagctatatatatatatctggtcccctagacttgaggatacaagagtgcatgtgctgtactaggacataccaaactccccaggcaaaagtggggacaccaactttcccctgtagggcgcccagaaccttgcttatgtgtgaagaacatagatagacataaatagatagatagatagtagatagataggcatacagctagtttgtagataggtagataggaagaaaatatattgtagattgataaggaggaaggaatgaagaaaaaagaaagatgtacataggtaatatactatagttagatacatacatatacacatacatagattgcagacagaagatagctatctagatagatggatggattatagagagataagcggtaggtagatagatatagataggtaggtagatagactgtagataggctgtatatacttagtaaatagactatatatagataaatacgtagtagataggttgtagatagatagtagattgtaggtgggtaggtagatagataatagttggacgttttttaaacttctgcactagctcagaaggcagtgcggaaatggggggaaatcctttaggtgaaagggtcaattactctgcctataattcagcaccttgaaaagatggtagaacttctgagaacaagatttcatggcagaaggactgggcatgaggagaaaaagctcctagcctcatgaagagtcttcttgtgcaagtttgtacactagcaaaagtgtgcaatgttgtcaacttcaaggaatcacctaggtccggatataatacattcctgctgaccattatggatagaccagaaaatctgaaccaaatattgtgaaacatggcaggacctaagttttctgaaataattcccaagaagataggagctcttcaaaacaaaaagacattacattttttttaaactattttgacaaataagaaattggagtgagatttaatttgatttggaagaaataaagtaaatgaaagactcttggatataagtaaattaaaaccttttcagtgagaacatataatcttgaaaatctgcaatttaaacacttggtacaatattatcttgagtatctggaaaatgtttaatttctcttttctcttaattcacacatacacgataaaggggaaaaaaagagaggaggaaaaatagcaaacttaaaagattttttgtggcagatgtaaaaataaataccagctagttttccaagtaatggaatcagatgtttagtttagcaggaatttgttgtgtatctaatttttccattaagattttcataaacagagacctgataatcactttttcagagaatactgacaaagtatacttgcttggctgaaggggaggaaaatgaatatgtgcatttaaaatttttatgattacatttttactgaagggaggaggatgacctgtagtttcataacgactttaatgcaatcggttccacttagaggagatgacatgttgaaatgtgatgtgtaaaagatgtgcagaatgcttccccagtaattggattcaagca

SEQ ID NO: 62140 - DNA, 1969 bp, Bovine  19866881069080
gggattgattccctacaagaagggacaccagaaaagcttgcttctcttggtctccctactcgtaggcaaggagtaaaggccacgccagacacggtgagaagacacctgtctgaagcccaaggagagagaattcgggagaccagggttcgatccctgagaggggaagatctcctggagaaggcaatggcaacccactccagtattcctgcctggaaaatcccatggacagaggagcctggtaggttacagtccatagggccgcaaagagttggacacgactgagtgacttcactcactcacttcactccaaggccacgccagacacggtgagaagacacctgtctgaagcccaaggagaggtctcagagatgctgacttgtgctggcaacttgatcttggacttttagtctgcagaaccatgagaaaacaaaagcctactgttgaagccccccactctgtggctttttgtcatgacagcccaagttaacacactcttctggataaatggcagccatttctaacacaccagactaaagacaacttcttcccaggaatctggactggacccaaagagagtcagcacctctccaggcagcttgagccttaagaatagactcagaggctgcagatagctatgtgagtgggcaacaggaaagacaaactgctgagaaagtgagagaaacaggtgtatgagataaatggagctgaaggacaggcagctgatacttcctgggatccagaaagaagttttgttactggtactttccttcctgtgacccatttcctttcttgctcttgggtttcacagattaaatcttaagcttttttttatttattgcaacattcctttttttccctaacaaagctgtcttgaattcatttctgttactctcaaacaagcaaaaactctccagtgagccttttgctctggtccctcaccatacacgagtgtttacattttggtgttgcatcatttttcggaaggtgccttagcattcctttgtgaatttgagattgtgaataactgaaaagaattcagatattctcttctgaagctggtcatgtagtcttctggatgtcactgacaacaagacagggtctggggggaagtccagagcacacagaggtggggttgttgacctggggtgtcttcagttataggattaactcttctgccacgaagaaaaattattttggcctggcctgacttgttttgaaagcatgttaactttttcctggtttgctcttgctttgtcatgagttgcagatcagtaaattatttgtccttatttctgggaacttactctgaatagtcccaagttatgactccaaactagggtgattgctattattgaagatttacagaggtgcttatgtttctaaatatcctttgatgagtctccatttctgtggtaacctagataggctactcagtacacacaggcacttctttgggaaaacctgatagaagaaaacctgaatttacagaagagataaagaagaggttggctattcacccgggtttatacaggatgcacagagagcagctcccctgaagcgtccggtgccttctctgctctccacacagatcatgaacaatgtcttatacagaataggctctgaatgagaattttgttgactgattgatgagccacttgggaagaagagaaatgtgaagccagggtgatggtttgctgctgccagttggagataaatcggaaaggaacagaaagcatcctgagcagacagccagagtcagtggggaaatggaaccccattttaaaaaatgtgatctgcatacagtttgtaggaacttcttgctgtataaaccaaggtatacaggaattttcacatcgatttgcttgaggcctgaaggatggcccctcgccctgggtgccagtattaatcaaaggatgagtgaggcccccaccacacggtagtgccaggacctggtgtttttgcagagaag

SEQ ID NO: 62141 - DNA, 1088 bp, Bovine  19866881159990
ctagtagtcttttaaacatgtttaaattaatccgtgagcctaccaagttgattttaataaaatcttttgtgaacatttctatgtctaaataacacatttcaaatacatgtgcatatcaggttatgtgcagttgtgtacaacatacacgtgtgcacacagtcataaacaaatgtgcacatcccttgtccctgccccatctactagtcctgccatcttatcacagagcaattagatttgtttggcatcagttgaccaacacaatccactatttttgttttcctttgtactgttcaagtggaaaaaaaaattgtcattttcttgcacttttcccctcaacaagcacatatagactttttgcatgttaattgctatatttgatttgccagtgttgatttataaggtgatgagcttttaaagacatttcccaaaggacatttgttttctctgacattgttttgctgctagactctgagtgtttttgttacccaaggccatgatcattgctgattttattaattggttgatgcataagagtattttgaataaatactgccaagcttatagcatgtgtctttcttttaggtcgtttttagattatcatcttatctggtttctcctaagcaattaagataagaaagtctattaaaattaaactttcaacaaagatttcagagtcatgaatatataataggatatgctttccaaaactgtcaatggattggtttcagatctttctgcacaagcatgtttgttatgactttggaattatccttaaaaacactcttatttgccatccttatacagttctacttccctggtggctcagacagtaaaacgtctgtctacaatgcaggaaagccgggttccatccctgggtcgggaagatcccctggagaaggaaatggcaacccactccagtattctcgcctggaaaatcccatggatggaggagcctggtaggctacagtccacggggtcgcaaagagtcggacacgactgagtgactttacttcacgtcatacatttctaagtactttggtagaagacaggtagcattatatttttataaaaaggtttaagtcaacata

SEQ ID NO: 62142 - DNA, 1594 bp, Bovine  19866881177895
ctaaaggaaatcgtcctgaatattcattggaaggactgatgctgaagctgaagctccaatactttggccacctcatgcaaggaactgactaattggaaaagaccctgatgctgggaagcattgaaggtgggaggagatggggacgatggaggatgaaatggttggatggcatcaccaacttagtgggcatgaatttgagtaaactccagaagctggtatggacaggggaagcctggcgtgctgcatgccatggggtcgctaagtgtcagacacgactgagcgactgaactgaactgatgccatgctccaggcttccctgtggctcaactagtaaagaattcacccgcaatgtaggagacccagattctgtccctgggttgggaagatccccttgaagaagggaatgactacccactccagtgttcttgcctggagaattccatggacagaggagcctgacaggctactgtccatggggtcgcagagtcagacacaactgagttactagcatacactaatgcacacacacatgccatattctaaggccctgggtttaattccctggacatactgaatggacatcactaacagtgtcagtcccaatatttataccagcaacagcacttataccaatataaagaaaagtgaagaagtgtgagcctgatttccaagtacaagccatctgagggtatgaagggttttgtttttgttgcttccttgttgcttttgtgattatgttcctctaggaagaacatagatgtgccatggagtggggactctgcagtcaggcaagccttcaccagaccttggctcatgcctgtggccagaatagccttgagccagtgacctaacctccccaaatttcacttttgtcatttgccaactgatgataataactctggctatgcctagtgtttggggcttctcagtggcactagtggtaaagaacccacttgccaaggcaggagacataagagacaagggttcgatctttgggttgggaagaacccctggaggatggtaaggcaaccctttccagtattcttgcctggagaatcctatggacagagaagcctggtgggctacagtcctaggggtgcaaagaattggacacgagtgaagcaactgagcatgcacacacacacgcatagtgtttgcaggagttaactgaaataatgccccaagtgttctttgaatactgattgccaagagtttaggaggtgctcttgaatgtcacctcaattttgcatgttgaactatgttccttctacctatataataggttaagactgaaagcttagacagactcttagagtccagaaaccccaaagaatcagttactatggctgacaaagtcttcttaagaagccccagcaaacccacttaattctcaatagaggatctcatattaactctgtgtctcctttatcctttcaggaattagtaggagctgaaaatcataaatgcaaaattaagacaaactaatgcactgtgactcaagtttatgtagaatgtcaaagagggagccagagtgggaggagacatccttctgctttgcaagacagctgtggctcaccttttcctctattaaaag

SEQ ID NO: 62143 - DNA, 782 bp, Bovine  19866881292930
ctgagttggttgtgactgaaaatttgcccatgtccgcttcttttaatttctctcaactccacagattcttaaaaaggaaataatgagaagattgaaatttcaatttcataagcaccaagtgttctggtaatcagtacagggacatttgtatgggctatctcatttaatctttgcaatatccacatatgcaaaagttttaaaaccagaggttaaataaagtatctaaggtcacagaggaatttagataaggaaccaaaatctcaacagattttggactgcctgtacaatacaagatgtcttcaactcctactcctcagataagagtaatgccaaaaacttaggcaaaagtctcagcattgtgcttttcagcacttcctcaccatttgtttcctgctttcttttttaacttgaaaacatcttgcacaaatgcatcctctgatttttttctgaggtgctgaataaacagttttggtgatgtgtggccgtgattgcaaacttgtcagaatccaattattaaactgatacttaggtatttattgctgtcataagaactctgaacaatggttttgaaaaattgccctgactcatggttcatatctgaggctttatcaaatgcacattttttaatataatgtgggtgccaagaggttacaggcacattgtgttcatatgcaataacactctgtagtcctggaaataaaacactggattacttttagggagaatttcttcctgcttatatttctcattctaaaactataagtcatctaagagaggacatg

SEQ ID NO: 62144 - DNA, 1530 bp, Bovine  19866881343516
accatccctcacccacacatggaaatgaaaactctctgctctttgctcagaaactatgacttctggaatgctcctaaattttgttgcatttgtttgtttgtagatgaatttactctacttccagcccccgctaccagcccccagagcaaacacagtatctcattcaattcccagtcaccagcatttacttagaacgtggtgtatttaagatgtcctgttaaatacgctgggcttccctggtggctcaagaatctacctgccaattcaggagacttgggtttgatccctggattgggaagatcccctggaaaaggaaatggccacctacaccagcattcttgcctgggaaatcccatggacagaggaccctggcagtccatggggttgcaaagggtcagacatgacttagcaactgagcatacatgcacacacattaaacagattaaatagtacgctccatactactctttgcctgtaagaaactctatcaagaaactaagcattcagagtgatataaaagtgatttgtaatctaaaactccaagttagaagatgagtcccttgatgttatcagtttaaaaccagacatcttctaaaatgtgtgtcactgtaaggtggctgaacgctttctcatgtgagtttactggctgtgtggtttgtctggattttcttattcacctgcatttccctcattctccaggcttaagtccaacccctgcaggactgcctcccgctcctcctgtatgaatcaaactgggggcgctcatcttgttgtcagattcgcctgacagatagatttgctacaacaaatgaaaacactaaataagcagctcccatctattttttatggctgatattcatccccagcaaacagcaaatgttatcccaggatgaaagcaactataattcctgaagttttcattttgtggtaaatcatagtgaatatttccattgtgagactttttttaatgtaaagcaatagttaaaatacatgtacctgtattttaaaaattccttaggaaagtatcacaaccaagttttggatccagaaacaattgcatcatataaggtttaaaaataccaccagaaacatttaacttaatcttattttctaaataaatatataagcatagatacatatacagacagatgcaatcaagagttcaaaatgcttaattacagatgcttcagctcctatccataccaaactttcattttttacccatctccgaggtcatcactacaactggcagcattcctgaacctaagatgttatagcagcagctactagaggctcacaaacccaccagccatctaaagtctccatacctccctggggaaacttgaccggaggggccagggtgaacggaaaatagcttctgggagacgaataatgacagtaaaagctaacaattattaagtaatttatatgcattatctcttttaatcttcatgactgcatttgaaacaagtactctgattagtaccactttaaaacaaaggttcgtctagtcaaggctaggtttttcca

SEQ ID NO: 62145 - DNA, 1193 bp, Bovine  19866880383000
aaccgatccagctccattatctccaaacgaatttgatagttcagattactaattagcctgtcagagggcccagaaactatagcaaaagaggtgtaatttactcaaagaaaaaatgctaaaaagcaaatgcacattttgtatcatatccacaactaccttctattttaatcagccatttgaccacaacgattgcactacattttgtgttttctatggatgaaagctatttgttctaggatgtaatcatttcatatagtaagaatttataggaaataaaattcataagatataaaggcaatgaaacagagtaagaaattcataagaaaaaccaagattaaatacttcttgtcagttggtttgccagtttctcctaagctcacaataattcagtggagccaaaaataactgacttgacatcactctgattcattttggcccatcttttatttctttttccaccttttctgctctcttaagttagaatatgaattagaataatcagctagaatgacttattaataacaattagaatataaattcttccataagaaacatatttctatgatgataaacaagggaaagatcactaagatggagcatattcatatttttgtatgactgatcctctttacaatttttatttaaaccctcggcaatagaatgagttgcaatttcataaataagatatataataataaatgtttaaaaaaagtgctagtagattcttttgaacgaaggtacagaggagctacaggactatctattttgtaggggttttttttttttttttcagttgagtttgtcaaactgttatttttcttcctgttttgagtagtggcagcttgaatagatctaggctggcatagcttctgctcacgtcacatcatttgagcctaacatgcatttgacagcatgaactctcgggccagactccttgtgtttgaattctgggtttaccattaccttagaagaggcttattattttaatttgtgaggaggtcaaaggaagcatgaatctgttctgcaatcaaaaaatggtagcagtctggtgtctgtagtctgtttttatcttttttcaggcatgagactggaatagttatggagcatcctggcttgatgctgatactgtacgaaagtgatcatgttagttggtagcaactgggtcagccaatagctgaaagctcttagggctg

SEQ ID NO: 62146 - DNA, 1060 bp, Bovine  19866880818237
aggatctttcccaacccagggatcgaacctgggtctcccaacatgcaggcagattcttaactgtctgagccaccaggcaagagtacttcttactggccttaaatgaagaaacatcgagggagattattttaatttttattttcttatttaaaattttatgattcttaaccatctgagccaccaggcaagagtatttcttactggccttaaatgaagaaacatcgaggtagatattttaatttttattttctcaaattcttaaccatctgagccaccaggcaagagtacctcttacaggccttaaatgaagaaacatcgaaggtagattgttttaatttttattttctcagattcttaactatctgagccaccaggcaagagtacttcttaccggccttaaatgaagaaacatcgaggtagattattttaatttttattttcttatttaaaattttatgattcatgcttgctttttagttgaatacttttgtttccattttgtttattttgacagtttgtatataagagaattttacccttgcttctattttttgttttagtgttagaaaaatttccttttattaaataaaagcatgatttaatttattgaccttttaaagaattgtggcaaagaatacaagcatacagtaaaatggagaagtcaggacgtggaaaactaaaatttcagaaatattggtttcaaggacaagagtggtctatatgcaatgtaataagttttataatattcccccatagatttgaactagtagagtcaaaaacaggtccatgatagctgaaagtatgatcactgacgttcttctctgaaagcactgtttactaatgggcacataaatgacagacaaggcaccaattttgaagaccttgcatttatatcctcagctgtctctgttatcagattctgcgttttgtcctgccttttgctttgaaaacgctttaaaattgatgaacattcttgggaaagatccactgtcagcttgtggcagatgtttcagcagctgctcccacattgtaaaggccttcaacaggacacagcccaaca

SEQ ID NO: 62147 - DNA, 2590 bp, Bovine  19866880356684
gtcatctactttttgtttgcataatcttagaaaaccaggatgatactgggagaaataaatatatagaaaaaataaagcaaacaaaaatccttcagctttgattaccaaaggcttatcaactattccactactgaatacttcctttatagctgtatagttctatagtgtaaagctaatcaatagtttcttacttggggatttaaacagaattaaaggagtgatatatttgtcaatttgttattatattgtgatcttcagaattcctactaaattccaatggcaacagttcttagttttagtaaaaggtatgtccatatatttttgacaatttttgatatagtttttaaagattaaaaagttgataatagctcagtagtaaagagctttcctggtggctcagtggtaaagaatctgtctgccaagcaggagacacgggttaggtcaggaagatcccctggagaaggaaatagcaactccagtattcttgcctcagatatcccaaggacagagaagcctggcaggctagagtccaggagactgcaaagagtcagacatgatttagcaactaaacaacagtaggaaagccttatatatgaggaatggcatgcttttattagtgttagttgtaagagtaaaaatataatcatgtcttatcatcttatagatatgtatttctctacctctcaacatccatccaaaagttattattttaaaacattttgccctaccacctaagatacatatgtgtgaattgtggtggtttttccccagtaatcgaaattggggaagtcctttattcataggggaaactaggtgtgtttttttccctatagtttcatgcattggttttgatgaacatttcatgctaaaggagtttccaaagtagaacaattcagaatccatgaatagtaattgagccttttagttctgctctaaacttaaaaccattattctccatttaaagcagacaaatcatgttgctctacagaatgctgctctgtcattttggttttcttgtggtggttgtttccagtgagctaggctggaatattaagcgctctttgcttcccatgctctctcttgctgtgctgggtacatttagggttctgtctgaaatgggcaaaaagcaattctgttgctcataaagaataacttgtaagctggtgtggatgactacacgtcttttattttgtaaagagaatgtgctgtttgccaggctttgaatctctggcaactggcttactgaaacccaacttaaatgtactcttgtgcataaacaatcagatgtaaaacataataaaaagtctcctcttatgactgtgcctctctctccaaacacatcggcttgataccctgctccgcatatgtggaactgtatctgtcagaaactaatttaagtgtcatgtaaaaacaaaaagttaacataagtgtaacatgataaatattgcttttaatattaaaaatagacgtctagcatttttagaaattggtcgcggttatggtccttgcagaaggatgtagccagatgctcctgcgctgagcactcattgcagagctggggtaatcattttctaacatgagctgtcatgttacaaaagtaaatacatgtttggattctcatggtctgttctgtttgcctgatggagaaaatgcgtaaatagttgcactatagaaatctttttcctcatccaaattttgttcactacggttttgtcctcttgcttttatgataccatatgttaatattcattaagtagatattatctatttttgtgattgaatgattcttgttttaagatgtttctacatgaattaacattttatattatcagaattatttctacatgaattaacattttatgttatcagatactatctgaaaaagaatgatagccctgagccttagagtctgaaagttctctctttcctttcttctctcccttcctttcttcttccttttcttacttcctataatgtcttttcatagaaataggaagcaaaataaaatatttctggcaacaggttaagtttattctgaaaattacattacgattttttgatgactatcacaagctaaagattaatgacatttcttaaacaataagcctccaacatcaagcctcctactgaatttgatgctcagcagcaacaaaagacacaagaacaataacaacaatcctgtaatagcaatgtctcccaatactggaagaaaaacagaccataactgatttgctgagagaatgtataagaaccaccaatgtgacatactaataaatctttaagcataattttgactattaaggaattctgtcttagttggtgaatatagagcctaacacctctagtaacatgtgactccacagtagacataaaagcatgacagatttatctggtgatttacattgatggcataatttggaagtataaaaaggaagcatatactactctggggacttctgccattctgcatgactgaagaggataatgggcaaaaggttaaaagcaattattttcttcatgcaagagattctttgaatggatttgggttactctagagggttgctagataaaatataggacacccagttaa

SEQ ID NO: 62148 - DNA, 1475 bp, Bovine  19866880450119
atggctggatggcatcactgactcgatggacgtgagtctgggtgaactctgggagttggtgatggacagggaggcctggcgtgctgcgattcatggggtcgcaaagagtcggacacgactgagcgactgatctgatctgatctgatctgatattgatatccatatttttgactacaaggtatctgaaggtagagatcaaatattcttcatccttgtatgccaataaccagtgtagtactcctaaataagtactcagctagtttttcctggaagaataaatttttaagcttttatgccaaatcaagatcacaagattaactggcaactggaacttagcaaagaacaaaattagccaaagaagattttatttttacttttccaaaggaacataaatagtattctttagtaagacttcattatacactaagatgataaagaattatctctacatttagcaaataatgtaaataattaaaaagcacaaaaaactaggtaattccattttattattctttccaattaatatgggtcactaactaaatagctataaagaaaaattatagtaattaaaagaaattaatgtattaccttctcttttaagatagattttgatttttttctttatgtactaaactccaaaagtattatatagtttatataatatttagatatgtttcaagaggtcactttttaagtggtgatatttaattatgttagattaattaacccactccagtgtttttgcctggaaaatcccagggacaggggagcctcatgggctgacgtctgtggggtcacacagagtcagacacgactgaagtgacttagcagcagattaattatatattacatataaagtgaaaagtttacaaaattatagtgttaaaaagtgttgaagttccctggtgtccagtgactaggacttggagttttcactgccagggaccaggttcaatcactggttggggttcaatcacacatatatgtatgtgtgtgtgtgtgtgtgtgttataataatatataaattatatgtaattaatctcagttcagttcagttcagtcactcagtcgtgtctgactctttgcaaccccatagactgcagtacatcaggcttccctgtccatcaccaactgccgaagtttactcaaactcatgtccattgagtcggtgataccatccaaccatctcatcctctgtcatccccttctcccgccttcaatcattcccagaatcagggtcttctctaatgtatatagttaaatatcaccaataaaaaagtgatcttctaaaatgttcaatagactattaatctaaagattcacaaaatgaataatcatccatatataaacaaaaatatcatctaaaatagacctctatatgttatttctacatttataacacatagaagtcataattcattagactatgctccttcttttcgaaatccaaaatccaagaaaattgaatcactttt

SEQ ID NO: 62149 - DNA, 2625 bp, Bovine  19866880465612
aaaagtttacttcttaattttccagccattatgaacctatgtttacatttgattttataaaaatatggtcacctatgttttccttttctcactagcatcctctaaataagcttttagattaccaacatcatccacttttcttttttgctctggttgccaaaacagaaactgactaaatattcagaatactttgaggaatcagaataatatgtgacatttacttctaactgaatactcattctgttcaagtattttaagccctagactgctccactggggaaagtttcatatccttgtgattttctaaatctttgtagaggacaaaatagtcacacaacttatagatctagcattctaatatcttccttttatactgaatgctttatcataatgaaatgtctctctttgaacctagttatgagttagggtggggatctatcttggtaagtgtcatccagtaagatcatgttctgacattgctttctttctgggcttttaattaagagcttataagtctttgccatctatcaatgcaagacttcagaatattgtgttttcctcttcattttaattttttagctcagctccataacatttcaccccacacaactttaaaatttagttatctactcagtattattattaattttgaccaggacttttcttaggtttttctggctctacatagccccaagggcatctcaggtggcaccagtggtaaggaacccacctgccaatgcaggagatatgagatgtgggtttgatccctgggttaggaagatcatctggaagtggtgatggcaatccaatccagtattcttgcctggagaattccatggagacagtagactggtgggctacaatccacagggtcaatccaaagagtcagacatgacttaagcaacttagcacacacgcttgcaaatatagccccaaagaaatgtggacaagtgaaaaggagctcaaaatccccaatgtcaatctgtcactttccttaaggctgtcttatccagcctctctggttttcacatttcttttcccagatgagtgcttgacctttggctcctatgcatgccagacaatggaccagtttacctgcctttttggattcagaaaatgtctagtacggaaaactaaccatacatccacgacctccaggactccaattttgtaattctagccattcatgacaccactgaaacttttggttgctttgtttgtatctcagcaggaacccttggcctggcccatgctcgaatctgccacctgtgctcagcaccagcaaatgattacagagaaaaataatggctgccaactgtcagctcatgtgtgaacaattctcccttctttggcgttttccttcattttagtcctcattgcttccatagctcttcagtactttaaaaatacagtgtttggaacttattcagatttctctagttgttgtcagaaggagcagtgtgctgccaagaccaactacacctaactcaaaagcaagagttttattttgttttaatgttcaatttgtccctcttggcctctagttttctgctctataaattgacatttctatctgatcctacttaataccatctccaatacctcttaaaaaaagtattttctttctcagaaggattaccttaagttttcctgtttcaaatatagaatcggtcactcttgattcctaaaaatcctggttcttttagtaacaaatagcatcagcgcattggtggtcaaaaacttgggtctgaggttatatttcagattgtttcatgtgcgagctgagaaaatgctcctggaaacccagtagttactttaaaaaagtccctttaaaaaagtgaacaaattaatgtatgttccagcttgattacaaatattgctatagtaactttactgatctatgttctccctcctaatacaacttgatataatatcattatgatatgataatatattatgtaatatatattataaatctccatttttcttccttttagctcttgagttaagtttccagaggttgggcatagaatataaggaagatagtataaaaccattgtcagaattactttaatgaaaaaaaatactttcagcctttctctaaaaacaaataatacagaccaataaattcatgagccttggaggcatgtattttgtcacaaataattaaggacaaggaaaagtataatatggattaaaataacattttggttttgctttttattttcctaaagttcaccttctctctgagacattaacatcattaatcataagtttttaataattgttcttatctgaaagggtaataggcattcctattgtctcaagtgaatcagatagttatagcctagactaggtgcctagattaagcttcccaaatgtcaagtagaagaactatcaacagccatcttcctaggtttttacatttcaagagaatgaagtgcagacctgaaagacagctctaggtcataaaagccagagacagcaggcatttatctggtccttgggaaaatgtatttatattcaagaaagtcagtgtgtgagaatacaggatcctttccataaaaagagcaaagtgttttccttcttttaggaaatatatgcatgcatatgtatatgctgctg

SEQ ID NO: 62150 - DNA, 957 bp, Bovine  19866880497720
gttgagctgggtttgcatggccattcctgggtttgcaacattgcatccctgatgaagggaaacaattttatgactctttcaacattctgattggaagggaaatgagtaagcatcagtttgcatcatccattctagttttctaaggcaaaaaatgttttaattgaggtcacaaagagagaaagaggttttccaggactcctatggagcaggaagagttgaggacattccttttgttctcttcctctcctacttaaaattggaaaaattatatttgccttttgtttattgcatggcttagtagatttgaacaatgcatatcaaatacctaatgtattttcataacatcaattttatcccaataatctccaactggcgaggtgaaaaagtcattcaatgttgatattgttgaaatggattcattaatttgtttattgaatattaattaagccatggtgatatgttagatattatattcagaattagagatgaaagggaattataaatacaactacccctaataaatatccaggcccataggagagacagaattgtaaacaaatacattagaagaatgtaaaaaatatgtaaagattgtatacaaggaacagaggcagtacagatgagagaatgactcactgtctctctctattctccctgtcatcttcagacttctgtaattcattaaaagaaaaacaaaacccataaaaataaagttaggttactagtactttcaaaagcttgtacaaaataaatagtaatactcaaatttgaatatttgaaaatctttggtcatttgttcattctttcaaccactatgtcaaggatcaatttttaaacttttagttgtacagtagatacagtttaacatacatatcatcatatagtaatttttggaagtacacttttttgtgggcttccctcatggctcagtggtagagaatccacctacaaactcag

SEQ ID NO: 62151 - DNA, 1666 bp, Bovine  19866880560924
tcttaagagtggtattagggtcccgttgtctttctactatctttccatgctgccattatggttcacattaatgtcctggacgatgatctcaagaataccaacaatgccaaaaatataggcaaatgccaggtgcttattaggccatgctccaaagtcatcatccactttctgtgatgatgaagcatggttacattgaaaagtgaaaatgaaaggcattcagtcatgtccgactctttgccatcctggaattctggccgggaattctccaggccagaatactggagtgggtagccattctcttttccaggggatcttcccaacccaggtcttccgcattgcaggcagattctttactagctgagccacagttggtcaatttgaaatcatcagtgatcacggggctgggaaaattgttgttaacctcacagacaggctgaataagtgtggagggatcagcctcagatttgctgtgcacctcagagatgtagaaaaatggcagagtagcctgctcctggcagtttggtttcatggttctgacaacctcggccagcatcagggaccatgaggaagcaagagaacacacaggagggaaaatatttagattctttttctaggaatgtacttttgttgttgttgttcagttgcccagtcatgcccaactctttgtgaccccatggactgcagcacgccaggcctccctgtccctcactatctcccagaatttaccctagttcgtgttcattacatcggtgatgccgaccagccatctcatcctctaacggcctcttctccttctgccctcatctaagggatataatacatacatgcaaataaaatgcctcagaaagggaaaaaaaaaaaagaatagtgtgaggaggtggcatgcatcaggaaattccacgtatgtggcatgaattctattgcatcccagcatccatacgtttagttaggaaccacaacccaagcttcccttctctgacacaatgattactgttctctcattgtgacttcacatgcatgaaattactgattactaactctggataacaacaaaaactggttatgtgtgaccactgataggagcaaatccccacctcccattacaaattcaccacaaggcatactcatacaggcatgcgtctatatacgtacttcccgcagacttgttcacacaatgggcttgaggtcgatcccaaagatgatcataaacagagagtatacatcataattaaaaagtttcaagcactggaaagcattggaaatggcatgtccattttgttgatgatttcctctctaacttctgctctgggactctccatttctctgttaatagaaagggaaagcagtccgctgtcctgtttgcaacaagatattgcaatcctatttcaatttataagtactaccaaggttataaactcataaattgaatatccatttattgtaacaatattgctaaactggggagacaacactgtgagtccaaaaacctcactgcaatcaccaataagcagcaaggaaaccaacagtcctgagtccatcagcaatctataaatacacatgattctatgcatgctgtttagataggtcaaaaccttttgtgtattttttattccaccccagttggcattaccatgcctcttcagaggaatctaaaggcactttccca

SEQ ID NO: 62152 - DNA, 2066 bp, Bovine  19866880811173
tccttttactgttttgttttgttttttcccgttggtgtttgaatcttaaaaggaagagaaaaattgctgcaacactggtgatatgaacagcactgaacaatgttgttttgtatgcaatgatgatgcacaacagaagaagccaaaatgagtcagacaagagtgtattaagtccattttcctcgttttgattcagaggttttttgctaaaaatcacaagccagtcttagtggcaagctttagaaaacttgcacagcactgataagaaaggacatcgctcataaatattcattaaaaattaccttttctggatcatgaatttttcaagcagacactgatttgacctctacaaggaacaaaatccagcctatagtggagtgtatcctatttctgacaaaaaaaaaaaaagatgaaaaattggttttcccagctaagcagctactttgtacactgtgtgaggtccgaggtcagttacctctgcgtttcacacacttgagcattaatattcattcaaattacaatctttaaattctaaagtcctgttcatacttctctgaaaaactgattgtaaggcaggccagggtttgcattttaactaatttttaaagtaacttcatctaacttctctgttgctcaaaaatgtatgaattcagtaatttcctttagaaaaaagtcacatctgcctgttttgaatttatatgccctccactaaggataaaagccacatttttcctggtaattatctgcagagtgggtgaatggatagaaccatctacatttatgtctatcagagagctattgttggtgtttcatcttcatatagctcctcacagttcatacatacaaaaggagctttgcattatttgggggtatgttttttgctttcattgttatgcctacaatatctcagtggggtagtcagcattaccacttgcattgtttaaatagagtaactgataagcagaatatgaattatgatagcttatactgtgcaaacttagcatctgaatcagaatgttttcctagaaccttgcccttggtgcttgttttagtttaaattctaggacctgtatttgggttacttgaaaaagtgacaaaatagtgaccaaaataatccttcaaacactctacagttcaagctatatatttttcttattgagctacacagcattaaaattttcttattacagctggatttcaatcccagctcattcgttttctggagttgtgaccttggatatatcttgacctttctattctttgccttcccctttgaaaattgagatggggagtattggtttgaaggatttacaaggcaccttaatttatacctggcagtcaaaatagttactatttagtataaaattaacttgacttgagcataatgtgacttagcacaaagaaggtaatagaatttgtattaggatatagtctctaggagaaatgaaaacatgttaaattggacatttccaccccatcccaccccacaagtcccagaacagcatagaaaatattatcaaaaaggtgattgggttagagtctccactaattttgttttctttattttttatttataattcaacccatattacctcctagttagctgctcatctgacttgcacagagctcttattttgagggtgaaacctatgtattatttcaatggtcttggtgatttaatatcaggtgttgatgctgcatcttgttgacccttatctcccaaagttttttatatggttgttcttagacacaagggtgctcagcctatcttccctagttttgatggttcactgtcccaactccactcctctcatgtcagagtgtagaacaagaaacagaatttatgcaagggaagctgaggaccagtcggatctcatccatttctccacctactatttgaagatgttcatgcactagggctgccaggtttaataaaagaaaatacacagtacccaattatttttgaatttagataaacaatgaattttttttgcataagtatgccccatgcaatacttgtgacatacttagaataaaagttacttattttagctgaaattcaaatttaa

SEQ ID NO: 62153 - DNA, 1187 bp, Bovine  19866880825702
tgcagctgtgcccctttgctcacaaataaaggatctgccgcaatgctttgttatggtgcttccacaaaagacttcctgttacacgtgttcgtatatgccatttgagttcatgtttacagcttttacagtgtggtaaaaggcagctcgacattctgctcttgtgtgatcttgtgtatttcatgtgtctaagtgagacctttgtgaccactcaggattcaggaacagactgtcccctaatgaataggctggaactagaacacatctcttcacattcactgacagattaatttgacaaatacccattagaccagccaacagccttgctcagttactcctatttactttaatttatttagcaaaagaccctgatctatcaagttaaatgccttgatcattcatcagttcacagatagtgaagtgtcccagactacaaccagattatcaatctgtgacaggtgaacatttgggtaactcatttaactgagcaaggtctaaaggctctaatattttaagttattggaggccatggctgagctataatcttctccttgtcaaatattgcaaacttataagcagacatttatttccatgcactaactgagctctaaacaaatgtattttcccctgcggttcattcctgactagatatttttcaggagatcttcactctgttattacattgaatatactttggtttgtacaaggaaattatattgttttgacagctctattattttactggttagctcccagcaatttatcttacagtacatgaggaatttattttttaattggctctgctttcctttatgaaggcatttatgaggtactattgcagctcaacattttaatgtttcctaccaatttggtaatcttgcaaacaataatgtttctgaagggcctctaaacagttttgaaacaagattaaaaagaaaaagctaacaaatgtagttttatctttaatacttaccttcctatcagccttaaatatacataaaggatacagtgatgtttgggctcaaagtttgtaaaacaaaacacaaaaattctgaccagaaataagacattttagatcccttttaattttattagaaactgacaaaagaggtgttattaaagaagcagaatgttagttttctgttgcaagatcctgtacaactggtagtttgcttatcacataaagacca

SEQ ID NO: 62154 - DNA, 2785 bp, Bovine  19866880830667
tttgtttttttttttctaaatactgaaataatcagcacagcagggaaataagccaatcattgggaagcaaaaaaggagagaaaaccaaagctctgcccccagcagacacagacccagatcttccccagcctcagaactttaatccctcttgtattgaaaaaaaaaaaaaaaaatgagtggagaaaagagaagggaaggggagggggaaaagaaagattgcaaacaaacaaacaaacaaatgtttctctgctgcctcaatgagaaacattcttaggtcttcaccatctgtattcacagatgactatctaacttagacaacagagtatttggttctgagtgaggttcttaacttttatattgcctgtgtgttaatattttatacctggtatgcctgtggcaagtggagtctatataataagacttttaaaaaaaacatagagataactttctcttagctctttgcagaaagtgattagcaagaattaaaaaaaaaaattaaatccatgactttttaaatttttggctatcctcttttaaatataacagagtgcaaactgccaaatgtacagctgagacctatgagagagacagacagataaagagacggatggaaagagagaggacaaagaaaagaagtcagagaagaataaaggcagccagtcaaatctttgatacgctgatgatggaagaatgatactaacgttttgtttaagtcagtgtgaatcctgaaggaggttgtattattgcttactgtttgagaaaataatggttaaaaaaaagtttcatttctctaaaatatacactatataaatgtactattaatatatgttgatgggggtttgagaatgataagagataaaaatgaaatatttaaataaacaattaaaatgataacacgccctactcgacaaagagaaacccacagcttggaaggagtcatgatgctgctgccaagtctcttgtcgtgtccgactctgtgcgaccccagagacggcagcccaccaggctcccccgtccctgggattctccaggcaagaacactggagtgggttgccacttccttctccaatgcatgaaagtgaaaagtgaaagtggagtcgctcagtcatgtctgactgttcgcgaccccatggactgcagcccaccaggctcctccgtccatgggattttccaggcaagagtggggtgccattgccttctctgaaggagtcatgccttggatgccaaagaaaaagctatcctagttccatcccctaactaccacgagttgctgtcactatcctttatctcctttatccctcaagactagaaagtgtttgacatacttagacacaaatttgttgaatggataagcaaatgaattaatacatttatgtttttctaagggtctcagagtataatttgagcataaagggtcttaaattctaagggattagtgaatatttttattttctattaagaacacaaactgcaaataggattcattacaaaaatgtaaaaccatcattaacaatgattataatatagaatttgcaaaggcacactcaacaaaatatctcctaaagatgaaatcaaaggaaaaataggtaagtcatcactgttttaaaatataaaatgcacatttatgtgcaaatctacctacagattatgataaataagtgaagaatgaagagaggaagccttgagcaaggggacactcaagagaactgattttagactgctgcagttaagaaggggcttttacactgtgaactgaaaaataaataggagctggccaaacaaagtgaatactccagatggagggaaaagtgtacacagaggccccaaagtgagaaaagcaccagagtggcgagagattaatgaacgagaggaagagtaagtgaggatgagactagagccaggtccttcaaaaatctcgtaaggcatgctacggttttgggtttgtttttcttttaagtctcttgtaagtgcactgaagtgcttcaaggtcaaagaaatttgagaaatgaagtactattgtgtagcacttacttgaaggttcaaaatgcacattagctaattaaagattccaagcatttcaactaaaaagaaatgtgttgagcttgatttatttcggggttttccaaatttactggagcaccacacattcttcatgtgatacacattgttatcctcctgaaccttcctccctggtggatcatttcctgaagtagtcacctggaacaatctgttgtgacaaacctgaacgccaatgttacttcatgaacaaagtgaaataacatttcctgtatctgggaataaaaggacataaaatattcaaaaagtattacttcgtagagataattggtttcatttttactcagttgaacaattatttgatagtctattttctggcaggctctgcactactgtgctaagcaatgaggttacaaggtgcacaagacctataccctaatttgaaacccttagaaaaacataaacgtattaattcacttccttattcattcaataaatttggtgtctaagtaagtcaagcactcttctagtcttgagggataaaggagaaccaagacaagggtatctttgctttgctgcaactcatattcttgcttggtgtgaaagtgaaaagagaaagtgaaagttgctcattcatgtccaactctttgtgaccccatggactatacagtccatggaattttcaggctagaacactgggagtgggtagccattcccttcttcagggggatcttcccaacccagggatcgaacgcaggtctcccacatt

SEQ ID NO: 62155 - DNA, 1093 bp, Bovine  19866880869253
caattgagcgactgaacaacaatatgtttttagttccagtgctccaaacactgctgggtacttcacaggctttcagtaaataatgactgaccaaatgaacgagtgcacagtccaggatctgagagcacaatggtgaccaaaccttggtcctgacctttgcagaataatcctttagtatagaaggtgagtgatgttacaagacaatcataacataataataccaaacaaatgcaatgtaattggagcaagtacagagagttccaaagatctagtgttgcaaaataagactctctgaatggagcagcatctaatctaagacagagaagttgagtaggagttagagaggctatgtatagggtacaactgtgttgtggtaagacaggagagaccattcagacaaagcattacagctgatgcaaagacctggagtttggagagggatgggcatatggcatttggttcagtcttattccctagatgtatttatattttctatacttcataggctttaacttccaatgctttagaatgctaaaaacaagaccctcaaaataatgcaaatgatgtatgtttgacactaggtattcgtaacagacactttcatcttcacaaaacctaaagaaataatcctcatgtacaaagttatgattctataaggtactatattacattttatcatgccttccactaatgtttataatgataaataggttgtcatactaattcatcaaagcaacatttcatgaaaccatatgaaaactaatactatgataaatgtgtgtctattacatactaccttgaggggaaaatccataagtagtaattttatgctatgaagacatttcctattataaaatggcagaggctgaaagttaaaatctttacaagtttacaggcaggatgaattgttttcctgaggcagtagtatgtctccaatctattagattaagaataacttggagaattcattgtggatacacttatttaccactctttgagcacatgaaaatatgttatttcatacttataaattaatacctaacattttttcttggataaatacatattttcatatatgattaatacatattat

SEQ ID NO: 62156 - DNA, 1532 bp, Bovine  19866880923162
tcctccctcctgggattctccggcagagtactggagtggttggtatttccttctccggggatcttcccgatccagggatcgaacccgggtctcctgcattccaggcagacgctttaacctctgagccaccagggaagccaccaggaaggctctagattagtttgtaccaaattgagatcacctgagtttgccagaaatatgagaagtgctgattgaggcctcagccctggacttcagtaataatattttattcttgcctttaaaaatgaaaccatttccaattcatgtgatttttattcataaataaaaaggaggggtagggaaggtggaggaaggaatctttgttcaagattccaaatgcagcttgacctctgtttttaaaaattcagatggcaaccatattgggcctcttgggaacatagatgatcaggtgagaacttaatttcttagagaaacttaaccagctccccagaatgtcatactggattattaggaggtaaggagaaacaggtgggtcttaccaaatgtgaagcccaagtaaaatacatgatggcagttaccaaaatcataatgcatctcactgttactgcccacaaatccttgtacatatgcaaacacccattgctaactctttagaagagcaaatatttgcaaagcaaggcttatgcaaaccagaaactaattaccaatgtttgtttccagccaatttttgcaaattaaaattctagcccagccaagaaagtgtcttttaaaataagctggattatcaatatttataagtgattaatcattagaaatgatattacatacttaaactgtggcccatctaacttttttcccattgtatgaaatgtatattctttatgagatagtctagcaaaatagccacaaatttctttaactctataagcatccctaactctcataaatcaacatatatttaaatatttaacatatgccaaaaatataaaatatgggtttttttatttaagtctatatcaccagggcaattttcatcaattgaagccacagtaattaccatttattaccactagaataatgtataatccctcactttctgttttcaaagcatgtggttggttaaagatacggttgaaataaaattcatggcagtatacttggagataattctatgctctcttatgaaatggattttaccgaagtaagtaaaggtaaaggaaaggaaaatgtaggagatgctaagcaaataattgcccatttagtttattaagtgtcctagtttgcatttaatgaaggaaagtagaatttattgattgccatcaaatgcctaatattatcaaactagttcacattttctaatttagtttttaaaacaatacatgtatagaacagtcttttggactctgtgggaaagggagacggtgggatgatttgggagaatggtattgaaatatgtataatatcatatatgaaacgagtcgccagtccaggttcgatgcacgatactggatgcttggggctggtgcactgggatgacccagagggatggt

SEQ ID NO: 62157 - DNA, 772 bp, Bovine  19866880929607
cgtggttttgaattcttatttattagcaaacttaaatttgtctatatccctcttagatttggaattctaaatttaatataccagatgagttctgactatatcatattaaattttagtcataaatttcctactcattgcctggtataggcctgcaatgtatccatgctattttctattcattttatacctgaaaagtgcaattgttgtaaaataccttgagcatattaagatttggttctgttctatctctcaccgtgtaaataatgtgtgtaccaggtaatggggggaaaaaaaatcactctttcagtgatacttctttttcatttttttggtttgttttacctcgtttcttctccctggagtatattgggaagattagtattttttcaaacctcaatacatgtctagttgaaaaatcttaaaatctatcatttaaatttaaattggattctgaaaggtcactagattacatctcctgctatacttagtgaaggaaaatgtatgttaagggagggaaagcagaccattctttaaatttctaacaggctaaattgggaacttgttagtgctcacaatccagttcttcagaagtataaaactgaactggaagcaccctggtcagctgacctgctgtggaacatctcggtctccactgaagaggaaagtggtgctttgcttttcatgaagagccacctgccatcacaggtgttaccaacaaacactggagcttcgaagagctgttgtattttccttcagccagccattgtgatga

SEQ ID NO: 62158 - DNA, 1142 bp, Bovine  19866880942270
atgcacatgtgccctaagagaaggacattgtttgctcttagaaacatttacaagaaggaacaaatctatcaccaatattgtaggcaagattcctgagttttatgcagaaggttagacatagggtcctctgagattctatgatcctaaaccaattcacggtaacctatcacaagatgtgggaaaaactttcaggaaaagaagtcttaattcttagtatactttccattagatatttggtaattaatttattggattattatgttaaggcagttgctatggacttaggagtactatagacttggttctgaatgccagctttgacctttattagtcaatttacttaatctcttggaaacacttttttttaataggtaaaatgagattaataatacctactacatagggtttttataaggactgagtaaaataatcttttaatgctaacacaattctcagcaaagaatgagggcacaatacacagaggctattataacacatataagtctgaagaaataaaaattttaaatagccatgtcactgaggatgtttttaaaagttatagaatgcaattgtgccaaagttgtgcataaaagtgattcatttatgagaagatcaaaccattttttatgagatcaatatattcacccctgtgtttcaattatgacttcttgatctgttaatatttctttgtttgtttatgtcatccaactcatttatcttgacatcctctgaaagcacttcaaaatgaatcactaagtgtgtttttcttgtttggcagttacctttttcagtagctataaatttagagaccattaccttcactggaggatctaaaggaagtttgggggcagtggaaggggagtagaagtgttcactggaaggaattgtttggtcttaagtatagaaataaatgttgcctatacaaaatgaaggttctaaagaaatgcaaggagaaagtcagcactgaggtcctaaactctaaatggaaaattaagaaaccaggaaacccaacagaactaacaaaacaagacttaatgaataattggtttgaactggggtttgtttccttttaaaatcctaattttaaattcatcaggaactatttgtgaagaaattagacttacttataaatgccatcagac

SEQ ID NO: 62159 - DNA, 1111 bp, Bovine  19866881031380
tgggcagttgggttttcagtttgaactagttagagctagaaagagtgctactgaggatgaagtacatttaaaagctgcctgtaagtaaagtagaatgaatttaatgagctacagagaaggacagtttccagggttgtgtatattgtgtgttttttacttggtatatgtgtataaaccttactaattgccctcttttagtgttgaaaaatgttttaagtcatttatgcctttggttatattctgaatttttcaaaataagcgtatttaaatttcatagtcagaaacatgtacaatagatgttactgaaaatatagccttcagaatatgatatagtatgaaattggagtttacaatcatattaacttattgatttatttaatgtattaagcagaactacacagttcagctaaaaatgaaaagataatccactagccatttgtaaggttactatatgtgtatgataattattttagtcaacttagattaaattgtctttgtaaaatactctgctaagaatcttcaaaataatactactgaataacttataattacttgatctgtactgattaataatgaaatatgcagaaaagcaaatagtagatggattgcttagttctccacactgtcatcttagatagtaaagctcagtgtttggagtgatttgtgtgtaaatgatctttaggttctaactaaccacagttcaatattacctcaagagtctttaaaataccgcataggcttagattatattaagaactatgttgtattctagtcatgattagtaatgttttccttatatactaagctagccagaaaagcattttgcaaattgatttcaattcaagggaatatattttaaggggaaatgacatagtcaaaaagaaaacatctatgaaaaggaaggaaaatattatataatctgaattttatttaataggaataattgagtgaatgagataagattaactcagaaataagagaacttgagaaaagtaaatatatgtattcaaatgtgtgctgcaaagtcacttcagtcatgtccgactctgtgcgaccccatagatggcagcccaccaggctctgccatccctggggattctccaggcaagaa

SEQ ID NO: 62160 - DNA, 1376 bp, Bovine  19866881091565
aaattatttttcttccaaagaaaaatttggtaaaattttccaaatatgatttgactgtcttctgcagtgtacatgtacatagaaaatattcctattctgttctcaaaatctaattcattttagtataatttcttgtgcacatattttagtacataattaacgctggaacaagtataaattcacattcagaagtagggattcataagtttaaaggacaacataaactccatgattcagaatctgttgaaatgttattacctttggctttgctgttaaaaaagaaacaaattaactctctcagtttaaatatgtgtgtaaactattgctcaataatatgtcaagtataatacttaataacaaaatatagagtgtgttttttatttctccattatgtaataagtattaatcttatgagcaaatatcaacttgtatattttattattcattttatgtcattaaccattcctaaacttatttaacaaactccaggagatggtgaaggacagggaagtctggcatgctgtagtccatagggtcacaaagagttggacatgacttagtgactgaacaacaacaaaattatttatggcgagagtcctggactatgaaatttaagcacaaagaaaaagaaaatgtctgttctgctgaaagttctgtaagatataggtcataaacaatttattacagtatgagatgagagaacatctcaaatataacaaccttaatataatatctattaaatataattcacattaacttctccatacatttaattaattatgctttctggaacctgacctcaccatctcaggtaatcaaaatgcctatataaatgaaaccttcatcatgagagactttcctctagccaaaatgtggactgtctattagaaacagactaattaaatgtagtttatctttctgcctagctactggagcaggtgctaacatgctgtgaaatgatgagaaaaaaacctataaaaagaagataacagagcattcccaatcaataatctgacactatactattcactctcttgtttgttcccatgagacagggtctgtcattagactacaatatacaaacatctagaacaatgtgtctcacacagaaagatgcgccataaatatctggcagataagtcatactacagaagccatatctacagtgactctgaaacaaaatgagttccagttacttaccaatgtaagatcttttccctaacagactaatccgaacaggctataatcaatgaccacttaaattgataaaaaattctcttctgcagaaaagtaattatgcttatggatttatctacaattttggaagccatcaattcacattacttaaaattgaaattggaataatatcttgaatt

SEQ ID NO: 62161 - DNA, 1483 bp, Bovine  19866881105192
ttggtgatggacagggaggcctggcgtgctgtggttcatggggtcacaaagagtcgaacacaactgagtgaactgaactgaaagattccttaagtataagaaggaaagagagaattccaagagaaagttctctgattctataacagaaatcatagagggcgcagtacaagaatgtagaaagaaaagaagggaagttaggacaggtcagggctatggggtgagtccagctgtcagtgaagggccaatgaagagccagcaggctggccttggacttcccatagcaaacatggcaaacaggaatggggctgctcctggagttttcctggttggtactgagaagcttttgcaaacagatttttatcaacagataaaatttaaatgagaaggcttttctacttttcttatattattttctctatttataagccaactaaagtcatgaccatggaggtaacgattttttattaatagtgtggtcatctgataacatgtacatatgtttttattactttcttgtttaggaatctcattaccatgttgttattctagtttctgtaatgagtggtacctgcagagaatgaggcataattacaaactggcaattttctctctcagaagtattataaattttccattactaaatttgaaggattttctcaatatgattatattgtattttgacatttgaaattctgtgggacattctttaatgaatatgttacattctccctaaagccatagggaaagttggatggattttgtgtcagtctgcatttagtgatagctacattatacttcagtgtaaaatgtgtgatcctacttcagatcttccatctgtgattgtttagtgtcaaacttataaattcttctttctttctgatagataggaatacaataaaaatttaaatgtcttcctgctaagtgctgaaattgaagcagttataagaggacaaaatacactctactgaacagtaggagtgctaatttttggcattttctcttagcttgttgaaacaagtttgctgaatgtaacatcgctagaagaagtctataaactgagctgtgaaaaactgcaaaattctcaatatgagcagttgtaaatggcttgcacccctgttaaaatgctcaaagacacaaatataatctatttttaaatggcatagacttaaaagtaatgggcctgacttgattcacagcacactgataaccaattttggctggcatttaatgacaactttctatgaggatgacatggggctatgagttaaggaagtgctgcttacagttacctggggagcttgaaaatactcaagcctgagcttcatcaaactttcacactagaatcagtgattgtgaggctgtggcattagtggtttttaaaaaatctcactaagtgattttattttgtggagttgtaacataatgatctactgattggaggaacatataaaaagaaagttgggtcagagacagatccagactg

SEQ ID NO: 62162 - DNA, 986 bp, Bovine  19866881175628
ataagaattgtccattcctcttctatccccaaactctacatattactcaagtcttaccataagcttcacaaaatctccctgacaattctttagttagcatgaaagacaccaggggataaaccagttcatgtaaccagtcttcccaacacaaccataatgttatcacgtaagacattatcacataaatgtctatgtgatagaaatcatgtactataccttttttaaaaaattaattttaaataaattgacctgaactgaattaataatgtgtatagaaagctaagaaactcatataaaattcaacatcaactctgaaacagtaaaaaaaaaaaaaaaaaagaaaccaatatacatcacttaagaaattgttttcagagtaattgaaacaggaaatggaaattaagaaaaaaaactcttaactacattggaataaatgcaacttaaagtttatagtatcaatactttagatacctacaagtgtggctatataattagtatggtgtaggcttctagaaagatattttcataaagaaaactaaacaagaaattatttgaaatgctcaaataagattatcctcttcttttttcccctacagtttacaatccctgtttaggggccttttacaacatgtttaccactatgaaaagtcaaatcattaaactcttcactaatcatatttccttattaatgcataaatttgtgtaagttttaacacacatggtcattcatccgaacatataccccaattaaaaaaataataatatattcagcctctagtgagaacaaattcagattggtctgcatgtatagcctacattgaaataagaatgcttatgattaaatattgaaaatttccccaaacgttatataaatctctggtgacgacagcaaaagaaagaaagcacaaaaacatcagtatccttaaggaaccatcagcttctttttgtttgctccagttataaattttgcatctgtgcattgctgc

SEQ ID NO: 62163 - DNA, 3442 bp, Bovine  19866881299739
gttctatccctgggtcgagaaaattcccctggagtaggaaatggcaaactactccagtattgtagcctggataatcccacggacagaggagctacagttcctggggtcacagagttggacatgactgagcacaaatgcactttacatacatttgatcctaggaaatagcaaaggttaaagaaatccccctactcttgtgttccagcaaacagcatactgcagaagccaccctaccccatatgatttagatacaactcacagatgtgtccttatatacctatgacaagtcagacatagactctccaaatgtccattctttgcctcataagtgatttgctgaactgcctattcctgctaatcaatcagaacactcaaacttaattttctctcctttccccaggtccctgaattttgacctccttcatcctaagccagaatcctaactctcctaaagagcccctgtcaagagtagggggcttcacagtaaaccactctttgatctgttgtctcatcaggtcatccttcatcctactttcccatacctggttctctctagccttgttgacttctccctagaaaagaaaagccttttcctgcttaactgttgagacactagcagatctcttgtccagagcattctctgtgttgcaataatagttcacctctccaactgcaatagtcactccctccaatctgttcttaggccaaattcaatgctttgatatttcttctcactactaatctctttgggtctgtctctctctcttacatacacacatacacagattccaatatggctatttatgtttctttaattaacaagtgtgatgattgggcaagttataggtaggttaaccatagaaaagctaatttttctttatctctgaatttctgcctacctttgatgttctctcaaattgcttggcaatctcaaactccttattgaaatctcttgttttatatagatgtcttttaaaaccgattggtaaagccaatcaatttaactcagaagaaaaacaagcttagaaaacatgagcagcccttgatttaattgtttcttttccttctcagtaaacagaacatgatttgccataaaaacctcaaactgtcatagttgactgaataaattctgaggattttagatagaataaataatgcttattctaacttggtattgttttggtattttttttttctcatgggagaggatttgttatgtgttttaaaagttaaaaataatatttgtttttcatagcattcattacttaccaggcctatgtagactttcatggtttaagccttttcaaattaaatttgaaggactgctattctttcctatcagagtaaaacacattctaaatcctaataaatctatttctttaatatgccccttgatgtataatagtgcaaacaaaaacacataatgggttcctcttgagaaaggaaaatgtattcactcctgatgaaagatcttttgataattcactcttggcttcaccacttgatttatatcatcttcccacattaatttgtttttaattttttcctgccttctaaggtttttctcatttcagtgacatgtacgtgacagatgaggttgatgaactacagaagtaaagatccttaactcagatgaaaactttaaattattctgtagtcccatagaatccatgaaagaaatcgaggagcctagatttccaagagcttgatcatagtgttttagaaacaagtgacgaaattgacaacaacaaacattaaacagagtatgtttcttttaccaatactgagtggctccctggagtgtattttttccaagtcttcagccaattcagttttgtaatctaaaatgatggcaaatatatggaagctctataaaatttcttctttatcgtagattttaatttcaaaaatgtattccttctatgaacttcatttcaatttaggggaaattaaataatttaactatcttcatttaagtgaggaagcagcaaagatgacaatgtctcaaggtaaaatttgtatatgaatataataataacccctttacacattcagcctatgtatgtaccttcatagagaacttcaactacttcatttctattttgttttccactagcagatttagaagctactttattagattatttttctgtattctgtcttagtaatggactaatgtttgggtaatcttttcttctctgtgattagattttgtgattagattattttatgtatctcatcagttgtcctttgatttccacctaagattgaatcgaaaatatagctctactagaacgctggcctcctggcactgcttcctggggtaattaagagtcattgtgtatcagtttcttcatctgcaaaatagaattcaaggggagatgagaaaggatcatacatttaaagcatcagttgctggggattgattgatacttttaaacttggtgcagtcatccctcagtattcacagggtattggttccaggaccccatacttgataccaaaatccacagctgctcaagtcccttatgtaaaatgacatagtgcaaatcattccttggtatctgcaggtcccacatcctgttgatgcagaaggttgacttagttgaggatgatgtgtcccatttatttaaattattagttttatttaaattattagttttccccagagcacctatatatactgaacttttaatattagactgaattgtattgaacttctgactgtatacccattggatgctagaaatatcctggttcaagagtaagtttgacttacaaaaacagctgaccagggcaatttattaaaaaaaaaatacatttgcctttatgcttgtccatgctgaagctgaagctgcaatactttggctacctgatgcgaagagccaactcatcagaaaggaccctcatgctgggaaagattgagggcaggatgagaaggggatgacagaggatgagatggttggatggcatcactgactcaatgtacatgagcgtgagcaaactcagggagatagtgaaggacaggcaagtctggtgtgctgctgtttgtggggtcgcaaagagctggacacaacttaatgactgaacaacaacagtccttttgggaagtaaattcttcaagaagaaataggaatgggaatacttttagatagtaaattccttcagaataagtcagctcagtgcatttcttacttaacactcctggagcaatactgtattcagaatgctggactggaagtgtttggtttgtgtgttaaatttcaggatcttcaagctgcaactacaggaaggtatggggaagactattcctgtccctgtggtgaacatcttctcacctctatcatgggcatctctccagccagaagtcccctggggatcacagtttacaaatagaagatcttgtacaatgtacaggtacacaatatctttgaaacatggg

SEQ ID NO: 62164 - DNA, 1104 bp, Bovine  19866881359875
cttttatacattgaaataatagttgttttcatttattttaagaaaggaacaagacactcttcttgctaacttttttttttttccttccaagctaaatggtagcaagtatatctgtaccttgtggaagttattgaaagatctactgcacaacactttactgtagtcattaatcaagaagtagcagctgttacagaaaaagaaaaaagttgccaaaatcgtacagtgcagtgatcaaatcatctgcacaaaagtgagcacatgcacacccacacacaacaccactgtcatttggatagtctgtacaaaagctgtgatttcagtaaaagttcaacaaagctatttttgttctgtaggtgtgcttgtatctgtgtcataatttggattgatatgatatataccctaagtttgggttataaagtaagaatagtaatggtgtattgaaattatttcctgtcttgcatttagttactgaaagaatataaagatgaagattggaacatggggaatatagtgtatacactcacaaaccgacgctaccttgaaaagtgcattgcctacgcagagagccatgatcaggtaaataagtatgtgtgtaaaccgttctctctctgtgcctgtatgtgttaacatatctaaaataagcatatttcaatacaaatttctatagttcaatacaattaatgcaatgtgttatatgtctgttttatgtgatagctactcttacttgaaaaatgtttcagggacttccatggtggtcccgtagttaagagtttgccttccagtgcagaaggtccaggttcgatcccttgtcagggagctaagatcccatgcatctcacagtcaaaaagccccaaacataaaacagaaagcagtattgtaacaaattcagtagacattttacatcaaaaaacctttaaaaaagaaaaacattaaaaaaattactttgtagatccataaatttcagcttcaaaatgcagtactacttttaccctgccaaactgtaattaaacgactgtgaatgacagttgcaagtgctatcttacaagttttccttttgttgtcacaagaagaatgttggtgctaatccaggttaattttaatttc

SEQ ID NO: 62165 - DNA, 1950 bp, Bovine  19866881373346
ccaggagatgaagaaatctgtttaatttttaattctttggggaagttgtgggtatctaatacatatttattggctgacaggcaggacaggcttcataataagaaactcagttgagttaaatatccagaagtttttagtttttgctggtgttttcttcctgtgttcacaactaaatcctattcaaatactgccttctatggtgagttgagatggaaatcaccccactcttttagtcagtgtgtgaatgacctctgccgggtaatttaccagtgataaatgtaaccatttgttgttgctgttttttcttttgcctggaagcaaaattgtgattgccatggaaggccttgattgaaagttgatagtgtatggaatgatagaccatttaaattggtctctcaaatgggttaggaaatcctgaaaacaaacaaacaaaaaccccaccatgacaaaacatatgcactaatgagaaacagaatagaataaaatagactttatgattgtcgatcctaaatagctactcataaatttaacaactggtctgtggggtcacctgtacaattgattctataactctaatataaaaatgtaatacatgagaaaaatcaaatcaatactcagatctggggaagtgccacaaaatgaagttatctgcaggtgtggtcttcacttcatggtaaatttgtattgtagtatggatggttaaactattagtaaatccctttaaagtttacagtactttatttaaaattgtaatgtgcatattcagttatttttttcacaatactcattagataatattgtcataataaatgtactggccttccagctctaaaagttgaagaatatcttagaaatagataacaaagcctgccagatttgcaaatgaatcctttcttgaaaatagcattgtttgggacatcttggaaacaataatgtgagaaatatatgtgttgctattggctacaaacataggctcccccccccccccattttggtatggaaataaatatataaatattgaaattacactgctgtaggagttcattttagttataatgcacactacacctcaggccattgtccttttagaaacagactaacacacaattctcttgagtttgaggttgctgagttgcttgggccttatgagattaccaaactgctcataattcttaaaagatatgcagtctctgacttttagaacagcaatctgacacctaaagggctatttaagcaacaaaaagggatatactttaggaaaaattggtacaattatgactagaaaacctgagctgctcctaatgtgaatatagactgaagcttttttaaagcttatgtgttatggttatatttaaattattgtctgcagaattctaaagagcattaaatatatttttgttgttttctagacgattacacagaaataggatccttaataggcgcttttgttattgatgctatcatagaactaacctaatgtggttatgccttagcaaggtcaggaagttaatacccacacaaggtattccaaagggaaggaaagggcaaataaagaagcaaaagtgctttctcattgtaaggacctcattaacattgagtagtgattctacaaactggggaaataacaaggaacagatttggaagacaaacaagaggaagcacctaaaatatgaaactctagccatgacagtcagtggttcacagctacttcaggaagaatacttccaggaagactagcaatcccaactcctatcctatcaaactctaacttaattggtctaggtccagtctagatttagtcatttacaatgactccaggtgatgctaataagccaagaggtttgaggaacattcatggtaaatgtctttgattaaaatgctatcttaacaaaaaaatagagacttttaaattatttttaatgtcatatatatgggggggggggggtatta

SEQ ID NO: 62166 - DNA, 1340 bp, Bovine  19866881397214
attgtaatgtctagtataggaaaagaaagataaagaaaatcatagatattttaacctttttttgaaaatgctgctgctgctgctaagttgcttcagtcatgtccgactctgtgcgaccccagagacagcagcccaccaggctcccccgtccctgggattctccaggcaagaacactggagtgggttgccatttccttctccaatgcatgaaagtgaaaagtgaaagtgaagtcgctcagtcgtgtcccactcctagtgaccccgtggactgcagcctaccaggctcctccttccatgggatttgccaggcaagagtactggagtggggtgccattgccttctcctttatgaaaataaggtcatcatttaaaaatgtgactcctgattatgctactcttaagagatattcattctgttatgataagtaatggtaacaaagatgatgaataattatcaaatggttacatacgttatgatgaaccatagcatgattgtagtttaaaaatgtatattacatctaactataaaattatgagtaattctggtaactgtttgtttaatgcacactattgattttgtgctgtgtgtttgatccagtactaaagctggaggtatatcttaccttattactttttggtttctatttctgtgttagcttttattgtcgtatttgattgatagtgcttcatctgagatctagttcatgcgtttctctgggaaccttaataagaggaatttagagagaaagtatgcactgaagggatgtcgctgtgaccttgattggtgtctagtggctgcctgttatcaaagagcttgactctgcatagtcttaagtagcgcagcagtccctatgatagttaagatctcctcccagcacttagtggacactggggcagccacagaaaaagtagatggttcttgtcttcaaagtatagatttaaagggtttgggtagtgggcagatggtcagttgtcaagaggcaatggaaggcgctttgtgtgttcaaaaagtatatggcctagtcccccagtgatgggggagagtatttagaatgagagggctccttgcaaggctctgttagaggtggttaaaagggacagaaacattttaataagcttgttttaaattttagagtttttgaatctgatcagtgcaatagttaagaaaagcatgattattcctttgtttgaatttagataaatagctattatgtcagaagctagaaaacctgacaatagtaaatgacttaaatgttctttattttattgtggaattgccttaatggcagtcagatttattcttgaacatgttaaaccttcatataacttgtcagtattttc

SEQ ID NO: 62167 - DNA, 1023 bp, Bovine  19866881400949
tcacacacacacacacacatgcacaattacaagctagcatcagtgcatttaaaaaaaagccccctggagtctggaaaagtcattacagtcaattcacttttttggttgttgttgctacagaggcatgaattttttctacctcactctaaatgcttctaagaaacagcagctctgcccttccttagtgcctgtggtagcagaataattctccagaagtactttgaagccttagggtcattttaatcacgtggctcttgctgttcttgatatttccaataaaagaaaaatcctagcaagaatatttatgtgctgattcccaagtaactgtgcttcatctataggtcaaattctgttatgaaagaaactacttaaataaaattttccatgtaacaaaaataccctgctgattaccctttatttcagaaaatatttcatcaaaattattgtataagaccgcagccagacttatgtagaattcactgtaatgggctctgatttattgtgagtctgtaaatactctcattcgcataagctattcataggcaatcctctgtttttttgtattgattgtttctctattagggatagatgacatcaaaattattattctccttgtgcagttccgaagcacataaaattcattgtttttaatcaagtcatttcactttccaattcacagactcttatttgctgtgagtcctgttagtcattagtataaattaggatgggtctacaattgtaatgatgcatgccttattaacctcctccctttatcaagcactgtgatttaagagatatcagttcagcctacacagtctgcaaaattaacattagtcactctggaaataatcaagaaagaaagcgctttaacaacatagaaattctgagccatagtaggaccatcagtcatttgtaaactcaaaacttatggaaagattaaagagtagagacccatacgcaaatatgtgtgcatctaaccaggaatatacgacttcacttatattggattagttaccccatata

SEQ ID NO: 62168 - DNA, 702 bp, Bovine  19866881492738
ttttctgaggagagaaggttttcttcatctcctccaggcatctgagtcttaaaaagagtaagaactactcactgtattagaatgttaggaactagaataatggaacacaagtaaggatttctaagaaaagaaagtgcagtctctcaatcgtgtctgactctttgtctccccatggactgtagccccccaggctcctttccgtccatgagattttccaggcaagaatactggagtgggttgccatttccttctcccagaggatcttcctgacccagggatagaacccgggtctccctcactgcaggcagactctttactgttgagccaccagggaagccctggtggaaggatttctaagctacataaaaaaggggaaaaaaaaaaaaagtagaaacctaaattgaggaaggcattttaaaaatctttggctgggttattcaacagataagaggcttagaaaagtcacattgaaatgaactctagttcagagaggcaatgagtgtgacttcagagaacaaaatttccaagtccaaaaatacgcgttacaagtaaccaggcactaaccatcaaagcatgctctttctgctcattaaattacgattatgatcactaatgtaatacatcggatggcacttgtttcaaaatgcatggaggatggtaattttttgagctgtcacttgagacatttgtaagaaaagttac

SEQ ID NO: 62169 - DNA, 672 bp, Bovine  19866881976549
caaatgtgataatttcttcttccccagcctcacacaaagagataatttgttccatgcccccagcaacaggtgaatggcacaaagcatgagcaatgcctgcatgcaaagaaaggcacgttttgcagataaaatgggtgacagagaaatgatccatacgcacaattactaaatttgcattaatcattttgggatggatgctctcattgtatgggtcttgagaaatttggcagaggaaagctgttgcctaagggataaaaatagctttattcttgccatcataagcctcagctctggggcattcaattcccttgccaactttttgaaactccagcccaaggcactagagtcacttaaagccttccacttctcaatcaaattccaagtttttctttttccgatacttaggttttatttgttctcaaacaacagtatcaactcagcttgcattctcatggcaattatgtgctgttcccatactagtatgagaagaaaatgttaaaaagtatcccacaggtaaatctatagaaggtgaaacacagctattagtataaaaagaaaaattttaggcttcttacaaaccattcatcctgctttataaattgtcaggaagaaatggtcactcattttgagtgccactgaaacccatgcttaagcccacaagtgaaaatgaaa

SEQ ID NO: 62170 - DNA, 1124 bp, Bovine  19866882118968
tgaagtgggtgttttcgaaacgagaaggctgaaagcgttggctgaacactttaaaacaaacatggggaagccagtgactaacactgctatagttaattaatgattctagaaaattccactaagttctttctctccctttccatttcctctgtaaacagcaccattcatgtctggttaatttgaaaaacctctaagcacaaagttcctattgggatttcttttcctgtaattaattttttgctgtttgatgtaaaggtccaaactataaattgacaagaagccagctggtacagtgatgaaattcaagacaatgcaactaatgaaaaaagcccctgctctgttagctgaacgttttgattagccactttgtgtgttttgtttctctaaactgtaatgcatactaattttacctaggaattaattaaagtctatcacagcctccatgctatggatgttatataactctttgttgatacaaagtttatgtatatatgagaataaggtgcagttttaatgagaattaaaaaaaaacaaacacttttgctcctactcctcttgatggtaccaaaaactaactctttaaaggaagtatctattttaaaatcaaatgctttgacctttctcaaggccatcaagtcaccaggaggttgttgttcagatgctaagtcgtgtccaactctttgtgacccatgaactgcagtgtgacaggtttccctgtccttcaccatctcccttaggttggtcaaactcatgtccattgaatcagtgatgccatccaaccatctcatcctctgctgcccccttctcctcttgccctcaatctttcccagaatcagggcctttgccaatgagtcggctcttcacatcaggtggccaaagtactggagcctcagtttcagcatcagtctttccagtgaatatttcctttaggactgactggtttgatctccttgttgtccgagggactcttaagagtctcctgtggcatcacaattcaaaagtaccagaaggtggggcacagtatgtaattctttttctatattagggagtgtgagctcccttttcagaaaaataaaactgctatccagtcttcctcccacctttgacactgatcaccaaggctc

SEQ ID NO: 62171 - DNA, 714 bp, Bovine  19866882254286
atttttgttattttaatataggtctgactttagagttttaaatctaggacagttgaatagaaagtagtataatatcatctgctacttttaaagaataataatgcaaatggaattcttggtaaacttcaaattatcatgttaaaatccaacttcagtcttatcttttattacaaaggaaatgtagatttatatttcaagatgcactaaagccaacaggctatttttagactttctaatcaaaactgatacactgataaaacacgtcccctcacaaaatgagttaatgctacaacttctccaatttcagatatttgatttcatgactgtgtatgattcatcaaaacttcaaaatgtacatttcaaagcatttacctgaacctctacaggaattgataataaaaggatatacaataatactgatctttcttgagcaatatttttgttaccttataatatttaattgtagccaatgttattgacctaaaaagtcttaagtaatatttatgccacacaaatgtcttcacctggggctttccctctaaaatatatagtatatttgatgtacctaccacatatctccacttagatgcttgctgaatttcagaagtcaacgtaaatgaaaccatgtcccatatagccccattctgttctttattcagtgttattcatcaatatttatggatcacatactatttaccggtattattctaggaa

SEQ ID NO: 62172 - DNA, 2477 bp, Bovine  19866880619342
catcaggatcttttctaatgagtagctctttgcatgaggtagtattgtattggagctacagcttcagcatcaatcctttcaatgaatattcagggttgatttcctttatgattgactggtttgatctccttgttgtccaagggactctcaagagtcttctccaacccagagttcaaaagcatcgattcttcagcactcagccttctttatgatccagttctcatatccatacatggctactggatacatctgcaaagatcttacttccaaataagctcattgaggttccggctgatgtgaaatgcggcggggcaggggcggggtggacactcttcagttcactccagggaagatcaggacagaagttgctggatatccagggctgtcctcaggtccagactccctagagctgaaggtgacattcacggagagctgccagctggctcggtaccctggtggggaccaccccccgctcttgcccctcctcaatgctgagctccctcccagtagggtctgtgtagccctgccttttgggaaggacctgcattgccttctttctttagggggtggatagaggtcaggtcaccttggattccattgccatcatcaccatcgactgcactggttttctggagtgtgtgtatgtgtttaacttgttctgctttttaaaaggcacaccagagcagcaaaagagtctggaggtccttctaacatcaccacaggctgacagagggcccattgtccccagggccagggtccctctggggagatataggtctctcttctcctgggcccagagcaggtatgagctgtccctgaatcctgcttttgcaggagagcgggcggcagaatggaccccaggagagtcataaaccccaggcaggaatgaagcatggctgaaaatgctgggctttgaatggaataatatatggcccaggagataagcctcctcttattccagggcttgcgttgctgtagcaaagccccagatggattcctgggaagagctgaactaggaaagagacgtaaggactggcctgcctgccctcctgccgtccagtgctcagaggcagtcaagccagagaatctgtcctcagggagccccttattcatgggaaagatgagcacgcaggcaggggcttgcggggaggagtgtggaagaaggcagggaacccagctgtgggagggtccagaaggtgggctttggaacacacccgcttctctccatctggtccccttgcagcttctctggtccctgacaccataacagccccccctcactgggctcccaagtttcccccagcaatcccaaacactctccacacaggaaccagatggactttagaaatcagatgaggggctggcgtaggtagagctctttgggatgatccagtgataaccgttttattgagaatgacaaagatgtagtttcttatcctcacacactttttcaccctgtactgagaccaggaaggactgttgccaggacacaggacatggatgaatatctccagccacagtgagcactgacctctctgagcccccaagaccagcaatgccccatatggagcacttcctccttccagctgcttcctgactttcctggggaagaaataggtgaggaattttgcctataaaccctctattctttgaaaaatcaaacacagctcttagagaccaaacaactgacttcgcccagacttgaagggtccttgacatggagcgagggccttggaggaaagacaagttctcacccaggagataaaggcatcctctcagtaagaaagagcacctagagtttccatttggattcctgaaggccttggggaaatccagggggaccgtttccaggtggtttcagaagtacctgacatatggtaggtgctggataaatatctgagtaaaccaaagagcaatggtattaataattgtgttaaaaactagaggctctttatcgggcacttacgaggaaccagtctgtgcagagtgcttgactcttaacgggagacacagcctgtcccctgatagtgtcaaaactgggcacattctggctgcatgcaagggtggatgcctgcctggctctctggaagcccacgtctggttagaaagacaagataccgaaaacttcaccactgataagggttaaacggccgttcaatacaacaatagaagagatgttcaaggcactacatgattaattgccccgggagtcatagggatgataaatgttttagggactcaggggagggagccatttgtccaaggctggcagaagagacagacatgggtagggggaagtcagtgtccttttgaagagggaccatggagctgtcgtgggatctacaatggtgtgatttgaggggcctgtcttttttttttttttttttttttttaaggagtaaatctgatgcttagttacccacttgctctagtctccccatgctggggtccttagaaaaccatctagttcaagaaaa

SEQ ID NO: 62173 - DNA, 914 bp, Bovine  19866880695371
caaaggaaagttgctgctttgcagcgaggcagcaggaggcctgcttccccggtggtgagtgtgagctgtttgcccagggagaatgctgccacagggactagcactccaggtgagctcgggacatgatctgcctccccccacccccagcttgaaacaggaatattacactgagccctctgccatcagcgccaccagctgccccgccccaagctaataagaaaacgggtcttcggatctgaggagttcgagttatctttttgtctgatgcatctgaagagtttacaatcagaatggtgctcagaggtgaaattctgaactctgactgaagtcccagaaaggatccctccctgtttgcaaagtgaaaacacatctgacaggccctggctccctggaaatccatggattacttacttaaacagtattttcttcctttcagttttgagacttttttttttcctccagaaaacgagttcctccaagggcctgtagctaaagacaaaagtcgtttcattttttactggtcatgaaataaataagatatccttcaaaaagttgttctttttcaattggactggatttgctcttcctttcagctgaacaagttggagggaacagtgtcatcatctggctaccaacctctgagaggactgggtttatatggcaattcatacacaggatgtcatctatgggttaaccttcctaattgggggacacactgtctgaattagtgacaagactgaattacggtgcgtttaagaaagattccattttagtgctttcgagttcctgaaaccgttagaactggtctcttcaaggacctcccagcacagacctccctgggaatctccttgaagcagaggagagaagaggttgtcagcttacatgctaggcagtctgaaaacacgttttatctc

SEQ ID NO: 62174 - DNA, 934 bp, Bovine  19866880786760
tcctgtatcaaaactgaagacggcttgaaacagctccacaaggtaatggcatatctttcagtagctgagaatttgaagaattgttttcccgtatcaagaattcatacgaggcttgtcttctgtcttaactgtccctagcactttcgtctgtcatcagctcgagatggggctgtgaaaatgcagcctgtcgtattcttcagagcccaccgtgtgggctgtggccgtttccctgcaattagtgaatcccagtgcaccccacatgcagagttgaagttgctgagaacccctttctgtgacagcaaactctgaaagagtcggggttttcttccttttagaaaatactttattccttggctaggccctcttgttttagggaatcgattgagtgggtgtttgttaaaacccgtgttgcgcgttctgtctgctggtagctgctgactcaggcctcccttgttgtggtacttttctgatgaattgctgctggggattcattctggagaagataaaaatctaattttctcttttaattaccacagtatatctgtgtaccaccttgaggagagagtagtctgttgaagtgagagtattagctttctcattctttgctaatactctgatggctgtctccagaatgtttttcatgatatttgttaaaaataaatggaaaacatccttaaaaatcttgtaatcaaccatgagaagcacatatgtacactgctgagtgactctcatatataattggctgcatgttttcttcagaaggaatgaaatacttcacagatgaaataaattctgtccatctcctcatggacagcggtactcctagccatgtgtgatggtcattttctctattcactaatgtacttctctgtcatctctctgagaccagtcgcttcctgtgggagaggtgaccatacctggccgtggtgccagg

SEQ ID NO: 62175 - DNA, 912 bp, Bovine  19866881198822
ggtctaattgaatctctggattttaaatcatctattgaaaagtccttccccaccctcagccccatcagaacaatgcttatgaattaaaattctctccaatgcaagcattttttaattagattgagaccttggaacctggtaactatatttcttctctgagtactgtctgggtgattacacgaagatgaaatggagaaatattggaaggaaggttgtcccaggttctccagcacctgcccaagtgtacaggtactcagaccacctcagtactcacggaataacagattggcatctggcttcttggcataatcggggagatagaaccacctaatgagatctgaatgtatttctgtacttgtggttctccacgggtaatctgtaaaggcaggaggaactgtcttttcatctttgttatttttctaaagatcatcaagtctgtgttctaggaatgcttctttcaaattatatggaatgactaaggtgccggatatgattttgggtcaagagaaggactttaagttcagaggatgctagaaactgcttcaacctctgacccacactggctgacttgcttggggaccccaaagcggtctacctcgtggtgctgggggtcctacctgtagacagctgcccactcaggctccatctgcagggggcagacccgggtggactaccaagtcctgctgaggattgagaggcaagggctgagcaaggctatggggtgaggggaaggtgtgattaggctaaaatcttcagccttgatctaggacaaaaggggggcaaaggcaggagggagggtgctgagactgtgcaaagatgggaaggtaaggaacagggagcgtagtggggaaccagacagagaaaaagagggggagggaggagagtgagggcaagaggaagagacaggagaag

SEQ ID NO: 62176 - DNA, 2245 bp, Bovine  19866881232883
ttctgccaggactgagtggtctaggatggcctaactcatgtgtctgggatgactggcattgctgtcatcccccacacacatgagcctctcatcctctgggaatctagcccagacttattcatgatggcaaaagggtccccaacagcaggagagggcatactgcatgctaagtcactttattcatgtccaactctttgcactgctagggaccgtagcccacgaggcttctctgtccatgggattctccaggcaagaatactggagtgggttgctatgccctcctccaggggatcttcccaatccagggattgaacctgtgtctccttatgtctcctgcgttggcaggcatgttctttaccacaagggccacctgggaagccaggtggtttttaattttcagcttatgtcacattttctcaagtccagctgcttaagaaagtgccatgaccaaagtcatattcaaaggatagacaaatagactccacctcctgatgggagggggagaaaatcactccgagaaggggcctgaaaactgggaggaatgatggcaactgcaaccatttttgcatacaacctactatgtgtgcgtgttcagctgctcagtcctgtctgactctttgtgatcctttggactgcaacctgccaggctcctctgtccgtgagattctccaagctagaatactggagtgggttgccatttcctcctccaggggatcttcccaacccagagactgaacctgtgtctcatgtgtcctgctttggcatgtgggatttttttgtttgtttggttttttttaccactgagccacctgggaagacctgcttggcacataacagatgcttaataaagatttgtcaaattagtaactgcctaaaattggcatatccatgcggaattggagagtggtattttgagatggtgttacccatcaccactcaaaaatctacctgcttacctggcactacctccaccttgaaggtcactcatggggccgaaggaagctgttgggatgataacccatctttcctctttccttccttctggccaaacgtcgagtgatggacctgaatatttatttcagaaagaatttcactttcatcctgaaaaaggaaattgttctttgtcgagagccaagatgagaagttggagcagagtacccagcaccagggctccctctgccatgcctcacaccatcacacagattttcactgtgattaatcccagaaagagaaagtgcatgcaagccatggcctttgggtctgtggatgctggtatttcagtcctggcagtttagatgctgggtttagaagccactccacgcacgccatccaacccgctgcgcaatgagtaaccgcacccttgcagaatgctgctctgtaattagatccctccagcaggacctggctggagccatttcagaattctctcttgctacttcaaagccttggggttccccccaccccttccttaattagataatgatagagggaagcagctacgtaatctcaccagcagagtccttttctgcttgtggttttgctcttactccttggagaatccatttttagcttccacaaagggttgagggcactaagcacagaaatcttcaaagccattcccagctccctggccctaatgaaatcccacccactagaaaaaagctccctgcacccaccctagcaaggcagggctgatgaacagctaggcacaatcatgctccttcctattctctctcttctgcttccacaagccccacatcctacccaccagctagtctgcaagtcctaatattccctggatatgccatcatcaatctcagctttgatcctttgcatatagagcttctgtccttgaaatgagcttcccctttactgaactcaaggactcctgggcacccatcgaaaccccaagctcaacaccccttcttccaaagatccattgctgacctccccagtgggtttcagtaaccttccctgtgcttccccagcccagcaaccatgtctcaattatcctccagcccagcagtgaggcaagattgtcttggtacaatccagcaccagactgcaccccagggtttccgggggaaccaggaacatgtaggcagcactagttgctctctgctcccggctgtgcactgcacctggagtttctaatccttggtttaagtcctggatttggcactggttacccacacgacttcaggcaagttacctgacttcttgggcccccaaatttcctgtcttg

SEQ ID NO: 62177 - DNA, 714 bp, Bovine  19866881703482
ctgcttttagctattgtccaattccgcctcagcaatcctgtttctctcgttttgtagatgttgtaatggaggtggaggcagaaggcctctggatagcatcatttcatctctttttctcagaggaagtgctgagggaatcaaatgtatttgtgtgtgtgtgttttttaacttggtgctctgactcagggcaccatcatagacctccattttcatcagcgatcagggagatagagcaactccctttctcccccagaaacttcccctttttccagatggggaaactgagagcccacagagggctcgccaaggtcacatgaccagcgaaccccacggctggaactcacatcttcaacgttgtcatttccagaccagcacgtttttgcttatgcccttttaattgttcatttctttccataaaattaaatgaccttcttccagaaagacttaatggtcaagatgtgatttggtaaaagcttcaaggatttttttttttttcttgttacagagattagagcagactaaggctaagagatttgcaaacagtggtatgtcattaccccgagttcagttttttgtgtaactgatgtgaagagattgctgccaatgactcaggttgccactgagcagacagcaacgctgctttggtgacctgcctcagtgtgcatgtatgtccgtctgtgctgtttatataaaaggtgtgcgtctacacaaaag

SEQ ID NO: 62178 - DNA, 1603 bp, Bovine  19866880395422
ttacagtgccattattctgtcacttgtccagtttaaccagtcctgctactgtagtatggactatcttgtacatacgttatgatttccccagatctaaatgttgtctttttggcagcactgtttttaaggagtgaatgactgtttctttggtggcaccatgaccctgaaagcaaatacaggtggaaaatctaaattctgaaaatgaattgaccttcattttctgatctgtttatctccaacagtgttagcatcgcccatgtaacaagtggtccaggcatttgagaacccctgttatttacttactcagccttgggtcatcattccttcaggggagactccctggctccccagacctcgtgtagcccctctggtcacacatttcagtggatccctctactcttccatggccatgcttctcacctttgcaatgaaatatttgctgcatgtaatgatttgtttaatgtctgccccctttactaggctctagacttcatgaaggacagaactaatgtctagcttcttgtgaagaagaaataccttgaaatatttttttcaacatagggtacctgacacgtgctcggtgtttgatgaatattggaaggaaggaatgcatcaatggaaggagtttgtgtaaaactgtgtttgtaaagttgtgcagtgtctggcacacagctgacacacgtaacagaagcagtaactattgttgataccttgatcagaatcatgcagtggccattgataaactagcttatgtgatttcacggtacttaaatctatttgcttttcattttaaggtgaaaattgacttgcaagtaaccatgcctcacagctacccctatgtagcactacagatgtttgcacggtctccagaacttgacagacagcagcagctgcttctcaacaaaggcctcacttcctacatcgggacttttgatccaggggagctctgtgtgtgcgcggccatccagtggttacaggacaacagtgcctcctacttcctgaacagaaagctcgtggacgaaccatcgacacaagcaaagccagtcaagaacaccttcctccggatgtggatctacagtcaccatatatatcagcaggacctccggaaaaagatcctggaggtcgggaaaaggttggacgtgacaggattttgcatgacaggaaagccagggataatctgtgtggagggcttcaaagagcactgtgaggaattctggcacacaatcaggtaccccaactggaagcacatttcctgcaagcatgcggagagtatggaaacagaaggagatgggcaagacctgcgccttttccattcttttgaagaattactccttgaggcccacggtgactacggcttgaggaatgactatcacatgaatctgggccagttcttggaatttctcaaaaaacacaaaagtgagcatgttttccagatattatttggtattgaaagcaaaagttctgactcctaggaagctatgaagaggcctctatgaagaggcctacattagctataacttaagctcactaagttatatttctattaataagagcaaaataaaaggactagtagcggttagcatcatcggggggaaaccagctc

SEQ ID NO: 62179 - DNA, 1537 bp, Bovine  19866880417894
ccctgagtggactgacttattcccaggctggcagcagttctgggcctttcatcagacagaacagtctttgaggaatgtccagaatgtcttctagaagattgagcagagctttagcagaagccccaggaagcctgtccatggtctcaatgggtcaaaggacaattttccaacctctggaaaggaggattggattgcttttagacagctaagactcaccctaggacctggggatggggtcagccttctccaaggctgtgtaggggaagaaaaaatccagagaaagaaactgaggtttggttaggaggcatgaaggaaggaatggatacagggcagccatccaataatccagtctaccagggcctgatgtactgctctttcccagtgcttatgcttcctgaacaagcaagctcccttctctatttggttccaggttaaaactgtctggcaactgggccccagaggtctcatttatgtcctccagtagcattttcctgaagttgactttctgggcacactgtctatgctaaaatcttagatactccatttgttactcaatcttttttttctttttttccctactgtttattcactcatttatttatttatttggctgtaccggtctttgttgtggcatgcagagtcttgttgtggcatgtgggatctagttccctgaccagggatcacacctgggccccttgtcttggagcctgcagtcccagccactgaacaccagggaagtccctgtctctcagtttttcttggttcttggtgctttcttgtggcctggcttttctgagcaggatttgtcttcttcttcttttttttttttaataattcatgaatcctctccctggcactctaaccatccaaggcttctcggctcccattcaagagtcacctttcctaggaactcatcctctggtcttgttattgactttggcatcaacttttgaaaagtctaaaacccaaccatgtttggtgatgccccatcaaattattttccagtcccattttagtttcatcgtcatcgcccaggagcttgaactgagtaggggagatggtgtgagtgcagaagcagattgctgctggaaggagccacaggtagggtttttttaatgtgaccggaatggctccactggagggacgccgtcccagctagagcctggaagctgcggctccacagctccatgtacaacatgaaaaaaaaaaaaaagaccaggcctgctcattctgtctgaggaagttgctgccactgaggaaagggaaagcgttgggtccctggaatcacatcctcaccagcaaataattgcagaaaattttaaagcattttcccaattttgcagaaatacaaattaaaaactgatttactgcaaggttgttctgcattcctgctaacaactgtgcatcagtccagttcagttcagttcagttgctcagtcgtgtccgactctttgccaccccatgaattgtagcacgccaggcctccctgtccatcaccaactcctggagttcactcaaactcgcgtccatcgagttg

SEQ ID NO: 62180 - DNA, 3200 bp, Bovine  19866880476000
agattgcacccaagtactgcatttcagactcttttgttgattatgagtgctattccatttcttctaaggggttcttgcccacagtggtagatgcagtggtcatctgaattaaatccacccattccagtccattttagttcactgattcctaagatgtctgtgttcacttttgccatctcctgcctgacctcgtccagtttaccttgattcttgaaccttacattccaggttcctatgcaccatttttctttacagtgtcggactttactttcactaccagacacatccacaactgagcatcatttctgctttggcccagtcgctatcttctttctggagctatcggttattaccttccactcttccccagtagcgtgttggacagtttccagcctggaggggctcatcttccggtgtcgtatgtttttgcctttttatatgattcatggggttctcgtgacaagaatactggaatgggttgccattccctcccccagtggaccacatttcgtcaaaactcttcattatgacccatctgtctctgggggccctgtacggcatggctcatagcttctttgagttgcacaagcatcttcaccatgacaagactatgatccgtgaatgggtttgagtcaatacctttcatcaattctgaagtctttttaaattgcctttactccatatattctctcttcctttttttggagctatgatttaaaacatgttagaacttttcattctggcttccccgtatcttatcctctctttccttttagtttgatgcagtcccacttgtttattcttgattttgctgcctttgctctaggttacctgtcccagaatatcactgccgagaccaatgtcaaggaacttttatgtatatattctcctctgttttataatttcaggccttatatttaagtgtttaatccattttgagttaacttttgtgagtggcatgagatagggatcttatttcattcttttacatgtgcatatttagttttcctgtctcattcttgacaccggcgatacagatagccttttgtacattttggtcagcgttgtcatgagtttatcatatttttagtctttttaaaaacaaacttttgatttcattgatctattttactgtgtatgtttcttctctttaaattccttgtggattttttgaaagtcagtaataggtattttttaatactgataatactactatgttgaagagcactttaaaaaaaactgagaattgctcagtgttacatgtaataactgacagattccttccttaaggcaaaacttttcaatataactcatgtctgctcctttttaaacagaaagtttatcttaagaaacaactatttcacaaagttgcagtgtatctaattttattagcagtatgttatataagaagaataaattaattctagaatactatgtctaaatatggcagacagtcttacatacacataccttatgagtaaaattgttattctgtattttttagagtatagctaatttaaaaactagaatttgtattacgttggatttttaaatttttagtttaatctaaaggtttattctttagcataattaaataccaatacttttaaaattctgtaacctattacatgataaaacatattgtgtcttcaagtttctttctttaatgtgatacagtacactaagctgtcactaagaacactagatgtgcaatttgagccccatcaaatattaagtgggtgtgtaaagtaaacttttgctaatacaaatcctagagagggattttagagctgacagcattcaagtgtccgagaatgactgaaatcagccagtatcttgtgaataataagtagggaaaaggaacaggaccattctgtgaatatttgctgtgtcctgtccaactctttgttacccatggactgtagcctgccaggcttctctctgtccatgggattctccaggcaagaatactggaatgggttgccattgacttctctaggggatcttcccaacccaggatcaaatcttcatctgctgtatctcctgcatcagcaggcaatactttaccactgaaccacttggaaatattcatgggaagtctcgtgaatatttaggagttacattatttaaagggcaggtggacgaaagtagtcagtggaaaggaacaagagtcagagagagaaaatataccaggagacagagctcacctggaagccaaaactggaatgagtttcaagagaaagttgtggtgaatagtatcaaatactgcagacaaatgaaacagtcaggactgaaagtagaccaacaaatgtggcctttagtagagaatggtgatgatattgagaacagttttaatagagcgggtagacgtatcagaaggtgatagacagaagtggtttttttgtttgttttttcctccaaaagttgaagtaggaagacagcttcaagccaggaagtaattaagataaaggttttagaattttgttgtcatttgttctctttttagaatcattgggagaaatttaagcacagttgttagtgcaggaagaaagaaattatatgaaagaaaaagtatgttggataaaacagggccctgggaaaggtagacattggaccctgaggcaaggctactactgtagttttaagtcacactgtacctaaagttgaaggcagaaatgtgggaagttgagggagttcccactagatgacctctgttttcagtataaagtaggagcaagacagattcttaattcatttattaagcactttgtaaaggcaggacttggttttaaggtcttcagttcagttcagtcgctcagtcgtgtccgactctttgcgaccccatgaatcgcagcacgccaggcctccctgtccatcaccaactcttggggttcacccagactcacgtccattgagtcagtgatgccatccagccatctcatccactgtcgtccccttctcctcctgcccccaatgcttcccagcatcagagtcttttccagtgagtcaactcttcacgtgaggtggccaaagtactggagtttcagctttaacatcattccttccaaagaaatcccagggctgatctccttcagaatggactggttggatttccttgcagtccaagggactctcaggagtcttctccaacaccacaattcaaaagcatcaattcttcagcgctcagccttcttcacagt

SEQ ID NO: 62181 - DNA, 1168 bp, Bovine  19866880482218
cttgggggtggaaataaaggatggtgtatgggtagggtggggagatgtaccagtgctgagagcacagaggcaggacacatcacccatgtgtaccaggtgtgggaggggcagggtcgttgtggctggtagctgtgggtggcaaaaggaggcaaagaagccctcctggggctggtatttgactcattgtgatgtattatggccgcaactgagtttgcagggaggggagaaggaggtccagagacaggtgtgcttgtttgctatataaaggaacccacattatatgaatctgaaagttctggggagcccatgaaggatattagagaagtaactttgtcagcattgtctactcagaaagatcactctggctgcactgtaaaggctaggttggaggagctacagattagagacagaaagtcgctttgtgttgtattgggtgagcctaaatttgtcaatggcagcaattagactggaacatataagaaatatattaaggaggagttgatggcaggatacatgcatatttttctgatttgcattttattattatgctgagccaatgtgtaaactaagcattttcgaggtacctggtattgtgatttgaagaaataaaatttaaatacaaaaataactatctgaagtttaaccatagtgaaaccacctcagctttatgtactccatcataacagtagattggattgctgcaggttctcttaacagggacataaagtcttatgtgctctctgatttgcagttaaattaaatctctcattatgtgtcagattttaagatacttgaaaaactattccaaaagcataacttcctgggtttcattgccttctcatccatatgcactcaatacctttttggtcttctgttacttctgctgattctgttttattggcctttacctgtctttagttgtttctgcttatatttttctggaactaccttttcccaggatttgggggttctttcatggctccttctccatcgccagtgactccagctcagaataacctgctacagcccaactttgaggcagcttttggaacaacgccttcaacttctagcagcagctcctttgatccttcaggtgaggcagtgatttttcaaatattctttttatttgttctgtttctaaaatacaccgcctcaggttcgtgtgata

SEQ ID NO: 62182 - DNA, 1545 bp, Bovine  19866880535221
tgttcttgctgtgacctacttctgcaggtaagaaaaatgattttgccagcctttctgtgacacggcgatggttgaactgttcccaagtgccttggtgtaggtggccttgtgaggataagcattaattattttcagactgctgatgcatcacctctggtgtctatatttgtcttctaagaatgcatcatcactctctaattataggtgatcttgtgggattagatcttttgagttagactaggtgacacaaaatgtgcatggaaagcaaagcctggaaaacttgctgagctgtggtcactgtgttttgtgtgtgtgtgtgtttattggagtatagttgatttacaatattatgttagtttctgctgtaagcaaagtgaatcagttatacatatatctgttcttcagattcttttcccatgtaggttataatggagtattgagaagagttctctgtgctcatggtcattgttaagaccccagacaatgccttggtgttcagaataacatttggatcatcttcacattgtcattgtcaccacccgcctaaatttctgcatgttagatcacttgatgattgtgcatgtctttaaagtgtgcatttttgtcatgaaaatggttatcacccaattcttattcttggactcttatattacaccaactagtaacttttttaaaaaatcaaaataaccatggaatccccaggaccccactctgtcatagttacctcctcacagggctgtgaagggcagtgagggtctctgcccctcagtctcaactttgaggcctgtgaagcagtgctgggcaaagctgtaagcagtatagtctaaaccaagttccttttctgcctgggtgctttgcccagcaggagggaagtattaggagtactggagttgaaaatatcaaaattcccagtctgtttttacctccatcctattaaacattttctttttttgatacctgcatagaaaacaactaagcctgggttctagttttactcgttaatttaatcattttttcaatccagctaacaaatatttatggaaagcctcctgtgtgcaagaccccatgaagggatagacagaaatttagataagacattaccatcccacaagcaagtttgccttttgtgggggtggataagaatgatttttttttactgagaaaacaaaaatgccaagtgtcagcaggaagaggcatgttgcggcaagggctgttgaacattccatggggctgttgttgcatgcaaggtttgggaaataaaaatcaccagtgctttgtctttctacaaacccaccctacaaggtagctccctggaatcagcagttcaagtgttgaatggatgatgaacaatgttgaagatggtggccaaagtgtaacaatgcttttcttgcctaccacctaccacatctaaaactgtgccgtttaaacagtgaagttgggaagtgggggaaggactgcatccaatttcactcccctactgggccgcagatgtgcccacaggaaccagggtgcagtgtgaggctgtcagatttccaaaagaactta

SEQ ID NO: 62183 - DNA, 1000 bp, Bovine  19866880591358
catggaattcttcaggcaagaatactggagtggatagccattctcttctccaggggatcttcctgactgagggattgaacccaggtctcctgcattgcaggcagattctttaccatctgagcgatcagggaagcccataacctcacatattagcattctgtaacttacaaatgttatttcacacacattagtaaatgaatccaccagtttcataacggagaccactgaatacatctttaaacgacccaagaactcagaccagcaacaacttgaatcatcactccccactcctgattcacaaaataaacccagcatttgatttggattgcttgatttttcagattactgtcactttttataaagaactttcctctaagaagaatagaacacatttattttaaagacatgataatcattctgaatgaagttatcttattcagatactagatgccacaattttcctagggtttccttaatttgcctttcagtataacgggagcagggggtagggtgggcacaagaccagcagagaagaatttaccttatctttatgggttaactgctgacttatcacatcctcacagatgctggatgaaggaaccaagttatgtagttgataaaacagttccacactcttctggtggtgctgaggtgtcgcatctcccagctggttccacaatgttaaagctacatgctatttaaaaaaagatgtaaaagtcacagtgtcatacaattgtaaatgagaacttctaaacatttcctattaggtacaaacaagcctctgactgccggacctagaaggtcttaatactcattatgtcgctgaaatgagatttaaaagtgtagctttccatctgcttacttcttgtcatccaggttttttaggatctcttacaacagaccctcctttaactaaatttactttaagcaccaaatatgttagcactttttacagggcccagataagaccccatttcactattctaggacatttagtaaa

SEQ ID NO: 62184 - DNA, 1702 bp, Bovine  19866880626310
taggtttgagaaaatgggactaatctctgactcgagaaaacttctggcaagttactgaggttctgcctagccatgaccaaactattttgtgctttcttcttcatcccgaaatagtgtccttagtgacacatcttcgccatatgtttctattttacctttttaaccttatgtttttaccgttttgcccacaaatgtaatactttcctcactgtgggcatagaaattgcattctagtgccaatgaaaatagttatgtaactattacagccttaccatgtaaataaatgcttttaactatacccttggggggacttttttcttaacagatgtgttattgaaatgtattagctttttatgaaaagtatttgatttttaaaaaatacttaaattctagtatattaatgatctaagataatgttaaatgataaagattttggttcaactgttatttagaccttcatgcattagagttgtaaattattgccaactagaaaaaatgtgcaaattaaatctattaaggaatggatatttaataatacaatatggaaaccatcaaatttcagcaaattcagatcgaaagaagaagtttcatcctctggtcatttaaaatcatctacaaaaaagagatttttcttcccataataccctctctggaatgtctatgttctgacttgacatttctaagtattttgcatagtaatttttgccatgataaactagtgatgactagtgataaactagttaggataaactagttaggattttttttaaataaggtaatcttgtaccaaatactttgatcattgtaaagatcaaagatagacgtggtagaacattttgcaaaagaaggaataccattggcctgaaaacatgttttaaagtttaaccacactaggttttaaaaagcatattagacggcaaatgagatactcattttctctgtcaaggtgacaaagatttttcttgtaatcccaactgttaatgatgctttaaacaatgaacattcttttacatcgatagtgagaataaaaattggtacaactcttgaggagtcaatatatgtcaaaaccttagtcataggcagatctttgatccaagatttctatttttagaaatttatcctcagtaaatgaaggtgtatgaaacaaatgtataaagatttttagtttgctgctactgctgctaagtcacttcagccgtgtccgactctgtgcgaccccatagacggcagcccaccaggctcccccgtccctgggattctccaggcaagaacactggagtgggttgccatttccttctccagtgcatgaaagtgaaaagtgaaagtgaagtcgctcagtcatgtgcgactcttcgcgactccatggactgcagctccccaggctcctctgtccatgggattttccaggcaagagtactggagtggggtgccattgccttctccgattttttttttttagtttatatatttgtttattttaaaaattgagatatggttgacatataacattgtattagttttagatatacaatataatggggtgacgtgtgtatttattgctaaatgatcaccgcattaagttaacttaacatccatcaccacatataattacaaattctttcttgtgatcagaacttttaaaatctactcttgtgccaactttcaatgtacagtgttattaactggtcattatgaggtgtta

SEQ ID NO: 62185 - DNA, 4464 bp, Bovine  19866880822326
cgtttgccttctgcccagactcttgtgcttggctttgaagaccattgacaagttttgtcacactgtatttattggatcctggtccacttttgctgtttctcttgcttcttactcgtagtccctttcttgtgtgtttagctatttttgactataagctgtttgttttctgggagaattatctgtgggacatttttgaggtttaccatgaaggtgtatcgccctggcagggtttagtgtttgcatctgctcggggtactacccggctggcgggtgataaggttctttgatgacagcattcttctggatccctgtggttatgtgcctctgagctgggggtccctggaggcctgtacttgtgatgacagctcttcaggaatagactttcccctctgccctgtttggtgccaagtcagctttctggggagtaggccctgggggcttactcacttctgactctgtcttgccctgaagaattgttgtttagttgccaagttgtgtccaactcttttgcaaccccatagactgtaggccgccaggctcctctgtcctttgggtcttccaagcaagaattctggagtgggctgccgtttcctcctccagggatcaaacctgcgtctcccgcattctaggcagacgctttaccgtctgagctaccatttgtatatagtagtgtgtatatgttaatcccaacctcttaatttatccctcccctccatgtttcccctttggtacaataagattgtttttgaagtcagagagtctatttctgttttgtaaataagttcatttgtttcattttttgaaaattagattccacatatgagtgacatcatatgatacttgtctttggcttactcctagtatgataatctctagggccatccatgttgctgtaaacagcatcattcagccttctttacggctgagtaataacccattgtaatatgtactgcatcttctttaggcattcctctgtcagtggacatctagtttgcttcgtgtcttggctgttgtaaatattgtaaatagtgctgcagtgaaccttggggtgtgtaatgtgaattctggtttgaagaacaggcctttggggcttcaggcacttgaaagcctgttctgctgggttgcacgtcttagatcagcatggaccttctacacagagaaccattgctcaactcctagtttagagaagtgccctcagagcaaaacgggcttctcttatcttgcatcctggaattctcacttaactctggcctaattggtactgcagttctttttgaaaagagataaaagtcttttatctttcattttcggttgtttttaaaaggaaggttcatctgaattacatagtttataatgttatgaaaatagaactaagttattacttttgtacattgccagcgatctgtaccaaatgactggttcagctgtcattagtagttcatatttcttttagaactgagtatgtgtccagcgtgtgcctcttccaccaccaaacagttcattctgactccatccacctggcagccacatcttacgcgtgcagggctcagtgcctcaaaccttgcccctccccgccttcagatgctgccacctgggctcctgacaaccctttccttgggccgattaatttgttcagataggcacatagaactcagggaagcattttacttccttagagtaccagtttattataaggagtgtaacccaggaatggccagatggtagagatttatgtggggaggggcgtggagcgtcagtgctccctgggcaccccagtctccactggctccccatcctggaaccccatccttcagggtttttatggaggcctccttacatgggcatggctgcttagatctttggtgtttgaactcaatctcttgtccctcctttcttccctccctggagcttgggaggaggttggaggagggcagggaggactataaatttcagttctttaatcctgtggttggttcccaggcaaccagctgccacccctaaagtttctaagggccttctgaaagttacctcattagcataacaaaagatgcctttctgtggatgctctgccggaaatggagacagatcaaatgaatgattcttagtatgaatcacagtatcacagcatgacctgtagttttaatgacttcagtggatgtttatgcatatttctgggtggtttaaaacttagcgtttcttgtattttctgagatgtctttttttaaagaggatttatgaccctgaaattgacacagtatgagtcttccaactttgttaagaactatgtgaaatggctttttgcgtttctgtgacagattatggcttgctgacgacgccccagctgcactacatggtcttctgtcgaaacagcaacggccagtatggaaaggcaaccgtcgagggttactatcagaaactgtcctcggcctttgtggaacttaccaaacaggtcagaatctctccagtgtggttagggtttgagcagttgcctaaaagaacatcagttgaacagtttatttaaacatttgtcacttttttccccccaaatttggcctgtctcctttttctttccaggactctgcaaggtctggcccttgtacccagctaactctgtgttggcatttatttggcaaggcacatagtatgttcttgttaccaaccagggttcttggcctccttaatcagtagaaattggtaagaggccagacaaattcaggcagggctttgttggggcctgtgctgcagcagaagggagcaaaacccatagattcacttgcttgctgaggggaggccaaggtggttccttacactggagggaagaggcatgtccagggttctggcgagaggagggcttaggtggtttgtccaccccttagctggtattgcctgcaggggcatgcacagtgcctgcttttgctcccagctcttcaaaagtagcagttgagtctttttggatggttttcgtatcttgttgtccataatttgccccaactgcatgcatgcagttattttcagtccctcttctctttgtattttgttgctggaggagactttgtccaggtgcaagcgctgcagcaaagggtctcaagtgccagcctgtctcattttgagctcactgggggagaagcgtgacgaacttgcagttttcataagtgttcatgcagatgaatttgctcttagagttactgtaggtgctgctggcgtcatactggaagcatctactgttaagaaaatctgtcttcaaggtgtattagcttcctaaacctgaacaaagatttgaggggtataattcacttgatcagccaatattgagcatatgttattgtcaggaattgttgaccaaaaccaagtccttgctctcatagaacttatattttgggctgagggtgggtaggagaggagattgccaggaaaaaacccacttgcccggtggtggcatacactatgaagagaatgacagatattattgctgctcattcatctgtatactcgtgcccacatttgagtgactgctatggaatacagactaataagggaccctgctaaattataataaagcttcatttctgtaatttatttggtctgtaaaacttttccaatttctgtgaccaaaaaatggtgttttaaaatcttacttgggtgttctacagttttcatatgaacatgtgtacccttctgtttcctggcttaaaatagacatattaactgaaataatggaagctgtttacatatgcatacctgtgctttatgcttcactttggtatcttgaaattgttcttccatttcttttccttttcaggccttctgccgtggagatgaccacagaacacttaaggttgactgtgcaaacggcataggggccctgaagctggcagaaatgaaacactacttctccccggggctgtcagttcagctgttcaacgatgggaccaaagggaaactcaatcatttatgtggggccgactttgtgaaaagtcatcagaaacctccacagggtatgcgaaaaatgtgtttttagagctctgtctgaaaccagtcactcaaacggaggtggcaaagagagagttgtgcagctgtcctggccccgctgctcttagacatctgggcctcgtccgcttgccgttgccatgcagtgacaggcagaacacggctgctctcggccctgagagtcttgtgactctccacagggggcgggaaatctggtggaaaaagcaaaatcaggacgtgggattttagagcagtgattcttaagctttagcagacataagagtcacctggaaggctggtgagcacgtagatttcctgggctctaccccagggggtcagattctgtaggtctcgggtggtttgtccatctgctgctgtccgtctgttgtggtaaaggaacagtcatgttatctaaaatctgatgtgaccgttgctcaggttcagtaaactatgcaagttacacaagacattaactca

SEQ ID NO: 62186 - DNA, 2515 bp, Bovine  19866880869545
gaggtagtgtgttatgccctcattatgcctggaagtaggagaaagtaaagaggtcaggattttaaaggactgccaaagattaggaatagtctttgggtacagtggaagtggaagctgaccaaggacaaataaaaggaatcacacaaatagaatggcagtgagagtctagccgagattggagagtatgtatctctaaatcacctagcaaggaggttcctgcctacaaggctttccctggcagttctcagatacatacgatatcaatggtggtaatttcccttgccatagatggctaggctatggatgctcgttaaaaggttcaaacaggttaatttcagaaataaaaaccccagaaccttaggctagaatttttatggtttccaacataaaattctaactttgtctttcgctacacccttacatgtaccaaatatgacattttagccaaataaggcttcttgctgttttttttaaagattttttttttgtttcctaaatttcacttcaattactttgcttctgctatttactcagcttatgaaaccctacatctcttttgaaatcatgaggtgattaaaactcaatttgttacctggtttgtaagcccagtaagggatgttgcctgtcttctcagcatctgttataccacttctatattacttttcatgtacttccatatatttcagagtatcttagtttctactaacttttaaatttctgaactgcaggtaccatatttttgtcatctttgtagcttgtcacagtgccagtgaaatgctttttctgtagtaagcatgtagtaaatatttactgaacttacattgtatttcacgtttgtactaagtagcaagatgggacctttaaaagaagataatgttttgccttttctgtaggctagtgaactgaagtgaactgataggctagttttaaaggtttatttttaaatgttttttcattaacttcttctaatgtgaatgttttgtcccacaggtatggcatgaactgccttattcagtttgaagattttgccaatataaatgcatttcggctcctgagaaagtatcaaaaccagtattgcacattcaatgatgatatccaaggtaatcagatattcactgcatatggatcaaaaacaatgtgccttgatattagttcataattttataaggattcagatttaataagaaatgtgcactagacacctatgaaatgccaggaattgtgtttgatgatgtcacacattgtttctcattgaattctacatatttgagactctgactttagaaagtactgtattctgcatgagctggagaaagagcgccctagaatctgataaaacccccagggattatggctgaacaaagaatgaaatgtatgaaaatatattattcattgtgtaaaatgaagagtgtatacacttctctcttcaaccttcatctcaatcagccacagtttctaagcatcgccacaacagaagctgcctttgtatacagcgtgtgccagattctgctgtttgtctttgattgattatagattcttggctacctgcttttgtctgagttgttttatttttctctaagctttgttttgctcctttctctaggtccacctcccccaaagtacttccccaaatccaaaacctcccagtgagaatcttactcttcctgtttcatgaagggcaggtagaataaaagcacaggcagagagtcaaaggagaaacacctgatgagttctgacaacttaaaagatcacacatagacttccatttcactaatcacaatgaacatttttccgtattgaccttacttggattctcagcagcttttaacattgtggaccccactctcttccttgacatattctcttctgttaacttccgtgtcacagacccccgctgactttcttcctacctttctgaatttttgcttccccccgccccccaagtttcatcccttactgactagctattagatgacagaacacttcagcatgcagtgccaggcccttttctctttgttctgtgttatatgttgggtgtatactccagggtcacacactgcattagcatatttatatctctagcccagacttctttgagttctaggtccatatacccattgggttattttaaactttcgctaggagtcgggcacgactgagcgatttcattttcacttttcactttcatccattggagaaggaaagggcaacccattccagtactcttgcctggagaatcccagggacgggggagcctggtgggctgctgtctatggggtcgcacagagtcggacatgactgaagcgacttagcagcagcagcagcagcagcagcagggatatctcaaagttatctcctactgagcctccccaccatcaaactcttatttccccaccaaacttgaccttctctgtgtattctctgtctccatgaattcctgatgtctctctcttcttcacctctctctgccaaatatagcccattactcatcctcctgacttttagcactaagttg

SEQ ID NO: 62187 - DNA, 2688 bp, Bovine  19866880917794
acataaccactggaaaaaccgtagccttgactagatggacctttgttggcaaagtaatgtctctgcttttgaatatgctatctaggttggtcataactgtcttccaaggagtaagcgtcttttaatttcatggctgcaatcaccatctgcagtgattttggagcccagaaaaataaagtctgacactgtttccactgtttccccatttatttcccatgaagtgatgggaccggatgccatgatcttcgttttctgaatagtaccttgaaaagtgcaatagtacatacaacagctggcacccaggggctgacatgcatgttcgcatctttgaaagttcacaacttgaaggctcataggcagaggacttactctacctttttacagtcctcagtgtaccacttattagtttctgtgtttacatgtctctcttccccttctggaaagtgagttccatgagggcaagggatctgtcttactgtttttggtcttcccagaacagtacaaaatttctggaaataaacatttgactaagaagtatttaatgaatctaaaaaataaattacttagtggacagttttgatatgaaatatttcttgtttccatatacattcatgctcacttccccaaattactgagtctttgactcagtattttcaaagcatctatgagattctagccctgattatagttgcaacatgtaccgattcctctttatgttccagaccagacacatcctaagtgtgtgtgtgtgtgtgtgtttatttatatattgttatattagcttcatgacagctcattagtcagataccattttatcagcaccgtacacaagaaaaaggcctataagtaatatgtctcatgtgaagacacagctgctgctgctaagtcgcttcagtcgtgtccgattctgtgcaaccccatagacggcagcccaccaggctaccccgtccctgagattctccaggcaagaacactggagtgggttgccattgccttctccaatgcatggaagtgaaaagtgaaagtcaagtcgctcagtcatgtccaactcttagggaccccatggactgcagcccaccaggctcctccgtccatgggattttccaggtaataaagggtaacacagtatattaaaccacactcttctattttagaacccatatttagctactgcattgttcagaagatggacttccctgaactgtaagagaaaaatagtaaagaaatgtattaatttcacaaagtggtagagacaggcaacatcttttagaaaggtgcggctataattaaaatgctagtctttgggtgtggcagaagtttattctatataaatattacatctatataatatatagatataatagatttatatccacataatgtaagttatatttatctatataaataaatagaatttattctattctacccaagtagaataagaagtaacatggaaaaagagacacagatgtatagaacaatcttttggactctgtgggagaagatgagggtgggatgatttgagagaatagcattgaaacatgtatattaccacatgtgaaatagatcgctagtccaggttcgatgtatgaggcatggtgctcagggctggtgcactgggatgaccctgtgggatgggatggggagggaggtggggaggggggttcagggatgagaacagatgtatgcccatggctgattcatgtcaatgtatggcaaaaccactacaatattgtaaagtaattagcctccaattaaaacaaataaaaatttttttaaaagaattaacatggaattcccttgcttcaataaggatactgaacttgaaaaattattccattatgtttctcaagcagcatttagtcacttatcacttatgtacatcgtgggaataattacaactcattttgtaacctgtacaaatatgcataattaactatttacaatatttagacccatgattataccatgtaattataacataattttttttacaagtgttgataaaattaatcttttgggtttgttttttttaaataatgccttttaaaaaaccccaacatttaattatcagtattttcctttctttctaatatttcttaatgaactccttccccttgcaatggaattgtttttaaagcttcagaaaggcctcattttacatcttgtttctgccactctacttgtgtgacaatggacatgttacaaagctttagctatctgcatgtaaagcaggaaaaaggagtccaaacttgcctggttctttgaaacgacaaagtatatgaaactcttcacatggggtctggaacctagaaacagttatgaagatgatgataataatgataccaacaacctctactgaatgattatctttgccaggcacttctctgagcacttcatatgaataaactaaattactccataaaaagtagtgggcagttgtccctgtaacagtagtattcagtttgaggactgtattccatgccaccatttccctatgggaaacacagtgatgggaggttttaaaaattgtttcagtgtcttccctcattgtccagtggctaagactcacagtgcaggggggccaggttgatccctggtcagggaattagatcccatatgccacaactaagattccgtgcctgcgaagttacttaagtcatgtctgactctctgcaactctatgga

SEQ ID NO: 62188 - DNA, 956 bp, Bovine  19866880949693
aatactggaatgggttgctattttctactccaggggatacagaaacgagacctatctaaatttcataggaaaggcggtgatagtagtttcaaatttaaaaaacagtgagaagacttcatagggttttaaaatgaaagttcaggtacacaatagaaaacagctcactctttctgccaagaataaaagtattcattatttatgaccatcaggaaatgtgggcaagagatgtggtaaaaacatagataaatatcaatggtattacatgtttcaaaatatcgaaatatcatttctataattgtagaaataaaaaactaatgtctgaagtagtataaatactattttgaaatacttaaaaagctaggtcataatctttagtaaatataaagtcaatgaaatgtgccttttggtaaatattgcatcttgctccatttcttcaacacggatcaagaagtacaacatcagtagcaaaattcagcaacatgctccctgctccatacacctggaaactggcacagtgcctgcaccactctggcctctgggagctacgtaccaagggtgcgctgggtggaacgcctgctgaccaggtggcaggggctactttcggctgccagttggcacccccagtcaacttcttctctccagcattccactgaagatctcccctaaaatcaaccatgcaaaacacacacacacaatcagaaaagaatagtatgtggctccttaaatgtttatttgtatttggggtcaagaagtaataaagagaatggatgaaacagacagaagagccttaccatatcgtatctaagagagcttaaggacatttgacaaaaacatcaagacagttttgaccctcagtgacaacaggaatttcctgtcactgctcatggaaaaatgtgccacaaaattcaactgaattcatcactggttacaaaaactttccaagtaagtcataaata

SEQ ID NO: 62189 - DNA, 1279 bp, Bovine  19866880989530
tcttttccaatgagttagctctttgcatcaggtgaccaaatgatcattcagcatcagcccttccaatgaatattcagggttgatttccttcaggatggaccagtttgatctctttgctgttcaagggactctgaagagtcctccagcaccacagatagaaaacatcagttcttcagcactcagccttctttatggttcagctctcacatccgttcatgactactggaaaaaccatagctttgactagacagacgtttgtcagtaaagtgatgtctctgttttttaatatgctgtctaggttggtcatagcttttcttccaaggagcaagtgtcttttaatttcatggttgcagtcaccatctgcagtgaatttggagcccaaggaaatacactgtttccatttttcccccatacatttgccatgaagtgatgggaccagatgccaaagatctaggcttcacagtttggcagactcactgcagttagtgtcactagtcttgggcaaacttagcagcaaggagtatggtgtccctaaccttaattttggctaactctaggaacacgtagtaagacaatggattagagctactcattttttcctggaataaaggcctagatattttaaatacctggtagttctcaggaaacattccaaattaagggaaggaatggagggatcttaggacagttagttttttctatcattttcctttaaatgtcaccactgttcatctgtcttccttgttccctttacctcttcccaagtagcaaccatgaagatggcatcaggtaaaaacatttttaaattgttggtcacatgacagcttacacttataaattaacgtcattcttttgtggacatttaaaaactgacctgtgtgccaggtacagctgcaactccaaagggtggcctcatcatgggctgtgcaaacatgacaggctgctgcggcatcatgggcatgcctgtccccgccggaggctgaaaaaagcagaggggttcccagtgtgagtggagtccactctggcaatgccctgacgtttatgtctttaatatgttaaagaaaattgctgaggaatccaggtttgtgaaaaagtatcacttgtaattttttacaaagatgcttacttacatttatttttatttatgtttttggctgtgctgtgtggcatgtggggatcttagttccccgaccagggactgaacctgtgcacccttacaatgaaagcatggattcttaaccactggaccaccggggtgcacactcaactgtgtctgact

SEQ ID NO: 62190 - DNA, 1311 bp, Bovine  19866881017676
tggaaaaaggagaatatatacaagaaaaatacttcatattcatatctctaggatcctgttactctatctgatgagttggtttaatgatgtctatgtttttaaatgtcgtgcttactgcctatattctgcttatgaagttgatttttttacttgaagttacaacctcctgtggctacaactgagtcacacggaggctgcaactggttttctgaaagttggatgcttaaatcataaacatatgtggagtagagaagcccttgctctttttgctcatatgagctggattagtcactttgctttcccataaactgataacaataacattttgtggattctgtggtatccggtgaaaagagtaaggtttgtatttttcaaatcccaaattaagaggaaagaaatttttcaagaaaagagaatacagattcagagtggtgctgtttgtaagcaaaaaaaattctataaaagcaaccaatagccccttgaaatagaggcaaaaggtacaaagccccaatatttgtttctaaaatgagtttcaaatgatctcgtttaagaagatataaaataagaaagttttaatgtttgtaatgagctaatcttttgaaaaaccacatttaaatataaacaatgactaaatatatacttttttgttttccctagctttcacgagaaccttggtttaaagattgctcttcaagttttccaccactatcaatttttaacaaactgctttagaagccaataaaaaaaaaaaaaaaagatcaaccatctgaagtcaaaactcatgttttcaacaaaaatccccaaagttgtgttattctacattcaaaatcctcattctatgattgcaaaacagttttccttctatgatgaggcattttttcctcaaaaaagatagaggttaaaacaaaaagagagcttgattttgccttctactcaattatcctaaaatactcagatgattgattttacagtgccaaatcaggtaaagtcactatgatttttggaagaagattttatgtctgctgacaagaatccatttcatgttctctgttatggaatgaaagtgatacgatcctgtctctgctgcttcagttacatcttcttctgccaaggctttctaactggactcccatgtgtgcccagtgaccttattcggttaagtgcctcttaaccccttcacatcaagtatcttattttacaatgagaaaaaggggacattttcaagagaaaaaagttaaccccccccttacttgattcacttgtgtttcgccctattaacccctctttgcgaaactttcatcccgagcctca

SEQ ID NO: 62191 - DNA, 1136 bp, Bovine  19866881018419
taccttgcagaactgttgggaagattaaacgttctaacagattagagccttttccactgggactggcatggagaaagcactcatttagccgcagtattaggtccctctaagttatggactaatactaccattttacataagaggaaattacggcataaagggaggatggaattgcccgaggccattcaattaataagaaacagaaccttaaacccaaggcactttttaccaacccaagatacgtatttcttagtaacacagataatgattccatgatatgggctttatttttctggatctggtagctaagaactgacatgattcccaccatcacatgctgcccaggaaactattgtctgatttgaacaattcatatttttatacaatacgtacatatgtaacatacacatatgtatgtatgtatattaaactataatctttttgtctaagaaaattgtaggtaggttagggataaaaaatctgcagtgacattcagggacattcaagaacaaagcacagactattcaataatggtagaggagagagaaaataaattcagcctccatgtgattccaactctgctgcaccattgctgagtcaggcttttcatttcttcaaagaaatgttttgcagtatctcttatatttcacaagccagcttgtgctcagtgtttcataaattcaaaataagaatacaaaataagaatactttttttaaaagatgcaagaacacacaataatactgaatagtgctgagaaagcaccatcatttggtacaatatatttgatgtataacttttctgaatacagtctggctagttattatcttagcacttgagaaaatacacacaaagacattatcaaatataatcatattgagaaatcagaaaacgttcaagaagctaaacaaaacactcataaataaaaattatcttttattacaacttgcttacaaactagatagacaactgctttcaggttaaaatcagcccttttaaaatgcattaacttatactagacccatttgaaaactcctaaaatgaagaagttgagggagaggagttacaagtagtttcttggatcccctagaatattcccttgaattctcaaacctgggtatccttatattttgacttc

SEQ ID NO: 62192 - DNA, 1425 bp, Bovine  19866881088999
ccaaacttcttaaaacataaaataggctgtgtgtatttcagcgctacatgtgttaacacagcacatggtgatctatgacagtcatcagggttcactaccaccacatgatagcccagctttaatctagccggacggactatctgagggatacaatgacttgaagattaaaattttttatatataaagaatctacctgcttaagcaaaatatacttgatgttctttctatgccaaggatatcatatgtgctgctgtgaaacaaatcaaaggatatgcatgtatcacagatgatcatcagacaatttagggttggaaaacttttttctggatattttggagacctaaagttgtactctatgaaaagcaaaagtgttacaaccatttcatctggaaatatattttttcagtataaatgaacttttctttttaccccaatactcctctcattcttttttcctcctcacaaaactgagaacaggattggccaagcagtactgatcaaatatggtacatggtatcttttccttacagtataatgttaagaaggtgttcaattaagcctgactatcatctttgaaatctctgctaagcaaatcaggttgagtgtcgtcttagtctgcttgtagttcttagaacttaccttgaaaaattcagtcttctcagctatgtatctcagattgcccggtgtgagaggaggtctaatcaccacagctactcgtccctggtttggacttaagggctgggcaggctccacactgttgatgttttccccagtgaccatggccacagactgagtcaatcccaccaggtccatcactagtgaaatggcaacactctgcacactgaaatcacttgcttggctgcaagcattcatcagcgtctggagccacagtggaggctgcacgtgctcccagtctgaaagagaagccggaagccaacacagtccatcacagtgaacctttcacgcatattctgtcttccaagttaatttctaaaaacaaagcacttatatctaagaactttaggccttgctctgtgaacaaaaccatggtttctcatatacactacagcttcaagaaaataaagcagcaacaggaatttcataaattttttaatatgtatttttcttatgccaagtcacacaatccattttctgtcctaaaaaagtttattaatcaacaaatattatgtagctcactgccctctgtgtgtgttatacataaatttaaaggaatgtaaatttatatgatgctagtcataataaaggaaatcagcagatctgaatgttacactaattttctccagagaaaggagttaatttcctccttagcatctgcttgctcgccaacaaactgtgagatatcatgatcacaaaattctccaacatatcaatctcctcaaaatgacagtattttgttttaaaaaa

SEQ ID NO: 62193 - DNA, 685 bp, Bovine  19866881112645
aaaggaacttgctgtgtttccattactagctatatgatacttaaaacttcattatttttctgggtggtaaactttgcctgtaaaatctaaatttggcacagctgagagattgtaataccttttcttttctcaagaataagacctaagaataacaatgaaaacataagaatgcttttaatgtttagtaattatattttgtgttcttattaacattgtagatatatataatactaaataataactctataggttaattctgaaacaaaatagctagattttatttaaatttctactcttatacatatgagaaaactgaggctcactcagaaaaagtaatgatttgcctttcgttgtttctatatttatggtaatttttttaaaaaataggagttacttaaagatccattgtacattggactacggcagagaagagtaagaggtcctgaatatgatgattttttggatgaattcatggaggcagtttctctcaagtatgtataatctttattttgtctatatttaagttggatttcaaaaacttaaagataatctaacataataaactataaaaatgttcaagtttggtataatatgtttaataattataagtgatttgagtgaaatatatatatgtatatcctcataaatattgctgaccaaatgataatgtcatgtgtctatcccc

SEQ ID NO: 62194 - DNA, 695 bp, Bovine  19866881134565
cgaagatcagcctgctcagcagagccagagtgctttgctgaataatgacagttctcagtttctgtctgtgtctgcagagggaagctgtgagtgtatgccaaatggaatttccagaaacagctcctcaccctgtatttcaggaaccacacagacttcccatgactcttctgttgcttctacagaaaccagatgtcgacagagaagtcacagtagcattcagttcagctttaaagaaaaattatcagaaaaagtctccgagaaagaaacaattgttaaggagtcaggtaaacaaccaggagcaaaacctaaagtaaaacttgccagaaaaaaggatgatgacaagaagaaagcttcaaatgaaaaacccaagcagaccagtgttttcttcagcgacggtctggatttagagaactggtacagctgtggcgagggagaaatttctgaaattgagagtgacatgggttctccaggatcacgaaaatctcccaatttcaacatccatcctctctaccaacatgtgcttttgtatctccagttgtacgattcatccaggactctgtatgctttttctgccatcaaggccatcttgaaaactaaccctattgcttttgtaaatgccatttcaaccactagtgtaaataacgcatatacgcctcagttgtctctgcttcagaatctttggccagacaccggat

SEQ ID NO: 62195 - DNA, 1734 bp, Bovine  19866881141518
tgttcttgcctggagaatcccagggacaggggagcctggtgggctgccgtctatggggtcgcacagagttggacacgactgaagtgacttagcagcagcaaactaatggccagcacccttgaccactgtactgggatggatgtagggaaagtgggagaagtggtggataaggtagcgagaagcgcccttagctctctgccttcctggttggatgagcagttgtgtcactcactgaggcaaagaactctgggtgaggcccagctttgtggcagcatttagagtgcgtatcttcagggattatccataagatcactttttagtcatcttattcaagttcaaattatgctctggtacagttgcccaaggatctcatgatgtatacagcttttgtttacttactaaaccagaaaatatgcttgatgattatacccatcctacctttatagacaaggaacagttaatctattctattctagctctattctacttcagtagttggttcgttttttgtttgtgttgtaattaattatctcttctagattataaataattccttttattgctagtacctaatgtggcaaatagtatgggttcaataactcttcgttgaaagagtgtaagattaatggcaaacattaaaatggaacttttacatatttcagacaagtttcatatggtcctgaatagaagacctagtagattttatttctagttcttaaaatgtaattttttaacgttgcatgtctcatttccatgcgttatttagacattaggaaagtgatttcacgaagtagattgaataaactgttagtagtttgaaacaaggatatagatcaggagagttttatgtatacatattttgtcctcaagaacctaagcttaagttatgcatatagcaaataataaatatttcttgaatgactttatattaatatattaattagaactgtgtcagtatttcctgttatcataggtacatgaatcagttatagaaactgttttaagagttaaccagatatatggattagactgtgaaatgtgagttaagttgtgaataagtctaatccatagctgacgtctttcaaaatgtgactattttaatttctagtatatacatgtagctactcagcctcctgcactttttactgactaccaggtctcatcagtttctcttgaaaatcctaccgaagtgttcgaagatggagaaaatccacccagtagtcgctcatcagagagtgggttcactgagttcatacagtatcaagcagaccgaactgatgacattgacagagaactgagtgaggggcagggggcagctgccatcccgattgggagcacatcctctgaaacagaaacggcctccactgtggggtctgaagaaacgatcatccagcccccttccataatcgctcaggggacggcaccccgaagtgggaagacagcccagaaaaccgcaatgcagtgctgcttggagtatgtccagcagtttctcaccagactcatcaacctctacattatccagagcaacgccttctctcaggctttggctccagagcatcaaggggatctcagtggagaacagggagaggttttgaactgggacagggattcccagggggacgtaaaagacagaaatataagtaaacagaaaacctcaaaagaatacctctctgccttcctcgctgcctgccagctcttcctggagtgctccagcttcccagtttacattgccga

SEQ ID NO: 62196 - DNA, 789 bp, Bovine  19866881176803
ttagagacaaatgtgacaaggccaaatagtttactgattatttatctactatgctatcttcttcaagtttcaactttatattcctgtagggtactacgtatcactataacctgacaaagagctaattcagtagtttctggacaagagcaaagcaaataagaatggctcatgtacaggaaagacacttaggttgtcatccatagtactcactcattaaatctctaaacgttgtcttatcatgtgtcatcagattgtccataattgctctccaactgaaagaaaccaggatcatgatatgtaattaacattttgttgttagtatttaaaaagtgttctactttgcagatagcagttgatttcaacagattctgtgagatgcattagcatgttgaatagaagcaggaggacttactggttaacacaagaggcatccatttgaaagaaactgggatccataaagaggtcaaaggcttcttttttccaagctctccgtgtgtactgatacccactaagactgctcagcagctggacacaggctcgataactgggtgcattatgtgcactgggaggaaggaaaaccacattaacctctatcttataactattcatcatattaagttactcataagtattcacatttacctaaagcaatgatgggaaatagcacttgtgtaagagaaacatttttatcactataatttaaggtaaaaataaagtctttttgtgataatttcatttttggaataaaggaacacaacttatttttaacagaatacgagttaactaaca

SEQ ID NO: 62197 - DNA, 1935 bp, Bovine  19866881194365
agatgaaaattctatacttatctctcaacctgctactatgactttcttcacagcctcggtgtttcaaagatttaaagttaactcttctcttagagaacagatgcgagcaagtaaactcagaactgcaatgccctgttctctttctgtagccgagttttgtctctgtaactgctgcccactgggctgactgctggctgccagtgcacccgtgctgaggagaggaatgtgtcgactcccttggctacatcttcaaaaaggccacctggaaaaggaagaaaaacccacagtgctttccttatataatgtgatgaaatggctgagtacacatcaaacctggatcaggtaggtctggtcagtaaggatgctcactggtctacaaagaaaatgactcctggttgggccagacgctgctattttactgagggagccaattagtccttccataaataaaccatacagtaattaaaataattcacatgcactttaaagggaaaaaaaattaagtttaaattgacactaacattgtactgccatgaagtaatccagttctcgttcccaatggttcaaacagctgctttggatgttctgtgaacagagttccaaatcctgaagactcctgggcaattccaggttcttgtcatgattgttaattacactaatatctcttccggttatgccaatgcttttaaccacacttgactatatacgtgggcttgtcagcgcaagttaccttaaaatttagttgtttcaaaaaatttaattcatatagacacaaaatcatttcagagtatttaataaggcccagatcaaatgcatcaaatttctcaatagttttggataattatgaaacaaacataataaagtcaaccataaatgctctgaaagttctagttcaggggtgataataaactgcggagagtgccagcatctggaagagagcagcatgcagtcagagataaagagttggaagtttgtcctgggccattttttgggggaaagagtgagcaacagaagcgaaaatattccactcttggacagctggtacttaagtccccaaacgcagttgaaggaggcgtgtatttaatgagccctgtaaaggggaaaggaaaaggaaagagtcgtgcaagggcagaaggcatctgctttttgtcaagtgattcagaaggatgttactcttcatacgatgctggtgagaaaagcccctgctgcgtttctgtatcaacttccagctgagtttctctatcaagttctgcagtgagaacaaagttgaaggagcaggcaaagaagagaggttaagattcctaaacaaaatataaacatggggtggggaggagacagcagagtagaaggacatgagctcacctcttcttatggaacatgtaaacttggacaactggtgcaaacctcaagggcttagagtcaagagtctgtgataatagttatgaaaacacttgtgtttctctccctggcctctcagctggtaacagatattagaagtccatgaatattcagatgagaaggggctgctgaagagagaccagctgggccccttaggggatgatgacagaatcccaggaagaggtttcaggggttactgagtctgacttctggctcactgttgtcagtatctctgttgggagactgcttcttcaacagcagttcacagggaccttctcaagaaaccaatgccactgctgatactcagagacacaaagatgacagatgaaaaccagttatccctttttgaattctgaaagctgctatgtcatggagtattccaaccagaactacttagaataactgatggtgacaaatgttgtcataaaaatggttaagaacttttgccctagaaccacacagatcagtggtcctctacttgggacaattttgcccaccagggtacatgtggtagtgtctgaggatttcttttttttt

SEQ ID NO: 62198 - DNA, 953 bp, Bovine  19866881264602
tcctcttaagaacatgctctgctctgcttattgccagcacttctttgcattaacactttgcctatagtacttcctgcctgtctgctgaattctcacctctctgagatcattctcagacctcatctgtggtgtcatgatgctttccctgaatttgaagcttctgattttgcacttcttgcatggaactaagccttcaccctctctgaagaaatgctcccctaaaggcacagaaatgggtatttgtgagatccccgactcgttttaaaacttctcagagtaaagagtgatgttttttcctcttctcacgctcttctcctcatttagggccttacttaaactagataatttataaatgcttgttgaagtttgttaaaatcaaggagattatgtatttatatattaactgtatactgaactattttaaaagaatgtcgtatttggggataagggcaacgttttatattttatctctgttaaatgtgctgttttgtttaattcagttgaataatagcccttctaatgttgagttgtctttattaaattctaattaatagtcatctacataattttctaccttaaaaggtctaacacattaataaacgttttaatagaaaaaatataagtaagtaatgaaagtaatgattaaaaaatcttgtttggtttacatttcaattattttaatgtattttgtattgtttttctttactctctttctttgccagtaagccaagtacaactcatggcatcaaaaggaaatggtgaaaagacacttaccatggacgaaatggagaacttcagccttactgttaatccattaagtgacagactgtccctcctaagtaccagcagtgagacaatccctatggttgtgtctgatttcgatctgccagaccaacagatagaaatacttcagaggtctgactcgggatgttctcagtcctctgctggggaca

SEQ ID NO: 62199 - DNA, 943 bp, Bovine  19866881280157
ttggtaaagaactggcctgcaatgcaggagaccctggttcgattcctgggttgggaagattcattggagaagggatagactacccataccccagtattcttgggctgcccttgtggctcagctggtaaagaacctgcctgcagtgagggaaacctgggttaggaagatcccctagagaagggaaaggttacccactccagtattctggcctggagaattccatggactgtatagtccatgggatcgcagagtgggacatgactgaatgactttcactttcacatggtacagtataatgtgggacagtgagaaaaaaacgatcccttgataacaaagttttttttgacagaactcatattcaagtaaggaaaacagggcacaataaagtaacatatgtaatactcacacagaataaaaccagtgtaaaaaatatgcatccatattaaaggaatgctagaattaatgcaatcagaattaatgtttagaataaaattagaaaagaaaagcatctgcaagaaaagagttgtaaactatattcagaaagagataataaatttgatttgttcctccaagtcaaactggctcctccaagactggactggaatatgggccaagatgcaaaactagcattaaaatactgaagtattggactggccaaaaagtttgttcgggtttttgtgcgatcttatggaaatatccaaacgaattctttggccaacccaatacacatccatcttaaatctttaagggaataaaactgtgtatatatatttacacatatgtatacataaagcacacctatagattgctaatacttacatgacctatctttttcatgtacttgaaaaaaaagtggagagaaagttataaatagaaatacctggcatttcaagaaaaatatggctatagtgaaagtgtgaatctgatttttctttggatggaa

SEQ ID NO: 62200 - DNA, 939 bp, Bovine  19866881456003
ttttgtattttaattccttagttaaactttttctttctggtttcttctttccctatgggttatttgttagtgttagtcacttagtcttgtccaactccttgtgaccccatgaagcatagtccaccagccttctctgtctataggattctccaggcaagaatattggagtgggttgccatttccttctccaggtatccctattttaaaatgaaagacaaatgaaaaataccactatagataaagtttaaacagtaacttaactaactaaatacaaagacttcatcatttaatttgcagtactgaagagccaagaaaaatgacaagcagaaaataactacggaatgttaacaatgaccctaaaaattactaaggtaagaaagtttaaggggcttttctaattatttagatcaagaggtctttttctttctagaggcatttctgaaccagaattatcttttaaaatatcaaccttatcatattacttgtaatcttcagtggtttatacagtaaaacttaaactgtttggtacaacttggaataatcttgcaaaactgtccttaatagtcctaccagcctttttggattgattctcattctctgaaatagttgaaaatgcatagaatttggagtcagagacacaaggattctaatccgtggcaaatagatgttatttcaactcccaacactaacaactgggaagaaaatgatgacttttaaaagatgatgctaacactgatctagccatgtggaaatcatcatcgctaagtcaacactttttaggacacttgacacaagtggttttccctacagctccatacactctctttacctgaattccaggtcaccagattctcttgattttcccttttcactgatcattcctttttttctttctttgctggtttctcctgggctctaaaggctttctaacacttatct

SEQ ID NO: 62201 - DNA, 782 bp, Bovine  19866881470343
ggctactctctggttgtcgtgcgcaggctcctcattcggtggcttctcttgctgcagagcacggtctctagggcatgcagatttcagtagctgcagtgcatgggctcagtagttgcagttcctgggctctagagcgcaggctcaatagtctgctccatgggcttagttactccacagcatgtgggatcttcccagaccagggagcgaacccatgtctcctgcattgacaggcagattctttaccccctgagccattagggaagcctgacactattttctgatgcattatcttgtttttttgttccgttggatggagaaagtatgagacatatggtctttttgcacgaatgcattacagaggtctgtaggtatggacttctaggtatatattttatccagggttttggaacaatatagaggttatttttcttgctatggagaaatacagagttttggaatgagacagaaaaacatatttcaaaaagttaatggagacttttacttttccaagcatctacttattccagaagtttacatttggccaaactcctagttttaaaaccaaagatagggattagaatctcattacaatcagtatttgactgggtcattcttaaagacttaatgttcctccaaattctcattcatctggtcaccaaggacaagaatgcaggaagaataccttagttattgcacttctttcctgatctttcttcatagataggtttcattctggcctttaattattggaatttcagacaagtatgagaaaaaagggggaa

SEQ ID NO: 62202 - DNA, 779 bp, Bovine  19866881556283
attcctgttgtaggttttatgagcttacagaaaaaaaatttaattggtgatatatctttcttatcttaatgagctctcctagtattggaaagaaactgatttaggaaagataaattgtgcatttgagaacaaataaggagcataactaaggtatttatcagtatgaattcctccgaggacaggtaaatgcttttcacaacaagttctccagctaaaagttcccatcagcagctgttcggttgttaattgtctttcttcaaaaagtagtcccagaaaggtttcatggcgccggcgttctttctgtgtgtctcctccatccacattcaaaggcatccttagaacacctggaggacagtatgacagatagcacagtccttctggtacctgctcttccatgtgtctctctgtgtcttcttaattaggatgcaaagtaaaagtgacagagctgttgctagtgaacaggcagcagctggcacctccatgcgagggggcaggcttagcgatcacggatagagactcataattcatccaccctgacaaacaggaacaccttaaaaatggaatgttacaaggttctttgccagtcacacagaactcccttgctatattttgcagtttcgtgtgatgagaagaaacggggtgactcgggttccaccagatctctaacttctgaagcactcagggtggagttaaggggagcctagtttcctcaggagacagcggggcaaattgagacatttctttggagaagataacttgaatataatggaataaaatgt

SEQ ID NO: 62203 - DNA, 1801 bp, Bovine  19866881629010
aaactgcctgctgatgcaggagatgtaagagacgtgggttcaatccctgggtcgggaaggtcacctggaggagggcattgcaatgcactccagtattcttgactggagaatcccatagacagaggagcctggagagctacagtctgtaggatcacacaaagttgaacatgacccaagtgacttagcaaacatgcacaaatctgaattaaactttcatcactgcatgtaataggatgttgtgtttgtctaatgagcccttatattttcttattttcctatcatcttcagatataggagatctgaggcaggagaatgggtgagaacagaggtttcagagcctgagagatgagcgaatcatgactgagaacactgcctggcatcttcgcagctgccgcatgtgagaaaagggtggagggggaaccaagaggtgggtaacgaacgcggccacgggagcttcgctctttgctcctgcgtgtttccatattcgggtgaaaacgcacaatgacgtagcaggctgatctgttttagcaccagagataaaatgctcagaagaaaggttatcagcttgcctagttattaaaaatccagcaagccgtggttgaaaaggtttagctaaagctcggactcttcgggggaaacagcgatgaactatatttgcctcaggaccttgtatgggctccccttcattgtcagtgtgctcaccccaccagtgtgacacccccttggtcctctgccttttgcttcacgggcttgtggccagcctccattctcatgattaagctatggacaaagagtgttgtcagttggcacaaatgaacttatccaagaaacagaagcagactcatatgcaagagaatagaacttgtggttgccaagggggactgaggggctgggagagatgggctgggagtttgggatcagcaggtgcaaacggataaggaacaggtcctaccatatgcacagggagctatttggtgtcctgtaataaaccataatggaaaagcatatgacaaagggtatgtgtaggtatagctgagccattttgttgtataccagaaactaatgcaacctgtataccagaattccaattcaactctactccaagaaaaaagcaactaagaaaaaaagagtgttgtcagttggaagcctgggagtatattttctttctcagtctgaattctgaatcatgttcacaggcagtccaacccataaaaccagtgcaattctcatgctttcattctcttcaccttgtggagcctcagcttcctcatctgtaaaatggagaagcttgatttcaaaatttccttccagctctgatatcctatggcatttatgacctgtctctgtttaggagagaaatgtgtgtgtgtgctcagtcgtgtctgactctttgtgaccccatggactgtaactgccaggctcctctctccataaaatttccaggcaagaatattggagcaagttgccatttcatactccagaggatcttcccaactgagggatcgagctttgtacatcctgcattggcaggtgggttctttaccactgggccaccagggaagccctgagataactaaaggtgttcatcaatggggtacctgattttaaatagcaagtgagtgaatttctgacaaagcatgtgtgtgggaaattgtattttagccatgccaaaaatgatttttaaaggacatttttagtgacttgctttggaaagttcttttcttcagcttcacctaatttgatgtgtgctgacctaagaaaaagaaacccacttatactgttgttttctgtctataaagta

SEQ ID NO: 62204 - DNA, 925 bp, Bovine  19866882136899
gaaggatgctttaaagcctgaagagtagcaaacctaatgcagtcacagataggctttgctttcaaaggccaacttgcaagatagaaaacaagtcaggagccatatgctgtgcgtttcctatgtcagtgggtgagagagtcagcagagggttccctttggggcttcctaagtgcctttcaccccaaattcaatttacacatagcgtatcctttgcacaaattgaagtgtacaggtcctggaaaaataacttaaaaaacaaagaggtttttctttttttttattgtgatgagaaacagaagttgtgagtaactgtaaaataatcaactgtgtaactttaccatcttcctttccctccactactgccaaacattttaagcagacattaattattctgtctcattcctgaaactaaacttgacgatagtgctatcatattttgaatagaaactggcacattgtcagtgaacttccttgccatttatttttagcatagaatcagtggcaagcttaccctttagaaatggcttatgaagtctttggtagacatgtgaaatatttggcaggctgaagatttttcatgctgcagtgaactgccgcacctttgggggattgtttagcggccctggagatcatactggaaatgtgctggcaccacagaggttctggaaaaccacctgccagaaggttgtctggctgtggacaacatcatcagcccacagctcgtcaggatgggctctgtggcctagaggtgggttttctaaatgtgatcaattccacatgtgacaacaatgtggaatattattattccacattgtatattattagtatattattaaccagttagacttctccccatcccatgaatcctacatgttttttttaaactaaatttgattttgtagcttaagaatgtaaaccttttaaa

SEQ ID NO: 62205 - DNA, 1740 bp, Bovine  19866880395428
cttaaatggtgtgatttggattctctgactttaaagtcttgctgtaggttttatttgaaagttatatagtacctgaaaagagataatcatatttaaaagatagcccaggaacaaaaaattggaatgttttcatttagttgtttgcatcaatcatcttaaagtagtgttatatataaggccacactctttacagttaggagagagaaagtcttgccctgtaatggcgcataagtaaaactgaagtagcattttggatgacctgtgcatctgtgggaagtaatggccctaggcaccaatttgggtttcatagaacgtggttttttcctatgtcttgttaggagtatgtccaaggtgtgtgtaatagccagaaggagaggctgctttagttctcctgacaggaatcccagagccactggaaagaaagatgatgacaaagggtcctttgcctcttgttcgtaatttattgaagaagagaccatgaagtagcatatggaatttttacttggcttttagtagatgtctctgctgagaaaaagccagcattgtacccagcactgttgtaacccagtctgggcattggtacagagtctgccccccagtgtttttacacagagtaggaacctgcccccaggtctgggtgtgaaccccttggaggatggcctccactgctgctgatttttactccccttgggtgtgtgggggcatctgagcagcagggctacagacctggaatgagagaatggccacatggacatggacgccgaggtcaccgaaggcaggtgtgagtgaagctctagaattatttttcttttttatatttttaagaaagaactttattcaggcaatttaaaaataagattgcagagcaacacacattccaaacataggtaatgagcgcttgtcaatacttgactgtgttaatattttaatactactgatctttctcatttgctttgtaggttagtatttatttaccagtcctgaagactatgaagagcgttgtggagaagatgaaaaacatcagcaatcaccttgtaagttctgacttctttgaaaagagctcccaagtgtgcagttttggctgcatgtcctcggaggagccttgtctggtggggacttgatgccctccattcatcatgtagtgtctgcgtggggtgtccctcagctcccggctctgggggcttggcttgttgttgatagcctacggttttacaggtgaaacctgctctggatcttctcaactctcctctctgatatttggcgtagtctctcatatttatggtatttacagtatattaacaatacattcagtggttttaactttctttccatatgttttggacagcatattatgtattttatccgatagtgtacattttttttttatgatcacctgatggtggcagtgcgtggaatgtcgtatctacttgccaaatgtctcttgagtcccagacaaggatcccccaggacacattcctcttcccggaagcagctcttaggccaggtagaggggcgtgtttacttccctgtttacattgttgacgtttaccctcagtgtcagtgaaacactgaatgtgacagtgatgggaagttgtgaacaattgtccttcactcctgaggttctcctgaattcttcagtcacccccgaaactcatttgattatttccctgtgtgtttagacacgactgttcacctgatgaaacttttgctttttagcgtctgcagactggttacctgcca

SEQ ID NO: 62206 - DNA, 775 bp, Bovine  19866880429566
ttgcagccttgtgtgcattcttgcatagagattgggcaagatcctggccagtcatgttcttggaaggacttctaaggtcaaagaacataaactacttttgattgtgggaaaatgcatataacataaccattttcaagtgttcattagtggcattggtactttgatattgtgaaatcatcatatgctgaactgttctcattttgcaaaaccaactccatccccagtaagcactaactcctctttcctcctcgcacagcccatcacccaccattcagctttccatttctatgagttttactgccctaggtgccttatggaagtggaatcatacaatatttggtgttttgtgactggcttatttcactttacttaatgtcctcgggtttcatccatgttgtaggatgtaccaggatttccttctggaatatttcattgtacttaaagaccactttattcaggtttcttctggtagacacttgggttactttcaccttttggctatttcgagtaactcttctctgaacatgggtgtgtaggtatgtgtttgggtccctgctctcacttctctggggtgtatacctagaagtgaacacaagcttttggaagtcccttgagatataaggtcaaattgcagttgagaaacggcgtgctggctgaatcctcttcgtgctcacccgcgtgcctgaactcctggccgggttggcgcctgctgggaaaaaccaggcctgcaggaaaaggaagagaagactttttaccaagctattttgacagattg

SEQ ID NO: 62207 - DNA, 996 bp, Bovine  19866880721837
gatgtactagaaataatctagaagctcacaagacacaaatgacttgcccctggacaggttggccttgtcttcacatgcgccacaaccccagctctgccttctgaccatgcaggcgtgggagagcttcccacccagcaaggctggctagcagggtctgtgactgtcagcttcctctgcatcctgctcactggtcagccagtgtcctgggccctcagggagacatggcggggagccaagtccaggggaaggcataaggccggatgtttcttttgccgctaagtgtcctgtgtacatagtcctctgtcaccattcagatgcccagagccgaggcgacaggtgacaaagctctctgtctccagcccagccaccctcccttgcacgagggagagtgtggctgccatagcttgggcagacgtgggactcagagctccttcccttggacctactcaatgttcacatctctgacaggagaagatgagacatgttaacatttttaagagtctaagcaaaaaccaatttgaattggaaagtggtgggggagccgaatggagagaaaggggaaacacagcaagaacctgactgatggctgcagcttgaagcccaggtggccgtgtgtggttctctgttgctaacattttgattcataactttgaggcatttacagtttagatttttgggttgctggcattgcatctcaggccaatgcctccttttttacttaatcaagcagcccattactaactgatctccgttaccgattagcacccattcataaagctgaattcctcacattgttaaggtcagttgtaaaactgcagaaacattaagaatagttcaagcatgtacttttgatattgaactgtggatggttatatttggatgtgagagttggactataaagaaagctgagcactgaagaattgatgcttttgaactgtggtgttggagaagactcttgagagtcccttggactgcaaggagatctaaccagtccat

SEQ ID NO: 62208 - DNA, 2050 bp, Bovine  19866881020463
aaactgtagtgacagaactgattggtggttcccgaaagttagtgggggcgtgactgtaaaggaggagtatgatggcatttgggggaatgatgaaatggttttatatcctgattgttgtggtgctctggtgtacaaatctatacatatataaaaattatagaactatacaccaaaaaagctgatattactgtaggttgatttaagatgtatcatttaagtttggggtttttttttttgtttttttttttaatatttttgattgtgccacatggcctgcagaacttccctgaccagggattgaacccatcccacctgcattggaagcatggagtcttaaccactgaacactcagggaagttctaagatgcatttgctgtatgaatgaatggatgaagtttctttgcaatcagactgacttccaggatttcctagttactttgcctaattctgaccaaaatgggtgaacctattgaactagaaaggataaatttccgaggcaacctatggcatcagtgtcttcctttgatgttaaaccacaagacacaagttgatgtgtgttgatgagtccacaattgaggggttttctcaggccctggatacagagttctctctcctgcaggaagacctgagtggctaggacataacagtaattggacatagcagagctggtcaggtcccctgtaggtgtgactctggttctgagatggtgggcaaagcactccagccctgacacccggcttccctgcccacagaatggatcgaagcattcttaacttacaaggtgattgtgtgtgaaagtgttttccaaagtgtgaattgtctgcagcaaagcagaggctgctgagcatcccatatccacacacctctcgtcacccttaccagctcctctggcaaaacgtggacaggcctcccctccacttggactgccttgttgggaggctgccctcttagtccctgtaacccgattccgtctgtcaggaaaggctgagtctgggagctggcacacttcatttgggtttgattaacgaggctgcggagggtctttggggcacagccgctcagatgcacacttctttccagcaccagatatgccatttatctgtgttttcctttggggaagaaggaggaaatgggctgttagtaaaaacacagactcacttattataataaattatagtgaaaagtaaaataaacatgaccccactcataaaggatgaatctaatccagacagagcctcaggaaagagaagataacaaagaaataagtaaaaaatactttctccttggttgttccctggtgcaggcagtggtattcaccgcacatttaggggcacacaggctattgtagagcaagagcgtccacatttaggccaccaaaatgctacagaagtttgatgtttttgttgcatgaagagttcatgcaaattgtggaaatcaactcccaatggacaagtgagagacagaaaattcactccagagaaaaagggattagggaacatattaatacatgtgggaaaatgtttaaccttactggtgattaaggaaatgaaaattaagataatgagatatctttcattgtctatcaagttaacaaaaacgtcaaaacaaaataaaatacgtaatgctggtaaggtcaaggaaactcatgtaatgctgatagatgtataaattgatacaactattttcagaagcaagaaactcatgtaatgctgatagatgtataaattgatacaactattttcagaagcaagaaactcatgtaatgctgatagatgtataaattgatacaactattttcagaagtggtaaaatgtattaagaactataaacaacatgcataccttttagcctgatgtttatatcatttaaccagtaatccatgtgagtaaatctgaccaaaagaaaaacatttaatgtataaaaaacatggccaaaagaaacaactctaaatacacctgaaaaaattctttgtacaaagttattcatcacagtaagtttggaagtaaactaaatatccctgaactattttgcaagcatctgaaaaaatggt

SEQ ID NO: 62209 - DNA, 2781 bp, Bovine  19866881227876
gtttatgtctttaattctttaatagtcattataccctcccagaagatttttctagtgcatgggagtggatagaaacaaagattggctctgcactagacaatcagggcaacaccaggtggataagcacatagagtcaaagtagttgaagaataaggtctgagttagacccctggcacaagcaagctgcatcagaaatattggctgccacccacaaagccagtgccaccattctgggagatagtatgcaagtgagtgataatgccacactgctctcttgccaaaaataatctgccctttccttcagtcctctggttgatgcaagcttgtgattaggttttggaattccaataaagttgatcttgatagtctttgccagctgatgattgtttcaatggagaaacaattttttgagcaccttttgctgccattgaaaattattgtccctcaagatcctgacataggagttccctgatggtccagtgataaacaatctgcctgccaatgcaggggacaagggtttgatccctggtccgggaagatcccacatgccgaggagcagctaagcctgtgagcctcaactactgaagcgtgtgcaccgtacagcctgtgctctacaacaacaggaggcactgcggcgagaagcctgagcactgcaaatggacaggagcccccttggtctcaactagagaaaattccccacagcactgaagacccaacacaatgaaaaaagaaaaaaaaaaaagtaacttgctatagcttccctccttagagaaatttatattaatatatgttgtcaacaacaattcaactaacaatcaagttaagaaaaaagaggaattttatccaagctaaactgaggattgtatcccacgagacagactcttagaagctctgagacctgttccatgtgttagaagttgaaggcacagtcatacacatttttgagacaaaggctcatatgttaaaatgacacactgatatttatataaagttcatccccatttttgaggcactctgattaacgtgtaatgtgcatgcacaccatacatcaaggagggagggaggaggcctgaatggacacagagaaggaacttttatttttttcttgtgctgcctgaaaatataaattgtttcatcaatgtaaaatataagtatttcaagataaactctttaaccgaagttgatcttttctttaacaggatttataaatcacatgaagcttaaagagaaagcgtttcctcagaaatctagacaaatttatgctgtaattgcagaatatggttcacggctttacaattaccaggtgatgtttccttaaatcattttgtctgttactcatttaaaatctaatgtgctacaaaagagagtccaactagacatgtgttatattggttttgcatgtgactatctaatagaacatctaataggtgttcaagctggatttagaaaaggcacaggaaccagagatcaaattgtcagcgtccactggatcattgaaaaagcaagagagttccagaaaaacatctacttctgctttattgactataccaaagcctttgactctgtagatcacaacaaactggaaaattcttcaattgataggaataccagaccacctgacctgcttcctgagaaacctgtatgcgggtcaagaagcaacagttagaactggacttggaacaacaaactggttccaaatcaggaaacgagtacatcaaggctgtgtattgtcaccctgcttatttaacttatatgcagagtacatcatgagaaatgctgggatggaagaagcacgagctgaaatcaagattgcctggagaaatatcaataacctcagatatgcagatgacaccacccttatggcagaaagcaaagaagaactaaggagcctcttgatgaaagtgaaagaggagagtgaaaaagctgggttaaaactcaacattcagaaaactgagatcatgcatctggttccacctcttcatggcaagtagatggagaaacaatggaaacagtgagagacttaatttttctgggctccaaaatcactgcagatggtggttgcagccatgaaattaaaagacggttgctccttggaagaaagttatgaccaacctagacagcattttaaaaaacagagacattgctttgccaatgaagttccacctagtcaagcccatggtttttctagtagtcatgtatcgatgtgagagttgaactataaagaaagctgagcaccaaagaactgatgcttttgaaccatggtgttggagaagactcttgagagtcccttggactgcaaggagatccaaccagtccatcctaaaagaatcagtcctgaatattcattggaaggactgatgctgaagctaaaactccaatactttggccacctgatacgaagaactgactgatttaaagaccctgatgctgggaaagattgaagacaggaggagaaggggacgacaggatgagcttgttggatggtatcaccaacttgatggacatgagtttgaacaagctctgtgagttgctaatggacagtgaagcctggcgtgctgcagtccatggggttgcaaagagtcgtacacaactgagcgactgaactgactgagtcgtaaagaatccacctgccaatgcaggaggtgtaagagacgctggttcgatccctgggtcagaacaatccccttgaggaggacatggcaacccactccagtattcttgcctggagaatcccgtagacagaagaggctggcgggctacagtccatagggtctcaactaa

SEQ ID NO: 62210 - DNA, 1625 bp, Bovine  19866880424173
aactgagtcatctaagaaaaaagttggaaatacgttcatgataggcagagccctatgccctatagtttagacagtctcaagtgtctgagtgttgatcggtgattcagagaagcaaacataagctccagaagatggctctaaaaatgtgttatgaaaaattcatgaggcttgtatatatctttgcagtctatatgctcaaaagcattttctattttacacaaacttccaaaagtgccttttaaatgtgctcgtgtgtaattttgtctgtctatagtaatgctcattactgaagctatggaaaatacaagtttgcaaagaaaaatttcactataaacttaccaattttagatggaaactcttattatcttttcatgtaaatgaaatttcaactggaaaaatactgagatgaggaaagacttgtctttattactagtttgttttttactgggcttggtaacacctgcaagtacttctgaaaagttggataagcttctttcatatttctgagatgagaagaggtagactggaataaatttgagcacacaagcaatgccattggaaggcaggtgaaatttggaagaggggagatgtgcagatgagcctaggaaccagttattttattgcaagaaaaagtcttcaatgtgcacactactatctgtgatttggggttttaggaaagagagcaggagttggaaaaggaagaggcaagacagatcaagaactttgagatgtgccaggaatttgaacagaatgccagtgccttccttaattggatcttggagacaaggtttgctgtgatacccccaaactcacgatccttatgccgcacattccactctggggatggaatatatagctgagggaagaggataattcttacagtacttatgctgtcctaaaatcaccatatcctgcctgtgctttgtatctgaaattgactgtattctaaatcagtcactgcaaaattgagaaatgagaatttcatctcattgcccattctttattcactatttgaaagtctcactttttttcctcttgcctataattacagccccaaaataataacattcacttacgtttgccttcccctttgcactttacactgtaattttataatccattatatcacttaactttcagaataaccttgaagagtgtacagcactgatgttattgcttctgtttctaaatgtggaaagaagttcagtagataaattgacttgttaaaggtcacatatgtgtttattggtacaaacagagtatactgtgagtacttcataggaaactattatattgcttgactactaaaactgtcatgagaatcaagtgagataatatatgctaattgcttttattaaatgcaaaatgctctatacataaaaataacatttgttatatcttctggggcaaatgatctggaaaagaggagacttgaagtgtataataaatgaaaaagtggtcaaacttggtagactgtattcagcaggtgtatcagaattgtggagttttgacagtttaaagtgtcagtttagacaattcatgcttctgttcctatgagctcactgacaagggataaatcaaagaaggaacagaaagaaatcctgtatcatggcttaaaaaaaaaa

SEQ ID NO: 62211 - DNA, 1044 bp, Bovine  19866880507182
tgcactgattttggagcccaagaaaataaaatctgttgctgttttcattgtttccccatctgtcccccaccaagtgacaggactagataccatgatcttcatttttttaatgttgagctttaagccaactttttcactctcctctttcactttcatcaagaggctctttagttcttcttcgctttctgctataagggtggtgtcatctgcgtatctgaggttcttgatctttctccaggcaatcttgacccagattgtgcttcctccagcccagcatttctcatgatatattctgcatataagttaaataagcagggtgacaatatacagccttgacgtactccttttcctatttggaaccagtctgttgtttcactgctactgcatacaagatgtcaagacctgatttcaccttattcactaaatctgcagtactagtgccacttccatatagggaatttgaccttgtgattgctgctgttacctaataccctcacatatttgacaccagctgtatccaccagaccaaagccccatgtatatcttggttcttctgctgatgacgtctaaatcaaacctcacttggaagcaggtgatagggcaaacctatgccacatgtatccagctggatttcaagagaacttgagagtttgacttctgagttagaaggtgtgaattgctacaagtggattgtttaaaagatgttgggtagccatgaatatgacaaaaatgggtttatactgtaaacccattcaaaagacataggagccacatcattcacagatttctagctcaagatcgtaggtgaataaatgatgggcccattacagagaacgggagcactggaggaggagtacatcagaataggtgaagagatgtagttttaatgcttgaagtgttgaacttgaggttcctgtgagatataaatggagatgcttaattgaatatatgaccctggagcttagatgaaaagtcagaactctagataataacgtgaacagagtcagaatacagatgacagttgatcctctagaacaggatgag

SEQ ID NO: 62212 - DNA, 847 bp, Bovine  19866880584131
tgtacacctgttgtaatcaatgaaaactctgataacctaatcaacaattagaagcatctctcacagagccctacgatatatttaccttggtgtcctcatgggcaaaatgcccctcaggaaatcgagtttccctggttttttccagatcaggaaggacccttgattttgcttgcacctctgtttcaaagtgttcatgcttctgatatttcccctgaagattagaaatcagagtttatggcttaatggagcctggtctcctggatgataaaagagttcttttagtcctctgctttcttgcaggcagaactaccagtttctcagcatagatgaaacgataacctatgaccatagctgctgctgctgttaagtcgcttcagtcgtgtccgactctgtgcgaccccatagacggcagcccaccaggctcccctatccctgggattctccatgcaagaacactggagtgggttgccattgcctagaggagtcctattctaaaacaagttgttgtggcagaatcaacgcatacaggtttttaaagattcccagacccaatgtcctggaccacagaagaaggtcttttcagtccttattgccttggggaaatttccaataaatattatgttaaagtcttaattgccttctgtggaaatgaaataatgtaacagaatttttccttttaagaaaagaggaagcaaatcctactgaaagtagtgaacaatgaagaaaattatcttgacaacaatggctttttttattttaactggggaagtttttgcatgctaaattatgctcttgttgtcatatatagatcgatccatttagtaggtaacacttcgttcttgatcta

SEQ ID NO: 62213 - DNA, 634 bp, Bovine  19866880614670
tacctcttcctttccttcttagctttctctgagacctgctatactttgggcatcatccctagaatgctttctggccttgtcagaggtgggcagggcatctcctttgtgggctgtgctgtccaaatgttcttctctgcttcatgggcctgtagcaactgcttccttctggctgccatgggctttgacagatatgtggccatctgtgccccactacactatgccagccgcatgaatcttactctctgtgcccagcttgttggcacctcatttctgagtgggtacctctttggtctgggaatgacactggtcattttccacctcccattctgcagctcccatgagatccagcactttttgtgtgacacaccgccagtgctgagcctggcctgtggagatacagccctgggtgagctgggaatcctgatcctcagcctgctggttctcctggtatccttctccctcatctctgtctcctacacctacatcctggcaacgatcctgaggatctcctccaccaaggggcagaagaaggccttctcgacctgtgcctcacacctcacagtggtcactattcactatggctgtgcctccttcatgtacttgagacccaaagccagttactctcttgagcggg

SEQ ID NO: 62214 - DNA, 1001 bp, Bovine  19866880645029
cataattaggatatttattaaagtgacaaaattcctttaagaaagagaaaaatcttcagattacaatgatccttgttcttatttggtatttatttatttagtaaatatttattgaggatctttgtgttttaagaactattctggttatgtggatcagcagtctttcaaatagtttactgcaatagttttactcagcacttggcatttaatgatcttagaattattgtgatcattatatgaattaatatatgtaaggagtttcaaacagcacctgccatgtaataagtaacataaattcatgatcttgcttgggtatttgtatcattcttagcaaattgatagtattcaaaatgttaagtaatacaagttccaatatcctttgtaatatgccttcatgggaacataagaaatttgggtatttttggaatttcttaaatatttgaatgaaataatgaagctgtttataattaagtgactcatgaattaactggcttcttcaagggttgtctcatctttctaatcttcattttaagctagtggtagaattcactgtatattacttcttaaaaaaaaacttctattcatttaattgacaaaatttagtgaaaggtagactgagtttttaaaaaataaattaaaaatctattttaaaaatccctggattttaaagagttctcaaaggtagagacattgtccagttcctaatacatgtttgatgcttagtaagcacctaaaactctgttgagtttgggaagagtgatatgtccattttatttatatgccataataaatgtacaacatcaatacagaggaaaaagagaaaacagcaaaggacctggttgactatatactattatggcaagatttattgataaaagtacaattacattttttaattatctgagaatttaaaaaaacaaaaagaaaaaactttgtagctactattgtgaatttagaactgattaaaaaagaaaaatatgtattttttcattataattatt

SEQ ID NO: 62215 - DNA, 1359 bp, Bovine  19866880877861
tctggaactgaaccctattatctctgaggtgtgcctgtactggaatgcaaacagatgagatacaaaggctgacatatccaagcactcagaaatgcacatcctttttagtcttgccagttcttaggctctcaatgagacatcccaatctttccttcacagcatggcaccaggaataccttttgcccattccttccacctttcctcccagtaagaactttcccttcaactcttggccttgagtataattccttcttcttttctcttgttctccaaaactcctgcctgtccacatgcacttatgctgggtatgagtgcctatctcatctgagggttccaacaaagaactaggggtggtggctcaaaagatgggaattcactaaataagctaggtgagagtcggagaagggcctcttaggtgggaagaggaaaagggatgtgacagtgtgaatgaagggagaaatgtataatcaggttcatctcattgtttatctttttcttcttcaaggtcaccaaggtcaagcaaagaacaaccacacaatcctgattcatatatggaaacctgctcagagctgttcttctaaaaacctggatgtcattaatatttgatgtttatggaactaagatacaattaaaggaaaaatgtatatatagacacacatatagtgtactttattagccattacttcttagaaatgaaaagcttttcatttttttttatacttttctgtaacatctcaatgtcccattttgcatctataacttttataacttggaaaaaataataaatattatatttttcttttctgaaggtgtgtatccctaggagttgatttgctgcttaaaaggaaatagtcatctgtggcctgaaaatcagatagagacagctaagcctcaagcaatatttgaatttatactttggggtgtgatctttacaggatataactctggtcaagaatgaacaggctgagcaagctgtgctcaaagaacccaggaggaaggcagacaaactgaaattccatctgtccttcaattgccaacccccatcccagggtggagttgctttagtctaaaacaatgttatcttttcagaattgatctcctggaggggccataattgggtaatttgtgtaccaaataaggcagcttttggctatttgcctgaagtcactagtacattttgaaagtaactgtagcccctctgatgtgaaataactggttccacttatttattcaggtaccaacagctcagtagttctccagttatacttcatggtcctcacatgtgtggattctatgaaaaagttgctccaggcaaagacctggattaggcaaacactgaagaataattaatttacagaa

SEQ ID NO: 62216 - DNA, 1353 bp, Bovine  19866880904068
accaagtcacttaaccaccctgccctatagccttgtttatttgtttatgcaaaggtttatttttaaatgtatgatagattccaagacaatacttcattcttcctataggtggcaacagatggtatgtcagagaatacaaatgtttaaataggaatggaattaaggattactcacttgcctcaggcacaaggaacagattcctttttgtaagatttcttaattccacctgtggccaggggaccctttccctgcagcctttcctgttagctcctcgaattccttctgctcctcctgtttctgcttgaatgccttatcttcctctttaatcttcttgacttgctctttgggctgcttcaggggcttcttcttgccaccttcacagcccaacatgatacctgaggcctcttccctggaccttactaccagaagcagccttctaatcataaaaagaaggatggtcatgtcaagagtgattactttgggaattatcatatgcatcaaaagggtttccactatcatataaaaagtagcaagacctcattgatgtctatttgaggaaggagcaccctgaggcttgaaactcttttgctaggattcaggtgtgacaccaagctgactgtcagagctcttgactccctaggtggaggtattgagggacacagcagatcgactcagtgaatcccacccagatgccactgatgacctgcagagccagcagttgaagctgaaggaggcctgggatgacttgcaggggcttacaaaggatcgtaaggagaacctacaggaggccttaaaattctaccagttcctcagccaggccaggtaaggttccagaggcagacttccaccaggtggaattggcagagtccatgcctggcccataaatggagcttctaggagctgtttgggtacaggtgttcttcattacctggtttggagggtaccctcttggtccagattgtacctttggtaaggaacaaaattctcaggttcaatatttcaagccatgaaatattgaattttggaagaatatgaggttatctaggccaattaagtatgcttctatggagtctatactatatagagagtgctatatgaggaattataggatattgggagttcccagaggcactagtggtaaagaatgtgcctgccaatgcaggagacaaaggagatatggatttgatccctgggtcaggaagatcccctgaaggagaaaatggtaacccactccagtattcttgctgggaaaatcccatggacagaggagcctggagggctgcagtccatggggtcacacagagtcggacatgactgagtacacacatgcatagaatatggggagatagtcta

SEQ ID NO: 62217 - DNA, 1670 bp, Bovine  19866880130037
gtctgtctagtcaggcttggtttttcctgtggtctgtatggatgtgagagttggactgaagaaagctgagtgccgaagaattgatgcttttaaactgtggtgttggagaagactgttgagagtcccttggactgcaaggagatccaaccagtccattctgaaggagatcagccctgggatttctttggaaggaatgatgctaaagctgaaactccagtactttggccacctcatgcgaagagttgactcattggaaaagactcatgctgggagggattgggggcaggaggagaataggacgacagaggatgagatggctggatggcatcactgactcgatggacgtgagtctgagtgaactcccggagttggtgatggacagggaggcctggtgtgctgcaattcatggggtcgcaaagagttggacagagcgactgaactgaactgtcacaagaataaatgaatgctggagcagataagagaaatgttattgccaggaagttccagggtagctagcgaagtagatagggtagctagtgaagaagatagggtagctagtgaaaaagatagagactgacccactgggagaagtcaacacagaacattggaagtcacgccctgctcctttttattttcttggctgcactgtgcagtttgtagaatcttaattccccaaccagggcttgaacccaggcttttggcagtgaaagcctggagacctaaccactgaactgacagggaattcctgggtcctgccccttctgaccactgtggcctcccatgacctctcctctcctcacacacccctgtcacattttaacaccaaatcagaacaccttgaaattgatcttattgctgtggccaatggaacatgcatatttttaggtcatagcatctccatcttttgtactcctgagtgctatctgctaagtaggtactaagcaaatacttcttttggcttagctcaactgggtatagttttatgaacaggaactgtagagctggacagttatccatctctagaatgcatttgataaagacagatgactaattcccaatttgtgtggctttctacctgcagaaatctctctggtcccagctggatagcatgagcctgtcccatcagatgttggtgagatgtgctgccatcattggcctaactttcactacagagctgttgtttgagattctcccttgttgggacatgaagatgatgatcaatgccctggcaacccttgtggaatccaacatctttgattgtttccaaaatggcaaggagctccgaatggccctagaaaagaacgcagcttcatttgaggtgaattatcgatccctttctctgaagccgctcattgaaggaatgggtgagtagagcctggaaatgaatcatagttccttcagtttaaggcacattttgataaaggaatggatctgtgttttgtagcagaggctgacttattttccatggtgtctctgtcttctctagaccatggtgaggaggaacagctccgtgagctggaaagtgaggtgattcagtgccacatcattcgattctgcagcccagtgatgcagaaaacagcctatgagctgtggttgaaggaccagaagaaagccatgcacttgaaatgcgcccgctttctggaagaaaacgcccacaggtgtgagccctg

SEQ ID NO: 62218 - DNA, 2447 bp, Bovine  19866880442544
taggtagtgggccttgacttttaaacctccttattgagctataacatgacatacagaaaagtacacaaatgataaatcctcagcttagtgaattttcacaaaatgaacatataatcgccatccaggccaagaaattaacaaagaaaaaaaaaaaaatagcagtactctggaagccctcaaatgctttattcctctccctttacccaaagatcaaaagtaattctaaattacttcagttcagttcagttcagtcgctcagttgtgtccgactccttacaaccccatgggctgcagcacgccaggcttccctgtccatgaccaactcaccaacaacatcacctaaattacttaggcctgttcttaaaatttatgtgaatgaaatcctacattgcatagttacataagccttcttttagtcgacattatgttgtgaaattcatccatattatttgctgtatctataattcattcattttcattgctatgtagtagagttggccctctgtatcagcagtgtcagcatccacagactcaaacaaccacaaagcaaaaataccttaagaaaattccaaaaagctaaacttgaatttgttgaacacaagcaactattcatgttgcatttacattgtatttgctattataattcatctagagatgatttaaaatatacagaagatatgtgtagattatatgcaaataccatgccattttatatacgggacttgagcatctgtggattttgtatccctgggggtcctggaaccaatttcctgtgggacacagagaggtgactatattccattttataaacatacaacaatgtattccttctgtatttgtacatttgagttgtttccagtctgggttcttatgaataatactgccataaaaagttttgtacaagtcttataatgaccatatgtttgcatttctgctgttgggtatatatatgtatatacaggtgatattgttgcaaaaggtacagttttggtagatgatgccaaataattttctaaaatggtcatatttgattatactctgactggagtgttacaaatgttccatttgcttttcattcttatcaacaacttagttttatcagtctgtacttttaataattcttttggtattatagtggtatatcattgtggtttccatctattccaaccctgatgtggttgagtgccttttccaaatatttattggccacgtggaaatcatcttttataaaagtgtctgtatagatcttttgtttatttttcaattgggttatatgtttttatagatgtgttggaattatatattctgaaaataagtccatttgtttttgctgtatgtgacttttcccattctgtgcttgcctttttattctgctagtgatgtaattaatgaacacagttttttttattttcatgaaatccaatttactagtcttttcctctgtagttagtacttttgtgaaagtactaacacactgtttgtgaaatctttcctcacccacaaatcatgaagatactttcctacattctcttctagaaattttgttttaccttttacttttagagctgtgacccaactggcagtgatgtttttgtaattcttggtaaaagggaccctatcataagaaagctaactcaagactagacaggaaagtagacataaaatgaagtagagaagagaccgaagtgaggattggcctgtggattctgaaagcagccgtttctaataatggcttgtagtttccttctgtcagaaggaataatggtttgtaatttccttctgttagacctgagcatacttaaaagtatcattataaattaaatcctggtcatacctgtgttagggcaattaagaggaggctctgccccacactggtgggggtggtattaggacagaatcttgatgtcagcatagtctaaaagaaggcaacagttccagaacagcaaagagcacccaaaccagcagtaatgcctcactttcagtgcattcaggtagttttcagagtatgcatgcattgcttccaagtccagatccacaaactcctgaaggctagaaaggaggagtgtctactctcacctttctccaaggccttactttccatcctaggatatgcttgtgatcatgattgatagcaaatggaaatcctaaccccctttctccaagatcgaggactcagtatgacggacatactagaacacattggtataatatgtatatattttgcagtctggtctagttgcctttttgccctgatttcaccagaataagataaaaatcaggcctatatatcattccttaaagctgtaagcaaaaacagactgtctgaggttagcagcatggaaagtactcttagaagagctcctgtacaagaacttctatatgcacactgacaacaaaactaacatgaacaaaaaatgttttttcaagggtcaaaaatgcatacaata

SEQ ID NO: 62219 - DNA, 1413 bp, Bovine  19866880731009
agggtggattattattatagagaacacagattattattcgtggtccaacctcaaaacaagaccttcttttaagcaagaagcaaacaaaagacaccccgtgctattgtgggtaggcagaaaagcagccccagggcacttgagctcagaatgaaggacaaagcacaagacgacaatctgacttactccaggaagcagcactggtttgtgacccttatttactctgtgattgtgactagttttctccactgtgaggagcactgcaaggcaagtcacagtctgtaaaatcaataaattaagtttctcaacgattttctcaaacaagatccctgctacaaggtctagctgcaagaactgttaccctggagaagttatttaaagatggaactaggccaagggcccaagtttacagtcatgtaattttgaccaaaagaccaaccaaatccctaaatgagtttttagacaatctgttcaagacagacaattatgtcaaaactggttaaaaaacaaatggcttttaaaaacaacaacatatcatcactctggctaatttggacatgtagtttttagagtcaggaaaatcaattccaactccagccagtcagctagttgcagaaaaataaaataacttcatacatagctagttaacctcctcttatccctgactctctcttactccttttgtaattcttagagattctgttagtcataggaagaaactccccaaaccctggtctctttatcttcttttttccaataatcttgtcctcaggcttatcccagctactaattcccataagcatagcctagatggggcttctccgccatggcactactgacggtcaggccagattagtctttgttgtggaggctctcctgtgcatggatgtttagcagcatccctgacctccaccaggtgtctgaagtatcttctccccttccagttgtgacaaccaacaatgtcttcagacaaccacagatttcccctattcaggggtaagttgctcctggttgagaactgctgccccagatcctatcatcaatacctgtgccccctccacaatcttatttcaggctctctacctctgatctttccagaacatttcctccaaaaccctgattttattgaatccttcagccacattaaaacccagaatccatcagtcctgcaacccttttacagtctcatccattctgcatctctaccagggcagctgatcacagatggagaaaagcacacaatcccactgactgggcttccccttaaacccatgaccattaacgtcaaacaggactcttaatggtgccgagcaatcctcccacatcccctctccgtcaaggatccactttcctaaatgactactttatgccttctctttaacctcaaccggggaccgcccccgctgcttctgctca

SEQ ID NO: 62220 - DNA, 1115 bp, Bovine  19866880809115
tgtgtacaatgtggagttttccggagagaatcggtgacattacaatgaagtgaagatagaagcagattgagattttagcctgtcctctgtgaaatcagacattaaggtatttgcaaaaatgtaatacatgccattctcactaaattttttgtttggggaaatagcatttttttccaatgaaaatgttcattatattcatgtgtcattggtttattttctttaatttttttttttttaagtaggattccggttccttgaccagggatggtacctgtgcctcctgcagtggaagcatggagttttaaccactggactgccagggaagtccccccaaaatatttttaaagtacctcagtttttgtttcacatatagcaatatcagtagatacaacctatataaatgtatgaacccatataaaagtacataaacccatagaaatatacaaacccacataaaaagctattgcatgcatgctcagtcacttccgactctttatgaccctgtggactgcagtccaccaggctcctctgtccatgggattctctaggcaagaatactggggtgagttaccatgcccttctccaggggatgtttccgacccagggataaacctatgtctcctgcatctcctgcattgcaggcgtattctttaaccactgagccacctgggaagcccataaaaagctattggaggtcctcaattattaaaagtataaggggattctgggatcaaaatgtttgacaactgtaggcctcggcagaacaattcagcctggaaggcttttattataccttcattattttgaattttgattggatttcatccggcttttctctccaagtgagattcagatatataaaaagcagctataaaaataccctacctggaaatcatcttgagtttccagtgcagtattcacttgcatcagagctgccaggtgacaataatacttgtagtggaaaaaaaaatttaagctatagatttgccacagcaaggagaaacaagtggtttgctggtaaagctgtgccagcctcttcttcctgttaaaggatacacacgggacaaaagaaaaaggtatcatcaccaacattcttgagggaagcacaggtgcag

SEQ ID NO: 62221 - DNA, 1976 bp, Bovine  19866880864862
tacattagcaagctagaatctaggccttaaagggtcagataacagaattagggctgtaattggttcagtgagtctttattattcatctttgcattcccagggctcagcactgttcttggcatgtgtagatcatcagtaaaatgctgtttgaataaatgaatgaataataatttttgtgagcccttattaaatattagggacttcacctcaatatcaattatatgaggtagaaacaaactaatattaactccattttataaatttagaaatggagactcagagatttgttagacgacttgtccatactcataaatctagtaatttatggagccacattgctttcaggtgccatagtaatgttgcattatagttaacctggagaaggaaatggcaatccactccagtactcttgcctggaaaatcccatggacagaggagcctggtgggctacagttcatggggttgcaaagagtcagacatgactgagtgcctaagtgcatagtcaaccacaaaatctcagcggtatacaatagtacatttttatttatatcatgaatatgtggggttcaattgctcttggctggatttggctgatcttgcctaggcttgttcatatgcctggtgttgaacaggttgtcatccaggatggcttcagataggataactgggaattgtggctgacataactggggcagggattctgtgtatctcatattggtctggccttccctggtggctcagacagtaaagtgtctgtctacaatgtgggagacccgggttcaatccctgggttgggaagatcccctagagaaggaaatggcaatccactccagtactcttgcctggaaagtcccatggacagaggagcctggtaggctacagttcatggggtcgcaaagagttggacacaactgagcgacttcactttcactttcatagtgggctagcccactacgggatatagtcatggcaatatcagaagagcaagcccaatgcacaaacatttttcaaacctctgtgttatgtttgttaacatcccatgggccaaaccgtccacaaggaggagggcactgcaaagggcacagatacaagtagggttgaagaagtggagccattaatgcagtcagtctaccatagaaactaactgtttctgaactaccaggactatctgatcccgaaacctgccctctctttcatttctctataccatctctgaaaataagagactatggaaatacacatacaaatatgaacctggcctgtttcctatcctgaaatccaatggggaagacaacatacacaaaattagcagtatgggagacttcggtatgtgctataatacaaaggcataacaaaatgtttagtatgatagtatagacaagggaatgagtcatttgttggaaaaggcccctttaagagaagatattatggggaaaaaaaaaaaaagagagagatgatattatgcagtggacaagcatatgcccttgatcctcgttttagatattgactctgtcagtatcctctgtcaccactacccatgggatcttgttcacgttaaactctatgtacctcagttttcttatttgtaaaatggacataataataataataccttctcaataagctttttgtctggagtaaagaaaatgattatgtaaagcacttgaaagtgccaggcatgtagcatgtgttccacaaagatgagctattgttgtttgagcaattggtagaatctttctgtgctgggagacaacataacacatctaactttattgggtcccctactgagtgtctggtttccctggaagaggggtcagttctacaaatgcagactcaacaagcattttttgaacaatatatcaggctctgagttaaggcagctacttaagttgattggagactctattaccaggtaagaacttctttgttcccttcctcttggcatctgcacccttgagtcaggggacagactcctg

SEQ ID NO: 62222 - DNA, 2101 bp, Bovine  19866880958949
taaggaaagttgagcactgaagaattgatgcttttgaactctggtgttggactcttgagagtcccttgggctgcaaggagatccaaccagtcactcctaaagaaaatcaatcgtgaatactcactgaaaggactgatgctgaagctgaagcttcattactctggccacctaatgcagagaactgactcattggaaaagaccctgatgctgggaaagattgaaggcagaaggagaaggggacaacagaggatgagattgttggatggcatcaccagctctatggacatgagtttgagtaagctctgcaagttggtgatggacagggaagcctggcatactgcggtgcatggggttgcaaagagtcgcacacgactgagcgacttaaatgagctgaatgatgggcttgaccagtcagaaaagacaggtcaaaaatttacttcacaaaaatctctgaagataagtattgtagtgtaaatttaatagttctggtagaagtcacaatcattattaaccaaaaatgggtgtttactcaggaaaaacttgtctttataatcacctgccaactattgcctaagttcaaccaccctccacatagtcaggactactttggggtcatagcagtctctctgacccttgctccaaatctccatctagggaccctgaacccatccttctgtgagccatgggccactggggctggtggggggaggggatggcagtgccagccaatcagaagcacagtccgtgcccgtgaaacaatgagctactgatgagggtgtggccaggagaacggcttttagagaaaactgtcattttatggtcagctttagacagacatggcacttctgctgtcttctgaataatgtcatccaggctcttttcctgtcttctgcactcctgactagatcctgaaagatctagtctctaatctaggccctgattttcctcagccttggagaaagaagaggtatgtgactgtaggagtagaaacagtggttgcagagctaagttgagggctacccttggggaagtaggtttgggagcttaaggaaagtggggaagccttgggctaggaatggaagttcatcttgaatatatctgcgtcaatcctttaagtgagattagaagtttgaacgtttcagtgttacctcatcctatttatcctagatgttctatttttctagattactatctatttacctctctcctgcaacttctcaaatgatacccttatcagtcatcaaatagcaaatgcctaccatgtgaaggagctctagaaagatgttgtggaggaaacacacttatacattgaatgtgatctctaaaacagagaagcttcaattcagagaagacataaatagatcaaaagataaccaaggattttaaaaatagataataagtcacttaaatttatagacactaaatgccctcatagcttagagggaaaattgccttgactagagtggtctggcaagctttcttgacagataacattatccctttatgttcagagtatctcctttggattcttgtaaaatctgattttacatattgatgaaaaatggggtggaaactaaaatctattatatatttagagaaacaataatggatataattgatctttagcttcattttcctttgagggtattgctgagttttctttaagcaaattaaaattggacacacactcttcttcattcaggaaaatctgtcttggtatgtcatcgaggccttgctctttcactctgtcagatatcctcattcctagatgctttcatgctttctcagtggccacactctgttcaagctctattcttgattaaactggacaaataattgatgagggtacctctgtagacattgaaagtgctctaaaattaaatattttctctaggttataaacatccccaaagtgtcataaaatgggatgtaccacgggtattctagaaagaatgctgctgctgctgctaagtcacttcagtcgtgtccgactctgtgcgaccccatagacggcagcccacgaggctcccccttccctgggattctccaggcaagaacactggagtgggttgccatttccttctccaatgcatggaagtga

SEQ ID NO: 62223 - DNA, 1631 bp, Bovine  19866881112409
ttttgaggtttggacccgaataataatctgttgttctctataataataatccccctctttagcagaaaaaaatctacttgattcagtgtggctatcagtttatttagaagaatggccaaaagtgtccattgtgtcctgagaataaacatttggaagatagttggggagaatgggggagtactgctgctctccttggcctggagtcataaagacctcaggaagaaaaaattctgaaaatgaccatcagtcccgcgtgacaatacccttccttattctactcatctattacattctaagaataattggaacactgtagatagggattctctcccaaatatttctttaaaaaatatcttattttgaaaatgggtgtttttcatcttttctgtattaactctgtttccacttttaggccaaattagtttctttctaatcttcatttagtccatgaaagagtttcttttgaggtgaagattattttatcttagcaacagtccttaataattcctgcagttgcctctgattgtaaatcttgaaatgataagacattttaattactactttccgggcttaggctaactgaaaaatgcaatgaggagaggaatatgtgactcaatgtggttagttatttcttgagtacacatgttatctgacacactgaaattcaatggtagggaagatttcattaatgaacacaagatatgttacgcttttttcccccttaaatacaggaaaagagtgtgttacataatgaacatggctttaaaataaagtgatctcttacctagaacagtttaaattggtttaaatatggaagatgagaaaagatcaacctgatataaattgaaatgtaggaggtgaatataagaaccatttaaagagttaaaaatatggcctccacatcattaaaaatagcatcagagaagcatgatgagatgtccttcagtagatgaactgagaaacttaagtacaaaggatattgttcagcaataaaatgaagtggtctgtcatgccatgaaatgatatgaaggaagcttaaatgagaaaagtcgatctgaaaaggctacattaactatatgattctagctatagaatattctggatgttggtgatacactaatgcaaagtgttaacactagagaaaactggaacttgggggaagcaagagggaatatatggaactccctttttttttttttggctgaagctcagagtcttaacgtctggaccaccagggaagtcccaggaactacctactttgtgtaaacctcaaactgctctgaaaattaaagtctgttaattcaaaagaaaacttaaatattaggtggaactgaactagtaaaaatgtcttcttactaaaaaacaaaaatcccagactctaatatacagtggtggtggattactgtatatagtttgtaatgttcttttatcttttctttgtcctcagataaatatgcacagtggtattcatgataaatcctactcctaaactgtccttgtttctctctccagtgacatatggtgtatcggccttgggaggtgtatacaccaaaagaaatcttcgtggcaaatgggacacaagggaagctgcgtgcagttcaagtctactaacacaaccggcacgttgacct

SEQ ID NO: 62224 - DNA, 1425 bp, Bovine  19866881317273
tgggagcaagcccttgttaagaacacagtgctctggcatatttgaaaatggttcattttcccctcctcatactggaagtacaaggaaatgtttttcttagtatttgtgagaagttggttcagccctgtgaccaggttcccctggacttctgaactctcaaaaaagctgtgcacatgatctctagcatttgttatataggttttgccaccgctgcagtgcctcctgcaggggttgtctgctccagtaaaccacagctctttacacttggccatctgtctctccagtcttaggggcagcagtttgccctgtgtcctccactgtcatgtgtatccgacaaaaactgttgatgtttcagtctgctcagctttttattaggcaacttctaagctccatacacgtggaactgggaaaacggaagtcaccagagcacattcctgtgcacttgcattgcttaggtgatgctgtttctatctcttttccactttccctttggtccaaattcctgattcacttatcattaatgtggtacaatggctgaaatactaaagatggtagaataatgacttaacttttatttccataaataaaaactgctattacaggtaagtggcagaaaaccccaatttcaaaaacagctaacttccaaactacatacatgagaaaataagttattaattttaacacacttcattaaaaatcattctggcactaccaaaaatgttcctatatacctactcccacttttcatacagcatgtgatatacaaaagaatgagtcataaaatatctgtgtaaaggtctgtatgtctatggataaatcacctcaaaagttacaggtatgctaagagattggtaatggtaaatttttatagtgataaaattttatagtaataaatattacaaatatttaaatcacttttcaaatgtttatcattactgaaattatatcacaacagtgtttgctggctcctaagttcaaaaattattttggcatagaaaacttttgagcagactacttgttgccagtatctatgtcagttaacacctccctgtgggtgtgccaaattctgtaattttcagcctgtgctgtaacatgacaaaggttcagaggctctacactctaccatatgcaataaaataagagatatgtataacatgaagaatgttggggcttcttcatttcaaccttgagtttattttggcaataaccatgaaatagttcaactattcaaatggcatacattttctaaaagacagcatgctctgagaaaaaagataatcttgaaacttggaagagattttgctcactgaatattaaacatgtcagcctatgataatctagtaatttctgtgtaggcccaaatatttaaaatgttatacttctctcccttacatatatgaataattactgtctgcaatgactatt

SEQ ID NO: 62225 - DNA, 2358 bp, Bovine  19866881429848
tattttctattcctgcccttgttctttcttcctattttgtcttcttctctttttctgctttttgtggttttcactgaacattttatgtaattccattttctttcttctcttagtttgtcaattatacttttttcttaattttttcagttgctgtagactttgcagtatatatttaaaacaaatccatgtgtactttcaaataaccctaactagcttcacatgtaggcaaataccttacaataacaaaatattactaattcttttcttttgtatcattgctatcattacttcacttatacataagcatatttaatataattgaatatctctgctgtcactgggagaaggcaatggcactccattccagtggggtcttgcctggaaaatcccatagatagaggagcctggtgggctgcagtccatggggtcgctaagagtaggacacgactgagcaacttcactttcacttttcactttcctgcattggagaaggaaatggcaacccactccagtgttcttgcctggagaatcccagggacaggggagcctggtgggctgccgtctacggggtcgcacagagtcggacacgactgaagcgacttagcagcagcagcagcagcagcagctgtcactactttgatcaaactgttgtctgttagatcagttatgaataagataaagtaaaaatttttattttcccttcactatttcttctctggtgtccttcctttctttatgtagatctgggtttctgacctatatcacttccttcctctctaaagaagttttaccatttctaataagacagacctattcttaaggcagcagattcctttagcttttgtttgtttgagaaactctttatttcttctttatttttgaaggataatttgcaggatatagaattctgggcttgtgagttttttctctcaaccatttaaatacttcaccccactctcttatttgcatgctttctaaggagaagtcaggtataatatctcagctcctctgcaggtaaagttttgttttcctttgatttcttctagatttttttttcttgatctttcattttttgcaggttgaatatgatatgcctcagtgtcgttttgttttgctttatttatcattatcctacttgattttcctgggcttcctaggtctgtgttttggcatctgatattaattaggggacattttcagtcatcattgtttcaaatatttctttcttattattgtttcaaatatatcattctttctctttctctcttctcctcctggaatccccatcatgtatatgttataccttttgtagttgccccatagctcttggatattcttttctttttcatttcttccagtcttatttcttgttgtcttcagttttttttttttaaactttacataattgtattagttttgccaaatatcaaaatgaatccgccacaggtatacatgtgttccccatcctgaaccctcctccctcctccctccccataccatccctctgggtcgtcccagtgcacaagccccaagcgtccagtatcgtgcatcgaacctggactggcatcttgtttcgtcttcagttttaaaagtttcttttgacatatcctcaaactcagagattctttcctcaactgtgcctattccactaatgagctcttcaaaagcattcttcatttcatttacagtgtttctgatctctaacatctctttttgattctttcttagaatttccatttctctgcttgtgtgtgtgtgtgtgccgtgtgtgtgtgtgcgtgtgtgtgtgtgctcagttgctcaattgtatccaattctttgtagccccatggactgtagcctgccaggctcctctgtccatggggttctccaaagcaagaatactggagtgggtttccatgccttcttccaggagatcgtcccaacccagggactgagccagcatctcttatgtctcatgcatcgacaggcaggtgctttaccagtagtgccacccttgttacatggcctattttttcttgcatgctgtccactttttctgttaaattccttatcctattaatcatagttttttttcaaatactggggtttgatcatttcaacattcagtgtcatatctgactctgatttgatgctagtctgcctcttcaaactgtggtttttgctttttagtatgtctcgtgcttttttctagtgagtggaacataattactcagtaaaaggaactaaagtaaataggtcattaatgatgtgatggtaaggtgtgaggggagagaaagcattctacagtcctatgatttgaagcattctcctgtgcctgtggctctcttttaagagcctgtatttctagactgcgaa

SEQ ID NO: 62226 - DNA, 1656 bp, Bovine  19866881430124
aacaattatataaatcttcataaatgtatttgaattccccagtttaatatacattccttaactttgctactaacactttaattatgaaaattttaatacaaaattaaaatttataaaataattttaataattttaattattttataattaaaatacatatttattaaatattttaaaaataaaaaattttaccgataagctcataacccagagataacttactgtccaactttaactttaatcttaatttttttcattatttatataaaaacttgattcttacatctttgcaatcttcttttgtacagctagttttgatgcgtgtatcaaaccacctaacagttccatcttcaccacaagacagaaaggtatacgggtcattaggtacagtcataatctgaagatggaaaggtaattgtacaggtaatgttagtgaacatttaaacagatggctttgaaaaatattactgctatatcacaaaatgattaaggcaaaagcaactaagaacaatttattggaattatttatgacttacccataccataatgcaaaacagtgctatacatacagatatatgcaaaatgtaactgctgaattaatgtgattcatttaccttcatttgaaattaatgtacctccagactcaaaattctttaaaattacaaatgccttacaacatgacaagaaaaatcctgcccctgaatagtcaaatttttatgttttctggatatgaatttacacatgctttagaaacaaagtaaaaaattttcttctctgacaatcattataaaaccctgtagtgccaaatcaagcattcaaattgacctctcaaaaaaattttgagtgatggtaatggttctataaccacacaaaagtactaaattgtcatgaagtgtatagttaaaaatggtaggaatggcaaatgtcacattatgcatattttataaaaaattaaaattttttaaagaaatgaaacattttagatattcctatatctatttctggtttagcaataaggctgtaaattgaggctctgtgtaccctcctatccaacatattccccccacccttctctgtcccaagaaatagaaactaccaaaattgggtgtttagcagttccacagagacttttatgcacccataaacaatggaaagtaggttcccatgttttaaaactttgtatactcaaaaaggtattcagattaactagtcttcaaggaaatacaaattatatttgtattcattaggtatttattaggatttgtatatattaggattaaatataaattataatcctaagtaaatatcactagacatcgctggaatgaccaaagcgaaagggatttgataatatcaaatgtcactgaggatatagaacaactagagctctcaaacatcattgatgagacggtaaaatggtatcatcactttgaaaaaccatgtgttagtatctgctgaagtggaattatgcttcttctatggcccagcaattccactacaaataaatgtcatagtcatctaaagatgtgtactacaatgttcaaggcagcacaattcatattaaatatttgaaagaacccaaataaccagaaagacaataagaaggaaattttatttattcttaaaataaaatataaagcaataacaataaacaaa

SEQ ID NO: 62227 - DNA, 1484 bp, Bovine  19866881570932
tagtaaaagctagttgaatacagtagttaagagcacagaccaagaaggcacactacctgggtttgaaaatccagtccaccacttaatcttattttgtctcactatccttagctttacctaaacaccctcatctgtaaaatggggacaataacataatacctaccacttagagcaggcatgtgaagaaagaatatatgtaaaagtgcggagaacaatgcctagcacacattgagcaccacatccaccatgtaggctgttattagactataaataaagactgatgggtctaggttaaacatgtctattccttctctttctcccccgtccatggacataaatccatggacataatgctaatcttaaattattggtaggtttccacatctttagtgtgggaaatttaccttgtcaaacatgaagactttgttgatttggccttggaagaccctcaggacagaattaatgtgcacgcaggcatcctgaatagctgagcctatgacttctgctttatcttggtccttaaacatcaggttcacaaacataactgtcactgggcgaagctcagacaaataaccccgaagctgtttgtcatcaatctgtaatttagagggaagctttccttaacatgtgtccttggcagtggatatttcctcccaatatcatcaccaccacacccaaaattatcactgggagggaactagccttttgagattctctagggaaactgaagttatcaaagttgggaggtagaacaaagcagagccagctgaaagtcaaaaagatggaaatggaatgaactatcaaaatctcttccaataggaacttacaagcctgctcatttttgcccagccaccactcccttgccccaactgctagctccctcagccaatatgagccatgacaataaaagaactgctgtttcttttggctctccaacaatttaggaataagaagagcatgccgcataattcaacctaatattttatagcaaggtacttttcagaatatttccatattccgtcctcctttatcctcaaatgaaataaaattacattatcctcattttactaattagataattgagggacggagagataagaaaactttccaagtcatatgggaaaacagtagcaaacaaaatccaaatctatggacttctttttgtagcgcccccttgcctctctttggtgttgtatttcactcagctcccatcttcactccaagtctatccaaaacaggcacagggaaaggaaaggtgagtctttcccaaattatccctgcctatatcatcagccctgaattttgttaaatttaagtacataacaaaacaatgggggagaagcactgcattttttctcccccagacaacacaaaagtgtcagattctccattgaaaatatgaaacacatcttctggatgaaaaaggaaattgtgtatagggaatcttgggaatcatgcttcctatctagctgaggtttcatgta

SEQ ID NO: 62228 - DNA, 778 bp, Bovine  19866880753908
aagtgtaagaaagtaagagataaaacatagtgaaaataaaaacagtttggaaatggctgtgtcttcaaaaattaacaatgtgaatgttttactcttcgggcaattgtaataggaagcctacatcccataaagttttcaaactgtttcagtgcacattccttgcagaataatgggcgggaaaatgtggttctgaccttccaaattatcgtcattgcaaataccggatgagaagggaatttgcttataccagtttatgattttatcattttaaaatcatttctattgcgtaagtgggaagaacactaagatgataaaatcttacagtctgagttttagctttgtccccatcatactgaagcaagtgcttagcacacatggctatatttcttggggtctgtttccttatttggaaaaaggaagtttaaataagtctacaacaatttgttgcaattctaagtttctttaatctgatggataaggccttctgatatttatgtgatacatttctgctttctttctaccatatgcattttatcccatcagtacaagagtgactagaatgttaatgaggttccaaccacattttcaattccatgaccaaagacaatcccagtcatcatgaacattcaagattctagttacttggaatcaggaaaagatgcaaagcacattctattaatattaatgtttagtcagtactatattctgatattgaagacatttagattttagaacatgtatatgttattctccttgcttctcattctatgatgaaaac

SEQ ID NO: 62229 - DNA, 1175 bp, Bovine  19866881624144
tctggctcaaggcaagcttctttctacatagcatataagctagaatcttgaaaataatagtttgatccttggataattagcaatggtatcacttgggagcttgttagaagcataacctcagacctaataagttataatctgcatcttaacaagttcctcaagtgtgttctttgccagttttagatgtgtgggacctgggcattactgaatcagagataactggatatctaccagtaaatatttctgtttttaataaaagaacttcctagttttagctggttaataggttaaccatcaagagaatacatttttaaaaaaatttttctggtaacatgctatagtgatggaacaaagttctgcccaagggaatgtgagtagaatgtggtctgtgatttccaggtcaggcctggaaaatgaatgtgtgtgagctccagccctgttccacctgctgctgcctgatctgtggtgacaatctgaacaactaaattggagccatagaaggaagccatgtattaaagaggagaaaaccaactgtggactgctaaactaacccagtgagaaagagagaaaaaaaaacatttatctagctcctgccacatatgttttgtctttctactattattgcaattgcatgactagtatatccaaaagttaactgtatctccatcattctgtttaaactacatctgtgacacaaaataagatatagtacattatatttaaaactcccatcatgatttttttaaacagctgaatcacctcactacaatccaataattaaggtcaatgaccatttttatctcttttgcacctttcaaatttgtgctatttagcagcctttaatttaaggatatgtcactctttctaacaggtaaaatgatcaaaatattaccagaaaaagtcaaaaaacaagccctagagtgtgttgcataattaaacaattatttatctttctgattttgaatgttaattttggtcttatattttaaaccccacataattgcatttttctgcttatacagttttatacttggcaaaacaaacactatttaacataaggaattatctttctataccaggatcccctagagttttaggacatgttcctggcatgctgctctgcatagagaatgtgttcatttacagagtctttttcaatttttaagatgtcattt

SEQ ID NO: 62230 - DNA, 1541 bp, Bovine  19866880167282
aaaattatgaccaacatagacagcatattaaaaagcagagacattactttgccaacaaaggtccgtctagtcaaggctatggtttttccagtggtcaggtatggatgtgagagttggactataaagaaagctgtaaagctgagtgcagaagaattgatgcttttgaactgtggtgttggagaagactcttgagagtcccttggactgcaagaagattcaaccagtcaatcctaaaggagatgagtcctgaatattctttggaaggactgatgctgaagctgaaactccaatactttggccacctgatgcaaagaattgactcatttgaaaagaccctgatgctgggaaagattgaaggcgggaggataaggggacaacagaggatgagatggttggatggcatcaccaactcaatggacatgagtttgagtaaactccagcagttggtgatggcaggggaggtttggcatgcctgcagtccatgggttcgccaagagtcggacatgactgagcgactgaactgaactgagctgaactgattgagtgctgggacaaggaaagcaggagtcagaccaactgccttttccccagttgtgttcagagggactttgagcccaggcttcactgatgatgagccactgctgttagtactactgtgcatgcatgctcggtcgtgtcctactctttgtgaccctatgggctgtaggcccatcagggctcctctgttcataggattctccaggcaagaagagtggaatgggttgctatttcctcttccaagggatcttctggacccagggatctaacccacgtctcctgcatttccagtattggcaggtgggttctttcctgctgagccacctgggagtcccttttagttctattgttcagctccaagtcagaaagaactgctatccaaagttgattcttcctacctttacaacttctgccccctagtgaaattttctcctgctattctttctagctccaagctttcaaatatctgaatcttcccctgtttttatattaatattttaagctcaaaaactatagccactacagctgctaggtgaagttagacaaatttcattgtgtctagattagctttcaaatgaggtttgataaattaaattatgataatctatagaggagtggatgagaaataaggatttggattcatgtcataatgtcacagcagcacagagctctctggatcttctttctttcctctctctctcttttccccagatgaaagaattatttctttttctacccaaaccaccacaagtcaatgtccagtatattgcaggaaagggttacttttataaaccagaggtgtactgtaaaaggcatttgagggccccatctagatagtttttcagcttattttctttttgacagctttaaagggcctttaaaaattgccaggagagtagattcatatttttatcattccacctgcatagcattttagacacatttatattcctgaaagcataataatacataacatttagcatttaatttagtgactcctgcca

SEQ ID NO: 62231 - DNA, 774 bp, Bovine  19866880381429
aataatattcaacacttctccctttaaagaaaaatgtaattttaactatgcaaagttagactgtgaatggaatgttttccatctaaaacctctactaaggactccaggcatgagaagaaaatgatggggaagggattaaaactctattccagtaagagctgaaaatattaaggggaggaaagagagaagaggaatggtaaaatttccctgggtgttttaaagacagatgatgatgaggcattggtcaaaattaggagagttttgacttgagccttagaagcgaacatgtagaaacagggacttagcttgtgttacaactcttaaattttgcaaatttattttgtagataagaaaactagaataatgtatataatgcagactgcatattacattcctttgcattctcctgaattttataaataacctctaggatagtttcactgttattagtcaatgagggcagaatgtcaggaaagaaaaaggagcagctttataatgaggaatgaatataattatagttattatcgcagagacaatgaggtataacaagtctaaaagaatgaaaatatgatcaaggatcaatttaaaatacattcttatctagctataaataccacacaatataactctgagaaatttcaataccacatttaggtaggcccatgtattttttaaatagctctaatccactgctgacctcaaaatgctcaaaacagagacccaaagttatctcatttaatccttgtacccaagtaggtgttaatatttatgtcc

SEQ ID NO: 62232 - DNA, 1137 bp, Bovine  19866880425330
tcgtgtccgactctgtgcgaccccatagacggcagcccaccaggctcccccgtccctgggattctccaggcaagaacactggagtgggttgccatttccttctccaatatgtgaaagtgaaaagtgaaagtgaagtcactcagtcgtgcccgactcttagtgacctcatggactgcagcctaccaggctcctccgtccatgggattttccaggcaagagtactggagtggggtgaggttctctaaattttaagtttgattatttcattccgttgttgggatttctgacattgctgcaataaaggattgtactactataattcttagtgtactgtgctccttcaactcttcctgttctactcccattagagcactttgtcttggaagttgacacttttcagaatgaaatacaccactgttgacctcccaaatttcttccttaattgtttttctgagcattgatgtttccaaatcaatgaagagagggattgatgatggaacaattctactctggctaccacaaaaaataacagttatgtattttagggacagagtttaatgttttggtgagtaccttcttaagagtgtgatgaagagttatttctgtgtactttcagatgcactgactttttctgtttgtggtgacatagcatggatgctgccttcattgacctttcaatacagtttctgaaacttcaaatttagtggcagttaatccaaaattcgtagacagttggctcttagttctacttaaaaacatgagaatggaaatagtgctatgcctgggttgagccattcatgccttataatattttaagtgttttaaattgccaggtaatatttattattttaatagttatactcaaggcacaatttatttgctctggctctaatataaaattcatttagattgtgttagagacaaattcagtagaatttgctatgtgatagaaactatcattcattctctttttcattcattttgaatgattgaagaacatagatttctaaaagaatcaactttggattttaaacgtaaactttgaatcctgggtctacttttgaattgttttataccatcagataattttaacttttgctagttaaagaattttaacttccctaggtcccatttgca

SEQ ID NO: 62233 - DNA, 1682 bp, Bovine  19866880570188
tgagactccctttaactgcaaggagatccaacccattctaaaggagatccaaccagtccattctaaaggagatcagtccctgagtgttcattggtaggactgatgttgaagctgaaactccaataccttggccacttgatgtgaagagctgactcatttgaaaagaccctgatgctgggaaagattgaaagagggaggagaagtgggtgacagaggatgagatggttggatggcatcatcaactcaatggacatgagtttgggtaaactccgggagttggtgatggacaggggggcctggcatgctgtagtccatggggtcgcaaagagtcggacatgactgagtgactgaactgaagtgaacttaggtaatcatattacctacattttagaattggttaatattaagcagtttcttagcgtgactaaagacactgtgtaatgtcacagacttgtcaggttgaagacccgagaataaaatccaggtgttgacacagaacggatgcacttgaccactgtgtcttgtgatgcttactccaaacctatgagcctctgagtccattagaaatggtacctctatttggcaatacactacaactaagctttttagattcatcaaaaacatttgaaacacaaaatcagtttttgaatatacatagagagtaaagaactctgtttattatatctgtgctatcaataacagatgcccatgtaaatctctgtaagtagtaccatatcccaataggatttgtgacatggttttttgttgttcttgttggaaagaagtagtgggagaggcaggggaaagctgaagttaattacagtgtgcctttgcagtatatcttatctcttttataggaagagttacaatattaataaagacataccacatgtaagtcagagatatattttggttacagtttgtgaaaaagacttttatctgcacacatatatcatctaaagagtagcagctgagaagtgtgtggtgacaggtggttatcaatctgtaactaaaaattagccatgggtgagcaattctcaaataaacaaccatcatgcagttcactgaaagtttatgttatataaatatgttactatatttgtttctttgaaagaaagccaaaccaaatctttataatagtgaaattaaaaatactatttatggattaagaccgtaacttctacaaaagcaatcacagaatatggatcactatacctaaattggtacatgtgtagagaattctcttctttgtgttttttaaatgtgtatttatttatttttggctgtgctgggtctttgttgttgtgcgtgggctttctctagttgtggaagtgggggctactctctagctgcggtgtgttggcttctcactgcagtgtcttctcttgttgcagaactcaggttttaggtgcatggacttcagtagttgtggctcgtaggctccagagtgtaggttcagttaattgtggcgcaggggctcagttgcctgcagcatgtgggatcttcccagaccaggaattgaaccagtgtcccctgcattgcaaggtggattctgaactactgggtcaccaaggaatccctatatagagaattcttagcaattttttttaaacttttcatttgactattattttcaggactacttgttatgctaaagaaaaaagttaattcactaattcatt

SEQ ID NO: 62234 - DNA, 1429 bp, Bovine  19866880599956
tactctaggacctttggcctagatagcccttatacaatatcttagatggatttgccatgtaaatcatgtcctcaaaatttctagcaaaattggcatattgtcttagcaaaaacagctgctttgattcaaacagttcatataaaaagcaacaacacaaacttagttatagcacagaaaaaaaaaaaaaaaaaaggccacaaacaacccacaagtggtaagcaaggctctttgtctatttttaacatttgctttaatatcaatggcaacacatttttaaacaaataatattcttttttccccaagttattttcaaatgcaaatctctaaaaacactctgaggcaagcctttggaatctttcaagttaataaactccagctgcctttaaaaaagtgatttaatcttacactatttgcctgaaccttttctgattttaagatgtaattgaattggtcccgagtcatattacaaaagaaaaactctatgaggattctgggaaaggcagatgaaatgtttaaaattatttttttagttcatttagaggacagccatatagacttgaaactgtcatagcattaaactctgaagaagtaatctcagaatatatttgcaaacttggaaaaaaaaatcctactgtaatccatttttaattttggaggagatgggaatggaatatgtttagttatatatcaaattgtttttttaagcattttaccaagagctatcaaatgctgtattcttatattttgtaaggtcaggttttatccggtgtaggggagattgttaaacatgtgtacagagaaatttcaaccaaaatttggctagacagaaatttattactcatcgatagattgtcaggccccacaatcaccttccttgtacatgttgctaatattttgcactgattaaaactttattttgaaataattttagatttatgggaaaactgcatagtacgagtagatcttgtatatcctatctgtttcatcttatgttaaaatcttatataaccatgtcacaattaataagaaaagaaaattaatgctaaaacatcattaattaaattacaaaccttattaaaaattttactaattttccactaatgttattttactgtatcctatactgtgtttagttgaaaccatcatcaataatatcagtagacagcatgatcccttgatatgatgtacaacaaaaacacatatcattttagtggatttttttttttttttttagaaaaatacataagctcaatccaggcagaagaaagcatcattcttacccaagctgagggacatttgaaaaaagtaactcttcagagctattcaaaagcatcaatgtcatgaaacacagacttttatgccagttgcattctctctcttaacctttctctctcctaacttcctgaaagtctgagagttatagcgatct

SEQ ID NO: 62235 - DNA, 1664 bp, Bovine  19866880650318
tcgatccctgggttgggaagatcctctggagaaggaattggcaacccactccagtactcttgcctggaaaaccccgtggacggaggagcatggtaggctacagtccatggggtcacaaagagtcggacatgactgagcgacttcactttcactttcttggaagatgagttcctcaagggccaggcctggctatgctcatttttatttactaaggttaagacaatgatctgtgcatttagtgtcctaaaactggaacttctgtgttgttcttttcaggaatattgcttggagtctatagcagatatctcatgtggagactattggaagaggccaccctgtatgcttttaccttaacaatactcagccaactgtctctccctcctcactggcctcctcaaccctatggctttctgcattaatatgtatcagattcccagggcctctaatgcccttaaaatagacagatgaccacatgaccctactccctgataaaggataggcagcctccaccggtcagtacagtctttccccatgtgtgctcatcagaattctggcaggctgttgaggactataccatagctgccctcatttcttttttggaaagaaacagaaagcagcagaaattttgctggagatatgctcaatttatgagcaagggtgttggggaggctcatgattgttctggaaagtctcccgttcctctttgttgcctgtgccactccatgatattttttaagatcttgtgttagaggattgtagtgagaatgatggcccagcccaggctctgccctctggtgcagcctgctcagagtatcatggcaacattgccagtgggaaaaatgcagctgagtccctgtgattggcgctgctctattaacaacgggaatgtgaaggatctcaggtgggagatgagagtgataacagaaaagctatttcttttcatttccccagtgtttatagactctgagcaaaattgctaacagaggcatctccaatttgaagtgctaacgctttggtaccatgttggaatagagactcttgattaacaaatgtgattgaatcacaaaagcacagcaaattgcggcatcgctttcattctttacaataatcaggtaacgaaacatcactacttggggggctgaatgatggaacagcaagcttccaattagaatgccttcttcctacaggagccccgattgtaccaatgtgtgtgaaaggatgttagagaggctgctcaggtagggaagagctgcctggggcgactccaacctttagtctgggcctgagaactgtcttaatggttttccaaaagggcagtaacacagtttgagaacctttctcttcagagagcttctttgaaatagccttttctctgttaacaaacacactagaccacctctgctcaggaccttggctccctgctctccttaaacacacacacacacacacacacacacgaatgtatacacatgcacacacacatttgtacacatccatctttgcttcatgtgttctctgcagggtttctgtgatatttttgatattttccccaccgtgtcataattagaaactaattgcaaactattgagtgtttgctaggtatcagatactgtcctttaacctacatgatcccattaatgcttcatatacctgctgggtagcaa

SEQ ID NO: 62236 - DNA, 1973 bp, Bovine  19866880692000
tgcttggggctagtgcactgggatgacccagaggaatggtatggggagggaggagggaggagggttccaggatggggaacacatgtatacctgtggcggattcattttgatatttggcaaaactaatacaattatgtaaaatttaaaaataaaataaaattaaaaaataaaaaaaacaaaattgaatatgtatgtcaaaacatgcttaatgtaattctgtacaaggcaaagaaagtttatggtgaaacagaataataaagttttatttgttcactgagataaagattaaagagaaaggttgagtttttcttggatgccattatgtgtgaagagaagagagccacatagatggagatgttcaagagtatttagaattaagagtttagagcaagtgagtggatgcacaaaatcacagaaaagggcttgtcctaagagtcatttccaatgtgtccttggagctcccagcctcccatttttactccctttattatctcttttattttttgtctttttcacctagaattcctagacaacaaatgcttgtatttgtcttctgccctggtctctccaatcagaagtaaacctatcccataagctcgattagattagaattaaccccagggagaatctgcactataagaagaaccactggaatggaaaatgaaatgaaatgataattcataaaatttccccaaacccaatagttctgacaaaggacaggttggaacagaacacttccaccatggaccactggtaactggcttcttctccagtcctgtgctttcctataaaggaggttgctaaaagaggctggctttcttggaaggagggtaagggtcaaggatggaaatgaagccattgaatgttcaacggaacttacttctactgattttaagcagcaagactccggattaacttggaaatgatcactgtgaataggctaccagtagaagggtagaacacgtgggtgtctgtagcctcctaggcgtcctgaaaggctgtgggctgggaattgagagggcagaagggatccagatagacaatcccttctgaatgctcatctcactttccaaatttgttcacctaatacctaacaacaacaaaataaaccctcttacattcctatgataacaggttgagatttaaacaggcttttacttcctgcccgtcgttgcagtagtcatgttttcattaaaccactggcactttttctccaaagatttctgggtgaagtgacagctaaatataatggagcataaatcaatcagcaaacatcagcttcaggggcgtctggaaggaaaggtgagcaagttttcacatatgtgtagactctgtagcgagactgaatttatcgccatgctccccacaacctttcgagagctcaggatgtgaaatgggagaggggaaacctgcttcttcagcatcagaccttcaaatctttgcaggaggaagcatttgattaaaatcattcatgtttttttagtagaaaaagcgattttgagtttggggtaaaagaatataaatatagaatcctatttaacttaagaataaactattaaaaatctgttcgaacataatcaaggctctactaaggaaatctattacaggagattgtattactacagaccaagtttaaaactcacatctccaagtttatgattttctttttccttatgtccctgtctctctgctcctctcccccttctcactctttctttatccctctcatagaaaagaacacaatgcaggttttgaaactacaatcctcacaaagcacttatgattatttttcagtgataattgctaaaaatattgtgcatttagcttttatttcatcagcacactaaaaactcactttgtaaccatcagagattttatctctgaattattgaacataaaggctaatccagtgaaaaactgcaagcatagtacaaggtaaagacaatgcatctttaacacatgttgctctgctg

SEQ ID NO: 62237 - DNA, 1500 bp, Bovine  19866880753540
ggtgatgtttagttaatgataaggacactggaaaagaactggccaaacagtattaggtcagttttccatttgactgttttacacaagacggagactgttggaatatctgggattataatgtacttaaatcagcccaggtggcatgttttcaacactcaacacatataggacttccctggtggctcagacagtaaagcaccttgcttacaatgcgggagacctgggttcgatccttgggttgggaagatcctctggagaaggaagtggcaacccactccagtactcttgcctggaaaatcccatggacagaagagcatggtgggctatagtccactgggttgcaaagagttggacacgactgagtgacttcactttcactttctatgtgccaggcatgtattctagtgaatatgaatttaataaaaatgttacaaccgctgcaattaagagcctagagtctgttggtgatggcagtacccaggagtcccattgtaatgctatgtggcttgttgctgcaaataaagccattatcactgaagaagctctcttagatggtattagccataagaccagatgctgtaggttcaagtttccagttgctatggtggcattggggcaggtatgatggactttctctgcttgtcttcatctgtaatactggggaaataacactaaccttacagtaggagggaatggacagatagtagataaatgtgtggatggttgagtaaatagattactaggtagacgataaataggtggatgatagataaatagatatttgtgataacatttggcattgtgagtgctccataaagaagtgtttcttctctccttcacctaaccctacagctgagttaacataaaatacttcaacctataaaagaaaaaagtactcagtaacatttttccatggatgatacaggtgctcgtttttaacactacttcatattttatagcaactttgtcaattttaagactatctcacttttggtaccacatacgttcacctacttacctttctggacagcgtttcagtaaatagaaggacccacacatttgtaaattaaaggcagtttgcctacattagatgcaataatatcagtcataggcttatgagatgtaataaaaaacacatttgttttagagtttcatagaaaatatgttatcttagtttatctattaaagtaattagagtgtgattttttccctctctctgccgttggctattgagttttttaaattcttcgaaggatcatgtatttgcacagatttaacatctgcaaagtaccttttaatcaattattggctattcagagtacaataattagcatatgtgtgaaaatatagggttgaacatccatttgttaaaaacgtgacaaatatgtatcttttgtttacttgaaatgtcaatgggtttttgcaatgtatatcctatgataaaatgttttaatttatattacaggtgcattttattatgcaatattagaatacttagaa

SEQ ID NO: 62238 - DNA, 1979 bp, Bovine  19866880778344
cccaccagggctcccctgtccctgggattctccaggcaagaacactgggagtgggctgccattttccctctccaatgcatgaaagtgaaaagtgaaagtgaagtcactcagctgtgtccgaccctcagcgaccccatggactacagctcaccaggctcctccatccatgggattttccaggcaaaagtactggagtggggtgccattgccttctctgagaaggatatctattacccacttaaaaattgtttatttggctgcactggatcttagttgcagcatatgggatctagttccctgaccaaggattgaaccttggccctctgcattgggtctacagtcttaaccactagatcaccagggaggtccctctattacccatttttaaaggcagaatttaactctgatttgtgctttgcttagagaaaaaatattcaaactactccaaacaaaaacccttctctcaagatctcatttatttctattttttaaagtatcttaaatagtcaagggaatttgtttaaaataaagcaaagtagagatgaaatgctttccttttgaagcatcattgcattttgtttatgagattgcagttcttgaacatgttcttggtgagttaaaaattcaagaagaatgagggaaatccaatagatttaggtaccaatagttagtaggaacatgcaactggtttgttatttctgtagaagactaaagcattttgtaaggagctttgctctagaagctagtcatgagtgatttaaaagtagaaggtattaacattcacaaaataaagctttgttacacatttattttaaaacttacttcacttggttattgctatgaaggtcagattaactgtagtcaagaaatgcattctaacaagatgaaatggaattgcatactccctattgccatgtttaatttgtactttataccttaacattcaatatgatggaatgtcattaaactgtgaaactgtcattaatgaggtcacctggtttatgtcaggctttctcgtggcacttattgatttgattgacttcagaaattctattctgaataatattttaaatgaaagatagaagtgttaagaaatgtcctcattcttcatcttaaacatggagttttaaaggtttaaaagaggcctttattccacttttattttaaacagctttccttatttagcatattctatcaagtactcatgaaaaatcttaaacataaatttaaacttctagttattttgtggtgttattttattatgcaaattgtatttttttaaaagtgctgataatcagaaagagtaattaatataattataaaattcatattaaaattgtactaatgactgttactgatatctaaatttgtattaatgccaagataatgttgaaaaatgatacttttattatgagcttaatttcccaacctattacttatctttctcccctgtgttccttttcatttagatatgacaaattcttggcaaataaatcttggagggttaagtagagtattatttaacctccaaagcatactaacagataaaaagtctatttattaagtagagctactgattcaaaataggccaggatggattcaaaaatatgtatataactgcaaataattttcttgcccaggagattatctccatagcagccaactttttagaactgaatggcagttatttatgactggcttagaaatatggtttttaatatctgaggagcaagatcaatggttttcggtgaactaaatatcataggtgtgcaggttgactgacgcacggtgggtgcctagcaggtaatcagctttctctccttttgctatcactgcagtctcagtatgcagtgctcagaccagcagcatcaccaccatctgtgaacttgttagacgtgcagagtcttgggccccaccctagatttaccaaattagttactctggagcttgagggttagcaatccaagttttaacaagtc

SEQ ID NO: 62239 - DNA, 1100 bp, Bovine  19866880857101
attcttattttgatataattctattccatgcagtcaataataccaactagactgacccacttgtgttttacaaattctaaagaaaaagattactaacttccgatggagactccagacttgatctctttggtgcctgttccattataatgtaaaataatcttatagccattgtgttttctaatctatttacatgcattttagacttattaaggctcttcggatgatttactcaagaggtcgatttttttactcctatatccattttcttcctatcatgatcattttacttttcatctgcctaagaaaagcaggtgcccatgcaagatttaattaaaaagccattgccagctccagagctattggtttcctacattactctagtcatgtgaaagaaaataagaactgggacggtatttctcaagaggcgttaagaattctttctgatgaacagttccccatccatcttcaggagactctcaaaggcttgaggtgtgtaagcatggctgaggcctgaaaaactgttttcaatattttcctggttgactttgtatgtaccatggccaaaccaaccttcttcgagacacttagtttgtcctgatattttattgtatttctgggtctggataagtaacagaaaacaagtctgtctgtctttcgtctgtgcctctctctctcattaaatgatccttctttttatctgtcgtcgtcctctcttcctttgaaaaaaattgactccacacatacccttcaccagaggctggcctggtctggagcccaaggagctgttcaaggtgctgaaaatatttctgctacagagccaggaaccaattaagtaaataaaagctgttctgctgttttctttgaggtcatcagctttggtcggacccgcacccaatgcctcattctaacaacacaaagaagtaggtgctgagatcatataaaaaaactcaaacatctttagataaggcgaaggagaggaaagggcaaggagtggatacattcagcctggaaaagaaatcaattcagctttgcaaacccccaatacatatatttttactctcatctaatattacaacttttcttgtctcacgggaaagaaa

SEQ ID NO: 62240 - DNA, 1311 bp, Bovine  19866880980555
tgcctgagttagagatgatggatgactgcagtcatggcattgatctctgggagctggcttactcaggtcttgcatggcttatcatgaggccatccactccgaaaatgcatgcatacaggacaaatttcacactttacattctatcagggccctctagctattcttttgttcatataactttgacctaaatgtacctaaattcaagcactactacccactgtaaatattctgttcagatacaatgactcagaaggagagggcagccatataaacgatcttcttcaatcactgtggtttgttcctaagtgaagctcctgagagctcaacttgtgactcatgcaaatctttcacattttcaagtaaccagggaacatgtgaaatattagggatttatctcaacctgcagcatttcaagatgataaatatgtccattcagtttcaatttatatactctatgaaatacaatatatatacatttttttggatcaatagtgacttgttagttaagtagaatgcattgtgacttcaagaagactatttttatttaaatttatttaaatcggacattttttcttgaaaggcatctcaacttcagtttcatctactgttccaagaaacacatgaacacaggactggtaacaagagtcatttcagattccacaatgcacgtactgttcctctaatcatttaccaaatgcagcagttaagcttcactgccccctccttgactcactgatttattggctgctgaacaaaactgccaaatgcacacttacaggggtgcttgttggaactgggttaactatcgtgatgccagttaaaaaggacaactgctaacttatcctcatcaccataatatgtgcactgctcattacacaaaataaacggggaaaactgttgatgaatgagcaaagcaaaagaaggaggaaatttatctttgtctctgttatgcattaacctaagtcagtttgactgttcagccaatgtcaatttttttttttaaattttgtgttatgttgttggtagatgttggtaaacttcatggttataggaaggagggcagtatcttttttaaaaaatgagctcttctgatatattttaccaaatgtggtaacatttattattacacagatgttgaagagtcacacaaactgctctgtcctttggagcagtctttgcccttgatgcaaggcacttcaccttgaggaaatgatcattcctcagacacaacactgacagctaagaataatgaagaactgactggcataggttagtgttaattagcaatatgtttaatatatatattcaata

SEQ ID NO: 62241 - DNA, 1625 bp, Bovine  19866881029395
ttttcagttgatcatgtatacagtctatcagaccatcagataaaccacatcacagaggactggtaataacaagtgctatgaagagaaacaattctggataaggggatagagagtgatagcaggctgatatttattgtgctcactgttgaaagcctctcagaagagttggggagtgagagcagttaaggaatgatttttctgtctctatgagtccctggtatataataggtaggatatgtggctaagaattgaatatccatttaatgtacaacagttaagatagataccatatacaagaaaaagaagaagactatggatgtatcctcacttatccacacccagaaagtccttttggaagaatgaaggctattcccactccatagatgaccaagtaaccagacaccagggttgcttgttctccatcgtgaaggccatgctggcagtgaggatgcagcaggcttctctagaatgtgaatgaaatgaatactcgtaaggactcacttaaacacactatcagagaatattttactcacctcccctattcatacacttcctgggatgttaaagctttctctagagaaaggagccccttcaggatccatcacttaacaacagccatagatttaacattactgtttttgctgacactactatacctatcgaaacacaaaccagaatcttcatgaaaccttactcattaaataaatgctaagacaagctaaagtgcctttgcatataccatcactttcttctcaatcctactttatcatgtaatcatcacccagcttttaaaatgatgttgtgaaatgggcttctgtatcctctttataatattggaggggtcaatcaaccaagtataactgtgacattttctatactaggacaaaaagttactaggacaaaaagttactgactttcctatgaggaatataactctctgttgagattttgtaggtgcaaaatttctactataatatgttatattttaaaattcatgttctaccaagtgatccatctcccataagagtgaatcccaacaagttatatgtttggaaagatgtatgaaacccagggactacctctactgaaataacattaaacaaacacacaactgttcagtctcttgaataccaagtaactaatctagctagtagtttataccctcttttaaactgaagcttcatgcatacgataataaaccactctaacaaccaatcattcagaacttgggaggaggagggaaatccctaaacctagttgtttacccaacaaaaatcaactcattctgtaaatacatttacagaacaaatcctgaaaaaactacacttagaaggaattagaggtcatcaggtccagccatcttattttaaggatgatgaaaccataacccagagaggttaccaagcttgcccaagatgccaataccagtaagttgcaaatcaagaaccagcattagagccctttctctgctctgtgtggttgtcgccgtcaaagccatgtccttgtactttgtatgcccagagaagagaataagactctttgggatttctcttctgaaatgtatctaacatcactgaaaatccattcgacttagagtagagccatctatcactcagcctcaaaag

SEQ ID NO: 62242 - DNA, 745 bp, Bovine  19866881041936
accccctttttttttcccctgaaaagtaatatatgccctttaaagaaaaaatggagaatgtaggcaactataaagcagaacatgaatcattaataggcttgcacccagagctagtctgagtgacatgtttctttacagcctcttaacaaaaaataaatccatatttccccaattcacttcttaatcatgttaaccagtgtaaagctaaaaggagttgctgatgtttttcagttgggtaagatgaagacctttcaattagttgctaaaatctgtttgaatgtgaggcaaaatcagatacaggtgagctctcatttcaaaagaagacttcaggttggactctcctattctagttcacattttaaaacccatgatggaacattttgaacacagtagaggagccttctaaaatgtcaagaataattgtaacctctttccgcaaggtctttttttgtccttttcagaatgctagagatgaggcaagcagaatttgtggtcttaggtgggactcttggcaatatacaatatgaagcgatctctcatagaaaggatgctcatcgtttaagtgtactgcaaggactgtggcctgttactgctagctgtctctgagtgagcatactttattgttattctcagatcaccagggtcttaagtattccctcgctttcctcggcctgtgtctcttccttttgacaaaagggaaagtgcagtctaagaacactgatggagccagaatgattggctgact

SEQ ID NO: 62243 - DNA, 1074 bp, Bovine  19866881077217
tttctctttcctttttttttttttttttttttttgcaccattagtccattaacttatttgcacttttgaatttattgagatgtgttgaatgctaactctacctgcacagctgtgtcttcctctgccacctggaggcagacacttatttcaccagagttatagacatgactcccatatcaggaatggacagatcagtgcaccaaagtttctattacaaactcaacttctcttatccggacagaacagcaaatgaactgaaaaattccaccaaccttggagagacctcaaggtgctaatgtttgacagcaataaaagctttaaatggtttggggaccattggtccctgctttgtaaagtattcatgaagtggaattacgatgaccttctaccttgatatgatttccaatcgcctcaagctctctgcattcagtttgacctcctttgctaccattgccattgatctgttcctgagattgtagctataggctttatgtttgaacctgagattaaagacagagagaaaagtcaccataatgttgctgccaataagtttagggccagtactgcagtccttggtaatgatcagggtagccactgaagagtccatctggaaaacaggatcttcagggactagagttgtggtgaaaatactgggatggttgcagggagagaaggcagaaaaggaatagttgtgacactaagactgctcctgaatttcagaaggaaatcagagggagatgctaaagaggggccacaagcactttgtatttaatattggcttatctaatacgttcagctcgaaatgatctttttttttccttctcttcttgggacttgctaagatgcttctgagtgtcatttccacaactctgtccggtcttcttgctttagttttttatttccctctatgccccatgcacagtatagcctggagtacttttttctctctgtgccgcatcataatttactacaatctcttgtgccatctgtatgtgtttttcgggttgttttttttttttttttttttttaccatgattaacagtttttaagcaggtagtaagtttttctttttt

SEQ ID NO: 62244 - DNA, 982 bp, Bovine  19866881112236
ttttttttgccatttttctcaacttaaaaaaaatcaacaagcttcagaatttattttccatctattgatttttttcaagccattgcagttttaatttttaagaactctttcatattctgtgactgttcctttttatagcatcctgttcttgttttatgtatgtgatatcttcccttctctctccaaggattaatctattattttaaactttcttttcctgaactatgtttgtttctttttttccctcatttctttctgccttcatgatctctgtttccgtgttagaggttctccttggctgtctggttagactttttaaaaattgcaatatatttgacatgtatcattgtataaatttaaggtgtatgtttggttagagtttagagtgaagcaactaaactctgtttagcttagggaacgctgtgtgcattggcagagctcattaagctaatgaagtttcactctagtggttgattttgctatatttcattggcatacctccagctttcaatatctgtgttattcctttgggttggtctgtttctgttatgtagaatttttcaatctcttgtcacgatggtgtaagcttggctgtgagcattttgggatctgactgtgggaaggaggcatggataccttaagtaaaagactgtttaagtagagacgtttattcttctgggtttcagtttggtgtctttgttctcactatgcttgggtccagcctctctaaggttcaacatctttaaagaataagcctcctttatttctccaagggcagaaagggtatcttggaagcctacctccttctttcaaagactctaagccaatccacctgtttctagttacgctttatgcccattctttcggagatggatggtgcctccaatcccttctatagttttttccaacatgcaaagcttgcttcttggctctccctcccttcctacagactcaaattttagcttcctcagttctgctgtta

SEQ ID NO: 62245 - DNA, 980 bp, Bovine  19866881168946
ctcccaacaccacagttcaaaagcatcaattctttggcgctgagctttcttcacagtccaattgtcacatcccatacatgaccactggaaaaaccatagccttgactagatggacctttgttggcaaaagtaaatgttctactttttaagttagactcatctaaatggaactttgtaaggcagtggatgcctatttatagaaaacatcaaagcagagacattaaacttgctgttggagatatcttaagtagggttcatgcctcagtagaatgctcaattgatgacttttaaaatccatttttatgctgacacttcatgatcctgttcctgaatttggaacaaaatatatattcccctaagtagtccagaaattagtgagaaaaaatgatccctgaactttgtttttccacagttatctgggaatatgctttatctctttctataggctcctctgtttagggggagaggtggggaaatacagatatgttcatttccaaggcttttggatccctctcttatcaacaaatataataaatgactctttcatgaaagttcttgatcaaatgttagtgggatcataaagtttctgagatttctctgtattattattattttttcattcagtaagaatcagcctgaatcacacttcctgttgaaagggttactggagccttaaaggcattccagtcaggatctccatgactagataacaaagatgccaattaatgctggttgtaaaggggaacagcagggcccaccagtcattttcccatatggcacacaagaacaattagatacataggctgacatttcatctttggtatttacataatgtatactacggtgattgataggaaagaggtacatagatgtgacagactgacagaggataagggcagaagccgtccatctttttcattatgatgaccattttaacgaacagaccaacttgtttctgcagtccattaaatcagttgaca

SEQ ID NO: 62246 - DNA, 2369 bp, Bovine  19866881170593
gctgtcctacagttatgatgagaggagaaaggcagccctgtcctctcaggaggccttgcagactggagatgcttcacacagtaaagtcccaaaactgtgtcttacatgatataacactttttaaaggagataaaagtcatccctctcttcctgctttttatacctttttatagtattttggaaacggcacaggaagtgactcgcaattgaaaagccatttgtggcatcgctgggcctctaatgacagcccactcccagcaggtttatttgtaaaaataggactttaagtttaacctagcaggctgcatgcttctcataacatccggcagttcacagctgattttgaatacgccccaggttccaagtggatcacggaactaaatcatctcttatttcagcctgctctttttgaaccaactcattttacactgtggttagcatagcctttccagctaaggatgattgctcaaagcacttagggcaatgttgtcttagcccagcatctagaatgaggtagttgacacaaattgcatcttatgctacttgagatttaatgttgttactgccaggagaatatttttgcaaaggttactgatgtataacaaaataaaacatgcaccaaaactgaaccctccatcagaattcctctttagtccaagattccaattacatcttttttcttaaatgtaggctattaaccaaaaagacaataagcaaaatctgcatttcttgatatcacaagtctttggtataataacaatatgaaaaaaatactgtccactgtacaaatcctttggttccaaaataaatacaatggacacttctaagatttcagaccaaaaacgttatttgttcactgggcactctctatactaaccctaactgttacctgtagagttcaaaaagcaatggcaatgattaatgtattctttctgtgttctacgttaaaggaaaggaaggctaacataagaaggaatgttagcgaagcactataaatatatggaggacatactggctatcctataaaatgatctctgagtaacagaacaattcacttgcatttcctagaagcatattgtgctggaggtcataaaatttaaaactgcccaattagattttatatcaagcaatacaatttagccttctgtggatccatgaactctggctcaccatgcattaaacagtcctgcaaatcactactacaagatgatttgcatagtatgtacatattcttattaattacttctttaatgctaatgtaattaagaactggccataatatgttgggtccttattttaattacagttatacatcctgtaataagcttaaagaaagccccttttgaacctacctggctttatgatcagaattttcctttttatttctatgatttccatttaattgatctgttcttcacagctcaaattttaaatttagctgtgattaggccaagtggctcagtggtaaagaatctgcctgccaatgcagggacgccagagacatgagtttcattgcttggttgggaagatcccctggagtaggaaatggcactccaatattctttcctgggaaatttccatggacagaagagcctgggagcctatagtccatggggtcacaaagagtcggacaagactgagcaactgagcacggtatgcacaggtgtagctaaatagcctttattctcttctggaaagttccatctagtcactatttgtctcaagaacataggaaggacacagataaaagtggatgcatctacaaataagtagattgcatttgttctcataaaccatcagcattaatatgttggtgatttgttctctatagtcatttaatctcgctgttgaaaatgacataacagtcttccaaaactggtagtagaccaatacactaaaacaatttaggtctttcttcaaggcctgaggtcatcaaaatgatcacatctttcattcaccacaccatcctccaggtgagggatgaagtcaaggaatccacaaaaagggatatgtcattagaagagaaaattattcttatttccaaactatgattttggcatatctttttttctttcctttctttgaaaagagaatcccccaaaactttcagatgaatagattttaaatggttctaggaatctgttctgttgagataacctatccaaatttggaaaactattcaatttcacctaaaccaatgaagcttctaacgtaaccatggcatacaaacagtcctgaaaaatgtttctaattcatatttcagcttgaaaaagaatatgtaggaattcaaaagaaaaaacaatgggggaataagtccataaaaatattattttttgtattaaataaatatctaagggtaactctgggat

SEQ ID NO: 62247 - DNA, 1197 bp, Bovine  19866881177851
ttgtaaacggggtagaacatattatactttaaatccgaaactccttggagtagcatctctgttggcaatgacttctggtcatactgttggtcctacttgaaaatatacatcccaaactaaaaccaactgggcaaagtttagaaaatcccaatatattaaaagaatcaaacgaaaggaactggaaaagaagttaagtaacacaatacgtctgtataaaggatgtaaaaattcagctgctcttggatttgctaaatgcctattttccttttaaaatgcttctgggaataggcaaaacccaaaaggtgttttactaagcactttttccattcatgtagaaatgtcccagaggaaatttaatctccatgtttctgatactttcacacttaacatcaaagaattgttttataagagttatttgatatattaagaggattttttgagcttttttccaagactttcaaattgtttttcttggaaaaaatgtagtcacatctaagcaaggggaaactaattcatacaccactaagttcaaatttagttcaaaactctgatgccaaaatatccaaagaagagactttcctagtttaaaaaaaaaaaaaatagtaacaattccagctcaatgctccaactttatagcagatatactttttttattaattactgtactaatttcacacatatcattacaaaaagagctaactcctagtataatgcaaatgggaatatcacatgttatgctatgttactgtcatgaattgaagacgcatgaatgacttcacacaaatttgcagaaagttcaaagggtgagtgaaaaagaatgggaactttattagcaataccttgttaaatatatgaaagttaccaggagcaaagagatttaaaattcattatgaccttagacttttctaatgtttaaccccagaaatatccagacaccatcatctgttattgagattacagatatatcctattagttagtctctataatttttataccctttgttcagttcatttttcataaagccaccagctatcttatccactgcaatcttcagtccattcttcatagataagtcagcattatttccttaaaattaaaatccaatcataactgtgatccacttgaagactatcaatgatcactacagactgacacttgtgttcccccaaaattcatttgtttaaacctaatcccta

SEQ ID NO: 62248 - DNA, 1317 bp, Bovine  19866881302670
ataagaggaggactctgaattggactacattaaaatgaagacttcatcgaaagatatcattaatgagtaaagatgcaagacatgggatgggagaagatatttccaacacatttactcaactaacacttatatccaaattttgtgaaactcacaaatcaacaataaaaaggtacacaattgtccaataaatgtaataaaatattatcctcccattaaacattgagaaaatggaaactaaaatcacagtgtaataccatcccacacactcagcagaatccttgagcagataaataaatatgtagtatactattttataaaacaaaatactatgcagcaaataaatgagcaatatattgcaatgtacataatctgaataattctcacaggcataatgttgagtaaaagaagtcaaacaaaaagaagcattaataactccatatataaacttacaccaggcaaaaccaatccacaataatgttaagtcagattagtggtaattatggtagaggacagtatggattgggtactggaaggaggatgacttctgaggacctggtcttgttctatattcctatctgatgtttattatgtgggtgtagacatatgcaaaacttaatcaagttgtacattacaatctactcccatcatgtagggacttcccaaggtggctcagtaggtaaagaatctgtcttccaatgcaggagacacaggagatgcaggttcaactgctgggttgggaagatctcctggagaaggaaatggcaacccactccagtattcttgcctgggaaatcccatggacagaggagcctattgggctacagtctacggggttgcagagtcagacaggacttagcaactgagcacacaatcacacgtgcctaacatgtatgttttgttttattaataataaaaattgcaaaaaagtgcaaaatatccaattttaatgttgtaatccaacacagtcatgcaacaggaaaagattaaaagcaagtgaaaggaatttgtcaaacacacattcacttcctctctgaagataaaatgaaggaaatatgtcataataatagagaagaatgtggtgagagtacttcggaaaatatttcatattatttgtgaataccatctattaccactgttttcacaaaagcaaatgttatatctatgagataattcttcatcctcctaagcactgactgtctaacttttccgaaactaatattgatctattgagtgcttagaatacatcagactctacaagaattttgaaagtactaccccaatttatagcctcaaaatccccatgaaacagataaaagt

SEQ ID NO: 62249 - DNA, 2934 bp, Bovine  19866881313705
atcaatgcttttgaactgtggtgttgcagaagattcttgagagtcccttggactgtaaggagatcaaatcagtcaatcctaaagaatttggaaggactgatgctgaagctgaagctccaatactaaggccacctaatgcgaaaaactgattccctggaaaagaccctgatgctgggaaagattgaaggcaggaggagaaaggggcaacagaggatgaaatggttggatggcatcactgattcaacggacatgagtttgagcaaactaggggagatagtgaaggataggcaagcttggcatggctgcagttcatgaggtggcaaagaactggacacgacttagcaactgaacaacagcaactgttatgctagggaagcccctatcacatttctagctgaacaagattacaaaagtgatatttacaaccacagaagccaactcgccaccatctgtggagctgtttggaaaaggaggaaccaagggaggaggactcgaactgacatatcccactcctcagagcaaagagctttgtctctcctctctttggtgccttcccttggtaagtaatgaatcacaaaaaaataataaaaataataaaagtgaggtttttctaccattcaacttcttgggggaattttgaaaattataaacttaatttttgagtgttggagttcacttaagcttcaagaaggagtgatgatactagataattttcacttcaagagcaggcagatgtggaagagttgagagctattatccttagaataaaaatgaaacttatcatgtagaattacagtaatagcagtggctaaatcaaaactcacaaatgacagtatatgatttaaaacaaattttaaacccatgaatgcttattcattgagatattatttcaaatatacctaatgcaacttacaatcattctatgaaataggaagtattatcccgggtttgctacagaagagaaaaaatgagactccaaactgttaagcagcttgtccaaagtcatactattagcacataaccaatggacgtgagtctgagtgaactccgggagttggtgatggacagggaggcctggcgtgctgcgattcatggggtcgcaaagagtcggacacaactgagagactgaactgaactgaacataagatttaaggttcctaacctgtggactccgtactatttccacagcatcaccccgtagcactgaggaaaagaaagtatgattgttaaatgacttcacagagttgtcctcaaaatcaactggaacgtcatgcaggaataggttgtataaagataaacctgtcatcaatatgcaacatgaccttggtcctaggtcacctcattctctgtgccccaataaggagagactctctggggggttcccttcactttttgttgttacctgaaattccaggatcacaaggtaattttagttttagcatccaattctcattttaaaaatgcctaaaacagatgtgcctcttaatagtgaaacactatattatgttagtaaataaggatagtggggaaagaagcaggaggaattaggggtagctttgttttttaaaatcttggtcctcctccaaacttgcactcatctgaacagagccagcacctccttagggatcgtggctctgaagtagaaggcaggcacacatgtccaaccaaaatcattggaagcagctgttcagccaactgtgtttatcctttcctggggctccttgctatagggtaagaaatggtgtggacagatgaaaagatgctgccctggcacttctgaaatgtgctgaattgcaccagaaaaaaagcagctaaagtgtcagagtcaactctccagggaaaatacaactctcagccacggaaaatggaaagcaatgaaagccaggcaagagaaattctcctggtcaaacactgacatttaatacacaggttctgtggatgtttgctaaacagcgacggaataatttcctattcatgctgttgctatctcagcaactgacatacaggaagagaactacagtgatggagatttctagaaaacagaattgagtaggatgcattgtcaatggggcagactatagaacagggtcagctactccatgttcaaggtcaggaggcagggccagtaagacggtaggtgttgcaagagggcatcagagggcagacacactgaaaccataatcacagaaaactagccaatatgatgaaactaagccatgccatgtggggccatccaagatggacgggtcatggtagagatgtctgacagaatgtggtccactggagaagggaatggcagtattcttgccattcggtattcggtattcttgctttgagaaccccatgaacaatatgaaaaggcaatatgataggatactgaaaggggaactccccaggtcagtaggtgtccaatatgctactggagatcagtggagaaataactccagaaagaatgaagggatggagccaaagcaaaaacaatacccagttgtggatgtgactggtgatacaagcaaggtccgatgctgtaaagaacaatattgcataggaacctggaatgttaggtccatgaatcaaggcaaattgggaatggtcaaacaggagatggtaagagtgaacatcgactttctagtaatcagcgaactaaaatggactggaatgggtgaatttaagtcagatgaccattatatctactactgcgggcaggaatcccttaggagaaatggagtagccatcatggtcaacaagagagtctgaaatgcagtacttggatgcaatctcaaaaatgacagaatgatctctgtttgtttccaaggcaaaccattcaatatcacagtaacccaagcctatgccccaaccagtattgctgaagaagctgaagttgaagggttctagtgaggacctacaagatcttttagaactaacacccaaaaa

SEQ ID NO: 62250 - DNA, 918 bp, Bovine  19866881323437
aaaaacggtaatggaaagagaacaaatactattacacacaacaattacatttttatgaagaacaaggtaataaaacttgcataatctcagagatttttttttttaattataaaagtaagatactccaaattcccttttcatgaacttttcaaataaaaggttggctcacaatcatatagacaagcaatgtgggcagaataattaagattcatgactataaagacctagaaatgacccattcttctagcaatgaggactaatagagtaattgtgaaaaaaacagggacactgccctggaaggaagagggaaaagattgagatctaatagctttggtctctgaagactaaaatggttctgcatgcagatttgatatgcaaagcccactcccctactgccgtgctgctcagagggaaggtgcagtttgcatttaagaaataaccctagttctaaaatccgaacagcaattaagatttaatagcttctaggaaggtcactttggcatctagcttgtctccacaagaagaacctgctttcatggctcccaaattctctacccaaggctgctgtccaatcttagaaacagagatctgagcatttaagagtcacgtcaattacatgaaaaatgaaggagtcccttttcaccttgatagcaagccacgtaagtacagggggatgtggtcacctggtaattcacttcttcatcaaagaaaatgaaaatcttaaagaatgaaggacataccttggaagatgacaaggaataataactgcaagctttacagctatgataaccaggcagcataaatacaagttgaaagaaatagacctaagaaagtattttacacactaaaaaaaaacattcttaattgccttccatgcaagattgttaaaggcaaaaaccaggaccatttacaaggcaa

SEQ ID NO: 62251 - DNA, 820 bp, Bovine  19866881374154
tctatctttcccagcatcagggtcttttccaatgagttgggtctttgtatcaggtggccaaagtactggagtttcagcttcagcatcagtccttccaatatatattcaaggttgatttccttgaggattgactggtttgatctccttgcagtccaagggactctcaagaggcttctccagcaccacagttcgaaagcatcagttcttaaatgctcagccttctttatggtccaactccctgtccatacttagtaccaaatgagtataatggagggccccgaattaaaggaagttagaggccatagtacagcactgtagttaagaacagagcctcttagtccatccagcttatgtgaaaacacatctgttatcactctagcttccacatctgtagcataggggtggtaataatataaaacagaccataaacagaatactctttgcacagaactgatgggttatcatgcacccacaagtcagcaatacgtggttgtcattatgattatagtgaattctagctcttctgggaaaaatgtaaagacactcagtctcttggttccttccatcttcttagaagcgtcacagatccccacttgtgtatgggtactgattctatcaagtaggtgaaaaaatgttgctgtcccaaaattggacagaaagataaaatacagacattgaagaaaggtcaggaagaggcagatgcccaggaagagtgagttgaaaacaacattcaaggtccgactcctggatgaaggtgttaaatgacaggtggggagcagtccctgctgtaatccagttaacatttagcacctaattatca

SEQ ID NO: 62252 - DNA, 762 bp, Bovine  19866881392891
tatattagcaaaaatattggtcttgatttctttctttctttttccctccttcagtctccaaattcagttattattgcagttgctttttgctttaatagcatctgttttagtaattagaaccaagtgtgtgattttggacatttgtgcctccagagggctcttattctttagaaagggaaaagcaataaaaacttgaaacaaaatgaaaggaaaggtatatagagaatcaagataatgagccaaaaatgcaggaaattaatactgcattgcatatttgaaagttgctaagagggaagatcttaaaaattattacaagaataaaaattttgtaaccatgaatggggacagattttggctagacttattgtgattatcaattctcaatatatacaaatatcacatcaaaaaatgcaagaattctattttagagatgaaacagtttttgatgcttaaaatattttgaatttggaatgatgtaatctatccaattttatttctaagtgttaaaattttagagttaagatgcataactgtgcttccttcagagcatatgttaaattttgaagattttttatcagtgttctttagtgttctcatattaattagaaaaaaagagagacttcataggctatcttgatttttgcaattattacaattatagttatacattttggccttttatgtttctgctgatatttattgatattctgatatctagtgcttcaggaatggagcagtgctgataacagtctgtagatggca

SEQ ID NO: 62253 - DNA, 964 bp, Bovine  19866881463536
aaaaaggacaactttttttctttctcccattccttaggattatataccaataatgtatcctgcctaaggacagtctttggattcaaccttctgttatcttaaaatgtaaattatgggagtaggtcggaggaggtctttacaacctccagacattctttggattatataacctcattattaacactagcaagcgggtactctttctgcccccttctgatgcctatatcagaagctttctctatctcctttatactttaataaaactttactacacaaaagctctgagcgatcaagcctcgtctctggccccggattgaattcttctcctctgggggccaaaaatcccggtgtattcgcgtgattcaacaacaacctttcatatgtttggtagtttagtcactaggtcatgtccacctcttgcaactccacagactgtcgcccaccaggctcctctgtccatgggattctccaggcaaggctactggtgtgggttgccatttctttctccaaggggatcttcccagtccagggattgaacccagctctcctgcattgcaggcaggttctttactgactgagctacaagagaagcctttcaacctatagtataataactaaaaagaaaacaaatcctttgtaatgaagaaaaactatgcaagctttgtaatccacaattgtaaccaaatttgctttaatgagtaatacatcttgagaagataccttaatgcaaagtatatgaaagatttaaaggtgaagcaaattcccttttccttttctttcataaacaccatcacaactgacctttaacgctgataaagctataaggaaagacaagggcagatgcaatattctgccagacctgtttgaatatatttagcagatggacaaggcaatgaccctttatccaaagaaatttcaagttgattttaatttctgtgtcagtatttgtatataaaagttttta

SEQ ID NO: 62254 - DNA, 2470 bp, Bovine  19866881587558
taaatttgccattctagatattttatatcaaagtgaagtgaaagtgttagttgctcattcgtgtttaactctttgcgatcccataactgtagcccaccatgttcctctatccatggaattctccaggcaagaatactggagtgggttaccattcccttctctagagattttatgtaagtgaaatacaaatatttgtcctcttatgtctggcttatttcacttagcatgtttttaaggttcatccgtgttgtagcacatatcagagcctgatttctttctatagctagataatattccagtgtaggtaatataacactttgcatatatccattcagtggtggtgtcccttgtattatgcttctggaagaactttggaatcatttttgtcaaactcctctcccaaactcctctagtgtcttcttaacattctttaatgtccctttctatctaccttttgttctattaagcctgtcttcccactttactggtacagaatgccttcatactggcccaagccagcactctaccttgatcctggaagttccctcaagctgcctcatgcttcacagttaacttgttacatcttcattctccaataaatatggacaatttcttttttgcaattaatctcagagaggtattgggaaaattagatgcctcttggtggaatgtgtattttaggaaaagggtatttgtgattttaaatgatttgcttttttaaaaaaaaattccaataacatagcaaaatatcttttaaaattttagtctacaggagggtagcttatttttgagttgacagctccttaagtctgcctgcccatccacagtatgttaaggcatccctgttttgtcagctgatgtctgtgtgaaatgtgaactcaatttttctgttggccttcctcctatagtaaggaccattattgactccagtgacagtagatgtgttggatgtagtttgtgtgtctggttggcagtgagtcggtataaatcaggtactattttaaaacagagatatcttgttaacaatctaacactaaactgtgtattctggtacgtagttcagggaagcaaaagagaaatgagagctggcatgctatgggacagcttcatgggtatttcaagaataatttatttgaaaaagatacatttcttctggtctttgcaaaggtaaggacaaacttctagaaggaagaaactattagactgatgatgtttattagtccactgttgcgtgtgtagtagaaaggtcagtggctttggaattgtgtataaatggcttaagttcttggttctgtcacttggtagcctatgttatctcagtcaaattaatgtttcctttaagccttagtttcctcaactataaaatatacttcactcagctgttttaaagctcaaacaagataaatagtgtgagacctcctagcaacatgtagtccattgtaaacactcagtgaagatccatctcctttcccttccttccctgtgatgatgtgctcagtcatggccgactctttgcgaccgcatagactgtagcccaccaggttcctctgtccatggaattttccaggcaagaatactggagtgggttgccatttccttctcccttcctttcctcagtcagttcagttcagtcgctcagttgtgtccgactctttgcgaccccatgaatcacagcacgccatgcctccctcacaactcccggagttcactgagactcacgtccatcaagtcagtgatgccatccagccatctcatcctctatcgtccccttctcctcctgcccccaatccctcccagcatcagagtcttttccaatgagtcaactctttgcatgaagtggccaaagtactggagtttcagctttagcatcattccttccaaagaaaagaaatcctagggctgatctccttcagaatggactggttggatcattgcaacaccacagttcaaaagcatcaattcttcggtgctcagcataacaccatttaatttcacaaaatgtcaaagagaagtagtgttagctcatttggccctccacaagaaactattttatctaagatcaggtgtcttaatgattaaagctttttatgaatgtatattcctaggcagccttatgtagccactgcgaagtcagattatgtttcagaaacatgggtgccttataataaagctgttttcttcatgaggtaatgttcctgaaatatatgctggataatccatgatccactaaatccatgagctaatgggtctaaaatacatgccataaaccacagaaacttcttgatgggaaaactggacatggattattatatttctctgcatgttagggtagtcaggatgaccaaaagtgatttttttcccctctttccccattttgtttcacaaaaatagacaatatttacactgccaattatttcagaagaaaaagtcacttatgaaactcttcctgcaaagaaaggagaaacaacaa

SEQ ID NO: 62255 - DNA, 1419 bp, Bovine  19866881759398
tccatctaggctatggtttttccagtggtcatgtatggatgttagagttggactgtgaagaaagctgagtgctgaagaattgatgattttgaactgtggtgttggagaagactcttgagagtctcttggactgcaaggagatccaaccattccatcctgaaggagatcagtcctgggtgttcattggaaggactgatgctgaagctgaaacctcaacacttgggccacctcatgtgaagagttgactcattggaaaaggccctgatgctgggagggactggggcaggaggagaagggaacgacagaggatgagatggttggatggcatcaccaactcgatggacgagagtttgggtaaactcctggagttggtgatggacaggaaggcctggcatgctgtgattcatggggttgcaaagagtcggacacaactgagcgaatgaactgactggactgactgactgactcaatttgcaagattcatcaaactgttgacttatttgagcactcttctgtatatatgttagtgaaagttgctcagtcatgtccaactctttgcgacccccgtggactatacagtccatggaattcttcaggccaaaacactggagtgggtagcctttcccttctccgggggatcttcccaacccaggtattgaagccagttctcctgtattgcaggcagattctttaccagctgagccaccaggggaagcccaagaatactggagtgggtagtctatcccttttccaggagatcttcccaacccgggggattgaaccggggtctcctgcattgcaggtagattctttaccaactgagctatcagggaagcccaaatatgttatatggtatatgtccctgaaaagtttatttttaaaaaatgtgcccagggtataccagtgtatgtgtctatgtagccactcgctcttctgacagatcctgggctgcccaaggaaagagaaagatctccaaaacttcagacatttcttctccttggagcttaagagaatagagtacaaaaaaaaaaaaaaaacagagaagagtgagtagcctgggtctgtgtgagaagaagagaatcatcaggaggctgaccgagccttctgtaaaatttcatggcgggggtgggggcgctcaattgaaagttatgttccaccatttaaagtgagaaaatagaaatgtaaataatctccaatccaaagtggcttttaaatcctctattaatggaaaattcgatatgtagacagtactacacaaagaataatttcacagtataaattgaggaaaatttatcagttcagcttagttttaatagcctcagttttttagtggtatcttcttaaaactgttatcttggcagcacagtacaccaattcaggggccatcgaaccaggtagattttctaaatcaaattataa

SEQ ID NO: 62256 - DNA, 939 bp, Bovine  19866881931597
accttggactacaacactgaaataatgcttatcaatttctttacctcaatcccatgtgaaagtgtaaatatataattaaagcaaaatgtcaaggagtacttgtacttaaccttcccacatataatgcactctgatatttcctatcctgttccatttcactttttaaaatacttgtaaccaccaaattgcttccatggctcactaacgtgtggcatcacaaagtctaaaaaacactaccatgagcaggaagattcagcaattatggacatggtattgaaaggcaagagtattttttttttaccatatgtaagatgaaaacttatgtagacagaatgcatccttcttactctctagaatattttacttgtccacaaatgtaagacacataaatatcaagccttactataatggaaaactacccctactaaagagaagtattttctgtgtctattttaaccagatgctcaaagtattagacacagttcatttgtgtaccttatgaaaacttagtactgtatatgaaaactcatatttataacctaaaaaaaaattgagatagggaagctgaacattcacatttcaaaggcaaccttaacttaatgaaggaattatgtcaataagtttaaatagaaataattctcctaatgcacttaagtcaccaataaaattaactaatcacttgacagaaccagccaaagggaaactaggttaaaaaatatcactgtcaatttccttttaatcagagaagaaaatagaacattgaaacagggaagatgttccaaggaaagatgtctccatttataaaactgttttttatagtcaacttttttaaagtaccaggataaggcagagatgttacagtcagtgatgaaagaatttgccttgctcctcagttaggtctgatgagaggggcaagagttgcccatgaataagctaagg

SEQ ID NO: 62257 - DNA, 1258 bp, Bovine  19866880425495
caaaatccacctgtaataaaatccagtggaagatttctatggattaaattttttgctgatggagagctggaatctatgggattttcagcccggtacaatttcacacctggtaagtggggacttgtttttttccccgtcaatgttttcttccttagctctcttgctatcatagtgtaagaacttctgtaagacaacattatcatttccaaagagcttcccagttctatttggaaccaaacctatagtgctctctcttttcatttcataaattctgaaagggaaattacttttccttaaaatttagcctactctagaggtaaaccgtagtgactcaggggtttacatggtcatcagcaacatgattaattagttggacttccattatgccgaaacatgtaattcaagaggcagtctgtaatagagaaactaattatactttgaatcccaataaacttgaaaaggcaattgcaatactgtaaaatgtatccatcaaaatgatctttggagaacttgaataaaatattcatttgttctgaaaattatcatttttaaagcaaatggatcttaggataaagccgtctaatctcttttttagaaatgcaaatccctaagagttgtgatgaaaggaaaagtgagccccctagcagcccagtattcatttgcaaggcctggcacacattatctgttattatataattatccgttctatgtcaattttccttttaaactgttaatattaaaaaaggcctatgatgttgactggcttactttatgatgagctatcatttgttacaataaaaattgttatcacattttaaactttgtgaacatcatgctgcagcaatttgagatttgatgaggtcatttttttttaatggaaagatgactcaaattacataaagcacattatttacttataattacatatttttttaaagtttgtgtgtatcgttttactcaggttgtaacaggcagtaaattaaattgaaatgtatgtaaactttgttcaagtttccatcccacgttacagaggtaacatcagagcagggctgtgatgctccgttcaaacactaaaatgttttaaataattaatatgagattaatgatgacttttattatgatactatagactaataatataattaaaataagtgagatacaaactctatgtgttagccttaaacattactagattgtggtttttattatgtttttctaatattgggttgttaacagaagtcaggatattttatatgtg

SEQ ID NO: 62258 - DNA, 1471 bp, Bovine  19866880451717
tattttaaatcattgtcatttttcagtttgaatgtaataacttttaaacaaataatatagatgcaatattttatttaactgtcataggaacacagctatgatgtatacatttaaaatataagcagtatgtaaattatacaaacagaaaaaatatgtttgtagctctagtattaagtatttttatactctaatcaagtaaacaactgtgatttttcaactctgaaaaaaattataaaaaaaatttgaacatgaaattatagaatttcaggttctttgtattgaatcttaatcattgccaacagtctacatttacatacatggtaaagggctaattcatattttaataatgactattcatataacatatgtggatataactgcactaaaggagaatttctaaaacataaagtgatttatcagttcagtcactcagtcatgtccaactctttgcaaccccgtagactgaagcccaccaggcttccctctccatcaccaattcctggagcttgctcaaacccatgtccatccagtaatttatagtaatcattaaaccatatactagattagtgacaaatgtcaaatgggctatttcttgagatatttcaaagtagagtagatgccacagaacttggatggataaacatttatttttctgagaaactgagggcttgctgtgaaaatttcttaaggccattttcagtatcagccatccattaacactagttcaaattatttctcagctcttgagaaagctgccctttagatttgaattaaagcttatttattaaattctgcaagtttagaacttcaatgtgtacatgttattgagataagcctccatttttgttacatatagattctatagtcctttaccaaaattactagagctcttcttccaaaatctcgctcatgctcatgtacatctagctaatccatgtctcttctcctgcctggtctacgtggttctcccgtcgcccaaggacagtgaagtccgtagctgtacagctggagtgaggtgacagagctgtgctaagctcacaggcacatctttactcatttctccaaaacataagaaagtcagtgcctcacagatgctatcatttatttcctcaagttgatagctattcacgtggatgttagttcacgtaacccccagaacttgtaaaacagttatcagttattgtaagtgggtagctgtagtgacttgatgggtgccacatcctttatttattgatatggcaagcaacattttccattcacagttacaagcaaatgttacaccattttaagtgacttgagcatccacaagtttggaatctgtaggggtcccagactcaatccttcgtggatactgaggacaactgtattttaaacttaaagatgatactattttttatagataatttactttgaaattgttttaacattttgcttttctgtaatgaattgataagcatgattgctaagttta

SEQ ID NO: 62259 - DNA, 1354 bp, Bovine  19866880563521
acagacatgagctaagggtatgccctttaatgtggttggtcactgaatcacatcgtgcaaaacattgttaagttcagatgatattttttggctagccagcatttctgtatggatgacactgtccatagactcacattaagaagtgacctctttgacttgagtagtgaaaccaggaatgccatccagtcatggcaaccattgtgtgcatagaccaacacaaaatgaccagttcagttttcctgatatgtaatttaaaagacttgaatagttctgcagctgtggtattgggtggcacaaaagggcacaacatatcatcatgcacatcctcctgaaaaatacagctcacagaaacaagcattgttgccttgttgttaacactggtagacatgttaagctagattgcataccatggtgactcattcatcttctctaccaattgtgtttcaatatcttctgccatttatcaattcatctagctatggtactgctgaaagagggaaatgttccaccttttgaactgcagtttctccaaaatgttcacaacagttgtcctcagcaccaggcaggattgactcttcagtaagaataaaggacttcttagctttagcaataaagtttgccactaagaataatgctctcagtgcagacgtatttgatgatgtgaaggccttcactaattgcttctgtttttcattttcatgtttttccttttgaaaaactccaaagccttgtcttttgaagcaagggacttggtcaccatttggtgaaacagtttggacagtttcatggctttattaaaattagtgtcggattctgatttaaagtctttcccgaaatgcagctgtacaattgaagtacatcaactcatgtgttactgaacagcttgctggcagatgcagcttgtcacttgccactcactgatagagttttgatatgagtctgcaagcaattgacttattttagtctctgtgtcatcaacctctctgctcgtgataatctgtgtttgcaggtgctccccagtgctggcatcatcccttcagctccacctcagatcatcaggcattggattctcataaggagcactcagcctagataactcacatgtgcagtttacagtggggttcgtgcttctgtgagaatctaatgctgctgctgatctgacaggaggcggagcccaggtggtaattacgcaagtaatgagaagtggctctaaatacagatcaagcttctcttcctcacccatcgctcacctctttctctgtggcctagttcctaaaagcttgcacaaatacagatttccatcatgtatcactgaggtttgtttggaaataaatcatcaagcccaacaagactg

SEQ ID NO: 62260 - DNA, 1185 bp, Bovine  19866880590940
tctcctggaggggaggtggtcttcctaattccatttctgataacttggagaagcatatagtctccccagcaattctgatttccccaggtttcctgttttcctccttcccataccagagacctgtggggagagagagagagagagagtgtacacgtgtgtgtgtgcatgtgtgtgtatttggggtcaaagaggaagatgacgacccagagctccaacacgcactgcccacctccagaaacacccccttccccacgaagagggaaggcggtctggtttccaggaggatggaaactttgctcctattattatggaataggcagtccaatgaatcatctcctagagctgctttctgctctctgggggatggttcctattttctaggacagaagccttgcttcaggcaggaaatcttattagctctcccactcctcctggtcttcctgacaacctgtatatctttctaaattgaataaccatagttcctacttacaggtaggcattgctttaggttttttttttaactgttagatttaaatcaggaattgaaaagtcaaacatagtgtaatcatcacctagatcttttatgtgtctatctcaggccaaaacaaatgtttatgtggcttacacaatatctatgccttgcagttatatctcttcattagagaagttattcttattttttaaccaggaattatatggcacttactaggtaccagacaatgttttacgaataatcaccatattccttaattaatctgagagttctctccatcactgttatgtccactgtacagaagaaagaactgaggaacagagaggtttgctaatgtgctcaggaaggtgcagccagtaatggcagagctgggattcactctgagcagtctggctccattaatctgtgaactaatcatgaaattgagcacatgtatctcagcgtaacggagaagctgtggtgcacagaataacatccccatggagatgcccacgtgcacatgtgaaaatggtgtgttcaggggaaacagggatcaaagttgcacatggagtcgaggctgctaatcagccagactcggaatgggcagattaagctggcttgtcagagtgggtccaatggatcacagagatctttccaggtgagaaagagaaatgggaggtttgaagtcaaagtgggagaggagatgccagagg

SEQ ID NO: 62261 - DNA, 2851 bp, Bovine  19866880675133
ttacacagttagtctcatgtctccttagacttttctagattgtgacagtttcccagacttgtttaaaacaaagtaagttcttaaatgtgggagctgtatcatgatgctaggccattttctggcatataaatatgtatgccagatatacctatgaccacagaatagctcagctggtaaggagtctgtctgcagtggaagagaccccggttcgtttctttcgtcgggaagatccccaagaggagggcatggtaacccattccgattctttgcctggagaatcccatggacagaggagcctggtaggctacagtccatggagtcagaatgagtccaacatgacttagcgactaaacaacaacattttaacatatacatgtgtacatgcatgagtcaaatattctgagaatgcaccttattccaaataagttattctgaatatagtaacagtcacattttcataataatattgcatttctaacactatgcagaaaaagctgaagaattgtcttccccatcatactttcttcctattctattaatcttcagtctttatgaaaatgaataactttacctgtcaaactgacctgaatacatagtctaagcaagtttgccctttttctcattaaatttgcagcctgtctagcttataatgaccccaggttaggagacgtaattaagtgatttggtttaataaaagaccttcctctttagctcctgctaaccatctctggctaagcagttctcatgggtttataaaatgtaagaaatgatctcacatttgcaatggaaataaattaagtcttgccactgaaaagcatgtcacatgatgtgtgtgttagttgctcagttgtgtctgactctttgcaaccgcatggactgtagcccgccaggctcctctgcccatgggattctccaggcaagattacaggaggaggttgtcatttccttctccagggcatctttccaacctcgggtatgaacctgcatctccagtgtctcctctgtctgcattacaggcaaattctttactgctgacccacttggaaagcccaatacaaaataaaaaaattaaaaaaaaaatcaaatccctatttatgattttaaaagtgagtctttgcaatctaagaaaacatataatgtttgaaagtgagagtcactcagctgtgtctgactctttgcaaccccataaactatacagtccacggaattctctaggctagaatactggagtgggtagctttttccctcctccagggggatcttcccaacccagggattgaacccaggtctcccgcattgcaggtggattccttcccagctgaaccataggggaaacctaaaaatactggagctacaatgtttataatattacaaatttattgttatttaagctcagaataaagcactgcttttattcaactatgtaatagaagttctggtcaagtggctacttttttttttttttaattttgatcttttcctaggctgacaataatgctgtctgagcttctcccgtgatgctagggggacacccagctgcagcccaccgtcagccatggggtgggtcaccagggtagacaactgatacatttacaaccatcctgtacccaagtaacagccattatgctgttcattttcagtgaagtactcaatatgttacaggatatctttaacatttcattataaaatgtcattcagtcgccaagtcagatccatcaatctgtgaccccatggactgcagcacaccacgcctccctgtctttcactatctcccagagtttgctcaaactcatatccattgagttggtgatgccatccaaccatctcatcctctgtcgtccctttctcctcctgcgctcaatctttccttagcatcaggtggccaaaagtattagagcttcagcttcaacatcagcccttccaatgaatgtgaagtgttgatttcctttatgattgacatctttgtgttagatgattttgcccaactatagcctaatgcgactattctgagtgcatttaaggtggccaggctaagctttgatgtttggtaggttaggtgcaataaatgaatttttcgactttaagttttttcaacctactatgggtttattgcggcttcccaggtggtgttagtgataaagaacccacaaaccaatgcaggagatacaggaaacaggagttcaatccctgggtcgggaagatgccctggaggaagaaaatggcaactcacttttgtattcttacctatagaactccacggacagaggagcctggtgggctacagtccctggagtcacaaagagttgaacacaactgagcccactaagcatgatgggtttatcgagatgtaaccccatcataagttgaggatgatctgtctatgttttaattgtgtggaattcctatcctttttttctagtaaatatttttagtagatattttccccgttgaagttcctaattactttttatgtaatggttttgccagtgttgtcaaggacaaatatacattacactgagcccacgcagcaaaaatattttgctgattctccataatttttgtcctttcgatggcttgatttatttttagtgcttttaataattctgtctagaacatttttttcccaagggcatacaaatattgtgaaaccctgaggaatatttttttgtttctaaaaatacatcaggacttcaatcattcaaagttcctcatatcagtaagacatgtaattggtgcctcagtgagtcaagcaagatgccggttgtgtaggaatattctggagattctttccatcaccataaaaaataaaaagactacttttaattggcaaagtttgactgatttccctttt

SEQ ID NO: 62262 - DNA, 959 bp, Bovine  19866880700031
aaaacacgggcattgtatgtcttccctactgttttggttatgggtaaatatcttgggccaacagacatttaacaaattctgtactgttagacccatacattaagccacaaaaaatcagacaccgaaattactcattcagtcattatctattagcagggtttctcacccccagcattggcatgtctcattcagtccctaaattttgaagacttgaagggaattcctcatcaacactgtttgtaatcagatctaatcagggaaaggctacttagaatactagttaatgtcatttatgagacagtattaaatattgtcttcaatatcaatcttattggccttaaactcaaataaaacaaaaacaaaaaaatagctgatggttgaagagaaggctagtagtggggaccctactctgagtgtccttcttgaaagtgttttagctcattgctatgagctgtggtttcttaatgtatctttgttgggaaatgatcagacacagacagcagataccagaattttactcaaagattattgtgggtttttaggcactaaaacaaaaaaaggagttgagatatgatttccacatttcccagaacgttatgtccacatccttaaggatgaaactgaggacatttcgggtagctttgatgtttaatggagaaggaaatggtaacccactccagtattcttgcctggagaataccatggacagaggagccttgtgggatacagtccatggaatcacaaagagtcggacacgactgagcgactaacatttgatgtttaaagaaaacgtcttaaaagagattgtgttaaagttaagattaatctaaatggaagaacgtcctgaaaaatatatttgcaatgtctctaatatatcagactatcattccaagtttgaaatatattaataatgtatttttcaggaatttttctattatacagatttattggggattttt

SEQ ID NO: 62263 - DNA, 960 bp, Bovine  19866880777994
cacctgccggtgcaggagacttgggtccgatcccctgggtgggaagattcccctggaggaggaaacggcaacctcactccagtatcttggcctaagtaatcccacggacagaggacccttgtgggttacagtccatggggttgcaaaagagtcggacatgatttaaagactaagcaacaacaaagcataaagcatgaaacaagacatactccatttataccaggtaggacccctattctgattattgtgaaggattccgtgacctttcgatcaactgccaggaaattgagctatttgcttcagtgagtgcctctgtctccctctgagtctacagacctcagaataacattggattattagcaaacctacataaaatcatcccataactctctttggttttagtgtttgtccgtacttacagctaaactgtcaacaaatagtttttcaatagttcataaatattactaagaaaatatgagatccaaaaataggaaacaaaaccaagaaacctgttattgccacttcctaatgtctttttcctccactcaaaggcatttaatactttttaatagttgaaattatatttatctatcttctgatgccttgcacagacacaggtagcaaaaggatagaatgattaactgtctgtgatgctactaaacccaagctgatcaatttttcttttatctgatttcctacagttaaatctgactagaatatcatcatgctaaattaccttttattttgagttactaggtgtatttaactattaaattaattttgaatcacatttttcaaacaggctcagtgaggagaattttaaatggcccttttatcaggtaaattaagcaacagcttgcatatataaccagttatacctctcacccataactatgaaaaataaccagcttagaattaattggcaacaaataaactgcataactgtaattccctatcatt

SEQ ID NO: 62264 - DNA, 1372 bp, Bovine  19866880792645
tctttctctgtccccaacacgatcatttccatatttcaattataagacactagaaaagtttctacaaatttccaactggactagtacttttaaaatgttctctcgtcgtccaacagtgaaccagcctcgtcgccttcagggcactctttttaatcaggtttttaccctagtgctgtaggataaattaaataggatggccattaattaggattgcagtcatgcacattcatttagacgccatcgccagaatctaagtctccacgacagggccagagccaaagaaaacagcttgactctgctttaaaaaaaaaaaaaaaaacaaagaaaaataatcttcatcttctataaatttatggtaatgtgttcttcttacagctttctgcgggctggagaggaatggaatattttaggcttccttgcagcttgagttaaggaaaatccctctgggtacttaatctaacctctttcctctgtctcaacactcccatgtgtcaagagtcagaatggcttatttctgagatagtttttaacactgtatatgctgccagtgagtttagggaacaggaaatctttcattttgttttattggagtatagttgatttacaggcttgtgttagtttctgctgtaagcaaaggcaacttatacatatattcactctgttttagattcttttcccatacagatcattacagagtactgagtagagtttcctgtgctatacagtaggttctcattgctgttgctgctgctgctaagtcgcttcagtcatgtccgactcttagtgaccccatggactgcagcctaccaggctcctccatccatgggattttctgggcaagagcactggagtggggtgccattgccttctccaggttctcattagttatctatttaatatatagtagtgtgcatatgtcaatccctgtctcccagtttatccctccccatccttttccccctcagtaaacatgtttgttttttacatccatgactctatttctgttttatacaatttttttagatttcaaatataagtaatgtcatgatatttgtcattctcacacaggagatcttttagattttgtaagctctacattcaatccaccaacactcctgacttgctatcttctagaattaaaagaggggctggacctatctcacttctttttaaagcgtccacatgcctattgaaaatcccatgccttgtggagctggacatgacttggcactgtccctggagccaggccctttgctagagaaaagaattccttaccttcgttgtatagcagaggctaaatgtgcggtcagcatttggacacatcccccaaggaagttttttcgagaataaaagaatggtatatacaaaagca

SEQ ID NO: 62265 - DNA, 1987 bp, Bovine  19866880797399
tggtgcatctgccgtgtgtcgggggtgtgacagaatgagaacacttatagcccaaattaaaatgtctcctggtgtctcccaagtgattccgaaatggaaaaaataaaagccaaggtcagaaaaatgtcaccatttgaacaagctgtcaagcagcctccaaggaaatatgttcagatgacttctatatacatagagtaagttagttaagtgagaggatataattcaaatgtgccttcattaagcctatcagggattgaaagaaagacatattcatttcttctgggaagaaagggcttacttttctttcttcctttaattctctctgcatgctcactcactcagtcgtgtccaactctttgtgaccccatggaccgtggcccatgctctgtccatgggatttttcaggcaaggatcttccccactcagggatcaaacccacatctccacatctcctgaattcgaaagtggattctttaccactgagccacctgggaagtcctaaattctttctactcctccaaaattctggggtggggatcaagaaattgcctctgtattatggtatcaaaaggggttccctttggcatgggacatcatgggaagaaggtcactaacaaatgaactttctaggtctttgcagcaggaactgtgagactgttaggtccagaaagtgcttacatatactgactccctcaccagcagactctagtacccgcctgtccacctatatgtcagtttcacattggtgtcaacaggtgtattaatataaactattgagtccccaaatttgcaaggattgtagtcacaaagttttactatttgtcttaaatatgggaattccataatcttgtagttgattgtttaaacatttataagaaaatgaaaaaaaataaggtttttactctcatgaaggaaataaatggtataaatgaatcatttactggtaagagatgcaggagtaggaaattgttctttctgctcagctcactgggacagaaactgagaagaaagagaagctctgttgtcaaagagatgcagacacatcatgggacattactctatgacatgcatgtgtgtatgtgtgtgtgagtgtgtgtgtgtgtgagtattcagtctttcagtcatgtccaactctttgtgacctcatggactagaacccaccaggctcctcttgtccttggaatttttcaggcaaggattctgggaagtgggttgccatttccctcttacagggcgtctttccgacccagagatcaaacttggcatcccttgtgtctcctgcattgacaggcagattctttaacactatcatcacctgcgaagcccgctctataacataggtcctctaaactcttttccttctgctgctgctgctgctaagtcgcttcagtcgtgtccgactctgtgcgaccccatagatggcagcccaccaggctccgccatccctgggattctccaggcaagaacactggagtgggttgccactctttttctccatacagttaaaacctcatgtctgggctacactggcttggtgcctcaacaataatgccttaattgagctgccgtggacagctatgcccttgtctcttatcaaagattattttaaggaatagccacatggagaaaattatcttattttcagcaaagtgcagatcgacattatccagtacagtagttagtgtctcttaagactttataccatatatatatttttaaaacattgaataccgtgtgtatctacttagtatgttgcatatgtatgtatatactcacacacagtctggctttcatgtttcttttttgaatgaaatctacctaaaatcatgtttcagttttattttcttgggaaagcaaagttaaactgattttgttgtcctctttgtttcctaagactgtttcctccttcctttccatcattttatgtatttctatttcagggcttttacttttatttgttcagttttgtatgcctcttttaagcaaa

SEQ ID NO: 62266 - DNA, 2100 bp, Bovine  19866881022147
ttgatttcgtttaggactgatgggtctgatctccttgcagtccaggacactctcaagaatcttctccagaatctttgtgtcatgtaaaattttatttctctctgggtgacagagtggctattccctggtccccaagttgtgttccagatgccctcaggcaccacagcaaactcacagggacgattcaggacatggtgcagtttcacgggaagcaacaccatctgtcagagcttgatggagttcacaatttcagtgcctggctgacatagttccccgttttaatgttagatcaccacagtcctgtcaatggagtcatatctctgcaaatcctttgtgtgtgtgtgtggtttctctaatgaaaagcaagtactgcttgaaaaccaacgtggaacagacaatgagggtgactgtgtccagtttgattctaaggtttccactgcccagttcattgaagcttcgagttctgactcctcttgattgagaaatgtctgtgatactcagtgcatactttatatgggttcttttaataaaggcagtggtgaaaggacttggcagagttgaaatgctgtgcaaatacaagttcttaacaactttcactaatatactgttgtagtttcctattagtcaagacatagaactgaaagtttattcaactgaattgaattgatccctgggtaaactttcttcatcatgtttctgtaagagaagtgccttagctgactttcatccccacttgcttcctctgcttttcctctagtaatagtactaatgactagcaaaatggccataagcctgaggccaaataattgttattattattcatatttatatatattttaacatttttagtatattgtgacttgaatgatccactaactgtgaaggtgtgtgtattagtcgttcagtcatgtccaagtctttgcgaccccatggactgtagcccaccaggctcctccagccatgggattctccaggcaagaatcctggagcggattggcatttccttctccagggaatcttcccgacccagggatcgaacccaggtctcccgcattgcaggcagacgctttaacctctgagccaccaggtaagcccaggggaaggagagggcgggacaaactgagagtagcaaggagacacatacacccccatgtgtggaaaggatagccagtgggaagttgctgcaatgtgcagggagctcagcccggtgcactgtgaccccgtagaggggtggggtgcggagggaggtgcgaggggggttcaagagggaggggacacgtgtatacttatggctgacccatgctgatgtgtggcagaaaccaacacaatactgcaaaggaattattctccaattaaagataaatttaaaaacaagatatagtccaaacttaatcatcagttctcagtatgtcatttatggtattagagtggctagggacatatttgacctaacttgactgacctctctttgactagctttggctcaaggacagtgaaaaaaaatttttttttcatcccaccatattgttttgtttttattttgtgtttaaaaagaaggcaatatggcacaaatgctaaatacacatttagagccttagtggaaacaccatagtggaaaatgaatcctacttgtgaggaggtagtttaaaattttagtctttcaggggtaatttaggtttgacgttttgtgaaaatgccttcatgattcacagggtttttagaagccagttaccttagtgattttatttatctttctgaaactgtctgacagttgaaatgtacttggttacacctgctggcagttgctagttttaaattacaggaaattgaaagcaagttgcttctgggacactgaacttagaatttctttcttattttggcaaatgctgtgtgactagtagtgtaagtaataccactgtaaagtttttgtcttaatatttagggatgcctcacattaaaacgagcagatagttaaatttattcaaagacataggtgtacaatagacctagatgtgtatctgcaggcacatacatgtacacacacacacacacacacacacacacacacacacacactcagctttagaaaataatgaatat

SEQ ID NO: 62267 - DNA, 781 bp, Bovine  19866881079368
tgaggaacataggtaaacatcagtacatttcctggaaatggatgttaacagagactaattatgccaaattagttattcatccctaaacaagcaatcccctgacctgaatgtcatccaggtcttacctcttgtttgtatgattttgggcaactcgtgtgagtctcctttacttttatttatttatttggctgtgccaggtcttgaggcatctgggatcttatttccctgcatgcgtgctaagttgctccagtcatgtccaattctttgggaccccatggactgtagtctgccaggctcctctgtccaggggattctgcaggaaagaatactgaagtgggttgctgtgtcctcttccaggggatcttcctgacccagagattgaactcatgtgtcttatgtctcctgtagtgccaggcaggttctttgccactactgtcacctgggaagcccagggatcaaaccagggtctcctgcattgggagcagggagtttcagccacttgaccatcagggaagcccctgaaaatcatttaatcatttccttgatttgcaaaaagtaccactttccctactcatttcatcaattacttttgaggatacaaatatattttaaaccattttaaaaacaaggaagtactataatgaatgcatttgaaacaaataaaaatctttcacattttaatacaaaacaattatttgcgccaatgacattaataagctagagatttaatagtcacacaaataaaattttgccaagtcaaagagagtttaatcaagtaatt

SEQ ID NO: 62268 - DNA, 1192 bp, Bovine  19866881106961
agagttaaactattgaattttacaaagggttttgtcatatctttttatacattctagcaattacctttttaatgagaccagatgtcctgaactttcttacacaattgagttatcaagtaagagtcaaagtcaagtatatttgttttcagcacaaaatattatgacctgtactaaggaaaatactattttcttctgcccttttatcctctctgcctacaggagataacatggttatgatcatattacatttacactgaatatcaactcctctttctttcactgacttgtaatctgttgactacagcatattttgaaaggatataaggctgcaccaccaccatctggctatttgaattttccagcaaagatattttgggcaatgaattattttactgttgagattctcctggttcatgaataaatatcatcaaggatttctgtctgcagggaagaatgacctctatctattctatgaactcagtgagagtgtttgaccttcttaaatccttgacacaaaaatacaatatggatgcaaatgagttctggatttccaaaataagttccctccatgacaccctctattacattttacaaatccagccaaagagagacagttcaaagcactccataaagtgaattgaattccattctgtttccaggtgctcacaaatgcagaggctaaatagaatcttttagaaagcacaggtcagagagaaagaaaaagagagaaattgtaatgtaattgaggaatgaaacatatagaggtggccaaaaagatagttaacaccatccataaaaaaaaaatgtgttttttctattgcactgagaaacccaaattctatgaggtattctcagcaattggaaatgaaaatctagactgaagccttcattgacttctctaaggcctttatgtggaccacaacaaacagtggaaaattcttgaagagacggatataccagaccaccttacctgcctcctgagaaacctgtatgcagttcaataagcaacagttataaccggacagagaacaatggattggttcaaaattggaaaaggactaagtaaaggctgtatactgactccctgtttatttaacctctatgtagagtgaaaatgaaagttgctcagtcatgtccgactctttgcaaccccatggactctacagcccagggaattctccaggccagaagt

SEQ ID NO: 62269 - DNA, 814 bp, Bovine  19866881592243
ttttattacaggtggattttgttgtcccaaaaacgtccaattattggagaaaatccaaaaggtccatctcgaacttcaatatgatcaaatttgcactcccaagatggttcaatagagtacttttcatcaaagtaaagttcaatgcactgtcttggggcagctaaaaaagagaaaggaagattatgtctagaaggtccttttttaaatttgtagtttgacttttcggattctatttaagatttcatctggtataataacttctatccaactttgtgacatacacagaaacactaaggacgtttgtttcagttagtattctacgggataaaatttctgtaagaatgtctaagggatgattcttaaaactgaggaggttgcccaaaatattattctgatataaaaagaccatttcaatgtctgacacaatgaacaagtcacggtatttttgtgagaggctcccaattcaggtttaaagagtggagaggcgtctttccgttacttctcccgtatcttcaggagaagccagttttccggtcagacaccacttgagatctgcttcgcgtggagttctacagtcattcaagtagtcccaatcagatgtcttggttagagcaaaatgtgtgtagaggaatatgaaaagtaactcttccagaacacaagtcttatcccatcattctcaggcttaaactcgttcagagaccctcagctataaaggaacaatcaacaggatggacacacagctttcttcgaagcctcctacagctcaccccagcaaggctcttccacctcacgaacagcccgagcccaggccatt

SEQ ID NO: 62270 - DNA, 1861 bp, Bovine  19866880123096
acatatatatggaatttagaaagatggtaacgataaccctgtatgcgagacagcaaaagagacacagatgtataaaacagtcttttggactctgtgggagagggcgagggtgggatgattcgggagaatggcattgaaacatgtataatatcatatgtaaaatgaatcaccagtccaggttcgatgcaggatacaggatgctcggggctggtgcactgggatgacccagagggatggtatggggagggaggtaggaggggggttcaggatgggggaacacgtgtattacccgtggtggattcatgttgatgtgtggcaaaaccaatacaatacagtaaagtaattagcctccaattaaaataaataaatttatattgaataaaaaaaagcagctatttcataaaacttttaaatgtttcctttcagacttgtgtgtacatactcaatattttacagagtaaaattgtatagttataggtgtaattttgtgttctgttgcactttgctacatagtttccattataatcattatgactgtgtgaggtctgggtcttactaatattcctctatgttggtcatgaaggttgtttcttctcttattagaaatggtgctatgatgcattttctttatgttacacacctttttttttttttccctttgaggatatagtcacaaaagtggaattactaggccaaagtaagacacacacacacacgtgtgtgtgtgtgtattacgtatacacatacatacactaagtgtgtgtataaatatatatacttatgttttactgcttatattgtgtgtgattgtttatgcatatgtgatatacacatgtatacatatatatgaggtgggaagtgagaaataatattactacgtaaattttactttcaaatgtaaacagtagatgtgaaggaaattattaatagtagttggtatagtcaatacctttaatccaaagttctttttcagaaaaactgtgatgttttctttagaaaataagattaggataatctagttgactgaagttatcaagcacacatttttgtcagttaaattttcaggcaaatagagtatgatgaaatatacttttttttttttttttaatatactgattattgagaagactctccacagctgtagagcctaagggtacacatctctgaaagcagagtataagaaggtaggttgatctgctctgtaggacacgatgaagtgtcatgtaaactcattctttgaaagaaattcttatgcacttgtttccttaacgtttgtctctttaaaatagatgcagaatgtgggataagatgattgggttagcttctcgcacagttaggtaactgatacatgatttcaaattctctagtggtagacggggagatgcatgaaagaaatttgaggggtttgccatgacactgatgagctaggaatgactttagtgataaccgagagcttcattttttttaaggctcggaagctgtgtgcttggtagtttagtttgcactttctttctttttatgaatgtacatatttgaagtcttaattcaccgcttctttacacagtttggcctcagtttcatattttactccttcacaggaatttgtaatcagcatatattgcctttcttttatagttttatgacctttgtgaactgttcagaactggaggtcaggttcctgacacaaactacatatttatggtatgtaaacaccagtgataacaactacttattttattttacattttttcacctacttattttaaatggagatctgtcttactacatgtagattatataatactttcattgccatgtgacagtcactatttaaatatgtaaaaagtattcaatacttcgc

SEQ ID NO: 62271 - DNA, 2515 bp, Bovine  19866880366967
atcttggagctaagcacaatgcatgtctccccatgaacattttagtgtctctgcacggagaagggttatctccttagtattcaatctgagatggaaacatggaaggaagattggtccgtttcttaagaccacacatttcaggattgtgtcattacttgaactatatactccacaggtactccagcggaaagtaacaggggcatatattttattcaaacagccacatgaactacttttagtgtcagagtgagcctgaagagtaatcagcccaggccaccgatgtagatttcactcaatgcagtcctgtgttgtaatgtgttcttaagtttgcatgctatgcattaaaagtaacactgtgataaggtcttctcttgagggctggcttgtaggtactggccaatggattaaataatgacaacaaatggcaaacacgctgcctctcgtcatgctcaggcccagggcagacatttttaatcaatcaccgagttgacgttgctctcagatccagcctgagatgctacctcagcgcaatgctctgggcagtcattacaaacctgactggagctggtgtaagacaaagccctctttgcttctctaaggtatgtgctactgtacttgatacttctgttaacaaaatactgtgatcagaagtgttatgattatgcctatggactgctttatgaggagagaatggaggtaaccatggaaacttttggtagaggttattttataatcttacacaataatgacatggatggaattcatggtatatgttcagtgatatattcttttagtgatgtggagatggtcaatactggcaattgagaaggtgaagggctcaagttagcacaagtggcatgactatcaaaacacttctcagcctgagaccctgtgctgggaaaaccaggctgacctgcccaatcagtaaaaacaagccttggacaaagaaataaggggcaagaaagtcctttgaatactgtgagactgcatttcccaaaccgcacaattaagaggagattctgagccaacagatctgggacgaggccaggagttggtgattctgatacacggtcatggtaggaactgctgctttacagtagcatgtaaatgacaggccttccctgtcttgattcttacatgggtttattggcagccctgtggctggtgtgtcataattaattcagtttctataagccagataacaagaacttattgatagtatactatgggcttcttagatcatggctggcattcgccatctgatccttttcttaactttttgaccacatcatgtggcaaacgcaattttagttccccaaccagggatggaacccatgccctctgcagtggaggctcagacttaaccattggaccatcaaggaagtctaccttttgatgttgtagagtcagtttccctaaacctacttcaacctgccagccttgggatgtttgggtagcaaccatgtcttagcaacccattccagtatttttgcctggaaaatcccatggatggaggagcctggtaggctgcagtccatgaggtcgctatgagttgggcgcaactgagtgacttcactttcacttttcactttcctgcattggagaaggaaatggcaacccactccagtgtacttaggctccttgagtacactcttgagtacgctccagtgtactcaagaacttcttgcctggagaatcccagggacaggggagcctggtgggcttccgtctatggggttgcacaaagttggacacgactgaagcgacttagcagcagcagcagcagcaacatgtcttagtgcctgatcctgcagtcaagcgtacaggagctcaagttaatggaaaaaaatttcaacttagcataagttcaagcaaggtctacccttaaagggcatctgtgcttttaggcccaacatggaagggaagcagacaagatgaaaacaaaatccaaaaacgtttttgggaaatataggaacggtcaggcatgatggccttgtctggtgagttttctgggctggtagagcaaggatggcaaacagatttcagcctaagaaccaacaccaactgattggtgggtgctgcttctgggctgtgttggaaaggggtcaggtctgtgccagagggaagaggtgcagtgattggtcagcactgtgaatggaggagggtctagcagcacacacgctaccctgacactgacctccagatgctaggggacggagaagagtaaaggatgcagagcatgtttggaatgggccaactagaagtaatcacttccttggtgaagggacactattaatgaccaaggtgtctgtcatgtgatggactggactgagtgtacgggattgagtttcagtcccagttctgctactgggatggatatcctactgtgtatgtgatgactgagggggagggcaagacagtacttgttaagtaacagctaagtgccagtaagcactaagtgctttatatgcatcacaggatttcattaatgcttccaaatgtcagttttctgtca

SEQ ID NO: 62272 - DNA, 1104 bp, Bovine  19866880418969
aacccccagagatctgaattcttccgcacccctttcctaccaccctcagggtaaccctgtcattgctgggactgcttcctggtctggcctcatcgcactccaacaccctctggtgccacagaccagcccggggcaccgcacacacccacctgtccacaccggggatgtcctcgcttgttaacttgtctctaaaagacttgcccatgctggccctccagctcaacccgcacctccatgggacacattcctagacgtcttcccacacagtgctcggccgtcagagaagcccgcctatgtgtcacaccacctgcagccgtgtccacatcccccgtggctgtccttggggccagacgtgccaatcagattccctcctccaggcgcctgcctgtgtcagccccacgtgacactctccctggccatcagggcatgctgtccttgggttctgggagacccctgtggccctcccagaaagtcctctttctccttgagctgttctgaagtgggtttccgcttctggcaaccaaaggagcattgctccagagagatgtgcagtcacagctcagcaaacattcccagaccaaggggcagctggtgacacctcggtcccagaggcctcctgctaaccagcctcagaaacaacgctccccccgtctgctctgcagactttggtgctcctgagactaagattcagcatatcctattaggcgttctcatccgctgtccttttaattgaagcagtggctggtcatagttattaattaataatatatcacccatattactgtaagttcacctctttcccggagaaaccttcttggaaactttatttacagtagctaattcttcagatctccccaaataaactgatatatgctgaatgtctggggccagaaaagtgaaagtgccggtattttatcctggaaacatcacggtgatatactcaccgtgactataaattcaatattgaaaaacctagctaataatttctgaaaaacctcgctttcggtcacttgacaaatgtagcctggttctcaatcgtggtactgaaatgttagaattcttagctgaaagttcatcattttgtgaatgtataaattacctgtt

SEQ ID NO: 62273 - DNA, 1649 bp, Bovine  19866880425654
ttatttaatacgagacgtatagtagttccattacggagaatttccaaggtcacaaaactcaactgtggctgggaagatagggaggagtgaaataaaggcagtctcttctcttttttttttaactgaagtatagttgatttacaatgctgtgttaatttctgctgtatagcaaagtgatttagttaaaattatatatatacacacacatatgtacatacacacactcattttttaaatattcttttcctttatggtttatcataatacagggcagtctcttttcatgatgatactaaaaagtctgaattatgttcagtaaacaaggggaaccacataaggaccttaagcttgagaattacaagatcaacttgcacagtatgtgaatcaattacagattcaaggtaaggaacccagtcaggaggctactctaagagtctggcaatggggtaataagagttaaacaagggttactgaaaagaaagtaaatgtaagccatatttgtgatctttaaattcccagtaatgctagaaaaagtaaaaagaaaaaactgaaattaatttgagtaatagtttatttaatccaatatatctaaaatattatttcatgaagtaatcaacacaaaaattactaatgagaaatttgccatgctctttttgtactaatctgaaatttggtgtgttttttaatacttaaaatatatgcctcaccttggacattaagtttttcattggataaatttgatctgtatttagatttcataatttacagatgaaaaagcagattcacatatccaagttgttccagatataaacattttccaataattaagtatccatttttaaatttaaattaattacaactaataatattaaaaattcaggttctcagtcatgcgagccacattttggagtgttcagcgccacacatggctaccatattgcccagtacaggcctaaagagtgacaagggaactttggctactgacgccttccaccatcagcatttcgtatctacttactgttaaggttttccaggtattaacatggataacttagcaagtactattacagcgggtcctactggtcacatcctcactactgtagctttctttctctaggccagtgccaacatctgtgaaaaaggaatcttcaaagactacacagaattgctatcaagtacctgacacgtggaatgtgctcagaaaatggaaccgacgcacgcacggaataatgcacttgctgcggactattttgtatctattttcctgtggttcagctgtttattacactctatgtacaatgaattttttaaaagttacctattttcaattatttatttattagaggcattataatgttaaaagcttcagctctggagtcagactaagaggattcaaatcctggttctatcattgattagatgtatgatcttggggaaatgcccagtttctcttgtgtctcagttctctcctgtgtaaaacagtgtacacacttccttggggagcttcaaggattacagaagataatacaaataatcacctgcacatcgtacctggcacatagtaggtgttcaataaaccttagcttttaaacagagctggtgaagaagttaaattacggctaatgtaaaaaaaaaactaggacttctca

SEQ ID NO: 62274 - DNA, 1438 bp, Bovine  19866880535483
tgatgacgaggtgaaccgctccaggaagagtggctgctgggcagcctccacctgctgtcccaggaactggacaatgaaaggagaatctggggggccgcccccgaggtgatctgccagagcccctcactccacctgttctctctccctgcaggtcacgcaatatttaaactcacgtatctaagcaatcacgactataaacacctctacttcgaatctgacgccgctaccgtcaatgaaatcgtgctcaaggtgagtgttccttcttggcccaggcccggggtgtgcagggctgcacgctccccccctcgcacccccgtcccacagcactgatgaggctcccgggccagttctgcagagacgctgcgctggcttacaggtcgcccggctgttgcgcacccaggcctgggccacatcgtaagtcagctgctctgcgctgaggggctcccacccctccagtgtgtgactctggccagtcatatcacctctctgggcctctgtttctcctcctgtaaaatggggatcatgttagctaccctgctccaccccaccaaagggctgctagagagaatattaaatgagatgcggtgagcctacctagctaagtgatcattcattttccttttaagagtagacatcatccaagtattaataatagtagtacaagtactaagatctactgaagggtccaaagtgcaggatctgagccaggcacttgacctgtcccctctcaaggagccttcacacctcggtgaggtagtgatataaaatcattcccattccctagatgaaaaccgaggctcaggggaaaacactcagccaggattgggacttggcagaaccgcagcctgaccccaggtctgggggattctagaacctgtgctcctaaggccccaggtgtgcatggcattcaggaatttaaacaggagatttcggtgaaatgaattgtttcacagaaacattttgagtttacaaaagattttcaaaagtggtagatgagaattaaaaggataaagctgccaggaggagaatttagagccgagacaagagtattgtaaccagttggatggaaagcagaggatttgtagactaccccaggtcagagcccatcagaatagccagcgggcggtgcctgcctggagtgcttgaaaccagtgatctaagagttacctgcccacgtccccaggccacccagggagctcatgccacactcaggggccaggtagagaaatactcccattaccccgtcagggctggcctttttttttatagccaacattaaaatattcaagacttgagaaggattctagtaaaattataatcctgtatttgacatcaaaataattttcacaacagcagattgatgacagaaacacaggtttatgacttcagtgcgagactgcggaagaacaagtgcagagaaatcattttccaggaccaa

SEQ ID NO: 62275 - DNA, 1495 bp, Bovine  19866880597641
tgcccttgagggcgttgtctgtggagagaagaccccgtgttcacatccgaagcagcacccaccactgcccgggatcctcccccaggcccactgggctgccagcactggggccatgggggagaggaggggctggcccctgaagagtgaaaagccttgcaaagtaggaagtggagagggcttcctggtcggcagactggctgtaagcccctcaggcgagtggcctcggtcaagtcccctgcctcagtgggcctcagcttccccttctgtgaaatgagagtcgtgaggtctaccacgtcaagctgttgtatggattagagaaaaatgtataggagacatttgcacagatcctggcaaatgtgaggcgccggacctgagacccctttccctcctaaagaaacactttgtaccagtgttttcatttcctggatccaatctccggaggcagaaagccctgctcccatgttacagacgttgtctttgtctggacccaccctctagtctctctcatccgggatttgacaccgcaggtagggcaggccaggtgtggccagcttcccatcccctctggaccccaggtctctgtccccttgttcatctcctaactcccatctctcagcttgcttgccctcccttcttcttccacccctgctggcatgggctgtactgaccggaacttcttcagctccatagcactggttggggccctctccggtcatccctgacctgcgctcccctgggttggaatggctggggtcagggaaatagttggaatgggtagggaaagcagtaagactccgtggcacagagcagggaacgaaaatccttcagcttactgggctctagtcccattaactcgctgcaaaagctggaggtggtcacttcacctctccgaacttgtttcctctcctggatcaactgcgacagcatgtgtgcaaggattcaaagctgtgataccagagacagaggaatcgtgctgtcgttactgtagtggcagggctcccagagatgtcctgaggctcatgtgacttctaccttgtctcttcctgctgggcttcccctttgctcagggtgtagccaggccccactggggagcagcccctggtctctagggaatgaaggcacaccctctggccagcaggcctcagccgggcccaaccttggcacccagccagggcagggcttgttcccacaggcctcactggaagagtcagatgcctgcagctgttcatgggcagggccctggccaggggtcagcggctttacacggtggccaggctgaactggcaggactcagagctgacagctggcaccaggagctgggagaagaggcccctgagatctgagagaccaagaactgaggggctcttgggagactggtccctcacagttccactcctggcccccttgggcatgggctaggcagaaagcctcagtggaggaggtgatcagcaggacccaggaaggggaagcaggctggggacacctctcagggaca

SEQ ID NO: 62276 - DNA, 1417 bp, Bovine  19866880714391
tgaacggaggaaaatccctcgtctgtatttttctgtcttttaccaaaacgtacctgggtgacaaggttaaagcatgcagaggaaatccctgacgcttatcatccaccggcattactgataaattgcgtggtgggggaataaaggattaccttctgtattttttcattacacttttcttttgttacagaatacataaatccattgtggcacaatgtaatatgtatcaccatgctacacctgcggatgcttccgagcggctgccatgtctgtgcagtcaggaatgataagtgaaccacccgtgaatgttaacgatagtgatcattctgaggtaactcggctctccatcttcctttacagcctccgtgctgcagccagggtagcagggttcatgagaggaaaatgaaaacaacagtggagggaaggggcaggcttggcgcggaatgtgccttctcaagtgtgcgggcgctggcgcaggggctcggcagcggcgaaaaccagcaccttttaaaggagaaagaggttgtgacccctgcgtcctgcatgctcagccggacttaatgaaagtttctttgggtcagcctcgcactccacttgctcctctcctgccagacagaacgcctaccttggatcctgtcccaagtctacgggacttaaaatgtttctaggacaccaaggggactggatcgaggtgcttcttagaatccatggaggtgcaactgttatgtgatgttcccatttaataaatggatatggaggcttgctaccacaattttcagcttgacttccaaacagtctgggttttatgcctcatttcttcatatccagggttttttatgggctttctaaaatgtctattgaaatacatcctttaaagctgcctttatttaatgttgggcactgggtctgagacggaggagaggatgatctcggggggaaatgtgtgcagcaggcaggaaggtgccagccctgcctcccttccacacagcactgtgttccagtctcagggtggtgacccgtgctggggatgactcggccttggacagacaggcgggtggatggacagatggatgggttacaaacccactcttagctcagaaactgctcctccctcatggacagatggcttctcttctgcccgtgcagggcattctaggggcgggcactggaccaaagcagctgcccttccacggccccctgggctgctggtggtgggttcaggacgaggcgccacctcagggagctgactgaatgctgccaggaatgcttcagtcagttccaacttaggccctgtcaagtctcgtaaccactgaaaaaaacatatgggcattttaaaaaaagattactcacttgaggaattcagctctgtcccagtgcaaagccaccggttaccagaggcaagtttttatacctgcattaa

SEQ ID NO: 62277 - DNA, 1173 bp, Bovine  19866880726709
tggctgtaccttaccagcaccggttaacctgtactgcatccttaatctgtaactgctactgttctgcggagaaggcaatggcaccccactccagtactcttgcctggaaacttacgtggatggaggagcctggtaggctgcggtccatggggtcgctgagagtcggacatgactgagcgacttcactttcacttttcactcttatgcattggagaaggaaatggcaacccactccagtattcttgcctggagaatcccagggacggaggagcctggtaggctgcagtccgtcgggtctcacagagtcggacacgactgaagtgacttagcagcagcagcagcagctactgttctgagagtttgacattaactccgtgttctctaaacctcacatctgctttatgaggagctttagctccaatattgcccctatcatatactgacgaaatcatccgtcggtgatgggcattccaaacccaatcggtcaaacaccagaacttgaatgcttggctccttcacactgttggcttcacccagtccactcccaaactcttattcatctttcaagatcctgttcaaatatcctctgttggatattcatatctcccaccagggtacacctagatccccagtttgtcctcttactgctgttgagttctctgtggactgtgacaaatgatctctgtgtgattgccacctcactactattccccagctccagaggggaaggggagtccttagagtaggggcgggaggtggggggtgttgagccggggaaggagacagaggaggtgggtcttctgggccattccttcagctctaggttctaagatgagttaggatcagatggccttcctagagccaaaacttccctttgtcacagacttctggaggtagtaacttccccttccctggatatccaatcaggagctaagtggcactgcagaaacctctggaaggcctctggaaggggttttctaagttgactgtcaaagatggacagaaaagttcagtcaaactctcagcccttggaagcagctcctcctcttccttcagagtccagctccgttgtcaactgccacacaaaaacctttctagatcttgactggtcaaatccctgtgttctcactctcatcattataaccccaactgctgagggcaataatcgctgag

SEQ ID NO: 62278 - DNA, 796 bp, Bovine  19866880743148
cattgaaatctcttggcaggtgttctctaagctttaactcttctcttatgcaaactaacccctaagctgagccctcctggctttatcacactgagccttgacaagaaccatcattagtgtccaagctccactttttccaggctgatgacatgtgtcagaccttgactcctgatgctacttctgcctgccaactcaggaaagacttctgtaatggctttgggttttttgaaatactaaagtcacatggcagcagctgacaccaactccctcctgaggatggacacttggccaggagcccaagctgaagtcgatttggaggttcttgatctttttagaaataattcctaacatcccactggcaattaaaataaaatcctccccagagaacagccaaaggtcgggcaagcctcttccatccataaaataagtcacctctgattagagaaaagtgttcaagtatagcagcaactgataaatgtcagagcctggagggccttcacagagttttgataacttacagctatttctcatttcataccatggacggttttaagccaacaccactcagcattgcttacttagtcaaatggggcaagtcagcataccaaactcaagtcaatggtcctgtttgcactagttctgggttcatccctaaggctaagacgtttgacctgtcaggcaaatgacctgaagtgccctgcagaatgcccaagaggacattaggaaacgtctgcaaaaagctggctttttcacggggagaagttgtgtaaataaataagcgaacacacacgtgcaa

SEQ ID NO: 62279 - DNA, 3218 bp, Bovine  19866880768035
aagctgggtctgacttctctgcgtctttgctggccttgttacatctctaattagctctattcctaacacatgaaccaatgtttttaatttttaaaaatgctttaaaatacatgctgactgcaaaattgggtatgtatatatgtatatgtataagacataagcgtctgcttactacccactgcccccagcctcactccttacagggactggttgtgaacagtttaggggtgggtgtccttctagtgacttctcctctgaaccctattttccctttgtaaagtgtaaacagtgatgcttggtccaaggggctctgtgaagggaggtgttgctcagtccaaagaggcaaagtaaacagagtgcctggcctggatctcaaatataataggtgtgcaggaaatggctgcttatttttcagcggttaccaataactccttgtgtgattgtgccccttcaagcctcagtcacccacctcggtctccccagcttgcagcccagggtcaaaccccatttactgccctctcactggatccagaagaaattagttctggcccaaaaaatcaggggagatgtagaggaagggatgaaactcccagaacttaatggcctccttggggtgactgatctcactctgtcttcagcatggggtacaatcccattttttgcaggcaaggagaccagggttggagtgtggaagtgacttagtcaagaccacctgactagtgggcacaagagccagaatggataccaagcaggtaggtcccttctgccaagccactctgatggcaagtcagtaattcagtatcctaaatccctgtattaggataggcccagtggaaatcttgaaaatgttttttgaatgaaagaataggtgaatgaatgaatcaacggctacttgatcaataatcaatgaatatcatatatagttaccatttgtacagctttggttttcttttcacatccctcatttcacgtgattttttaacagtaatactacctgctaggaagcttcatctctgtttcacatatggggaaataggtttgttttttctttttggccccaggccttagcatgagaaggagacagagctggaactcaagcccaagttggctgaagtcagaggccacgtgagccgtttccactggccccgctgccctctccacagtgccggggccagccctgggagctcctgaaaatggcgtgctactgctgttgctaagtcgcttcagtcgtgtccgactctgtgcgaccccagagatgacagcccaccaggctcccccgtccctgggattctccaggcgagaacactggagtgggctgccgtttccttctccagaaaatggcataggtcaggactaaactaagtgctcatagatgctgaaacactaggcgcttgcactgatgcctggggaagggatacggggcctgtctgctcaggaccgtgtgaatgatgggctttgggatacttgcccaaattctcctggatgcccatcctatcccagctgggtttggtctccctggagccctgcataggaaggctccagaagaagtggacacccagctctggtctctctgtgtccttcctggctctgagggagaagggttggaggaaagggtggggcttgctcaggtcctgaggcatctgtgaaggcagttgaccaagattggcatctagtggacgaattcccacctcctgaggttttggggggacatgaccctgccctgctcaggaagtcaaaactgggggccctagaatcctcttccccacctgcgctgggagccatgggcttggcctcaggtaggggccagcctccgcctgctcaccctctcccctttccttccttctttgtttctgccctccacccccactgccttcctctcaccttcatccctccctctggctctggctgaatcctgcccctccacccgctgagcctgctacctggctctgccgggtctgagagctccgggaggagggcctggccccctcgggccatcagggatgtcttctaggcaggcttcaaggcctctggagttaaggaggtatctgccaaatgcaaatcagggagaggatctgggagggggaatggggtgtcgggggccctggaccacccggggggcatccacaggaaacagaaatgagagctgagaagaggtgaggaaatgcgccttaaatgccaggctaaggggcttcacatgcccagaccagtggttctccaagtagatgtcatggaacccagagggtacaagaaggagcctcagaactccttggaggggtgaaaggtcaggaggaggagacccaggggtggaattctgggcccctggccccactccagccagaatgactctaatttcacaatatttacagactatgcttgggaagcagtgaaaggcattcagcgggatgagggcgtgagacccacctgggctttaggaagcgagtgctggctgccagagaggaagaactgggctcatacaggcctcctgaccttttctcctcacgtcaccaggaggtaataataataatagcaacccgatcatcccagtgccagcacactgcgttacctcatcaggcggagtgggtacctgtgccggtggggagcttgagggctcgggagaggaagagactccaaaccagggtcaccacccagcatcaggggcagagtcaggatgcagacccggggtctggtgtaccccgggagtgcctgacccccaggcagcccagagcagctgtggagcagctgccatgggatccgatctcgggctagagccccctctgcccacctgccctcccaactgtctcagccacacctggcacgcatataccctgtggaactctgaccagccttgtgctgccctccaaggagacagctggaaggtgggggttgggagacaggagtagggtgggggccagaaagcagaagcagctctggcagggcagggagagactagccgcctctacttgctgtgtgaccttgcgctccttgtcaggcctctctgggctagggctgctctgagccacctggagctggggcttcagggtgagctacatggaactggtggcttcctgggttcatctgttcatgcctgaaacagcacactgggccccacggggtgccaccacatccttcaccccagggccagagtgctgggagctgaccgcccgccggtgagatcccaggcctgtgtctcagcttcctcatcagtacattgagagggt

SEQ ID NO: 62280 - DNA, 1357 bp, Bovine  19866880819723
tttgacttttttttaatatatgctgttgaaatgactagggaaagaagtatctgctgttttcaggtgagaagacccttaatttagtgttgtttggtagagcaaggactaaaatctgttttttgtctggcactctttcccattaaaaatgccttctgagctggcttctaaaatacaacaagcaaagttcatactgctataaaatagacgaaattcgattaacagtactagtaacttaattcactgctcttttcagatccagtaccacccactttaagttgatagagtgcccttgccactgcagacttaaaagtagaaatccaaatgtactaacgtttatcagtgacaactaacaatttttgtgtgtgtgacttctaggtgaacgacccctgacgaaagacaatcaccttctgggaactttcgacctgactggaattcctcctgcaccccgtggggtcccacagattgaagtcacctttgagatagatgtgaatggcattcttcgagtgacagctgaagacaaaggtacaggcaacaaaaataagatcacaattaccaatgaccaaaatcgcctgacacctgaagaaattgaaagaatggtcaatgatgctgagaagtttgctgaggaagacaaaaagctcaaggagcgcatcgacacaagaaatgaattggaaagctatgcctactctcttaagaatcagattggagataaagaaaaactgggaggtaaactttcctcagaagataaggagaccatggaaaaagctgtagaagaaaagattgagtggctggaaagtcaccaagatgctgacattgaagatttcaaagctaaaaagaaggagctagaagaaattgttcagccaattatcagcaaactctatggaagtgcaggccctcccccaaccagtgaggaggaagcagcagacaaagatgagttgtagacactgctctgctagtgctataatattgtaaatactggactcaggaactttcgctaggagaaaattgagagaacttaagtctcgaatgtaattggaatcttcaccttggagtggagttgaaaatgctatagcccaagtggctgtttactgcttttcattagcagttgctcacatgtcttggggtggggggcaaggaggaattggctataatcaaaagtgggttaaaaaaaagctgggttagggcgtgtgttcaccttgaaaatgttctatttaacaattgggtcatgtgtatctggtgtaggaacttttttctaccataagtgacaccaataaatgtttgttatttacactggtctaatttttgtgataaagcttctaattaggttagtcatttaaggttagactctcatgtgttggga

SEQ ID NO: 62281 - DNA, 819 bp, Bovine  19866880879206
aattaaagtgtaattagcctttacgcttttatattcattaactcttctctgttaatgatgctaggctggagcagaagccctgcattacgaaaccacatccaggaaataaaatagtgatttagataatggccacaatgcattgctacttacacataattaaacaaatgctccatttaaacttggaaacatgactgaatgttgattaaccctcgcccagcaattctgctcggaactggggaaggggaggcaccgtgagctcatccgtaacaaagtgtctggaccagtcacgtgtgcccactacactgccagccatgcccaccagccccacctgtgccggctgggtggctacaggtctcatgccaaggactgtggccgtggatggaggtgaccgtgaaagttatcccgggaccacttaagaaaccacaacactaagtgaaacaagccagacacaaaaagacaaatattgtatgattccaaatttatagaaacagaaaggagaaaggtgaccacccaggggcagaggctagtgcttaatggatacagcatttcagcttggggtggtgaaagatgttgaaagattctggagatggatggtggtgatggttacataacaatgtgcacacacttaatgccacttaactgtatcctttagaatggttaaatagtaaatttcatgtataatttaccacaattttttaaagcttatttaaagcattaggaaaaaagggaaaagtcaccacaccccaactctactgcccacaaatacgaaaagtctgaatttcaccttctcagagatcaattcacaggttcatcacgact

SEQ ID NO: 62282 - DNA, 1849 bp, Bovine  19866880882823
catttattgaaataaaccattggttatgcttctaaagttttccattgatagcctttctcattaagtatattcagcctattaaagagtagccttaaagacccatgtataattatgggatatgagcagttattttaatgactctgtaatttatatcatgaggatatagcatatctaaagcagccttcaattaattagaagaggctatttaatctacatgtataaaaatttcaattaaaacatctttgctaaacttcttgtccagttttattatattttgtatggttcaattgattgaaacatccttgaaaatagttactgtgttgaagtggtaaaacactgattaaggatttactctgtatcaggcatatgctaagtattttgtatatattatttcatttaatcctcacagcagcctgtgtgtgatataggtagtgtcactggtttacattagttcacagatgtgaaaatttctctggtggctcagagggtacatcgtctgcctacaatgcgggaaacctgggtttgatccctgggtcaggaagatcccctggagaaggaaatggcaaccccttccggtactctagcctggaaaatcccatggacagagaagcctggtaggctacagtccatggggtcgcaaagagccagacgcgactgagcaacttcgctttcactttcagtcctctctactggggttaatatgacctacttcagtgtgtcatgaggattaaacgagatagtacatgcccaccttgaagtacatactccagaaatggtagctgctattcttgctttttttgatttcatattttaaacaggtagtggttcttacgattcaaaaatgtaaaaaggtattacacagtgaaaagcctctctcctgtctgtcctccattcatctagtgcctacccatacccattttactagatattccagagtgtccatgtacaaatttaaaaatatattcttattttttcaccttttacacaaaatgttacatactactaacactgttgcagagcttgcttattttacttcacaatataacttggaaatctgtctgtattagtgtccagagaatttctagaatttctcattctttcctattgctgcatagtattccactgttttgaaatattataatttatttagccagttctctgttgatggagacttgagttgtttctaatattttgctattataaacaatgcagcagtgaataatctagtacatatggcattttgcaagtgtgcagttatatatgtaggataaattccaggaagcagaattgctgggtcaaagggaatatgcctttacaattttttgtcagtattgccaaattgccctccataggggttgtgcccattacactgttaccagcaatatatgagagtgcctgtttcctcacagcttcaccacagaatttatcaactgtttgaatttttgccagtctaataggtgaaaagtgaatctgtgtcattataatttgcattttccttatgagtgaggttaagcttttcatttgtttaagaaccttggcagttttgtgaacttcccagatgtattagattcttgatctgtttctaattttctaggagttctttatatattaggaagattagtccagtttattgtgtatctttgaactttgtggttttttggactatacatacgtttttttatatagtgaaatttcttatttttttctttatagcttctatattttgaattcatttgtttggggaggtatctttcatatgctctgcatatttcttaagttttactcctagatatttgcagttattgctattgtaaatggggtcttattttctgtatgtttctaattatgt

SEQ ID NO: 62283 - DNA, 751 bp, Bovine  19866880888614
ggttgatgggcagttctctttgtatagcccattatcttaaataaaatatacctaaaaacctgaaaagttatgtactatccccaaagtatctcctcctttacatctctttttctctgagtagatctcaactctttgagtcatcctttcctgaaatcttagtcatttttgactcctccttctcctataattaaaatgcagaggtccattaatttgaccttttcaagctttctcatgtcttttctctcattcaaatttccactataacattcagttatttattcattaaataaatatttgttcaaattctatataagctagcatttctgccccccagcaagtaggaattatgtggtttccataatttaacatagaaatgataggtcccattaaatacttgtgaaataactcgctaaatgaaaatattgggttgaaccataagaaattattgtttttctagggtcaaaatggtcaaatgtcagcaattttgtatactcaacaaaaatatttctgatatgaaggagaaaaatacatatcaagttactcttaaatagtaacttaatgacaagttcaagtatgttaacagtaatattaacgtgtacagtaatattaatgtgtataattaatgttaacagtaatattaacatgtaagattttctttcttcaaactgtgtaacttgacttttctctttatttgtttaccaggaaacacggaattatccagaatcatatccacagctgccaagggatggaa

SEQ ID NO: 62284 - DNA, 1314 bp, Bovine  19866880931283
atgtggaggtgacaactggatgacctggtttggggaaaaccatgacactcggctggatggtaatgagacagtaaagggctgtctccaggtaaactcgccagagcaggctgcctccatcgctgactggcccagtggccttaggcaagatgtggttgcctcccagggagcctctgtttcctcacctgtgaaatggggcgaggacaacccctctcctaacatgtgcggccctctcactggagggccggcccgccagcccaggctaggtgttggtgtaggaggggccccatcgcgcctctcctccagaaggtctaccttgaggagctcgggtgcctgtttcttgagtttctccatcttccactcgttctcgcaggggttgagtgaggagggcggcgccgtgcaggagcagcggcagtcggtgccggagctcaccgtctccaccgtgtagaagtcctccacgcgcgcccgcccgctgcgcacccggctgcacgcgtccttgctcagcggccgcatgatgcacttgcagcggcagtcggagccctccgaggtcatgcgcacctggtccacgtcgccgaacacctgcagagaggccgtggtgagctgaaggccagggctggggcgaggggagtgttccccttccctccgtccttttccttcaagcccaccctgagaggccacacacccgatgtcttaagtgtggtcactgggggcagcagaactttcagcctgcaggagtcagctgggtgagatcagtggcaggcaccaggctccagcctgctttgccctcacacaccagtagggccctgggagtcccagccagaactcccctagctggctcagcccgcccatcctgggctccaggctctcagggcacagctatttatgactcagtcaacaaacccacacctttgagctctcactgaagccaccaggacccaggcaaattcaaggcccccttgggctttctgccaagcccacccccatgagcatcccagcgtcctctgggaagggcagtaggcactccatttctgctctgagccctcagacacctgtttgaagccctggcctctgccagactctgggtaggagctggaggtgcagaagaagtagacagaggggcatccttgaccttctcagccatgggagaagttgatgcagtgagccctgagatccagagaaagacacccatgaagactgctcggaggagggcaccccgggggacatttctaagcatgagtagaacagtccagggagagcaagtcagatgtgcaaagacaagcaaggactgggcaccttgggagcctggaggaggttcat

SEQ ID NO: 62285 - DNA, 1618 bp, Bovine  19866880935084
ggctatgctgctgctgagtcgcttcagtcgtgtccgactctgtgcgaccccgtagacagcaggcccaccaggctcccccatccctgggattctccaggcaagaatactggagtgggttgccatttcctcctccagtgcatgaaagtggaaagtgaaagtgttggttatggctgttgatattacaaattctatggcttctgattgggaaggagtaaagtctcctatgttaatacctcatgacttttgcgcattagatggaggacagtagggttttctttgtgatgaatctttggaatttagaggctccagtttctcccttactcctcaaattcctgatagggaaggcctgctcattcttgcttattttgaaccaagaaataccattgttgctgatttcccattttgcttgtcagtggttgtagacagcaagtttgggacatgtggtatgtactggaactggatgaggaaaaccaattttgtccaattcatatggcctccgcctcccttttcagtggtagagcagatgggtagccatgcttagaatatgggcagctgttcacactctggccgccttcctatgattcctgggcttcctggagtccaatgttacggcacaggttcaggctaagttcatttctacaagaagcatctctgtaccctgcctattagcataagctagggacaagggcagtcaaaggtcaagagaagttcaaaacagcataacctttctctgcttctgtttccaaataaccccagtctgccctgctccccaagttttttttctcagccatcatgtttactgtgtagttgtaaaactcaagagaacaacgactgacttgatacaagggaagttagagaatagaagtcattgttgcttaaaacaggagaaataattgatttatgtttgggggccaattaggctataaaacaggaacagtaaagggacctatgacttcaggacagctacttgctctgatttctgtcccacagacaaggggctccccaataaaggctgtcagctttctaggctaaattattaattcctttcatgcctctcagggattgtaaacagcacataatacaggaaaacaattgatactcttcagttattggccagatagagggtcaaagggtaaatagttggattagcaacagctgttcttcttccctagtcagactttgtcccttattacattttagcaaatccattcctggatttttggcctctgaatagttaaatccattcctcttcttataaaaataatcctataaataattggagaatggatattgaccaaaattgaaaatactgatattttagttcagtttctgtagttgaaggtgagcattctttttggtatgtgctaactggaggttgtttggtattcaaagggtgtttcccaaggaaagtaacaaccttgaagtttagacagattagtagcttttttagctgtttataccatctgcttggaggattttcctgtagcttgattaaaagacagaaattgcctttatttaaactggttggtaggataatggcatgttcattgtggaaaacactaaaagaaaaatacaagcccctaattccatcacctggaaataaccattgcttcttatt

SEQ ID NO: 62286 - DNA, 1063 bp, Bovine  19866880940285
actcccacaggtggggcaaagagcccagcaagtggatgtgggtgtgttctgtgtggcccaggccaaagaggcctcttcctggggactcaccccataatccaacacccatccccaccagcagcggcctccacatgactgcaacattccttccctcctcagatgaggtgctacgtcctgatgggggtggccaaggccctgacacaggccaggaggcaggagtcagaagaggacctccactccagccccagctgccaggagcctggggcaagggccccacctcctgtggtcacagtgtcctgtggtgcttgactggaagcagcagagcctcatggaaagaagccaggcctgggctcacatcccagctcccacatgtcctcctcgcatggccctgacccctctgagtctcagcctcctcctctgtaaaatggggaggataacagtcctttccccataagcttgtcctgaggctgaaatgagtcaatgcatgtggagcacctagcttagaacagctgctctctacttgctactgaagttgctgccaataacccttttgcacgtttgtacgtagttttctacctctgtgctctcaccacaaccacacatcttggagaggagaaatctgagtctcagagaaggtgagggatttgcccagggtcgcacagcacagcctgactccaaaatgtagttcccatgcaagtcaccaggcaagggcttctccacagcaactgagctgggagagagatggtggccctggaaggatcaggcctcggtcgggcaggggaaatggatctgatccattttgccctcagtctgcaggctggggttactgccaagcaggaaagtccctgcctgagcccccatctttccctgcagcctcactcagcacacactgctgctaaagcccccaggagtgtgggtggcttgtgcttaaaaagatccccagctatttgcaaggaaatcccacagtaagaggccaagaaggcatgtttgatatttctgaagagagatggataaatcggccagaatggggaagtggggtttcaacctagaaaatttctaggaa

SEQ ID NO: 62287 - DNA, 1637 bp, Bovine  19866880974169
tggccttgggaatgcctggttctctccccaactaaacagtaagcaattggagggtaaggaccagttcttggcttctgtgaaatccctggtgcctacacagtgccttcggcataactgccccccaataaatcaatggacttctacttttgagcagaagtagaagcctggtctgatcggctctggccctgcctagcagcttatcctctgccccatccctgctcgagaaatttggagtattgtgactatacctcagaatacccctgcctggcatgtttttctcacttatgcatctggcaaagtcctagttaatcttcaaaaaaaagttgtcaaattacttactccagagtatcttttctcagaccgctgcctcggccagcagtttttaagcactctcttatctgtgctgctttagtagctcatgtaccatattctagtgcctctctttttgagtctgtttccacgtcaggttttctacctgacttctcatacggtggctggaatggagcaggcagcactggacgacggtcactgcactaagcagggtgtctcagagccttccggagctttcgggcacacaaggccctctgtatggtgcccctgattcatcctctcaggatgttacagctcaggaaaggaaagctcagaaaagtaagtacatgatgacacatttggttttcttactctaaaatacattttaaaatattttaaaaatcaggatacagcttaaaatccatatgtacatttaatatagtagtatttatttctttcttctctcctgaagtgctattattaaattagtggggtttcagaattagtccctagtgggtcccgggaaaggtcccagaatgcatgcgccccctctaccctcacggagcttgctgggagtctttgtcttttctcttccttccatttttttttcccctttaatctaatccatgcctgtgacttccccagatggggtgaatgaatagattttgtgatggaaaaggaacttctgaaagattagcaactagtaggaagagtaaatgctggtcaaacgtagttttggtgaatgatatatttcgaatttttctgatgtggcggctgcaagagctcataacaccgttctaaaataattgggtctctaaagtggttccaaaagatttttgcttgacataaattctctaaatttccaggctttctggataaaatagttgactgtaatgccatctttaatgtgctctgctctatactcaagaagatccatcaggagccgcagagcactccagacagggggaggctcaggtgagatgaaaccacaagataaagaggcagagaaaggaggcagggggaatatttaactccaagctccttgcaggggccacttctgacttgtgagcatcttggcagtccacatttactgtatcattttcccactgggtcactggacaccaagcatcaggtctttctttcttatccaactcctacacatgagtgacatctgcatgattacttactcttttaggagggagaagttttctgcagaaattactgcccttttgacaaagaacatttaaacagtcctatttaccttttctttctcctttttaaaaagaggattatttgctacaacataaggaaagtacctgtctgtgttt

SEQ ID NO: 62288 - DNA, 870 bp, Bovine  19866880984896
cctacaggaaaaataccactttgacatctggaacaaaataatgcaaaaccaattgggaaatctatttataggtcttaaaaatacaaacagaaagattaaacattgttgtacatctgtgttaaaaatagtcaagttcagaacactccactacttctgattaaacctaataaacttctcactttgacatctggaacaaaataatgcaaaaccaattgggaaatctatttaaacgtcttaaaaatacaaacagaaagattaaacattgttgtacatctgtgttaaaaatagtcaagttcagaacgctccactacttctgattaaacctaataaacttctatttcagtagatgaagaacttttggaaaaaggttactggcaaaagttaccttttaaagatacgtcacagttaccaaggggaaaagatggggggcagggatggataagttaagagtttgagattggcatatgcacactaccatatatggaatatatggtcattagggacctatcatatagcacagggaactctgctcaatgttctgtaataatctccatgggaaaagaatctagaaaagagtagacagatgtgtatgtgtaactgaatcacaactaacacaacactgtaaatcaactataccctgatgtaaaatttaaaattttttaaatgaaagatatgtcatgaaataatcacaaataaaataatgtctggaacatgcctaaacataatcacataatcaggagaggggatgaaaaggtgggagaagagatgaaacaactggccaggtgtgtatgtgtactgttgcatctgggtgacgggtaatggtgctcagtgtactgttctctcctgtattgtttaaaggtccatatttaa

SEQ ID NO: 62289 - DNA, 1669 bp, Bovine  19866880994658
tattcccagtgttaacactgtcgatcagggctctagcaggaaacagactcaagttagggattttgaagagtctcacagagacttttcaaagctgtgggtggggtaagaaagtccacaagagataatgtgctagaagcattgggcataaagggggcaaaggcatagacaagaaacacagaaagagcaaccatagctgggggtgaaccaaaggtaaaactaagctgtgacctttggccatgggatgcaatcaaatagaagggacctcacgtggagatggctgggggaatacacttctgatcacactcttccacccagttcttttggtgttccccactggcgccctcaattacaagccagagggcaatggagccctgctgatgcagtccctatgggccttcagacacacagagaaaggcaggggatgggtagagagtacaccaagaggggcaaacaacagacatccagcacacccaccaagaaaaacgaagacaagagctttccaagtcagtgtctaatcacctggcaccctgctgccaagaagtggtaccagtgtactaggtactggagaaagcattttccaagccccagagaagaggccaatattcacaaggagacaaaaataagatgaactaaccttttcaagctgatccactttttctgaccattcctaaaacaaaacaataaagaagtacagtttccaggcaagagtatcaataaaatcaagattttcagaaaacaaaataaccctccccaccccacccaaagcaacatatcaatcaaacaaaacagcacattaaaaaaaccacgatgttggcttaacagtaagaaagccaagagtcctaaaaggagaagaaaatgaattttatataaaattctagagcacaaatataagccagaaaacttctaccaagagcacataaagctatatagctcttctgatgcagctttcagcttctttctgagtctctgtctctgagtactattattatttcttaggagttggtagcagggagcagctgagttggtaactctgcagttgatacttaaaaattaatttactgaaaaagaggtgaacagcgtggtcttcaggagtccctgatcattattttccttctcattttaatttttaccaatatccttcttgccatctggtaaaagttaaagaagaaaggattatgcctcttattcaccaatcacagaagaggggaaaaaataaccactgggacaaaaggctgtatcctaactgcctacaatcaagtccaccaatgctagattatttcttcatttacattcacaccacagttattcactaagtattgctgaatgatgttttctcctagctggttaatgtctgagatgactactacacactgtaaaacaagccaaccaaccaccccacttactgaagatgaaataaattatgtgttttcttcaatgcaatgtaatataatacattgaccccgtcttaataaatcaaaattatcattataatgcaagcatgctaagtcccttcagtggtgtccgactctgtgcaatcccatagacggcagcccaccaggctcctctgtccctgggattctccaggcaagaatactggagtgggttgctatttccttttccaatgcatgcatgcatgctaagtcgcttcagtcgtgtccgactctgtgca

SEQ ID NO: 62290 - DNA, 1161 bp, Bovine  19866881020101
tggatggataacaagaaagtaatctggctatgtttgtcactataaatttcatgtgtttgcaatgctgttaaaattttttaaaattcatctctgaatggtatgggaaacttaccaatctttgcaaaaggtcaccaacttcaacacaaaacacttgcagacgcagaaaaaagcccttcggatgaggaaaatatcatagggtaatagctaagggctttgtgtcgaaagagacttgagttcaaactgaagctgcattgctcatgggctatgtgagttcagggaataagcttcatctccttcacattccacttctacaaaaacggtacaattaaccagaggtggctgtgaagtttcgatgagatgatatatgtagtgcctagcatataacagaggtagaaaaataaatggtagtaatgataataaagtctgatggaaaataacttcaacagtaggtcaaccctgaagacaaatcgtggatgcatactggagcaacaaagcagcagtgaaactgggcgacatgctctatgtgccaactggagtgactgtgtctgctgtgctctagccttggggcccactgagcctcggggagtttatgaacagggaagacactgatgaagcaagcgatggacagcacagattatttactgctgtgtaaatcatcctgaggaatgtctgtgagtccctagcaccacagaggtttcaagggcaaataataagtctattgatcaaagcggaaagccaaacattggtatcagaagaattctgctttgattgtcatgggacgcccccaaatcccctcaaaacaaactcggcaaatgtcacaggctaagctctgaaagccaaaagactcactgcgccaagtgctcttctcccccagttcttgaatataaagtgtgatatcacgtattcattcaaaaagcaactgaaatgcctaggctatgctatagtctgtcctgagcactgggaacacagcaaggaaaagaacgaatggttcacccagttttacaaattaatggaagtcttctctgggtcatcatcaaagtttagcagtaaacagggctcccctaccaaacctgtaattgaacatataaggggggaattgactaaaattccatatgctaggcatgggtattgggttctctgtgcctgtatacaggaatcatg

SEQ ID NO: 62291 - DNA, 1038 bp, Bovine  19866881032865
tctgactccacagcccacactcaagtcctgtggacttctgggagatagaggtgggatttgaacccaggacctactgccttcaggacccagtgctcccttagcctcccttgggaggcaagaagtaaaacaaagccagacctcagaccgtgggatggctcccagcacatcaaggcagaaaccgcagctcggaagcaggccagcttccaggcgggctccgagctcagctgagtccgaggaagtggctttggatggagcccctgagcgggtggaggactccccaggggcctggctggggcagggcctggactccccagatggcccaggagttggcgggcatttgtgtcgaccgagtgttttgcagtaattactgtttcctgcctccaagggcttccaagttcttacatttaatttttttaaacagctgggccttgcaacctccttaaaatattcttaaacataaaattcataaacacatattcagagatgacatctctttttgtaatatccatactctctggacattattatcaaagtctgatgttgattgcccaagcccctctggaagaaaacttgaaatatgccgtcagaaccgttaagggcatgggctcctgtccgtgaggcaggcctgtctctccagctgcatgtctccagacaaatcacgtcacctctctgagcctgggtagtgggcgttcttatcaccaggagtgaaagagatgcccagtatcccagtacacccaagtaaactacatcttgggctcggccctctgtaaggtgatgagctggctcctggtgaccagactgttttcctggaaagatgggtgcccttggccctgtctctgtgccttggcctttgctggccctcccatccttctgcttcctcacactgtgcaatgcctcatccatgctcttcaccccacccaggctgcacaggggcttgggtgtgacagtgtctgtcccacggcatagagatggcaagcctgaagcactggtggagccatagcaggcctggggccagggttcccagagcccaagaggcag

SEQ ID NO: 62292 - DNA, 1944 bp, Bovine  19866881122451
ttagaatctggatattaattggcataaaatttttaattgtccttgatttctagagctgctgcaacacaggtacatactaatttttaagctattgtaaaagtagcttgtcggtgcttttggaatcagctgcaatacatagataagtcccattctggctcttttaagaaagataattgttttaaatttatgaattctaggttctgtgttatcagatgcctctattactatatttctgggtgggtttgtgtgtttgtttgtttttcctttggggccgcatcatgcagcttggggatcttagttccccagtgaccggggatggaacctggggccctggcagtgagagctcagagtcctaactactcaacggccagggcatttctctgggtggttttattttaaaattcaaagcaaataatttaaaagcttaaaagttaggcttcaatcctgaagtgggaggatggggaggaattgcaatttggtttttctgaaaaagggaaaaggcagcggcttcacccatcccgcctcctgacgtagaggttgctctggtcactgcttcccacgtgcatgacagtctgtgtgtggtctcgcttaggtttatcttaaggaggcaccgtggccctcggcacagtcagaaatcaggacaataagtgcttacaagacgccccgggacaaagtgcagtgcatcctgagaatgtgctccacgatcatgaacctcctgagcctggccaacgaggactccgtcccaggggcagatgacttcgtccctgtgctggtgtttgtgttgatcaaggtaggtcctcgctaccacccgtgagaagagtttctttgccatcctgattcggggggttgtgcagagggtcgccaggtgttaacagactttgactcttttacaagtttccagctctgtgatacccaggaagaaagtagttaacgtcaagttatgttctgttctgaagttagggttttccaaagaaaggaagagctagattcctagatgaacattttcagctttttaaagcagtgcctgaaggtcttgcttggagctcagtaggtaattactgaatgaatgaatgagggcaggttctctggtcatgtttttaccatcttctttcatgttgaattcttcatagtggttatcacataaactactacattttcctgtcatctttctcctctttgacctcacattttattaattgtaccatattgtttttaaaagcactgacacctcttgtccttttttgactttaaagtgtcaccattcacatggtttattttgaacattttggtttggaggtggggaccctgcagtttgggtgcacaacagccagccagtatgtgttccagtcagctcagccctctggtgatgtctaaagtgtatttgacatatagcttactaattcttaatgttgcggtatttctgcagcctgaactcttagctcagagtcagaaccctgactctgaatcagtgtgcgatgagcctgcttcactcctcctattgcccgttgctcagctcccttccgcaggtgatgtgtttagtccctatgcagagccagtctaagccccttttaaggagcaggccttagcttgccctcctgatttaacacacttgagcctggaggtgaaaagcaggagtttctgtgctgcctcctgcagcagagggcctactctttttttttagtttttttctttctctgctctatccttacttactaaacagatataactcaatttgtctgcagcatttccttccttatctggaatcttgggatgttgagtaaagccactgggattagtgcagcccctctaaggacccgtgaggtcaagtgctttgttaggctagaaagctctagatagtcgagctaggattagaacctgagtcttctttccaatacactgttgctcctcacagtaacttgggtttacaaatagttccaaaaagga

SEQ ID NO: 62293 - DNA, 1278 bp, Bovine  19866881170924
cagttgctcatggggacctgctgggggcacgtctgctaagtttgtaacatacaagaatgtctgtgtttgtgaagaaaattgactggtactgagatactcagtgggttttcttacactctctgtaaactttcttcatctttccctaggacttactaataaacaagaatttccttgtgatgattggaatattggtatcagagtaaaagacatttggaggtatcaccttttttttcctcctgggagaagcctcctttttgctattaaattttcacttaattgttgacttgggccttatgaacctataattttttttaaagagttatataagtataatggaaggtttgcatgcatttacattctccttgattttaattatcatttcctcaagtttttttttgattgtaacactagaagagatcctaattgagaagaaggtaaggggagagattgtttcctaccaaagaaatctgtgggaaagatttctcagctggataaatgattggaaaaatctgtttcccttgcctcctgccaagctccaaactgtgctttcataataaataaatggagtgcttaggttttaagttattcctgtagatgtggaaatagtaaggcattctttcattaaaatcaacatatgtattgcttacaagactcccataggcaacttccaggacagggtaactgtaaccagattagcccttctatcataaatgactggaaaactgcacagaatgtaagaaactgttctcagactttggaaaacaagcagtacaggactgtgaaccccgggagaagtgaaacaaatgaggtgagacctacgatcacctcagctttcttccagggttttccaaggagaatagagcagtctcactgagctaagagacacagatcagagttaggagaactaaaattagcaaaattgagtatggagattgcctggagtatcccagaggaacctggcaggctacagtccatggactcacaagagtcggacacgacttagcgactaaaccgctgctgccaccaagtacgaaggggagggagctataccgagagagctctaggaagaagccctgtaaagccctttactcttctgttgtatactaagctctgtgtgtctgtggtggatctcacgaatctggtcaaaaaacaactgctgggagctagaaactaacattctggccaaaactcaagtttatagctccccagtcattgaagcatccaggacatttcgtcatgactctggaaaggccatatcttaggagtaaggctaaacta

SEQ ID NO: 62294 - DNA, 1691 bp, Bovine  19866881207453
tatttataaaacattagaagcttagagagatttatttcaacctcctcgcttttacaaataagaaacagatgcctatttcaaagaagaataaggtgccatgatcacctaattaaatggtggcaaaatcggtttccagagaactcatgtctccttacttctctttcattacactttgatcacttcagaatttagtggcattttgaagtggggagagaaaaagagaggcagctttaggtccttgactcagaaatatgccaactatagatatctagagcttccaagatgatgaaaatggcgcacctcttcatgacagtttggtggaaggaagaggggttttccagtcagatccggttttcatgttaacacaaacaagaatgagctatgtggccaaatctgtctgagttccattttcttactcataacaggctttctttgatttccttaggagaatcatttggatctcaagttattctcacctgagttcttacagaacttggctgttacttctgcatataacttaccatactgctctttttcttatttatacatctatgttctcctcaagagcaaggattctactgtctctgcattctcacttaagagtaaaatggctggcatttataaggtacttaacaaatatttgttaaatgaatgaatatatgaatgtgtagactgaatcactctacccatgaaaaaaacatattgggtattattaatgatgtgtgtgttaatgagaagaggagcagtaataggctttctttttcttgctggtcacactgatatctgttagccaaatggggttttcaaggcaatgtacatgtgtagagattgcaattcaagacaaggaagaaggcccaggagaaagagaaaacaaaagacacattcttacagttaatcaagatgtgagtaccagcatctcagtttttttatggagaaaaaaaaaacacaataagaaattattacaactatataaaaatgttcaattacatacatataaaaagactagaagaaaagggaccaaaatgtttataaagattatgttaacattcaagcaatgagcacttttttctaactttctatattttccaaatgtcccacaatatatatgtataactttcagtttctttataaaatccatggaattctccaggccagaatactggagtgggtagcctttcccttttccaggggatcttcccaacccaggaatcgaaccgaggtctcctgcattgcagccagattctttaccagctgagccacaagggaagcccttcttcataaaatacttaactacatttttgataagggtaacacattcttactgtggacaatttagaaatatggaacaagacaaagaaggctgggcaatcctctcacttcactacaaagagaaaatcattcgtcctagagactctgagcatagccagcctgattcacacatgtggtcatttactctaccaggttttggaattaaggaggaaataaccacaacaactgcaacagggcctgataaggattaaatgacataattaactgcacagtgcctggcatggagaaagattctcattttgccaaaatttcttctaccacatttaagtttctgattacacagaagatgaactaactatctatcaagagtcttatgtctccctccctaccagagggagaagaatggtcaaaatactcacaaa

SEQ ID NO: 62295 - DNA, 1397 bp, Bovine  19866881234846
ttttaatggctgtggtgaggtgtacatctctttgggggagtatgagatttttatagttatcagaaagggtcatgggttaaagatggtcatgaaacactgcattagtttctgttgctatctaattttctatgattctgtaatgaaaatttcacggaaggcttcagtggaatgagccctacttatttctagtgtatgcatgtgttgtacctacagtttttgtttgcttgtttgttttttaaaattggattctgacactgttaccttagtagttatatgaccatgggcaaatcacttaatctctctaagcctcagttttttcatttgtaaaagagacatgatgataacaccttctatataagattatagtgataattaaataactaaagctcttagcttagtggatggtgcatcataaatgttctgttcatattaattattattattagaggtttggggtggatattaaccacacctctccctgatctgactttggagccttgagagttccaatatagaaatcagaaaaatggaatttaaaatatccattttattattggcgaatctggttatgattggcaaccctattatttcctccactgaatgtatgtcagcattatccaatagaattttgtatgttgatgggaatgttctctatctgtgctgtccagtagggtagccaccactcacatgtgactcctgagtacttgaaatgtgactagtgtgactgtgcaactgaaacttaaattttatttaaattgacttaaatttacataggcacacgaatctggtggctactgtattggacagcgcttctaagtgcccagaacaggtaaggaaggccatgtcagttaactcactcttcccgggacaaagaagaaaccattttccccagtatttcaaatagggcacatattaggtctgctttgtgcctaaagctaagaagcctcaaaatagaaggaataggtccccttatattagtcactgcatgtacagagcattttcttactaaatttaaaattttcaatgccttaatgataaagacttatttttattttgcttcattctgtactttaaatatgaccctagttgtttctttgcaattcctttgttcccttcctcatattctttcttttgggcttaaatattaaagggagtcttatcagcacagcttgtttctagaaaggggaaggttgatgtttcttttgaaatttccccaaaggaacatcgtgcttatagctttgctccatgtatagagattgtgtagtttcgtgatgtcggacctcctatcggccatgagtaactgagtgaattcaagatgacagtattttgggattagatcttacatttgagaattttatctgaaattgccaccacatgtacagcaccccctcccattt

SEQ ID NO: 62296 - DNA, 1869 bp, Bovine  19866881287833
tataacctcaaacagcatgaaactcggccccacaagaacctcccagaggagttgaaattttagctctctgaaagagatttgggggctttgcttcttgttgctattattgcattctgatatcttataaaattacctttgggcatggcagaaacaaaacgttttctccaccaaggtctgttcctgtctgatttctcatcatcgctatctttgcgttcttcagtctgcagaaaaagtttgatgttttatttgtagttggacagcaggataaattactatgaaaaggattttagttagtctgtaaaatacaaaaaccactcatttgtcttcaaagcaaaactgttcttattgtggtacaggcagcttctggaacatagacgtatacctttcaagcactagactgattgattacttgagggcaggcattatcacactactgtcagtaagccaaaagggtaatagagtccagcatagagtaggcactcaataaatactcataagggatgactaaatgcaatgcagataaaatctagagatttggagagaggtagcagtagtattaataataaaactaagtatgtactgtgtgccaaacactgaatgaaaaacatgtattacctcatttaaacttcacagtagccttgtgggtgctaagtggcttcagtcgtgtctgactctttgcaaccccacggactatagcctgcaaggctcctctgtccatgggattttccaggcaagaattctggaatgggttgccataccctcctccagggtatcttcctgacccagggatcaaacctgggtctcctgcattgcaggcacattctttactgtctgagctaccagggcagcaaaagggcttaacaataatatttatagtctcaggaaataaatttattactaagccctctttatagatgagaaatatgaggctaaaaaaggttatctccccaggttccccaaagttatacagactggatgtggcacagctgctcaaagctagatgtgaccaattgcgaagttgctgctttgaccatcaattatgagttatcattaagactacatgtcaaaaggcagagactataattcctttactaatctatgatatgaccttagacaaatcattttattttttggtttctcatctacaaaattggaactaaaaataccttctctgagggcatccatgtgaatgggatatcagaacctaagaagggaaatgagggcacccagggagggttcagtggtgggggtgggatattcattacgagggagactcatcaattaagtacctacatgaagaatcatgaaagcaggcttctcactgctggagaagggaattgcaaacacagaatgagagacatgaattctgctgttcttgaactggaaatgtttctctacatagaaagatagagaaatatgcactggagcatcgggttggcacctaagtctcacaaggctgggggagggaggctctttgtgtctcattccaactttttttagtaaccctgtgagtgctgaaaaattaaaaataacaacttattggaaaaagaaaaaaagcagttcctctatccatctctgaaggaaaccgtgaggtttaaatgagatacaaaatcacttgtagaaaagttaaaagtatcataaaaatgcaagatactacaaaaccaaagtagagggatttttttaatgggttaaggtgctggacataccagactgacaaaccacctttagacatgactactgtccctccttcaccctagatttatatattccgcattaatttcaggtatcaagagaactaggcagatggaacactaactgtagctgaccataacgagcaagctcttctgcatgggcctgtgtcccgtacct

SEQ ID NO: 62297 - DNA, 983 bp, Bovine  19866881302666
tattttatgggaaaaacttagtcacttagcttctcctttaggcaccaagaactaataaaaatgtattgcctaaagacacgaataaaaaataatttaaaacttctccaaagttactaattcaaacattttgaaaacctgagatttcttcattgagtattccactctgtaaatggtgggtggtgttctaaaacgaggagcatggtaagaaaacacggaaatcttgcccaaactatgcctttccaattcttctcaatcagactaagtgccaagattcatgtgtgatttgacttaacacccacaacccttagcacagtgcctggcatgagtcagatgttcaacaagtgtttgctggttgaatgaggcctgactgctctcagcaggaaacctggcctgaaagcacagctactgctgataaaagccctttattccaggaaagtcatttcattaaataaacaggaagggacgccgggacatagaaccgtctacatgtatttcagagctagacatgatggggctatgcggtgaaatgggattctacctgtactatgctgagctctttgaggaggatgttcttttgaaacttatcccatttttaaataaaaaccttctttttacctgagtaggataacataatttaaaaatcaacacaagaaaaagagagacgaggaattaatttccctccagatgctctgcagtcactggagacagtacacagctatcaaactcatggttggcttgtcaatactacctctcatactttttcctttcagggtgttcattcataatatgccaaaaagaagctgcaaaaatacaaatgctgcatgaggtaagaacccaacccctagttatatattccttgggtcagataacaatgttaaaatgattcaagctgtaaaaaaactggtcaagtttacaaatctactgatgttgtttgaacacttctcggggaaaaaaggaaatgattaggtaaaacagaatttcag

SEQ ID NO: 62298 - DNA, 1084 bp, Bovine  19866881399779
tatcatataaaatctattatttaattccatccaaagtttctttggaaaacatcaatttagaaactaatcttaggtagaacatttctgagttctgggtcgtattttccaaaacaactaaaattgaagccctgaggatttactttgaaattgtagaaaggaaaactacattttcttttgttggatatcaaactattatagcttgctggctaaataaagaaaccgtctccactttctctttagatataagaaatgacattactggtaattctaggtgaggggagagggatattcttccatctcaatgagcagaagagaacagtacatgggtttctctgcaagctctcatgctgcaacctgagcaccaaggggccagaatgatgtccatttcaaaatgaggggacacggcacaacaaagttgtaaatggttttgttcttctttcttctgtgatccattagcaaacacaagttccaaatgatagcatacctgaaatactcatcagatgagattgtgaatgatcaaaaagtgctttggaaatatgaactgttgtactctatttggttctatggctttaggataaacacataccaaattttatgttgttggaaaaccaatatgcaacttttaaactactactaattgttggatttcttcaaattctatcattactcaccaaacacaaggatcaattacaacctcaaactatgctataattacatgtggctatttttatttgaatttaaataaaaagtaaataaaatttaaaatttcagttgctcaatcacactagctgcatgcatttctagcactcaatagccccatgtatgtaactagtgactattatactggacaaagcaaaaaattgtatttcgaaccgcagaaagttctgttggacagtactgatctagagcgtatgcttgctaagtcactacagtcatgtctgactctgcgaccctatgaactgtagcccaccaggctcctatgtccatgggattctccaggcaagaatactggtgtgggttggatgccctcctccaggagatcttcccgatacaggaatggaacccacatctcttatgtctcctg

SEQ ID NO: 62299 - DNA, 1285 bp, Bovine  19866881405211
aaacagctacagaattttcttttccaccgaaaggttgaagtgtctgcattcagaataactttacagaatggaatgaatggatcctgtatttgatttttcaaagagctagctttggcttccatcaggtcaagctttatgagtaatctggaaaagctcttaaaattcaatgaaggatggagaatattacttggcagagggaagcattactggctagtggtgggagctttggtgctgttggttctcacgcgattatacataaagctccggctatcatttactgagtcgttccctgctgtgtgacaagagtgcatctcattcttcacaggtacaattcttgctgtcttcattttacaaatgaggaaactaaagtgacttctaaaggggcatacctggagaaagcatgagaactaggacttgaactaggtctgtctgaatgggcaagccgtgctcataagtaccatcttgtgccaggacataccattgaacatttctgtgtatcagtttctgcctctaccacatggggacaataactagtccagggcatcctcaggaggttaatgtcagatgaaagtagggacagaagtaaaaaatcaaaggttatgtgcaaagggaacggtactgttgttaatcagaaaaatgctgctttgctaggtattattttaaaagtctgtgtgtgtataagacccttctctctggtgactgttccatgaggagtgcaaagaacacactgctgcatttattctctgctcaggcctcctgaatatatcctccctttggcaggtacaccctgaccctggttggagacagcccctgtgcacgggttggtcacagctgctcatatttaccccctgttggtgatgccgagagagggaaggtcttcattgttgggggagcagatccaaacagaagcttctcagatgtgcacaccatagatctgggtaagaccagcagtggaggggacttccctggcggtccagtggttgggactccaagtttccgctgtagggaacatgtatttgatccctggtgggggaacaaggataccttgccatgtggcatggttaaaaaaaaaaagaccagaagctacagagcaagtgccctttggctagagagcagggctttgtgctgctggccatgatcattcctaagattattagttcaaacatgtacattaccatatataaaataagtaaccagtgggaaattgctgtgtgtgagctcctggagcttactcaaactcatgtctatcaagttggtgatgccatccaaccatctcattctctgg

SEQ ID NO: 62300 - DNA, 1047 bp, Bovine  19866881406350
tcctgagggtgatatttttttttcctcctcctacttttttgattgaaaatatattgcttttacaaatggaaacttgcacatttaaaaaatcctaagaacaatggaaaatattttttagaagaagaatgtatatatacatataactgaataactctgctgtacaacagtaattaacacaactttataactatacttcaaaaaaaaaaaaaaaatcctaagaacaaaacgatttgtgttattagctctctaaaattgaccagttcaactgaagggaaaaaaaatctcccagacattctctaaatgacttttaaattacttcttattagaaacataattctgggcacaaatctttctgtcatactagttaatcattaatgctaaagctcagtaccatctcttatgtctgtttcagaaatccattgtgtggcaacaaagagatacaacatctttaacctttcaccccagaatctttcaaatccgaagcaaagctagtagctggttagtcatatctacaaaataaccccaaaagaaatttttttaattattcaaactggagtcaagatacaagaacaacaaacaacatatgtttatttcaccacataaatgtaaaagacactccataaacaggattaagggtgaaaaattccaatttttttaatggattattttaattaggttcttcttaaaaagtttagaacaatattctgtgaggataaattccaactgtaatagcatacacagagtggagacagccctggaactgaggaaaagctatgattcttccagaatttatgagtccacagctttctgatcaaccttgcactgctgctgctctgtaatttcatatttctctgtgtccctttgaagggcttgccttcctgatacctgagcttacatagcttcgtcttcttgaagtaaacatcagtgagatgttctgggatttttcacaccattcaatttcggtggagatgacaatgacaaatttctggtgtgagggcccgagctcagccacaagtagcaagcttcaggaaaacgaccctcctgcct

SEQ ID NO: 62301 - DNA, 1288 bp, Bovine  19866881572486
tttgctcctttatccacttcaggacagcgggttctgcacacaaattgtctactgggatatcaaaaaagccctgaatttgagaggcatgtaggtccatcgtgatgatatgatctgcgcctgccgttgacagcatatctgcaacaagtttggcggagatcggggctcggctctcacctctcttatcctgccgggcatacgggaagcacgggataactgccgtaacccggcctgctgaagcaatcttgcaggcattaatcatgatcaaaagctccatcaaattgtcattgatttcgccacagccactctgcactatgtagacatcctctccttgcacactctcgccaatttccacgcaggtctcctggttgcttaatttcttggtcaccaccttgcccagctccaggcccaatcggtcggcgattttctgggataagtcctggtgggagctgccgctgaagattttgatatttggctttttggtcaactgcagtaggctctttgcgtccattgatcacgccggcagctgagacaggaacaaaactcagacggcagactatgccaggcgccacatcgggcgccagatactgtagactctaactaacggcttctggttgttactctgtgcttccggtcccgtcaggcggtgcgcgattttaaactgctaccctagatattaaaaaaaaaaaaaaattcctgcttggaacggacctcacaaaagagaattaaacattttttcagttcgtgaacttttttcccccttctgttagtgcctgttttagtttccaagggcagcttaaatctgaataagtgaaaatataaaatttctgttaggcaaaaaatgtaacttcgaaaaagttctggactggaggaaatatctagaatgtgtcctgagttctttcaagcgaggaaaggtaagtaagaataaacatatgaaaaaaaaaaacactagaaatcaagaaaatgatacattttcacacaccagttgagccaaaattatgatagataattccttctattctaatgggatgtttaagtgagggattttgtgaaggaaatttcgcatataacctttgactcaatgtgtcttctaggaatctactccctagaaatattcttaaaatataatgataactatttctttctgtattaatccttttagtcaaaatttcctgaggtattatgtgtgtcaagtttttgagccttttacagagtacaagatggtgaatgacaaatagtaactctctagaattgtttataaaagcaaaataggaaaccaataaatgtctgt

SEQ ID NO: 62302 - DNA, 1154 bp, Bovine  19866881628280
ctggaatttgtcattaggcatctttcaggaatgccatatttcaattaggcataatgtcatcagcccaattgactctggacgttcaggtctagatgatttcaggagggtgagaatgcatcaggagactgattttattacatttcacttaaaatagattacgactacccagtcacactcttccctccaatttggtcattaattgttaaagatctggacatttctatagttccctgaaagaagaaaagtacttacaccatgattgttgttgtaagtggctccccattccctgccttcctctgcttcttattttgacatttataaaagtcaaaacgagcagagcaaaataaatgtgcatatctcttctgtggaataaactctgccccacattcctttctcagaaagggagggggaaaatcatcatcagagagacacggttttaaaattttgttctatggccctgcaactcctgaagccgtagtcagtcaatattgttaatgtagcttgttaatttgataggatttgtcaggtaactccactggaaaattatataaaactgttccagatgaaaagatgatagtgacatgaattaaagtgatagaacaatagtggaatataaaccagaaatgacacccaaagtggctgttgatttattgccgtactgagtttggttctgggctcccatgtatattagtgctacaaatctgggtccatttagcagagggatgcgcatacatacatcaccagctcctgctccaagccaaggtcactccccattgcatcaatcttttcaacagagcctacttcacaaagcaggacttttgtaaccatctcagatgtaacagactctcgtcctctttcatctttcttttatcatgtaaagtacactttaacttctattatttttatctgcaaattgttcctgtagagttcatccattatgggctgtatcttagcatcagtagcctaagctctgttccaccacgagaacactttcccaaacacacccttccctggggttattgtgtagtcaccattcaccagggggaacccccaagtctgcggtttggggatgaagatgtgggagttgaatgcattaggatcaagacaggcaggcaggtggaacaccacgaaacaagaggtatatttcagaacag

SEQ ID NO: 62303 - DNA, 683 bp, Bovine  19866881895449
tatatatacacacacacatatatatacacactatgcagcatcagcatatattaggtagtgtgaagcttttagattttttttcctcctccccttggtatgattcaatccaattcttgtataactttttcattagaccccactgtggaacatcagaaataagagggaattgtgtaggccacttctatgtaacctttgactctatatctttgcatgcccaaagacaagaaaagtatgtcttattcattcactgtctgtatatatttctcttggtactgctattgtcactttggttttttagtaagggaaattggcttatttgaaatgtttgtcttaatcctctatggaaatatcagtttacaggaaggttaaggcagctcgtttaggttcctctcagagtctctgctgcaattgtcggaaaggaagccccagggaagcccccgagcacaggctttggaagagcagtggctgtgcagaagacacgctcgagatgcattatcaggtgctgtctggagagtagaaattacggtgtgaatgcggaaatgctgatgtctccactttcccaacttagcacaaacatcttctttatctttggtgaattttggttccataagaggtggctccaagaagccttaaatgcaagtgtgaaattgtttttagaatcctggcttgaaagcatggtgttg

SEQ ID NO: 62304 - DNA, 631 bp, Bovine  19866881974138
cccctttccccccctctcccgcccctgcagctggctgacctgtctcacccactgctggcctatcgaacggccaggactgtctggttttggctcatgcctttgtccatgtctggcttagttcctctctgtctacgcttgcctctacccccaccgccccaggcggcacaagtgtttggccacacaaaactacagatagaaaaggtggtaaaaactacaaactttgctagattttccaacagtttattctttcgtttattcaatttctcccttctttaatacttcattttaagaaaacacatacgaaattaattatctaaaggcaaagaatgcaaagcaacctttgtgttccttataataactgacttcataactctctccagctgcgttatggggtgtgtataaaaagcttctgttctgagaacaaaggagcacgtgcagaaatgagactaaaaaatccactgacagtatttcaccacacaaattccttaaaagattttagtcaagactctcaacagattcaatgttaaaatggtttttagtttaaaaaaaaaaaaattgaaagtgcttacccagtaaaagaaccgaagtagtcctgaactgttacgtaagactttttacagttggatctttg

SEQ ID NO: 62305 - DNA, 1156 bp, Bovine  19866881986432
catatacaatgatgagacagtgacaacagtcgacatttactgaatacggactttgctcatttaatcctcccaggaaaggtgggtgctatcatcagtcccgttttataatggaggaaactgaggtccggcgagactgagacacgtgcctggagctgcacagctaacaagtggaggaaccagaacttgaacccaggtttgccagaccccaaagcctgtgtctgaaacctccctatggccaagggagtttggggaactcaggggaaagagagacttaagggaacatatcttccagattggaaccactgaccagtctatggtgaaggtcaacttccactgtaacaaattcagttttactgtaaatgtcccaactctcagactcagcatgtgacctacaagacccctttctgaaagcccctggagaaggtcctggtttcctgagccacagcctcagtttgtggaggtgggacgaggctgacaggagcagtgccccctcctccagccctgaccggttcataatcctgatgaagacgcaaccctttggttcccagcctgctttggtcccaattccatgcatgttcattctcgagcacttcaaggtagaaaatgaaaatatatgagcgggagaaagccttgtaataactgcagcatgcccgctttaaagcaagtccttcgggtatattactttatccataaagagagtttacgctagtgtgaatgccacattttggttccccttgcactgacaaaaatcttttttttaaagatcaaagtgtatggtgtgcatatgtgatgtttgacattggacaaagtactctttttcaaaacagacattttccaaaaacataactcactagactaatgggcagtgagaagccaaaatgactgcccctccgccttctccttgtgtgtctttgccagagtccttgggacttgccaaattcggtcatgcctgcttagcttgctcgactgattgtgccagaaaagaaaataagacacagatgtatttgagctctttgagatgccagtaagagagacagctaatggcttcatttcgaccctccccttccagctgggcacaggtgggggataatgaggtccctctccctaatcaaactcaattatttactactctatataaccgcaaagacattcacat

SEQ ID NO: 62306 - DNA, 687 bp, Bovine  19866881267361
tggctcctgcctctgggaaagccgggccaggcgagagacgcttggaattcggggagacggggtgggggaagggaggaaaatgcggtcaagatttttcaaacagtactgtttctccagggttgcactacggccaggaactgttccatgcccctcgcctccggggcggtgtgagggcaggacgggcagaagcgggggcggggcggcccgaaaggatctggcacgccggagaaggaactgggatgtcgggattggcagggtgcgtggccaggacagagttaaccgtgcaagccacagtcgcgtcgctcagagttcgacttgggccgcttgtttttgttccattgtgaaccgaggccccgccgccgagtgcccggatgatgacgtcaccaccccccttttccgggattgtgggggggaggggtagcggacccagagaccgcgcgctgggcgatcgccctcacagtggttgtgggggggtggatcccagtggcacagctgaccctcgtcacgtgtttcgtgagccggccaagcccacggggcgggtaccttgcgggggccgtggtgcgaggtgccaagggccagccacctgctccttgccgatagggagaaggtgtggctatctcctgcggcggcaggggggagttgggagtgggggccctctcaccaatcttggaagcaggtgctctgaga

SEQ ID NO: 62307 - DNA, 1026 bp, Bovine  19866881363320
caatgaggcttcggaagagaacagctttccctgcaagcaggaaatacatagaaatcctcaggctttcccttcctctccttcctcacactgtctcccagtccactaaatgtagtacaaacttgtattactctctcttccagactagggtggggagtgtggagggtggttgtacaaacatctatagaacatactgtcttcccttgtgttgtctaagaagaagactcccttccacacacacaagtcaagaatttgagtgccagtttatttgggaggtaaacctagaaaatatcagtgtgggtatgtggaagtgacaggaaggggcaggaagtcaataaagggtatgctcttgccaagaagttatcagggtcatttattcatttatttaaaataataaatgcttcctggagaaattccagaaaaaaatatatagtgacaaaatgtgaagggtctgaggttctgccctacttgtacgctattaagttagcctgccacagattcatactcatggaagctggcagaagacagggctggaggcaaaggaatgtatcatttgtggcacagctggcagcccctgtatctcacaggacaagggagaatggcccaggtggatgctgcttatacagtatttatcaccaagtcccatcccccattggctggggctgttcctggggcattcattctgtggcatttccagcccactgatcatccaccatacttagttgccagagccagtcctgatcaaaatgtggagttggctttgattgacaacctccccttcctcaaactttccctaaggtgattctgtctccatcttccccaggagaagatgggtccacaccttcatgtatcctgatctcttcttttattcccagtgaaatctgcctttgtaaactcctcactggggcttcccaagtggcactagcagtaaaaaacccgcctgccaatgcaggagacgtcagagacgcaggttccatctctgggtcaggaagatcccctggtggagaaaatggcaacccactccagtat

SEQ ID NO: 62308 - DNA, 1554 bp, Bovine  19866881380466
tgaaagaccccactcaaagtccaagatagattttaatgaaacaggttatgaaaagtacattgatgtggtttcagattccatatcgcaagtatccttgaagaaattaccatttcttcctaaaaagtacgcccacgattatctgtaaaggctattgaaatgctccagccttttctaaactacagattggtatgaggctgggtattcttccatcaaatatacttcaaccaaaccaacatatgacaacagattgaatataggagatatgagaatctcactttcttctagtaagccagacattaaagcaatttatacaaatatacagtgccatttttttcactgattatctttcttttggaaaaagaaaaaaaaatggttattttccataaaatattctatttatattatgcttactacttttatttttaaatgcactaatacaaacattctaaaatttctcagttttaatattgcacatggtaaatatcagaagctataacctacataaacaaaagctctttgggatccttaataactattaagaattctgagtctaaaatttgagaacttttgaattagaacatcattattttccacataataatagttaatgaagtaatggatctaggaattgatcattgatggccaccatatcacaaaaaaggagatattatgtacctcctgatagatatttacaacatcacctatgaaatattcttttcaaaaaatctgtctctgataaaactctagattccactgctgctgctaagtcgcttcagtcgtgtctgactctgtgtgaccccatagacggcagcccaccaggctcccccgtccttgggattctctaggcaagaacactggagtgggttgccatttccttctccaatgcatgaaagtgaaaagtgaaagggaagttgctcagttgtgtctgactcttagcgaccccatggactacagcccaacaggctcctccatgggattttccaggcaagagtactggagtggggtgccattgccttctctgagattccactaccagtttatataaaatatataaatttatatataaaatttatttattatatataaaatagaagggcaagatgaacctgttaaggacacactgggtatataaaaagcaaaacctagcataacaggtctttccataggtgacatgactccatttcttcaatgaataaattgcaaggaaaagaaagtggagaagcaacccatggactcctgttcctgtgtgtggaatgctttaccctgcatttccagttggtgagctcatatttatctttctttaaaaaatttttttcttccagttttattgagatagaattgacatacaacatcatgaaatgattactacagtaagtttagtgaacatccatcagtgcatatattcagttcagtcagttcagtcgctcagtcgtgtccgactctttgcgaccccatgaatcgcagcacgccaggcctccctgtctatcaccaactcccggagttcacccagactcacgtccatcgagtcagtatgccatccagccatctcatcct

SEQ ID NO: 62309 - DNA, 2065 bp, Bovine  19866881052695
atgttgacaaacttgcctatgtacttcacacagttataagcacagtacatagatcattttattctcagtatgcgacttaaaccagtgctctcaaccgttgtcgccattttcgctttcttgcttatatttgttcatgttaaaataaaaatcctatgaagtactatcatatatgttttaatacaagtaaaaactttctcaaatgtcaaaacttaaagtatccttttctctaacatgttggacatctaaacagaagtcactgtatcacaaagacccagatttttgaggcttaatatgttcaaaatgtgaaaaataagtgaaaatttttaatgagaagcattactcaaaatgatagcttggataaacacttataaggaggataatataaaaaaataaatgaggggagaaatgtaaacaggaagaacagaaaaagaatgagaagcaaatttaagattgtactaacaccagtgatttacagctttaaggaaatgctttataagagtaatctaggctatcatttctgacagctgtaatttttttccattatatgcactaaagaaatagtctatttccattacagatagaatgagacaggtatttttcaatgagaagatgatgcaggtaagtcacatagagcatcctttattcaattgcctccatacactagcaccattatcattttttagggaaaataataacaaataagcaactcatcatcactctagattttcatataatcaaaaataatttgccgaaaccttttccaggtgaaatttttaactatctctgccagttctatacgatgtttcatgaaggtttcagtgtgagccagtgacttagagatcattttacttacatgtgcccttcctttctgatttcttctaccacagctgagtctcttaggttaatttggttgctttgttgctttccaaaccatcccagtggggttttcagggtggttgtcaggtagttctctggaatcccttggttaaattaagtctgctgctgctgctgtcgcttcagtcgtgtctgactctgtgtgatcccatagacggcaacccaccaggctcccccgtccctgggattctccaggcaagaacactggagtggcttaccatttccttctccaatgcatgaaagtgaaaagtgaaagtgaagtcgctcagtcatgtctgaccctcagcaaccccacggactgtgacctcccaggctcctccatctgtgggattttccaggcaagagtactggagtgaggtgccattgccttctccaaaattaagtctacaggtggttaagttaatgggttctgatttaacaagttttgaccagtctcaagtccatggttaattactaaatggtctgtgggaagaatacaaacggagacccacataccacataagccaacacttaaacagtaaaatctatcaaactgttatataaaatgtttacccccatctttacaaagatatcttaataacaataaaatttgtacacactgtgtaaaacaagctcttatgtacctgaagagaacaagatttcaagaaaatgtgattttattattgttgtacaagttcgggtgatttgttgactgaggtgatgatgtttgagtaagtaatacaatggagatggtccataattatacatcattgtataattattccatacaagttatttctcatggctttatttcaggaagcaaaatgccaattaggttgttaaaatcaggattttcttataatttgtgttctattaacagtaatgtcaaactgagtcactgtaggtcctaaactacttttaattagtgtaaatttggagaaactacccagctgaaaaatagcaaaacagtttataaaatttgcaatacacatactggggaatgaaacaaaaattacaaaatttaaacattattaaagaaaattttcggagaaggcgatggcaccccacctccagtactcttgcctggaaaatcccatggatggaggaggctggtaggcctgcagtccatgggagtcgtgaagagtcagacacgactgagcgacttcactttcacttttcactttcatgcatt

SEQ ID NO: 62310 - DNA, 921 bp, Bovine  19866881414588
acgttgctgaactattccacagagaagaatgtcacagagaaacaatactatcctaaagccttaggatgtatctatattcccaggttgaatttctagaaatgacaaggtgaaaattgctggctgggctaaaaactaactatgcccttgaagatgacagactccctgggttttttggacacgagtatatcaaccctagaactagtttgatattgctggcttcttgcccagactgcagttaatgtttgagtatttctagttctgtataggtacaatgttccttgccttaagttgttaaaaccaaagctaagagtcagcctaattaaaggaaaattcatttattaaatcaaaagcaaccagggacaaggatgaacatctttcaggctgtacaagatagttgattagctcttttcagactgctacaaaaaaaatctgatgagggatagatgaaaatgttccatataatattattaaaatacatgcagtccctctataaaaaaaatacttgggggtatatactgatctggagaaggcaatggcaacccactctagtactcttgcctggcaaatcccatggatggaggagcctggtggcctgcagtccatggggtccctaggagtcggacatgactgagtgacttcactttcacttttcactttaatgcattggagaaggaaatggcaacccactccagtgttctcacctggagaatcccagggacgggggaacctggtgggctggcatctctggggtcacacagagttggacatgactgaagcgacttagcagtagcagcatatactgatctaggttttaagaatgaacaaaacaatagctgtgtgcatgctcagtcgtgtccgactctgagactccacctactgtagcctgccagagtgctctgtccaagggacttcctcaggcaa

SEQ ID NO: 62311 - DNA, 1254 bp, Bovine  19866881008888
ttactgcctcttcgtaggcagagataccctgtaggggaaaatggttctcggagtgaggtttctggacctgcagcatcagcgtcacctggcagtctgttagacacgcaggttcaagggcccacccctatacctgctgagtcatgaccctgagagtggggctggcaggcggaatcaaacacgccctccagggtgatttccatggggctcaagtctgaaaacgcctgctatagagtcaagggagagttgactctgacttgacagagaaaaataattttagatctttcttctgttgtttttaagtcttgttagggttaaatgtaaaaattagcttcaaagtaacttttcccagaggctcctaatacgtagccttcactgcttctctttgctgatgtaaataataatcgtttttgctcagacttagtggaaacctatcttttatggtattcctagaaaaaaatggaatcttattatattcttagagtaagaagttattttattatagaaatacaggaaatatattcttaggaaacttgaaaacaataaatattattttccaatagtaagtcatttaaaagaggcaatgaaatgacttgactttagtcatgtaaaatttaaaaccattattggtgaagattcttgaagcccatacgtgctattaatgtggacttagcgaaacacatccttccctcagtttagaagtttggaagcatgtggctgtgaagtgagccattggtgctgcatttgaaatgacataattaaaagcactaacactttggttctgcaggtccaatctgactataaaatgtgatgtgtacatagagacccctgagaagggaggcgtgttcattgctggaagagtcaataaaggtggtattttgattagaagtgccagggggattttcttctggatttttgcaaatggaacctacagagtcacaggcgatctaggtaagtgcatttttctgtagcatgtgatttactatgtgatatgttgatgtgagtgtctgctttttacctatgggagtagtgaaatacctcaccatgtttgagcatctaattgggaagagattcaacatgtgtaagcaaacaccaaacgattccacattatagtgttaattaattagtacagaggcagctcagtgaaagaggaaattgtgcaaagtctctcgggtattgtagccttgagctaggctgttagagtagggtgtgggggtaaggagagaatactcaggaaattaaaaaaaaagcagaagt

SEQ ID NO: 62312 - DNA, 673 bp, Bovine  19866881038932
cgtagtgcccactccatggctcctgagcagtcatcagtccacaacgcccatatggcaactgctgatagtaactggccaccaagttccaagcaatggtgctaaaagattgtttgataaaagagaaacaccaagcagcttgtaataaaagtgtaaatgtctagaagcctatagtataaaagaccttagcaaagtttacacaaatatatgcaagtggtaaaattaccacccaaaacaagaaaatttaagttgcctaagttcacccacattttgaaaaatcaaatgagggatgcaatatttttaatagtgaatcatataataaaaaatacaaatgtatatgaagtgcacaatttttactgcacaatggtataaccagaaaaagagtcacgacctaccagtaccacaaacgtgagtcaaatacagataaagactttatctatacctgctttctttttgacaatcagccttcttaatgccccagtttcatgacataatttcatgacctgactcagcggctgtaaagttttacaatgagaactcttaagagtccgactgccagggctcaagtgatggtgtaggcagacagggcaggggaagagaaccacacataactctcttgatacaagaggagccatttaaggcctaagccactttgtggtctaagcctgcccacaat

SEQ ID NO: 62313 - DNA, 1485 bp, Bovine  19866881089659
aaaagatgctcaacatcactcattatcagagaaatgcaaatcaaaacctcttatgaggtaccatttcatgccagtcagaattgctgcgatccaaaaagtctacaggcaataaatgctggagagggtgtggagaaaagtgaaccctcttaaactgttggtgggaatgcaaactagtacagccactatggagaacagtgtggaggttccttagaaaactggagatagaactgccttatgatccagcaatcccactgttgggcatacacattgagaaaatcagaattgaaagagacacgtgtaccccaatgttcattgcagcactgtttataatagtcaggccatggaagcaacctagatgtccatcaacagatgaatggataagaaagctgtggtacatatacacaatggagtattactcagtgattaaaaagaatatatttgagtcagttctaatgaggtagatgaaactggagcctattatacagagtgaagtaagccagaaagaaaaacaccaatacagtatacaaacgcatatacatagaatttagaaagatggtaacaataaccctgtataggagacagcagaagagacactgatgtctgatgatactggatgcttggggctggtgcactgggacgacccaaagggatggtatggggacggaggagggaggagggttcaggatggggaacacatgtatactttttttaaattaaaattgaaaaaaaaaaaaaagagagatagtctttaagaatttggaatacactctctgtcacctagtgagtgtgacttctgttagtctaggtgcagtaaatgactttttctttaaaatgtcctatgtctcatctgaataacttacatgattttttttctccttagagttataaacattccaagtgtatacgaccacttcttccctatttcaatgtgtcacatcagtttgctacgtttgatcttaagggttcttttgtaagtaaataagtagaacttttattttggttttgatttgagaatttatatattttatcatgagctaggagtttttaagtgaaatattataagctattaagagttttcatacacattgttcaatgacttggtgtcttctctttgctgattggttttagtcaggaagtacagaagccacgaggaggtaatgctctttgtggttttgaagaatcctaacaaaagtcacttacaagaaggttgttctttttggtagagcatcatttgtgtagttgaggaagctttccagcaatgctctttaaaacattcgatataaaaagacacaaaattcttgttatttctacctattgttagatttgaatacagaaatatatacagtgcactttctactaattgcataagcattggtttttaatgccagaaaattcttaaaaagctttttatataggtataataataatgagtatttttgaagcaaagatacaaatctttttttaacatttgccaaaaatctgcag

SEQ ID NO: 62314 - DNA, 2377 bp, Bovine  19866881110646
ctgaagaagatatggacaactgaatatccctttatctgtaaaggaagttgaaaaacttttagttgaaaaacttatagttaaaaaacttttccacaaagaaaactatagccccagatggctttactgggaaattcaagcctccctgggagcttggctcaaacaggaagtaagagctaaggcagagctgtaaatcgcccacctgggcattgaagcatgcccccattacatatacagagcctgtcagcaaaggctgggacacttgctagctccaaacatgaggaaagctgtaccatcatgatctgaccactaagaaaactgagcagagatttcagtggccatacatgataaagcttgcaaactacagaatctgttcaggaaagtcacaaagcaaattaacagcaacaaccatgacaaaaagcaacaacaaatgctagagaggagaaagaatctgatgtccagagtgtccaggttattttatgtaacgtgtctagctttcaacaaatgatatatatatgatatatgatacaacaaatgatatatgatatttgcaaagaaacaggaaagaatggcccatatacggatataaaagcagttgacagaaacgatgtctgagaaagcctagccattacctattagatattatacttcttagacaaaacacattaaaatatcaggtatttaaaaatgttcaaagaactgaaggaaaccatatctaacaagtaaagggagagatctgcttctagaatgtcagtgtgaggagctccataaatatactcccagcgaaactggtgaaaattatttaaataataataatgctaaagtctggaaatgatcctaagagcacactacaaatacagaagtattcaagaaaatctactaaaactcggtatgagcatcaagagtatatggcatttaaaccacaagccatccctccctgtccctctcaggctggactgacagaaactccaggccaagtaggtacagtcaagaacatggggctccctccctcccagttcccaggtgaaggcaacaatatctttgggagagaagcagaatatcagtatttctcatgctctttcccttcagctacttgaagaactggcagaatttctttaaaaccaaagctgcaagaaagattttcacgtaactgtgtagaatgggggaaaaaaggcataaagttgggtccttcacgcctgggatgaatctgaaaggaagagaaggtttgcacaggtggaccctcagcccagagagtgaccaggtcaagccacagactgatcatcccagtcctgggatcctacatggaaaagaaaagctccttttttttctttaaggtgttcagttacattttatgcttttttccccccaatactaacaaagtgaattaatccaataaaaatgacaaagaattaccatagtttcaatgatgacagtgaggttacctaagccatccgtcagagctacgtagcttcctcctctctctaaatggccaactgtcttcaggtaataccaacctggttgagtaaactgagtggtatgagctatagaaaagcagagaaagacccaaataacattaaagtggtgataataggattcttccagaaataaaaaactatctacttacttgaggctgaaagagaacagagtatgccaccccaaaatgtgccactttagcatgcatattattttgaactgctggcaatcaagacccagaagactaaagaaaaaatttctctctccttcaactgcctgaaagaatctagataggagacccggcccagaaagagagctattaccaacaataactttttatctgaaagacttatcttcatggcacagcaaatatctgttcttctcttccaatgaatggtcttcttcccctgtaaagctccaggttcctctctctttctataaatggccttcttcccctgtaaagctccaggtccctatctctttctatgaatggtcttcttcccgtgtaaagctccaggtccctatctcattcctttgcttaggatggcattataaagcctcaattgcctgactgcaaacttgagtcccatatttttatgtacaaaattaaatgggtttttttcctggtgatctgtcttttgtcaattattagattgaccaaagaactgagacggttacaaggaaaactttcccaagtatgactgagtctaacagctaatttctattttggaaaaaatatttgccagcctcatgtttcaacttttgagtaattagcctagttgaatggtataattaagggaatattcttagaatgactggtaagaaataaataaaccacactctgtcagttcaagactactgaaaaactactttattccaacagtaaataaagttatctcctcccagt

SEQ ID NO: 62315 - DNA, 874 bp, Bovine  19866881387693
cacacttaaaattactggaaaatgttggagctggcaggcatcttagacacaatctgccccaatatcttcattttttcagaggaagaaaccgaagcacagagaggggcagtgacttaaataaaggtcataaggcatggtgaagacttcttgggaacaggaagttggttgtctcagcctgtgtttataccctcctaatccctggcatttcaagtttaatcaaagtcagaaagctatccagcccttcagcgctgcatttgcttctttccgtgaaacttaactgtacaaatacctgccacttgggagtcagcaagcccaagccaaaggctgcgaattcttgctgcaccacttgcagtacttatttttagcagcgaaaggatcattctcattcttagcatcgtgaaataataacagccggcatctgctgagaattagtttgtaagctccgtggaagcagggatcaagtttgattttccacatcaccacatccgtcgagcctagcccagcccgtgccgcacgctgcataacacgacaggtaaacagctgttgggtgagcggccatagtgttacgaggtggcaggcactgcgttaagcactttgcatgcttatctcattccatcttcatgaccatcccatgaggtaggtaatatttaaaactaaaaattgaaaaagtgcccaaggatgcaaacacagtctctctgactgcagggttaccatcgattatcgtttgaaatgtataaaactactcttaggttaagtgtgggggagttttaaaagtctgcctagctgacatgttatccagcactaaagttaagttactttagccttaaaaaaaaggaagaataaataggaaaagatgacctaccgggttagctaa

SEQ ID NO: 62316 - DNA, 1380 bp, Bovine  19866880082520
gcagagtctcctcttcaccaaggaccccgaccgtttttgtgaaaaccttatataccctaagtgtacgtgcccaaacccacctccccaaattccctgaaactagtctgaacaaaggaaaagaaagatacagtcaaagataacccgtgattcatatgccttaaacctaggtagttaacagtggacaattatcaataggcctgtggtcataccccaataagcataatagaatttatgattccattcagttatgcagataattagggtatttttttaggtgatggagagactaggtatgagccctgaggctcttccagctggggggtctggtttttcagttggtatgtcatttccatagatactgggcatatagatcaaagtcgatagtccagcccaagatggagtcctgctttcaagatggagcctgttctgtttcttccttcagagtgactaacacatacacacaaaattttgcagttgctagtataaatgtttgtgcatagtccagcaaagggaataattaaaccaggtcactgaagactgaaaaatgtcttcatgatatctcaagatgcaggaaatatgctgatttttcagtttctggggaaaatgtggaccctgctgttggtacctattgctgaacatcacctgcctgcttgtgccctgtgatgtcaacagtatcggaatataagcagtgcccacctgggccccttgagggctctctcactgtgcccctgtgcctggcctcagggcagaaccttagcctggtggtggaagtccacgtccattctgtagccccctctgctcctcctcacttcccccataagccatgcttcgtggctcacaacttcccaagttcaaagacaaagccagcccatcccccagcagacattacccaccttactcactttttaaattcctaaacaaggcaccctgtggtcttagcttagcccagagtctggcataaggagcagactcaggaagtggcagattttattattttggcttctagtgccttctctcccaaagggcagggtaacgactgctgaattagacactgggaaccaaggagggtgatgagcacacccaggggcaaacctcagagcccacctggaggtctggggcacccagaatatctggatagcatagctctccttcatttaggcagcgcggctgcaggagaggcaagcgagggaggacgtctgagtgacaataagccctcagagcttcttgagaagggctaagtacagtaatttgttgtaatgactcaaatttaaaacaataacccagaggcataatagcatgagccaagaatacctactgcatgtgacgggctgttaatgggaaaaaaaagtttgatttggtggcagaaaaatcttcaaatga

SEQ ID NO: 62317 - DNA, 1089 bp, Bovine  19866880412782
caagccaggaatcgaacccgggtctcctgcattgcgggcagatgctttaccgtctgagccaccagggataggatatatctggttttccttgcttactttctatgcttgctaagtcgcttcagtcgtgtccgattctttgcgaccctatagacgacagcccaccagactcccctgtccctgggattctccaggcaagaacactggagtgggttgccatttccttctccaatgcatgaaactgaaaagtgaaaatgaagtcgctcagtcgtgtccgactcctagagaccccatggactgcagcctaccaggctcttccgcccatgggattttccaggcaagagtactggagtgggatgccatcaccttctctgctggttttccttaattaacaataatcttttaatactcagattacctgccccttactgtaaaacttctatgtagtgtgacttctccccccagtctctttggaaaacagttctcccagggtcacctgggatgcttgaggtcctcatagtttccaccaaataaatctaactctcaacttttaggccacgtatagtttttcagtggataccacaaatgtactacctccatattccttgtttgctgagtccctctgattctcattgttacagtatccaggtaccatttcatttgcaaagcctcagtcttgctgctcagtgtgtggccttgggaatgctaataattggtagcagaccctcagcagaacccctctcactgtcccagacccagagcacaggtcgctggttcttgggtacagcatccagccagcacagggaggacccaagcaagaagtacaatgggacctgccctcctcactgcctacccacaaatactacacatcttccctttgcaggtggtccacaaaaagactaacagtttccaatctatcatgatgtaataaatgacctgctatattacacaatctctggagggactcatcttcaaagagacaaatcctggcactaaatggtaattaaaaaggaatcacaagcattatttatgcctcttaaagaatagaaaagggatctaattcataagccaatgtaactctgttcaaagccc

SEQ ID NO: 62318 - DNA, 2300 bp, Bovine  19866880428640
actgtagtccaccagggctcctctgtccatggaattttccaggcaagaatactggagtgggtagccagtcccttctctggggtatattcccaatccagggcttgaacccaggtctcctgcattcacaggaagattcttcattttaagaggtttcaaaacaaaaatttcacctctccccactctcaactttattcagatgcaagcttaaggtggcagaagcaggagatggctttcctcctgaattctgggccccagaataactgatcaaatgcaacacattttttgggactattgtgatgcttggagatttttatctgaatctaaatctagtcttttctctacttgtgccttagattcccttgaaacctcccctcttcatgaaggttttgggttgaagcaacagcatggcagttcttctcaagatgaaataaaaagttggattcaagttttgaagaggccctaccaagggtcactcatttgggggctgccccattgatgggacctcatgaggttttatgtaagctgtgccggtggcctgagccgagtatgtctagtgagggcaacagtgcatagtttatggaagcaattactgagccaagttcttaagtagccatgatgccttcagttatgggcaaaattgggaggggtttcaatagaatgagtgtttgtattttcagggccctgggaatccataaagatcactgtagtatattatttcactcctactctgccttcctagtcctctcatctgatttaaaacgttctcagcaccggggtataaaattaaacactcatgaccaagctggtgctagcacacagaataaaagggaaaaaagaaaaccttaaagatacaatgtaattgtgggaagcagggcccaccactctttcccatggatagaatttacaattctagctgtaggattcttttcagtatataatttttttctaatgttgaaatgatttcatatgtatagaaaatctgcaagtacagtaagttccctatgtagaaactttcaagtttcgaactttgagagatgcaagcatgcattccagcccctgtacgccaggtgctgactgtactactggacttttcaaggtactgtacagtgagattaaaatgtttcctgtattttttgtgtttgacttttatgtacgtattatttgtatgaaaagtattatgaacctattacagtaccagcactatatggttgattgtgttagttgcatagctagttagctgttggacttatgaacaaattggacttactgacatgctctcagaagggaacttgtttgtaagtagggaatttactgtacaattaaaataatttgctttagttgaaccatttaagagagttctatgagccatacattcagtactttggccacctgatgtgaagagatgattcattgggaaaaaccctgacgctgggaaagtttgagggcaggaggacaagggggaaacagaggatgacatggttggatgacatcaccaactcaatggacatgaatttgagcaaactccaggagatagtgaagggcagggaagtctgatgtgctgcagtccatggggtcacaaagaatcggacatgacgtagcgactgcacaacaacaatcttaagctgtcacggacagccatgaaaatcaggaaactgacattggtgcatgaggacaattttcccaggcttctcgagatataattcaccctataccattgtgcaagtacatttgtgctaggttgcttcagtcatgctgactttttgtgaccccatggactgtagcctgccaggctcctctgtccataggattctccaggcaagaaactggagtgggttgccatgccctcctccaggggatcttcccaacccagggactgaacccataactcttatatctcctgcatggccaggtgggttctttactactagtgtcacctgggaagcccaagtaagtttaagatgtacaatgtaatgatttgatatatatatatatgtgtatagtgaaatgattatacaatgttaggtaacacctctgtcagtccatataattagtttttttctgtgtgcagtgagaacatttaagatctaccctctttgcaactttcaaacatacaatccagtattgttaaccgcagttatcatactgtgtattagatccttgaaacttatttatcttaataacatgattatcatttagtcctcagaccccattcaagtttctgagctctcccattatgtcctccctggaaagaagctccagtccaccatcctttctcacctatatgttcctgggctttaata

SEQ ID NO: 62319 - DNA, 2487 bp, Bovine  19866880446866
aatgaaggtgcccatggaaaagtatgaaagcacctaggagtgtgggctgggctcttacttccatttatttacatgtacaatggcataaaatctctgcttcataggattacatgaagtcatgtatttgataatactttgcaaactgggatgttgttaccaatagtatcaatattactgtttctataatactgttccccattaagaggggaacagagaaaaagaccacaaaagtggcattaaattaaaaccttgccgactgcaccttttgccttgggcttggtctgacctgagttaactcaacctaaatattaccagagaaagttacatcaggcttagggatttacaggccctgacagcaactctataattatcttgtttttaaatcacaatttctgcattttctgatgatagtttccttaatttcttcatataaattgtatagggtctgaaggtattaatagtaagagatggtaagaaatgtgtgtgtgtttaagatgtcagcattacctgcaacagatgaaaatgaagatccaatgccttgaagagttcgggccacaaaaagcagagtataggtaccagaaaaggcaaacactgggcaaagagaatagcaagaattccccagttagcaaatggcctttgatggtctggccaccagtagatgggctcatgatattacagacatgagccattatgctcatgttttaatacagagggattactgctccttgttttcagagctgctcttctaatcctctcccttaattaggattgcattataattgacataaagactgagaaaccaaagaagcataaactgatgcaccacatggtggacagatggctgggtgcccacatttcctgctgaaagcccaacatcctgcccactggagtcagggctgaacatgtaacccaatgccctggactgagaactagtccctagaccctacttttggattctccatatgcaacgacctgatttgatctttgccatagctgggtcctattgggtcatctggagtgggaaacaaaagctatgtgtacttgaaggtccatgggtattgggtagacaagaatatcttgtgattcaatcggatccttcccctcatattggaaaatcttttagccaagtcagatcagtgagtatttattaagtaatactgaccatgcagctgtgctggactctgcagcaatgtgaaacagagaccgcccagttcatgcccttgaagagatgcagtctactagagactaacaagcacgcgtgaaactgagagccaaacaggagtatgttatcagagactaaattacagagtgttagaggtaaggttgatgagtccagacatgtctcatcccagattctaagacaacaccgcagaaagggagaagacttgcttccaaaatgtttgcatcagcaatgttgaacccctttgcccattcattacaatggctgtgcttataatcttcccccattacttcccccacatgatcacaccgtctcccaaacatgcaaatgattggcctcttcccggccacacttccaatgatctctcccaggctttctgatttcaatctgttcaaggtctgttacccctgtgtcctctgaaaatagttagaccaactcatccctgtttgcccaggaccttcatgattttattttatttttatttatttattttattggtgtatagttgctgctttacaatgttgcgctagtttctgctgtacaatgaagtcaatcagatatatataacacacacacacatgtatttcctccttcttggacctcctttgcatccacccattccacccatctaggtcaagaggcatgtgaaaagatgatcaacatcactcattattaaagaaatgaagatcaaaacttcaatgaggtatcacctcacactggttagaatggccatcatcaaaaaatctacaaacaataaaggctggagatggagtgaagaaaagggaatcctcttgcgttgtaggtgggaatgtaaattgttacagccaccatggagatcagtatggagattctttaaaaaaccgaaaataaaactactttatcttattttatttttttggccacatctcacaatatgtgggaccttagttccccaaccagggaattgaacctgtgccccttgcagtggcagcatggagtcctaaccactggaccaccagggaagcctctaggaccttttttttaggttttaaaatcaagtctcacatcctgggaagcccctcaatcccaggcaaactgggtggttggtcccccctgtttagaagaccaaagtaattttgtacccctaacacaggccaccatttaactcctaattacattgcttgttttccagctagggacccttagggagagtgatgggcatcagcaacctcatttagtatttaaaaaccctgaaggggacttccctggtgacacagtggataagaatctgcctgccaatgcagggaacatgagttcagtccctagtc

SEQ ID NO: 62320 - DNA, 1623 bp, Bovine  19866880505670
gagcggaaccctactgtgtactacctatgccgggatctgggttgcttgctccttttaagaatctaatgcctgatgatctgaggtggagctgaggcagtgatgctagcgctggggagtggctgcaaatatagattatcattagtacagtaaatgtaatgttcttgaatcatcccgaaaccatcccccagctcgcccacccgcctgtctgtggagaaattgtcttctatgaaaccagtccctggtgccaaaaaggttggggatcactgctgtacattgttggctctgttggttaaaactcggttttgcatttctgaaataggcatgtgtctcatgatagatgtgcacatttattgtagtgcttgttttcttccccaaaagctcttattaaattgatgatacatcttaccaatgaatagtgtctaaagtgaaaaagttagtcattcagtcatgcctgactctttacaaccccaaggactgtagtccaccaggctcctctgtccatggaattcttcaggcaagaataccggagtggattgccattcccttctccaggggatcttcctgacccaggggtcgaacctatgtctcctgcattgcaggtagattctttaccgtctgaggcaccagggaaacctaagcttaatagtgtctaagaatcgaggaaatctgatccagtagttcagtcctaagcatgactgtgtagcactaaataatgtctagagagaaccttcagataccctccaggaggacagaagcaggtctccttcttatgaatctcttcaacagcatcagtagtaaaatatgctgatgtccagtcctttctctatgaagaagctgctgggaacaactgtgggatttggtttatttgcatttatttttcactttctcattgttctaggttggggacatcctggattcctttgacattcctcttcttcttcaacctcaatgacctgcatctctgaaacatactattccctgattcccaaatgacatcacagatggtgacatattcattttagtttgtgcatcgatcctggatctgacctatgagagtgaccaggatctggcctcttcccagggttcccaggccactcattctcttatgcaagctctggttggatttactttaggcggaggaagagcgcgctcaggcacttgaccagacggctcagttatcgtttactagctgcataatcttgggaaagccgctcctccctcctctggtgtcagtttctcatctgttgttgttgtttagtccccaagttgcgcctgcctctttgcgaccttatgaactatagcttaccaggctcctctacccatgggattctccagacaagaatactggagtgggttgccatttcctactccaggggatcttccagacccaggtattaaacccacgtctcctgcattggcaggcagattctttaacactgagacacctgggaagccctttctcatctgtacagtggtgctttttaaagggttttttttttctcatctctataactagcctgacctttttgcccctttattacaaatctctctaaagccatagcagaggggtggggtactgactacaatggagtcagtccatggcactgagggcttacagtattc

SEQ ID NO: 62321 - DNA, 1522 bp, Bovine  19866880505702
ataatcagggtattgcattcaaagtcacttaagtttgaataggcttttccagtgccctttgattacttaaatgtctcatacctgctatgttgtgcctttataaacgctcgctgctctagtataggttggcttagactcaaatgcaaagaggctcatgttctctgtagagagaatcttctcaaaaaaatctacagcagtctccatggggttttaaaccacccatcattaacctggtgaccagacttttccttcgatagccatctctacttctgaaccatcctaagccctagaactcctggggagtttctaagaataggagggatttattccatagcttactttaccttaggcaaacagtagctgtatatcctcatgatttccctttgcgtccaaagaagtgaaacccaactggtaactctcccaaatctgccttcctgggagggcagaccccactgaatgtgaccccatactagggcaagttctgagccattagcaagcttattgtcatgcttcttaccaagaaaaaagcacctgactgaggaggttaatggaaagagagactttttttcaataagagagagactctttaaagaaggaggatagcaaaaatcagttgaatcatgggtacaataggtccaagagccaggggcctttaaaactggctgaagcacccacagacagacagcacctgcataggcaactgcttcattgctgaagaatgctgcatgagtcagagcatctacctcacccacacttgctgcgggccctccctcatctcagatgttctcttggtcctaagcttacattcagccctgtgctgcctccttgctcttcctgagtcaatcatggggaggaaagagtatccctagaacccgatgcattagtttcctggggctgctgcaacaaacagacagggcctaccctggtggctcagtggtaaagaatccgcctgccaatgcaggaggcacagggttcaatccctgggccaagaagatcccatatgccttgcagcaattaaacccatgcaccacaaatactgagcctgtgctctagagcccaggagccacaactactgaacccacatgctgcaactactgaaacccttgggctctacagcccgtgctccacagcaagagaagccaccaaaatgaaaagcccttgcactgcaatgaagaatacccctgctcactgcaactagataaaaactcccacagcaatgaagactcagcaccaccaaaattaaatacaaatatttttaaaaagcagacatttattctctcagagttctgtaagctggaagtccaagatcaaggtgtcagcagggttggttctttctggaggctttgagggataaactgtcctgcctcccagcttcaggtggctgccagcagctcttcacattccttggttttgagatgcatcactccaatctctgcctctgttgtcatgtagctttattccctgtcttctctgcatccctgtgtctgaatcttcctctcctctttctcataaagataccagt

SEQ ID NO: 62322 - DNA, 1866 bp, Bovine  19866880700478
agttctacatttctctgattaagtctatgaatgctcatggcaagaataatcattgaagttttcatagaaaaggtggggctgggacttccctggcagtccagtgggtaagactctacacatccgctgttggggggtgtgggtttgattcctggtcaaggaactgggatcccacatacctcatgttgtgaaccaaaataagaaaagaaagaggtagaagaggtggggcttgttcaggtctttgagtgagatggatttggaaagcagaggggagttgggaacatcataattaaggaaatagaaggaggcatgttgaattggatgtggaagaggacatcaaatagtaagtggtgggacatgcccgggaagatgggtctttgaatactaggcagaggaattcagacttcatacgagggaaaagcagcccaggaacaaatggcttttctttttaaactgtctgctttctccttgtgaaagtagaaaggtcatacaatgaaagtgagtcatcattctttcccactcacttagcattcagcataaatcaacatttgccctgggtgaacgggcaggtagttatttgcaaggctgaatcagatcatgcagctgatatgggtgctgcctgtctgcctcctctcctgatgctggtcaggcttcattcactggaaatgcattagcactggggaactggtggggatgtgttcttttttccattgaagtatagttgctgtacagtattatataagttacaactgtacaatacagtgattcacaatttttaaaggttatactccatttatagttattataaaatatgggctatattccccatgttgtaatatatcctttgcaccttattttatacataatagtttgtatttctcacccatatattgtccctctccctttccctcttcccactggtaaccgctagtttgttttctgtatctatgagtctgctttgttgttattttcaacagcttgttgtattttttaggttccacatacttccaactcccacatcttcttaaaccagggatggaatccaagtctcgtatgtctcctgtactggccggtgggttctttaccactagtgccatctgggaagcccagtgttagtccctcagtcatgttggactctttgcaaccctgtggactgtagtctgtgaggctcctctgtccacgcaattctctaggcaaagatactggagtgggtagttattcccttttccgggggatcttcccgacctggagattgaacctgggtcccccacattgcaggtagattctttattatctcagccaccagggaagcccttcacatataaggatatcatgcaatatttatctttctctgtctgacttctttcatttagcataatgtggtggggatgtgttgttgaagaaggatgaggatgggatccctcttctggtaagggatctcaccaaggagcttgttctaaaatcttggaggtaggaaagtgttctcagggtggatgggcatgtctggaattttaacttataccactgaacagatgattgtatcctagagcaagcagaagtgctttcttgggaattaataaaacaaggatacactgtcttcacctgacaaccctgctagaaatttggactttcaatctggggcatttaaaagcccattaaacatggtcactgggcccctactgattgcagcagccccaaatcctccactgtcagagatgccagactccattcttccccaacctggccaccaccgtgagcagtcagctgtttaagcagaaatgatcctttgtgaaaatctatatattatttaatgcctttgccctttgcctcagctctctttccccatagcttctcagccaagatttcaat

SEQ ID NO: 62323 - DNA, 732 bp, Bovine  19866880717099
tggcattcctggaaggctggcactgcctcaatttatgcagcagctttttctcacaccctccctgactctttcagtctaatatcttttcagtttcaatttgcatcaaccccagagcctatctttgcccatctttactccattggccaggctttaaatgcataagatactaaaactattaacaaaccagggactttacataatcagacacagactgcacaataggctggaataggaaacaggaagggcctccttcccttcaaaggtgaacaatgggagccagagttgcatttgttagtaagaacttcatcgctgccagtgtggggcttaggcagtttgaaaaggattagaagcccaaatcagacccattttaaagcacacacacacacagacacacacagaaaggcaatgggttctgcaaagacctactttctggctttttctctcacccctcccaagcctcatgttaaaaacaagtgagtgaaagggtcagttttgccaaagagagccaagggtgaaagcaatttcatctcctgaggaaagaccaggggagccaattcctcaacccatattttctgcattttcatttgagaacaggggctgggaagggagaaagaaactgcacagtgaggttaggaaagcacgtggggctggaggcagaggacccagggtctctggtatctgaggatgcttggacgtgtgtatgggtgcagccttgcctgctctggtctctgt

SEQ ID NO: 62324 - DNA, 924 bp, Bovine  19866880737184
cacagattcatccgtctagtctttaaatctcatttggtttgtctgttttccctaataagaagaatagaattagttatcttgctactcagcagggctccagtatggaatttacgtaaattatctccttaataaaattactaaatatagaatcaacatggttgcaaaggggaaaaaaaagtaatgttctcagattgtgtctttaaaaaatgaagcaatgttccaccaccaagggaaatgaaatttagcttcttaaccagtaggtacaatataagggagggggaagtgggaagatcagggagggtgggggacaagatggggagagagaaagggagaagtctctaagccagacacagagataaccatttaattaattgctctccagggatttgctgggtgtttggaatcaggtcaagaatataaacagttcttgccttcctgaaaagatattctgattaccttctctcgtgtcaaagagattgatccaataaaataaaaacactagatatgtgacaataggtcaaggtagggtgtgtgtgtgtgtggtgtgtgtgtgtgtgtgcacgcaaccaggccaacactgggcataggggctaagtagaaagcataatgttagaacctgggggcagaaactgaaactttgttttaggggcacatttttgtgctagctacaggagaaacacagaaaagaccccatgatgttctgagtcctcccttagttcttacatataagatgtcctctgtattctacctaccaagtctcttgttttcaagggtccccatcactccctttattcggttccttctctatttcaacactctccataatactctcctgtaactccatctctaacctctcatattccatctccatagggctgtcagaggcatcttcttaaagtatgcttagatcatgcattgtgctga

SEQ ID NO: 62325 - DNA, 887 bp, Bovine  19866880956127
tgaatccaatcttcataaattcccagctgcagagatgtcattatccacacactgttgggtgaagaatagacctgacctttagttcagtcctgtcccagccctttctagctgtgtgacgttggatgacttacacaaccattctgtgctggggtttcctaagctgtttgacagaaataatgaaacctgcctcatgttgttggaatttaatacaacatggtaggtaggcatgtttttagcctagtcctggaatgtggttttgatccattcccttcacaatcctgggccccgctggctgtccccatttctgatcccctctccaaccttacttaaatatttaccaatcctctagcacatcgaaagctgctctgggtcctggatggcttttgctgtctatgttgggtgggtctcgtgtgtagtggatgctccgtaaacatttaccgtctgattgaatgattgatcttcctttctcctctatcactagtgcttgtctttttttccctccaaactggctgtctatgtcctggccctggaagcccagctggtatccaaggacaatgagatgaccccaaaatcacccacttgcttctactcttgtggctgagacctgagacaacagctcttccgtgaaccagctctgatttttacccttgaggtctcaggttctttctcaatcctgctttccatggattggcacctactgaggtcacctggcacttcctcctaggcgtgatggcactcactgcccttgtaatttctcctatctttttttctgtattgatagctgtgtgatgctgggttgccatgacaactaattgattagcatccaattcctggactgggaaacatgcagccataaagaattacaaatgatgcctgattgtctgctg

SEQ ID NO: 62326 - DNA, 3545 bp, Bovine  19866881021718
aatattgctagggtcatgtcacaaggattcagaggccagctttaaagggctcctagtggtcaaagatgggacaatctgagctcaaacatgaggataactacaatggattgaagctcataaaaatgtttacattgaaaagcttataatgattgtgtgtgcgcatttgtgtatataccctttggaaaatgataaggaagcaactcattatcttgaaaattggtgaataaagagaaggagtccaacattaaaaaaagaagaagaaaatgcagtatataaacacaatggaatatccaaccattaaaaagaatgaaataatgccatttgcagcaacatgaatggacctagtgagtgtcatactgagtaaagtcagtcagaggaaaacaaatgctgtatgatatttcttatatgtgaaatctaaaaaacagtgatacaaatgaacttatttacaaaacagacagagacaggcttagagaacaaactcgtggctacaagacgggaagggctgatgggggaggaatagttaaggagtttgggatagacatgtacacaatgctatacttaaaatggataaccaacaaggacctactgtgtagcacagggaactctatacaatattatataacaacttaaatgggaaaataatttgaaaaataggtacttgtatatgtataactgaaacactttgctgtacatctgaaatgatcacagtattgttgaagtgagggtggaagttggtcagtcgtgtccaactctttgtgaccccattgactatacagtccacggaattctctaggccagaatactggagtcggtagcctttcccttctccaggagatctccccaacaccagggatagaactaggtctcctgcattgcaggtggattatttaccagctgaaccacaaagggaagcccaagaatactagagcgggtagcctatcccttctccagcagatcttcccaacacaggaataaaactagggtctcctgcatttcagatggattctttaccaactgagctatcagggaagcccacagtatcaactataatataaaataatctttaaacaagaccccttaaaaccctccgctgccatgtctttcttcaatcttcaatgtcaaactgtggagtggggtatgctcttggttctctccaggcctttgtttctttcacagatgaatgtgcgaacggactagataatctccaagttttctttctgtcatggactgttatgcttcttagacaggtgtgaacagctgtggctggattctagcagaattgtgataaagcatcttggaccaattttcttcttacaaccatttaatataggttttcatagattgaaggtaattcctgcccctgccattcatgatagaggcaagtaaatctgacaagggacaatgaaggaaaaggggcaaagggacattaaaatatatctaacaccagggcctgaccctgtgccaggtgatgcccccaacataacatcatttggaggtacattaagtacacaggaacccaggctctgggttccggctgcctgtcatggaactctggctgtaatactaagtatctatttggccttgggtaagttatcccacacttctgcatctcagtcacctgatctataaaatggtactagaacacccttgttacaaatttcctgtcagaagaatatgacaggaatgtttgtacatgcaaaggacatagaaaagatactgacacatattaaatgtttgtacatgcaaaggacatagaaaagatactgacacatattaaatgctgaataagtgttagctattattactactattcaatctttttattatttatctatggctgcactgggtcttcattgctgcgtgcaggtggtgagtgggggctactctctggttgcaattcacgggcttctcatggtggtggcttctcctgttgcagagcatgggttctagtgtatgtgggctccagtagttggtgtgtgtaggtttagctgctctgtggcatgtgagatctacctggaccaagaattgaacttgtgtcccttgctttggcaggcagattcttaaccactgtaccaccagaaaagtccactactattcaatcttaatcacacatgccttttacgaatatgaaaactgagaatcagggaggttaagtagcttgcttgaactcacttagccactgagtggcagagttgggattcaaacccaagtttatctggcttcaaagcccataatctcttttctactctaaaagtcttaagagacaagaatctggaagaattatcttccctctcaattttggcttctaaagcatcaccataagaatgttttaaagaaaactgggactcactcttcatttcccacatagactctggtttaggaaagcaaccataatgtcgagaacttgatgcattgagcatgtaataaatctgggcccagtcaaaaactgaggctgcagcagaacctgtgccattggcttcagaagatccctttccactggctggtgggagagaggtctcctttggaatcagacatttgtaatggaaataggtaacttagtctctgaaagtcttgattttcacatctattataggaatgggggcatccgaggtggttcagagataaagaatctgcctgcaatgcaggaactgcaggttcaatccctgggtcaggaagatcccctggaggaaggcatggcaacccactccattatttttgccttcagaatcccatggacagaggaccttggcagttcaggtcatagggtagcaaagagtaggacatggctgaagtgacttaacatgcacacatagaaataggagtctgggccacctgcctcgcaggatagtggccagggtggcaagacaccacttccgccagttccctcgaacattacacaggacatcttagctcctctttattttctttctgctttcccctttctcctactgttccttgagcagataattcttcctaacaatcagaaattaagtatctaagatcttgcaaccattgctgtgtttttatatataaaaacaaaagcttattgaggactgtaattgctcagggatttccctccttgaaacgtctttgggtaaccagtgtctctggctcctctcatactgtttctgatgttaacattttaataacacattcagagtgtttttgttttatgaattttaatacagatggaagttctccccaagagatgtttttaaaacaggtgttttaaagtgaatatccacatgcctatttccgtgactaaaagccatttttccccactccagacgtcaaattgttctagttttcaggcagctccaaagtggtcacctgttttgtttagcatttctttacttttctctgaactgcaagctgaaagatccataagtgggtgcgtgcattgtacaagtatgtgtatgtatgcacatgtgtgtgttgaacattcagagaagtttgcccacagtttgatgttaaccttctttctcacaatggttcaagaaaatagctgtaacacctctgaaaatatctctgagagtgtcttcagt

SEQ ID NO: 62327 - DNA, 1404 bp, Bovine  19866881040947
ggacgaggaggggatcttggctgccctttgccattctctcccagtcaccagctccatcatgcctggagaagaccctgatgcttggaaagactgaaggtaggagaatgggggtaacaaaggatgagatggtcggatggcatcacagactccgtggacgtgagtttgagcaagctccgggagactgtgaaggaagggaaggctggtgtgttgcagttcatgggatttcaaagagtcagtgacgactgagtgactgagcaacaacgaccatgccgctgtgtctcagcctcacacagctctgagtctagcctgctctgccactcctggtcctgcctcctggagccctgaccgttcccacactgtacactctgcactcccaacaggctctgtctgacaggttgtaaatagcctgtttgaaaattaactgcatgtttggggctggtgcttgccatttgtaattgctcattctttccccagccacttcctcctcctatttcctaggttcgattcccaggaggcagaaccaagagcctctgggcaagtgactacaggagatgatgaggccccatgggccacacaattcagccagatttgctgaccaggaagcctctgtgcaccaaagatttgcttcaagccataggacagaaaagacagaatggactcactccttcctaaagaattctttgagcagcagtgctctggctacaaagatgcctatcatgacctagagcacatggaccgtcctttacttcagcatttggggcagcagaagccagccctccaatgatgtctatctactagttccctcctagcaccctgcttcccttaggtccctcagacaccaaatgatcagcattcatttactgaaaacctgctatgagcaaggctgccctaagaattctgtgtgatggatattccccctctgagttgaaaacagtgctatcagacaccaggcgttgcaatctccacatctcctcacctctattggcctggtcctgttcggagatagctgaccagtaatggagcaaaccctcctacaggtccatcatttccatatttgttgctgttcagttgctaagttgtgtctgattcttttgcaaccccatggactgtagcccaccaggctcctctgtccatgggattcaggcaagaacactggagtgagtttggggtcaattccaaccattggcacccaaactctttggctgctgaagttcactctagcttgaagtgtcagggaattgtcccactagggcagccctcaaccaatgactaagaggctaacagaggttgatagataaatagccctcctccctcacctctcaggctggataactttgagctgcacattccatactggcttctggatttaccagcaaaatcatccttcattttcctacagggaaa

SEQ ID NO: 62328 - DNA, 1383 bp, Bovine  19866881063124
tcacccacctgcagccccagaccgtccaaattcaagacataaatcacccactgccagcatgttgctgccctagacaagaacccatgatggatctctattgctttttgaatccaaactactgcctggcattcatgatgcttcgccttcctctcctgttttcatattcagccaactgtgtctctgttctctactttgccaacacagttgtctctatgcttcctctgaaacccccacccttgaaaaatatcccggagccaagaaaactaccccaaatacatcaggctcatttgtatctcctttcatagaatcatgtcttgtgtttgtctctcaatcccaataatatccatctttggagtcaaatttcaaatcccacttcttagacaatctgaatccacactgacatctttttttttttgatggcctggagcacttttgtctgtagcagacatgttggcatgtaattctgttcaagatgctgatgttgagttgttttatactcatttatccaagtgttgagtaatcattcattgagtgcttgtgttccaggcgttgggctgattcgttaatctaggaatcatccctgcttttttttttctcaccttcatgaccaatcagtcaagtggcctgaggcatgtgaagggtgcttccaaaatgtgtgctggtttggccacatgtctacaccaccgcctaccccttgcccaccgttcttgtctgcactactgaaatggccttccgactggtcccccatagctatttttgcctcagtgcagtttgttctctacaaaatagaatgattttttaaaattttattttatattggagtagagttgatttacaatgctgtgttagtttcaggtgtaccacaaagtgattcagctatacatgtgtatatatgtatattttttttcttttgcagattcttttcccatttaagttattacagagtattgaatagagttccctgtgctcgacaataggtccttgttgattatctgttatatatgtatatgttaatcccatcctcctagagcagcagttcccaaccttttcggcaccagggaccagtttcatggaagacagtttttccacagatgaagggcagggggatggtttggggctgattcaagcactttacatttattatgccaccactgataggacaggaggtagaactcgggcagtaatgcaagctatggtgagctgctgtaaatacagatgaagcttctcttgcttttcggctgttcatgtcctgctgtgtggctcagtttctaacaggccaggaactggtaccagtccctggcctggaagttggagagccctgtcctagagtgtgttttaaaggagaaaattagatcatattggtttgtcaccattgttaaaacc

SEQ ID NO: 62329 - DNA, 3974 bp, Bovine  19866881067827
ggaagcccacccttttctgtgcccatggtaaatcacccccggtttactaagaggcttaaaaacagtgccattccatgtgctctggtaaagactctagaagggctgaatgggggaagtgaacctctgcttcatgagggttagctgggtcctggtcactcgcaggacaatagggcctctcttgctccagggggtctcccagcagacttgaagttttctcacatggcagcttgggggccccgagtatatgtaaaagtggaagctgccaagctaggccgaaactggtggagcgtcacttctgctgacttggattaatttaagtgagtcccagggtttgtctggactagaggggagagggctacacagggtcatcagtgcgggcatattcccatgggtgtcaccaatgcagcggcctgccagccttgggccaggtccaggagaaggggaggggtcacccaggcctgacatgacatgccccaatactggggttctggatttagatgtgggctcctgtccaggcttggccagctgcctgaccttctttgcactttgttagctcaccccctacaacccccccccccacacacacaccgaccccctgcccactggtgggacaggacatcacctttcttacttcaaatgcaggagctccagggagcttccaggacacagccaggggaaggagggtagcttgcttgggagggtgtgactgcctcccccgcgccgaccccctgcacatccccatcggcctcgttggcctcatgtgctccttgctggcctgtcacctatgcagacaggcagggagaccacagctatgggaaggccgccctggggtgcatttcttgtcttccctctcctctccacttctctaatgttccactcatgctaccaaagccccctccacccatcaccttcccggagaccctgatctttcccacccagaggcacttacatctacccaacacatgttccacaggctgcctcgtatttttaattccctctttacaagtcccttctgtctcctgccacctgagtagaaaagccctttgagtttcaaatctgggcccagagcggtagggattgcttgtcagtgaacaaggcaggctggcacggagaaggctggacagatggccattgtggtgactgcaccttcctagctgggaggcccgggggtggtgacaatagccaccctggtctccagccaatgaggccatatgtaataggccaaggagctggctggcgaggtgagaggctggagggaagaggcatggaggtctgaagttggggctgggggaagggggctctctttcggagaaccctctgcctttgcaggggaccacagcccttggtttcctttccacctcctcaggttctccccaagacctggtcacacagataaggtcacagggttggtgaggggcagggaccagctgaaggtctatctgatgccaaggcccctgctttcctaccagccaatacagccactatcaaagctgtccctacccctccaccccacccccaaacccctcccccaacccgctgcaaaccatccccaccactggtgggaagggacatcacctttcttactccaaatgcaggagctccagggagctgccatgccacagccaggggaaggagggtagcttgggagggcatgagaaatggcattctttattcataaataaaaacataaaattaccagaaatagtttacatggccaaaagggggcatcaaaaataaatcaaagctgtcaaaagcagagcaaaccaaacaagacacaaccaagagaaaaataactctgtacatagtcttccaaatgctagtccatccatagccagcctgggccggagttcccgcttagcctgcagaggaagcgcaagggggagcacagataaatgaggaaggcggagcatgaaagcacacaggtgcatacacaggtgcgtgtcctcctggcagggacagctgcagctctgaccacccagcctgcctgacccctaggatctctctcccaagaagtggcccaggctaggccgggagtcgagcaggggcagaggctcggtgggtgcttctcaggggagaggtaccccccaacgcagtccccatggaactcggtattcatggggaccgactgtgcccagcaggggttaatccaaatgcagagaccagaggataaatccagggtgggcgccacatgagagtctggtcactctaaagcccagaggcagagcccccctcggtgtggctgcctccttgctcacagcagagagcttcaccatcctttggctagcagagccgcagctctgatccagcgagcatgcgtcttagcagccactctcgggggaagaggcggcgagctcccgctggccctgggccaggccgcctgttccgaggcctgcgtggccgacttctccagtcctgctcagcctctgctgctcagaggctccttccggagagaggctgggtctggcaaggtccaggaatagcatggaggttttagcacagcgaagggaagggaaaccacaccgcggcgagatcgctatgttataggacactctcattctggtgcaactgggccaccctggagccttgggctggtggcaacccagggagggctccatgggttggcctggggcagagatggggacaggggtgcagggcactatcacactgaggtggagctgctgtgcccctgagcgccctcccctggggcttagcacccacctctttgcagcgaggtcttgagggcagagcaatgggcttttggctgccctttgggggggtggtctccagcccgaggagggggcagcagcctctttctatccatcaggacagcctctgggaggaaaggactcagacaaggcacaggctggtagagatgaagcaaccaggagacaaggggtgggaagtctttgacttggggagtgggggtgatctgcctgtgtcctgtggaggggactggcctccaggcagagagggagctctgggcctgtggattccgggtttaagtctagcctatgactaagagtaatggcttgaaattccagagaggctcctctgtcacgtgaaggcaggacaggcacagcctagcttggggaatggaaggcagagccagcatccgggaaggcggccctgctctcagtccaggctcaaggagggactgtggggggaccctggcaggatgggaggctggaggagaagcagctccccactaccacctggggcctggaggggtccacagtcggggacagaactggggagcaatggcctggggctgctgcatactcagacattcagttaacccccctcagcatgcgggcgtgagcccaggaatccagccggggctggctgtcccaggaacagcagctgcagctcgaggcaaaaatagaacatggaacagcctggctgcctgcgagatctggcttgtgtctgaaaagacaagaaaggaaaaagaagaagaaaattccctgaaccaagcaactgagaaacaatcttttctccgcacatctttgaaaaggaaaaccagccttctgcaggccaggagtccttgattatggggctcaggtggggctaatgcaagcagaggggggtgcagccgggggccccagggctgttcagaggctgtgtttgagcctcttactgtctttggacactggcactttggggcccctccctgacctgtaaaggctctgtctgtacttagccctggaggtgacaagggacatgaccggcagcaggatggagctgaaggtgaagggggaaggcctagcccagatgaccctgtgccatctcagtggacaaaggttattctgagttcaagcaaagacttggttcttaggaatcaaaaccaatgctgagcaacttgaacaggaggggaaatccctatctctggtctcatgatgaccccatcctgggggctcccctggggacagcttggagtcacacactcccctgcatcatctttcttcctcagcacccat

SEQ ID NO: 62330 - DNA, 1154 bp, Bovine  19866881122112
aactgactcattggaaaaaagcctgaagctgggaaagattgaaggcaggaggagaaggagactacagaggatgagatggttggatggcatcaccgattcaatggacatcagcttaagtaaactctgggagttggtgatggacccagaggcctggcatgctgcagtccatggggtctcaaagagtcggacacaactgagtgactgaactgaactgaaccaatgagccatactgtctctgtcaaaattattccactctgctgttaaagcacagaagaagccacggataatgtgtcagtaatgtgtgttctgataaaactgtgtggcactgaagtttgaatttcacatagatctcacgttatataattttatctcttcttttcattttataccccccagactattaatatattcaagaacaggctgcagggtgaatttggcctacagttgattggccccctctttcttcagccatgcagggagatggagggacagtttactcctcctaggccttctccatccctctgctcatcaattcctaaagctcaccatgacagtaaaaacctccctagaaaccctggccttgacctcccagtagctgtgctccattgcttggctctaacctgtttatcagcacaagacattcttttaatttagcaatctgcaaaggtctcggatgaaaagccttcacctgccctttttctcaaatctgacataattagctacatctcagccccaccttctattctctcttttaatgagcagctccagtcctgaatcgctttaaaggagcaagcagcctcttggtatcaattaaaagagaaacactttccaacgcataatctgtaacaagccacaaataggtacaaagagaaatctggagttctggcactactaacagaacaatgcactctgcagtgattgtctctcactcttttggaggaaaaaagaaaacagggccagcattctaggtaatacattactccaggtggacgtggctgaacgctggaatcctcaagccagagacaggagagctgtccaacaaccatgtgatgaaatctttcagcttgatgttcttgtgctttcggatgcagaagccctgcacagccccagagagctacgtccagagaagagatttaagacgagtgttttaactg

SEQ ID NO: 62331 - DNA, 1087 bp, Bovine  19866881125981
aaaagtagagacccacaccttgcagggggcaaggagagagaggttctagaaaaaggccaggccaatgattcctttactggacttttcactgaggttaggtttactttatgacataagaactgcaagacaggcggacctaggatctcaagaaacaggagattaaatcaaaatgtttaacatccaaaagctctaagtgtattactgaatcttgctcaaagtataaaagaaaatcaagttttatttccttgtgactagaaatttaaccaatgtgttcaagattatttcaagtctgcagatctcattttccagaccttgttaacagccccataatcccccaatttttcaaccagcatcctatttgtacagtggaactgccaatattccactcctttattcaaaaaacacacattaactataacttttcacttaggatggtaacatctttaattagaaaagtgacaaggttaatcaatatttattcagaagtgattaaagtgttaaccagaatcaagaatgtagcaatgtaagaaaaaaatgacaaatgctgttagctgttagcatacgtatggtatcatttgtgctttttagaataatccagacatagaaggaaaactccaaccaagtacaccaactccctactcctgttccatccacattaaggattcaaacactaaactgttagaataaggggtttaaatacaagctacacaacaattacaaaacagaatgccttttatgtgtgagcactggactaggcactgaggatacaaaaaggattcctgaaccacaaagtttcagttttaagcattgtgttgcaatcctgcatcttatcagggggaatctcatctcctgaagttcttcagccactgctaagcacacacagactgtccagaaatcatacctcccttaagagctcacaaccttactcatggagtactctttcaactacgtttcagttgatactctgaattgagactgagtgaataattatatggaaaaatgactactgcctcttctaatcttttcctagaagcaccactaatgtcttatctgttccacccaaagaacatcaaagcatacaaatgca

SEQ ID NO: 62332 - DNA, 1505 bp, Bovine  19866881150548
ctgcctgcttagacttttagataactgtccaaccctggaagagacagattccctaacaagtgatatagcccagaacctttcaaagcaaggatgctgaatgagaaataaccaaccacctcctattgaaaatggtgttgggatacgaggaatcaagtcagaatattttcttctcagtttttccataatctagtttaaccttgcatttacattgaagcttttgctaaacagttatcttgtgagttttggtggctggtggctggaaaaaacctcttcacactaaagctagttagtgccatttgagcaagctttgccggtggctccgcggtaaagaatcctgcaatgttagagctgtggatttgaaccctgggtcagtaagatcccctgtaggagggcatggcaacccactccagtattctttcttggagaatcctgtggacagaggagacttgcaggctacagtcatagggtaacaaaaagttggacacaactgaagcaacttaaaatgcatgatcaccatttgaaccctttgctttagctaaggtgactgctttactattctctgctcaggggaaggctgcctacctgtggtctccactgcccaaaccaaagcacatcaggcactggatcagtcacacggttgctgaggtaggcacaggagccatgccttagaccctggcatcccagtgaaactgggccaatttcttatcttgctctttgactcagttttcctttagatgaaagaatggggtggacatatttcctaaggtgacttgaacatcttactggagatgagtcatcccaggataggaattctgaggtcagcacgttctccccagggcctggaggtgtgtttgttccctccacaacttccctggtctcctgaatgggaatataggttaagaattcagagtaataatataataatgtcagataataatgtcaccgatgataatggtggtgataacaataatgctaaacaacttctggaagttgtgtagtactttctaggagaggagaaagactatttgcattttatctaacttgttttcttaacaggtagagaagtcaagggaagagatggccctctcaaagcacaggagtttagtgatatccagagataagagatgtaaggtgcccagagatgtacaagaaatgtaaattctggttctaagagcttcacatcctggagggagaccaggacattggttgggcatcttctaagatcaggaggcattggctttgcctgaaggaaaatcaacctacccccacttacctaggctagctggaagatagatggagtagtggaagcctgttgatctgttaaagcttttctcaatgctctgctgcatgctaactcacttcagtcttatccaactctttgcaacctcatggactgtagcctgccaggctcctctgtccatggaattctccaggcaagaatactggagtgggttgctatgcccttctactaggggatcttcccaacccagagatcgaacccatgt

SEQ ID NO: 62333 - DNA, 1013 bp, Bovine  19866881161980
cattagagtgattctattttcaaaaaaagtacatacatccaataaagaacaaagacccttacatatataatgaaaacatgtacagaatcttccctagtagagagtagaaaatgtccaaacccaggaaatgattgctgatgatacttttttgggatcacaaagtgaaaaggataagtagcaaagcaaagaaatattttacaggcacaatttgaaagtgttttcatatattgctttgttcctatgaagttattgaacttttctaaagattttttttttctttacagtctcaaaacaaatgaagaagcacttagataaactatcagtagaaaaaacagtagtaatttgtcaggaagaatgagtataatttgaggggatggggcctccctgtatttccaatcacatggattgaccaataagaggcaacttctatgacccctgctcctcctcctctgcgccactttgttttaggaaagctctgtaggaaatagttggaaacagcggtaagcctgccataggctcccctctccaccaacatctgggcttctcattcaccttccccagagcgctgccctctccttgacctccatagctctgcaggctgattagcagcactgcacactgggaaatgagactctggggaactaactcaatccacccacacatgcggcgtggactgccccatgtacctacaccagagttcatgcaaggggacaggaaaaagcatcacaatgtcagaatctacactaggtcctctagttggggctctgcttaattttatacactggctaggaagaaggaagagaacggagtgcttctactttgcacacagtttgaaaatagagttgtatagatatgtacttaaatcacagatacacatatttctaatttgatccctgtctctaccatgtatttgtgctgtgctgtgctcagttgcttcaatcatgtctgactttctgtgaccctatggactgcagaccaccaggctcctctgtccatgggattctccatgcaaa

SEQ ID NO: 62334 - DNA, 1710 bp, Bovine  19866881171610
cactcctcagcccggtcatagcaagacttgctgacttactggccaccatgatatcacctgcttcatgcttgatgctacatagaagagatggggtttgccttggaaagcttattttccttttccagaaaggaaaattcaaaccatgtcaaagacctatagtatcttattcacagagactataatcagtgtacatacacgcatgctcaattgctcagtcgtgtccaactctttgctaccacatgactgtagcattccaggatcctctgttcatggaatttcccaggcaagaatactggagtcggttaccatttcctcctccagtggaccttcccaacccagggatcaaaactgcatccccttgcatctcctgcattgcaggaggactctttacctctgagccacgggggaagcccctctgacaagtgtatgttctataaatttcagtctcggaactggagatgaaacgaggtcagggcggcctctctgatgggcaaggtgaatgatccggtagaaaggaagcataaccaggaggccgtgctagggcctagctctgccacctgccacccaagggaccttaaaatgtcaggtaacttctctcagctttaattccctcatttaaaaaatggccaaaatccaatggaacctattcatctcatcaggctgctatggagatggacagaataaataatacaagcaaataccctcaggatggtggaagttacctctgactgatggaatgcatgtcctttgccattggtgggtgatccacacacctggtctaggaagcccctctgcgaaaatagatgtgatccattgggcctcaattacctcattggtcaaaagcaaaggtagaactaaaatcctttttttctcgaaaatgcagggcagtgaaaaatgactcaaggtggggcaagagcagagcatgaagctacatttaatcggtgagaaatttatttcctttttaattatctttcaatccttcaagtctcagcttggctcgaattttcagttaacacctctctaatatctgctaatttgtctttccaaagaagagagagtaggcctccggcttagaaccttggcaagcagcagtgcctacctagaatttaatgacttagccgagttctccttgtatttcttttctgccttccacttatgggaagtaatattggtttttccatttacagtaatgatggtttcctttctggacatgtttacataaaaaggtgagtgctattaaaggaaactatcatatcaataatagtgcagagattatacagataatggcaaaaatcaaggcaggagtttgagaaatgctgggccagctgatccctaaaattctttccagttgtttctttctctgacactctccccccactttctgatgggggtgcaattcccaccatggcttgtctctactttggaaagagtcagaccttcggagaccctcatttagaacaagaacaacagtgaaaacaaaaggagggccttagaaagttcccacagtacattcatgtatgatctcccatttgatttccaccattgtacaaaagagaaaaaggagacgcctctgaatttacacgatttgcctaaaatcattctgtaaatgattaatcagggctctaacaacattcctccaaagccctgattctttccagaatttctcactgtttctatacccccatcataccaggctatgagataccaaga

SEQ ID NO: 62335 - DNA, 1268 bp, Bovine  19866881191714
agtttgcttaaattcatgtccattgagtcagtaatgttatctaatcatctcatcttttgctgcccccttctccttttgccttcaatctttcccagcatcagggtatttattagatctccttctaacagctacctttccaaggttcttctccttcatacccaggggcagtaatgcccactttgagttgttaaacccaggaactgtgcttttccttaagccacacctacatctttgtaaaggtacctttattagattctccttaaatttgtaatgactgccactcatttgctgatgacccctgactgatgctggccctggcttctgagaactatccttgggtactgtgacagatatgaaaaaaaaaaaaaaagtataaaacaggatctctgcttacaacccagtgggaagaaatggtttgtgataaagtcactgagaagcagtggagcaacatctgagcctttttcagctgtgaaatgaagggaatgaacccaaaatatgctttcagggattccacaaaacaagaacatattttctgccaatgtttttttttgttttttatctcactaactatctttatcactgtctaactgatactttattaaaagtaaacaagattttcaaggtagtttctggatccaacacaataagactgctgacatcttaataaagtgctacattaaatgcaatgttcaggaatagccaaggagaggagtgagcagggctggcttgatattgtcaagggaaggtgtcaatgagaagatggacaaacaagctgagctttaaggatgggcagtttgggatacacttcacagtttggaaaagacttcactttcactttcatgcactggagaaggaaatggcaacccactccagtgttcttacctggagaatcccagggacggggaagtctggtgggctgctgtctatggggttgcacagagtcagacacgactgaagtgacttagcagttcattcctctcacaagggagtcagaggaatgaatgggcttcccaggtggtgctagtggcaaagaatctgcctgccaatcaagagatgcaagagacatggattcaatccctgggttggaaagattcccctggaggaggaaaatggtaacccacttcagtattcttgcccgaaaaactctctgaacaacaggagtgtggcagcgtaccttccacaagattgcaaagagtcagacaagactgaatgagcatacacagagggatgaaggcattctataatttaaacaagacctgcagggaagc

SEQ ID NO: 62336 - DNA, 1430 bp, Bovine  19866881297766
ttggaaatacccaagcagtgagctactctgttctaaggcaagggctagaggaaaaataccatccacactacagatccaagtgactgaggagtgcccatgtaaccaaattttcagatcagaaattaagaaataagcagaaaatgcctgcaaatcatttaagaaccttcatttctctgaatataaggaaaagctatttctaaatacaaattgacttaggatatataagaaatgcatacataagaaaataagaaagactaaaagaaaaacaatggaaaactaaaagatataaaatggaataaaataagtactctgagaacagaccaaaaatatataagtgatcaaaaccaaagggaacaacaaaccaaacaaaaccaggaatttgtcaacaaatcagtagtaaattttaaagtcataactctctattcagagacacaaattataaagaagaattaaatgtggccagagagagaaacatcttaccttagagttcacctggtatcaggtactcagtgaggtattgccagctgttaacagttcagcacggacttttctcataaagtgtgccttctggtggatttattgccacaggttatctgaggaggccacgtgtgccctttgtccacaaagatttaattggaaccttagctccctgcgtcacagggaggaaagcagcactgaagagcacaaagagcggggagaaatcatcctaaacaaagatgcactaggatacactgttttccatccacgcttatctatcatcaaacacgttaacttttgtctgggtctgaatacaaattggaagatacaacggaaccagggtacagatcttgtcccttgttacttagtcaaagagctccacatatccagttgctttctggaaataaacaaatattagaacacccacaggaccaattaaaaaaaagacaaaaaaaaaaaaaaaactgcaattctcaagtataaaaatccaactcccgtggcctctttggaggcatcgattgtgcacttccatttttatatcccaatgctagctcaatgcctagcacatagcagcctccagtaaatatttcttgtgttgatgactggatggatgggttacatgagagagtatggctcattatggaagcttggagtggccctatacttttatgacattgaagagtcatcattagggcaaagaacatgaatgctaagtcacttcagtcatgtccaactctattcaaccccacagattgtagcccgccagattcctctgtccatgggattctctaggcaagaatactagagtggattgccatttcttactccaggggatcttcctgacccagggatctaacttttgtgactcttgctttaacaggcaggttctttaccattagcaccacctgggaagctcatgcaaagaacataaataatttataaaagagcaaata

SEQ ID NO: 62337 - DNA, 1627 bp, Bovine  19866881321255
tgttcttacctggagaatcccagggacgggggagcctggtgggctgccatctgtggggtcgcacagagtcagacatgactgaagcgacttagcagcagcagcagcatatatgcaataataaaccaagttatatacttatgtataaatatattgtatatatattttatatgtaattatatattgcatatttaattcaattacacaaatttatacatacttttgatataaatatgtatttgtatattatatttgcaatatatttcctgtatatataaaagtgaagatatagtcactgggtaaaattctcagttgatatgtgaatatatcacagacaatgtatataaaggactactgtctttctaaagaaacagcagtgaatcatacacagttataaaatataggcaataagaacacaaagtgctatataaaattatacaattggagactcatatacttctgtgagcctggtgggctatggtccatggcatcgcaaagagtcagacaccactgagcgactgagcacagcacagaacatacttctgtgacatagtacagcatatcattttgtgctaactctattactgagaatttttgagagaatagtaaatgtatgaatttcagacagggttagacttgagttcactttctcctgcttttagttcaatgtatacaaaacccatatgtacgtgttgatctaaaacatatttttctctccttttttatggccagtgaaatatttcaattcaaaagcataatttctcagccattctgttaattttactagcacagaccaatacactgtaatattcaaaggtagcatggtacagtggaaaaagtattgaattcaggcagccaagagtctaaattccaacccgattgcttgtgcgctgtatgaccttggacatgtaacttaaactttctgaactcaattttctcatctgtaaaatgagaccaataattctcatttcacaggatcacagaggctcaataaatgctgattcttcaaccttcctcaagctccaaatctacttgtcaaccaaaaaaacctagttcaattctctatgtatctgttgacttgcaacctctgaaaatatgactttatatcaaagccagggaatgatatcttggcttaaaaaaagaaggtaaaagagaaaaattagcattattgggagctttaaaagccacacttgaatgagccatagtgagcacaatgactcagaaacaaggacatttttctgcagatgctcttggagttctcaagtacttgggagtcaaatctggcagattcataagaagattaataaagtcttagaaagttgtgaagcatgtgaaggaagaagcgagagaagaaaaagtgatgctcccctgaatctatgcaacctggcagagtggtaggaacaggtgtcagggacagaccttcagggggtctgctctctgaaagtacccttttcctaccatttactaactgtgggactccaggcaaagtccttgacttttttgacctttagtctcttccactatgaaatgacctaataaaattcactttctaggattgctggaaataataaatcagatcaagcatataaaacaaagtttgaaaactagaaatctttaggtcaaatctggt

SEQ ID NO: 62338 - DNA, 993 bp, Bovine  19866881375715
cctattgctctatcattcttttaaagcccgggccctaaccccttccctcctgtttcaaaagcaaaaatttgcatgctaccatgcaaactttctcaattaacagtattaatgagagggagcagaagaacctttgattcaaaagtaacaaaatgtatactggccaccttttccaccaaataaaagcttgagagggactttattggtccccttccttgatgtgtcacatggtaggcacagagtgaacattctttgagtggacaaatcctgaattaattcacaaaataaatcaagtagggctaatcagaattcaattatttgatatcgaatatgctgactaacattgcagttttaagatcttaaagacatgtgcatatttagtcagttcttgactattccttctgtagcctgtacatgcttctagatcatcacctagaatctctctttactgctcatttgttgctagttttttgcccaattggtttgcagtctataaccatgtctaagcagaaaccagttcaagccaggcaataatgtgagtcttcgctctagaatgagcttataccttgagaaagttagactgattgagcaaatggggttttgggtggtctatatcaggccatctatctgtttgccctggtcctcacagtcctgtaaaattgaagagtgagagccaaccccgacttcctcagaatcttccatgaattgagagcactggcaatctgtctggggccacagtaattgaaattaattggattttagagataataacacttatgctaatgtgggtattgagaagtgacaatagccctggagataataccttagagaggtggggtggggagaattttgctgtcccagctggagagattaggtatcctggtggggcgggtgggttgctgctggagtggggggttgtgagaatgaggtacatgaagttataaagaagatgggagacttcagagaagcaagagaggagtaaagtgggggcagggg

SEQ ID NO: 62339 - DNA, 932 bp, Bovine  19866881537094
agggaaagaaatgaatgtgatatgtgtgtaggtgggagactgtgtgtgtgtgttgctttggctgaatgagtccaggcagtgataatttgcttcactcgtgtccgactctgtgagaccttgtggactgtagtcctccaggctcctctgtccataggattctccaggcaaggatactggagtgggttgccatgccttcctccagaggatcttccataagccagggaccgaaacccggtgtctcttacctctaacctgcattggcagggaggttctttaccaccagcgccacctgggtagccccaagcaggcagggggccacttaaatacccaggttcatcacccaccttctctatcgatctcagcccctgtgacctattccttcagtggaacattctaaacctccagctgcacccgtgtccccgccaccagtgcagacacacacagcccgtctccaaagttccagacagcaaagttcagtggcccggccgcggctgtcagaccctgcctgcacatctcccgcttcctcatttctggacttcagtgtcacccaacaactctgccctcgtagatcagactcgggaccgggagtagataaacccggtctgtaggagacaaagccggaaggacgggcgcaccctcctttcttccaggcggggaccagactcgccgcacgagcccgggcagaggggagaccctgacagttacatgcggagacaaagacacctggacagacgccggcacagacagacaaagacccactgacgcgctggcacgccgcggggagcgcagtttcccgggagcccggctccctccttgggaactgagcgagacccctgtccacctcaccttatctgtccctgctcctggggctgacttcaggtttttttcttttcttttcttttccagtgtgttggcgatgtgctcccgtctct

SEQ ID NO: 62340 - DNA, 730 bp, Bovine  19866881552925
accccggccttaagccggtgctgccacggtcaggcgccatcctccactcatcccctgagagcgccggccaccagctgcatcctgcgcctctggacaagcccaaggagcaggagctgaagcccagcctgtgctccggggcactgtccgactccggccggaactccatgtccagcctgcccacccacagtaccagcagcagctaccagctggacccgctggtcactcctgtggggcccgccagccggtttgggggctcagcccacaacatcacacagggcattgtcctccaagacagcaacatgatgagcctaaaggccctgtctttctctgacgggggcagcaagctggcccacgcaagcaaagacaagggctctgtgcgctcccccatctccacggaccagtgcaccatccaggagctggagaagcagctgctggagagggagggcgagctgcagaggctgcaccgcagcttcgaggagaaggagctggccgccagccaaccttacgaggagcggccgcggcgctgcaaggacgagctggaggggctggaggccaagggcaagatgaaggtggccgcacagaagagccagcgcgctcagcaggtcctgcatctccaggtgctccagcttcagcaggagaaacggcagctccggcaggaactcgagagcctcatgaaggagcaggacctgctggagaccaaactcaggtcttacgagaaagagaagaccag

SEQ ID NO: 62341 - DNA, 1277 bp, Bovine  19866881622314
taaacaggcaaatttacctgtcagccaggacccaaatcctcttttccagaaaagataacctaagcagagtgcatatctttttgaaacatcaggaataatcccaaccatgaagtattaagaggccagcactctagactgcaataggcttgtcctatttccaccctttccccatttaaaccatgttccagggcactgaaataataccaatagaatacttctgttcactggttctcttcttggtactaaacagtcatgatgttacaaagaaaacctgaaactcgtggcattacgccaatattgcgttgtctttcccaaagagctgactgcctgggatgcagacaagtaatcacctttatcccttctaaccatctttatgatatcttagcccatcctcctatttctgagtccctgagtcccctatatggcactgcacccatcaagatacctgttggtaagaggtcccacgaaggggttgaccagaagttgcatcagagccttggaagcaaatagaaccccaacccataagttctcttccttcaggaattctgtggcttgaaagcagttgtttccatgtgctgggatggcttcagtgactggagggaagatggtgccagaaatgctgcttgtccttgctatgccactgggcacactttcttcaacagccacagtgttgttttcaaagaaggagaggatggtggaaaaggcgggagtgagggaaggctgggtagttgtggcagagccgaggtacagagaaccgttgatgtctttgaactctatggcatagaggtaggtgggcacaatgggcactgaaagtgaagtacaagtcatgagcactaaggccagattgtcttttgactgttagtcaattcagggacattaccacacaatccagattgatgctcatggagatgtctaagtgacatgatctgaagtctactcaaaggctgtgccaggacttccctggtggtccagtggttaaggacccacctttcaactgaggacacaggttcgatccctggtctgggaacttagatcccacatgttgtggggcaactaaacatgtgtgccacaactactgaggtccctgtgccctatagcctgtgctctgcaacaagagaacccactgcaataagaagttcatgtactgcaactatagggtagcctctagtcaccacaactagagaaagcccgggtgcatcaacaaagaacctgtgagccacaaaaagaacccagcacagccaaaaaaaaaaaaaaagactgtgcctgcccaaattatc

SEQ ID NO: 62342 - DNA, 1423 bp, Bovine  19866881688521
agcaaataacgttattattcttagcttgctagtgaggtgactgaagatcagagaggttaggccacttgcttaaagtcacacagccagtgacagagataaatgagtgtgcttgcattctggccagtctataaataatgtagctgtaagcttttctacatgaagcatgggtaacccaggatacccaaattccaagtttgggggcttagggacttaactatagtgttatgtcatgtgttctcttaggctgggctccagtttggactggaaggttttgtttctgggtgaagtaattgggtggggaatagctctgcttagtgaccttggagtatgacacatcgagtccttgcttgagtttttttttgcctgtgataaggatgagaagcctcataccctgggtttgatatgtctagggaactcatatcccgccggtgttaatcctgcctgtgaaatctcattgtaattataaacacgtgggcaggcccagtgagcgctttgactagtagagcccttggaggagggctgatttggctgaaccagggtcctgattccactgcctggccctgggcactctgagtctccagaccgcctcaactcctacaccccagccccagtttccaatgtcaagacagcagagtactctggtcctgtggttggtttttccttttaaactccaggtttggccagactttcttcccaacctggagtcttaatcacagggagcaattacaccagaatagaacgacaaatcgggatcaatacagagaggcgactgtctactggaagaaacacaatttatggcttggctggattatgcttaccagctgaaaacagcggtaattctaagcaaccctactgaccgggatcaatcatggcattttattactttgctaaaccctgcttgctccctacccccaacctctgtctttttagaacccaatcctcaaggaaaatattgcacttgttatcaaattttagaaagagaatttatggcaaagggagattgatttaaagccttcttctaaaaggggagcggagggtggtgggaaggtaaattttgctgcgtcttttagattggttcttttgcttatctctccattttatgacataatctgttgtagcattacccagggtcctctgggctgacgcttcttgcccagcattagataagggggagatattgtcagggtgtaaagtttaaagcccgtggcaagggctcatttttctcatttcaggcaagggagaaaggatataaaatggaaagcaagcaatcaataaagaagaaagatagagatcttccccaaaaggggtggggcggggagaaaagaaatcctcacctcactgactgctcttctaactaagactttaacaggcggataatgagcccacacatctcggtcagggcagagactggagacccatctcc

SEQ ID NO: 62343 - DNA, 1823 bp, Bovine  19866880340825
accgctggaaaaacgagagccttgactagacggacttttgttggcaaagtaatgtctgcttttgaatatgctatgtaggttggtcataactttccttccaaggagtaagcatcttttaatttcatggctgcagtcaccatctgcagtgattttggagcccagaaaaataaagtctgacactgtttccccatctatttcccatgaaatgatgggaccgcatgccatgatcttcattttctgaatgttgagctgtaagccaactttttcactctcctcttgcactttcatcaagaggcttttgagttcctcttcactttctgccataaggatggtatcatctgcatatctgaggttattgatatttctcttggcagtcttgattccagcttgtgcttcctccagcccagcgtttctcatgatgtactctgcatagaagttaaacaagcagggtgacaatatacagccttgacgtactccttttcctatttggaaccagtctgttgttccatgtccagttctaactgtcgcttcctgacctgcatataggtttctcaagaggcaggtcaggtggtctggtattcccatctctttcagaattttccacatatagtagggtttatatttcaatcaaccacaaatttcgtgaaggagatatatttccttgccaaaatgaaactacaaattttgaccctttgggatctaccttcccttcctctctaagtgtgcataatccaaattatttttgtattcttttcaagcaaggacttaaagtgctgtttcactttgtcttacacttacaataattatattcctaaaggaattatcatttaaaaaaactattgttaacgcatttggctaagttacatttgtatagccagctattgtaaaagtgtaattttcagtatagtctttaagagactctggaggataacattgaatctctctcaaatttgagttttagttttcatggatgctttagttttatatagtataatctttgctattcagagtattttattttaagcatgggaaagcttagctttattttggtgattaactaaataaagctatttatcattctggtaataaaacaaaaaacaccagtattgctttggtttttctttttcccctctctttccaaaagtaatgtataattctttatagaaaaattgacttttttccattgaaaactccttgttatatcaaatgtgaagtctaagacagagccttctgccttccagaagctcagcacccggtaactactgtactaatttgaaataccataagatcttttgggaggtttgagtggagcactatggaatcagtgatgaaggaagaaaaagtttgttgtgaaagtttcaattaaaggaggtaaaatgtctttggactctagagcaattgttgttgtcgttcagtcactcagttgcgtcctactctttgcaacgctatagactgcagcgtgcctggcttccctgtcctttcactatctctggagtttgctcagactcatgtacattgagtcaatgatgccatccaaccatctcacccccttctcctcctacccttaatctttccccccatcagggtcttttccaataagtcagctgttcacatcaaatggccaaagtattggagcttcagcttcagtatcagtccttccatgaatattcagggttgatttcctttaggattgactagtttgatctctttgctgtccaaaggactctcaagagtcttctccagcataacagttcaaaagcatcaattcttcagagctcagccttctttatggtccaactctcaaatccatacatgacagctag

SEQ ID NO: 62344 - DNA, 4155 bp, Bovine  19866880344433
accaatccctatgtgcctaatctgacatttacattgtttggactatttccaaaccttcatgccgggtgcttttttcaactgcacacctctcctttgatgtggatattctagttaagattttacagtgtggtagaggagcctggtgggctacagtccatggggttggatgcgacttagcaactgaacaatgacaacagaggattactcccaatacattcctctaatttctaaccttttctttcttattacttctactcatttcctcatttttcatccaacagatcagtgagaaagatgcagaagaaaggacaccaggcaccattcacctattattcaaaaacatgtttctaggatgaggcatttaacaattatgctgcctttcatcaatggttgttctcttaactcaagaggcagtggttgctgttgttgtgtactaaaaaaagagtaaataaaacactgaaaaatggcttacacatttttgatcatttgcctaacttatgcattaattaactctcaagtttgctttttcatattgaatttatagacatttactgagtatgtttattctttaatcttatagaaaatcacaaaagctattgtttgaaaacttcagaacagaaaggtcatcgttcctttacacaaaacaattttctttccaatcatgtgtaagctacttttaaatatgcatatttgaattagaagttacacaaaataatccttctacctatattttgtctttatatctgttttgtgtttaattgaaatttctcattccaccctgactcaaacctttaccctagcttattttgaataatgagactatgagtagcttcaatttattgtttttgacttatctatgttttataatttttcaatagccatatattacttttgaaacaagaaaaagcataaataacaagcatttttaaaaatgtgtactttttaactgtcctaaaattctctagaagtgaatctttctcatttcacccacctggaagatgttcttagtatcatattatcatattaatccttcttatttcattatatgtaaaaatactgtcatttgtaaacagattttagttcctccactaggaaaagtgttggacacaaactcattttggaatttctcacaatactttagagagcggctcttaaaaaatagggtagtgtggagaagagtgaactagaattagaattaatggctctaatggctctaaaaacttcaaaattattcttcaatatattgtcctttagtcactgtgtccaactctttttgagacctcatggattgaagccaatcaggctcccctgtccctgggatttccaaggcaagaatactggagtggtttgccatttctttctccaggggatcttcccaacccagggattgaacccgtgtctcctgcactggcagctggattctttactgctgagccactaagagagcccttcaacatagttatcttttggctatttcttcaacctctcaacctccttaacttaattttttcttttgttaaattaacatctcacctgtcttttttctcgaatgttttgcaattttttgtccaagccttttcatagtttgaaacaatcaaagccaatttaaataggcttgtttatcccaggaaaataaaagtgcacaacctacttcccttagcaagggaagtgctgtagtccattataagtatgatgtagttaggttttattattttatcatcatattgacttaattaaaaaattttatcacaagtagccaaacaagcaccaaaatataaactcagtcaataaaaatttggggcaaaattaagaacagaaaggtctgttacttcccttcaaaaaataataaaacctaactgcacgatacttataatggactacagcactttcaaatttgcagaaaggagcatttagataaagtcaacacctgcagatcactttaacacctgaagcttaagcctattaaaaataccttggtaaaaaatgacaataccatgggaagatactggttatgtaatctatacattgatatcctaatactcttaatgaaaaatgataaacaacccattatctcccagatccaatttaccgtacagaaataatcctcagtttcttgattagattgtgcacttatatcttaaaagtacttaaaattaagatgtctctgctcctcaaatagttcattcattatttggctattggcaccaactaggctttcaatgtattttgtaattattatgagtctaatcacagtgtgacatttaataccagattctaagtctttctttcttaatatgaagatcagtaattcattagaaacttattatcaggataactatgttcctatcatttgtgtctttctgagaaatgcagtatctttgctatcaaggaaactaattaggattaggttttttttttttttttttttcccctccaaattatactgaagacctatactggtgtcttgagttaattctagtgaaaaatgacaattacttcattcctaagcactgacatttttgggtcccaaaggtccagcaactcagcatgtctgtgtgacacaataatgcactctcatattgtgggtgtggaaatggaatcattttccatgaatctaagaaagtcttgataacaggtttaaaacactttatagactcaaaatttaatttaaaggaatagcttaatcagaggaaaaatcaaaggttacctacttggactaaatagctgctacacaaatcttttatccaaattatcatatatctgcctatacgcccctgccttatcctgccccatgatagatgtacaaccttttgatacagtggacacagtcattattgcttgtagtagtttagaaatttcctttgtatttaacaaatattcttcttgagaatatacatgcaattaactggcttgaaaacaaaatatgtgtgggattatagggagaaagtgtcctgggatttctcaggtttatttaacacattgaaaaaagtctgttggggtgctggagagaggacagtatttcgaaaagaggtgaaagcccatttttccatggtaccacaaaaagaatgataacatattcaagaagataagaatacttggatgatgaaggaattcagaaactttgtcgtataagaaacactgaaagaagatctgattaatgtaaatatgggcttccctggtggctcagtggtaaagaatctgccagtgcaggagacacaggttcaatccttgggttgggaagatcccctggaggaggaaagggcaactcacttaagttttcttgcctgggaaaccccatggacagaggagcctggtgagctacagtcagcccatggaattacaaaagagtaggcaccccactccagtactcttgcctggaaaattccatggacgtaagagcctggtaggctgcagtcccatggggtcgctaggagtcgaacacgactgagcaacttcactttcacttttcatgcattggagaaggaaatggcaacccactccagtgttcttgcctggagaatcccagggacgggggagcctggtgggctgccgtctctggggtcgcacagaatcggacaggactgaagcaacttagcagcagcagcaggatacaacttagcgactaaacaataacaacaacataatgtacaaagaggaatggggaaaggtcgcaggagtgggggaaggggtaatgattcgcctggaaagctccaggcttactttgtctaaagccagtctaacactaggaatttcactttacagaatcatcactattagttcaatgtggagtaattcccaaagacagtgactatctcccttttcatttagagtgctgcctgtaactgacaatgtacaagctgaggcaaaatgatggatgaagaagagggagttttctaaaatctatttgaattttaaggagttcagtgctgctgcataattgatggacaatgggttaccgagcagagatacggtaatataatcttgagggtactgggtatatggaaaattaaatactaacatatgagtaccaaggggaagatgcatagtagacaaagggcattaaaaataatgtctccagggtatcttcattagttctaagtatacaataactcaaccatatgtgcctatggacaaattatctcaagcattctctca

SEQ ID NO: 62345 - DNA, 1298 bp, Bovine  19866880353966
atcactataaagctctttccatttgccataatttgttacagaatagaagagtttgtgataaaaaccagggtgagacacagcatggaagatgtgcaactctgtcattccaaaatgaaaataatttattgtcttagagtagtctattcaaataatagctgaagcccactgtccatccacattattatcaggctgcagccttccacacagaaacacgttagccaaattgttccccaccactaaaatgtgtgtttatggtttatgtgagctgaataaattactgttaaagaatcaccttctcaaacctatcgatgctaagttgaaactgaaattatttcatgctaatatgagtgaggatggttgtagagagatactattccttgaaatctaaagggacaagctaataaaacactttcatctacctttaattgagactgcttgtctgctgacaaaacctgttaaagtacagatttaatgaagatttagctcctaagtctgtctttcccccacacctaaacaatttctaagacatcaaaagtgtcctgtcatgtggcgtatgctcgggtaaattctttttattacattcaacagaaaaatagactattttaataaactccaggcaattggaatcatacacctgccttgttgacttcttttctgttagaagaaattgccaagtttataaatgagagcctagcgtgcagcactctctgtaaacactatgtgcctctgagattcaggtgagagctagttttggaaacagttccaattgcaacactcctttatacatataaactggatttgtctttgtacatctggaaaatacaggcaaataatctactttgtaggctcaagctgaataagcttgtttcctttaccctttcttcttggcacattgtttttgtttttggaaacttacaagtaaacagaacaggagggaagggctctttcttcatcatagaaatagaaaataatatcaatatgacactgcacctcagaggtggatttcatttccaagaacagttcagctttgctctgatacacggtgggtatctgaccaccccctgagttttcattgacaactccctgcattttaagtgaaattcctaccctctgcttgtacagtactgcactgactgtgcagtcaaatccttactgggctgagacatacaaagtacaacctgggctgcctccatgatagtatctgagaacatgaacgtgctccctggaatcatatggggcaatctgtgtgacatgtagtttgctgtctcacatgccaaaatacattttgagagacttta

SEQ ID NO: 62346 - DNA, 1401 bp, Bovine  19866880369558
tatggatgtgagagttggactgtgaagaaggctgagagctgaataattgatgcttttgaactgtggtgttggagaggactcttgagagtcccttggactgcaaggagatccaaccagtccattctgaaggagatcagccctgggatttctttggaaggaatgatgctaaagctgaaactccagtactttgcccacctcatgagaagagttgactcattggaaaagactctgatgctgggagggattggtggcaggaggagaaggggatgacagaggatgagatggctggatggcatcactgactcaatggacgtgagtctgagtgaactccgggagttggtgatggacagggaggcctggcgtgctgcgattcacggggtcgcaaagagtcagacacgactgagcaactgaactgaactgaactgaagatgattaaatagagtgagacagtaatagagaccagacttatggacaagaggagcgaagagggaggaaagagagggtgggatgtatggagagagaaatatggaaacttacattactgtatgtaaaatagatagccaatgggaggttgcaatacgactcagggaactcaaacatgggctatgtaacaaactagaggtgtgggatggggtagaaggtgggagggggattctatggggaggggaccataatgtatgcctatggctgattgatgttgatgtttagcagaaacaacacaattctgtagagcaattatccttcaataaaaaaataatttaaaaaattaaaaaaaaattttaaagtttaaaactatttggaaatgcttatatagattcattgctaattttcatatctaaaagtatttaggttttccatcacacaaacatgagaaaatgtgaaatggatatgatttatctatgataaatatatttctataaataaagcttatttcctctgttctattttttctcctttccccaaagacctcacagtgtttcaatttttgaaatctttcctctaaccaggaaaaattaagcagctgctacagataaaatgagcattaccagcagatattaaaactgtcacctgatggaaaccggggctcaacattaggccttcaagcaataaccagcagtataattttgtaactcatatatcaattaactttatattactgtcacacatgacactaacagctaacaatattgcttcatgctgctatcttaattgcaaagtatgggtgctgaacgtgaatatcttaagatgaaaatatgtcctattaaaaagtatctaagctgtttggcaaaatttattggaaatctataaatctaatggtaggaagagttttatcttaatttttaaataatcttcagaattaatgcagactttatagtatataaagtgattttgtataatttg

SEQ ID NO: 62347 - DNA, 1734 bp, Bovine  19866880428732
taagcttacccataagtagaaagaaaaagaaataggaatctgcatattcccaaaaacactataatgagttccttataactcaggagttaatgactataagcacagtgtagcttatatttcctgatgcaatttcctgactcatagtcacatatactaattatatccacatatgctgattatgcttgattattactcaatctctgatcttcaactagttagtgttttctataaaatatcctaaccaacatttactttatttttaaagaatgtatagtttctgtaatgtccacatcttttttttttttttgaccatgccatgcagactttaagatcttagtgcccccaaccagggatcaaattggaccaacagggaagtctgttcacagtttcttaaatcatgttcatggcatcatttggaaaattcttttttctttactcacatccctcaaagaataatccatcatcagtgtactaaaacataaatagactttcatttagatttaggcttaaattctctgtaatctactgatgcaagctagctaagtgagcccaagaaaggataattgaattattatataaactccctttggaaaagttgagtaaaatgcagtgtctacgggatgtatattctgcatgagtgttgtagaaaacccacaacctagtaaattggaaaagcaatctagtggcttagttgtttaagtactaatgcagagataaaattgcttttaaaaagtatcacaccctcttccaagtgaacttttgtttatttcctattcaggttgccttggagaaaggagaatgaagttaatgttcctttgacataagtgcaccataatggtgaatacattaaatatcctaaagtagatggaatagttaggtagctaatttactatatcatgaatggttagggataattcatcttctactgtttctgttaaccatccttttgcctttttgcaggtctcaggtgtcaaagagtgaactaggacacaaggcagttaagaaggcacaatggtttagcagggagaactttgtctgagcccaaatttgccagtatgtttcaaggttttgaccttggaaaatcaatttaaatccccctgagctctgttttcttacttgttaaagagggaaattggactaaagtatcttgtttccaccttgatcttttcatgtattgataatgcactaactcatcaacaagacaatcattgataattgcatttttcagatgaagttgttattaaattcttagaaaacagccaaaaaacagctgtgccctaagttctgtttactttattatcctcaatgtcactaagagttaccattaatgatgcacctacagtgttcagtgcatttgtgctggcagtgataatgttacttcccattaggaacaaatttacattatgataccaaggcagtccatcctaacatcacaatgggtatctaccatccaaattaatgctgatttctgaccacaagaaaacattttaaaaataatgatatgactaattggacaaggtaatatttctgctagtggtatctggtagcaagaagaggcacaatataacctgatgtataatgatatctcattttatcagcttcattttcatttggcttgaatatgttctttaatttctgataatgggcatttggtcagtattgttacttaccaacaaactaaacaagaaaaatgttgttagatgcactgctaatggaaattaatgatagcctgta

SEQ ID NO: 62348 - DNA, 1875 bp, Bovine  19866880550270
acatttcttatattctttttcttatattctataaactatggtttatcacaggatgttgaatgtacttccctgtactatacattaggaccttgttgtttatccattgtaaatgtaatggttttcatctaccaaccctggacactcatttcatccttttctcaacccctgctcttggcacctgcaagtctgttctctctgagtctgcttctgttttgtagatgggatcacttgagccatgtttttgacttcacatgtaagtgatatcatatatttatctttctctttctgacttacttaacttagtatgataatctctagttgcatccatgctgctgcaaatcgcaggatttcattctttctgtggttgagtaatagtccattgtgtatatatagcacatcttctttatccattcgtctgctgatagacatttaagttgcttccatgttttggtggtaactgctatgaacgtgggggtgcatgtatctttttgaattacagttttgtctgggatatttccaagactgaaactgctggatcatacaggaattctatttttagttttatgaggaacttccatactgttttctatagtggatgtaccaacttacattcctattaacatgtttcttaaataccctgaagtttgtctgcaatattcttgggctacatatttggtcaaaagcaaatggagaggaagagatattcctggttattaaggaaactatctatgtgtgtacatctgggggcacaaacgactccaccgtattctgcatgtggctctgatagactcgtgcaccacggctcgtggactcctccaggagggggaacctatctctgatgccccatcccccagcccatagttaatgtccagtgaatccctgctgaataaacagctctattaggtctggggaaccatcacgaggaatctgcctatgataggctcctgatcctgaacaagtaacttgacctctctctgctgcaaatttatttgtctgaaaaatgggaattatacataatagcacctatatcaaagagttttgtgaaaattaaattagttagtgtatggaaagcacttcaaatagtgcctggttatatcagtaccatgggcttccctggtggctcagtgataaagaatccacctgctgatgcagcagatgcaagagatacaggtttgatacctgggtctggaagatccgtctccagtattcttgcctgggaaatcccatggaccaagaaacctgtgggctacagtccatgggatctcaaagaatcaagcacaactgaatatgtgcttacacaggcttcataaacagccaaataggtagagaaaggttaaaaaaaaagtcaaaggcattgtttttggatatgtttgtggaaagacacaggagtgtttagggagggatggggatggtgatgaaggaaacttagaaaggactttggtactttgttatcattgagttggcgtccttgactcaggagttaggaaagtgcagccctgagctgtggctgtcatgtggcaatgattttaaatcagcctctgacatatctggtagcagcaggagggcaaaataaaatctttcctctgattgaaatggttaggggattcagggaagaggagcacaagtgcccgaattagaaggaacctgggatcatcagttgaaatccattctctttagggagaaaaaaaaatcctctgatgagtgcaagtaactggggtctttcttccctcttttatcactcatcttaaaaacgatacccttgcttgcctattaaaaaaaaaagaaagttcgaggcttaattcagaatgacatccccatttaggccataaatgtttgaagcttaaaatcaaactcgttttccgactctctgcaaca

SEQ ID NO: 62349 - DNA, 1787 bp, Bovine  19866880606999
ttttgacaacacagaaaacacacattctcctttgcaagtatctaatacttgacactgctgctgctgctgctgctgctgctgctaagtcgcttcagtcatgtctgactctgtgcgaccccatagacggcagcccaccagggctcctcctgccctgggattctccaggcaagaatactagagtgggttgccatttccttctccagtgcatgaaagtgaaaagtcaaagtgcaatcactcagtcgtgcctgactcttagcgaccccatggactgcagcccaccaggctcctctgtccatgggattttccaggcaagagtactggagtgggttgccattggcttctcactggcacctcttataggcacctttcactccaaagatacaatgattcacaattaaagactactactaatgaagcaaagaatattattagtggtactaccaaatactctgaagtttatttactttatgtacatgaagtcttgaaaaggttttcaggacttttttttttttttttttaatttgtgtgtgtgtgccacactggggacaaaacggcccagaatagcattatttgactttttaagcccatgttaaaattaatagagtaaatcaagacttcatttatgagaggaacagtacaagaaaacaccaggtttgtcatatttgttttaatcttttaaatattgatactcataacctatactttagttattttgtaaatatcacatcctgatgcaaagagctgactcactggaaaacaccctgacactgggaaagattgaggacaagaggagaagggggcgacagaggatgaggattgcatggcatcactgactcaatggacatgagtttgagcaaactccaggagatattgaaggacagggaaacctggcatgctgccattcacaaggtttcaaagagtcagacacgacttagtgactgaacaacaacaacaaatattacaataacaaaatggcctccataagtaaaacagaatcaagtttaacctcttcctccaaggagagttttatatattttaatttgatgcttataatttggtgttagtcctaattggagtatagcatcctataaagaacctctaatgatataggattgctcatagaacattagtagctctatggaatgttgcaatgatatttaacaatcaaaagagagtacaataaaaattaacaaatttcctaagttttactttgttcaaggtagaaaaaatatatactatctattttcaaataaggatgaagaacatttaaatattctcaatcaggtgaccttttgtttcactgcacgatatttgtccttgttaagccctagtgccaaaagattattgcattttaaagctatttcgaggctaaaaatattcagaatttctacttcataaaaatgtaaatttgcataaagtgatttacactcttagaacacaagaagcatgaaactagattctttttattacattaggacttgtgaatgtcaaatcagaagtgtatattttgattactatttttataggaatataatgaaaattcactagatagttcatacacttaagaaaagcaggccaatcctagacaattaaaccatctttctttgtttttcaacattagcaggaaaaaaataatgaataaaagggactctaaaatgagctctttaaaacacaaagttaaaacaacaacaacaataaagtacttttcaattaatggatagcataatcataatctctttagtgtttacagttaaaaacttaattatataaattttaaacacgtacat

SEQ ID NO: 62350 - DNA, 1792 bp, Bovine  19866880738890
ccaggagaaggcaatggcaccccactccagtactcttgcctggaaaatcccatggatggaggagcctggtaggctgccgtctatggggtcacacagagtcggacatgactgaagccacttagcagcagcagcagcagcagcttcaaatactaacgttgtataggcatgtttggttctgaggtactcaacttttccttttaagttgtgcaaccaaaatttcaagcatttagagatggactgtgtaaaagtcacaatatttaatagtaatatacactttgagtaattgtacattttgttgtactgtaataggttatttttcacttttagaagcatgtcttaaacattcaaaatgagtttaccttctaaatattaatttttaatctattttattttcatagaaatgaaaatttaagttaaatagtgtagcagtagaaaatttgtaactatgcattgctaactttaaaaacctccacagtgaccagctttttctttcttcagtggctcagagtttgtagtttgttcagtaaatttacactggcgcccaggcctaacagacacttactgaattcttcaagcggtttttgtagcagttcattcttagggaaaagtaaagagaagtttgatctaataggaatcaccctgcagtgtgtattcttctgttatctccttactttttcctcctggatcctcatctctgccctgacttcgcactaatatgtgagtaagaggaaaaacctgcacttctttaattagctattctaggatgaaactttaaactaggacaccaagtaaattcagatgacttctctctaacaacttaattaaaaattgaagaaagtgcagttgttatatgcagaagtagatgtgtaatcaggtagcaggacagagaaggtagttggtctaaataaattatttgaaatatttttggtgtcagttgcccagaaatctaaactagccatttcattttcccaggagtaagttttgcaaacttaaggaatgaaatggatacatatataaatatatattatatatgagagctataaataaaatggaagttggtcttctaacttagcatttcttaggtctcaagttctgactcacagctgttaaggttgctcatccttgactgatcatattcagtaaactgagaagagactaatacaattttaactgagctgtcagatttgacatcatatggtcaattcttcatttgtactttcatgttatcaattttcagtttctaaaaacaaacaacagaaaataggaactttttgcataacttcttcaattttatacctggtattttttgtagctcatgacctcttattttttgactatatgagattcccaagtaatgttgagaagaatttttttaaatcaggatgttaacacatatgctgtcccaggacaaaatcttgcataagaatttgctgcaggtcaggatttctaaaatgtgaatatattaatattggtaaagagttaaagataagatgtgtcttccctttcttaaatgatattttgttgaattgtagttgaaaaaacctaggtgctcaatttgtctaggctcgttttcagtgaacaagtttccaaaaaatgggcactgtactttaaagctatttttgggaggtgtttgagcattgctcctcagtgtactctgtgttgtagcagcaccttttggaaactcaaagaaatgcagaatttcagccctaaccaaggtctactgcatcaaaatttacactttaagaagatgcaaaagtgacttgcattggaagtttaggaagcattatcttag

SEQ ID NO: 62351 - DNA, 1756 bp, Bovine  19866880746595
atatagtaataattactttatgaggattaatttaaattctcatgacatgtgtcttctgtagagaagtacttaactatctgtgttacttatagtgatgtttatgacacccattgaacttttattcatatttcacaattatccaaataacacaagcccacctagctaagacatctgtcctctatcatattaactaataaagacactcttctcacttgatagtttggggtttagattttatatctacaaaatgataactattctatgaaaaccactatctcaccatcctttttgtttttctacttggaagactttcatactttttaaatgtttgtttgattgtgaaggtaaaatggaaggagctggaaaatttatttactccatgcctttggattctagataattctaggggagggaagttcttcacagtgtcataaaggatgtttgcctatggtgcttccaatctcctttgtgttaatattaaatattttcatcagcagtatactttcatgattgctcccatttccacaaatatctttcttttatctttaattcacaatgttgtaaataaatgatgaggaaagtttcacttcttccagggacagttgctacctgtatagatctgagactcaaacacacagaattttagttcacatccaacaggtgggaaagatttgagaagaaaacattgagacctgttttggaagtataaggttggagcagagtctcagtaacctaaagtaatatgaacaaaataactgcttatatgatttgcaagtaggtttctttagtccaacatctgtatcaaatgcgcatttatatgtggcatgtcttggtgagttgttaagatgactaaaggcactgctagcatttaatgcctagaggtcaatagtgataaatatactcccaataaaaaattattgttctcaaaatgccagggatccctaaattgaaaaacaaagcagttcctctagtggttatgagagcaggctttgtgtcagtagatgagtgtttttggtcttgactgtgcccactttctggttggatgatattagtcatttagctttccacatagcctcatatctgatatgcaagatgcaaacagtagattttccaagagtattaagagaaatacacaaagtttaatttagcatgtggcacatagtgcacattcagtaactattatcactgatagtattgttttattatcttccataaaagaagtgttttcaaaatctagcaacttaacacagtaagaagtcatactaaatggttgtgaaaagcatattaaaatgttgactatatttaaatcaaactgtaaacattcagtctattttctagactatttttgacacataaactaaactccagctctattagtcacttggtattatgttgatgttcagtatttccctatgtgatctttcctttgtttggaatgacattctccttcttggcagtttggtgatttcatattcatttattaaaatgattaaaaattaccttttctggaaaatttccctcgtatttgtatcagttctttctgaattgtagtggaattacccagtatgtgtgtgtgttagttgctcagtcatatccaactccttcacaaccctatggactgtaacccacccaggttcctctatccatgaaattctcctgggaagaatactgcagtgggttgtcattcccttctccaggggatcttcctgacccaaggattgaaccccaatctcctgtactgcaggcagattcttta

SEQ ID NO: 62352 - DNA, 1833 bp, Bovine  19866880787443
taatcttcttataaattaaaatcagtttcacaattcacatattaaattttcttttgctaaagtaatagcagttatatttaaaatgcatgccactcttttcatgggttaattgtgaagtttgtaaattttcacagaaccaacatatacataacaactaccttggcaaaatctttgatgcatctgttttaatcatgcatattcaaagtgctgaattcattaagtattatgtgcagtcatgtttccctaattaaaaaaaaaaaagattcctaacccattgtgatacttctattgtacgttctgcaatacaaataggcacaacttaggtgcgcagattttttttttaatacaaggacatatttatactgataaactgtgtttgctagcttggcacagacgttaggtcacacaggctactatacgtaactatgactgacccaggtggaaaaaggagacccattaacgctgataggcatcagagttttcctcttattcctttgttcgtgttcacaagtgtctgaagtgggggatgctcaaacacagcaacaaaaaccacagggctattttgaattctgtattcctacagaaaaacaattcacttccacattgctctctttcagaaagcctggctttccaagttcatctagcttagtggttttggccactcacatatcctccaggcaatattggggaatgaattacaaagaccaagcaccctgcacattgcgctgtttataagtctggttgagaactaaataaggatggggcacagctgcagacacacagcaggtagaggaatcacttagataatgaaaagtagcagaataacaagctttgaaggagagaaaaagttcagaactgagatcctggagtgacaacaaaaactggaagaggaaaaggatcacaatacttaaattctactgtgaaatccccaatctggaacaagcaagatttgtaggatataaattataattaaaagatagtgaacctctggtgcaggggaaatgacactacatttgtgagtgcagggatctgaattctggtcccagcccagtcactgacttacctgtaacttgaaggaaattatttaacctcttttggtcctatccttaaaatgacagtggcagattagaagtttcaattatacattttctacacttctaaaaattaaaaaaaaattttgtaaacatttttaaagatccctacagagtatatagggctgcactggtggctcagtggcaaagaaactgcctgctaatgcaagagatgcaggtttgatccctgggtcaggaaggtcctctagagaaggaaatggcaaccactcccatattcttgtctggaaaatcccatggagagagaagcctggcaggctacagttcatggggtctttaagagtcagactcgacgtagccactaaacaacaatgacaaaagagcatatcatgtattagataatatccacaagattagagcagaaacttgaactggccacataaatttcctgggcagcatccctggatgtaggtgttagcactctgattgttcagcaccagtgattctgcatctggtgggatcttaggtttaagtgatattcatccaatcatttttacccctggatccagtcccatcctcaaaataatataaaataagtaaatttcctcttaaagactaaaagcagcattttttatctctatgttttatcttctttaggctatgaacattcttgtttctatcagctgttgctcatttacatgatgtcaaaacttgagaagaaaaaagaactgctgactttataaaccagttcaagttgtcggaatctgttttaaatggtgatacc

SEQ ID NO: 62353 - DNA, 2269 bp, Bovine  19866880809965
ccttatccctgaaagatctctaggatgttctgtgtgaatgctcaataatgtctgactctttgagaacccatggactgtagcctgccaggctcctcttgccatgggtttctctagacaagaatactggagtgggttgccattccttctccaggggaatcttcccaactcagggattgaacctgcatctcttgtgtcttctgcattggcagtcagattctttaccactacagcacctgggaagcccttgagacttactattaaaggcaaattgcaaatctctttcttcccttcaaagaggcagtcttaacttaaagtatgagaattcaactacaaaaaataagtatgggtccagtaagaaaaaataaataaataaagttggcatttacaagtatattttcacaggctaaggtagtatcttggtagaagtgctcatctaattgttaaaatattgaagtttctaaatgtgtctcaatgatactctacatagatggtggtgccaaagagagtaaccaagggtacataagattgtagctgctcattaaaatttttggattcaagtcttttcaattgcacaaataaaatttttttctacttctgtcatatacatcttgactgtcattcaactaaaatgtaagtcaaaccattttaggggggaaaaggagggggaaatagaaaaataggcctaacatatttggctgccaagctaaatatcttagtctttcattttctttgaaaatgtgattggcattttaatagacaggaatcactcatagacatatgctatttaacagaaatattattcaataatttttggtcttggtttcaaaccaaactaaacttgttaagttactttttaaaaatcctcagcagagctttttatgtgcattttctagactagactttaaaacattttcctttgattccatggcatcagggtcagttcagctgctcagtcgtgtccaactctttgtgaacccatggactgcagcatgccaggcctccctgtccatcaccaactttcagagtttactcacacgtatgtccactgagtcggtgatgccatccaaccatctcatcctctgtcgttcccttttcttccaaccttcaatcttttccagcatctttccatggcaaaatgcataactgttttttgtctagtttgttttcatctatatcaaggagaataaattttcaaatggtaagacagaacaaacactcatgagataattgaagtaaaaaagagatgaggaaattatatgaaaacagagagttcctataaatgatttcaagcctcttcttcagaaaaaaacatttacctcccaggacatgcaaatgttatttcagaacactttattctttggagaatggtaacaaacagaagataaagaagaagattggaaatttttgtaaagtattttgtaaaatttttgtaaaattgtaaaatttttctgattgttaaaatatcaaaaatgatatacatgtagtattattgctaggcaagcatatagactattaagtagaaagtgaaagtgaagttgctcagttgtatccgactctttgcaaccccatgaactttagcctatcaggcttcttcgtccgtgggatttttcaggcaagagtgctggagtggattgccatttccttctccaggggatcttcccgacccaggaatcaaacccaggtctccctcattgcaggcagatgctttaccttctgagctaccagggaagccccctggtggctcagaatcctcttagtcattaagtagatagttgtgggattataagagaaagtctattattgaagaacaaattgcattcaccaaagtataaataaataacaatacattctaatccaatctcattttatttttttatactattaatctgggtagaagaatcatggttgtgaagatatggtgtatcaattttattattttcatatcagcaattaatataatggatcttaatagtccaaaaggggaaattatgaaagataaaattagctgcattttataactggttgaatagcaagtttcttgataagtgctgcttaattgattgatgaaaatctataggatccttctgtatcctctgctttagtcaagcattttcaaaaatcttagtgatgacttaaaagaaaagaaaaatgacatttctagattattataaagcaatgaggaatagtgaatatgataagtgacagaaggaagcaaagtcaaatgtaacatagctaaatttagatttataaaagcacattttcatatcat

SEQ ID NO: 62354 - DNA, 2319 bp, Bovine  19866880891275
tgcaaggagatccaaccagtccattctgaaggagatcagccctgggatttctttggaaggaatgatgctaaagctgaaactccagtcctttggccacctcatgcgaagagttgactcactggaaaagactctgatgctgggagggattggggtcaggaggagaaggggatgccagaggatgagatggctgaatggcatcactgactcgatggacgtgagtctgggtgaactctgggagttggtgatggacagggaggcctggcatgctgcgattcatggggtcgcaaagagttggacacgactgagcaattgaactaactaactaactaagataaatgcaacctgaggtctatttttttatggagtataaactgataatgtttatttgtatgtttgtttttccattttcattattttacaaacaaatgaagacaaagaagaatatacaactgagctcacaaaagctcagtaaaacctaaaatattttctatatgatcctttacagaaaaagtctactggtccctgcagaaggacaggacagtgtaaagtcaatatgaaaattatcacaactatccagttttcaaatcttagcctcccataatgccatttttatattccctggttggtcaatgagtcaccaaatccacatcatgttctatagtagaacaactctaaatgattttctgaaggaagttagtggaggatgataaggaaaaaggaaaacgatcagaacaaatacacttctgacttaaaaggaagaatctagttttaagtatataaacatcagattgccagaaaagaacatacatctgctgaccactgattgttgaaaagtaagtatcgttaagcattcaacagaaaatcctacaaggaattacatattgaatgcctcagaataaaagcacttttcaggaagacttccctgccacaggtggtaccaagctttcattccacaaataacacttccactattcactttaattctcatcatacaaaatgctagactaacaactcgattgaaagccctaaggaaaaagatgatgattttcctgattttcaattctcacagcttcatagggcctgaaagatggttagctgtttagatacttggcaaattatttcaaataatgtagagaaaaaaggctttcacttctaatataaggctaaagaactatttctcatagtcaatggtaagggtataaattatgaaatttctctaatttcacattaaaaaaactcatcccaacatgaaatcagcttattgctaaatcagccccattcaagaaggttttctttgaccttatatggctgttagtgaaagcttacttctgcctcatgaatagtagaaaataccctttcaacctggacctacacaaacacagaagaggaagaaaatatgtgcctgttaaccttgcagatccccaaatatctcaatttcatttgattttcattgtttttctgtatgcatgtataccttctaaagcattttggtcatcagcttctcagaagacaagcttttcctcttcctctgtaacatccaattttttctctgttagaattttgtcattgcagagctttcacaatgtcataataaattatatgctatattggtcttcttatcattttaaagggtaaatggatttaggaaaaataaatcattgaatcagcgatttttacctagtattttgtagatacaacatactttgtcttcaaatcaaagataagatacttttgctcatacaccttgcacaaaattccccttcttaagaatcaatcgtcaaggtttgatttctagtatttatctttcacaatgaatgtatgtacagtcatataattataaaattatgcaaatattttatgtagatcagtgatgattgcatataaatgttataaaacaacacattacaaagcactatgattagggaaaatggtaattgtgaacatctggattgagaaatttaaatctgaaaaagtctgatatttttcataaagtcttttctcagtgtttgtccagatttcatttggtactgactgaaaccacttatctgagacaggctaattaaatgtagatccaaatatgttactcagatgaaacacccaggttttttaaaaagtatttttctctctttgttatgtaactactttggtataagaatttttttagtgttgctcttgagaatattcagcaattttgatatctgagagtacactaagaatggccaaaatgagaaaacatttaaagtcaaacacaaaatttcattgaggaaaacaactatatacctaaaattgcaaaaatatcttgagcaggtatgaatttca

SEQ ID NO: 62355 - DNA, 1544 bp, Bovine  19866880978120
tggtgtatctgagattaaatttagatcattgtccttaaaagactattctgtgtccatttaatcacacagctacacaaaaacacaagttcattccattctgcatatttaggctgaaaacaatttatgtacattagttacaaacacatatatgatggatgtcctttgatgtggtcatattacttttgacatacatatctaccgcttgtttgtgatatatgtatataaggaaatttagagaaataaacaacataatgtgaaatggattaagatcttaaaaaagatgtacttaaaatcagacaggttatttccttcagttttattttgcaaatgattctaattaattctggaaatgtaatgtttttcaaaaactttagataatatattgtgatcaaatttgcttaatttagtacacctttaaaatttaagccagtttctccacctcataaatatctcttttacaacagaataaacacgagtcagctgacttacttttcaaccagctatgaaaatttattatgaaaatatcacccctgtctctagtataaaaagactgattgaaatgtaaattcaaataagatttctgacagctacaacaaacataaaatatggacatattaacagcattatctactcttgtaaacacttggaagactgtaattttaaaaaggctacaagtcttccataaggtaaacacagtaatgcaataggaaaaatggaatttctaccattattatttagttacattctttcctactttgtacatttgacttatgcttttacgagaatggctttatcaatgaatttcagtacatttgtttgaaggcaaaagtctgaattccaaaagtttcagtcattttcacctttcgaatatttagaacataaatttggctaaaatgattatcttgaattttacaaattttactttgaacaagcatgctgtttcttggtattctgattatgtccccttgaatattttagtctgtgctgtggtacaagtgtctcatatgttctagttaattgtatttttatgaggagaaatatgttaaatccagagaaatgataacatcatagttataaaatccataaattatggatataatcaaaagtttaaataaactggtcataggcattctacttttttccaacattagtttgtattttaactttactggtttgtatgtgagagaatgaggtaaaattggagtcaactaaaagaaattagaaatataatagtataaatttgggtgctgtgctgtgcctagtcactcattcatgttcgactcgttgccatccctggagtgcacctgcccaggctccctctgtccatggggattctccaggcaacaacacaagagagggttgccatgacctcctccagggattcttcccaagccaggtctcccaaattgccagtggattcttgaccatctgagccaacagggaagcccacagatttgaatagctgatatcaccatctagggactataccttcatactcacaaatctcatatatatatatatatatatattttttttttaactga

SEQ ID NO: 62356 - DNA, 2793 bp, Bovine  19866881032610
ccagagactgtcctcaggcaggatacatccttgtaaagaccaggtctactcccataatttacattttaagataacagaaggtttaatccagagactgtccttaatccagagactgtcctcaggcaggatacattattgttatataatcctaaggaatgtagagaaggaaaaaaagtttgtcctttcttcctccttgagaattccagacctctctctccttggggacccctagacttcttatcaacctgcctaggaaatgactctctcataatagacactggctttattaaacagttctaaaaatcatcaaatatccaggcttacttaaaacctgctttaacttccttccatctcatatatccaattatgtccagccaagatttctaagtctttcacattccttcttcaagtccaatttccttttctactaccactatcttcatcgaatatgatggtgttgtcatagcttcctaattagtcttattgtttatattgattatttctctaatgttttcagatggttttaggaaaaatatcccataatcctaatgatggaatttctttgcttatcgatgtgcagtacacaattcccagaattcccagttgtctacagaatggaccctaatctccttgccctgaattcaaggtactagaatctttgaagttcacttcccttatggcctaaatacttagcacttacctagcctagtctagaacttgaaaaaaggggcgatcatattcccttgtggaaggaccccagtgtactacccaaaatggatactgttgatctttgtttcagtcttattcagtaggacctgtggctttttatcagagtaactatcctatttggaaaaggaaataatcagaatactcctggactactagactattgcaattcaggagacccaaaatgccactgtggcccttcagtcagaaaagaaccttaaggagattaggtaatcaatggagttttagctcagatttgcctcacagtgggtccagtggggtccccaagcctgtcttgtggttatgtccccaatttcagagtacataattgcaatggttatactcagcaagtggcagaatctccaaaactttctgttgaacactcattatttattgactttcagccggtggttccacagtttcttctacctggaaggcccttgtagatgtccataaacatccaggtccacattttaaggtcagtcttgtcttgcccattatatgcagttacgttgggattatcagacagagtatctgggtatgcaaaagcaggcatcaggtttagtgaggaatctgccaaagaaccataaacatgcagctgaaagaaggtcagtcacagggaataacagaggtagttagagccatactgagggagtgagaaaacatagtccattagtctccttgagtttacttgtaaaagtgcacaagtattaaagatggaaaagaaagtcctgtttgtatcagttacaaaacctctctccaaatcacttgattattatctaagttggtttcttttttcttttttaaattagagtgtaattactttacaatgttatgttaatttctgccttacaatgatgtgactcagctatatgtatacatacatcgtctccctcttggacctccctcctacctccacctcatctcacccatctaggtcgtcacagagcaccaagttgagctccctctgctgtataataggttcccactagttaactgttttacacatggtttcttaaaagagagatacctcttagcctctcacattgttcattattcacaaaccctcccctgaaacttcttggtcagtttcctaacctccaaaatatgacatctcccctcttttatatgactgacagtaaatttgacccagttagaaatatttctgtaacatatttctttaattaaattataggttcctggagattgaaagctttgttttatttatctttatattgccaccttcactctatataatccttgttgcaaagtagacaagcatgaataaacatttataggtaagctgctaagtcgcttcagtcgtgtccaactctgtgcgaccccatagacggcagcccaccaggctcccctgtccctgggattctccagacaagaccactggagtgggttgccatttctatgaacagctaaagttgaaatttacagtgggtagattttcaagaatgtccttacactttttgcctaaataccttgacatgaataatgcatgtagtgtatattagaagggaatcattgttatactgtagaatgtagttattattgattcagttacagattagaaggagaaagcaagatttatgaaaggtgaggaaaattggtaatctgtgatttcagcttcagactaagctatgaaatgttcaaaaaaagattttcatttttttctgaaggagtttagtgtacatgtattctggggagtaaaaatggccagattattactaaaaaataagtgaaaatgatcatgaaaagaaagattaataaacagaatattcacagagaaacttgcttaaattgccaagattcacatctttgctatcttcctaccctgaggcataagttgtcctagtttgttatataaacttttaattttgaacacagataaacaatatattgagataaaattggcccagatctacctctataaatgttaatttttttgcaaaaatgtttggggtatttgggaagttggttctagttctggtaaacataattttaatgttagtagatattgtatcatatggaattccatttcaggaacataatgacaca

SEQ ID NO: 62357 - DNA, 1069 bp, Bovine  19866881074913
tgagtacagcacatatccagtgacctaggcagagcatttacagaaaatagaaaaggtaaaagcatttgcttcaaagtagtcttggtttaaatacagtctgaattctgtgggactctatcatttatttttcacttaaaatatttctatattttgggaactcaatttttattcacatgtactctgcacctagaatagaaatacatgccaggataaatgagtcatccaaagtagtcataaaatcacattttaggtaaatatcctattttacatgtttttaggtgccataacactgatgggccctagaatggcaattagccagaattggggattacaagcaaaaataataaagaaattcaggcacaatatatgcaaaaatctaactttgtgttgaattaggcctgcatttccaaagccgtgattttaagagttataaagcacttgaagggcacagttaatttcttccactgattcatcatgaaaattgcaaaacacatttatcatcaaggaaaagacatttgtgtaaaaaatggacaaaggctttttgcagggatattgttagatcatccaccaagtcaaaacagttgtacattttgttaatatgttactggaatcaaaatgctacacagttagagctggattatgtggcctgctgccaaaatttgtagctctgattacaaggatcaagtttaagtagttcctcattgatttatgtctgatgcttcataattcactaactgatgggataagaaactaaatttgttaattggacagtaaaatacatttttttgtccttctgttttaatacttttgaacttttaggctaaagttgttaaaaaatacataatatagtaaaatctattacattaaaaaatcatggagatgtaaaatattggatatgggacctagtgtaattttttaaagagtttttagttttattttattttttggctgtactcaggctttgttgctgcactcaggctttctctagttgtgatgagcagggtttctcattgcagtggcttcttattggagagcacaggctctgggcgctggggcttcagtagctgta

SEQ ID NO: 62358 - DNA, 1233 bp, Bovine  19866881084242
ttagaagaaaaagaaaaacaaagcagtttgtcaacacacacatatgtgttgcaaggcattttgctagatactttgaggttcaccacagaatcataaggcatgacataggtcctaagaatcctatactttttaggaagtgacagcatatgcagtctattaatttctgtactactggtggcactagtagtaaagaacatgtctgccaatgcaggagacttaagagaagcaagtttgatccctgggtcaggaagatcccctgaaggagggcatggcaacccaatccagtattcctacctggagaatcccatggacagaggaagcctgggtgggtacagtccacagggtcacagagttggacatgattgaaatgactgagcatgcacatgatcttaactccaaatgcaccatggtatgtttcaaatgattagttcttaacagcatttgaaacttattctgttctatggaatgcctgcatatatgttttttattgtttccacatttttgtttttaggcaacctgtataactgttccactcatacaccatctctttctttcccaaactctttcttcaacatgaacgtcttccacactccagaaccttttatccttctacctctgaatctctccatgtgaacatcatacaaacaacttgaactcaacatttataacatagaaatcatcatctgcataagcccactttctgtcttgcagttgtggtcattatctctgactcccccttatttccttcagaaatcctggcaaccagcatgttgtctgaattctctatctcccttgtcagacctttggggttctagtcatcttcctttgcttaaattaatggaaataccatttaactaggtccccgatgatttttctacacagcaattaagagtaatttttctaaaacaggcatttgataaattcactctcccacttaagttcaatgacagtaatcttttcagaataaaatcatctgtgacttgcatagttatctatgatgtgtgctcttcttcatctcttcttacctttcactctaaaattacactaacctaacatggattcaccacgcttttgccgaacacagaacctttgcataaactattcactctgcttatatctcttttatcctattctctattccagttgacaaatttccattcatcactttagtgtgcacttgtgactgctcctggaagatgcttcttccatcaaatatttagcaaagggcactat

SEQ ID NO: 62359 - DNA, 2812 bp, Bovine  19866881085315
tgattttatgaatattaatttagagatgtggtcctatcctttttaaaacccaatgtgagattaatgtattttgtctgtgatatgaagttaatagttctgagaaaagaggctatctgttgaggtaaaattttcccaattttatgccactggatttttgataatataattaatatggttatgatgaatttgaagtctaattgttaaagaaaaaattgccatgttgatagatcagcatttgttacttaatgtcctaagatatactacatttttagtcatgacacatgcagtatataattaattttaaaaagtttttttaagtttgttcctatttgtgatattttactaaagcataagaacatagtaattaagcaaagctggagaacatccttttggctaaggttaagtataattttagttcaattaatgttccctttcctttggtagaaacagttgggtaagtgctcagggtgttttgtggtgatttcactctgcaactgccattaaaataaacatgaagccacatggctaaattagagcatgtggctttgaaaatgaaccccactattctcaacatattaaactgtcagaacctgacaacactgggctcacattcttaatttgagaatatgtttataatgcatttataccctttcatccaacattggtatgaaatgtaaatggtagcatacataacatgcttatgaatgcatcagtattaatgaaaccaatgtatattttagaagtgttcctcaaaatgccaaggtttaatacatctgcaccggtgaacatagcaaaatgtgtccagtgaactttgctgtaattcaaggggaaaaaatggaacttatttcaccatttttgtctattttaacgtgcatggcaatgtatccttacttttctttgaatttgcgagggtgtttttgcagtcagttcattgagtatcctgctcactaatcaactgacaaataattactaagcagagactgaagcaaagcagtgtgctggccttctccctacactgcgtagaactctctatttgacactctgatactcagtaaatatttgctactttgcattttgcttctatgctgaagaacagacgtgctaacaagtagacaacaatcctaacgcacaatgaggatatcaaattgtgtttaggccaatgcgtctaccagagacaagttatgtagttaaatgtctggcctttggagccaaaccaaatttagctccagttctaattttctcacttaatttttggatcatcttggactagttgcttaacctatatgtatttcaatgtttttagtataaaaataggaataataatagaattactgtaaagtgggttttcaaatgattaaatgaattcatgtaaaagttgaaactgttcctggtgacaggtaaacataatgagccacagagacgttttgagatacagactctattttaattatgttctcccatatattagcttatggtattggtatttcacacattggagaaggaaatggcaacccactccagtatttttgcctggagaatcccagggacggggaagcctgttgggctgctgtctatgaggtcgcacagagttggacacgactgaagagatttagtagcagcagcagcagcagcaaacaatattaacttattttacttaagtgaaaatagatttggagaggttaagtgatattaggggatgcctgaaagacagtttatgtatgagattactacataaactgaccacaaacaagtgccagtgttgactcattcattcatgactatatcatgtatctacattcagattttagagatagaaagtaaagctgttttaaagtaatactcatttgcaacatcttaatggatctgaaaccattagtatcctttttctttcctcttttccagaaaactgaacctatttaaaaacccaagctttaagcattttttatgggtccccaaataaaatagtagtttctttttaatttcagttattttctacagaataagagcatcaaacatttcaaggctctatatttataaattctaaaaatttccttcaataaaagttcagagcccataggatatgatttcctctcctacaaaaatgaagctaatacttccttccagatagtaattttatgacaagaaaacaaagttaggggagaatttatatgtttattattttctctgactatggcaggtagaataatgacctccccaaaacgtctgtgttctaatcccaaaagcctgtgaatacatcaattaaaagataaagggacattaagattgcagatggaattcagtttgccaatcagctaactttacatacaagagggagattaccctagattttccaagtgggcccaaagtaatcattccctaaaatagaataaagacaggaaagtcaaagtcaggggagacgggactatttaatgaggtcagagtgatattaagtggggactcatctagttcttcatggctttaaagatagaagatggtggtcaggagagaacaagtgggcagcctgtacaagttgaaaaaggcaaggaagtggattttcccctaaaccctccagggcaactacccctgcaggcaccttgattttggccaaatgagacttctggcttgtggaactaaaagggaaaatatttgtgttgttttgagcctctatgttcatggcaattttttatagcagcaatagaaaactaattaaatataattattatataactatctcctatgcttctcctgggtttcccagatatacctagtggtaaagaacctgcctaccagtgcaggagatgtaagagatgag

SEQ ID NO: 62360 - DNA, 1920 bp, Bovine  19866881118596
tctattttcgtcttaccctgtcagcaatgtgtgggtagaacctactgttgtcctcccatcattatgttctcagggtctcttttggtaaatggatattaattaaatcaataagtttaaagtcttttaaaatagagaacaagaatttttttattgaaaaatacatgtaaaagtcaaaatatggactttgagagagataaaattgtagtctttgaagagcccttaatagttaaaaaaaaaaaaaacaaaaaaaaaacacataaggaataggagatattgcatcatccccgaaagagccaaagcctaaccatctgcttcatatctcactaagcctagagatgagaaaaaatatgtgaattttggtaccccctgggagattggatgagaatcatacaggattcagagaatagaacttgcagggaaatgtcaataatttaggtgtttttttttttcttttgcaattatgaaggagaactgtcaaaactgtttcattccttaaaaatatagtacatgaaataactctgcagattcatttcagtaggcttttgagaaaaggaaggtaaaaaggaaacagagcatttctattgaaatttcagaaaagaactctgaactgcaaagtgttagtctaatgataataaaaacttgactcaaccatgttgaatgtaccagtttttttcaactgaaaaacatatcctatgcctcttgctaaataaagaacaaggtttttactctgggtactttttgctttttcttggtaaagaagcagttccaaatgagtctatactgaagtgctttacaattttccatatcactgcctgaaaaaaatgaggaggcaaccaatgttaaatgatcaaaaaaaaaaaaacctttctctttgaaaattaaatgtcaaatttaatttgaaatgtttacagagatacttcttattgttcattatgatcgaaatgataaatgagcaaagcttcttcctggggataatgtacttcttaaaattttcaattttgtcttgattttatataagatggccttgtaagtatgaattgccatttgcagcaccaaaagcacttggtgcttaataaggcatagaatgattactaatttagtagccaatagatagcatataaatatacaattaagtacaattttctcatactagaaggatattacatttttatactttctcatctaatgagaataaaaacctgtatgtacacccatgcacaccatgctccccagttcatatatttcccaatcaggtatatcatttatgtgagcatttatagtgatttttataaaatcttgtcatatacttctagtaattattactagccttagtcctgtgcagatttattttgactgtcatttgacattaagaaaaaaaatgtgttttatttaagtagtgttgaaactaacagaaagcacgttaggagaaacagcctttaaaataatggtaaaatagctggtggtttgtttgtttcatactaatttaaacaggtttacataagtaattggagaaggaaatggcaccccactccagtactcttgcctggaaagtcccatggatggaggagcctggtaggctgcagtccatggccgctgggagtcggacgtgacttagcgacttcactttcacttttcactttcatgcattagagaaggaaatggcaacccactccagtgttcttgcctggagaatcccagggatgggggagcctggtgggctgccgtctctggggtcgcacagagtcagacacgactgaagcgacttagcagtagcagcagcaacataactaatatctggaccatgaggtgaactggggtctgatactagtttcctattgctgttgtaacagattgccacaaaacttaatggctttacaacaacacaagtttattatcttacatttcttaagtcaaagctct

SEQ ID NO: 62361 - DNA, 1216 bp, Bovine  19866881166909
tcttgataagtttttagttaattaattattatggaggaagcattctcctatgaagtacattacctcagtttgattgtttctgttgctggataaaagtcaactgatggaatgatgaccatgatcgaccataagtagttttcagtgaaagcaaatggcagccattcattaaataaggagcaacaaattaatttatcttcatttctgaactggaaaatcacctaattaaaatatgacttaatccaaatttatgaaataaggaaggtaaattctctttaaatcttatactgaaaatgccacctttttcagtatatggataatgaaactctaagttgagtatgtcagtttgttgaaggataaagagatacattattagaaaataagagaagtttcaaacataaaaatatctgcctaggaaatctataccatttagatccaagtattcttactaagcaataattttgaaaacaaaacagatctacatgacaagccattgaaagataaattgcatgtaaagaatatttaatgactttttaaaacatagaaacctctgaaacatgtcactgacacaatgcacacactcttaatttgagtttccttataccccgtggacatttattttgacattcattggactgtttacaacttcaatggagtaagcatctcaaggagatcaaaaagttttattgtccccaagtccttctctcccactgtttcctgattggtgggttattgtctttttttgattttgtgaacagaataaccagccatgcaaatgatttctgaatatgtgccaattgggacctaccagaagtttaacaaattagcttcttttcattcaatagaaattgccatggaagagaaaactaaggcatgttttcacccagatctctgtttagtattcttgtccctgtgggttgaacttgaagtaaaggaaataggtaaactatgttttctcagttctctggctcccacgggccatgggtttactttcaggtttattggtccattcattgaactcacattttgtacagactgctctcagaatcttacagtccagctgtttattttatatttagtaaccctagagaaagaatgagtgacagaagaaatgtataagattaagcgcaggacagaaagtatagcaatagaaaatgaaaattctattcatcgagtctgtagagtctataagtcttaagagaatataaaaaatgtgaaa

SEQ ID NO: 62362 - DNA, 867 bp, Bovine  19866881193107
tcttcataacaattattttaaaaagacattattttgcttaaaaagattcagaagttctacttatagaaagcacatttaggatttaaatccatgtctgtccccaaagcaggtgctttttcagctgtattatgctgtcttttgacattcattgttaattgtcttatgtggtagactattgactagcatagtttaaattattcagtatctcttagtctgctagtttcagggaaagaagttagatgacacttaggtaatttttgctaataagacaaaagtcatcatatgtttcctttgctgtatagtttaaactctttgcatatttgctgtttattacacatttctctttctttccagtgtacaaacatttgaggttgtgttgcagaatgagttcttatacatgctgtttttgcatatagtttttgcatgcagtttgcctaacacaaccatttcctctccctttctttaacacatatctaaaatttgtcaatggcatttgagcatgtgtgtttggggagtgtgaatataaatatcatcgtatagataaaattttcaatcatttcatttgttctagtgtgcactaaactgtgatttaatgggaagtaaaactgctttcttatggtttagccataatatgctttagatttatttcaaggcacagcttgtgctagaccaaagctatctttagaccaatggagtccagtctttcattttattttcataatcccttcatatttctacaaaataagaaaacttagtattattataagggaaaattgaatatttcagtaataccaagggtgatggtaaaaaatatccaaaagtgttggcagtactggttttgaaggcttttaatctttattctggatg

SEQ ID NO: 62363 - DNA, 849 bp, Bovine  19866881260504
ttttagtgcttttactaggtgacttttttttacatattgattgaaaaggacttttctggacctagtatatacagataaggtaagccttgccaggactgaagaaacattgcccaatttctgttcttgctagtcaatagacactcatatcaaaaaaggcataatatagagccacttaagactgtcaaggtcaaatggtatatagacataaatagagaatcattggatatattacgactttaagacaatataacttctgcactcacttacgtttatttcaggtcattctacttagaatattcagaaagaaattatttaaactttctgtcctaattagctcagcctttgccaatgaacacaaacattttagaggtcattattactcctatctacatttttacagtacactgacctatatgctacttaaattctggagttttaatttcatcatcattattgcagttttccaaatgacaccagatatagattactgccaagtaagacttgttatcagcctactggggttatgatgtactacagacagtagtattctgttaaggccaaagtcatttatttcatgtggctagtttacagaacacataatgcaaaagaaaacctgaatattgacaataatacagaaaaaatgcacaagtattctttttagcatttactttgcagttacatctccacatttaacacttttcagtttattttaccataatgaaaaaagtaaccatcatttctcctataatgaggagtattataattgtgtagactaattttaatgtagattcatgatcttcatatgtttaaaatatgtgtaatatgcacattttaaatttataaattgta

SEQ ID NO: 62364 - DNA, 759 bp, Bovine  19866881272357
aataaggtgaaatagcagtcatccatgaaaacaactgacatttagtttcacatgtaaggtaaatctgaatggcaagagaacctttcctactcacaggtatctaaagattcgtctgaatcatcagggcagtcagggtctccatcacacagccagctctgggagacacaagtcacgtgatcgtggcaaagaaattcaccaggatcacaggactgctgatctgaaaatgaaagtgtttcaaaataaaatatgaatgatctgaacatgaacacgagaacagtacaaagatgaaatgtgagaaagcaatgcataaaaggtacatgaatgggatccgcactttctattcagctgcaaagctagaccaattatttttcttaatttaacccactcagctcaagcactcaaattcgaaagacggaattttttggagtctcacacaacctatcctaaaaatagttaagaattctgtttgtttggggggctacaaatctttctcatgtcagttaaggcatatatatattccagcaagaaggttaatagaagatgttgatccaaagcagaagttcttaagcagaatcttttagtttcctactctggcccaagaaaaggaagaatcagccaaaaaagtgaaaccttgtacataaataccatctcttagtattcagttcttaaccgttcaccccgatgctggaacttcatgcctctctatctattagataccccatctcatcttattttctcttctctttttcactgaaactt

SEQ ID NO: 62365 - DNA, 1675 bp, Bovine  19866881283039
tgtagcagtctccgcattcctaccaaaatgtagtctttactgcctgaggactttttattcatttagctataacataaatgccaatttacttcaccatctgggaaaaagggttgtaagttagtttctcagaaaatttacctaattgaacatagcttattaactagagtttctttgggatggaaaaattatgtatgtgtatttgtattctaacatatttcatcagaaatgatgatttggaaaatacccagggtgttatttatcacacagcttcattctctcagtaatgtaactttcatgacatcacctggcaggcctggtcacaggaactaccctttgaaacaatgaatgtgatatggagtttttcttttcagtgtctcagtatggttctgcatataagctgagagaaaaatggtacaacttgatggaagtgcaggcataaaactcatatcttaacagatgtgttatttaagtttaaaatggaagtaaaaatgtaaatcaacttctaccaaagtttgcacagctgtcgctatgttttaaaggtgccagtggcttgacagttccaagaaataggcaaaaataaagcatgagggtatctttgaacagggttttggaatgttgatcttttttatcttttaacatgttccatgggccaaataactatcagatctagttaatgtctcctttgcatctcttctcacctttgtgagagctgggcttactgggttcactctacatagaaatgtaggcaatggatagtgaaaatttatgaaagatgccaggcaataaattgagtctatttgtctgtgttatgaatattattctatatctactttagccatccactcaaaaaaatgaagcatgtttctcatcatagtataaagtgtcatggtttttttctgtttagatattattggaaattaattaaccaatcaactcatcactatatttgttacacacactatatgaaagtcattcctctgagaggagggtgttggtcttctttaaggaatttaacttaagtcacagtaaagctaccaagtaacacatgacctacctatagtaacccctgtttggtaaaacctccctaagtcctctgggaggagttaatgcccagctcttcttgctgtcacagcatttgtactgcactctttaatcagttattaccacgtatactattgttcaaagcttaggttctagtatcatgctacctggattcaaagtactatggctcagttaaatattgtgtctcctcatttctaactagaaatgatgtatgtacttgccttatagagttgatatactgatggttaggaccatgatcctgaagcattgttttggtaagtacatcctgcagaaaactgtggtgcaaaggttagctaataaacagtttcttgaaaaagattacaaaattgaccaaaaatgattatagtaaagtcagatagaaaaaattatgtggaagtagaaattacatgctggctgaataactgggtaggggatgtgtttgggattggaggcttgagaataggtcatgactgacgggataataatggttcccagtaatagaaataagaaatttattttaggaaaaaatgtttacgattagaagcatatcaagaaacatccattttcctgctttttcttcctcatgaaaattactacttagcattatatttaa

SEQ ID NO: 62366 - DNA, 1117 bp, Bovine  19866881320972
tccctttgttcccagaagaggagtgactgtccccataggcatgaccttacccctccacttgagtctgacttgaatcaagagcctccactagctcttagtaaaaagatgaggctgcttaaattacgttttttctcttcttttaccttctgttttaggcaagtagaaacccagggctgtgaagaacaataatatccaagttaagagaattgttcttattgcctcaaagttaagaaaactgtagaatgagtcactctggcagaaaaatcagagatccacgaatacattattgaaatgtgacttctgcatccatcttcagaagcaaattggacagtagcaatgcaacaccaagtgaagcaaatttaacacttctgatgccctactagtaccgtgattaaatgtccatttttgaaatattgaagatacatcattcatttttacttcactttgatctggaaagactcttgattccataggctcttacaaagtagcttccttgcttagctatatgctctcacatgcaaggcttggcttaatacatgtttttcttccatctattcctttaaagcatcagctctcccccatctcctttctgtttgaatttgctgggtggcaggggtgccaggagtgttgtatctgccaacaggtagccagccactagactggtgtctctaaatcagcaagtccccatctgtcagcgagagtctctccaaattcattctgctgattagagcagctgagcctctagctgggttctttgtgggcttcaggcagatgcttaataaggtgagccaaagggagtctggccattagatgtgttaagacctcagatacgatctattttttatgtttttcaagtgcatgtctacagctctcctagtaactttaccacataatgttattggggcatcaaccacccatgaagtttgatactgcagacaaaaatgcttctgtcatagtatttaagcttaatcattaatttttgagtttaaaaatgtttagcaattagcaccctggcttaagcattgttagttttgaaggaaagttttagtagagcgactttacagataatcacatcttaccaggaaaagccaagttcagtctaaaggggatctgtaat

SEQ ID NO: 62367 - DNA, 1419 bp, Bovine  19866881345751
tctattttcttctgttacattaacttatcccttgtttactaacctacagaaatgtagtgctggttaacagaaatccattaacctgaatgacatatctttatcaacaatgatttcttccaaccgataccgttcttcattagataccatagaacaaatggtcatatctttgctttatcatgagctttcaattcttcccttgacatagattggtcctaaatttcatctagataaaaataccaaacttccctggtggtgcagtggataggaatccgcctgccaatgcagaggacatgcatttgatccctgatctgggaagacttcacatgccatggagcagttaaggccactgctccaaaacttgagactgtgctctagcacttatgagccaaacctactgaagccccctcacctagagcctgtggtctgcaacagggaagccaccacaaggagaagcctgtgcactgcaacaaagagaagccccgctccctgcaactagagaaaagcccatgcagcaacgaagatccagtgcaactcaaaataaataaataccaatggtttgagaaaataaaagagatgatcataattttctcctgttaggttttcaaatttaatctcaaattaaaagtcacccactgtgcctctatatactcaattcttcataaatctatcacctagctacaatgatgcctgatgattcacagagagggaactcctataggtacttgtcatccttcattgaaaataatcctaccaaaactattaaaacatcaccaaatgaccggtccctccattggctcttcctttcatagtactttctttgaaaaagtataccatcagtagcttacagacagaaagcaagaaacttccaccatttttttctgtctttacattctctgtcttcatgtatatactactccccttatttaaaaaaattttaattttagctccacacaatctattagccataccagtagcaatttaacactgataatccatctctggtaagagtaaatgcctgtcatcattctttatgattcttctttgtcatgtccattatctcctctctattcatactctattagaaatttcactaaaatgaaaatgaagcaggctgctatttattgtctatttaaaaatgatattttgtatacttcataaaattatgtttcataaacagataataatttgaatatttaatatgaaaccttcatgtcagttcataatcatatagcaatttgaatatttaatatgaaatcttcatattaaccctgggttggtaatgagttatctactgctgcataatacattgaccttgtaaaatttatcaattgcttcccctatgccaatcaatcaatacagatttattttcagttaaatattattttctgatgaatcactcttcagctgattgcatattta

SEQ ID NO: 62368 - DNA, 1182 bp, Bovine  19866881479234
catgataatgcttatgcaagctctgtcttagaataaaaatggtgactcatgcaactctgcttaatactatagctcattaaattttgcttgtctagctttcttcacagagaaggcaatggcaccccactccagtaatcttgcctagaaaatcccatggacagaggagcctggtaggctgccgtccatggggtcgctaagagtcagacatgactgagcgacttcagtttcacttttcactttcatgcactggagaaggaagtggcaacccactccagtgttcttgcctggagaatcccagggacgggggagcctggtgggctgccatctctggggtcgcacagagttggatacgactgaagcgacttagcagcagcagcagcagctttcttcaaagtctagccacattttagaagatgaaggcatgaatcctccagaaagttgtgattaattctctttgagcctaaaagctgatgttcttctgtttgttgtttatgtttgtgtgcgcaaaccacttttgttctatcaaggattttttgtcttaaagctttattatttctatagttaatctatagtggaatttctattttttcccctaaagtccagctcagaataataaaaactattctgttttctccttttgtgtgagacttgtgtaaagaggtaaataattagtcaaaccatatttgaggggtttgttttcttgtactctctctcaggttcaaacagctgcgataggttcagaagaaggatcagacatagcatgtgtgtgaggcttcctgttgccatggtagttgctaatgtggtttacaaaatagtaagagagggataatgactttctactattggggaaaaaaaaagagacagagagatagaaagatgtaaaggacattcacacagagctaaaggattttcgctgccatgattgaagcccccttgtaagcatcaaagcaggtctttgtaaaggcacttttttctgtcctcttgtgcattagtgcattagttttggtttgcttctcttcattttctgatggagagaggcatctctgttcttgaggactcttgaggagaaactgaaagacttccatcattcttgcttgggagatgagttttaaatgaagtcctctagaaagctagttcctggtttctgctccggttcttctgagctaaccgctttacacaact

SEQ ID NO: 62369 - DNA, 980 bp, Bovine  19866881526370
ttactgtgtattttaattaaattccagatcttgcagacaactaggtatacatctataagacatatcctatctagaaagtgatgtgatatgaagaattcaggcatttatcatgatattgaatgctccaaatataaataataattcagcaattattcaactctgtatttgaattaatctgtatggacatggacacatttttgaaatggatgatagtctaattcatgcagactttgcaacttaaaaaagatgagtattttgtatcagtattggtgtgtttttttcatattaaattagatgaagttaaacaaaaccagaaagctgcatcaaatgtggactggaggttttttttttttttttttgagaatcaatctaaagataaaaatatagaatataaaatatacaatataaaagttataaaatgcaaagaactacagaaaaattctactacaataaattattttttattattttgaataactttgtattctgtaaagaatgtttctgcaaatagattaactgcaattcacattgccaccataagttattaagttgagtccaagtgtctttatcctaatatggctgacttttgggtgttcatttccacctgaaaggtgatatttatttagaaaatagcatggtcatttccagaaaaggagacatgatttaaatatcaactgtaacttaagaagaatgatcaagataataatattataggcacatttaatcaggaaaaatgacaatttgttgtaaaattcataaatactagttgataactcattccagccacataaagggccttaaaattttcacaccaaggcagagaaaattttttgcatagcaagtaattatttagactacaaatgatagaccattgaaatacaagaccttgctatcattattcatgctttgaaggtaaaataaaataatgataaacccaccaatattaggacatgcaagaaataaatgagcacaaatagaat

SEQ ID NO: 62370 - DNA, 1400 bp, Bovine  19866881531759
tactctctacctcactgtactgaggatacaaaaaggtaacacaattttaggagaagcaagatgcaatttttttcatatttttatatatattttttgtatttgttttaactcctcagtaattgcatacatatcaattagccaagtgaaaacttggccagtcttttgtttatttgatcagtttaacagtcaaattctttaattcagtcatctgaattcattttgagcctaataaatacagtcataacgtagacacaatatcattcatctctaatagaatttctcacactggagctaagactaatggtgaaaaataacatttataatagctaatgatgagtctggcattgttctaagggagctgcaactcatttaatctcctccaaaactaatgaactaattaagactattatcctgatttttacaagtgaaaaatagaaaaagaggggttaaataattacccaggctcacaagtaataagtggtagactagcgctttgaaccattataccatgctgtcacagcaactttctttcatgcatctcaaaaacaaatactgaaagagatgacttgtgttttcaggaagatcagctataattgaactgttgctagttttcaggtttggccaaagtgatcagcacagtttttgagaagtatatttgaaaggagctcatttttccaatccacccttatatgcatatttgtaatgtaaaagttatgttgctttaaaaaggactggtatgcattcctatatataaatgcccataacccttgcaaggcaaagcaaacaactcagtttttgtgtctccatttatagttgaactccaaggattggaatatatgttagaaataaacagatttattaatgtactccctggagaaggaaatggcaacccactccagtattcttgcttggagaatcccatggacagcataaccttgcagactatagtccattaaggtcgcacagaattgaacatgactgaagtaacagcattaatatactaaattgctgagaaatatttaataaggatatttataaactttagaaaggaaaacctaaagaacaaatcatccatccgaccatactgttatttagtcttacctctgataggtgttgactcttgaaataattctctagaaaataatcagaaaatattaataataggtgactgtatttgcagtgctccttcctgtatgattagatatttcttacttacatgtgaggataagtgtaaaggagccaacatctgctttaacaattattgtggtaaaatatccataacaaaatttactatttaaattgcttttaagtgactattcggtggtattaagtgcatccacgttgtgcaactgttatctctatccatcttcagatttcggccatcaacattttctttcaaa

SEQ ID NO: 62371 - DNA, 1916 bp, Bovine  19866881609553
aagaacgtggcatagagctctgtgagtacccactacatatggtgccaaactcaggcaaggtggtattctctgcaagagctgggttttcttctatttttgcatatccccttatgtgttagtgttgcacttgagcacagggaacagaagaaagagctcagacaaaagagagtttacttttagaaactcatagaaagaaaaaaagtgccaaagtggacaatccaggattgatatggctgctccagaatgacagcaggtttcctctgccattcttagcatggagctgtcagtctttcagccacagtaggacttttccaccttccctagcagatgaatccatttctgccagagagatgggaagaaaacagggaaacagcaagtgccagctgagtctttctgtttctcagaggatgataacttttacagaaagcaaactcagtaggtttctgcttagatcttgtttgccggaactgatcacctaaggcatgaggcactgtgtattcttcagggtttcccaaaataaaatatacggtcctgctagtcaagaataacaggagactagatattggccaggcagaggacccaagtaacctgagccacagtgctctcttcactctcttttcctctcttcatctgtggcaggggtgggggcagtcacaaggtatggtctgaatcccagctgcttgacaccaaagccagttcctccaaatgaacatctttgctcttgtgcaacaaagtactcattccaggtctctagtaccttgtctgtacaatggacatgatagtacccgtcccacagtaaagtgcttgaaatactgtcttttccataagatcttctttccacccaacacccctcccctatattctatctctccagagctttgaccaagcaccttaacctcagggtcttttgatagagcaccctaattgctgcctctcccgttcttactgaaaatcagttttattctgtaaggttgtggctaggggtagcaataatttaccatatacactaattcgagtaaagttgctaacaatttttagcacttaggcgtattacactcaaaattaagacaagtagatatagagattattggaggacaggtgacttttcctaggaactcttccaacacatcatgttgcagaattgattaaagttaagatatatggttaaaaaaacagtttagttcataatggtttattgcttaattgacatggcagtcctgaaatgtggatgttttctcattttaagagatgaggaaattgtttacaatctttctctgccttctgatttgactgttattggtaaaagtggagtttgcatttctttcaactcactgttgtttttatatagactcaggtaaggaagaattcaactcctaaaaggaatccttaggccacctaatttaaaaatacagtgtcatttgaaaaacagacactatcccagcagagttatctcactctgactttggagatgatcagttctgattgaaaaatgcagtaaacacaccatgtctcctgagtaataggaacagaagcatttgtgaaaaatgaaaatggctctaagttattagggttagatgtgtcgctgcatgaactgaccattgctttgattgtatttccattgttgtggagtttgagctttatttggatgggaggatattaacgaacttcttatattcataggctgacctttcccctaggatgaaaggtagaaatccttttacagtttccttctatctttctttaacagaggtcagggaaataaaataaaattcatgtgggaggttattagcaaacagatactgccctttaaaaataaatagcaggatagggcactgaaaggagactctaggaacaataaaatgaatggaagtagggtccttgtttctgagtaataggatttagaggtcatttggaat

SEQ ID NO: 62372 - DNA, 1571 bp, Bovine  19866881755482
tgtgtatgtagattcatttcatcactgggaattgaaaatctctcatttgcaaagagagtaggatgtgatggcagcagttttcagagttacaattcctttgagaagaactaaaagacatagaatttaagaactgaaaaagaccttagggatcatctcttccaatccttcatgttacagatgcagaaatctcatctgcaaagatgaagttacttacccaaggtcacccaaatagccagtgacaaaataataggctttaatatgaattaatgtatttcagtattacagttacaaagaaatcaattcaagttgaaatctgatttcctgatgtacttttttttacacagccaatttctgtaaacatgttttagaatgataatattatggctacagtttagaaacagataacagcaatagtatgacagagtagagttgctatttcagttaagccagataaaaggattcaccatttcaggactataaaataatataaagaattgtgtttattctgctgtacaatactctatctgatgaatttcaccacacacacacacacacaaaaaggaattaaaaacttcactgggtaaagtttgtaaaaagcatttaaaaaccctagtggtaactagaacaatgtttgtcatgagtgggtatggacactcttgtttgatggtacctttgccaatccaaatgcagacctagccagggagctcaggttaccgtggacacaacagtcaatcggctgtaagagatgcttagagcagaagctcctgcgataggaaagcttgaatcttgaacctattcacgtattccctggaagagtgaggataagctgagttctaaagaagaaagtgcactcactgggttagggcacagtaggaagaagcattccaggtccaggtataaggaagtgtaactagagctcatgtaacttgagagaaaatggaataatatgaagctggtgcaaaaaactaggagataaaccatgaagagacttttgataatgttggtttttatcttaacagcaagaggaagacattcatgtgtcttacacaatgagattctctgtcaaatatatgtttaaaatattactatttctgcagacttgaaaaaagttacttgcatctctctctcttttttaacctataaaaaagtgacaataagtagtattcaaagtagagaataatgcctaatgcttacccaataagtattaatatctttctggaatattatacaattttaatttctgaacaagagttataaagacaactgaagcacagtatttatttacctgcccatctttacctatcacctggcccagtaacctgtttctggtaagcattccaaggacattgctaattgtctattaggcaaacaaccagttcatctgagtttaaactcttcaatcaatatatataggcaggtgtgtttttgccttgcagcactaccctcacatgcatctttcttttcttttttctttttaaacaggattggcatgttattcaggcaatgttctattcagttaagtaaatagtgatatgagcaattctttgaaatgcatgtgaaggacagtagca

SEQ ID NO: 62373 - DNA, 919 bp, Bovine  19866881800176
actctgataaaatctcctggcttaagggatgaggtacagtaaacaaatggtcttgcaaggctctctagggaccaggcttaaggctgagcaaggagccttctcagaactgatacaatccatcatttatccacaactaatctagcagttggggttgggatgaaggcttcttacctttcatgggtgagtaaatttcttcccagaggatgttttattctttatagtcagtgtataaaattttcatttgactttcactcagaaacacttttgaaatgacatattttgctaaatgaagcactgaaggatgttttgttctaagaacttatttaatggcagtggcttttttctctctcccttccctcatattttccattatccttccctgaaagcaggatataaaatcctactataatatgcctatggaattcttagggcaaaagtataatccttctactaattgctgcattggcccttttcaggatcaggcagaataattgattttcggttgactattttaaattaaaatctctgtagcattagcttttttgatttgggggtaggagaacttgctcacaaagagtaaagttcatgagaagatgagttaaaaacagggcttaggtgacagtacacaaattcagtaaaggtagcttatagcaatctactcatcttgaatgatttgttttactttccttttttttataacttttctgaaaaatcatagagggcagggtgtgattaaattttactttgcttgatcaaggatcagataagaaaggggagaatctctcagcttgcacagatctttctgggtactaaacagcaagatagaaaaacaaaaaagtaaatgcttctcaacaactttgatgagttaacaaaagataagtaattattaattaaaaaattcttgtcttggactgtagca

SEQ ID NO: 62374 - DNA, 1047 bp, Bovine  19866881909734
tcacttcagttgtgtctgactctgtgcaaccccgtggtcagcagcccaccaggctcctctgcccatgggttctccaggcaagaatactggagtgggctgccatttccttctccagaccccattctgtggggtgatttaaagtgagagatatgtaatcaactgacatgagggcaagccacaggcaagcctcaagatcagtcattaaatatatttcaggtttaaaaaagtctaatacagttctatagacagattgtggaccttctagatcatttaaaatgtgtgctttaagcaaacacttggggctaagagctgaacacactaaaaatgcatttatttgtttttaagtgatatatatatgtgattgtgaataaaagataactagtacttgaattcagaaaactattaattttgccttatatatatatatatatttttattttttttcctcataactgtagtcctgggtcactttctagcttccagtaatgtaatcagtacttgtagataaacaacttgatttctgttgacttactattttcagggatagagtcatattagcttttaccacaattctaacttaatcctgacaaccaagacatttctggacttcttaaatagactctgttgaataaaagttaatccaatcttgataactcaggtctatgagctaattctcttcatagttatatgtaatgtatataatgtatgtctcctgagtatattcatctttggtcagtgcgaaaagttcagaggtctagatgaggtctacaaggctattggtcccttttctaaaatagacatacacttttgatatctatgctactggcctccagcatttgattctcttccttttagtcatcactttttactgctcacagccctagattactctagttagccttttcttttctgacttctttctgggccactttgacttagagccaataaatctacctgtgttaattttgggtgtaaactgagattaagcaggtataaatgacaatctatgtgcttctcctataacgtgttagtagattttctaaatat

SEQ ID NO: 62375 - DNA, 774 bp, Bovine  19866882270520
ttggcataatgataaaaataaatctatagggctgaataagatcactagggagagaagtcaggaataataccaataaattcaaacactttgaggtcaagtagtgttagaaaactggcaaaagagtctgacaaatatcagccatagtggaagatgtaaaactaatatacaatgatgtcatgaaagtcgagaacaaatagtatacctgacataaaggtgggattcaaaggctatttttaagatgaatgaatgaaactactcatctgcattgaatgctgccaacaagtcaattaagatgggagctgaaaagcgtctatcaaatttaacaatatgaaaatcaatgatgaccctataagagtcattttggtaatggaggttggggaaatgggtgggaaaggatatcaaattaaagcaggctgaagagtaaattggctccagttcgtgagcttcaccaaaatgagtattcagaatgtacacataatatctacatattaagagaaaagcaaacatataactagattgaaaaataagaaaagtagaaacagttcacaaaatagaaaacaatgtccaaaagcatatgaaaaagtatccaactaatattcaggaaaatggcaacatgaaatactggtgataggcaggctctaagatgcccttcaaggacatttgttgcttcctggtgctcatgcccttgtctaatcctctccccttaagtgtgatctggacctagggacttgctcctaatttttaaaacatgcaaaagggatgagatgtctattt

SEQ ID NO: 62376 - DNA, 1306 bp, Bovine  19866880430281
ggcatggcgacccactccagtatttttgtctggagaatcccatggtcagaggagactggcaggctacagtccatggggttgcagggtgatatacaactgaatgactaagcacagcacagcaaggggttgtatagagacaactactgaacatgttgtgtatttgtatgtttacattttgtgtaggagagttacatattagaactcaccttcaaggcattttggacattaatttaaatgagagagagagatgcaattgagaagggacaattaaggcgatgtctccagttgcttaatagtctgtagccactttttttcaaatctattgaacaatgtgttaatttcattggacattttatctgatgtgtaggctcctgtctgatttagtgaaggtcacataaatcctgatttactgtgaggcaacaacctataaggtccttcatagcccaggcaggtggttggtgacaggatgctgagtgatttgaagcctagaattgtaactggttgctgattgtgcatgcaaggctcaagttctggattttatatttcctgtttgggaatgattgtacaaaaatgagaaatatcagaaaactccatagtacttttgagcaattctttttcttttacttgagtgcatgtgtatggtggtatgccctaaattaaacatcaacagctcttattattttgttgaaaaacagtactgacaactatccactgaaatgtaataacagctcagctgtctcagtggaagcaaaactgttcacaagtggcaaaatgtaaatagagatgaaggagggtgtaggggaagacaggagagctaagagaggattaaaaatatttttaagacttaaaaaccaggaccttgcctatcacaaaaatagcagctttatatttaatttataaaataaaaagaattaatagttttggcacaggggcaaaaatggattgaataacaaaatggaaagacatagtaaatgattattctctagataatgtattatccaggctttaactttctcttctcccttttcctagtcttttgggcattcaccacataactgcaaaaatttagacaaaatttttaaaaaatgattgaagttcaaactggtttcatttatctgcttgctggaatctttcttagaaagtgaagtgagagatatctcaaagcagttgacttaattgaagaattatctatagatctgtaatatagatctgtaattttgctattcacagtcctacttaccataagtgtagttttaaaaaaacacctgtggcggattcatgttgatgtaggcaaaaccaatacaat

SEQ ID NO: 62377 - DNA, 2649 bp, Bovine  19866880511925
gttgggaagatccctggagaaggaaatggcaacccactccagtatgcttgcctggagaatcccatggatggaggagcctggtgggctagagtcaacggggtcgcaaaagagcagacacgactgaagcaactttaatacaaacaaacaaacattaaaacttaattaacttgctaccttcatcaattttgaacacttattgggtgccaagacatcatgttatatgctttatctatgttacttatgtttattctatcattaacccttggaagaagaagagaatgacaagatgttttggtaaacatcttttatttaaaagggataaaattttttctttgtttgcttttaagtcagtgcttctcaaactttaacataatagaaatcccttgatcttgctaaaatgcaggatctgatttggtaattccagagtagggaattacctgagtcactctgctcttgggtgatgaaactgctgattcactttgtatcacaactttatctatactaatagcagatcacgttcaaatacatcttatccttttcagtgcatttttcattagtcctaaaaacatttggtcctatacatttggtattaatatgttattagaactgtatttgcaggaaaacattatcaaaaaactaaaattttgtagaacattgtaggttactgggaataaaccaacaacaaaaacttctgtcatgatgcgtaactttttccattctgttaagcaatttatttaattttaattcacactaattctactaattgattgcttttcttttgctttgattttgtatatttgttacttcttatccattcacattattaaagtaattataattattactttaattctcaattagtctgccttttttgtcgtttcaagactatctcattagaattcattagaatatttattaaaggaaagctataataaaagtgaattaatttcttcttctgttatgattatgatgcttaaaaagaaaagaaatgcctcacagaattttattttgtaaaaataggcttttgacagagtttgtagtcatatatatgaaagatatataaatttgtacatttctgggatataatttggaaatttgtttttccaatatatgtctcatatatgcactttctttagttatttcacttatagtaaaatagttcatcaaataaaataattatatatatacatacaggaaagctatatgatgttataaaatagtttgtaatgtaaatttagaaataaccaggggattggcaagtcagctttagtaaagccatgcattggagtacagataagaaattatgttgtataataatatttttaaaaaacatgcttgtattttaagcaaacaaaaaaggttacaaaatattaatttaaaaagtcttattttgaatgtatacatgcacatttacctagacatgtatatttataaaacaaatagaaagaaatgcactaaaataggagtaatcttgcctttcgtgagtaatttttattttcttatatagtttctaaatattctctgacaaaatttctctgtacttttaaagaaaggaggaagaaaggaaagcctaatttaagtatagcccgtagtccttgatagctgtttaatcagaattccctaaaggtgagggagtggaacagagatcagaaggctaataacactgagatctgattcttccctgacacctgggtgatgtttttcctctaagcagaggtaaagtataaaagacaagaataggcatggcttatttctgagccagattatgggaagccaactgggtagctgccaaccaagccaccttataaaaagtactaaaacatcacttcagtaaatctcagatttgttgccagttaactcagatgtctctacccaagaacaactagtgaaatataaaatgattgacttctttctttacaatagaaagtaacaaacaacaaaatatgccttagcctgtgtcttttaagccttttaaataaatgttgaacatatgcacaaagaaaacctttgaatgtaaactaaattcttagtctgtttagggcccatgtattttggaaggttcagctttatttcaatactcttgttatttcttatttcaatagtcttgttttcaaatctggtaacttggctacacagactagaagatgcttaaacacaattgtttcaactagtatactggttctgacttaataagaaaagtttaaatagatctagatgttttaaaataagaattacatactagccacctcagagtaaaattgaacagcctgaaaatggaaagaaagaagagtattcaggggcccctcaaaaatgatacaaaacagactttaaatttgtagctaagaatgatttcatacatacctttaattttatttatctggccttcttttaagattttaattttaaaaagaacacctacatctgcaattgctatatgcatatattctttaagtcttagagaacattcaaaacagaagccttgtcttttttgtctttggaatcacatagcttaacatagtacattatgcagaatcaatacagaatgcatattaaccatatgtatgaataagtggatagatggatggaaagatggataaatacatgaacctatttttaaagacttgggattttagctcttacctactcagt

SEQ ID NO: 62378 - DNA, 1848 bp, Bovine  19866880534798
ttcctgtgtatacagtgagtaaatggcatatcaaacattccagcctatcccatgcttatccttgcacaactttgattaaatgtacttttaatataatccagactggacttctctgttggctcagtgataaagaaccacctgtcaatgcagaagatggggtttcatccctggatcaggaagatcccttggaaaaggaaatggtaaccaactctagtattcttgcctgggaaatcccaaggacagaggagtctggcaggctacagtacattgggttgcaaaagagctggacacagcttggtggctaaacaacaacttttaataaaatccagaatacattttactatattcattttcttttttgataaattttgcctattgtttcatcctatcatttttaaccttaattcactttttgtgtcggccttttctctgtttctcttaataatcaaataatgagcatattacctttcctcatccaaagcattcatggacttgatacgcagaatggtcaaggatggaatacaattgtatatgctatgagcctttttttccaagtgatattgattcatgtggctatacctttagatcaagacatttacttattttaatataatctagaattaattagtatccagttatatttttccatcttatccaggattttataatagtctatttctaatacttgtctatgctcgtttataccaactgtttctattctaatggtttacaagaagccctatcaaatatttgagtaaaattatgtacactcgaatatttcccaagtagtttcaataggataatttttcaaggtaattgatacttcaatgattttgaattatgtaaaatagttttctacaattagagatttttcatcgattccttaaatatagatataagtatatagttaaagattagtgtgcctgtgtatgtatacatgtgtagatgtgtttatttataaaatttttagatgtatacacttaagccaactttataaaattttaatttcacaaaaagaaatttgactgtttatagtattaattatagttataatcctagaaaatttcagagttcaagtagtgaaagcagcttaagtggtgaagaaaagtatttctgtcactcttttgccttctagaatcatccaagttctaattttatatcatagtgaatacacaaaccttttgactttgagagaatcttgggtagcaaggtggtgtgttgaatttctaaatcaaagcatagcctgttttaattttctgcattcacctctcagtttctttccaaatggactgttagaaaatagaattaaaaattatgcatattgcagaaatactgagtccctggctttctgtaggggtatttggaaaactcattgtcagttaggtattaaactttgcctgagtattttattaaatgctgggccatgacaagtactcagtgagaaatgcttgaacaaatggtgccaggttgatgtccactggcaatggcatgaattgtccaacttccttatctctgtttttgcagcttcattcgcttatcaaagagagagagaagcccaaccattttacaaacagaagatggtcagagggtaaaacaaaattagcatgtacatcagtaattgctcaataatctccccctgcaaaatcattgcaaatgactctttttctttgtaggaataattgtgcacctgcttttcacaacacaaaagctggttttgcctttgtgcataaaatgtgatttggagagtttggagatcatgcaaccacatatttacataatcaaatgacaaactgcaatttattttaagctcatggattctttgttattccttacccaacaatcatgtaa

SEQ ID NO: 62379 - DNA, 1554 bp, Bovine  19866880990535
tgtcaaaccacctcttatttcagatacacttgttggaggcttcacctctgtcatttaccaaaagagctgtacaagaagctcaaggctgcaacaactctcctattcagggctagagagaatcactctaaatcctatttaggggataaagaataactgcactgtgccttcagtggaaccaaaactcatagtaaccaccccaaagctctctcaatgatgggataacaaaatccttggtattatttttcatcaatcaactaaattgtaatctttcatatttcctttgctatcataaatgaatttctgtgcacctcagcacttaaagaattattaacagacaacagtgtcatgatggcatctacgccattctgcaagttaggattaattttcaactctctttcaatgaaccttcccagatgccacccagtggcccctacataaaggggtcaacaacatttatcttactctgacttgccaggtgatcattttcttttccatcctagcttataatcttctcattagggagcttggtctgaatttgaagctgctattaccagaaaagcgaagtggctaattgtttttttttatcaaaatgccagagggacgcaataaggttaacaaaatcagagcattttatcatttctcaatcatgggaaggatcaataaacaactgtgggtgaccactcttccgaaagcactttgcctgaaaaaaacaataaccattgggaaccaattgaaaggcatatattttcttctgtctttggagataatgagaacacttgattgaatcttctgttgccacagtctagacattctggtcatataacccattttgagaaaggttttagtgggagagtaagtgtttacagttctagctatgcctttgtaaaccatcacatctatcttgtcagaatctaaagcaacccaatatccatgctgtggaaacgtaggaggccctgaacacttctgtttcaccttgactcccatggtcttcattccaactactataatctgtcacctgtatatagctctgcccctcagcaagtctcttatcatttattctgcagttaaatgaagaatgcatagaggaccaatctgaagctgccacttttcaactctgaacccttcattggctccccattgccctcaacagaaagtccaaactctatggaagcccttcatgaacttgcacctgcttacccagcctcatctctcaaactctccctatacctcagtgagtgaattcactgaggtataggaattcactagcttggaattcattagctaccctgggctgtcacttgcctcctccagaacctttgtgcatttacttcccaggatgaaatactccttctacatgctcccaccccagccctctagttccttgcttaagtctattaaattttccattcttaacctatccctagaaaactttccctgtcacccaaccctcagatggctcgatggctcccttctttctctcatgacatcctctttttacgttattacaatatcttggtctccaaaccataaaatccaacaggacaagaatcaagt

SEQ ID NO: 62380 - DNA, 1240 bp, Bovine  19866881100737
aaaaattgtataaaaatgtgaaaagtgaatttattgggagaaagacaaaagatctattctatgtagcaatcccctatataaacctaaaaatttctccacagtctcagggagataagatgttcagaaataggagaaagttatgctcatagtacaagtgtctggtatctggttgtcttctcagtcccagagcctttctgattctcagtctgtgctctcactatgaggccttgactaatctttgcaactcaggctctctttatgtcctttggctgtagtcaccacttctttacattacgtgtctcaattcaaaaccatccacacacaggatctggatgaccacattagtcaccattactctttttgccagagcttttccaccagaccactatatatagaactggccaacctatggcttggatagactgcctgtggttcaaaagcaaacccagaccagtcagctgtggctgtgtatgtcctccaattccagtccagctactgattgagacatatctcttatctcatatctcgagaagctctgaaagtggcaagcacactgaggctggggttgccaagagtaatctgtatcctatattaaagtatttgggtttatgtctcatcttcctactgtatattatgtgcaaatgggaagagtgaaagggctgacttgttatatcctcttgacttctaacaagttattttgaaggtatcataacatattatataggtttaaaatgaattatatttaaattataaatcctatagcatgtgaacaaataaaacacttttttatggtttaagttgtcattttttgtggaagttaagctgatttgcaatattatgatgtgttagtttcagttcagttcagtcacttagctgtgtccgactctttgcaatcccatggactacagtacaacaggcctccctgtccatcaccaactcccggaccctactcaaattcacgtccattgagttggtgatgccattcaaccatctcatcctctgtcgtcaccttctcctcccaccttcaatctttcccagcatcagggtcttttccaaggagtcagttcttcacattaggtggcccaagtattagagtttcagcctcagcatcactccttccaatgaatattcaggaccgatttcctttacaattgaatggttggatcccctagcaatccaagggactctcaagagtcttctcctacaccacagttcaaaagcatcaattcatcagcgctca

SEQ ID NO: 62381 - DNA, 704 bp, Bovine  19866881174601
caaagaaagtgtgatagagtcctaattttctgcactagctcatcggtcattagataattgaactctctcttttgattcattgcaaatgagaaaaagtatcttcactttacaaagggaaatccatagcaaggggaaactcctcaataacaaggggtgtgagataaagtataagacagcttctcaagatgtacacgcaaactaaacatctcaccttctatgactatccctcaactgcttacccagtaaggaatggaaatcaattgtgtaatgtccaaaaagaaaagaacaaagagggactatgacatgtgtattttagccaaaatgtctagcccccgtctcttactccctttgctatcattaatctacacttgaagactaaaacttatttctaccttgtgttcccttgcttggctaaaagaaaaaaaaataagacctgtttaatagatagtttatcaatttttggatttcaatgacaatttttaaaaatcggtgccattcatgggaatatttgactcaagttaatgactggttctttctgggagatggaacttgtaactttcatttttgacttgctgttgttttgtgttgatattgtctcacaatgtgtacaagtttgtaagaataaagaaaaattcaaaagcaaaataaattcctgtcattaaggctatgtgtaactgaattttgtatagtctgtaagtggcatt

SEQ ID NO: 62382 - DNA, 1230 bp, Bovine  19866881451998
taaaaaattttctgacctctgcctttgtgtgattcacagttgatatgcattgctagtcacattcgtctgtctgacagagcctttcaagttagaaaagcagcataatgaagacagcccaaatgaaaatgaagacttctgaatgattccaggactgcatgttaaaccgtattagtgacctggagcctagtggtaaagaaccagcttgccaaagaaggagatgtaagatgtgggttcactccctgggtcaggaagaccccctggagtaggaaatggtgacccacttgcattcttgcccagagaatcccatggacagaggagcctggtgggctacagtccatagggtcacaaagagtttaacatgactgaagtgacttagcacccacagatgcaaagtggcgtggagcacagcatctcctttgagacagagccactaaagttggctgcaattgtttgagttgttggcataatcagaagcctggaactgtccttccagtcctttttatcaagcacttaaatgccctttctagatgcagactgtgctgttgcataatcactaagggaaacataaaaggctgcagagggcagcccattcatattcacaaatgaaaatttcttctactctgtgaatacatagatctttccctgtgacctcagcagagtcctgaacataatacctttatcatgtcatttactacatcatgttgtctttcaggacatcaaagcacaacaagagggtcagcttctgggatgtcagagtaaacagtcgccattactgtagcttgagggctgaagtccaccactctcatcccctcaacctctcatcccctaaacatttcagcctgctctggtgcctacaatttcagcttgaatagtcatttatttcagtgtaagtactttcgcttcttgggaagtgaatataccagtattgtgaatgtgtaagttgtcaacatcttaggatttctcacctgagagctttgttcagaccattctctgggcacatagttttatgaatacttcagaagatattcatgaaaatttcatgaataattcagaactcagctcaaaaagaaacttctccatgaagtcatccttaattttttgaggaaaaaaaccaaattgtctagcctctcaacaatcacagctcctaaactgtgccttttggatcaaaagcatgttatgtgtacactataattatgtatataattatatcatttgtataatttttcagcc

SEQ ID NO: 62383 - DNA, 1494 bp, Bovine  19866880346389
atgggattctgggaaggcaggcaaggcaaaggaggcagtaagagctaagtctgactgcagagtgcagggaaaagcaaccaaccaaggtgatttgcgcctcattctgactcacctggcacaaaagccattaccgatttgttaccttgttaacaggaaccataagaaacttggaatagtggcccacttaccctttggattacttttctataactgagggtactgtaagtaaatggattaaagaaccatttgatcttcaaaaagaggtttatggtgctttgatgattaagtacccaggggacgcagtggattatcatggataatggattaggaaaagtgggatattaaaactgaactctcctccctggctgtgcgtggatggtgctgagaggttgaatggggactaggctaaccctgtcacttgctcgaatgaacagtctaggtaaggggagggaacatacttttctcacttctgggagaacaattgagaatcttgttaatgcaactttgaagggtaaccccattatctcaagataaattcttgggaaattcacaagtacattcacaagtatgagttcagagctgaaaaagcactctgagaaaaaaggccttagtttaccaggggctcacctctgcccagcaagtctctctcacaaaacatcagcccctggagaagagctcccacagggaagactcctagggcgggctcccccgtctccgctcgtctttttcctagtgctggctttccctacacacttgggttctggagtgcgcaggctcagtagtcgccgctctcaggctcaggggccccttgacacgtgggctctaatccaccgaccaggggttgaacctgtgtcctttgtgttgcaaagcagattctcaaccactgggccaccagaaaagtccctccactctagtctttcatctgttctgagaccacacttactctgctttccctgttgggagaaatagttggcgatgatgaagtgtcatgaaataaggagatttgggggtgaggagaataaatataaacacagtagcttagtaaatacatacgagcatggatgattaacacattctgtgccctgtaagtaccctatgaaagccaactaataaaccaaaggtattgttgatgccaacatgtatcaccactcaatctaatgcagaagtggaatctcagtaggctaccagagccagtatagtaacaaacaaggaaatcaggccaagcataagtgcatgcacattcactggccttggtggagactgtggttaactagaaagcttgcctctcgtaagggatggacccaatatgcctgctatgtcacttcagtagcctctgactcttcgtgaccccatggactacaggctcttctgtccccacaggctcttctgtccatgggatgctccaggcaagaatactggagagggttgccatgccctcctccaggggatcttcctgacccagggatcgaaccctcatctttaacgcctcctgca

SEQ ID NO: 62384 - DNA, 1375 bp, Bovine  19866880352147
tattgcctggaaaatctcatagacagaggagcctggtgggctacagtctgtggggtcacaagagttggacagatgtagcagctaagccctgagagcacactcctgttttcttacgtcttttttttagtgtgctggctgtggcccgccacagtagcgtttcgtgtgtgcagagcatttagtgcactgcctgccatatagcaatcttttgataaattttaggttttattggacttaattcatctcttttgctttatttattttattatatgtattttgtgagaaaagtaatagaacatttttcagttacgatttaaaaaaatattttttaattattctaagaatttatttgtccatatgtcttatctctattgcttcccttgtaagtctgttttgttttataagaataacctgagctttgttagggctaatattaaaccagtgtttattatttacagggaatcattcctgtggatatgcttaatacctctgatctcttcaaagcagagagcatgtttacaaatgcagtacagattcttgagcagttcaaggtaaaacaagagcacacacaaatatggacatgattccaattttaaaactgaatacatcttgtgaaaatatttgattttgcattttaagaaatgattttcattatttattatctttaaattgtttgtatttgactagtgtcctgaagtttcacatttctgagatgcacttttcatgaatcagtttgagggtgtagaattagctctgaggagcatcccgaattggtagatatcacatatgcttataaagactacaaaccaagtctctgtcaatggaatctgccttgtagaagtagttttagagattgcagcatttcatgtcgttctgcatatattattatttgcattaacaacttaaagaaatgaccattttactgaaacttgctgttattcataatactgttaatgcagcatggcttattttgtttcctaagagttaaaaagtatagcttaattatatgacattttgcaggcttgatatacttcatcctcagcatgttgtaatggtactatatagcattaacattttctttaaatatttatgaagtaggatactaacacaaaattccatttatttctattgctgaagaaccattttaatggatatttgtatttcgaaatgaaattagttcatttttttctcttatctaatataaaatattttcacgcttggttcccaggtaaaaatgactcagaaaaaagaagctactttatcgtttttgtttacaccatttaagtaagtctcttatgttttttattaacttgtaggaaagaattttccattgagtttgaatgcttgacacaatagattaggttcttagaaaatttgt

SEQ ID NO: 62385 - DNA, 2633 bp, Bovine  19866880381118
cttttcacgtggagacatggtggaacttgtctactgaactggaggcaagcacacggatctgctttttgggaatcaggatactgttgccgccagtgaggacgttgttcctttctccctctgatggtaacttacttacttggacagcaaaccccaaaccttgaccttgttagcttcgtattctaaggagctgggaaaacagaaccagggagttgctttaaaagggacgtctcttacctaggaaattccagcaacttttaatctacatgtagatcattttcaaaatggcactttgttcagaattgttatccttttgcacaaggctattcagtttgaatcactagaatcacaataaggaaaagaaagaggagaaaattgtttctaaaaattttaagcagaaaattctggaagctttattttttgccagctactactatctaaataatggcatttccttcaactaaaatatttgtaaagcttctcagtttcttctatttctttgcagagcagatggtctgaatggcctgagtctgtcccaagatggtttgatttattcttccagagttgctgaaaccttagaaggataacagctcaggacaatgccgtcagggactccctctgctatactgggtctctgctgtcacactgacaaggagagacccccaggaggccccctagataaaggctgcaacaccttccagctgttggacattcttatcatcacagggttgtcatcattaagggcaaggggaaggagttggaagcgaatgtgtcagccatccagtggaatctctctgtggatgaagaatgtgggaccattactgcacacagtctctgtgcctgatgcacagtgaggccaaagtacagaaatgtgtgagtttggagcaaagaaaggtttgtttccgggccaggcaaggagacatgcttaaaaaaaaaaacaaaacccaactccttgaaagctttcagcaaagcccttgcactgggaaggtgagggagtggtgtggttagttgtcacaaacttcttggtgtgggattctttgttcttgcaggtgtccacgtaggtcaggccatggtcatgttcgtataaacctccatcaaaacaagtgttattctctgttctgacaagaaagggaaagggaggcattaaattgtgtctccaagcctctgtgctgcttttaacacttagaccccatagtaagaaaagcggcttcatcacccctccttttgcttgttcaaggtcccgagcttgacgttcgccctctgagatctggcccggccgagaggagggtccctatgcgggcagtcacgctcccgggagctctcctgcaggcccctgggccctctcacattccgggacccgtcgcggcagcagacctcggccggcactgcccctgagccaggcccccgcaccctaccggccgtcttcactgttagacaaaggtgcctggggcccaggcggcccgcaggctcctctggccaccccgacagggcaggtcctggggactgtgacctaaggtgaccgccacggcggcacccctgtgatgccagtcatgccagagcgccattgggagcagcctcgagctaacggtcacgggctcacggtcacgcactaacagccacctgctaacagacgccggctaagtcacgtgctaacggacacacactaactgccgagtgctaacagtcacactcagacggtctcgcgctgacggttaagggctgaccgccaggcaccggctatgtgtccgccccaccccgtcacagtgccagcaacagcctggctgcaggagggcacagattaagtgatgaaactggaatgtaatacttgctgcagggaaaaaatacctgctgctttctctattgcctggaaaatcccatggatgggaggagccttggtgggctgcaatccatggggtcgctgggagtcggacacgactgagcgacttcactttcacttttcactttcctgcattggagaaggcaatggcaacccactccagtgttcttgcctggagaatcccagggacgggggggagccttggtgggcttgccgtctatggggtcgcacagagttggacacgactgaagcgacttagcagcagcagcagctttctccatttaaatggaaagcagtatttagcatcttactgtttttttgaagctagtgccacagggctctgctcatttgcaatggttacggttccacgtgggtctgtgagggtgagagtgtctcctccgtcctacatctctggccacttccaatgtatctgtccagtctccccagcaagttcatggaggattgcccgtcttttgacaggaccagagccatgaaggctgttgggattttctgtaggaagaaagcattttgagtacattttgaagtattaagggacatcaaacgatataactgttaacacaagacattttaaaagtagattattctccagcgggagacctgggttctttccctgggttgggaagatccctggggaaaggcatgacaacccgctccagtattcttgcctggagaaccccatggccctgaatgaacaacctaagcacacacatattctccagcttgtaaggtctggcttttcaagagggctgctgttatctttgcttttgtgtccctattg

SEQ ID NO: 62386 - DNA, 2237 bp, Bovine  19866880399588
ctggaatcaagattgccaggagaaatatcaataacttcagatatgcagatatcaccacccttatggcagaaaggaaagaactaaagagcctcttgatgaaggtgaaagaggagagtgaaaaagttggcttaaaactcaccattcagaaaacgaagatcatggcatctggtcccatcacttcatggcgaatagatggagaaacagtggaaacagtgtcagactttattttttggggctccaaaatcactgcagatggtgactgcagccatgacattaaaagacgcttgctccttggaagaaaagttatgaccaacctagatagtgtattgaaaagcagagatattactttgccagcaaaggtccatctagttaaggctatggtttttccagtggtcatgtatggatgtgagagttggactgtgaagaaagctgagtgctgaagaattgatgcttttgaactgtggtgttgaagaagactcttgagagtcccttggacttcaaggagatccaacatggtccatcctaaaggaaatcagtcctgggtgttcattggaaggactgatgctgaagctgaaactcgaatactttggccacctgatgtgaagaactgactcatttgaaaagaccctgatttggggaaagattgaaggcaggaggagaaggggacgacagaggatgagctggttggatggcatcactgacgtgatggacatgagtttgagtaaactccgggagttggtgatgaacagggaggcctggcgtgctgcgtgtggttcatggggtcccaaagagtcagagatgactgagtgactgaactgaactgaaatgtgaaataaaattaaagccccaaatttttatctacaatttccaaattctgaaagttctgaacacccataattttatcataagcttgcagaaaactgattggaaaaaaatcagctctgaacacacataaagttattctttgtctttattttttatacttatgtgcatttatatttgatacatattcaatgctagaatacttaaatatgagttcagtttcatatagcttgatggtgttaatatctggtatatgcactctattaccttcctgagacctgaaaattttgaattctgaaacatatcacactccaaggatttccagtaagacattctgaacctgtagtatataaatcacttggtaacttttagtccctttccttctcccaacacctgtttttgaattttatttaataaaggattgtgagtatttaggatcagcctcccatttttatataatcaggtaaagaatatgattctctcgctatagactgaatgggaaccagaaactcatgggttttccttgcacaggccaagcctggatggggctctctgacttccttctcggtaagataacttcaggggcaaagagttccagtgagaagcttagcaaacttagattagtatttgtgtgtgtgtgtgtgtgtgtgtgtttaaaattttgcctgcgctgggtcacggtggagctcgggctctttagttggggtgcgtgggcttagctgccctgaagcatgtgggatcttagtttccagaccagaaattaaatctgagtccccatcatgggcttccctggtggctcagatggtaaagaatctgcctataatgcctgccggggagacctgggttgggaagatcccctggaggagggaacagcaacccactgcagtgttcttgcctggagaatcccatggacagaggagcctggggggctatggcccatggggtcacgaagttggacatgactgagaagctaagcacggcccctgcactggaaggcggattcttaactgctggaccacctgagtccctagattagtgttttgagattttaggtataactatgaagcagatacattttaaagaaaatcgtggctagagtgatttaacagaattctggcactttgctgaccccttttgtgttagagtatcatagaattggggttggaaagaccaccaccgtcctgccttatcctcagcagatacatttcaagacctcccacccaaggatgcctggaaccatggatagtgccaaaccctgtgtacaccatgtttttcctgtacatacgtgcgtacctacctatgataaagtttaatttataaattaggcacagtaagaagttaagcacaataacaaataataaaatagagcagttataagtatatattggagaaggcaatggcaccccactccagta

SEQ ID NO: 62387 - DNA, 1819 bp, Bovine  19866880418700
taactgtgtttatctcttgaattatcagccttacaaaataaaaatttgctcctatgttgaggtttatttcatttaaaacttccacttatgaatactttggggggaaaagaatattctgcgatgcgtttttactttggctctttccaccttcgtgtctctctaggagttgatccccctcatcttgtgcacagcctgcctgcaccctgagcccaaggagagggaccagcttctccacatactcttcaatctgatcaagaggcccgacgatgagcagaggtgactatggctgcttctctgggaaataaatataatgtggacttgctctttattgctttgacatcatgattgcctttctaatctaaatgccgtctctcctttctaaggtctcttaataaagcaaacactgcccctgttcacagtgccctacagcgctctccttgtcattccagctgctcacgtcgcactgccacacttttgtgttaggtatcttttgggctgctaattatgccattaagtctttgcttttatctttcacatttgatttccaagaactcctaaatatttcccttttccccccacagatgagctagatacagcatggcctcttaatagttatggtttaccagaaataaaatatttaacataggaatgtctgcatcaccgatcagtttctgtatggctagagggatacagtgttttggttagtcctgattcaaacgcccacaatcaaggatgcctgagtggagaaatgagttgtacttgggagtggtgaggggcatgagagtgttgggggcagggggacaagacacatacccaggagacttctggaagaaaggggaatgggttttttgctcaggcagccgtgatagatgtctccccagaaagcagacttttaaatactaggagaagctgtgcaagtgtgaacgtgaacagaatatcctagtggagggtaagcagaccaagcaccagttggacaagactgagctgttgggatgtttccacactgtaattttctgtcttaataagcagataatttttgcttatactttcgcaaaacaatagagttatacattaagattaggtaacttgatataattttagttcttgttttattgactattacagtttttacctcttctgagaatgttggaaaatcataaagtgaaccatacgacaaatcaagcccaaaatttaaaacacaaggaatctctccaccatgagaataaaaagtcatgtagacttttaaactctgtgaacatgtatctctttcctacccttattaaaatatacctgagcaagcagacatgttttttttcaggatccagtcaagattaatctacatgctagctgaacagaagtaagggaaattcaatcaggttccattcattgcaaaccgaaaattttcttaggacaatttgatggttctgtctgtgggatcgcacagtcggacacaactgaagcgacttagcagcagcagcatataggaaaattaatattttatcttctccttgaaaatattattccctatcttggaaacttaattaataaatactacttattacattgtcatttttagaatgcaaggcaaaaatctctcaatttacatagcctgtttttacagactctgctgtaaagctaacagctgccatctggtggccaaaagtacctgtcagcctgacttcaggtcaagatacgtcaggatttaaacacgcatgttcacagctgatcttccacttttcagaaataaagttatttatttaaataagctaaactgttaactacatttgatatgaataaaaaataaagcaaaatttttaaa

SEQ ID NO: 62388 - DNA, 1511 bp, Bovine  19866880454797
tctgcacgtctctgtggcggaaacggtgtcggagaagtagcctgaggggcagggctcacacaccgtgtccttgttgagctgcactgtcagaaaaaccaacggacaagagaacacgggacagacgaggacacttagagatcggccaggaggggcccccaggctccacccccgccccagccgcccccgcggctgctggcggaggcccccccggcttcagggggcccgagaccccgaagtacgagacagaagcatgtccaggggcaggacgcggaggccaggcctgactccagcccggctctcagtccacggcctctgccgtcagagctgctgtcccaggcgcccatcctttgtttcccggccagggagctgctgcctgtctcctttcaaccaagtccattctctcctgtctcccttgccaggcgtcagtacagagaacggtagcccattaaccactctgaaaggaaatttcttgccctgacaccttctgatcagtaatcttaccagtctaagtatcagagtattgacaaagttcaaaaacaaaacccacgctacaccatgggtgtccttctcttaaaccaagggctggcagtaacggctgttttctataaagggcctatgataattatcgtaagcttttgaggctctctggtctacgcaaattacttgcagcatgaaagctgtcatagacaagtataaagacacacggctgtgttccaataaaaccctatttagaaaggcacgagttgggggtggactttggaccccgccttaggccgcagcactcaaggcaggagttaatcctggttggtaagctgtcgtcgcctctctcatattcctcataaaccatattatcaaactaggaaacgtctcagatttcctctgtctgttccttttactgcaactggcacacgatgaccctttggtaattccaataaagaaggacattggctaccatgtgctgtcataataaacaattgtcttgtgccaaaaccacaaattactcttgaaattagtagcacttctgcggtttatcttcatgaataaaatgcaaaaataaggaattacattttctctgtccaaagtcaagtgggaagtacactcttggtttttgcagttgctcagtacacagcaggtgtgcgtgcgtgccaagtcatttcagtcgtctctgactttgagaccccatggactgtggcccgccaggctcctctgtccgtgggattctctaggcaagagtagtggagtgggttgccaagccctcctccaggggatcttcgcgacccagggatcaaacctggatctcctgcgttgcaggcagattctcaccgtgtgagcccccggggaagccccaataagtagcggactcattccttactctagcaataaggtttgccttgaaacgatatcagcaaaggtacagttaactactagtcactcagatgaattcaaacagcttttaaaatgataatcacactctagaagagtaacccttaaaaacaaaatgacttctaagg

SEQ ID NO: 62389 - DNA, 1170 bp, Bovine  19866880501607
tttatgcttcatgcattttggagctctgtttttaggtgcatacatattatcattgttttaccttcttaatgaaacgatcctttttaccattataaaatgccctttttgtcctagtaacagttcttatttttaagttcattttgtctgacaatagtaacaggtactccagctctttttagttactgttagcatttgtcttctgggacaaagtcgtgtataggaagaggaggaaactaatgtttataaagcttctaaaacttcctgaactatgcaagaaaattcccatataagcagtattctttaactgatgatgataatgctttccaagaatggatactttctggcttgcctccatgttgttgctatataataaagtccaaagttttgatagagaaggtatagagtatttgaaaactagaaaaatctcattctatgacatgaaaattagtaaaaatcattcaattgcataactacttaaataccgatgggccatgattatgtttgtagttcaacataatagaccaggtacagccttgaggaacacatgatttggaatatgactgatgtagaaaatgtgtacacactttcactcatatccctcaataaataattgatgtaggtatgaccctgacttacaattaacttatgattttcaactttatgatggcatgaaaatgatatgcatttcaaaccatactttgaatcttgcattttcatcttttccctggttagtgacatacatttgatcttctcttgaaatgctgggcagtggcacgctgcggcttccagtcagccttgcaatcacaagagtaaacaatcagtacacttataagtattctgtatccatacaaccattctgttttttactttcagcatagtattcaacaattacttgagacattcaacactttcttataaaattggctttgtgttagatgattttcccaactgcaggttaatgttagtgttctgagcatgtttaaggtaggctgggctatgacgttcaggaggtttggcgtattaagtgtatttttgacttaatcatattttcaacccatgatggatttactgggttgtaacccagaatcccagggacaggggagcctggtgggctgccgtctgtggggttgcacagagtcagacacaaccgaagtgacttagcagcaacag

SEQ ID NO: 62390 - DNA, 1731 bp, Bovine  19866880554440
aaaacacctgcaaacatttttctccacatcctgattgtttttctagtgctgttgagtcgttagaactacttgcaaaaccagtgctgagagctgatggatatttatggggctgcctggtgatttccttcaagttcagccagtgcactgattccggatgtgatcagcactgccccctcaagagcaagttacacaggaagctgtacagtgggggctggagattgctatggctgctctgaaacatcgtgagaagagtttccaaccagagggaaaaatgaaaatggagaatgccttacaaggcttttccacaggtgtaaccaccatttcacacacgccaaacctcaagaaaatggaagctcttttattccagataacctgtaaattcagaattccacatgtaatttccttatacatgcagaatgtgttacacgttgatttccatcttcttaatgaatccttgacaagactttagttgaaaaggagaacgagaaacagcccctggatgctgaaagatggctttggcaactttatatgacgtggcttttgggtctgccacacagactgagtttccttgtcgtgagcatctgagctaggcagttgagaaacaccataaagatggtcatggacatgacaatcacgtagtggctgatgctgcaggagaaaaagaaacatgttacaggcggacagaacactcaagaggaagagcataagactccgctaacatttctaaacgtacaggtgatccttgaacaactcagggattaggggtgccaagcttctgagcagttgaaaatcgatctacaactttatagttggccctgagcatcctaggttcctaagtatctgtggtttggtctctttgccctcagccaaccacagatcattagtactgcagcatttactatctaaaaaaaaatccacatataagcggacccatgcagttcaaatccatgttgttcaaaggccaactgcatatacaaaatacataaattacaaaggatatgaatgctttttaaatagaatcaaaatgttaaaaagaatgaatttgttgcagaagtagtagtgaaagtaagtaacattttgagacagctccgacaactataacctgacgtgaagctggtattagcagtgcccgtgtctctgtcaccatcagaaactgagtttaaacatctagcttctacaaaataaatgtaactttccccttataattctcatatcctctgaatcacagccacagactccccaagatgtccccagattcagtaatatggtattttggagcacggcattccatactttgacaaaaatacaggccacagagaaagaaagaaagatgttactcaaactcaaagtcagtgaagtgaaagttttagtcaaagagtctaaacaaaacaaaaaggacacatctctctgctaatctgagtcaaaccactgcgtgccagacttctggaaaaagaacactgttagaattactcaatcccagctcccatctatcagcaatagtaaatgttcagtttttctttttaagcaccatactacattgtccacggcttgatcatcaatttgcaaacatggaaagaaattgaggacatagatctgacaaacgtgcaatagagcagaggtctcccacagtgaatgccaagctgagcttcggatgacactggcaagttacttatgtactaggcctatcagagttacacgaaggatctaacttcatagtaaacttatatccgg

SEQ ID NO: 62391 - DNA, 1550 bp, Bovine  19866880565578
ttatgggctcatgtctgtagtttactttgaaatatataaaaaaattgaagaatgcatagaggaatggttaggtggatagatatgtgataaggcaggcagagtaaaacattaatagtacaagctaggtgatgagtatttactaaaattccttcaattttactgtgtgtttgaaattcttcatagtacaatgttggaaaaaatgaggattgtggtgataaagacagaaataaagaaaataatgtttctagacgtaaattgattagcaagacaagcccaggaaagacattgtcactcaaattttcctggagaaacatctttgtgtggactttaagattgcacctgaagactctgaagttgttgctacatccttatggctatgggtacacttggttgcctttttgtgacacttgcccttcaaacctaaaattaagacaagattcagctcaaaactaaatgttcccaaaccatggcctgggcgcttaacaaggaggaaatgctgtggattcttattgccgtagcagaaggtcagattcctgataggctgatcagagatgtgttttgaattgtccactttatcatcatataatatctaacttcgtagtttcacttggcaagttctgatgagtagagcatggtgctaatgagatccagggagtgtcggccaaacggcctttaacctaagtggtataattctgacttgatatcagaattacgggtccagtcatcacccagatcagttgcttcatatgaaccattatccagtggccaaaaatacagccctgaccctggagctgtcatttgcagccgtgtcctttgtgacaaaggagagctgagagcacgtctacataaaacatgcttatcaccactttaggaaaaagcagttcacttacggccataggagatattcaatagcattaacctcccaggtttatatgagctcatctgagtggtaaacattcttttttaatggagaatattttaataaaatgttgcaaaagttggcagtatttttttcctctctaaactttttattttgtattggggtatagccgattaacaaacaatgctgtgacagttttgggtgaacagagaaggagcacagccatacatgtatacgtacagtccacggaattctccaggcaagaatactggggtattcccgggtagccattcccttctccaggggattttctctacccagggactgaaaccaggccttctgcgttccaggcagattctttaccatctgagccaccaaggaaacccatatatgcatcttcttcccctagtctcccccgcatccaggctgccacacaacgttgagcagaattccctgtacagtaggggacacagaaggccctttttggttatccattttaaatacagcagtgtgtacctgtccatcccaaactccctaactagctcttctcccgatccatccccccagcaaccataaacttgttttccaatctgggagtctctttctgttttgtaagttcacttgagacagtatattgaaagacatcagaagtatttccagaggaaagact

SEQ ID NO: 62392 - DNA, 1560 bp, Bovine  19866880566432
atataaaaatagaagactcaaagttgtcttttaaaattaggggatggctagaatgaagagtggggcaggtcaactcaaatttttaaacttctactctacttatttaagctgaaaaaaaacattctacttctcaatctttgacaactgaggttcacagcaaaactgatccttaaatatagataacataataaagcaaggatacaacaacaggaaagtgcgctgtaggcttcaaagagatgggtagcgatatccagtcgtttagagtccacaatttgtaagttgttcaccaaggctaacttatgcagatgcggtataacaactgaaaagaggaaaagaaattattaattttaacctaaaatgtcctttatccatttgaaaaataatatttcattttataaaattttattttaattttggatgatttcgaaagatcacccacatcctatacttgctttttcttactagggaagaaagcatgttttttcagaataaagagtgatccagaatttgggagaaagagatcacagcgtgccatcatgacctaattgtgaggatgcacacaggtcatttagcttcactgcaactcagtttcccaatctgaaaaatgaaaaccaaataaataaatgtaaacaacctacctcttgtgttattattataaagtttatacaaatcaggtattaatgttgctattaaaagataaaaagtatacttattctctttcaatatcaaatgatttcactacttcatgaaaatattactggctttagtctctcaagttcatagcaaagaccaatgtcaaacagcacaggtggctgagttttcaagtcactcaagggctcagtatgtgatatctcaatgaacagcgtaaaatttcaaaaatacagataacacgctactaaaataaaagagatggcccaagaaacaataaccacttcagtaacgctgagcacccctactgcctaagatcatgagctctaaataccatttcccactaaaaccagggttccttggagaaatggctccagggtaagtgattatcaagctgttgatcacagggtccctttctagcccctgcttggttgggggactcagagcatggctcatcagggcgtcttctgacagtcgaggtgacttctttcatgtttacactgaatttgcatatgttaaagccacaatctccttatcaaaaaatctttctcaatagatcagcactataattacaatctttaagcttaccttagtaaatgtaaaaaaaaaaaacaaacctacaaaaacttaggacaactatggccatttttaggggactttttgacttgtcaaaattagtaacaacatacttaagaggtgttctaaaaacataagacaaaaacttcaactattcattgaattcctaatcaatttactgaaactttgattcattaactggcatgctgaggcctcaacaaaatggtggctctgagacagtctctcaaagagtctttatttcatttctgcccaaatttaccttccttgcacttgtttatctataaaagcgtggcctctctattcattctgctcatt

SEQ ID NO: 62393 - DNA, 1732 bp, Bovine  19866880623672
aaacgaactctgcgggtcgacagtaaaggggtttgaagatggagaggtgaggcaggagatgaagtttctcttgcttagtccccagggaacccctcgagttctgcaggcaccagtttgaaaaccgtagttcttttcctgagtgagcagaggttgggagtggaaagggctagggttttacttagaaggtctaaaagactgtggtgaccacaggcatagcaaaccccagtgaggttatctgggccagccaggaggcctgaggagcccctgctgtgagacatgacctctgtctttgggggacatcctgggaccatgttcatgtaaagggtttggtagattggtgcttttgtttttttccttggctacactctaagacttgcaggatcttagttccccgaccaagtatcgaacctgggtgctcggcagtgaaaatgcagagtcctaaccactgggctgccagggaactcccagattgactcatttttattgatttattgggaggaagcagttttgattggcgcatgttcccccttctaatttaaggaacatacatgtcttccaaatgcaccactacgtctgagagcgtctgtctgccctgtggcttggacgagtacctggacacctggaatgaagaagataaatgcttgctgcacaaagtctgcgacccaggtgagtcagcctgtcggggcagtgtgggtgaatgacattgttggatatggtgatgctctgactttgggggcaaggaagacgtctgcccacagacccccgagggtgtgccttagagcccaggagcactgggttacggcttttcgtatagaacttctgtcctggaatatatctgttttgttttgtttttactgaaagtgaaagtgaagttgctcagtcgtgtctgactctttgtgaccctgtggcctgtagcccaccaggctcctcggtccctgggattctccaggcaagagtactggagtggggttgccatttccttccccagtttttattgaagtacagttgctttagtgttgcgtttgtttcaggggtgtgtgtgtgttctttttcagattcttttcccttataggttattacaaagcgttgagtgcagtgtcctgtgctgagagttgatccttgctggctctctgttttacatacagcagtgtgtatatgttaatcccagactcctgatttatctcccctcctacatttcctctttgctaactaggtttgtttcctatgtctgtgggtctcattctgttttctaaataagttcatttgtatcattgttttagatgccacatataagtgataatatatgatatttgtgtgttcagtcctggaaggtatcttacacttgacagaaggtctccacggcacttccacatgttgttacttaattctcacaaaacaaccctgtgagaaagctacgcttaccccatcgtaaaaatgaagaaacttacaattatcccattgtaaaaacgaagaaactaagaggcagtgagtgatttctccaaggttacaaatgagaagcaggactcaaaaccagatcttctaactcccaggtctttttcctaaaccatccacgtcttcctacctccatagtctgatctacttaccattactgctatagggcttttgcctcagagcttttaaaaattaaagcttatttataagaataggatcaaaatatgtctcctgtcctctttgctaactaggtttgtttcctatgtctgtgggtctcatt

SEQ ID NO: 62394 - DNA, 3966 bp, Bovine  19866880630992
tttgaatgtgttatatgctgcttggctatcaaatttatcttctgcattttaattaccaaaaatgaggttcatattcctaagaataaaatacatattaaatcatccaaaaactaacacatcacccaggttaaaaatgctatggataaaaaggtcactgactttttaaaaagattatcaggactttttaaaaatttatttttaattgaaggataattgctttacagaattttgttggtttctgccaaacttcaacattaatcagccataggcatacatatgacattatcaggccttttataatctcatttctagaaagtttatggtgtgttcaggcatataagcttgttatcatttactaataaaacccaaaatcaagtctccagatttagttatatatacgtgaaagatatgtctggatcacctgaatttttaataaatgcttgaggaatctctagcaagcaggaaccattcagcaactgaaacaggctctgccggtatggaaacagccggccctctgtgctttcctggagtgtgtatgtggattttggaatcctgtccatgaaactctactttcaaatcgctcctaaatccagagaatgtcctcagccaagtaaacgagcagggagctcgttcgcccaaggcagtgttgtgtggatatgacacgcctgttaggcccacagcaggtgagagtattctagctggagaaaggaaagccacctgcataattcaccagtgtctcccgatttcctcattttccatctgtatctacacctttaaatttgttctcctggctcctgaaaattggcccagtgtcccgctcagagtaaagaatgctctcactgcctcaggcccactcggcctgtgcagcctctcggggcagcgcacggaggctcagcgcagcatcggcaggcggcaggcggtccgccaggcgtcctgtcagttggttggttccatccctccgtctcccccgcctctgtgacactcgctgcggcatcctcgcaggctccctcccgcctcgctggtccgccagccgctgggcgagctgccatcagggctccggctctgtgggctgaatggctggcttttctcatgttggggggggctgaaagaaaagactgtcaggagccaaccaatgcttttttttttttctaagataaattcaaatcttcaaagagccagaaaaagaaaaaaaaaatgctccaattaattttaaatgaacttggtaggcatgtttattctttattaaatagtcaattgttggccatcatggctccatctatcttcaaaaagagggaaggctttgtttccctaagccatcctccagctttcatacgcctaggtttgattctcagccgtgcaaccctagacaaacgtcttaatctttccatgcttcggcttctcacttgtgaaacagggataataatacctacctcacaaggtttttgagattacatgagacaatatatgtaagatgctgagagcagggccaggctacagtaacagggtcagaggcaaagaaaagcatcatgtatttaaatttcccaacacttggaaagtttcaactgaaatgattccaacttctccagcctttagtggtcaccttacctgtccatggggattttccaggcaagactactggagtggggtgccattgccttctctgattttctttctacagtaatcataacccaacatattgatttcagtttgaaaaacaaggcactaaacaaattgcttaccgccatcaaaaaggtagtatttcccagtttcaacaactttaagatacagattgcaatttttggcaactttttttgggggctgtgcacttggcttgtgattgaactcagagcctgcagtccttaaccaaccactggactgccagggaattctgctgacaacttttttaaaattaatttttattggattatagttgatccacaatgttatattactttctgcagtacagcaaactgaatcagttatacatatactcagtctcctagattctgttctcatatgggccattgcggaatactgagcagagttccctgtgctaaacgcaggtccttatcagttacctattttaaatgtagcaatgtgcacatgtcaacctcagcctcccaatttatccctccccaccttcccccttggtaaccacagtttgttttctacatttgtgactatctctgttttgtaaataggttcgtttgcacccgctggcaacttcaaatggaattttgaacgcaatatattacaatagcttatatatatatttgtgtgttgtgtagtgttaagccgctcagtcgtgtccgactctttgtggccccatggactacagcccaccaagctcctctgtccatggaattctccaagcaagaatattggagtgggttgccattcccttctccagtgtttatatataatttacagtctataatatatgtaatggtttatatataaacatgtatatttcagatcttactactacctgaaaattactagctgtgtgactgtgaaagtgacaagtcctctcagtctttgttttcttttctcttggttggtatatttacatatacatatgtttatatttatgtataaatttacatatacacatgtttatatttatatataaatttatatatacatgtatttatattatatataaatttatatatacaggtatttatatttatatataaatgtatacatacatgtatcctagagatgctgtagaattaaaaagcagctataaaatgcctggtattcaacagatggcagcaatcataactactgcccattaccaaggactacataagattctcaagaatggttctcaatcatggctacacaccaaaatcccttagaaggcttttaaacatagatgcctaagcttccctccacacctagtgaatctcctgagatgggcaccaggtaagacaacttaggtaagaaaacacaaagggtcaggtatccaactcagattcaacaggaattatggatcttacccagtgtcaaggtgaataaggactccaaggaaataaacaacagcaaaacatgagctcagcacgctttcctcaggcttccctggtgtctcagtggtaaacaacctgcttgcaaggatagaatcgggttctatccctgggtcaggaagatgccctggaggaggaaacggcaacccactccagtattcttgcctgggaaatcccatggacagaggagcctggtgggctctagtccatggggtcgcaaaacctcggacacgactgtcactaacactttcaatttttctcttcccttagcgaggtctggaaccattaggtgtaggcacctgcaaatacccttctattttctgtacaaggtgcgtgttggtccacacggaatatgaaaggtgtgagcaatgaatgaagggcattgcctgaaagctgctttagttatgtaacatctgctttttatactccattaactacactactcacatgacattttcaagcaagctgtgccccataaattccaggctatttacaataaacaacctagacagaccccggtccatcttgctaaaacgttccctagataaggacacccatctagcaaataacataactgtgtctgtcaacaagtcactagtaggtttacaaaggacctgattcaaaactttccttctcaacaggtgataccacttacaggagccggaaccgcacaactcgacctttcccggttccgattcatcatttctgggcttatttgaatcaaagtcgttttgaacaaagacgtgcaggggttgatagtcagagtgtccctaaagtcttagaacagttgtaagctttaaaaaagctgagactgatctttagaaagcgtaaaactgccctaaggctttgacactccactttatttcactttctgaatgaggaaattgaagcagtaacaattctttgtcgttgtgttgtgtttggggatttgtttttt

SEQ ID NO: 62395 - DNA, 2220 bp, Bovine  19866880646546
aaggcaagataacgcctggatttggtgggaggtaaagatcccctgaggagggtgtgcaacccactccagtactcttgcctggagaatcccatggtcaggggagactggcgggctacagtccacggggtcgcacagtcggacacgactgagcagctaatcacgcgtgcacacgatgacacagtcagctttccaaggcgagtctgtttgtgtaaaggtgtcaccgcacttctgggctgtggtcaccagtgattctgcctttcgtcacacgcccggtatattaattatctatcgttgcatatcgaatggtcccccaggtttagcagcttaaaagtaatacttttttctggatcagaagcagcttagctggtgctttgggctcagtttcggtcacgaggttgcagtcatgatgtcggccagagctgcggttacccgagggcttgctgaggctggagaatcagacacgcagagtcggaaaagtcaacagtgacccgatccagttccctccttttataatgaggaactattgttcttcacaagctcaacctgaaacagttcttaggcaggttacctgtgttaacccatgatcacagtgagggtctctggaatgtctcctggtgacttagtgactgacacggaaggctgagtttcagggttaccttccctcttattttaaggctttgctctctgcctgtgtacctaggcccctgtggttgtgtgagtgagtgaacaagcagagactcagttttgaataaggagatgggaagactgcctagagcctttgatgccgggagaggagccaagggggactggagggaggttgtgtgtgtgtgtgtgcgcacgcttacttgctcagctgtgtccgactctttgtgacctcagggactgtagcccaccaggctcctctgtccatgggattctccaggtaagaacactggagtgggttgtcatttcctcctccagggcatcttcctgacccagggatcgaacctccgtcttctgcgtctcctgctctagtgccagctgggaagcccccgagggggaggctgggggagcttaatctctccgtttggcctggtcagggctccttcctctagtctggtggggacgcaagtcatgtcacgtgctggagggaggagtggaccaacctctcccgatcggatccaccttccttcagtcctcgttgtgaggtttccaaaccagctgtcttctctccaaagggaccacgggatgtcctgctccttactcccatggctctccctgtggacagggtcaaccgaatgggatcagaggtcatttcttaagccttgaatcagttttgagtgaagaactaaaggacaaagagttatatttcttgagaggatggagcaagagcaaagaatcagaactaaaagttcctttgaggctctttttttggaaaatatttattttagaattgccctttcccctcaggctctgttctgtaattatacacattaacacagcaccaaacgccaacatggctcatctcagacaaaaacacagctcttctcagaggcctaatctactgaataatgaagctctgtatattctaagtccatcttagagaagtttaaggaagtgttgttccagagaaagagcaataaaatggctagtgtggatgatttatacctgaaattcattaacctggtctccccttcaatatctaagcactacagatatttcttctatattttgctagcgttttcccatccatttggacatgggccagaggtaacccctctcataaagaacatcaaaaatacgacttgaaaaaatgcaggcttgcatcatttttagccatttggcaaagtggtttgaaaaatgtgagcagttgaagatttcaaactgttggcaataataggatcatctgtttccaggaacactgtcagactttcgatcttgttctgcttaaattacaccagatactataatagcagcatttctaagagtgcttcctaaagtggggtctgagatggtcgtgggtgcacgtgtgtgagagagagagactgagagacagcaagagagacagagagggctgattgcagtcctttagggaaagcgtcggagaaggcaatggcaccccactccagtactcttgcctggaaaatcccatggacggaggagcctggtgggctgcagtccatggggtcgctaagagtcggacatgactgagcaatttcactttcccttttcaccttcatg

SEQ ID NO: 62396 - DNA, 1910 bp, Bovine  19866880653995
tgacctcactgtctgcttttttggttctttgcttgttttctaagcacctttgttggaaaaaacaattcaggattggctcggttttcgttttgtatatttgggtcaaaaactacattttttttttttttttgtatggtggcttttaactgtgcctactaccttaacccccatggttttaggatgattaactggaaaagagcacttaccttggtctaaaagtacagtctgcgtatacctaaattgtgaatatcgattgagaagggccttaaatattaataacctattttttccttcagatagttgtttttattggcttctatgtgtatgtactgtaactaactaaacacacacaacacacacatctgtactgtaagagttgatgataaaatgtggtttctaaattatttatactaaaaacatacttgttgatacttaaataaattgtgttctgctgtttggccatattttgaacacgatgcctctttggttgacttttgggggatttgcattagtttaggattgatgagaaagcaatggcaccccactccagtactcttgcctggaaaatcccatggatggaggagcctggtaggctgcagtccatggggtcgctaggagttggacacgactgagcgacttcactttcacttttcactttgatgcactggagaaggaaatggcaacccactctagtgttcttgcctggagagtcccagggacggtggagcctggtgggctgccgtctgtggggtctcacagagttggacacgactgaagcgacttagcaacagcagcagtggtaggattgatctgcttcaactcccttatcatatgaatgtttgtggaggtattaccattaacttttttttgagatctaatcgtcatgacattttactagttttagatgtccagcagaatgatttgatacatgtctgtattttgaaatgatcaccacagtaagcttagttagcacccatcaccacatagctacactttgtttgtttgtttcctttgatgagaacttctgtgatctactctctgagcagctttgaaatacacaaaacaatattgttaactatggccaccatgctgtacacttcatccccaagacttatttatcttgttggaagcttgtacctgcagttaactttttaaagtggttctggccccatttcagtggagcgtgcgaaactggtaactctccaattccatatgtgcatatagtttctacaaactaaggaaatctgcacaggaaaatctgagaaagttggatgtaaattgtcgaatttactttaaaaatagattcttcagatttctgagaagtgaatacttgatgtaattgaatacagcaatggtatttactaagattgagcaaaaggtaactgtaacaggatcaagaagagtgtcctagagctgatgtgtttgtattatagcaagctacgtgatagatctctcacattgatgtgaataaaatagagaaatatgagcttggtagaagagtaacagtggaaacatgtgtggctgataaaacagtagtaggtctgtgccagtgtgtaccacctatacttttgaaagtgaaagtgaacttggcctattttttgaagaccaccgaaaaattgatgcttttgaactgtgatgttggagaagacttgagagtcccttggactgcaaggaggtccaaccagtccatcctaaaggagatcagtcctgggtgttcattggaaggactgatggtaaagctcaaactccaatactttggccacctcatgcgaagagttgactcattggaaaagaccctgatgctgggagggactgggagcaggaggaaaaggggacgacagaggatgagatggttggatggcatcaccgactcgatggaccttgagtttgggtgaactctgggagttggt

SEQ ID NO: 62397 - DNA, 1511 bp, Bovine  19866880665306
ggcacgagctgtcattgcagtttccacggaaaggccagcaaggcatcaagcaagctgaagacgggctactttgggacttcccttggggcccaagggttaagaattcgcctgccatgcaggaggcaaaggttcagacgctggtctaggaagatcccacatgctgtggggcagctaaggctctgggcccacagctactgagcctctgctctagagccaggagctgcaaccactgagccacgagccgtggagcccaagctctgctgcaagaggagcccactcagtgagaagcctgacgctgcacctagagagaagcctctgctcactgcagctagagaaagcccttgcacagcgacgaagacccagtgtagctaaaaaaaaaaaaaaaagattggctagtttgtgtctcagtgggctccataaggctccagttgtcaggtgcctggccctggagtaataggtcagaaaaatattgccacggagtgtaagagccccagttgaggggctggggggttgactctggattggccagtgtgtatataaaggtgttgtcaagcgtgaattcttcactatttctagtaactggttacccgtgagaggacagtttcccatgcttagtaaggccccagttgtcaaaacattagaataaaacaatgtgttattacataagattttgtctattgcatccctgctgtgtcactttatgggcttccctggtagctcagttggtaaagaatccacctgcaatgcaggggatcccagtttgattcctgggtcaggaagatctgctggagaagggataggctacccattccagtattctggcctggagaattccatggactgtatagttcatggggtcgcagagtcagacacaacagagcgactttcactttcatgtcactttatatctttctctgtcccctatatttgctataaattagaaacaaaatttggaggcttgattggattcaagttttattttttaccacttccatcagaaaaaatataacatacaattatctctttttattatgccagcagccgttgaagagcaatggctgaattaaattatttaattagtaattacaaaagaagggcattctaattctatcattccttccctgtttactagagagagaatttttttttggtaaagagaaatgtttcctcatcaactctgtgataacccagagatagattgtagaggaacggtagattaaatgcttgactctttccccttattgacctgttttcagaaataatgtgttggtgtcagcatcctgtgaaagtgaccagtgagttggtttcagagactttgacatatctgatgggcttcaatccactgtgttcttactgatgctgaagttgtcccgtctggggccactgagcttctttgagttgaccccttactcattttgacggggcacagtggttgacctgtcttctgggatgagaagtatttcaagcttatattgttcatttcctgccctaggtctggtgtgcgctaagtt

SEQ ID NO: 62398 - DNA, 2577 bp, Bovine  19866880674805
ttgatgcttttgaactgtggtgctggagaagactcttgagagtcccttggactgcaaggagatccaaccagtccatcctaaaggaaatcagtcctgaatattcattggaaggactgatgctgaggctgaagcaccaatactttggccacctgataggaagaactgactcactggaaaagaccctgatgtagggaaagattgaaggcaggaggagaaggggacgacagaggatgagatggttgggtttgagtaagctccaggagttggagatggacagggaggcctggggtccacggggatgcactgagtcggacacgactgagccactgaactgacttaacccttgttctttgctctttgcctccaagaagctgtttcttttcctccacttgcagcactagaatgggccttcttagtagaggatttgtggatccctggggctcacacagcacgtaaaactcgcttttttgtgctggtctcactctgatcccacgctccatgtccaggatcccacggctctccctctgcactgcagtccctgcgtttgtaactagtgggaactctagaccttggacgccctgggctgcccctctggctgaccccctggggacctgtcccttggtgctgaaggccaggccagccctgcctgtggcctccctgctcccacgtccccaaaccccaccttcttaggcttggtctccggcgagccagagctgggtcttttggataccagcctctgtccagatggcccacatccacagaggggcatttctggtgtgaatgagtggacgcccccagcccctcccagtccaaccctcctttttcctttgggttctagttctgacatccctcatttcacctgcgctgggagagccctcaggcctctcaagctcctggtcctttggccctttcctcccgctgctcagaatgtgggcctgactccgtcctctgatgctgaagctccagtactttggccacctgatcaaagagtggactcagtagaaaagagcctgatgctgggaaagaatgaaggcagaaggaaaagggagcggcaagggatgacatggttagataccatcaccaactcaatggacatgagtttgagcaagctcggggagacagggaaggacaggggagcctggcgtgctgaagcccatggggttgcaaagagtggggcacagcgaccggaaaacaatctccccctgaaaccaaagatggcagctcttatcattggtaacagtcctcataaggcaggaattagatgaaaatatgttcctacctaagtatttcggaagcaatctcccagggaatggggtgggtggcggggagcagtgggagccgggattcagcataaggcggcggattttcagtaaacggggtgattttctcaaccacctccagtctcgtctctttgcccaagacggagcaacagacggcctttggtaaccgatttgagcggtatagattctagttatctacatttttgtctcgtttgcctttaggatcgacttgtttccctctaaaacaacagggcttttgacccctccttgttttcattaaacaaataaagcagaacgacttctcaactatttatggaataaagggtacggtcacataaattcaacgttaggtctgtcgcagcgcttgtgtttggggaataggctttgattcagggtacttagaagccttgtaaaaaccacgcatgtgctgacagggccctactacaggcttaatcagtaaactacaaaagtaacgtctgggcccgcagagtttgcatcgactaacttctgcttcctgacagacagctcctgagtatagaaggatccctagaggctgtttatagcaaatatcttttacgtttccccctttcttctcccctgcccatatacattccttggacagtcttagaaaaaaagaagttaaaattaaaattaaaaaagcagttaagacaatgcatctagcgtattggccatctgttacctcactttcttttgtgttttgtgtcatgtcgatattcgtttcagggcgtacaagctgctatttaattttaatggctgacagactcttctggaataagcatgtctacagtctatgcaaggctttgggagataataaattgtaaatcaaaattgtctttataaagctccgtggatttattggatttgtttcccaatgcaatgccatgttaggtctaatcctgaaaaactccaagctgaagaaacaaaacatttctctgagcagagtggcagagattggaggatctgtatttggaatcctgcagggaagattgacttaaatatttatttttcgtgcagttaaatcaacccaattgtaccgaaaggcattatgaatcctaaaattacttttctgctctactgaaaattcatgctgacatgtaacaaaacagaaagaagcttggctccttctttcaaatcaagaagaaaagaactcaacccagaagaacaaatgagggattttccatagattttattttataaaatatcatccatgactgtatttgagaatctggctgtaaattaagtaaagattggatcacatttcgattgttacagtcta

SEQ ID NO: 62399 - DNA, 819 bp, Bovine  19866880727474
attaagaactgttctaaaaataacttgaaattatttatgagttacttttctatgtctacaggacatagtgtaagaaaccactgagtgacagcaataatgatcaatccccaataaaaaacttgtttcacttggtagctttcagtgcatgaaagacaaagtgcagaaaaggctttaacatatgacacatcctcagagaaactgatggttttgctcttacatgtcaattcaggaaagagtaaaaaaacacaacttacactcatctcggaaccttggttctgcattaggcccaactctaccaaatgtttttatgatctctgtatgcagagaatattggtcttgatattgagggtcttccaggaaagaagccaactgcattttcactctttccagcaacttaaaattgaatattatacagtcagattgagagaaagatagacactaaacatggtttgcataactggattcaaatgacttatatcaacatgagttgaagtttgaaattaaataagtacttctttagtctttcagctcagaaaagatcctacatatttatgtttgccaactcatttttttttttaaacacaaatattccctgacaaactgtagaaagatcccgtaatatttagggaaaaacataaatgtatgatgatttttgtgtctaagtcagaattcttaaaacagatcacaggggtaagttaccctcttattcaccttctgaaagcaatgagtcattagtgacttatatattactcatatttcccttaaaagtttttattttggggatttaagaacatgttgaaattctgccaagactgcaag

SEQ ID NO: 62400 - DNA, 1767 bp, Bovine  19866880809948
tttgttgtgttgtgtttggggatttgtttttagggtgcaggcagtggttttggacatgataaaacaggaatgcagtcttccaagggcctataatccagaactagtccctgtttcacatagtatgcactcagttctctcatgtaatatgctataagtatgaataaatatgcttatccaataagacaatgcatttaatccccatttctacagatattccattgacagaagcagtgatcctggaagattcttctatgtggacattacaacaggtgccctaatgactgcaagacctcttgaccgcgaagagttttcttggcataatatcactgtccttgctatggaaatgagtaagtaaaacaatacactggtctccatatagtgacaaaacataagcattgtagaaggcggaagtttccagagcctgctggaacaaaaattgtattctttatggaaaaaaatgcaaatcctggtttatgcaattgaatgaatgtatttagttcaaatacttattgaggatctctatatacctagtcctgtgctagggataaaaacaaaagtatcatgcaaaagcagcacaaaaaacagcatccttaaactgaagagctacttctgtatgaagaaaagggacaattcttgagacatctaagaggctttcaatctttaataagattaggaatgcaaatagtatattattactatatgaaaggagacatttataacatatcacgcttatcatgcacacacacatacatacacatgcaataagaatttgaaacatcttacaacagattaacactaaacctgaaataaagttgaagattaataaactaaattaacattataatctcaatacaaattatatactactacattccatttttttctttcacaacacccatggatttgggtggactccgggagttggtgatggacagggaggcctggcgtgctgcggttcatggggtcgcaaagagtcggacacgactaagcaactaaactgaagttatgagaaatattaagggaaatggtaaatccaaacatattggcagaagtatgtacagtcattcatgagggaaatttggtaagaaatcttttgtattcagattctccaatacattcatcctctttttctcaagaattctactcctaataattatcttatggaaatagtcataatattaacaaagatttatgtaccaaaatgtccactgcattgttattttaagaggggaaatacctaaatgtctaataacaggagtttgactaaataatggtacagtcatacagtaaaatgagaatatcctgtttacattaataccaattaatgtaccaattaattaatttcaaagtacatttcaatgactttcagggaaaatctttccctaaaatattaaagttctaaatcaaatttttttatttttcttaatttcagtgtgcgtgtgtgagagagagagagaatttggacacatgtaacattatacataatatataatggatatctctggtggtaggactatggatcacatttattcttatttttctgaaatttttatcactgcctatataaacaagtaccagcacaagttacaatggaaaaatttaaacatgtcagcactcttgctaaacaagcaatataaatatttaggggaaaaacaatgtataaatattcttgagggaaaaaaaaatgaaccaaaagaacagggcatttcaataaaattatttactaagcatacttttctatgtcttaataatttctattttgtcttc

SEQ ID NO: 62401 - DNA, 2720 bp, Bovine  19866880832620
actcttgcctggaaaatccatggacagaggagcctggtgggctgcagtccatgggggcgctaggagttggacatgactgagcgacttcactttcacttttcactttcacgcattggagaaggaaatggcaacccactccagtgttcttgcctggagaattccagggacaggggagcctggtgggctgccgtctatggggtcgcacagagtcgaacatgactgaagcgacttagcagcagcagcacggggctcactgccctgatcctgtgagcctgtctcgtggtggatgcttggggaacgtcggtcccgttacccaggtccacagagagtgtcagacggccttggaaccaagtccagatacagccttcccggcaccctggctccggaaacacgtttgacgctctcgttgacctcagaggaactgtccctggccgcagccccccagaagctctttgcctggcctggggaaggtcagggaggcccttactggctgcgtcctgcacgccctgcttactcttttcttaatttttactttttggccatgtctcatggcgtgtgagatctgtttcctgaccggggatcgaacccgggccccctgctttggacgcagagtttgcaccaccggaccaccagggaagtccctcttttccggttttaaatttagttttggctgtgctgggtcttcgttgcggcacgggttttctctactcgcagcccgcggaggctgccccatttgcggttcgcgggcttctcttgcagagcttaggctccgcgtgcggcttcgggagtcgcagttcccggctctaaagcgcaggctcagtcgctctggttcacgggctcagctgctccgcggcatgtggatcttcccacaccggggatcgaaccctgtgtccccggcgttgggaggaggttcttcacccgctgagccgccgggagccccggctgatgtctgccctgtgagccggtgctcacgcacagcgcgcagggagggcccgctgccccccttgcagcccaccgtggagagccaaagccccttgagagcaaggtggtgactgcggaccccagcccagcaaggccctgcgcctcggtgtgtgcacgcaccgtctgcgctgctgaccccgggcctccgtgtctcccttgggtctgtaactcgactgcctgcttgtcaacaggggtgtgtgttgtttttctctaacagagacagctgataagggaaagagctttactgtggcaaactgataagaatctgagtgaatgcagggtacttggcttttgttttgctttgcttagatgagcaaatgtggaaattattattggtgttagaatcatgcagaaaggagaccgaagttcaaaaagctgaagcggctcatggacatcccccgagccggcgggcccgcggtgctccgggctccaggtcacaggctccctataaccccttgctgtcccactttttaaaattctctgcatgttaaaatttttttaaaggcaagcagtattaagcatctttctaaaatcataaatagcttgtcagatcacatttcccttggtataacacacaggcttcccagatggctcagaggtaaagaatgtgcctgtaaaagtcagcagacaaagagaggcaggtttgatccctgggtcaggaagatcccctggaggagggcatggtaacccactctagtgttcttgcctggagaatcccatggacagggaagcctggtggaatgcagtccataggttgcaaagagtctagtacacgtatgaagggaccccactctgtacttccccagtttttatgaccagagtggactgaccacacggtggatgacacagaagtggggccacttctgtacgtggttggtcaaaagcagttttcaaccttctgggtaccatttttaaatttcctttcaatccatcctgttagcatgagcgtaaccgaaatatttttaaatacttaaatggatcttgatgccagtatccttggttttgtacattcttaggggaaagaaatgagctagaataggatagtcatatctttggccggggggcggtatcatgccgagcggcggcaggacggtttctggtggcttcctctgggaagaacttgtgtttaatctctgcctgatgcacattttctttctaggtgactttgcagatcacccctccatgtaccagcgagaggtattacgagcatcttggacaatgctgtaagaaatgtgagccaggttcgtgcggctaaacctcctgttgtggccctcccaaagtgggtgggactcttttttgttttaaccttagtaaataactgattctatcttgccagatgagaaatgaaatcggataggcttcttatggcagtggcaggtagtaatgtctgtcactctgaagacaaaaatcttactctcaatagatgaaataacttaaaaatcaagagcagtttcaggaactggaattaagcaccagttttctaaaacactatttctggagaaggcaagaggttttttaaaaactctgttttagaagtttatgattcaaactctcaaaatatgcaatacaagtcttatttaaaaggatcacttgcagtagttccctggttgttcagtggtttgggctccgctctttcactgccatagcccaggttcaaaccctgatggggaattaagatcccgcaagccgtgaggtaaggccaaaaaaaaaagtattaatttcatagaaattcgccaggg

SEQ ID NO: 62402 - DNA, 1529 bp, Bovine  19866880860066
ctaagtcttctccatgatttttgcttttttaaaaaaatcactgctaaatcagggggacggataaatcaggagtttcgtattagcagaggcaaactactgtttttataagatagccacaaggtcctactgtacagcagaggaagctatattcaaacgttgtcatcagttataatggaaaataaacacaaacacaggcgtcgctgacggggacttctctgacagtccagtggtaagatttcaccttccagttcacgggatacggttcaatccctggtcggggaactgagatcccacgtgcctcacggccaaggaaccaagacccagaatagaaacaatattgaaacaaattcaataaagactttaaaaatggtgctcattaaaaaaaattctttgaagaaaaacattactgggggacatgagaaagataaagacctcaaggtgttgaagatgctcctgtatccactcaagttcacggcttttgtgtgaaatgtttccaaagaacatgtcagcccaggtcccggtgcccttagcctgctgggagcgcgtctgcctctacaccccatgccctccccgtatcaggcacggttgccaatgagccagagtttgtcttcggggcccctcatccccctcgcccttcctgcttttcatgtccaaccatcgttctctcttctttcccgattccaggaaaggacccagtgttaatacattcattcacactgaggtataagggcctaagaagatgtatgcagacccacccacgaacagccacattttacctaagccaagctttgagcaggcagttaaaatacagaaacgggaacagagttggcaacctctccaactcttcccccaggctgcatttttatgcctcaaaatcagattctgcctgcgtgtctcagaaaaccttagaaatgtcttctccgaagcctcctcccgcggtcagtctctgtcatgtgctgcgttcggaagcctagaccgcgctctccccatcagccctcttagccagagccctgtgccacgtcaggttgctcagtgggcacagaaatgtctccaaggcaccttctaaacctgccaaggccgattcagaaacagaaggctgaagccaaatggagacgttgggggagctcttgtggagaacagagctggcctggacctgaaggcaatttattactaatgcagtgagaggctgcaaccaaacaagaccacatggacattggcacagaacacatggaaagttctgtcttcactcaagcctgtggcctgtcctagaacaaaggagcagaggttccttaaaaataaacgcagctgactctccagtgggagagacagtctctctttcatagttgcaaaaccagaaccggcgggtggggggctgggcccaggaatctgtatttttacaaggctccctgggagagcagatggtctcaactaaagtgatggcaaataaaaagccaaaataaggtggtttgtgttctcttttgtttgatgatgttgtggatatcaacaatgaggagtgtgatattcatctt

SEQ ID NO: 62403 - DNA, 1654 bp, Bovine  19866880987567
actggcaggggaagggaacgtctcaagtcacctcagatcccctgttcgatggaaaccgcggttcacatcacaaccccctgcagccttcttccttcttgcagcctcaactccaaaccagttgcaactgagtccattcaaaatgctgcagccaagagtctctttactgcctccctgctggactgagctgcagcgggtgcttctctggtacagcgctgggggcgttagcacctccaggtccttgaaggggcacgctggacgatcttgctgcccttgcatccatccagacccccccacttcccttagaaacctagtttgccctagcaccaccccgtgaccttgggacatttctcagagcctaccttctcgacgagaaccgagtcccaatgccaccccacctgcccatgtttcccatcatcagccactcaccccagatccatgccggcagtgttcgctcatcaactgaacaatgtgcgactctgagttcctagtgcctgtctccctgtcattcccacgtgctgccaaggagagtgctttcagccatccttgcgtgacctgcctccagttggcctttggtgcccccacagggcaacagggagaagcagttttgttatttcacaccccaaaagatgaaggatcacatctctcgtctttccccagtaggttaaatgtggagatgaccctgacatccagaaacagaatttttacccccaaatttggctttgcaggacagctgagatgctgaatggttcacaaaaacgcagcagaacctaagacagctggcatctgcacggtttccaatcggcacgtggaaactgtggcagtacaaaattgttctctgggcttcccaggcggcactggtggtaaagaacccacctaccaatgcaggagacataggagacacaggttcaatcgctggatcagaaggatcccctggaggaggacatggcaacccactccagtatcttgcctggagaatcccatggacacaggagcctggagggctgtgatccatgcggttgcaaacagacaggacaagcgacttagcatgcacgatttttctctaattgtttttcttttaacagaaacaataaataattatggaaaaattgaaaacatgaaaatgttataaaagaaaatcgaaccatctctaatcccactgaatggaaatgatgctattattttttagggtattacgtgcctgtatttttctactcaggcaatacattattgtatctaatttatatactatagtatggattgcttattaatataaacaacttcagttattttttgtgaatatactctgcctccttgagaatcctaaagaattacctttcaccatgtaaattcttaatacttggtgagttcatttgattttttgtgagttcatttgattaattggactactcccatagaaagtttatggcagattttgagatcaacagagttaagtactggtctgttttgtaccacctaacagtctatgacctgagcaagcttcttaaatctgtgcctcagtgtcctctgatttaaaatggcgataattgatggtgtctacttcagagagttactgtgatgatgagggtggaaggttctcagcccagagtctgcgtctggaggctctcggggaagggcagttcccttagcgtctctg

SEQ ID NO: 62404 - DNA, 712 bp, Bovine  19866881033105
cctatgaaaccttctgtagcccaaacggtgtaaagtgaagaagcaattacgttaggacacaccttgctagcagacgcacagaaaaggcacagacgctcacgcaattcaagggcgtggcagcctggcgctgaggcgccgggcgctgcttcccggggagagagctcgttgctgccagtctcaccgctgcagcctgccctcaactccagaacctgaagtctacgccaagggagaagctcagaacctctttttaaggttcatttgtgacgtctgccaacccgggagtctcaccccgcccctcctcctgacgtcacacacccggtcctgcccacactcatgttccagccacactctaaacacgcaacccctgcaacctggcgctgagttccatggtctttatgcatcccttcaaagaccagaatgaggagacaaatacctgctccaacaaagacctgctttcctgcgtctctgagccctcctcacctttggtttttgtctgtgttgtgtgtgcttcctgtagacaatccgtcccaggttgggagtgttcctgtcacaatcaaagtcttagatgtcaacgacaatgctccggagttccccagattctatgaagcttttgtctgtgagaacgccaaggcagggcaggtaagcagcctgagcactgtggttaacctcccaacacgtggaaacgagttacagataaccagattgcccatca

SEQ ID NO: 62405 - DNA, 1458 bp, Bovine  19866881136456
tctgcctgcaatgtgggaaacccaggttcaacctctggttcaggaagatcccctggagaagggaatggctaccactccagtgttccttcctggagaatcccatgacagaggctgcagtccacgcggtcacaaagagtcagacgtgactgaggactgacacgtcacttcccccaaagagcagagcagagcctcacagggccctgggcacccagcagagcagcgtgagctgagaagctcgggttcgtaacggttactgcagggaagaggagaaaggagctctcctgtcaaatgaataaaagttaaaacaaaaaattcaagaatggcaaagaaaaaaaaaaaaccctccacactgggagaataaagggggcattcacagagcctgggagggttggtgtgaggacgagtcacccaccctaatcgcgctgtttagggaacagacgttcccgctgctgcaggtagcgcacagctgcagacttgcttcacccctcatctcccagaagacaaagacacttgcaattaaagttttgaaatgcaaggttatttcttcattttcccttgggccatatgttttctaggagcagagataatacatgcattgtgagccgagtaagaaagagagatgagcagaaatcaatagacctttgatatgctcttgtctgagtaagatttttttttaatgagcttatctggaatcaaggtgatcaggggggaaaagatgctgatggggccataaaaccaactttcaagacagctcgtgaagtcgactgtattgtttggtagatcgaaatggtgactatgccaagacttctaaaaggccacaattactctacatttttacgggttttttttttttttttccagttaaatctgacctgagtcagatttttgtttctgtgtgcagtatctatttttaaaaaatctcatagcaaaatggttaagatagtaaattttgttatgagtattttatctcggttaaactttaaaattaaaaaagtcttatgacaaattatttcctccctgatgataaaaatagcacggagtgcttattatttcaagtgttatgtccactgggaacctgcagtctgtacctcagtcctgaagctgcaggtacatgttaactcgtgatgtggataaactatgtcaccagttgtgtggatttagacttcccgttaacctgacttgttccctcacttcatgcaggtctccactcaaaagtcaccttatcagtgaggctcccctcgtaattccatcaccttatcctgtttcatttttccatcgtgatcattccagccagattccattgcatgtttgcttcctgccattcttctcccaaggactgtaagcaaggactctctctggctaatatctaccatgtccacaaaacttaaaattgtctctggcacataggatgtgttcaatcagcatttggggagtaaagaatgcagtgtgtcccacttt

SEQ ID NO: 62406 - DNA, 547 bp, Bovine  19866881179599
cgtggggagcaggcggggcggggcggggcggggagaggggcgggtcacgcgccatttctcgcgagaccggggaccaggaaagacgcccgcagagccgggctgctggtgcagctgcggctgaagctgtggctgctgttgccgctgcagcctgcggacgattcgcctccaagcctgcgcctggtctccaggtgaggagacgggacgtggcaaggccggggctgcagaagcgagcggcgaccgctgaggctgagccgggactcaggccgcggcctgtcagagccagacagggaggcgcccacactcctgacagtgtaagatggcggcgatggcgcctggaggtggcggcggcggcgtgaaccctttcctcagcgattcggacgaggacgaggacgaggtctcggcgaccgacgagcggcgggcaggacttcggctgggtgccgggggcggcctagacccgggctctgcggactcgctgtcgccccaggaccccgtggccttggggagcagtgccagagcggggctccccggggaggctgcggcggcggcc

SEQ ID NO: 62407 - DNA, 1385 bp, Bovine  19866881220791
attatgtaaactatttttatgacctataacaatgtcgttcaagtattcataaaataacgatgtaactgctcatcctgaaaaatgcgcccccaaatcaatagcttttgaaaggaagttatagtgataagacatcaagaataagggcaaagagccacagtgaaacacggtgcagttaatatgggagacagcctctgtgaaatattagatgtaacaccgggaacaggaaaagcggctttcaagcaaaaatatgttacaacttgtaaatgtgctctgagaatgcatctgtcttgttttatacttattcccttgagaaaatcatccttgaattatgcaagtttgaattatacaaggtcttgtgagacgtagcttttgtatgaaataagacctccccacattttacaaccagaaataatccaacttaaaaaaagtgctgctggtacttaaataaacaagttccaggttgtcttattaatagaaaaactgcagctttagattatataatccatcaatttgagttgcttaaaagtgcttagtaaagcccatgtgcaaataggtgtaaaggaaatgtttttggtgataagaatcgggtagttaatatttccaaagcattttggtcagacatgtgaagagctaaattaatttccttgacatgtttagtagaatgcatagttattaatctaattcagcttcctattaatgcaaaactcactggaatgttacagtgtaatggtcagctgtcgagatgatttatgccatttattatttttaaaaggagggatgttttgcatttttttttatttccatgtgataacctcggcagaatgaaatctcatttctagtttccacagtgcaataaaaagaagtttggctcttcaagttcagctgtgtgatttgtgtgtgtggtttcagcttgtgctgtgacagccaatgaacggctgatttaataagttaggaacctccactacacgggaatggctgaagtgatgtttcctgagatcaataatattgcttggttttaccaaggaaataaatcattttgccacaaggttgccaaaaggtgagggttgttgtttttgaccaatgacacaaaactgagtggcctttggaaagactgagatctgagtctattagtcaaattcaacttcagttaaatctaatttaatggactactgcctaatagaatatttaaaaggaagtcatagttgaagcacactgagtttttcttttcccacaaatggctaatccactgactagagggcaatatttcaccagaactggcctgcatattctcctgaccaatgaatttctgatgcttttgctcaattcttcccctttaagtgtagaaaataaaaactttgggctatagacagagaccaagttgattt

SEQ ID NO: 62408 - DNA, 949 bp, Bovine  19866881263551
aaataaggatcctcagtcagagcagtcctcctggtggaagacgacagatggaaagggcccaacttgtgattacatggtttacttatgcaagtacagttaagctgcctgtgaaattcacatagctaaacaaaaattacaaccaagttacttattagctaccttgaacctgcctccctgagagatggcaggctggtcagagagccagtttccgagccagctggggtggtctgccttgctttgtattgtggtttttagagcaagtgggtcctgagcatgcggcgtgtggctgttcgcctggcgtcgcccagcgatgtctccagactgatcagatcagcagacccaccagtcccctgccaacactgttactgtcgagtcgctaagtcatgttcgactctttcggaaccccatagactgtggcccaccaggctcccctgtccatgggattctacaggcaagaacactgcagtgcattgccatgccctcccccaggggatcttccagacccagggatctaacctgggtctcctgtggctcctgcattgcaggccgattcttcacctctgtgacaccggggaagcgcaagaggaaggtgaccctgtagtaaaggagtcttggagacacaaatggtcaaaacacaggaaaacccaccagacagagcaggcagctcattttatccaaggagagagagacactcttagggtataagcatgtgagctgtatcttcagttcagttcagttcagtcgcttagtcgtgtccaactttttgcgaccccataaatcacagcacgccaggcctccctgtccatcaccaactcccggagttcactcagactcacgtccatcgagtcagtgatgccatccagccatctcatcctctgtcgtccccttctcctcctgcccataatccctcccagcatcagagtcttttccagtagtcaactcttcgcat

SEQ ID NO: 62409 - DNA, 1133 bp, Bovine  19866881298041
ccagaagaggggcatggagattttgtgttggggtgaaaagctgaaattttagtttggtggccgcgagggccccttgagaagatgcttttgaggagggatctgagcaaagatttcctgttatcagacagggtgcagaaagagggctgtaacctgcccccgagcccgccaccccactccctgggtggaggttgaaatactgggactgggttacaaggtcagtcagaccaataacactgatgcttagtcacctgaggctgaattaccactgctaaaatccaggcagggatgagttattcatctttgtacccacagcatcaagcacagatatccaataaatgtttattgagctgaacccttaaatctccgagaacatggggtggggctgagataactatggccctgtgattcccaggacagcctttctatcaggaagatacttccacagacaatgcgataatctttttttatcccttttcatgactgtcttcctgatcttcgagggcagagattctatttcagcttggtccctgagtgcctgacgctctaagaaggaggcagagatgaaatagcacagggaaacgaacagaccctcccgggtgctgacggccctaaagatcccagtccagcccattagtgagggtgaggtttttgtctaacatgtctgagttttacattttaaaaccgcatcttgaaactgaactatggtgatagctgtacacttgaaacaagcggattttatggtgcataatttatacctaacgttgttttaaaacgttgaagtaggagccaggttcagacagctttcgcgtgctgtaaataaccccaagaggcatgttgcaccaaacacatcatcatccttcctaattactgtttaaaccaagttgacttggatgaaatactagggaaaagtatatattggtctccacccctagttcctggcacagagctcccaagtgatacgaacaccgggagcatcttgtggtctaacatttggtctctggcactggttcctgacatcacggtgatagaagtgtcttttgttctggtgaggtgaccctgggtgggctcctggatgaggactggtcaccagaaagaccaagacacggtcagaagctggaattttcagccctact

SEQ ID NO: 62410 - DNA, 1198 bp, Bovine  19866881320879
ttttttcttccttagtgtctgatatcaaatggcagatttgaactgtcctatgaagagttaaaacagtgcccatctctgcttgtatcctttatttctctccagcattaaacatctaaccatggaaaaaagggggaaaaaatgtgtaccatccactaagtggtgttaatttgcaagaagtttacactgctttttctgtctaaatctggtgctcagccatataaaacatccgcagagcgctgccagcaagcgggccagatcgtgttcgcctgaggagcagccagactgagttttgaggctgtgctgtttcctgtataattacttctacatgaatggcctcctggttcctggtccaaacagcactttctcgttattgctttttctttctcctggctgtgccgggtcttagctgtgcaatgcgggatctttagctgtgtcattagttggtgcccctccattgagatcgtggagtcttagccactaaaccaccagggaagttcctcgttagtgctgtgctgtgcttagtcatcagtcagtcgtgtccgactctttgtggccccaaggacggtagctcaccaggctcctctgtccatggggattctccaggcaaaaacactggtatgggttgccatgccctcctcccggggatcttcccaacccagggatcaaacccaggtctcccacattgcaggcgggttctttactgtctgagccaccagggaagcccattattactttaaaaaaaaaaaaaaaagaaagttcacttgcctgttccaggccgtagttgtggcttgtgggatctagctccctaaccatggatcaaacccgggcccccaccctgggagcaaggcgtcttagccgttggaccaccagggagtgcttctttactgctttttaaaaattgtcatgctttatgttctataaaaatgtgtgaaagaggatggtgcttgggtaaaagttatgagtgagcttaatcctgaaaggcaccatcttcttaggacttgagggaggtgacctttttattggcttttggatttatatgtgtgagtatttaaaatgaaaaaaaaaaaatcttgcaaccaaatcaagggggtttgtgcagaaatgacaggcctggacacttcctcagtaggaaaagcaccttcttggcacccaacttttgcagacgacgatagctcttcaaacagctccataagcatat

SEQ ID NO: 62411 - DNA, 1020 bp, Bovine  19866881560603
ctgtgaaaacatgacccgcctttatctcttgaacattttcatgccttttgagtgagattttttttttctgctcttcttgctttttctgaaacaaaaacctgcctctcgtttcctgaccgtctccactttgctctcttcaagactgagtgactttaggtgtgtctaatgcgactggatttatttgagaagctcaagcactgatttgtttattccatttacttcgacagcatgcccattaccccgggattctgagcacatataaatgatctgctcggggttggcaaacaagagctggtgatggatggagagcgagcagacagtctaaaagcattcgtcaaaagggctcttccgtcccagaaatgcttggttaagcaggttagtcttgcagtttgcttggatcctgacattttaggttcgagccgcttgctttttatttgacatacaccaggaagaatccctgggtgaggagggcatcagaaacaggccctcgaagggccaaggcggggacccagaggtgacgtgtgcccctgaccactcgacaaaaccctggccgctgtctacgtatgttatgattcacaaagggaaaggctctgggaggtggatgaatcggtttgccttggcaggtctctagtatgtcaacctgcttcaaggaggaaaaaaagaaagacgctggtctccacgaagaggggatcagaaacgaacaaaccagagaggaacccagcttgaagatccaccaggggttcccactcaggagaaaggcgctgacatcagagccagcgaagaggaacaaggatgccggccctggtcctcctttcaagtccctcctcgactcgggaggcagctcgccgtccttgtcactccttggcttgtcggccctggagcaggcctcgccctctctccgcacctctgttttcctgtctgtaaagggaaggaagttgccctgcagtgaagagtcttcccggcgtgaagccctgggaggccgcaggggaggaccggggtaagaatggccaagccagtcag

SEQ ID NO: 62412 - DNA, 1195 bp, Bovine  19866881790201
caattttctttccaggcatacaacacagccaatttactcattttggctgggaaagaatcctatttacctaagaatgagcacgtttcaatctcatgaggactaagtttcactgtattaagatgcaaccaaaacacagatttctgtctcacacacagagaaaaccagttgaaggtcttctcccaaaaagcctgagagtttcaccagtcagctttatcatttgaaatcaaaccccttacaggcaaacaaattaatcttccagcattcatcttcccagtttgcagtgtttggaggatgttttaattagctcagctgcttatcccttcaagtgtctgaaagtatctgttagcttcctacaggtttcagtaatggccccttccctagagatggctgggaagtgtgtgtgtgtgtgtgtgcgtgcattgtgagtccaactctttgtgaccccatggactctgctggagtgggttgccattcccttctccaaggaaggctgtatttggtttcaaagttctgtggctttctgagactagcattccgtctattatttccaacactaaccactgaatgctgaaagttttagctaattctgcacaccgcaatccacagtaaacctgaaaccagtgaaatcaactgaaaagtaccctgtggtcattcctgtccctggaacaggttacaaaggtagaaagttgacggtccacactgggttccagaaatggtctctaaacgtctcagcatttcccctacaggtcccttctaaaaatgcaaataacctgaaggattatgaagatttgtttcccatagcagcattgatcagggcacagaagtgatggaaatttttgtacagccaggaagaaagggctctgatggtgcctgggtcatgtaagttcagaatatggagcagggagaatccaaggagagcagcagcaagacccctcgatctctgatcagacacaacattgtggtccccactgtagaaacaataagacaaccaagcccttagaagggagagcagtaccccactgaacagcaagagagccctagatgtttgagaagcttcatgaagagaggacagagcaaacagggcagcggggtcagttctgcctggaaccgtctctgctctgtgacgtgtgggccacctgtgaaggtgacactctgcgtctcccccagttgtgaccctgaagaccgaggacgtgaa

SEQ ID NO: 62413 - DNA, 2944 bp, Bovine  19866881997715
gacggggaggcactttctaagcccgcgggctgctccgatgccgctcggacacgagcccattactgaggggggctggggctccccggcgtctgagtcacctgcgtgccccgttcagaagccgtctcgagctcactccacctcgcagagcaggacagggtaggcatttgctcaaattcccacttgagtacttctgataaaaccaactgtttcaaataaaactggaagggcttttgtatttcgcactggtaccatctaagttctgggtttcaggcttagttgacttaagtgaaatcagcaacagagcaggagagggctgtctgggtgctgatccaaaccctaagctgcttccaaagcgctgcatgactctcagagactgcgttcccaggggctccatgacacagtcatcagagacgctccatcacagctcccagttctggaaagctgagctgcatccctgtccagcgggagcatatgccaccctctgaaacgcacttgaagctgtggcctcaatgagcatcaagctgtctgctggggaagaaggcaatgttatgggttgaactgtgtctccaaaaaagatgtccaacgcccgggagctcagaatgcagctggagtggggaacagggctgctgcctgtgtcatcagctaagatgaggtcacagtgcattagggggacccctaatctaatagcaccaatgtgtttaagagaagaaacacgaggaaagaaggcggtgtaacgacaggaagaagagatcagtgatgtatctatgagccaaggttgctggcaatagcagacgctgaagaggcaaggaaagatccttctttacaggtttcagatgaagcgtggccctgcccacaccttcaacctggactcccagcccccagaaatgcgagacaagattctcttgtgtgaagccacccagcgtgtatgacttcgttacaacagccctgggaaaggagagcacagggtaaccgaacaactgggggatcacaaagacctcttgactgagaagcagcaccaaggaggaaggaggaaatacagacggtctccagctgaggatggttcgatttaggattttttgactttacaacggagtgaaagcaatgcgcacttgggagaaaccaaactttggattttggatttgctctttccccaagcgagcaattcccggtccgctctcctggtgccaggcagtgacgctgagcacggctgcacgtcagccacgtgaccaagggcaagcagtcactctatacccagacagccattctgcttttcactctcagtacagcattcaataaatcatatgagacagtcaaaactttattacaaaataggttttgtgtggggctcccctggtggctcagatggtaaagagtctgccatccatgcaggagacccaggttccatccctgggtcagggagatgctctggagaagggagaggctctgtgtgaaacggttttgcccaacggtgggctcgtggaagtgttctgagcatgtctaaggtgggcgaggctgagctacagtgttcagcaggttgggtgtattcaaaccactttttactatgatatttctgacgtatgatgggttgattgggatataacctggctgtacgtgtttgtgaccaggaacgcctttcatagtgtggccgcctacctggctgaactggagggagacagacaaggcccagcatccctggaaggagcctttcttcccctaagaacctagactatctaactcaggccccgaggaggggaaggagcagggcaggcgtgggagcaacagaaatgaaaggtttcattcctccccagttaagccaaaaccctgcctcctgcatcccggcccagtcccttccctgctcacatgcttacagaaggaccctaatgggtgttttcagagccatgatctggtgtaatcttcatacgacagggaaggagggaaagtattatcactcccattttatatgcaaggaaactgaggctcacacaagatcacaaatgcaatgaccaccctgcaaagagggtcagttaacaaagcaaaaggcatgggagtgggcatggggagtgggggtaggaaaaaagctctaaatttcatcttaaaaaaaaaaaaaaagacggggtcaaacgaaagttcccaagggaatcagatctgttggccttggaaagcggaccttcatctgtttcagtcgttccgacagcgctgctgcggacacgatccgctgattctttgaccagattggtcaagggtctctgaggagaaagcccaagcatgtaagaaccctggccttctgtctcattcggggcttcgctgtcttcagaagcgtctgcgcaagcagagggcccttccccaaccatcaccctgagcaagccaggcctcagggagtgagaggccgggggaccacagacccgcgtccaacagcctgtgatgactgacgggccggccccttccccgaagtatcaccctgcacaagccaggcctcagggagtgagaggccgggggaccacagacccatgtccaataacccgtgatgactggacgggccgaccccttccccaaagcatcacggaacaagagcagagacggcagggatgcagcgggctggcaggcaccccaggaaacgacagggctgagagggttatgccacaaagcactgggcagaagagctgggtggagagctctgactccaatcagcggactcttccatgtagtataatcctccccctctggaaaacacccatcactggtcaccgagaaaacgtgcctttcccaccctcaaacccatggccaagatgtcaggcacagagacctcaggagtcaccactcaccaccccaagaaatttcctctgcgaagtgccctcactccccatcttgtcagcttgaaaatattaaacaccactgaaggaaatttaaggtttctttttcagatttaaatgtctactatttcaaa

SEQ ID NO: 62414 - DNA, 1270 bp, Bovine  19866880379333
tctttattatgttcgtgccagtttttgcatgatcatgaaaagaagtatttttagaaaatgtatcctcagctggcatagtagatagagcctatattcactactggggctgtttttttttttcccccactaatattctttacatcaagaaaggcacatacagtataggtttaacaggagaaaccaattcatcactatgactttaggccaatatccctttcaaggctgttctgattgcttccagaaataagactgtgttcataaaaatgctggttgtgtgtgtatgaggtatgtatcactgggcaagaggtacagaggtttgttgttgctgttgttttaaatttcctatctcctgtctccattttataaacaggtcttaaatgaagcacttttaatggcagtcacaatttctttaaagaatgaaaattctgtccataaggaaaaaaaaatctgtttcttcacctcagttcgttagctttatcttgttttaagaaggccagagtgatttttatgccatgtaaaagtagcacactttgagcaaattgaaaaattaatttttacatgaaaggtaaattagagatatctactttatctactaaaggattcttaataggattctttaaaataccaaagcttctgtagcaaatagaaagcaaccaatatttactgagcactcactaatgtgccaggcatgccatctggccatttcagattcatcatcttgttgaatccttcctgacctgtggcatgtataggataattcccactgaacagatgcccagtactgcagcgacagacccccaggatcccagcaagagtgagtgccagcggagggtttctaactgatgatctgattctaaagccatactctctccaatggatcattcatacttctaatacattttaaaatataaacttattgtcaaaactgtcgttaattttcattttctcttataagttgaggtgtcacaatgaactcttaaaagaaaaacaagaactcagtcttttaggaatttaactgaagagatcttgtggaagtctttgcctttcaaagatgacagggcattaacaaagcatctcttgggcatgaaaagggaaaaaataacatcctttgctctctttttaagttttttgaaccagccaagaaaattacccagcaatataaccgatctgtggtccagtctctaatggcctaattatgcttatcttaccacaagggtgtagcagagataacaaacctaataataacaaagacagtggtaacagaaacaca

SEQ ID NO: 62415 - DNA, 3012 bp, Bovine  19866880399610
tctcatcctctgtcgtcccctcttcctcctgcccccaatccctcccagcatcagagtcttttccaatgagtcaactcttcgcatgaggtggccaaagtactggagtttcagctttaacatcattccttccaaagaacacccagggctgaactcctttagaatggattggttggatctccttgcagtccaagggactctcaagagtcttctccaataccacagttcaaaagcatcaattcttcagcactcagctttcttcacagtccaactctcacatccatacacgaccactggaaaaaccatagccttgactagacggacctttgttggtgagatgtaattgtatctcctaagaaatggacaccttgcagactcagtgtgcatatttcccatgattgtgttaagagctctgaactaggttaatcttctctcttgacccatctataccccatttttctttctctccagaaaaagaagctattcgaatcagttgaaagcaatgagattaatgacagaaagaaaaagatcttaaaatctagtttttagctttgaagagagattggttactactgtctagcaatgggcaggttaacccactctcttggggccagagatggaagaactgatcagaaggcagcagaccaaattcctagagggtttagtgtttgaaagagatttctctctgtagacataaagatgaggaccagccactctcatggttaagagagaggaagtgagaagggtggcagagatgatttaaacaacactaggaaaaagagacctgtttgaatccagagttcatgccagcatccgctgctagtttaaaattgaccaaagatttgtttcaataatctctccaaccattcttacttgtgcttctcattcttcttagacttgatatcatatatatttaaattttcatttaaaagcttccagtaacctttggcaccaggattcctgacttggaggtagcccatgtctgatcattgggctataggaggctgtggggatttaatgcaatcctctcctgctacagttctggttattggtggttcaaaagtagttccccatttaaaatcttgaaacaatccattcataattttctgatgttaatgagttgatttccgggccctttttgaaaaaggatttctaggtagaagaaataagcaaactcttattcatggaatatcaaacccaaacaaagggtatctcagggactgtctcggaacacttgatagaaattgaattctgtatcttccaggctaatgtgctgtggtcctttaggtgggataggaaggctcacctggtgacttccctgatgatagagttatcctgcatcagccctagttttccagtgttccttgttagtttacttgctagaggggtgaggcaaggctgggttaaaatgtagagttgagaatttactgttgcccaggaagattagctttccaagcactgattcttgagaaagaggtttcttaacaatgttgcctggacactagaaggattccccccacccctaccctcaacatgtatataatttgtagtttctccaaagcaccttgtgttcataatgaggaagaatgactcacaagatgagtaaattcagagccccaagagcaatgaggtttagtggtgaatatactaaccatggggaatcaggaaaccaagtggggtcctggtttggctgctgactgctaaagttactcaccatctctgagcttgtgtcctctaaaaaataaaaagagctcctatatgtcaaacatatcgtatgttttaggaaaatattattattatattgtgcatcatttcatttaatcctcaaatttctgctatggggtatgactctgcgctctgttgtttcggtcatgcccaactctttgtaaccctatggactatagcctgataggctcctctcttcatgggattctccaggcaagaacactggagtgggttgccatgccctcctccaggggatcttcctgacccagggattgaacttgcatctcttgagtctcctgcatctgcaggtggattctttaccactagtgccgtggggtgtgactttaatcacctctatttttgcagatgaggaaattgaggcacatagaggttaaataatttgcccaagttcatagccagtaatgacagcttggactcaaatactggtgcgcagactgcctgcagtctctcccattattgctaacactccaccacctcctaaagtgaagagaaaggccgagagaatgctgagggtccttttagtcctgctagtgtagggcagagggctctgtttctggagtgagaagatccagcattcagccccacctcgttccttctgactactgggaatctttcggggaatacatctccactaccaggtcacaggtagcatttcaggacttggcttatctcctatgccccacaaaaatacatatcagggccattcttttctgagcacatgggttaagccaaagctcaacgtagtggggccttggagaaatgaagcatggggaatgttggccacagagagaagtatttcagcaagaagctgcaagctcccagctcgctggcttggtagggaccccagtaaatcaggataagccatggaggctggcactggatctcagcggcagaatgtggtcaggggctgcggacccctcaaaacaacagcagcagcagcagcaacaaaccaagttcaagctaagaaagcagactgtgtgtgcagaagggggctgaaagcatgagggaatgagggggaggaaggaacagacaggaccaaagggacctggaacaaaaggggagagaggattctagtcacatctcccagagactgggaaagggctccagtgtgccctgaaatggaaggagagggaaagaagtaagcagctcacagtaagctagaggaggaagtgggagatgcgctgcttcctgtataaagaccgatgattgaagacaaagctgggtggggactagtccctgggctgcaggcgctgctgctacacatacaca

SEQ ID NO: 62416 - DNA, 971 bp, Bovine  19866880400331
ctgtatttatggtaccaataattctgcaagtataaacaatgatgtgggcaaaattgtgcaagtttgcatggtttttctttgttagtgattttaaagccaagagaacatatttttcccatttcttatgatttttcttcttagatatgaagtactacagctaaactgactctgtaccttctagtattagcttgttcagcctagtaacgtcacagatggtcaaaagagtatcagtgtgagaatttcctggtggaaatcagccagtttcaagggcctattttcggttctcggcctttcatcattttcggggtgagggtcgtgttatacttgaatccttccaacaaatgttgcattgcgctccccttgtatcccaacaggttgtttccaagagagggaaggactacatcctgaagcacacttccaaacatgcacaaagatcagtttgcactgacagcttctgaggctcatcttaaatatatcaaagaggctgtccgactggatgacgtcgctgttcactactacagattgtataaggtacaaaactgcagtacgtctgcagctgtatcttcttgatcaggagaagttttttttttttttaagttttggttgtttttaaaatgggtttttaaaagaatttttatttgaactgctgtttgtcgtcataagtcagtcttggagtcagtgatgtttttctttgggcctggaagcaggagtgagtctttttcatggttctgatattgagatgacaagtggctgtaaattgtgcttttgatttttcagtgattatgaaatagttattctcctccttcccaaatctgcatttctgccttggggagtaatgtttactacttctttgatcagtaattatttaataagtgaagccacacctgcactgtatccattagtaataagagcaccaccacagcagctaatgtttattgagttttgtatttatgggaacacttcatatctat

SEQ ID NO: 62417 - DNA, 965 bp, Bovine  19866880742342
ggatttcccaggcaagaatactgtagtgggcagcatttccttctccaggggatcctcccaacccagggatcgaatccaggtctcctgtattgcaagcggattccttattgtctgagccatcagggaagacctgttgtaattattgcaactatcataaatgttagtctaatttttattgacttaaaaatcatatcaatagttgatgaagggtaacaaaagtaaccattcaaaaaatcagaatctctaacaaggatcagcactggagtcaccgtgtttctgtgtcaaagaccatttttggtcagtcatatactggaacatgaaactttggcctacatatctgcctactacacccacccccccaacattagtccaaagttcattctagagtcagatataaaccttctgttgttatcctaacataggaatctgctgctgctgctgctgctaagtcgcttcagtcatgtccgactctgtgagaccccatagacggcagtccactaggctcctctgtccctgggattctccaggcaagaatacaggagtgggttgccatttccttctccaatgcatgaaagtgaaaagtgaaagtgaagtcgctcagtcgtgcccgactcttagcgaccccatggactgcagcccaccaggctcctccatccatgggattttccaggcaagaatactggagtgggttgccattaccttctccgacatagtaatctacttctgcctataatttctatgacttgtttagaagggaagagatgggatatttttaaaagttaagatctaaaatccactattttgctttgctcttcatgatttttctctaaataaacttaaatgcggtgagtgaagcagagtgttagaagcaaacataaggtcaaactgaggatttcagaagatttggaagacagcaaaataacccagtataacttatcatggccaacggcagatctaagagctca

SEQ ID NO: 62418 - DNA, 1800 bp, Bovine  19866880757900
aaatttgctaatgagactctacaataggaaattccagtgacaattctcgactagatcctgcttctctttttctcaggactgttgtgttatctacatgtctgctaatgccatgatctgattatcaattattctttctctttaagaaaaactgtactagcatgctgtgatgacaaagggccagcggaggctgatgggtcgtttggctcatgccaaagcagactgttgacaaagacagaatgaatagtgcatgaagctctccgtctcccacatctgccatctcttggagcatttaacaatgagatttgagatccacatgaattctatagtaagcacacatatgtttttcagttttcctcaatggaatcagtatatcttttccccaaacttgaatgctacagcaattatttgaaacagaaaaacaataaaaaagatgcacccaaatgctgatacaggctatagatctcatcttatctccttaacccagggtgaagcagccaatgctgtgttgctctcttctctattacgacatcaatcctatggaaccaacactggggaagcactgggaaagaaaaagcagaaggggccctgacgatgggtcagcaccgttagcttggagggcctggggggcaggttaccatcatcctgtgaatcctcctccagccggtccttgccgccactctccaccccggaggtgtgggagctgccgtggctggtcatggagctgcaggttttcagcttgcggtggatggcactgccagggtaggcgtcctcagggcccgcatcccgggccttggtgtcggcctcgatgcccgaggtgtgggagctgctgtggctggcggtcgagtgacgggacaggcgcttgtgcttcatgctgccggcgctgctcccgctggcccgtgaccgcttctccagctggtccatgtcgaggtccaggttgtcgctgatgtaagactcccggtactgcttcttctctgtgtggtgaggaacacagctcatcattacagtcaaccaaggcaggaggaatggctggttagcccagggcaggcatcaggccacgaacgagtacaatttcacattcagaagtgagtgactggaaagtgctgataattctgataggaactctatgtaagaagactgcaaaatgaataaaacccagtacaatagatctgaggcaggtatttgactacttgaagacttttaaagtttcaaacactgcagaagaatgctactcaatgtggatgaaaagaccacttcttgtctgaaaactgttatttgtccacaatggaataagtttaggaattgagaataaacatttagaaactttcagagcgatctgatattgccaggacatccactaatgagactttgaactttgcaaaagtatcagtgcatggtggattagaagttttgaaaaatctggttcttccccacagataatttctgaaactctgctacagaaatggtttcataagtacacttatactaactgcctttcatttgatttgttcatctgttcagtttggtccattgttaacttagctctaactgttgaagacaatttaaaataaaactatttttctgagaatttctttcaaaaaattccagaactgagattttcacagattaagattgcttttctccatttaggctgaactaatgagacttcacgatctattaagaaaacatagtaatcactctggtttgatgatttatacccacttagcctctgactgataaaactgttatttaacaagttggtacagatctttaatgcagacaaagacacaatacggaaagtcc

SEQ ID NO: 62419 - DNA, 1537 bp, Bovine  19866880810996
ccagatgggcagcaggatttgcgctctgtttacatgcgtttagattgttccatcaaaatgtgagttctgctttcttttgttttcctagtgacagagcagcaagatactattactactggcacctgagaaaacaagttctgcattcgcagtgtgtgctccgagaggaggcctacttcctgctggcagcctttgcgctgcaggctgatcttgggaacttcaaaaaggaataagcactatggaaagtactttgagcccgaggcttacttcccatcttgggtaggcactgttttcagatctaaagcgtttgctctagcacatttctagttcattgttctagttcaatagagacatatcaacccctaaaatgtctaccctctatgttagacacattgcgaggcgcaatggtaatgacaaagaaactagtagcaaccagaaatagtcaagctactcatgcagcttcaagaactgggaagccaggtgtttaatggcccacacaccctccatgacacccgggtacacatttcacacttgagagcgtggcacacacagtctctccaccaactcgacctgtacgtgggtaatgaggaagaggatggctgtccatcctgcagatgctggaactgggaatttgtcagccttcttttgagatttactcagctttgactttcttatttactcttaattcaagcagcatatttccccttcaggaggagaaaaacactgttctttaaaaagcgacatcattcacaacttttcctgtgctgagaaaacaaatataagtgaactgcttgtgccttccaccatctccttcactatcaaaggaggagccacccccttccttcagcaagaaaatataggttatttgagcactgactgtctcagccatgttttcctccaccatactctgctgatatcacttcccgttcttcctccaggtctctgctgaggcatctctcctgtatcttcagcctctacttgaactaactcggttcacaccttcctatcttcagaggaggaaggagggagggaaagaagagctacctatctctccttcccttctcagtaaagcttcttgaaaaagtgatgtgaatttgatgttttaacatctttacttcgacatgtactcctcaaccgacatctatctgccttctttcctcaccagcccctccactatggcgttgtccttagggccagcagtgacctttaagttgccaaatccagtggacacttttcacatcttttcctgggtttctctgctgtgattgacacttagtcactcctatcccaggagacctcctccaaattgatgctttttacaaccacatatgtgctggcacctcccgaatccatttctctcccttatgtctgtaagacagatgtttacccataggcacctcaaactcacagtgccccagatcaaatttatctgcttcccacctcagttctgggtgttcctacctctgggttcataacctcagccagtggccctggtcacctaaaaacttaagagtcattcaggctcttccttaacactctt

SEQ ID NO: 62420 - DNA, 2734 bp, Bovine  19866880876898
atgacagaggagggaaatcagaaagtgtaaaatcctggaaatcgaagaaaatgcttcaagaagaagggagtgatcactttggaactacctatccatccaacaagatgaacattgggaagtgaccactgaattttgtagtggatggctagtggttctgatgagagcagagttgttgaaatagtggaggggaatatcccgataggagtggatttaaggcagaatgcaaggagagattggagatgtgaagatagacaactctttccagggatcttactataaaagggaggagaggaatgagtcagtggctagaaggtgaagtgggatcaaggtgggggttgtttttaagatggtaggaaacaggagtcacgcaaacatgagtctgcagtatgtgatgaactgggtttaactaggatggcggttacccatttgaatacactgaaagtaagagaggtaaggaggatgagagtgtgaaggagtgataataatgatgagctatggaatctgagctagataagaacagggagggttggagggttagagaaaaattggtaggatcaacagcttgtaggtatattggagagctgctggaattaaatcattcttggatggggggagatatgctgaaaggtcagtagaggatgatcaagtcagaaaggagaaagggtcattgttgatagtaatgaccatcccaggaaatacccgtgggggtggacagcggaagcaggagagaccaaggccactgcagggctgacaggctgggtgggcaggacacagctctacagccagtatgtaccttgctgctttactgaagtattcagagctggtgtctattctgactcatcagttagtgcctttgccctatgagttgttaaatattttgaggatgagtcctgagtccaagaattgaaaacctcaccactgtgaatgtgatatttgcaagcattggactgggatatttggagagcacaatggtgggctacaagtcatcaggaagggaggatctgtaatgactgcctgctgagggtagaaggagaaggctgaacctccaaactgtcccttgcctgagcccccgaggatactcctaaagggtgggtgcagcactacagggtgagaaaaaaccaaggcaaaagatttctcgaggaagacaaaaggccctcaaaccgagtacaatccagaacaaattaagccagcttcacaattttgccttggcagcccaaccaattgaacccggtctgtaaacgaagctgcatcttgtggctcttaggatgcctgattcatacctggctataattcattccagaagccccagtgtggctgtgagtcagacagaaatcatcagccaaactacttagtccagcaaaaaggacctgttttcctctgcttttgttaatgtttccttgattgattccttcctccttttctcctccagcctcacttatcagtcagagccaggataagtactatctgagagatttcaaggttctcctggtcctgctttcctttacgataacaactgggccctggaaccaagatctagagcttgcgggggtaaagaggggggagaggggtagctgtgcaggtgaaagagctcatggaagaccaggccccccgactccccatccatcttgaggcagattcccaagacatgcggcctctccacctcacacaaagcagccttgctggagactgtggctttcaccacacggtgactcagctctctgaaggatgggaaaagactgtctgggaccgtcaaccacacaggcaccaaataactcatgttggaggagaccagtcatttctcccaaggccttttataccactgacccatagccactggcccaaaggcaagtagtacctgcctcctccccattcttccatacccaaacatcaagcctgtgtcattctctatcttccgcagctttatgcttccttctgttcctccacagtcagtccctctctccaaacccttcacccatttccagcatgccctctggagccaccatttcagacaatgagtgtttcaatattttcttctctatagttttcttatcaactgaagcctaccttctcccaaaggtgtgcgttttctgacttccatctctggtggaggctgccgtttctcccacacgccctgagacaggaggcaggggttggggccaggattcacccgactccctggtgctgcacaaactgcatcaaagcttatgccacttgaggttaccattttctgtctcctacaatcactgaagacctagatgtgtgttgtagtcatcttctcaccatgccaaatcctgacctaatcctgagacgtttaaacctatccgtggatgaccatccaatacactagtggttagttccttgacattttcaagtctcaaagctgagctagttatggtctgaaaatctttagcaacaaaggataccagaccttcaagttctctcactacatctgctcttcaagagatggccaagcctaagattcctttctttcatcctaattcagtgctagttaagctttaacaagcatcagaatcacctggaagacttgtgcagccacagattgctgaactccaatcccagaatttctgattcagtgggtagggggtagggctcaggaatttgcatctctaataagtaccagggagatgttgacactgctgatgtgtggtccacactttaagaaccagcgtcttaatgtattgggacacattgggaaccagtattcccaaattat

SEQ ID NO: 62421 - DNA, 3094 bp, Bovine  19866880926373
actgatatgaagagaaaacaagagcaagaggctttctgggtggagacggctttcatgtggtttctacaaagcctgtctggcaccttggcccatggctgcagactttccatcctttgctgagctcagcatttattgatcacctttttctatgccaggggatgctcaggatgcagttgtgagcaagaaagacatggtttccaccctcaagaaatttacaacaaggtgcagtttttaaagataaagttcagctggccctctatttctacatttgccgtttatcttcttcatcacaagatacatattttagattgtggactagggtggctttgatggggagagcttaacgaccacaaacactaggacccagtggtaaaaccttcaagagcctgaatactgcacgtgggggctctgaaaaaaaaaaaatccccaccattccctacccaactgtggctcttggctctcagcgttctcctcgtatcatcccgaactgtgagatctgggtgagaagagacggttccagagacagagctcacatcttctggaactgaatctggtccatacacgcatcatcatctttggtgccccctcctggtgccgagcagaaacacagcccccgacggccccctgcccgcacttctcagaccttgggggttgtcacagggaaagaaatatttgtttctgaatctctcagtcgcctttcagaggttctcactgaagatgaatgatgggaataaagttggaaacagtctaaaggagagttttgctcctgcgcatcccaggaagcagctgcttctcctacagcacaaattcatacctgacagatgctgtgaaaacccctgcaaaaagctgacatcccctcctgggtttcagagatttcctttcgcatctgaactgctcgtaagaaagaaaggagaggaacggctcaaatatagtgaggactgccttggcctcatgggcagggctggtctggaaggagcttgcactagggctcccatggctggtgaggggggatgaacgtgggcatccgcatcctgggctctaccgttggaggttctgatcaggtgtggtgtgaggcctgggaatacatgaatccttccacaaggcttccgtgagtctttctgaaagtcactcaggcttgtgaacccttgaattaggggacagactgaccaatagtcccctagttagctctccttccatcctgacagcctccgtgtctcctggctccctcaggttcagtctccctccgccccactctcggtctttagcccccaggggctgaaacctgagtcagcaccaggccaggtggagcaattgactcgggcctgttcaatgaaggcgtttagttaccagacacccatctgctggctgtcctcaccaaggaaacgggggccagatcactttcactgggcatcggccccacacttgccaggtggagtgtgggaggaagggagatccaccccgccttctggtgccttcactgcaaacaattcccatgtgactccctccagctccagaatagcctgcgagcgttgtcaagaaaagcccacgtccacagaacaacaacctcgctctccctctcccattctgcattctgggctcggcacccattactctcttcaaatttacaacccagtcctcaaaatgaagagtcctgtactctttagggtctctaggaacccagggttctacactggtgactgaaattagttttatcttctttaaaagaattttaaaaaaatttaagtaatatacatttacataatttgacagtagaatgtactatttaaagcttctaaaaaaaaaaaaaaaacacttttctttccctccataaatgctaaattaacactttcaattcttaaggtggtttaagaagaaaagtgtttaccttccatatttccacataaccatcctttataatatgtgtatactgcttttccaatcaggaatattctctgtcaacttccttatcatggaagatgaggagaaagtgcttttacattgactctgtcccaccactgtctcctccctatagtgacatcatagtttttgttaaatcaatattatacaatgtttatttttatgcctatgcaagtgttgttgggccaactgtaaaatattatgatacgtttttctttcattgtttttcttggagttaattttcttttttgtctgctcagttgttctgtatgtagagcaacaaactttcccatattcctcacagaactataaagcccctctcaatgtcctgttctctctgaggaggtgacatttgaactgagtcctgaataatgagggggacccagctgtgggaagatctgaggaagtgtgtgctaggcaggtgaaactgcaagagccaaggccttgagatgggcgagagcctggcttctttgaacaaaacaaacggagtgtgagtggctggagcatggtgagtaagggtggagtggtatatatgagatgcaactacagagacggtgcagcagagccttctgccacggtgttttatcttccagtttttgactgggcatgtggctgcccaggataaagatgacattttctagtttttcttataggtagatatagtcatatgactaaattctgacccatggcataaaaatgcaagtgtcgtatagatcttcaaagaatcttcttaataaacagtaggcatggaccccttgtcctttgtaattcttcttccaactctgctgtttgaatgtacataaagactggttctctggctgcttttttaggtcactggggtcaggtcctggggatggcagagtgtggcctggaaggagtttgtgccttgaggacctcatggttttattgtgtttttttttttgtttttctttgctggtcattccttgtggcatgcgggcacttcgttgcagagaataggcttctctagttgtggtgtgtgggtatagttgctctgctgcatgtgggatcttaggtccttaaccagggaacctgcatccccggtattggaaggcagattcttcaccactgaaccaccagggaagtccctctgagggaagtccctctgaggggttcttgaagctaactccagtaccagtctgttggtcttccttcagac

SEQ ID NO: 62422 - DNA, 2275 bp, Bovine  19866880981380
tatggcaggggaaaaaaaccacacacacaattaaaatttcagtgtcggctgactctaaacactctgaacaaaagcagtatgtctttttatattctgtatggccagaagtagtggaaatagtcccattttacaggctaggagttgcttcatctttttcctaaaccttctaccatcatagttactgatctgctgttactcattcatgttgtgcttcaagctggaatttaacaactaaggaaatgttttgggctatgcaaaaataggtatctcttgttcaacgtctttttaaaagagagcagggggtttctggactcccctgtgcctatgacccaaggtttcattttctcactcttttatggaacacagagagaagtaaggcagattgtctccacatcccccacacaaagcagggtgttggcattacctagtgaatccagactgtagatgagtaagtaccagaggatgagtcccattttcattcatatagcccagactcccaactttccatttcatgacaggcagcttgagcatatagctccagttaggggcattctggatccaagatccacccaagactcttctttgggtagatgatctttacatattttactctaggagacatacaggaactggagccatggaatacgtggcatgacttgttttgcccacaggtttgattaaattcaacagatctgtcagaggagctccatggttcaacaccaggaatactttgcctgttagtcatcataaataagctcataaaattagacattttattccttaaggacccaaaaattcttatttctgaaatgtgctgttaccccacatattttgagaagccaaatcaatttcataaagatgacattaaaagaaacttcacaattgagaataatgataaaaaaggaaacatatatactctccatggcatatttagtatttaaaacccacatttaaaacatttatgagtgtctaaatatgacctttttattatttttactccactataagcagttctttctttcctttgaaaatgtatctcctttcattctaaaaatacaagacaaaacgtttttatcaatgatcatttattgcttaaccgtactacttattggagacaaaggttaattttaaaaatcaggctatgttgggatattaaactcttcctcctacatactctgtgaaaagaatctcacaatttcatttctaatccgttagacctatttactgcacttgtatgtatcattcacaaatatgaataagccagggccacagactctcagtaagaagacccattgctcaagaatatcaaagaataaaaatcacattctgatttcactattttgtccatgcacagcatatgcaggtaaggaaacaactccagcaacactttaacatgttgtccctcactgaggctaatatgtaccttgacctagagctgagtaaaatctatataaacataaaatccatatatacactcctatctgattctagacaagttaaactcgccccactcctttgagaaaggatgcaactttaggataagacccactggcaactgatagctgtttctaaggttatcctgagagcagctgcagagacaccgttttttaaatggtaaatactgcccctcacatacgcaattccagcctttgttggcaaattctgagtacaaaaggatttaccctccccaaacaaacaaacaacacagaaagccaaatcacaatccttatgctgcaagacaggccactccagtggtctgtgtaagaaagataatgcaattgacattttataccacttacacccctgaaacaggactgcgacgctcagatggtcagcccacagcttcacagcccccattgatttcgcctgggctctgcttttcttacaaaagaactctgcaaacagcttcttaatatttagcatgttttcctgatgagtcacggaagctaagcactaatgaggattattttttcaaaccaaggtgtcacaaatttggtccttctcaaaagtcctcctaacagaacccatcctgatcatttcctccaatccccgaacaatgtgcctttcttcccttcgaaatctgcccttaaaaccgctgccggtggtcatttttcccacttaacaaggagcaacacgaacagcgtttcctttaccttggctcccgaggctggtccgaggagagtggctttccttccgccctccgcgccgctgagtgcaggcgagctccggcgcagcccgcccagcccagccccgcagtagtaggagctgcccactg

SEQ ID NO: 62423 - DNA, 1383 bp, Bovine  19866881037991
tggatgtctgtgcttgcatccatgccccaggactgtagtttaattcacctgaaatgtggcttgggcattggagttttagagatcctcaggtggggcttcccaggtggcactaggggtagagaatctgtctaccaatgtaggagacgtaagaggacatgagttcaatccctgggttgggaagatcctctggaggggcgcatggcaacccactccagtatcttgcttggagaatcccatggacagaggtgcctagcaggctacagtccatgggatcacaaagagttagacacaactgaagtgactttgcacgcaagtatgcacaggtaatgctatgtacagataatagcatctggaaatcactggtatcaacatcttctagcctccctacccctcctactcaatctggaagatacagttaatcatccaaactatacctcccatcttctgtatccttgcgtcagcgttcttccccagggaccctcaaacctgggtcagttcatttccccactgctcctaaataccagatatcaaatgtggctggagaaaactacatagccccctcattttctggctcatcctagctgtcctcattaactgatcttttaacttcaccttggttctctctagacatggagactagagataatcactagtaatccccaaacttcacattccaatttccctacgtaaactccagatgacctcacctccaacttcatcaagtaaaattgcttccatcaggcatgctctctttccattgtatactccactccacccaaataacacagttatctgtggccacttgctttttatcctttcagcttagatgacgtattcccactccaattcaaggtcaatgtctctacactcccacacaaatggccacacttcgctagcatttaccttgatagcaaggtgctctttccatatatcttcaaccatcccttctctgctagctctggaccccctgcttcaactcttaccctctccaggctctgactgtccctcttttctttcttctctctcatacttaaccccaggttccaattatcagctcttgctgttcactgatggctgattcagggcaaggagaaaattcttccaaatgtcttcagtaaaggtttttggatttggtatttagaattttttttttcttgtttttccacgtgaaaaggagactctgattgcactgtcaacaccacacttttctttatttctagaaattgacttctttgctcagtatgctagacactaatgagaaagctgtctcagaagcatatagcattatattaatgatactcttgcttccagcatgtatttaatattcgacaaaaggcaggcaaatagcttctgtcagcacaaggaaaaaacaacaaatccatc

SEQ ID NO: 62424 - DNA, 1564 bp, Bovine  19866881129752
tgggtaaaggtaacaggccctgaaaaacagatgtctgttaggcaaaatatggagcagcctaatgttatcttttaaaactgttgctgagttttcgttgtatgttcatttaacaaatattaattggacacctatataccaggttctagacatttataggcaaataaaaaacagataaagcccctgtcctcatggagcttaaagtctagctggggaggcagaaaataaaaacacaactgtatgtgtgtgtgtatatatatttacaaattgtgatacagaaatcctcagaaggatggtaacagggtgccctgatatacaataggaagacaggtgagcattaggattttgagctcttagaatagtctcccttgaatggttcttagtatcttcttcctttcatcctatttgacaatgaaagataacaagaatgcctcaatagtgaatttttcctgtgttactgccaatgttgatctttcttaaccaagatacaatgaatttacagaggcctgatgaaacacaattgttggggtcatggaaacatgaaaggcaatgtggaatcttgaggagggcacctggctccttgttgttgttgtttagtcgcccattcgtgtccagctctttgtgaccccacggactgcagcacaccaggcctctgtgtcgctcaccatctcctggagtttgccccatttcatgtcaattgcagcagggacgccatccagccatcttatcctctgacaccctcttctccttctgccctcagtctttcccagcatcaggtgcttttccaatgagttggtcttcctagctccttaggaaaacctaaattctactaaggatcagggaggaggcagggagagaagagaacagtatgtacaaattgcattaggattggagtgatgttggttgtgctgtggactttgctgaattttctgtatgtccctaagttaagataagtctcctaacttcactgaatctcattctttcttctataaaatgagagaattaaaatgagataatttctgaagtccttttagatccaaagtcttgaaagactatataagtatagtatataatttagtacagactctgaaaccagattgtaagaatttaaataccagctctgtcacctactggctgtgagctcgaataaggttcttaacttctctgtgcattcatttccaaaaatggaagataatattagtacctaccgcacagcaggaggactcgatgaattaagaacttagagcagtgctgcctcatagtaagtgcttaataagagtgttgctattatcaatatcctctgaaagaaaattatctctaaaggatgagagtccaatagaggcagaatgctcaagacactggagcaaacatataaacagaaccgtgtgtaggttccaagattcacatttccactattcctatcacacctccctttgtttcagcatggtttaaaggggcaattgcttattgctggaagaagggctataaccatacaatgctctgttggatgcccatagggcctcttctttcttaggacacagaagataattaagtctctgggtatggg

SEQ ID NO: 62425 - DNA, 1656 bp, Bovine  19866881468334
actgggggtgtcgagggtcccttcccaagggtggccttatcccttctgtggcctccagaatatccttggccgcctagagtaggcttaccatgagaagatctgaagagcatattcctttttaaggcttcgtgtttcctatccctttgtatcacagatcctgggagatttgggctaatgaacccattatctgttcataagcctcaggcatatataaattatactcccagcctctctgtgtttcttcgttagcatttcattcaaggacagaaaggaaagagaagccaaagaaagctgggatgggctctggggaaaggggcaaagagaggttttggagactgtgacactcagatgtatgaaacaacaagatatgctgctgttgagcaaaggcctgtgaaagaaagcttgtcctgagagtgcgagtcaagagagcacatgtgaaagcaaaggacagtaagacttcagtgaatctatttattcgtcactatattaggactctgggtttctaataatagaaacctaacccaagctggcttaagcagaaagaagggattgatgataaaaaatacaaggcgtctcagaatctgagagcagaagtgtagctgagtgagcatcaggagtcagaattgagaggccagcaggagctctgggtgctctgggatgtctctgcttctctcagcctctttcctttcctgggaggaatagatttctcagctgccctttgcatgtggtggacacaaaatggctgcccaaaactcccaggatcacacatcacactttcagctccatgaagaaagtctcaccgcctagagtggtacatttgctctaccaaggatgagccatctgcagcttcaatcaactaacgcttgaattacagcacattgcacaaacagggctcccaggaacccacccacccataagcatgggaagggtagttaaggagggggtgagaatcatcataagctgaaagggagccctttaatgcatggcattgttggcatcatgaataatatacatggtaagtgcaaaataaagccaaggccaggagcatgagtgaaatgattgcctcttaactaattgaatgctccttatattggcctcacatataaatgccaaagttatttctcatttctcccaaatggttccaatagacctttcaaactggcgttctccactgtctaaagaatatgctgtgcagattaccatctctctggttattctgaatccctcagtgagaacacccttccacttattcttttcctatttgttgttgttcaattgctcagtcatgcccgactctttgcaaccccgtggactgcagcatgccaggcttccctgtccttcaccatctcctggagcttgctcaaacttatgtctgttgagtcagtgatgccatccaaccatcttgtcttctgtcatccccttctcctcctgccttcaatctttcccagcatcagggtcttttctattcttttcctatttattgtagactaaatgtttgtgtcccttcccatattcatacattaaaatcctaacacccaatgtggcagaatttggagatggggcctttgggaagtgattaggggtcatgtaggcagagccctcaggaatggaattagtgcccatatagaggctcagcaagctccctttccctttcca

SEQ ID NO: 62426 - DNA, 689 bp, Bovine  19866880353862
ccggtaaaaaaaaaattacaatttgaagaacacgtgcggctcgcgacgtgaaaaccgctgccccacgtaaatagttaaacgtttcaaatgaacccccccccccagccctcttcccccagcttgcagcgggatgcacctggcgtttggaattccgaatggctgggcattcaaagggttaaaccggatcaggagggggccagttgcgggcagtggagccaagaaagggttaaaaatatcaacacgtttaccccccagtttggttcataaggggcagcaacaggagtgggagagccagggagccccctcaaggaatgactttttaaaattctagaacttttaattccgaccaaaaacaaaaaaaaagtgtcccagttcgaaagttcttttaacctcttctttttttcattttttttttttttttctcgatttctcccgggctggtttataaaagtcgccctgtccttttgggttcgaggaaccaggttccccccacccccgctcccctccaggcagggcgcggggcgggggcgccgagaggaccccggcagttttctcccggggccgggttgggacgcgcggctggtgagtcccggctccgggcccctgaattggggggtccgcgtctgccccaaacgccgctttcttccgttttccatgtcatttcctgtactaataagatggtggtcaaa

SEQ ID NO: 62427 - DNA, 1572 bp, Bovine  19866880367786
tggtgctggttttctatttaaatctccccatccatttggcccagtctggcttctctttgccaggaacagtcggtctccaggctccagctctggagtgaggctgggtccttgggcattgcaggccaggagtctccagtcgtcacgcttggtgggcacagagagtctgcatggttcagagacccaggtctgaggtccggcctgccaccccctgccatggaacctggggcgcgtgactcttctgtctgagctccagctttttcctgtgcgacacagaatttgcaccaggggtcctaccttgttccctcaagaagtgccctgtagccacgtgatcaacaccacggcttgggaaggcatctgaaacaagactgggagactctctgggagcccaagacaggcaagggctgggacaaatgcctggggtcagagggcagaaagtggtaattacctatagtgattatcccagggcccgaaagtaatcactgtagacaagaggtctggacaaggtaggcctttgagactatgcctcagcctcttccctctgtgggctgagttgggcctgaaacacagaagtaaggatgaagaggagctccactcagatcccctgagaactagttgggggtcaggcggtacaaagggggttgacatgaatagggcacatgacacacactttcagggaccttaccatttgaccctctcagtaatccaaggcaattggcatcattgctgttattgcagacagggacaccatgctcagagaggttaagaaacttacccgaagccgcacagctagattcacagccagatgtgtctgactccattgctccatgctctccacccttggacgacattggtttgtcgtccttctccataagacaactttttagcctaacagttggtaaaatatttccctggtttctcctttgtgcatttcacacaataggagctgaccagaactgtgcgatgggatgtcaggctcttcatgatcaccccctacaaaaaatttaccaacaatcccagtcacttccaggtccctgtgaggacactgacatgttctaagtgaatgaagctcagatcttcagaaagaaaagccaatctgagacctttctcatctactactgatacccaagtaaaacatttatgcaacgagctgcgatttaaatgccccctggatcactagagattcacttccacatttgctgtgaagcaaggaccagtgtttattgcatcaatcgatgacccttctgaaagccttgagggagaaatttcattcaggatttagtgcctgtaaaaaacagaccaaagatcaactgcatttccctcgaggagctggcaagcatctcccttgctaacaagaagagctgcataactgatcaggtctccctttttacgcaggttgccaggaagctcagggccagattccacccccgtccccaacaactttggcagttgctccctcctcattcctcctttcccacttctaatcctactaactcagctttgttttctctgccttttattaaagattcccccccacctttaaggcaagaaataaatatttaaaataaatccaca

SEQ ID NO: 62428 - DNA, 3624 bp, Bovine  19866880400675
ggtgcagctcagctctgtgtcctctttgctccctggcctgaggctgccatatatccccagccgtccacccttccacaccagcctcctagagccagggggctgggaggatcgctgtgcccagtgcccgccatggccgttccctggagtgctgcttctaaacccagcccgagctttgccccgtgttgggagaatggagggcaactgcagtgtcctgggctccttctcccattctgtggttctttgggggttcccgatccccaaaagtgaacactcccctgtctgacagcctgatggcttgactatattgcctggcattgccccaccctctgatgctggaatcaaagattgccttcccaagtatttttgttaagatggcaataaaaagaattgatctcacacttggaacacacttggtctccagcatctttctttggtgtatattctctttcttcgcttcctgtgaaaacctcaaggcccccgaagcaagggttagatgaccaagggaaaacatgttggtgagaggggcttgagtgcccctggcattctccaggtcccatcagctctcagacgccctgtgttcagcacccttaaaggaaaggaaaggaattgataggctgagggaggcaaagcatccacataagaaattgttttcactgtgtttaatttctctgctcatcaaaagtgagatgttgctcaatgaattttaccttttgtctcctaaaagtgtgttaggggtcctgggggagaaagccccaccatttctggcaggaaactctggaagggtcaggggctgtccatttgctagggtacctcagagccccctctgagacactcattttttttgctcacctgcccattgatctgggtgtctgactggcacaggtaaagcccttctcacccagctctgaggcttctcatgaagtgacttcctctggctcccctggggagtttcttcagcaggaaagggaccccctgacctatgcattgccctggcttatttccagtcacagggagagattctcccaggcaggaaatgcccaggtcctgaccaaggatccatccactttctggaagattccagcctgtctttgatctcttggaatctaggtcctcctctaccatttttgaccaaaaaagcagggtcatggaaatgaagactatccaatctccaggagatgcaaagatgctgtgaaaccaggcctgggggtctttcccaccaaggtcaaggtgctaagcggtgactggctggcctctccctctggccctggggagagaagagggcatgtaggaagcagaagggacacagagatgcagagacttgtcgacttcagatggaaaggttttccgcttctttttcttggcttcagtgggaatgtggggctagcaagttaaacaggaaggagaaactggtgccagtggatggaaatgaatgagcagccagtttcagcttttagatggggacatcgctcctaagagtctgaggcgtccagccgtgccgagggagggctggctgggtggtgttctcttaaagtctaggtgaggatctagggggtgaatgcctaacccaaagaccttcccagcccagaatacagagcagaatacagagcccagcctctccttagtcattcctttcctatctctgcctcggggactgggctgcttcctttccatcatagacagagcccctgggtgggagagtctgagcctggccttcatctatccctgccgacaaaatagatgccctgtagattgttttctctcttgagttgaaactgatagttcatttcctgagccagttagaaaatatggtgcacttgataagactcagtgggtgaggtctgaaaagtgttgtcttagagcttatctagccaatacccaaagtcagcagagttgagagtaaaaacaatccattgtcatcatgaaagtttcagtccagaaccaccccaccaccatcaccaccaccaccacccacccccttgattgcttcaaagggtttgaaaaaccgtcaaataagccctagtgttcacagatcagcctatgctgtgcattttctatcatccttctgacatactctgtgcttccagccaacgaggtagtgactggaaacaacaaatagattttcactccctggaagccttcggttccaggaagggcccttgttcacctgcagccgtgtaatggaacaggcgtgcttctgcatacaggggttgttgagtggggacagagggattctaggcgtggatccagccgtttgggtgttaccgcaaaatacttaaaagtgggagacctggctagaaatagttgatgttgggacttagctggctccatttagctttacttcaaaaatgatttaacataaacatcttttcatgggaatggattgtttatgattcactgagagctcccatgtgtatcttatttcaaatgccaactttcagaatcaccaagtacaacaggatgctgaaccagttttgatctttgaagatactttgtgatctatacaaagttttggagtcctcttcctaaatattttaataatttatttaattgaaatatagttcatttacagtgttgtgttgatttctactgtacagcaaagtcatccagttatacctacatatgtgtgtgtatgtatagctatatatattctttttcatattctttgccattatggtttatcacaggatatcgattatagttccctgtgctaaacagtgggcttccctagtggctcagctggtaaagaatccgcctgcaatgcaggagaccggggttcgatccctaggttgggaagatcccctgaagaagggaaaggctcagtaggacctctcttcccctaagtattgattcttgttgggttcggaaagtgtgaagaggtagaaagggaaatggacttgaatctttctaaacctgacatcttcaccaggttgctctttggaataaatgcctaatcgtttcgtgttcctcatctacttttttctcttcaagttgaatgtcagagaaaataattctatcttttagagccggatagctatttagaaactggaaaaaggaaagattgtgtacttttccccttgggctctgtgattcaagtgattcttgttagaacaaaacatgaatgaatggtttgccttctgggtcagggagtggagaagtttgatctgcctcagttctgctctgtgctgaccactaggctgattaattttggatgtcagatcccaggcttttgctaaaatggggactgggaaaagagtttgcacatttagaagaaatctcacgtatgaagaaaaaatagactcctacagttggggagttgagattatatgtgaggggcgctatgcctggggtaccacagatgtggattcccaaagccgctggccaccatgactgtccccactgacagcctgtactggaattggcatttgtactggaattggcttttttagggggtgggggagagggattaacagtaataattgcttattgaggaagacttggaaagtacagaaaattataaagaagtagaaccatctataaaggctaatcactgttaaaacattggtgtatttcaagtggtttaccaggcttgtttttaaagcatattagaaccacaatacatcagtc

SEQ ID NO: 62429 - DNA, 2005 bp, Bovine  19866880518582
gcaagaggcccgaagataaacactcgtaaagcccccctctcagaataaagagcccttcccgcccctcatttgtaaagacctcttcccctgatggctcagttggtaaagaagctgcctgcaatgcaagagaccccgtttcgggaagatccactggaaaaggcataggctaccccctccagtattcttgggcttcccttgtggctcagctgtaaagaattcgcctgcaatgagggagacctgggttcaatccctgggttgggaagaccccctggagaagggaacagctacccactccagaattacccattctggcctggaaaattccatggactacagtccatggggtcacaaagagtcggacacgactgagagactttcacttcacttcacttcatcatttattactgttgtagccacacgttctgagaaactcactcagaagaacaatgcagatggtggagggcccaaggcagagtctcctcttggccaagggccatgaccgacttttgtgaaaaccttgtataccttaagtgtactgctcaagcccacatccccaaattccttaaacctagcctggaaagtgttaaagggagatgcaatcaagttacagccatgattcttaatcggaagggtcagctggttatatactgtagcctacaccaatgggtgccatccagattacaaaggcgattgacctcataggggagtattacattctttttggtgacgggaaatcttggtatggaatctggtgtttatcagtccaggaggccagtttggctgtaggtatgttatccccatggctaccaggcacatagtccaaagctcactgcaagtgcaagacggagtttccttctttttcaagatggagtcagctcggcccattcctttccttcctcataacaaaacacttcaacatccttgccagaacccctgcagagagcccgaacctgtcatctgtattccctgtgtcacaattaggcccaggacactgcctgggagaccccccacccccgctccaacctccctggacccaccactcgccccatcgccctcctcgaggtggctggccatctttgtgttttgttcagtgtgaacagcagtccatccgggtctgtatctctctttgcctttctgtgtttctttctctcttaccccagcgacttacatctgccttttgtctctccaggcgcccacccttttgtgctgctcccctccccccacccctgtctctatctcctctctgtctctgggtctctcccttttcctttctcctgagctgtctgtcttgtctgcctttctctccataattagcctcgctcctagcttttactcacaagccccatggggggagagggggggcagcaagaccaggaggacgctgtcttcccagcaagcagaaaatgggccaattaaagccacaaggctgctcaggcagcagaaccaggaggaagcaaaaatagccccaggcgggcctagctggaaagataaacagagaaagagggagaaagggcagaatgaaggcagagtcccgagtccccgggattcttggctagaccagagatgggagggggcggccccttcccacccaaacccgggctgccggttgagcttaggctgccgcctgccccgcatcccggcctccttctccagcgctgctggaaccttcctcccgccgggaggcagcctcccagggcctcctcctgagtgcgactgtcccacttcacacttcccagtggtggcagccacggccggccttcgggatgccgggagctgggaggcgggaggcggatgcccggctgaggcctgtctcctgccctccatccccaggaaaagcagggcctgctctgcccggggctgcaaagctggggtcggagcggatgtagaatgaagaccacagtctgtcttctcaggggctcacaggtcagcgggggaggcgggtaaacaggcagcaatgacacattgcggtcatgtagggagtggccccacgtgtgcgtgtgtgcgt

SEQ ID NO: 62430 - DNA, 793 bp, Bovine  19866880592854
cccctaatgagcaaagcaggactgattacaggagtatgcgttgataggcaagagcagtgtggcttagagaagctcagtaaccagtgtggggttgcccagctggaacctggcatgctcggccttgaggccaggtcagtctgctggtaaagcccgcgttgtcctgctgctgccgtgggacataagtgcccggaagcacaggagctgtggtcagcaggcgcctttcctggtggacaccgctgggggagagtatgctttcactccccatctgctgcgatctcttctttgcctccttttcctctctttcccaggctcagaaaattgataaacattgacagccactctcagctggaaccaggctgttccccagcacactctgtaattagtgtgcagtttgggacttgtgtggaatcacagccggggcccctgggaagaggcgcccaacatgtgggtttcttcagctggtaacccagcttcctcaggagacggagggcctccccctccaggcctctggagtgtttggtgctgcccgcaaagggtggcagtccaacaggtagaagtctcaggcacctagcctgcctctaccctttcccctagaagaaaacttacccattcattccacaaaggtcttgtccggtttccaccacgtgccaggcagtgtgcctgaagctgagagctcaggagatgaggacaaagacccaccctcgtgactcactcatctcgatcatcgcactcactgtagccgtcactgttccacaaatacactcctgcatgcgcttggacccctggcctgttt

SEQ ID NO: 62431 - DNA, 2343 bp, Bovine  19866880663478
atttacccaggggctgaaaggtaaacccaagcttggaccgccgtgtggtccagaggggccccagggctctcaggggagagcttggccctgggcggctttcttctcctgctcaccctgcaggccaagggagatcaaatccctggccacaacaggccccattgagagtcggcaaatctgcccaaggtatggggttacattaccaggttcctggccaccatcaccaagcagagggtcaggctgacctccttccctccccgcaggcctccatccagaaccgacagggccgagccaggcagaaatctgatcgtccgctgccttcccaggcagcagcctcctctgggaaatcagtggacagcgggctgaagctgttgcaaaggctggagccatcccaggcggcccacgggaacacgggccctctgccctcagaggtgggtctggagctaacacagacaagagagcccaggataataacattcttgggactgttaccagcatcgtgcacattatacgtgttagttcacttggtcctcatggaagtgctacacacgccgccgtgagctgtttcacaaaggatgaaactaggcacagagggggttaagtcaatttcccagaaacaccaggatctgaaccaaggcacttggattccaaagtttacttatcacaacagccaggaggagacactgaaaaacacaccttttgagtaagggtagaaaaacccaagtgtgaaagaggacagactccaggggccatggctgttgtttccagccctctggggactggcagagggcaaggcagcagattttctctctggctaaagaagagatgaaggaatagctggagatcctcagggagacatttggttctgggcaaagcctcagtggacagactttaaatattgcacagcaatttttaaaaaatgcaactggctcccataacccagcggcagcacaagaataaaattagaattaagctaaatgtacagcagtaagagaatggctagataaatgataatcctctccactgatacactactgtgttcagttcagttcagtctctcacttgtgtcccacgctttgcgaccccatggactgcagcacgccaggcctccctgtccatcaccaactcccagagcttgctcaaacccatgtccatcgagttggtgatgccatccaaccatctcatcctttgtcatccccttctcctcctgccttcaatctttcccagcatcggggtcttttccaacgatttactacttgttgatttacaatgatttacagtgatacactattgtgtatcagtttaaaaaaaaaaaagataaaagaaaaaaattatggtaagctcactacataaaactatgactagatccaaagttaaatgagaaaagcaatttgcagatgaaaccgcttgttgaaatgtacatacgtacatatgtatgtacatgcgtatacacatgctataatggtacatgttcccataggctctgtgtgcaacgtacagacggagatctagaccaaagtaataacagcgatgataagccctgcggaggaggttggaatgctacggttatcgaggaaaatcatgtttcactttttaaataatacttgatttttttatagcaaaaatttttctgtatattctttatataattgaaatttagtaaaacaacataataaaaatacaaggagatgtcttgggaacagtgagctactggtccctggacgtgtgcaagcccatgcattggggtggaaggatttaccacaaggatggaggggtccagcccttctgaacctcacagcctcaccagaggaggaggagaaaagcccttactgtccccgcactgtgaatgtttttaaagcagcacggaatctcaggccctggaggagggagaggccaggagttggggaccctcacagggacaccggtgtgtcagaggcccacaggccagcttccgagtccacctcctgccaccagctccccgcccgcccccccgttctccttgccccagtaatgccgtcccggcccctctgtcccaacaaccctcagcccccagccagcatgtctgggatcaggcttagactctcaggatcggggccatgtctttgggaagacctcacactggggggcaggaatgcaggaaggaaggaaaaactgacttacaggctgaacgcacctgactgtaaactgagcccagacaagggcccaggccaccaggccacacgaagagccctgcctaatccaacagcctgagccccagcccgcagagccctagtcctggtcaggcacctagctcctgacactaacaagccgagatcagtgccgctctcacttcaggacagctaccgg

SEQ ID NO: 62432 - DNA, 1281 bp, Bovine  19866880848108
acctgcctcctgtggggactctcgcttattttttgccctcagtggagttgttgaaattccaaacaaactcttgcaggaatctcaatggagagactctgtaaagctgcagacggtggggggtgggggaggggcaggtggctggacatgctggatgcttcttggaggcttcagcaaagcgcagttcctgggagtgtctgtggcatgttagctcccaccgtatgcctggcctttgttgacatggttggtcgttctgtaggccaagccaagccctgctcagcattagtgcgtcacattattgatgtgatcacatcacatctctcaaccctgcaggggctggaagggattcttttccagagtaatgccttgcaacatcccgctgctccaggaacctgatcagtcaatgcagtggttttcaaactagaactctagggttctgtgcaaagatgcctgagggggtcacaggtgatgaactgagaggaagtcctggccctctgtcctgcccgtatcctgaatggcatctctttgatctgtttggtacgttgggtttgaatacgagctgtttggaaaatcacgattgtggcgaatgaaagaaactcatattgaaacacatgctggcgtaggatctctctatgccctcctcccttctgcagccctgatgggtaagtgatttccaggatgcctcctggatacaactccagggtgaccccagcctcagcgatagtgacggggccagagggcatccctaagtgaggctgccctcctgcctccccgattctgtttcaggagccgtctgcggggacaggagaggtccttctctccatcagctacctcccggccgccaaccgcctcctagtcgtgctgattaaggccaagaacctccactctaaccagtccaaggagctcctggggaagggtgagtgaggtgtgagaggggagccagggcccctctagggatgtgcacagatggaggtgacgcttgggaggcagtggggatgggtgagcagggccctggaactcagtacctttgtagagtcagcctcagctgtgtcctccacccccaagctcacaaaccagttctgaaggacaccctcacttccctaaagtcatgtccattaactcccgggccagtcctacccgttagcgcccaggggtcagcttcctagggctcccaccttgcagatccattgtgagaagaacagcctgatccacggttcacaggaagcccaggatcagactgtagccagggagtggagaatctggctgtaggggaagctggcccca

SEQ ID NO: 62433 - DNA, 812 bp, Bovine  19866880961016
aacatgatttgttttatattctatttgtgaattagggtgtgtttacagtgaaagaatgatttagatgatgacgactcagctggaaatagaaaggcataattgaatctccaagtctattaaagactcttgtcttgtgtcttatgggttgacattttattacagaggccaacttggctcttgctttcagtttcttttcttcccttttgtatctttcaaatattagattttcccttctcccaaccagaaattaaaaaaataaataaaataaagaaaacctccaaggagagccaggatgtctgaaaagagcaccctggggaggtggcatcacgtggcaggttggcacagggactctgggcattggcactgtgcctggcaccctgcactgatgcccagtcaattgttaccctcagaacctctgccatccccagccctgccaccaacttgctctgtttcctagggcaaatcaggtcaatcctggggtccccttgttcctcctaccaacggagttcttgacagctaatagctccggcgaagcccagaaaagcaccacaagaggcataaaggccaatgatcaaaataacccaccccgattcctttgtagaaggataatatgtcactggcgactgctctcagtaagtgggtcttttttttttttctctgaagaggctggaacctgttccccagggctgctaaatcgggccttgttctgcggtctgatctgctggcgacctgtgtccactttactgaaactggccggggggccctggcaccgtcaggccacgtgggccgccaaatcgcaagccctttctttt

SEQ ID NO: 62434 - DNA, 513 bp, Bovine  19866881045477
ccccctgtccccgcggacaagagctgggtgtgtttcttttcagccctctaaattatatacaacagccttactccacatgaaacaagcatctgagaaagaagagaggtttaacatttttctccctgaagtcccagcccatcccgggggtggtctaagcccctatcgcccaacaacaccccgtacaagacacgagcaacttttccaccggcaccgaccagcgctcaagacaatctgtattctccttgcagccacttgcctggggcgtgctggccttgaccggagaaaggtcatcggccgccaagtgcctgcagaggagactaccttggggattgcgggggtgggaggtgggaatggggggtacactccggagagatttcccgaagagtctacaccgcacctgggatgcgaaacgtgttaaaagaaatgccgccggcgcgaccatatttaccgggaaatcgtgcaccccgttggaaagagggccccccaccgtaccccggcaggactcatgcctcc

SEQ ID NO: 62435 - DNA, 1419 bp, Bovine  19866881103343
tatctggcagatgttgtagacacctggcccggcatcccctgtgacctttcaccctgttcatgctggaagatgggagctgggaaacagtgttgggctttgatatgctttcctttccaatagccagtgcctgggacttctcggaggactgctctgtcctctaacccctagaactgctttgctgaaaggcaggaaaatgtacatccctgggaaattcctgggaatttacatcctccagcctctccctcagctgcagttaaccctccactgatgccttctggggtatgaaagccccagcatccttaccccggggcataacttaacaccccagaggtcccctgccgccaccagctgaagctatcctgcacaggacatcgcctgaagtcacgtacttgcacttgcatgcattcttcacctctccttcctgttttcacaacagcttcaccttcttgataaatcacttgcacaggaatcctcacgtcaggtctacccttggggctctggccacaaacaccccacctctggaatgtcatttgcaccccacctgcgaggctgaccttttgtatcagtgacaccagcagagcctctggagagggatctgaaggaacaagggccccataatctcttctgggtgcctctgaaatccccccatttgagagtcattcccttgaaatgtgtccctctctcctcttaaaatggagttgctcctgggagatcagctttattactggcattaatactgcttcttggagtgaagtttcccagtaaatcagaaacctttttgctgttgcagctgctttggtggcaccagttggctgggttcaacccgctgggcctggacaaaatgacgcaggcaggaattactgcctttgccacggcctgcctcattgtgcagagaacttgccccctcctggctccttcccccacccctttctgagggcttatctcagctgtacttggaggctaatccactcaaggtttaaaataatggcatgataacaacgcaaatgatgataaggtgttattattttcggcgagttattattttcagtgatgtttccttttaaatgggatttctggaacatcaaaaatgaccatgggacccaaggggaagcttgagtggtagaattcaggcactgtgatccccagataagagtagtttggaatcctgccctgtacccttcaattaccgtcggggcacatggggctgcatgtagagcttctttgcacaaattaggaaaagatgccccctctgcataagtgaatgagaaaagggtgcctcttgggggcagacacagctccaaggctactcagtttggagggcgagaaccggatttcggccccacttactcctgccgagtgcctttgtgcagcgcacacactgcctggccctacaagacggcaccaaggaccctctagtag

SEQ ID NO: 62436 - DNA, 1334 bp, Bovine  19866881157878
cttcccagtgccccacgctgtcactcgggtaataggaggagagtcggttgggggccaggccctaggacttggagagctccagggatgtgtttcagatccatcagtttttttttttgtttttttttttttgagatttttctttttttgatgtgggccatttttaaaggcttattgaatttgttacacattacttgtttcatatttcagttttttggctgcaaggcacgtggcatcttagctccccgaacaggggtcaaacccactcctctgcactgaaaggtgaagacttagccactggaccgccagggaagtccccaactccacccttcttgtggaaggccagccacccaccagggcctcacatgtttggagtgaccaccaagtatcctttggcaacaaggaaacctagattctcagccatggatcttacgctctgagactttgtcaggggcgggactctacgtggttgctttatccagctcccagctataaatttttctgtggacgcatttgcttatctgcacagctcacgagcagcacatcaggtaccaccctgttgatgtgagtctaatcaaggctggactgagtggcaaacgtccaccttccagtctttgttggtcccacaaactttcagagcagcagttctcaactctggtaccaatgaaaattaactgggaaccttagaaaatactgatgccccagccttctgctctgtgggaaggctccagggggaggcattttcaaagctccccaaggttgagagcatcgctttagagaaacccactggaataggctgtggaccctctgagcacggcaggtgtgcctcatgcatacccactcacatcagcctaatccaccctatcaaagcccacgaaacacaaatcaaaatgtgcctgctggccagagaacgggtctttgccaaatgcagctgagccttgtggacttgtgtcctggggtgagttctaactgtgtcagtgccattgtgacttcagagtcaccctggcctggcattattcctctgccatctcacccatgatagccgaagccccactgagacttttattgtctgtgttatactgttgaacaggagccttagatgcttgtggtcatgattttgaaatattaaattacaccaagcactaggggctatgttttctgttacaagacaggttaattgctgctcttcatctttaattttgagatttaagccggtttctcagttagctctaattggtagtgtttcgacagccctccctgacctcacaagcctttgatatggtttagaaatccttttatgggagccctttttttcttgtgccctgcacatttaatag

SEQ ID NO: 62437 - DNA, 1956 bp, Bovine  19866881304561
atccactcctgacattcatacataaataaacacttattgggtgcctattagatccagcaaggattggcctccagactttgggtcacatccagagaccttcatatctgtagcttcattccctacccccttcttccttcatgcctctactatagagttgagattcaatttcccagtctcttttacagctagagatggctcatatatgtatctgacaatctggcagggggagttagggccagcattagtgggaggtggattgatctttcaaggaatcctggtaaagatttcaaaaagctttgaaatcctggtaaaaaattaaaaccacattagtacataggttaacttctactctctttctgccttaaatacagacatgacttctggagttgcagcagccatcttgtgaccatgcgacttcaaacataagaatgaaaaccaataagctaagaatgttcaagaagaaggatgataattctgggttcctgatggcattgctgagacctgaactaccactccaatcacctactaaaaggtgaaaagaacaagcccctatttgtttaggggctaaactttaggccagtagttctcaaggtgtggcacttgcttgaacagcagcatgggcattacataagaacttattaggaaaccaaaattttgccctgcttccatgattcggacctgctaaagcggaaactctgagcaaaatgaatttttacaagccctctgggtgattctgatgcatactgaagtttaggaaccattgacctaagcacctcattgatctggtactcatttacttgtatcagagagtaaatcccactgacactatctctctgagcttttgctcaaagacttttccctgcctagaatgcccaatttgcccttctcttctaggatttttcattaaatgaattaattttaataagagaaacccagaatggcagaaaattcagctgctgcagcttggcaaggtgcacgattatcttctggatttggtctcagccgtctcagagggctggatataagcgcaaagctataaaattgtgccatttaagaaaatgtctggttccagccggaaaacctagaattggagtttgtctctcttctttttacatgagaccagaaggagtgatcagcgtgctccaacatccttcctttcagctccacaagttcccccaggcctcctctcagtgaggcctcgatccgagcccacatggtccgtagtgggcagctcggatgctgggctgatggtccaaggaggcaaaggcagaagctgaaagaccttctgagacctaggctccaaaactcacacaacctcacgttggccagattctacactcacaggccaggctgtattcaaagggatggagaaacaggcttttcctctggccgggacattcagtgcctcacgttgcgaaggggccagtgtcctgggatgggaggaaggtatggccagtacaccacttaccacaggctcttccttgtctctcactctgctttaatcttatagacagcttcatgtttcctctgagacattattgcaaatccactcttggttccaatttttctgcgagtcagagattctttagttgcaaggaatagaaacgactcaaaatagctcaaggaagctgggaagagtacagatatcgtggaaatgaaatggatttggacctggcagaacccggagctgggaggaaccaagaaagtacctttttctagattactttgcttcctctcttctttatctatgtggtcttgcttctacaattctcccttttctgtctacataccctgcatccttgtggcttctttccttccctgtcattttggtctcagatacgcaagctagagtctgctggtctgtggaggagggaatgtgaaaggcagctggcaagtttgtggtgtccagactggccccaattccacagtctgttatagacccagaaccccagttaa

SEQ ID NO: 62438 - DNA, 1113 bp, Bovine  19866881305816
tcgattctgtttccccaactcagattgatggaaggatgttgtaaactgccgctggctcgataatagcagcaaataacaggtggtacttactaagtacttcatacgtgctagacgtgttttctacagtgtcccatgtaatccttcccgttagcacctgctctgtgaatgtgtggtgagaattagatgaataatatacacgctaatggtagcatgtggattattctctccatcttacaagtatagaccctgagcagcagataaatatagtgactcactcatcagataaatacagtgctcagcagaggcagagccaggctcctaacccacgtctgtctcagtccagggtctaagctctaacctacagtgtcgtctggcctcctggacaaaaccagtttcttccctgcttcctcctcatctccttcctagctgttctaatgatacgctatgaaagagcaatttctcttagaagaagaaggttggagagaggtgggaaggtgagtttatgtatggatcatagcctggtgggtgggggtggtccgtccaggctccatttaaaggaatcatttgaaagtggttaaaatattcgccagctcctagccccttgcctcttttggtcatcctcagccacgccagcacaaatgggtgagcccaggtcatttttccaacgggaccttccttgaactaaaaccacatatccaaagacccagagtccatctggccctgggaaccaaacctacacccaggcctcactatatcatgtttctgaccaaccttcttattgtaaataaagcttcatttggactatgaagagaaatgataaaaaaggagtgagaaggacccattggaatgacgctatcttcaaaatcaaaacagagcaaagcaaattgtgaacactgagaacacagctgctacctgacttggtaaaaggtatctggtgattggatgggcagtgagaagagacccaatagatacgctcatctcttgtcttctttggagctgggtgttgggcacatatttgccagttacacttgggaaggcatgtttccatgacatgattgcaatgatttccatttgatctccggagatgccatgatgaaaatgtctggaacagat

SEQ ID NO: 62439 - DNA, 1019 bp, Bovine  19866881342367
ttttgttttgcccgtgagcctgtcgtccccatttctattcctttgatctctaaatggaaaacaaaattcaaggaacctgagcccatggcccatggagagaggcctggagggtagagatcaacagggcctgagccaaaatgcagcatcaggtggcaaatcagagaaggccagacccagaagagcctcgaggggccagatgggaaagtgatcactggaggtcaacagtgagccagaggccacactgggactcctgctccctcagtttccttacccataaaatgggtatattagtatcttcctcacctgttgctgaggagaagtaacacaggtaaagtgcctggcacatgttcccccggatggtacttgctgtgactgcttttgtattatctgttctgaattattatttttttaattggagaataatttcttgacagcattgtgttgtttctgccgtgtattaacctgaatcagccacaggtatacgtatgtcctctgttgtgagttaggtgttcccaacttgcctcatcttcctaccacactggttctcaaacttgaacatgcatcagagtcacccagaaggcttgttgaaaaaggggcccacccccagagctgctgattcagtaggtctgcagcaggaccaggaatcagcacttccaacaaggtcccagaaggtgctgatgctgctggttcggggaccacactcagagaaccactcttctactgcacccagcggcctaacgacatacctgacgttgatctgggaaggcgaacgcaaaagaagagagctggaagagctctagcaaagcttcttacgggacaacttagacccgggggagaagcgcctttgcaggggtttcgggtggaagaggaactggggaaggtgtcacaaaagaagtaatacttgagtggaacttgaagagccaggagaaatttgccaggctggcaagacaaggagcatccccagcagagggaacagcaggtgcagaggtaagaaggcaggagaaaatacagcacgtgtg

SEQ ID NO: 62440 - DNA, 718 bp, Bovine  19866881430156
ccagagctcagacccgcatctccaaggctgagacttgcccctcggggagaggttgagtcatccaggacagaaggcaggtctcctctgcgaccagacaacctgaaaccaaatcctagctcctgtaagtcagggaacctctctgagcctcagtgtccccatccgtaatatggagctactagtccctggcctgaccatctcccggaagccctgtgaagctgtcaaatatgggcatgcatggatgtggcagtgctttggcagtggttaaaacttgtgtgctgtcagaagggcttgttcctctgcaactggtaggctctgctcgccaaaaatcacagcgtttgtgaaatctgcaccaaccaagtacacgtggctgcagattttagcttgtctccttctgctgtggatgagggagtggcggggtggcgggggcgggggcggtcctggcaaagcctacaggcaatccgagctgatagagagtaacggaggcttttgtgggggaaggaagggttgatcatcaagcagcacaaataaataatgacaaaaaaatgttattttgagcatttcctctgtgccatacactttacatctgatatcttttccagtcctcatcccaaccctatggcaaaggaaccatgcttttttcagatgaggacattaaggctcagagtgactcagtaactacttgcagctcaccacagctgggatgggatcccagcgctgt

SEQ ID NO: 62441 - DNA, 1662 bp, Bovine  19866880399944
gcaaaaaaaaaaaaaaagtgcaatgttttgtttggatcatagatcatagttcctaagttatggctagagatctggatttatgttcagggtaatgatgtaagatttctttctgaagcagaaacacttaagtatatttctcattttagaatgagctgacttaaatacaactactaagtccataataaaggctcacaatccaccacggtagaggaggggtcttctagcctgggtgagtgagcagcacagcagtaggctccccattgtcccccaggagtcctttgaactcaatagggaaaagtggcctccctaggagccacctgggacccttcaacaggctgccttcatctcgcacgcatgctgggggggagctgagtctccactctcttgatttgaaccgtgaaggagacacttgggctcgtgagggcttgtccccacggctttcctcgtctctccctctgcccttgggtttcccagagctatacagctccctctggactcaggctttcaaactatcaccttcattcccgcggcagcaatgaagttaaagaacaaacagtacctgtttactcacctcggggttctgatgtactttgctccattaataatttagtgaggtggactgaattggattgattccccccccaaatcaatatacaaaatgattactgtttcagggtacttctgagtggttcagcaaggcggagggggagctttttgattgaaaattgaaactgcactccttattcaaaattactgtggagagggttatgtaaaccaaggggatgacctggcactaacatttttattgcagtaaaaagccttttttttttttttgaatggggcttttatagcatactatcactgttccaggcctataatttgaaaattactgttcaatactgaaggtaaaattattttactgctgcaggtctattaaagttggaagaaccagcggcggcctggagagtgtctaggtagatgcactttgctgcactgagcccattgccagtgtgcctgcagatgcggcaggcggggtccctgggctgcacagggtggagcagggctctgctctgcgctttgtgaggttctgggagggtagggatgctgggaaacacattaaatccagagcagccacttaggctggccacctcaccccacggagtccaggtggaaatgttgtcacaacttggaattttgccagttttagtactttaaaaagtacctatttatttatctggctatgccagttcttagctgtggtacgaaggaccctcggtcttcattgtggcatgcagggttgttttttttttttaagttgtagcatgcaaactcttacttgtggcatgtgagatctagttctctgaccaggaattgaacccaggtccccagcattgggagcatggcgtcttagccactggaacactgggcaagtccttattttcagtattttttatttgtggtcaaatgcctattacacaaaatttaccgttttaagcacttttaagtgcacagttcagtggcattaagtacagtcatgttgttgtataaccatcaccactctccatctccagaactttcattttcccaaagggaaactcttgttcatcaatgaatccctgttggttcctcctccccgagtccctagcaacgacctttctactt

SEQ ID NO: 62442 - DNA, 2107 bp, Bovine  19866880479879
ctctataaattactcaaagtcacacaggtggactttctctccagttctctctggctccaaagctggtgcttttcctcctgcactgcgtctgcctctggactccccatctcttccttatcctataaagaggctggacttgatgaagggagggggcaggaaagaggcccttcaccaaaaaagctgatctgtgcccctcacccacccaggggcttactgccattgccatcagagccactgtgcccagggggttccctaccaaggttgggtttgcaccaaggcttctaatctctggggtctgagtccagagcggccctgatctcggtgaggtagcaaagactggtggcatgaagcaagatcttaattccctacccaggaattgaacctgtgtagtctgcctgaaatggagaaggcaatggcaccccactccagtactcttgcctggaaaaccccatggacagaggagcctggtaggctgcagtccatggggtcactaagagtctgacacgactgagggagttcactttcacttttcactttcatgcattggagaaggcagtggcaacccactccagtgtttttgcctggagaatcccagggataagagagcctggtgggcttgccgtctatggggtcacacagagtcagacacgactgaagtgacttagcagcagcagcagcctttctgagggcttcccaggtggctcagtggtaaagaatccaccatccaaggcaggagacacatgggttcaatccctgggtcaggaagatcccctggagaaggaaatagcaacccactccagtcttcttgcctggagaatcccatggattgaggagcctggcgagctacagtccatggggtcacaaagagtcggacaggactgagcgacttaaccacagcaacaacaagcctttctgagacctccaacccttgggcaggaattctgcttccagtcctcggaccagagttgggggaggccagaggagcacagtggtaggtggggacgctgactatgtggggagttaggagaggactgctgtccttctggccttaagaacttccaaaggaacgggttgcccctcacgcatcttgtcacttggatgctgctcgatggtggggaaggaaggtctttttcattgagcaccagtgacctgcaggtgcttttgtaagttctgcggctgctctgaggatggtcccacaccagcctgtccaagggacgagggggtaggaggctctggaggtccactggacttcaaccagattctctgactgtacacggtgaaaccggtacccaccatgaggccaccccgttcccagcctccctcctgccaaagagaatgggccgtgaggtcagggagggagaggctgaggcctaggggatgagaaggagggccgtcagaaggggcacggcactcatcccctctgggagggtgagagcccccagctcaggaagggagggggcgctgcggcccaggctggcgcacgggaagccccgccagggaccaggaggagggcttcctctcagtgtcttcatgccacaagatgtaaaataatcccctcggctcagaaaaacacattttatggccatgtgactcatttcccacaaagctgggttcaaccccctccccccgccaaccacgtgtagagcttttgttttgaaaaataaaaagatatgttgaaaatttcaagatgacttttagacataaattgttcccttcctcacccccgtcccagacccccctcacctaatttcccaaacactggctgccagagcctcgggagcatccggtccaagtgggtgtggggtgactctgggcaacatggcccccaggtccaggccagagaatgtctgctgggcatggagatgggccgaggggccctccagggaggtgggcctccctggcatctgctgcagtgccccgatccttctggttttggggtcccctgtgggccccaacacccactccaagccctgctatatctccaggcctgggcccctctccagagttcccgggacgcaggtaaggtctggctggttcctccccttcccgaatctctaggccaagggttactcccaggtgatctcagacacccagctgggactcgccc

SEQ ID NO: 62443 - DNA, 1866 bp, Bovine  19866880487024
actcagactcacatccatagagtcagtgatgccatccagccatctcatcctctgtcgtccccttctcctcctgcccccaatccctcccagcatcagagtcttttccaatgagtcaactcttcacatgaagtggccaaagtactggagtttcagctttagcatcattccttccaaagaaatcccagggctgatctccttcagaatggactggttggatctccttgcagtccaatggactctcaagagtcttctccaacaccacagttcaaaagcatcaattcttcggcgcttagctttcttcacagtccaactctcatatccataatggatgttaaatggttaccaaaagttttttctgtatctattgatatgattataagggttttattcttcaatttgttattatggtataacacactgattgagtgatttgcagatattgaatctctggaataaatcccatttgatcatggcatatgatccttcttaatatgctgctggatttggtttgttaatattttgctgagaatttttgcatctatgttcatcaatgatactggctttactggcctgtaatttttttgtgcgtgtgatagctttgtctagttttgttatcagggtgattgtgatctctagaatgagttcagaagtgttccttcctcttacatgcataaatattgaagacattatgccaagtgaaattagccagtcaaggaaaaatactatacaatgctgtataaaggacaagtagtacacaattccattatatgaagtatctaaagtagtcaaatttatagatatgggaagtagaatggtggttaccaggagctaaggataagaagccaagaggaactattgtttaatggatatagagttccagttttgcaagagaaaacattccagagatctgtttcacagcattataaatatacttaacactactgaactgtacttttaaaaatgtacagttaagaggatacattaaatgatatgtgagttttttgtgctttattattcagtcgtgtccaactctttgtgaccccatggacccagcctgacaggctcctctgtccatggaatttttcaggcaagaacactggagtgggttaccatttcctactccaggggatcttgccaacccagggatgaaacctgtgtctcttgtgtctcttgcgttggcaggtggattctttatgaccgtgccacctgggaagccccgtgtgattttttaccataatataaacaaacaatactctttagtttaaaaaaaaaacaaaacagatgatgctgagctctcgagctaatagaggagatatgtattcattgatttcaatatctacatcttatctgctatgtgccaggcactttgcttaatgttggggttagatggtgattaagaaatgatctctgctctcaagagttttcagcccagatggagacagagagaaataaacagtgtgacatgggctccacatagtataggtgccaaggaaacacaaagtaagggagcttcctctgggcttggagtggtggtcaggaaagccttcccatcttctttcctgagtaatgaagtaatggagtaatgaaggtaagtatgcattagccatgcaaatgtgcagaaggaaagaataggtggaggcatagtgaggaagccagggacagtgagaagcatggtgtgaccagagtttagggttggagaaggctgaggagactgaaaatggcggcctcctgaaggagtttggatctcatcttgagatcagtaagaagccaggaaagctttttaaggaggggaatcatgtgttcaaattggcatcttaaaaggattattctggcagctacagtgagaaacagattgatgaggaacaa

SEQ ID NO: 62444 - DNA, 2169 bp, Bovine  19866880509737
tcgagaccccaaaacatgggcccaccgtctctggcagggtagggggacacctgggggactggtgcccagcaagtgtctgaaaagggagggcctgtgtctcatctccctctaccccttgggcccatcatctgctccctgtcagccccagaggctcagatcctggtggccaacccctcaccagtgcagtccagcaaggccccttggggtgtggaatcctagtgctcccctcttggagccgagatcatcggggcatggctgagcagccccttgggagccagggtaacgccccacatggaggggccacagggcccagccctggccaccctctctgggtgcaggtcccaccctgtcctcctggctttgttcgtcccagggccgctggccttggctggcacatggcctgcccccagctccaccctcgtaaggtggggcagggagcattgccagcctaggttcttgtgctcagtttgagcacccggtgccgttgctctgtggaggcccagtgggcaaggcggccgcgccccagtgacagtgaggctcctggaggctgcttcctgagggcctgaggctccagcccttcagggcctccctgggggccaggcggctccgaagagcctgcagtcctcagaactcggtgcctggggacgctctccatggtgacctttgccccagaaacatggggccgggatgagtttgattagagcccagagtttggacatctgggcaaccacagagatgctcacctggtgctggtagccacagggccacagacccctgccggtttgccggtgaggctgtggcagctgcaccttcaccccagaaacctttgctccccacagcagctccaaggatgattcagccccccatgtgggggtgtgcaaggacgcccctcccccacccccacccgagcctccgtctggggctcaccgaggctgccccgcatcagctcttgggggcacgtgcttttctcctcctgatgccaaagattttactgggctcccagggacggcggagcctggtgggctgctgtctctggggtcgcacagagtcggacacgactgaagcgacttagcagcagcagcagcctggccctgggagcagacaccacgggagctgggcccctgcgggtgaccgtgggtgagaggagcctagcccctagggcacagtggagagagaggaggggtctcaagtccagagctgtgctaagagagccctgccggggggcagcctgggccacatcggtcttgcccctcgcctcaggctccctggcctcagccagtgcaagggctccctgtgtcccccgcaaccttgccctgggaagctctggccaagctgccagaggccacagcttattgcagcctccttctgagccccaggtgtctggtggcccgacatgcaccgcctggccgaccgcatccacttggaggagctgacccgcatcggcctcctgaccggcagcgtggacgccatggtccaggtccacctgggagccgtgttcatgcctcacgggctcggccacctgatgggcctcgacgtgcacgacgtgggaggctaccctgaggtcagtgtgggcgcgtcggccccagcggcctgcctgtgggctgaagctgggcctggccctcccagggtggggtggggctccgggacattgccgcagtgtagggggacaggcaggatgagaaggactgggctcttggcaaggcctgctgcccctcctcccccttcactcaggggttgatcctgacccaggtcactgccccgatcccccccacacccaagggccctggtccttacatgagggcgtctcccctggtggccacctccacagaacctggcgggcaatgggtgtgctctgcacagggcctggggccgcacactgggggcagcacctgccttgaaagtgtgcagtgcacggggtccccagagggccatgggagccccgaagctgggtctcagtgatgggctggcagtgcacccgtcatgtcctgcctctggcttcattcatcaggtgtgatgaggctcctcaggctggtggccagtccatcctgagacgagctgagcccagcgccccttgcaagtcctgccccaccctctcctggtacagcttctgtccccctagatgcctgggccaacagggcccccatggcctcctcgtctccaggaggcatg

SEQ ID NO: 62445 - DNA, 1831 bp, Bovine  19866880523110
ttcctcgcctgcgcgccttggggaaggccgtgcacacggctctcttggccgggagtgggagtttctgcctgtgtgtggttagggttgtgacagtgattaaacctccaagcaacttggccccagtgtctggcccggatggtggttacgacacccacggccagggcaggggcccctgaaatgagtggaggttactgtccttgggctaggctgcaggggtgggcataggccagagggtctccctgcccgcctaaggccccaacgccccagctccttggcctctgcagcccgtgggcacctctgagcccacaggcctggccaggaggattggggttcccccgagcctactcacactagggatactgcacagggatcacactgcagagaccgggtcatctgccctgcctgccctcccaccaccagcaagcaccgaatctcatcctctcttcccaaaacctctcctgaccccgacgcctccatgggcccccacctctcctggacccctgccggtctcctccccactcctcacccccgctgcctcctgtacacggctgggacaccaggccatctctttggagcacgggtcagaccaggccagttcccaccccgagaactgagccccaagctccttggcctggcttccctctccagcttcacccccacccactcctgaggtgcccctgtgccttccacctgccgttctctcggctgggacacctcatcttcccagtctcactcccctgcctcccgtggacctctgtgtcgaggctttctccaggaagccctccccgattgcctcttcctctgctgcccgagctaggcacggaatggtctctgaaacctgagaaggcggggccaatgccctgctccaagtctgacaaccacatggcctgaccgggagccccagcctccctgtggctctctcgcagccagtgctatgacttgatggacccaggattcacgtgtgcccccaaccccactcctctgtgcactcaggcccagggtagcaaggcagcatctgcattttgcattgtaccacctgccttttgggtcagagggacctgagtcctggtgcctaggccccactacgtatcccaagcagcctcaagtcaccgactggtctttgtgcccacctggccccatcggaccacaccttcccctgatgggccgggagcctgctgggcgtgctgcctggcctggctcctgggagcctcagcagcatccatcatggctttgaggcctcctgcccagagtgtgacagcccttgggggctctgaggcccggagccgagccgggaaggcaggcggagagccccttgagctacatcctcacagcccatccagacaaagagctcacttcatccgaagacaatggccctcgggggatgaccgcgcgccaggccctgggggtgcaggagggaaggctcagggccggggtcccagggcaggccccgtgggctgcagggaagcatctggcaggccacactggcgcggggcggagggcttccagcccaccccgccacacagccctgcctgctgccaagacctcgtgggacccactcaccctgcagaagggcaggggcagcacgcgcctgggcagccggcgccacgatgctgagttaagcatgaccgccccacgcggtccccgtgtggtcccccaccccaaaccctggcagagaggccagggagggcgggaactcacccactgccctttggccagcagaggggcctctctcaggccagagggggacacagggccttcaccaagcacagtcctggctgtgctggtttctgccctagggcgcccctgtctgcacggcatgctgtcccaccat

SEQ ID NO: 62446 - DNA, 1739 bp, Bovine  19866880563689
ggaagcctggtgagctgcagtccatggggtcgcaaagagtatatgcaactgagcaagtgaacaaaaacaacacccaccaaaatttaccagactcttcaacaagctctcccctggaagctgcatgttcaatcggatttcagagttccaaaatgattgcttcagaccactccaactaactcaacagttgtttggatggaagaacaggttcctgtagcattctaccctcccatcttcaatgacactacccaccccttcctgtttttaatcaccttaacctcccacccccagcttctagaactcacccccctgcctcccactgttatgcctgggcaatctgtgggtaatgggctcatgctcaccaaggccccgctccagtgcacctccagtgatactccttgctctgctcaatcagaatgccctcctccctctattttctgccctccaaagtttattgcaacccctcactgctactcttccctggtttgtctttgtccttgttggttcatatctttgaaaattgctttactttcacggtggcagagttgggacagggaagagaagatgcctgaggtcaagccactgtgttgtgtttgtttgtttaaagtattcatttatttaggtgggagttcagtagttgtggccccactgcgtgtgggatctcagctccccgactagggatctaaccctcatcgtctgctttggaaagcggattcttaacccctgggccactagggaagtcccaagccgctggtttttaataggatctcactccaggtttggctcctgctaaaccccttgttccagcgcaaggaagcactgttactatttgactgctactgtgtccctttgtgtactgactatcatggtcggaagacatggtggaataggaagtttgcaagggtttgtccaagtaatggcaagatagtcaaccctgggttgcatttagggaaagatgggtcaaagcggagattcctgggaatattacaggaggggatgctgaatcttaagcgtgccagtatacagtcttgctggattccaaagcaacctgctactttggctttgttctgagtctaatctgcccttgaactgaatgcatgaataacaggcacctctgatgctattcatatatgtataaacctctagttgagaaaaacgctcagtttgaacatacatactaaatttattcataaacatatccatcagcaaaagctcattcaaggagaataagcagggcttccctggtggctcagacggtaaagaatctgcctccagtgcaggagacccaggttcaatccctggctacccactccagtattcttgcctggagaagtccatgggcagaggagcctggtgggctacgtatagtccatgggatcacaaacagttgcacacgactgagtgaacagtaacactttcactttcactgatgctaggagggtgcctgagtctttagggtttaaggggagtaagaggcctctcctctgagcggggctcaggcccccacacacttgcccatatctaactgcaaacaggtagcaatatcctcacaggtgaagtgaaagtacctcctttttctgttctttggtgtttaatactgagtttcagccccgctcatgatcacagctgctgtcagaggacctacaggaaaatccgtttttattgaagctgaaaaggtcaattttcttggacgtctccatggtgaaagtaataaacgcagcacattcagacccagtgtatat

SEQ ID NO: 62447 - DNA, 2584 bp, Bovine  19866880565398
tgggaggcctgcacccgtcatgactaccctgaaggcaagggagccggaccaggccaccagacaggctgaggcagccatcatcctgtgacccaactgtgtgtacagggtcggggacaggggctgtgaaaacaccccacacacgcaccacaccacacacgccatagcacacagcacacacacgtcagttcccacaccaggaagtgccatgtgcagagcctcagccccagacacagctccctcctccctacaaaccccaggccagccacactctctcacgttcaagccagaggtctcagccaggggtgggagcagaacacagccaggctgctgaggtcctaggaggggtcccccaacctggcccagagtcgctcaccctccaaccgtgctgaagcttccccagggtgccaatttcccacctgctcagaggaccccagacagcccgggggccaaaactgccatcagctgagctggattctgacggaaatgaaaggaaacactctcacatcaaaaaaaccaccagacttgtacaagcaaaaatgccaaataaaaacaaaatagaagctactgcattcccgtccccacaacggcctggggtgaggaacagcctgagcccccagcttccacgggcccctcacatctgaagccttgatgacaggacaggctgtttacacaggaagcggcaaatgtgaagacgggggtgctgtttccctgggcgacttcggattgcagtatctgccagcaggattttcaaaagccatcagagagagactcagaaggaagctgaggagctgaaggtcaaatgttcaggctggtgggttttgatcgaaaaggccaggtaatcccgccagcctcgctcccgccctattgatcaggagtgtcagatcagctctgcacatcagactaggccgctccccactccagccccagacagcccaccccttccactgccctgttcccaacatgctgccttctctcccgaaggcttgggacacgcagactagtagaaggtcacaccagagcagagagaggggaaggctggatggggtaggcacggaagggagccaggtctgccagagacaaggggctagctctctgctgcggagccagaatgcccctggggaccggcctgctccatctggcctgcccagaccaactaaagcctttccaacagggagatgcaccctgcagacccatctgtaccctccaaaatccgtaccacacagtcagttgccctggcaaagcagggacagattagagaagaacttttaacagcagttctgaaacacagccatggtcaaagtgcagaagatcatccctgtattactgaagactatgctctagaacaggcaaccgctaacggctgctccctgaccagtaaggtctggagttttaaaccctcatattaggacatccctggtggtccagtggttaagactcggcactttcacttcaggggacaagggttagatccctagtcggggaactagatcccacatgtcatgccaagcagccaaaacaaaaccccccaaatgccatttggctgtggggaggcagggtgagacctgctcagctgtttggaggatccccagggaagaagccacagcctggaggatgtccactccaccccatggacaggcactccctgacttctggcaagagtcagccctgtgtaagcagcatcagtggtcagaagtggtgacaccttcagagccccgccacgcctcctgatggaaactcactactgtccacacccacgtctcatggggctgcatctctgacactatgggcgtctcagcacacctggggccaggaggcagggccatggggaggctgagagggtaggcaggccaaggccacgggggccgcccaggcacaggggccccggacatgccactggcaggaagggctgaggctacagctctgtgatcacctcagggtgcagggagggctctgggagaatcttctcacccagactagatctaaactctcaccaggaaactcctgcagtcaccagggctttgtgacaagccaccctgacccacagtggagtaaaaaaccatgtatcgtgctcacagaccctgacggtcagggctcgggacagactttcaagagggctgaggctccagcgggtggtgctggctggcagccaggctctgggccctccacacaggtaagtctgggttcctcaccacatggcagctgggctcgaggagcaagagcctggtggaaactacagcataatttacagtctagcctcagaagtcacaggcttccctggtggctcagatggtaaagaatccacctgccacgcagaagacctgggttcaattcctgggttgggtagatcccctggagaagggaatggctacccactccagtactctcgcctgggaaatcccatggacagaggagtctggagggctacagtccatggggtcacaaaaagtcagatacaactgagcaactaacactcacttcactcagaagtcacacagtgacccaggcacgtttatgcattgaggctgtgacccagatcctgaccgagtcaggcaggagggacacgattccaactctccatagggaa

SEQ ID NO: 62448 - DNA, 3272 bp, Bovine  19866880575403
tctctaagcatctaagtgccacagtgttgaacaaaaaccaatttgaaagggacaggaattccgtctctcccggagatggatgtgcagaggcaagttctgagggagccgtggacaggaattcaataccctgggacccccaggacattccttccctacgccgcgacccagggatgcaaagggtaaaatccgggaacaacaggagggaggcaaaggaaagagctggttggaattacatattctcaggaggctcgatcaatacgtcttctcagagaaaccagagccgcgaagaaagaaaacagtggttgagctcagctgtgagttgagagtgcctgagaactgaccggggccaggcagtcgtgggccacgtgcggggagggctgggaccagggcctgacgccccgacatcctgtgtccagccttctggcccacagtaagccaggttctccctctaacctcaggtccccactttccactctgctttctggctgacttagggctaaatgcctactcattgggaggcaaagacagcaatcctaccggaatactttccatatacacaccagagaatctaggtcatcatccacataccctttctaatctgggacatgttacccaggatgcagaatcctggtgcacgtcggccccaaaccgtccacacctcactgtctcctgggcagtagaaacagaagggtctccccactgcctgatgaatacgcacgggccacctctgctgggtgtccagcactggcacaggactcaagctagcgtggtatcacttaaaacccgagaaggtgcgtgacgatggctgacatgcctgctcttttgtgacgcttccagaggtgctgaactgaaacccacagcacggagctattagacagcacagaggcatctccttttatttcctcatccaccttcagatcaatttaatcatccgccgaacaggaaagtagaaccacagcctaaattatggaagtgagacgtctgctcttattaagtttcaacttttgacctccatgttcccactgtaatacccagcgcaaggaaagaaatgatcagttatgatctcgtgtttgtgggggaagaagagtatgattacagtggaatttacaagaaatcaaaaaggtactgctcgagtgaatggaaaacaataaaagcagtcacagaaaggaaatgaatgacacccaaagggaagggaagcttctcctgtgctaggagaggcctccaaatcagactggctctggaaaggatcccaaatccccaggccagctgccacctaggagctggggtgcgtgtgggtggcacggtgtggttcttccaaccccaccttaccctggcctcacatgagatctattccaggggctctgagcaggttgggtggcgaagaatgaaccagctgatagtggctgacactcaggcagcacccgcacaccacaagaggctcctcagagccacatggggcggcatctgagcctggagccactggcctgggcttagctcccggctttttcttgggcaaatcacttccctgtgcctcagtctgcccacctgcagcatggggatgatcagaatcctaccttataacacaaataaaatgtctcttcaaatgaggtgaggggtggcacacaggaagcctcaaaaggtgccagctggtggtccaggggttaggaattcaccttccaacgcgtcggacgtgggctcactccctggttggggagctaagatcccacatgtgcgtgttcagttgctcagtcgtgtctggctctgtgcaaccctatggactgtagcccaccaggctcctctgtccatggggtttcccaggcaagaatgctggagtgggttgccacttcctcctccacaggatcctcccaaatcagaggctgaacctgcatctcctgcattggcagacagattctttatcactgtgtcacctgggaagccataatccccactcgctgggaggcagctaaggccgggtgccacacaactacagagcctgtgggctgccctgaggacccagtgcagccccaaaaaagcgactgccgttgttattaggatgtgttgtcatttgacttctgccctcagtctttgagccattcaccaagggagaccgcatctactttgcagtggaggaaactgaggtgtggtgtgttatacactaaatgctgtgttcccctcaaatttataggttgaaacctatctccaatgtgatggtatttgggggtagcacctttgcggggtgctttaggtcatgagggtggaaccctcacgaatggggcttagcacccttaagacaccctagaggactcctttaccccttctgccacttggggacacaacatgaagatgccgtctgtgaaccacagtgggtccgtgccttggccttgaacctcccagtcttcagaactgggggaaataaactttggttgcttataagccactcggtctgtggtaattgttaggcagcatgcatcttcacatccaagctgtgagtcaggcattacatccccattttacagatgaagaagctgaggctcacaaaagttaagtgacttcccagggggcaagggggcatatagggggtggctggggatagaatttggatatgcctgactggacactttttccatcaacgcaggtaacttctctccatggagccgagagaaagagggtggtaaaagcagccaggacacagggcccgaagacacatcaatgagccataatttaacaccacggaaggccagtctctcctgtaaatgaggggcctaccagccatcccacccagagtccttccgtcagtaaccagagaggagggcgagggtggtgactcccaaagagcctgccaagaatgaccgcagtcactacagaggccggaacccacgctgctaaacacacccctgaggccgtaagcatggtgtgacatttctaaaatagttccatggccatcaaatgccaagtaagtcctctctgctgaaggctttaataagaccaggaagtagtttatcagtgcaggatctacctcagagcagtggaaatgtcactagaattaaagtgcgcttgttccaaaattacaaactaatgacttgtccctcgggagatgtgaggtgcacaacccagccctggcctccaaagcatccggagtgtcagcagctgtgggggatgtcatgtggaggagtggacacggttcctgggcatccaggatttattcttctaccagctgcgggttacagaagggccgggcatgttacttcataaaaacaagaagagatgggggg

SEQ ID NO: 62449 - DNA, 2874 bp, Bovine  19866880588613
actgcagccccctcttcgctgggctccctgctctgcagcagtcccagggccctccctggcctttgaggctctttacagtcaggactctgtgtatctccaaccccatctccctctttcaccctgctggccacatgggccttcccacagcgtcctggtcagcgtccatctctctcactcattcacattctgcactggaaagctccctccatgcttagttacagctcttctttcagggctcagggggagagtcacctcctccaggaagtcctccagggccggcggtctagggcagattactctatcgtaaatctctggtttgcaaccacacggatatttcctctacctgttcatcagggcctagaatcacacatgcgttggtgacctgtttagtaatagggccggctggcatggcatgaatcggtgcgtgatgagtggatggtgatggagtttctgttccaccagatgacaaaacctgcaagaggagggaccactcttagtttggcctttcccagagcctgatccagcaacagacaccaaatacacgcttgtgtttggtcactgaatggagggcgacaaggaatctgacactgggagtatgggacacagcattctttagctttaggtttcaacattaacagttctaatttaggtcaaataaatgtcgttgaccaggcccagctctagccttgagttggcagggacagggtgtcttgctctcagtcaccagtagcaagaagtaccgatttcccaggagtgcgtgaccttcaaggtggggagtggaaatgctgggacccaggccccctgcctacagacactctctgacttccccaaaggtggctttcacgatggaattttgcttctcgctgtcaacccacccggattgcacacaggccgctccagcctgccagtggctgaggatgcatctgtggccagcaggtgcaggctggagcaccagatcacaaatgacaggtagttttgtacagggtaaaagtcacaactttttcccacggccaatttgtaagtctcatcttctgtcgccgtgatttaccgaccgcagggtcacacatcctccagctggaaggaaatgagacggcgtctcctgtgtcctctgctacctgagctaatgtggctctgtcctccagctgcctgaactcaagagtttcctctgcctttgggcagccttttcccaggagggagggaacacagctgctctgccgtcagacgagctttggcagtggctccaaagagctggggagcctactgtcaccacaccgttagcacgctcttgcctgcccccagcaaacatccccaggctcccagatactgtggccacatacacatccagacaatcattcttgatcgcttttttatgtctcgttgtcccgtgtcacagtcacattgatctccttgggccagcactacataaatttcctgtttataactcattaccttttgattagctgaaaggctgggtactggtttcacagtgtttactgactctaattgccagttattcacgaaaaagctaccataatcttttgtccattttcttgcccatatgttccctccaagctccatgtttctcccacatggttcccacacatgggtaaaccaggaaggtgtggcaggtatggctaagacaggtgtctgagactctaggccaggcagcaggcaagagatcgggcaccacaccttcccccatcattcccccaaagatcccaggtgcctactgtatgtgccttcaaccagatgcatcagctagcaatgaatacaactcgcatctgttcgatcggcacaaccacaaacagcctatccggccaccactgacaccaaccagagtgatgagcagagaagcagcctgcacggcatttccaatcaggagaatctgatgttccttctttagaaggtgaattctgagatgagcccaccaggcatattttcccaacaaccatatggcaaaaaaaagtagttactgaactttctcagacttattagctttcataaacagagatttgaataaatgtttaaaaaatgaaattcccttgatactctgtaatcagtatatgttcattatggaaacacagcaaatatgtatgaaatttcccaagtgatatctggctacaagattaaaaaggcatctccaactgcaggctgagttacagagcatacttctccggtcaccattcaggacaactctgcgaagcccaagaggtcagacaaggctgtttctttcctagctgaagcagggaaaatcagaagatgctcccttttgcctgctcaggcaatctgggaagtgagcccctccccccactgattgattgatgtctctctataaataattaatctttgaccttgctttaagaaagccttgactttttaatttggggtctttttaaaaatcaatacagggggaacataattcactctcacggagtctgattccaggtaaataaataaatatgctgtgccttccctctgtcccagggtgaatgggccaggcaatggatggggtcagactttgccgggggggggggggggtttcttatcaactgctattggagtatcgatcatcctatgaggtttaattctcttcagagtttgaatgttatccctcctttgggtcacttcacagaggcaagtctgaccaagtctttggaatgcgcttcacgccggccaagggctccccacaacacgtcctgccatatgcagtgggctgtctggattaaaacagggcctcctccagggaccagaatgtcacccttcctggtggcctgtctgccttgctttggggacaggagcagagggtggctaggagaggctatggcagctgggaaattttaaagagggctctgccactcttgcctggaggctgca

SEQ ID NO: 62450 - DNA, 966 bp, Bovine  19866880598767
acagggaggaggagaggcagccgggaccagactggggctggaggtgcccaccaccctttcgtgggaggggcacccatcagatgctgatggccctctcatcagaccagatgctggcttcctgcaggcctgcctagctagacagaccctgggacagggccgtgcctggcagtgaactctcaacgtggactggctggacagacagacaacagctgggtgacggtagagaagctctctgtcctctgggctggcttccgggcccagggaggcccctgccacccaccacccggctcactccacagcactgagatcttgcccacggtttctgtctccggagcagcgggcgggcagccctgggacatgcctacacaaggttccctggcggccgcacgccaagccaacgccagagccaggccaagagcagaagtctcggggcctgcccaccgcccacgtccctcccagccttctgcgcctgctccagcgcaagaccgcgagacccagccctgaccccccagagcccagagtcctatccacacactagcccccccatgcacctcaggacaggtgtcttcccctgcaggtcccaccctcagcagctgtccaggggtctttgcaaatgtcagtctggtcctgttcctggcctggccccccaaaggtgctccaggcccttgtatctgctgccctcctccccacagcgtcctgttgggttcagggtggcaaggccgcctccctgtccccatacttgttactctgcccatctctctgggctgtctctaaagcagcttgctcctgccccggggttccctctgggtctctgctcggctggcccttctcctcactcaggttcaggctctgctgcctcccaccccagggaccccttcctgaagtaacccccagtctctgtccagggacacgctggccatgcccccactgggctagactcccaggaatggccctgtccgggcctca

SEQ ID NO: 62451 - DNA, 1557 bp, Bovine  19866880734064
tgtgtgaaggaaggggatgaccatgacctcaggtaattaaacaaactctgaacaactgggaaactatttccactgcatgaaatgtatgcttagcagcaagacctccaggtggtctgtggcgtgtggccccaccctcccctccagccgaagttcaccttgggccaggaggacaagtccgctgacgatgataatgaccacgatcaccatcttggccgccgtgaacatgttctggacatagctccccagccgcacgctcagcgcgttcaccgtggagatgagcactgggaagtcagaggtgggcactgttctgtgtctatgggctcaacatcaccctcctgtcttaaggccctggaaagagcctcctttccattcccaggccccgttccccgccagcctcccctctccactgccatatccatgcacctttgaaatccagccagggctgtccaaccccctccccaaactccacctctaagagcaatggagatgcagccagactccagccaagcgctgccctgtggggtagcctacagccagccctccccgatggctctgatggccccgcagagcggagaccgaacgtcaaagaccatcaggcttgggaccaaggccagccctggccctgctccctgccggcgcctccaggcccacctggcctctttcttgggtgtgcaggagcccagtttctccaccccccagctgtgccaggtcttttctgccccctgcctggtgttcctcacaggtactcacagatggcagcggcagccagggatttaacgacaacttggggagggctgcagcctgagtagaagggcgcacaaacgtactcggagaagctgaggcagatgatggcaaaggatgagggctttatgacgaacaggctgctccaggaaaagaggtatgccggaatggggccaaaggcctccatcaggtaggggtactcgccccccgacttggtgatcatcgtgccaagctccgcgaagcacagggcgcctggaatacagagagaaaagggggccccgggccccttgtgaggtctcgccctggtcaagggaccccctctccccaatgggggttgtgctcccagggcccaccacggtgcccctcatcctgagctctggcctttggacattccgtaaaccccagtttacacacatctgcacaaaagcattgaggggttctgggcagcgacacaaccccacacagacagagctccaacatcctgccccacatgcaacaggggatcattgccagggtgggcatctttgttacccagtgtcgcaagaaccccacacatggtccatatgatgagacagggtcccacggcttccatgttcctgagcacagacttgggggagatgaagatcccagagccaatgatggtacccacgatgatgcaggtgccactgaacaggcccagctgggttgtagagcgggggagagaagagttagtgccgctgcagggtgcagctcagaaggccgcacgcagccctcttccttccatcctcctccccttccatgctgggtacagccaggcagcccagagtcccaggcacc

SEQ ID NO: 62452 - DNA, 1643 bp, Bovine  19866880737103
cccaactcttatagccccatggactgtagcctgccaaattcctctgtccatgggatttcccaggtatgaatgctgaagtgggttaccatttccttctccaggagatcttcccgacccaggaattgaacctgggtctcctgcattgcaggcattgtactgtatgtatgttctatttcaataaatagggttaccaaaaagaaagaaatactaaacaactctacacaaggcaggctgctgcagtatctaggcaagaagactgctgcacgtctcttgtcctgagtggccctcgtaccttctaaatttataggcatctcgggagccacaggctgacacagtaagatgaccatttgtgtgcttctagaatgattcccttggccagtgacagggagaaaatgaaaagttaagtgtaatttgggtaagcaccacccgggctgtctactaaggccgggacctgaatattgagtctattagaagcaattataaaagggacagcattttttttaatgtttctcgtttgacaggaaggtttttaaatatgggacattagttaataaaaagtccccagaagcctattataatatattacctaattcctatcagttcgtagtcactgaaataggtaaaaagggaatgcaaaattaatatatagttattattaaaattgccttataaattagttaagtcccctggaggtaccaagtgggcatcattattctaagaccgtctgaagggcctccgtgtgccccgtgtgtgtgagtgtgagtgtgagtgtgtgtgtgtgtgtgtgtgtgtgtgtgtgtgtgtgtggagtgggaatgcccagccaggacaggagcactccgtctccgtactttaaggataaaacccctgctcaccctggaagaggcgagaactagcagccagaccacagacatttcatagagaaatctcttctctagttggtgaagtttctggggaggctggcactttgtggcctcaccaagcctgtcctatgcccgagcgaggaaagccgggagagacgaccagattcaagtgatagaagtggttggaagccacatacaagtgtttgtgtagctccctaatccctgggatcgaccagttgtctcagaactggggtgggaggtgtaggcccaaacaattcccttaaagtatcctcccccagcacaccctgcttgtggcaggccaggggaagggtctgatggcatgctcccggccacagcagcagctggtacagcagagagggaccaggggcctctgggagacgtgtgtgcatttgactcaggcagtcgggggaccatctccaggctacaacgtgcagggagccccagcttcccacctttgccgtgcagcagtgtgttgcattggggatttagaagctatgaatggaaatccattcgactctgagctacttgctgaattcaagtgctctttccaggggcattaggtgaacgtcaggtcttccctggtggctcggacagtaaagaatctgcctgcaatgcaggagacgcaggttcaatccttgggtcaggaagatcccctggaggagggcatggcaacccactccagtattcttgtctggagaattccatggacagaggaacctggcaggctgcaatccataggattgcaaagagtctgacacg

SEQ ID NO: 62453 - DNA, 1190 bp, Bovine  19866880780979
ttgctctgggatggggctaggatgctttgatagtgaatttgtatctttcctatgtctctgcttgcgtcaaatcctccatccacagaaaggcatttgggggagggtgaggggcagggggtgtcctgagaagggagacagcgagagacttgcagagaaacaagaaagacctttcgaaggcgaggcaccggtggtttacttcatttgaagaagagtaaagccctgcccttcctgccatcgtaggaaggaacagaaggaatactgccttggccccggcacggacgcggccctgtgtcggtggaaggtctgtgggtgcttggaagttgagcttcgtggctgagcaatgccagggtttctgctcacccttgacctgctccatgagtggcctcctgcttcctccccactccccattttctcccaggaaatcgacagctctctgagaggagactggcaggttcctgcctgggaaggtgggggcgggagacctgggagtggcagacgctcctcagcagtcccagtggctcatcacaggtgtcagggccaaaccccgtattcacagattcccaggagatccaggagataagggtgacatggcgacactgctcaaccatcaggaggcatctggtgccaaggggtacctcccatctccttctgcccttgctccttccctggaggctggctcccccgaacagcgctctcaggggaccctgggctccagtgacctactgtggggctgaggtccctgtcacccctcataggagaggcagccagacatagtggacttggcccatggccgggtcttggtcaaaactgctgcctccaagaaaccttccctgggggcctctgctccactttgaacttccccttattgccctgtcgcccttgaagcgcatctcgggtccacaggactgttcgtgcctccccaatcccaccccccggcatacagtaggcatccaataaatacgtggggtgtgttctcatgccagactcttgaagtaagtcttcatgaaggctgcagtcaggaggggaaccatgagggccccttcaggaagcagtgggtggtaaggaccagctctccgtggggggcccctctgccttggcacagggcacatgccaggcaggttcaccccatgctcccctctccccccaagtgggttgctctgtctactggggaccctactgggggcctcatg

SEQ ID NO: 62454 - DNA, 712 bp, Bovine  19866880842295
ctttgtgatgacttttgtgatccaaccttgccctcccagatgagacctgtccaggggttactcagttcaggggctctgataggcctaggagtggggaaggagcaatccacaaagccagcccctgggccccaggcagcatcccctcactgagtccatcctcgtccccaggggtacaagaagcagatggcactgaagctggacgacatgaatcatcatctgacagagcagcaggaggactttgctagcaagtcagctcagtaccagcaggagatgaggcacctccatcggatgctcctggacaagcaggacatcctggacaaggcgctgcagcagaaaaggtctggccgccccagcccctgggtggtttgtggtttttgaatgtttggtaagatttttccagtaacatgctctggacctgttttttgttcatttgattgcttatttttgtttttacattttagttttgtctgattttaatgttggtcttgatattttaaaatactcttttatctgtggctgcaccgggtcttggttgcggtgcatgggcttctcgcccttgttatggaacgcaggcttgagggctcagtagtgtggcacacgggcctagctgccttgcagcaggtggggtctttccagaccagggatcaaacctgtgcgtctccttgactgccaggtggaatcttaaccactggaccactagggaaatcctgac

SEQ ID NO: 62455 - DNA, 1628 bp, Bovine  19866880854767
tcttctctatccagccatcagtgcagaagaagagcaagaggcagccagaggatgatctcagacctgaagactagagggaagaagccagctcagcacccacagcagcagggcaataaggaacaggtgggcagcaagcaggcaagggaggagggatgacccctgggggacagggaggggagcaggtgaatggaggctggccctgtgaggggtttgggaagtgagtgtgtgtttaaaaatgggtgtttgtccagggaaaccagggcacctcaaagtctttgagggaaatcaatacagagcgagtcttgacagagagccttctggtcctttgaccccaaactgtaccacagagcccaaaccctagtgccgagaagtctatctggaccccgttcccaagccttgctttggtcctctgggctttctgctgccctcattatctttattggagcaagcatgaaagcactgagtgttcctagcttctgggaccccaaggtacaaggatgatggggagcaagagatggaccctgattttctgctcaagcccagcccttgattcctggctggggactttggctgttggcaaatgggtatcaggtggtgatgaaggtgatgggctcctgggtgggcaggaccactccacccacacccgatgatgttcacaacctcatctggcagtgccaacacttcacccgggcgaggcagaaacacagatctacctttagcaacagagggtacagagttttccaaggcatccaaagcaaaccttagactccaaataaggtgggagatcactcaccctggcaagctgcttgttctgatttcagggaccatgaaccctgcttcaagggttcttcaggctctgagggacttccctggtggctcaatggttaagaatcccccttctagtgcggggcatgcaggttcgattcccgggtggggaactaagatcccacacgccacagggcaactaagcctgcatgacacagctattgagctcgcatgctctggagcctgcacgctgcaactagagagaagctcaactagagagaaacctgcatgccgcaaggaaagattccacatggcaatgcatccaaagaaataaatctttttttaaaagaaggagggctctgaagttgcagcatcctctttccgtgccagaccgtagcttttgagcagtgcccccacccaaatctgcttggcttgttgctcacagtgggcgtgaagatccaatccaagtctgatctgggctttttctgtgcgctcacatttcctgggaggagagcctattggaaatgggcagagagggagcattttaattaacagagctggtctgaaacatgaggctgatgcaacttcgctccatgccaaggctgatcacagtttaacatcgggagaagaaagcaatgaaggaaatagatcagatgaggcaatatcgggagtttatgaatcctgtgcattttcttatggcttcccaggaatggcttttaaactggctgtcacccatgcacaaattatggcctcaaccagggaggatggggaggccgacaagacatacacccgtgcgtaggacacaggcactcaccagctcataattctttcttgtgctgcaaaagtggagagcactgtgatag

SEQ ID NO: 62456 - DNA, 1979 bp, Bovine  19866880859561
aacactgggatatatggatctttttgaattagagttttctcctcttctgaatatatgcccagtagtgggattgctggacgacataataactagcttttagtttttttaaggaccctccacaccattttccacagtggctacaccgatttacacttccaccagcagggttccctttcctccacaccctctccagggtttatttgtgatcagtcgctgtggtcacgtgcaggtcctacgagtgacaggccaccagttcacattctaaaacacgtgatgtgactgtaggggctgagcagaggtggacaaagcaaattctaactggccctctctccttgggatatgcaaaaagaccccataagctgcacagaaccatgtttttaaagcactgagaaaagaatacaagaccctccttttcaactcaaaacttagaggaaagggaagtctttgaatttttgttcatttttctactacacatcagcctgatattaagtttctaatttctgctgaaaagtagataaggttataaattaactctaccgagaagtttttaatttttaaactcccttgacatcacagaattaaaaagttaagtagaactatttccatgtctgcaaactggttactgtctattcattttacaaagtagaaagcaaatataagtgttttctaacccctcaatatattacattcattttaaactatgcaaaacatgagtttcttcatgttttaaaactattttttaaaaaaacattcaatagtaaagtgtacaatgacagaaaaaacaaaaaccaaaaaaaaaaagaaagaaaacaaactagaccatggaaaagaacacttaacagaagctttttcccccacaaatcacaaaagttgttttgaaattatggtagaaattctatttaaaaagaaaatccatttttaaaaaaacaattcttacctttaatttcagaacagaatgttttccatctgatgaaaacagagagagagaactttgtaaagcggagaaagacatctgacagctctgaagagtacaatcttaggcactcaccttctgcacacgagctgaaccagcccacggaccggcccagctctgaaactgcgctctcccccctgctcgttcctgaccgccttcagtggctcacacgactgcagagctcaggccgagctcctccgtgtgcctgggagctgcctgcctcccagcacccttgcccgcgccctccaccattccacctgccattccccacgggggcgaaggtgccactctccctgcctcctctgcctccagcagcagtccacttgctcagatgctggtacctcgaccaaaggatggcagtgtccaagcttcttggctgggtactgctagggtacagggtggctggcacctcaggctggtagccttgagacagtaaccatcagctggcatttatggaggatgttttgcttcgtgtgcctgcgtgcatgcttaactgttcagttaggtctgactctctgtgatcctgtgcactgtagcctgttatgctcctgtaggcaagaatactggagtgggttgccatgcccttgtccaggggattttcccaacccagggactgaacctgggtttcctgcattggcaggcggattctttactggctgagccaccagggaagccctgctgtgcttcactcacatgactgaatttaatccttctaagactcttaggagaggtgcactcaaacttagaagtggggttaaggaactggccaagtctcacgccacctgaaagtgacaatgtccaggagcttttaatgcccaccacaagccaaaaaccactctaggaacttcactctctcctaaccaccacctgtgctccaagttcatgttaccaagtgtgccagttaacactgcctttaacttccaaccccacctttactgcctgctcctgttactgcagcagctctcctttgtctggtggtgcaataataaacctcaccagtagaggg

SEQ ID NO: 62457 - DNA, 2062 bp, Bovine  19866880862268
aagtgacttagcagcagcagcagcacattggagaagtataagggtgggactcctagaaagacagacggacagcaaactgtactaccacccccagctccccatcttgacgctcatgagaaataaataagtccatcctcaaaaggaccccaggaagactctgttcccagatatctttgctgagagccctaaagacccattcccccatcccactccttgttcagaggaggaaatggagacccagagggaggcagaactgctctgggttccactgagggtgtctacaacccagacctacagacccctagtcctgcactgggctctaccagtgacttgaggtgccccaaacctctgtgcctttccacccctcagttgtcctcatctgcaaaatgggcgcattgggtcagaaggttgtagatacaccttctggcttcgatacctagagacttaggacccagccctccaagcctccgggaaatccagagtcccctcccttcctgtgctcttaccactcagcacctttttaaaaatcacctctgtcaattacaaaaggcatcccccaccggccttttaacctatttcaaacagcacagaagttatagggtagaagctagaagtgtctcccaccccagtccatctccaccaggagcccagggtctgtgcaaatgcaagcctgccctcaactatctctctaagcccttcttcctgcagagtcaaggaggggagcctggaatggctgagcctggggaaagccctgagcccagcccagcgatccagcacaccccagcccctgcccacaccagcccctggctgcacagccctctcctcccacgtctgtcccctgctcggagcccagggacaggggctcattatcccatcccgtctgccttggatgccgcagagtgacagctgttccacgtttaattactgatgggctgcggctatgccaacccatgaataaaattacagttgttctgcaatgcaaataccgcggcgctggtctgtgaggtgcttactttgattggctggcttttttaatgagaaaagttttattacattttaaagaacattagtaatgatgaaactcgcacacctaaagatttatatagcgccgcaaacaaggagcagggagaaaggatgttatttataacttcaaatactgctcctgctgtctgattgcattgtttttggaaacagggcatttttagctgataattgttttaatgataaatgtggaaactcaagaaccaaaatatatgtagtatctttaaaaggcaaaaacctcagctaagatctgggtgaagtgaccttacttaggggagagtgggagggcttacctagtggctcagcggtaaagaatctgcatacaatgcaggaaatgcaggttcaatctctgtgtcagaaagagcccctggagggggaaatggcaacccactccagtattcttgcctggagaagtccatgggcagaggagcctggagggctacagtccatggggtcactaagagttggatgggactgagtgatttagcagcagcagcagggtagggcgtgaagggaggggagcttgactttaccagggcatgtgaggataagatgttatgggacttcccttgtggtccagtggttaaaaatccatacgtggaatgcaggggacgtagtttcgatccccggtcagggaactaagatcccacatgaggcagggcttggcccccaaacaaaaagaagatgacgtccagactttgggctttgagagaagtttgtcatttgcaggagtccactgggcacaggttcagcctatggaagtgggaacagactgacctccttctgttggagccgccaccaggggatatctgtcctctgctgtggaggaacgtttcccttcagggtgactgaggtatctgagccacagctgggtgatagtacaaagttttgggtcaaggatctggattcatacaggtttgaacacagaccatctgattctacttccctttcacctagagaacggagtttccccggggaaggcgggcatttgcagatggatgaacctgggagatggcactta

SEQ ID NO: 62458 - DNA, 911 bp, Bovine  19866880899298
aaacaaaaacaaaagtgtgaaatgtatttcctcagggccacagatctcgtttggtggctcagtggtaaagaattcacctgtcaatgaaggagatgcaggttcgatccctgggttgggaagatcccctggagaaggaaatggcaacccactccaggattctcgcctgggaaatcccatgaacagagaagcctggaaggctactgtccatggggtcacaaagagttggacacgactgagcgattaaaacaacaaacaacaacacaaatctcatttaattgcaacctttgatttgtttcaggagacccccttaggaagagtgtcaccagccttcccaggacctgggtatcaagtcatttcctaagtggtccctcagggcatcctccacccaaagggctccatcgtctatcaccacccagtacctgtggcttttacagacaaggttccccaggtaccaggacccgggagtggtgaaattctgcatgaaatgctgcatgggaaacactgcatgaaatattgtatgagattcaggcctaagtccccagagactgtttacgagtaaaaggggagggcgatttagttgggttttgataaacacttcatatagcacatcctaagaggagcagaatccttgtcaagcatgcatctttatgagctgcccgcctataaaccttgcacgaaaggtccatgcttaatgttggtttggcagtaaattggcgcgatgcatgggtctgctgcatcaaattagcatcaacccataaaacgttactgaacgattcctcaaatctgccaagtcttcaaatcaatttggagaaagcgtcaaaggttttttttttttttaactttgataaacttttcatattagttatcacagaagagcataaacctttctaatctgtcttttcacaaaaaaa

SEQ ID NO: 62459 - DNA, 1463 bp, Bovine  19866880997705
ttttgtctctcctcttctgtctccaggggggcacccagaggaggaactgagcctagaacttgggctcaggcccctcggccactccacccagctctcatcttcatgctgctccctgccctgctcccttgctccagccagagcatcttgccctttgtcctggaactgccagcacccgttggggccactagcctggcctcctcccccagcctctgcagcccctgctcctcccccaggaggttggccagcgggctggaccgtggggaggccgcagagcctggacacgtgtcctggccccaggcagaagccgagcgctggccacagagccacactggccaggcccagctctgtcccctgaggctccccgagcaagtggagggcaaggctcctgcctaggcagtggaccccccactccactccaggttgggaaactgagcccagctggtgaaacaagatgtgtggtgacccccagcagaatcgaggtcagccagcgatggccctgtcgcccctctcagtgggatctcagggaagagcttttcctggaaggggcagtgagaaagaaggaccctctctcagctgtggatctttccaggttgggagctgactagcggatctccttcgggaggatagggaggagcatcttccagcctgggcagtcactgtcctggaggcccttattgtgatcagtgctgtcattcagtccagagactgctggcacccaccgccaggaagcccacctgggctgaaccagaagtgggaggaccccagatcaactggccttcttcctcactaagcacctggaccaggatttgtcctcatcatgttcgttaggctagaagttgcaggaacagggctgggccctctgctctgggaagatcttagcagtcatctcccattcttgggcctcaagaatgggctggtcactcagagccagggctgcattagagatgccccgacctgacatctcagaatacagggcaaggcccagcttctgatcactgatgggctggagtttgagcaggaccctagctgggaagccctcagtcctggctgggcccggagctgcaggttgctatggcagatgagcctggaaaatgtcaggagataccagcagctggaggaagggcaggtgggggtggtgatcagtgtctactatggctgcctgggtttgcatctgactctgctttcccatccaggagtgtgttgtgcctctataacgctgctgcctggcacaaacttagccttcaatccatggagccattagttctgttcaggtcaacatgctcagagggctggaaaattcgtcatttctgcagacctggccaagacctgtctccaggcaaagggaaaaactcctgactagatctcttctttcgggccccagtgtcctcaaggcacaaacaagcagttgtgtatatacacacacacactcatacacacacacacacacacacacacacacacac

SEQ ID NO: 62460 - DNA, 1235 bp, Bovine  19866881154889
cagggtccctgttccagggagctagcaccctggctggggagacagatgttgcaggtaaatgggacaatggtgttgggatggatgatgccatggaggtgggcacggtagtgcaggaagccccacaaagggcccattcgcagtgagtctctacactggcacaggaggtggtgggagagaagcctactgcggggtgcagctggggtcatcacccccaggccagagctagactccccatttcctgctcatatgttccgtgtgtaatgtccgaaacatccaagtgtgtaatttcaaagtgatgttagcatgactagccttggcttttatttcatgagattgcctttgttctcttccagacgggccaagaagtgggacagtgcagctattcagtacttccagaacatcctgaaaggtaaggcaagtgcatgaccgcagctgcctgctttgaactgacacccaagggggtttcaccttcagttggggaaagggtttgacacgtgtgtgctttgctgtttgacctcctcccctcagggggattcataagtcacatggagctttttccactccaagtatcacagtgactttgtacccttggaatctgagggatggatgtggacatcagtaattgacaagagaaatcagcaaggaattgtgtaggtgaggcacccttacacggtgataacgcctctttcttagtctgtgtaaaaccgcagcactgcaaaataatttacatgcatttcattgaaccggcaatgatgaaaagcctattttttagcaggcaaagggtagtcagtgggtacctactgtgcggtccccgtccttgctaatgaagatgtatagaatgtctcagcacctgtttggtgtgctctctgtttaaatcgttggccgtaaattagactcttctgtggcatctgtcctaagccctggcagtctgagccaagtaactgggcagcgtctagggtcatgctgaggagtagtgggtgtgcagtggctgggctgcatcctgatgcccgttggggccctggcccctcttcttcactgccctgctgtctgggtgaaggagcagccagaggcattgttgctggagaaatgggaggtgggggcacctctggttttgtagtttgggcccttgtgagcccacaggggccctagagactcagacttggaggaggcagagtgtttgggttgggtaccgttctgctgcctctgagcagccttctgagagcctggtctcctcg

SEQ ID NO: 62461 - DNA, 715 bp, Bovine  19866881159778
ccgttgaagcactaggagtgttttcgatgccttagaaatagaaaactttcgtctgacaaaagctaggaaggaataaagtccattctatagctgttagatctgcctctcaggaaaaagtacttgttctttttgttcctggctttcctcagtttgtgagataactctatttttttaaatataattttatttctttcaatggatttgaaataaaaaaaaaaaaactttggaataatgcctgtatttcattgtgggtttctttgttagatgccaagaaagtaatccaagtttgttcgccagctctgaggagcaggcagatggatgcctgcagcctctatgtgctcagcccaaggcaggggtgaggcgggtgtgggggcacgcagaggcgcttttgtcccgtctctgctgtgctcagttgtgtccaactcttcgcaactccatggactgtagccctccaggcactgtccatgggattttccaggcaagaatactagagtggattaccatttccttctgtgggggatcttcctgacccaaggctcaaacccatgtctcttggatctcctgcattggcaggcaggagtttttactgttcagcaaccacgtctaggcttcccttaatgacgggaacacagttgtctctgaatttagagtgcctcttctgttacgttctctgtcacctaatgtaagtagtatataccagaacagagggagcaga

SEQ ID NO: 62462 - DNA, 1832 bp, Bovine  19866881161166
cgcctacaatccccaagtgcctgctcgcactctgctctgctgcagcagtcgacagacccgctccacgctgacgaatgtagacccttcagtcgccgtaacaacacacccagggccgacaagcacggctccggttccttctaatgagccgccccctcctcaaggagggcctggggagtgtcagtgactcatcgtgctgtggtgcgtgcagctccggggccgggcttcagtcattctcagagcagttactgagcaaacaaggagggcctggggagatggagcatcggtgggaggggtgggttggtacacatccggggctcatcaaaaccttgacaaagtgtggggcttgtcagacagcagttaccctaaatcaattttttttaagaaagccatttttttaaggtaatttattttaaagaaataaagactctataccagggatgtccatcgtcatgatttataataatcattaggaataatgtaagtgcccacagaggaatgagtaaataaactatgccagctctgttaagagactaggacatggcgcaactctgtgctctgctgtcttttaactggtgaacctgggcagatgaagtcttaaggtttttattttattttactgtttattttggggcttcccaggtggctcagtggtaaagcatccacgtgtcaatgcaagagatgtgggaagagatgcggaaagagatgtgggtttgatcctggggtcgggaagatccctgcagaaggaaatggcaacccactcaagtatccttgcctgggaaatcccagaggagcctggcgggctacagtccatggggtcacagagtcggagtctactgagcaactgagcatgtgtgcacacagtgtttctttatttggctgcatcagatcttggttgcagcacacaggatcctcaccgcgtcatgcagagttcactgcggtgcacggaccctctggttgtggtgcgagggccctggagtacgcaggcccagtagttatggcgcgtgggcttgttgctctgcggcatgtgggatcttagtttcctgaccagggattgagcccacatcccctgcatttcaaggcaggttctggggccaccaggaagtccccctgaagctttttcactggtgaaacctgaatttgcagcactagtttcacgggaggttacatgagatgagtctgcagtgactgacgcaggccatgatcaaggtctccctggacgtttaccatccccctcagtagtgactggtaaaaatggcatgcttgaagaatatttaatgacaggaaataaacgaagcgcgtaacttcatatgatccaaatgtcattacagatctgtttttatgtgcataggtaaaaagtctcaggggatgggtttgtaggtgtattttatcttttttatagttttcagtatcttccaggttttctctgggagcctctcagtattaaaaagcatgtatattacatatgtcaaagcttatcaaaacatgagcttcaaataatgtgcagcatagaatatgtcagtgatggctccataatgcagttgaaacaacaaacaaatccctctaactctcaccctgtgtcagagtgtcagagtttagggtgggagcatggggagggggctcaaatacagtgggagctgccgtggccaagatgcagagtggactgaggggtggagccaggagaggaagcaggtggtctcaccagagtggcaggcacccttggatgtcatggcagatgcagtgtgatgggcatgttgccaggggaatgagggctgttagggggcagtagaggagggagtgaaccaacctgcctgggagagggcagggacccaagt

SEQ ID NO: 62463 - DNA, 748 bp, Bovine  19866881289966
tcctagcggcggattccttaggttgacatgttgccctctcttgtcatcctctcttgagagaatgtccctaagccaagcgagtgctcccagcacccagatccttcagcttgagagaaagactatgagcagaggctctcagggagcgcgtggcaggtgattggaagattgcttgttgctgctgccctttcctctgagatgtatgccagctgcgaaacagcccaatatcatgtgtacaggcagcctgcaggtgacaggagtctctccctagcacaaagcaggtagtcctggaaaataagaagagggacagcctgcaattacagtcatcagctatttttggttaaggaataaacaaaatggcccaaagtgctgctgttatggattctagcaaaggagtggcgtgtaggaaagattaatgtacaattaaaatccatgtatgggtaaattacagggtgacagctatctaatgcaaacactgcagacgtgtaattaagaggagttacaggctctcgagggtggatttgctgaggaaagtgttagggagctgtcggtggagctggaagggcagggaggcttgctgggacggggggccatgcaggtagtgaagaggagcgcccccccacagcatctagggggcagcctgggatgtgatgacccccagatctttcaggcggcacagctgcccctccacggtccactggtttcctgttccaagcttccagcccttttctggagccattctgctctcccc

SEQ ID NO: 62464 - DNA, 903 bp, Bovine  19866881344589
tcccggtggagagatgcatgctgccaggtgctgtggggctcctggacactcaaaaatgccacttgttcaggactgcctggagaagggcaagacctgctgctgtttctccatctctgctgtggccacccacaaggtttcaagcacacgttgcctttgccaggagggtctgagaaaatcttgagactaacactgcatctgggagattctgagagtgcctgtcctcagacaagtacacattgtaacagagcttagtgaccaccttgccttccagctctgtgggctcagacctatggctcttctagaaggtagtttttctagtctggttaagaaatcgccacttgagtgtcctctttgagtcacgtttctaagctcatcttatgatatattcccctcctccccaatcagggaagtctcagggtgcccctcctttcccaatggcatgctcccagtggcatctgataaatatttctagagtgttcctgtggaaatattttgttcagttcaaagcgatcctttcttttcaaaaatctccaaacccagttcttaatacgaagcattaaatttagaatagcattcaagttttcatccttttttaaaaaacgcctttagctatctcaggaactcagataatacttaagccccacttccttaccacataatggaaagagatgaagtgatccatgacttttgtggtaagggcacacaagctgatgatgctagagatgaaattctgccctcagagaccccactgcctctctcagatcccacagagccctgcatgagctgagtaacctacagccactctactccggggagccaccagtaggcacaagaaaggaagctgagttgtgccagtctgggcgacgccaggagtcctagagaatccgcaagctctcccaatca

SEQ ID NO: 62465 - DNA, 1683 bp, Bovine  19866881473217
cttccttccaacctgatggatatctactccaagtttatcttcgtaatgaatatttcacaatttcccttgataatttatcatgttgcctattttttcttccagttgacaagtggcagttcactataatttgcaccacacttagcattaatagtgttactggccatctatactattgcctatctactggtctaaagtgaagtgtttactcaatttttaagaacttgtttaacacctctcctgggattatctcaacaatcaatgattatgttcatcttatttatcttctatataccaactgggttgttagtctttaaagctaatccctaatgaactcagagataacaataatctaaagaagtagagaccaggaaccaagtcgattctcatcctggctcgcacatccccgtcccactctggacacacccttccctctctgggcctccgtttccccctctgcaaaggagggatgtaaaatgccctctgacactgacactctaccatgaactccagtcaccaaaaacacttattacaggctccaaacttagtgaagttcatgcccgcttttgttctcaaagacaccagaacaaggaagggcactttcacctctgtctgactcatcttgccaaggtactgaactcagcagacaaggttttgaaaatgagtccttggcttgtaaaacaaacaggaatcatcaaactggtaaaatatgtaagaaagggaaactgggagattaaaaaaaaaaggagttatttttatttccccaaccaaagacaagccaagaaagcagtgctcaaggtgaagagttatccaccatggaaagggggtcaaagagctaactggggctaagacttactccaaacagattgccaattttattttttacactgagtaaaacagctaccttgaaatgctacatacagtttacagttctgcagtttacactgttatctgtgcttttgtttctttcacaaacatttaacgagcacctacaaaggaaaataagcttatttcaaatctggatgttcaaccctaaacgagaaagtctggctcctacgtggacaaatgcagttccaaagttcagtccacaggaagcagggcggcaccttgcttccttgctgtgaatccctctggcaggaggcagaaggaaaactgaaacgcagcagttcccaaaagcacggtccctgaaccagcggcatcagcatccccttggcagacatgcaaatgctcaggctgccccagacgcaggcaccagcagtctcagaacagggctaagcgctcgtcttgacaggagccgcaagcgactctggtgacactgacgtttcacagccactgccacaaaccaaccacagatcttcagaaagatggactgagtgggtaccatttttaaattcaaatttcttaaatcaagtgacattcattcaaatcagggatacactgaaaactcaaaatgttagaatgagtacagcaaaatcaaaattttctcaagtttcacttgggacaataaatgtctcaagcattttcctagccctcttgtcatttttttccatatatatacaatgagatattcctcctctcctccttcccaaataaatgtttaatttcaatatccccaatgaagatctacactccaaaatatccagatatttgtcccttgttccaaatctgttcaaatcattggtatta

SEQ ID NO: 62466 - DNA, 1231 bp, Bovine  19866881512445
gcatggctcctcccgcggccgcaaagagtggtgctgagtcctgactgcccccgagccccaaaactgaagcacaggggccctctgttcccccaggtacatcagggctttccattaccccacaggcaccctggggctcggcctcccggctccctcttcctctgccattcctttaatttcccaacgaccttgagccgtgggcatcagtatctccatgtctcaggcaggaaacagagccccagacagcacgtgacccttgtcagctgaggaaaacctgagggcagacgagtgggcagcctcatggttcctgctgactcccagatagccgaggaagtgcaccagggtcggaagggcagggctgggtggaaggcccctggtttctggcatgtggcacagatatacctagagaacacccaccccgagagccagcctcccgtctttgccgggcaactagcgcattcaaggccctcgacacagcactcgggtggccacccacaccttcctgatcttcccagagggtggcctctggaagcttcctaagggtctccaaaggatgggcagcagcctgtagccaggcaggggcacccaccagcctgagcttccattgaacctgtagcccaagccgggcaggaacccgccactcttgggccgagcaactcagcccatgggctcaggctcctcagattcaggacgagacagagccactcattccctagcctctgcagcaagcctccttggggcccacgactgtgggccagagtgcacccagagcacactccccccaagagctgcccgcttctcatccattgtagcccacagtccacagtggggtgccaccagagttcatggttctccagggctctgggtccccacccaagagcaggaagcagccgtgggaagcagcagggggctggagtgtcttaccgtcaacggctcggcggagaagaccctggggttaaccaggggcaggcatggggggagtgtggactggggtcgtccaggctgacttgggccctgagcatcaggggaagggccagaggcgacctggacttccttaaccacaagaaaatgactcagctaaattgaggaagatttccgtttcggaaacactactttttccactatggtaagagtttttacccacaggctccagaggagctgataccccagagaggggcttagggagtttcgatttgaatagtcaatgctgattcttaatcattatttgaaaaag

SEQ ID NO: 62467 - DNA, 1776 bp, Bovine  19866881591484
aaggtcaaggtcccaaagggcaataatgttacaatgcggtttacaaaggcaggaggggcacactcaccaaaggagaggatctaagcatgggcgtctccccctgctctgacagcagtgcaagtcaggggcagccccttccgactgcctggactgcggacagactcagagccccggagtcaggggcagccccttccgactgcctggactgcggacagactcagagccccgggaggacagctgcatccctatcctggccacacactactggccaagcacagtgggaaaagattaaagctgcagggagttccctggtggcctagtggtgaggattccacgctttcactgccgtgacccgggttccatccttagttgggaaactaagatcccgcaaactgtgtgacacagccaataaataaataaaagtatagccagggcacctccaagtccatcccacaccacaggcctctcgcagcctggggcttttctgacagcagcatctgcagctgatgagggcctgcgagagggcctcctgacacgtgaaggcccagccgagcctgagagatagcctcctccgagcagctcagcagccacctcccaggtaccagacgcttccggcactgctaagggagctggtggctggaccatgctgtcccgcgatgtcaagccaggctgcggcagggggagtggtcgccactactgacctcgtctgtgtattggacatcatccacggcgtacttctccttgaagtgctccttggagtggatcctcaaaagaagcacaaggaaggccagggtcagggtttggccctggctgggccccggctgccttcccacccccagtctagggcccattcctaccctatccagcacttggcaccaagccagcccgcccaacacagactcggggaaggggggcaaaggacaatgggccacagagagaccgctgaaccccgcctgcctccctccacctctcccagccgacctctgctcttcctttgagtctgtgaccctcaccgcttgcagcaagtagctgaggacgaccctccctccgccctccagggagagtccatggggcagcccgccagcacaccctactctttggggagtgaaataagccgcctcccaggcccccacggagcctctttaaaagaaagtttaaaaatcaaaaattaacattttaaagaagtcaataacagtattactcactgtgatgagaaacactcaagcttcctcatcgtccctaaaaagtcagctggtgaggagacaaagacccagagcggaggcggctcagtcgcccccacccacctcacggccacgcgtgtgctgaccgtggtcacggctgtgctgggcagggctggcgggtccagcaagcaccaccccaccccccagcctcttgtgggaaaatgaatcaatgtcactgctggtgacacagctcacatcaggagcatcagccacccaggagaaagggtgtcccagccaagtctagtctcacacacacacactgccctgtgccatcccatgcctgggcactgcatcagctcagagggttcacccttctcctgcctgcgatgtggggtactctagtcaccaagtgtcagatccaaaggaggcctcagaggaagcagcagatggcttttagagtgtttcctgggctctcaaggatgagcagacaggcaggggggcggtgccaaggacagcgtgcctgggaggataaggcacgggggataagggagagagggcacttggagacaaccacctctgagagcaagccccacat

SEQ ID NO: 62468 - DNA, 781 bp, Bovine  19866881593665
atgatgaatgggtgtccctgcagagcagagcaaccacaagaacctgatcccaggacgagtcacactgaggaggacgaggaccaggccacctggcagcagagagggtgagtcagaaacagagtagcatcgacacacatgccccaccaggtgtaaaacagacggctagtgggggctgctgtgtaaagcagggcgctcagctccgtgctctgtgatgacctggcggggtgggatggcgggatgggaggcaggctcagtgggaaggacatcctgtatgcttatagctgattcacagcaatagcagaatctaacacaacattgtaaagcaattatcctccaattaacaataaaaaaaaagaaacaaactatctgtctgccagccaggtcactttcccactttgctaagagagctcaggcttagaagccacagggaggcaggatcaagggttgggcatttccccttctgcctctggagcccagcttcaagatccagataacaatgcagacagtagtgctgcatggctcctagtgggacccggggttgaaggaccctcaagtggggctggcatcatcaaggtttcttctgctatggcaagaggacactctagcatcacctcttcttttagatccaggctccttccacctctccccagccaggatcagatcaaatcagccagcgagtcagtaagtctccaccaagcccctctgagagccaagataggagtctagccacagggagacccgggtcagaggagagaagaggcacagtgtctaggagaaggag

SEQ ID NO: 62469 - DNA, 781 bp, Bovine  19866881669982
ggaacttttcctgcctggagtgggttgggggcgggagccagccggagccgggatcaggatgcgcggcaggaggcagttgctagaatgactcctgtctcccctttgtgtcttctcggacccagcagggcaggcctcagcagcccagggtgatgtgtctggggagggccgagggacccatccagccctgccagagcttttctgtccacctttccagggccttgtgtgcgggagaggggaagcaaggggttaaatcctctagccacatggctcctttatttaccatgatgaaggagggaggccattatctaagcccggggtcattgggggacaccctatggtgtcgtcagtgaaggctctgtaatcccagaaggtttgttgaagccactgaaatgacaaagtaaaaaaaagaagcctgttcactttagggtgcactctcctctgcccccaagaatctaggagctggggtcaggcccctgccttagctgcgtgagcagatctcagtaagcttcatggcccctagagtgcccactccccaatctgtcagtgtggtcccgtgctcctgagtgcctggcttcccctggggtgcaaggcaaggcacagaccctttggcctcccccaaggccctccccgcccagcagagcctgggtgtcctgccagggggcagctggctctcttcttcaccagacccctgggctacagggctgacccctgtagagatgttctctgcttcccttggcatcgttgatgttggggaagggggcaccctgaacctcaggaagtt

SEQ ID NO: 62470 - DNA, 1109 bp, Bovine  19866881854240
attcttagtctttgagccctcaggttggaaggagccagcctgttctgagaaatccagggacagtaatgctggactagtaaaaatcaagaatgtggtggtcaaccctggagccagctcagaaaagccatctttgtcccacaggacacccaggggatatctgccaggctccatatgacctcaacttcaaaaggactcagctggctctagggtacaagcattcctccccttcctccctcctcttcctaacctttcatcactcaccacacattgcccaaatacctcctctgtgccaggcacttttgccagctgggaacacaaaggcaagtcctctgggggcagcacagggagagggattccctggaaggaagccagccctccttgccattctctcctcctctggagtctatggattgccatttgcaacttggcagcagctgcaccctgccaggggccagggcattctgggtttactcatacactcctttctgtccatattataccccaactctcaattttgagaagtaaatatgcaattttttcctccctgtaattttccctgctgtggctgttggatgtcagagcagctggaaaatgtgaacagctcagtgctttctaaaagtaaaaggaggccgtgcagcttcatacatcgtctgctgctcttggcaaaatccgacagctctgctgggagggaagatgctctccaggctgtactgtcaggggaacttttaacccaaataatccacatccccgcctaccattagcaatgagataattgccaaaaagtaagcgtatgtgtgtgcgtgcacaggcacgtgtgtgtgtgttgcagagatgttagtagaggtgaaacaaaggtatctgcttatgcagtcaaactttctgcttgttcctcaggagactttcaaaccctcgtgtctcagtaactgaaggtcaggacagtctgatctacgcttttgtttggaagaagcgagtcaaagagatccagggtggcttatttactgtgtaaccttgacaatgtttagtctctctgggtcttaattttatcatttgtaaaacagagcagaggacttggagatatgcttcctcgagccccttgcaggaaggacgta

SEQ ID NO: 62471 - DNA, 947 bp, Bovine  19866881909055
tccccctatgctggctttgcttaacaaccctggcaagaatcccaggccgggcactgagggggcctgtgtgcacagggcaggcctgggccgggggacagctcatcccctggggagaagcagtggcccgggctgtggatgagcagggccgaggagtactctagaagtggccaaaaaggctggcgtctttgaagagattcccagtggccacagggaaacagacacagaccctgatgtgttcccatcacaccccggccttggagacgtggagtgactgggtcttccaggctttgcatttacaggagtgacaccccagccaaactcaagcctcagttccaccatctaatctcctcaccccgcttccttctgcacatccccgaagcttgagcatcctgctcctccctctcctgctgagatggccccgagggcccgggggaaaacctgctctgggcttagtgccagcctggcctcaagccacccctgcaggacagacaggacacctctgccacctcacagatgactgggccatgccctccagtcccagggctcccctccctggcaggcctgaggtgatagacagcctcacaagcccatgaaagaggcccaggtctgggtagccagccccagagacccacacccacatgttcacatgcatttgacccatacatgtgcacacatagactcacacatgtatttgcacacctgcacatctcacacacatgccctccacacctacacacacatgtgctcacaaacgcacatacacgtgtcattcatacctgctcaggttgggtgcacacacatacacaagcacattgtgtgttcacacacacgtacacacacatctggtcactgtacttgtcacagatactcacatgcacaccatcacacatgcagtgcgtgcaggcccacatcgagtcactctgacacccccgcgcacacgtacctga

SEQ ID NO: 62472 - DNA, 1757 bp, Bovine  19866882055049
ttcattaaggccaggagggggtcccctggcagaagcaggattttaggtgactcagaggagagtcagcaccataagctgtaacactgtaaatgtctcttgcttcctggggctatttggacagattccaagccgccacctgatgatacagagcattggctttagcctgatcaccacttcctcctttggcccaggagtctcatgacgcaaaggctaccttggaggtggccataaaggacagcagaaccgcaggtgcagtgcagctcagccagacccagcatcagactgagtgtctgcagagcaggcagcaacggttgccagccgggcgcgagctctcctgcctgcagcaccaggaacaggaagagatgcaggtccccctggccttgctagtcagaaaatttttttgccttagaacattccgtttctgttggattctaagaagagaaaaggacaggggatcaaaaactgccacttcagaagtagtttctttttctccagtattactgtattagaaacataactggaattccctggtgattcagtggttagaactctttgctttcactactgagaggagccaggttagatccctggcccttgaactaggatcctatatggcaatggacaaaaacaagcaacaaaaaaagtaacaaattgttttgaagaaaggtaattacaggagtgtacaaaatacgcacataccagccccggtctaggtaagaactgtaaactaataatgagtatatcctgtgtgtgtgttagtcgctcagtcgtgtctgacctcatggactgtagcccgccaggcttctttggtccatgaaattctccaggcaagaatactgacgtgggtagcctttcccttctccaggcgatctttccgacccagagatccaacccatgtctcctgcatttcaggtagattctttaccatctaagccatcagggaatacatcctaccagttgaaataaatgggtcattagttgggtctgaaaatatatttgactcacagaaattgttgtgatcacgaatctttgtagagtggcacacactttgtacccacacaataggtgtctatagatttgtaaaagtgactgaataatctcattcaggattatagctacatttcggttcatactgtggcccctaaccccgtgcggatggatggggatgctggagggaggcgcccggcagagatcgtggaagggcaggaggcctctttacaagtgccaagttcacgttttaatttttatggacgtggaagaggtagattctgttcatccaaactgccctgaatctccagtgtggtgaaaagttaaattagatgtattttttgtgtattgtagggtatcgcatgctatttctgtgcttgctggttgtcagtttctggctaacttataaacaaacaattgtgctttccagagcttggtggttgagtgagggattgcgtaatcctaggaaggagtgagaaagtgagaaaggcagagaaaataacttcacgcactagagaggcagccaaaagcaccccgtcttccatgccctgtgtgagggtctctaatcaggagaccctgcatggtcacccttcactcagtctcactcctgacctggaaaccccaagttcacactgtgccctcaatttgctgaaaacatatctgcatgtgtgagttttatctttggctgtgtggaagaagggcctcactggttctctggggggtggggggagccaggtgccatgcactgcctagagcaagtccccaccctc

SEQ ID NO: 62473 - DNA, 1070 bp, Bovine  19866882127734
ctcctgctggccctgcccgggtgcggggctggagcagggagggaggggcggggggtagccggctcttggcaattaggattcagcagaaacccaggagactggagacctgggaacatttccatgtattcagcctgaggtcaaggtcttaacagggaggaaccggtggagggggtggaggagggagtaaaggagagagaagcacaaggcagctaggaccccatgggtcgcccagggctgtgtgcttgcctgtccacccctcacccaccagcgatgggccactccacttgccacaggagccaaggagccacgaggggccagccagcccacaggagagccagacgctgctgctctgatgtccaggaggaagcgagtttggaagtcagccccaccaaacgccctttgcccccctcaacaagtccagagtgcacacgggcctcaagggccccgagtcacccaacgagccacaggcctggctgtcagcaggaataaccaactgcatctcctctggcacttagcatgccatttcttcctaaaggacagggatagttaagtttgaatagtacttatttttcatgttttggggccaattctagtaaaaatcatttaaatggcaccgtaagagataagtgtgccaggctaccatgtcaagccagccaccagagggactgacaggaaaaggaccggcacgtccacaggaaccctgcaggagaggtccctgggcaactccatgcccactgagcgctgggctggctgcggccacacagagaggtgcacgctgccctgactgcagtctggagcccagcagggcagctctggccagatcccgtcgtatgggagatccaagtggcagcaactggatgcgagagactgggccagcagggaagccaaccccaccccagaaactctcccttcaaaaggaaggggcgacctgaatctcccacaacattgttaatcagctatacctcaatgcaaaatatttttggtaataaaaaattaataataaaaaaattaaaaaaaaatttacaaaaaaggaaggggaagctctggcaggagagaggaggcagggcccc

SEQ ID NO: 62474 - DNA, 4490 bp, Bovine  19866880400801
actgtgagggcgccggcctcagaggcctcagcggggctgcctgctggggtggagaggagacggggcggaaacctgggtgcgggagggagctccacgaggtgccggcttccctccttagtgccttacgtatttagtcttgagtgcagatgtttacataaggacgtttggaaaatacagggagagagcaaacaagttaaaaatcacttgcattcctgtaggtgaaactgatctgagagccctgagcaggaacagtgggcggggtagggatggggtgagacgggcgctggaacccaggttagcaccgtgtccctgaagacagcgtagacctgaggagtgggtggacggagttggagggtctccgtaaggaaaggcgggggcgcagaggaagaggagccgaccgatgctcacagtgggcctctggtgggtgttccatagaagggcacggccgcgtgatttcctttcccaagttaggagcatagctgggcctgggcttcagaggggaagagatgaagtcagcctgaaacccagtactgtccaagcgcagggacctgggacatgcgtggaggctgagaagtgcatccttgcagaggagggtggagggaggcgcaggctcaggaagacacccttgagtggggagacaggaggcttcagagtgagcagagatgctagcgggggcgggcggggcagctctaggagccagggggtcaggccccacgaggtttcatcgctggggccagtgggggcacgcggaatgtcagcttgagtccctctgcccggctcagtgctgcgggcagggggcttggctgtggctgcatgcgggcttggcctgcatgcacctccagctctgggttgagaaagctacaggtgaggtcagcgtgggggagagcggggaccccgggaagaacctgagaggcagctggggttgacgggcgggtgtcaaggaaggtggcccagccggccgggggctttccaggtgtgcacttcaccgcggggggtgggctggggccctggtggacaaaacagcggatttagcgagatggctgacaagggttttatggccctgaagcagattgatcaggtgtgctgttcagaccccagacccttcgtgcgaccttcactgtgatggaagtggtttttgtgggtccatcgctcactgcacttgctctcaccgtccgtcattcgtggcgaaggcagctctgcttcatcagagtcgatggctcagccaagagtgaggaaagctcaaagcacgctggggacactaactctggctgctgacactcgctcgctcagttgtgagatggataccaagtgtctgtccagcatgcagctgcaggacccgcccaccacgcctgtgcgggtgctttgtgaggcgggagacaggttcccctcaggtggggacacagggtgtgggtggcaccggggtaggggcagcgtgggtaacctgcccaagcagcctctgcagcacgggcacatgcaggcgggcaggcggggctgcaccacgggcacacgcacacgcaggcgggcaggcgggctccgccgccgcggagggactgttgttggcggttctcagtgaccttctgtcttttcccgtcagggtgttgagatgctggagctcttgttggaggcttccagagcgctccagggagaggtagggaagggcgcttgtgccggcagaagttgggaagcacagacatcacccgccttctcccgagccggtgttgacgcaggctgcggccgcggttgtcgtgtgctgggtaggtggtgggcaggtccctgtgtgtgagagcctgccagggcctgactgcactctgggaggccctttccatctgtatctcaatcaacaaagaatttcttgactgcctaccctgtgcctcgcactgtactaggccccagccgaggttctgaggtcaggacaggcctcgcacccgaggcgctcctccctggtcggcgggctgagagctcgtgcgcaagagggacgaagaggggctcacggagctgcaccccaggagtgtctcggctggaggcctggagagggggccgtcctggtgcagagggaggcctttccccgcgggggcgcagcgagaagcaccctctactcagggcggagggggctcagtgccccttgggggcagcttgctgtgggagtgcaggggccaggggcgctgagctgagagggtagtggcccagggtcagggccagctgcctgggcgggggtgcagcgagggggcagccgcgcacaggtcggggtggaggtggggtgcccgagacactctggaagcgctcagatctgagcccgatgggtcgaggagacgtccaggctcttttagctgagctgatagattactttaggaagattgctgttttaaaaaagaagagcatttttttccccagttataaatgcttttgaaaatttggaaaatacagaaaagtataaaaatgaaaattaaaatgtccccatgaccccgtcaccactaggtagctattgttagcagtttcgtgtggaaagagcattctccatcacactggtagagattcattggacgagctggtgcagatatgttcacgtcacttaatgcgaacgcaggttgatgaagactgattccaggaagttttccaagttgatacaagttagagtttgggggcttggtccatgcagggccttgcctcccccatgcagcgttctttcaacagcagcttgctgtgctctgttgaaacccagccagggtccaggccgtaggctggaggactagtcagtgaactaaaaataataaagccacgtctagattggggtttttatttcatttgtaataaagattatataacgatttattagagttgtatgttttatcatgtaattaaatctcaccaccaaatgctgcaggatatgtttttgtggaagtcactattaaaaataacaccttctgatcaagtttcctgaaatgtgtcactgactaaagacatacaaaataatgattttaaggtgactttgtaaaattattgtgttcttgttagtattcacagagtagtatggaatgcaaaataatttctagaaatatttgtaaaatagagagtagatacaggatgttagattttcggcaatctgaataatgacagttaaaaagaaaaaattttgttaaacttaaaaaaaattagcttgagacaaagttcagaattcttaactataattcacaatttatagtaagttacctaaaattgacttcagtgattatcttagaattaacacctttgttttccttaaatgtttcttttgactttcagatgataaagttttattttttagaaattgtttttagtaggacctgcccttagcgaagcagtctagagcagtgggaagcacagtttggagtcagacctgggcttaggcagacctaggttttacagtgatcagcactgacttctgtgagttcgtgcgtcctctgctgggtcgcagggacgaggagcccttggcacagttcctggcacatagtaggcaggcaataaatggagctgttggttctggagtgaaagcctctgtcacagcataagccatcgcatctgcgtctcagcttcatcacttgcgtgcgcaagcataggaattacgccttttatgcttgcctcattttctgtgtgcttggtaattatgttttcccctgagcttatacgccactgtatttttgtcttttatttttaattcatttcataataagcatttatttgttatccattaattcttaaggaatcctttgaatatgatctttatactactgtattgaaacatgttaaaaaatgactgagttggaagatggagtgtggggtactagttctgtttccctgtcatctcggtatgtaatgaagtaatcctctactcagcccctagagtgtagacgtaagtattttttagtttatttggtgacaaggcaaaaaaggtgatgtttataaaacttaagatagaagtaaaagtttactgtaacaagcacatagctgaaagctcatctgtttttcccactaatatgcttgggttaatgacatttaagaaggaaaagagtagatgagcacagtggttatgatgtcacataaagtgggcaggcaagtcggtgagtgtgatggaagcgtgatttctggttcccgccaggtgtcgcctgaggaccgaagcgccctgtgggcgatgctcaccttccacgggggcggctgccagctgaacctcaacaggaagtgcacgcacctggttgttcccgagccaaagggggtaagcgacccatgtacgttctccttttaaatgtcttctaagcatttccagtcatcgcatgtcttctttgaacttcttttaaattaactggattctgtttgcaaaagttgataatgtgagtttatgtcacttgtaaaacagctttattccacaatggatgggagatgacgaattttactttgaaccggatgtgacttttaaatacaaagaaatttgggtttatttcatggtgaagattggacag

SEQ ID NO: 62475 - DNA, 1535 bp, Bovine  19866880410275
atccttgatttaaaaccctgtaatcgcctcatattcgcagtgctcatattctaatcaatgaataatcttatttatttttccaagtcaggcctgctaaagaccatgtcactatgaccttgacccttgaaaacagccacaggactccctgcctcagcttcttcctctcttgtctggacagtgggctctgaatcatgaatccagagatccaatcagtacaaatataattaaatgcaaattttacattttagccacagtatattgtttacgcatgaggagtaataataataaaatgttttcattttaaaaactttcctgatgcttattataaatttggaacatacagagaagtataaagaaaacaataaaaattgcatgcaaccacagtacccattttaaaaaggtttccattttagccaattttaaaaatcatcatcatataaatttacatttattacaaagatgtgaaaaacactgaaaaacacaaataccaacaaaatttctattcttaaggaaaaaagccaacttttcaaggatctctattaaatcgaaatagcaaaaacaaaaaagagaggattttataattttaaagaacttccagaatttacaaaaaacacaaaatcactcgacatactgtctgggcagagaaggggttgtggggacaccacctgtacaaaaagctgagtctgtctgataatccagggtattaaactgatgttacccggttccagccttctgtcacaaagctgtaagaaggcaggattctaatcaaagtccttttagtctcacctaacatcctggacaccctgttctcgaaggtctcctcagagatggggagacccgaagtgtcatgataagagcctcagacggaatgaggtcctcacgctacagaaacagatcgggctaaccaagcctcctcctgcccagtggctacgcctgaccccgaggaagctcgaacaccaccagcctgacttttcataaaagctgtttacagactgagggtttccggctagggactgagaggacagaccgggacggaacgacactgaacacgcaccgctccaaaatccatcaatgccaatgtcttggtcccccttcagatgtttcttttttcccggatatttcttacatattttatttcgttgatgtaatactgtacataactatgttatatcctgctttgtcccccatttaaaaaattacccatatgtctgcatacgtttataaaacaaaattcaaaactggctagatagctagattattatgtattaataatggaccagaatagtttcttaaacatttccaaatcgtggatgatctgcttatttccaattttaccctctcataaataatgctgcctttatgcatcaatctgccgttatctctatcaatttgggataaacgtctaaacacatgagacctgcaaggaaaacaacagagtctcctccggctctgacatggcccgacttttctagaaaactgctcaccgatgtgcactgcctgtgggggtggggaagccggccacagctcggccacca

SEQ ID NO: 62476 - DNA, 767 bp, Bovine  19866880526907
gggtcgcccgctcctgttctcggcccctgagtgagtagctccctcccgctcactcgctggtctggtcgtgggggaacctggagcccaagcgctgcagtttcaggagcccctgtcttgccctgacccggtggcaggcgctccaaggggagtgagaccccatagcgcgtagatgctgctcccagaacgctggtcgcctgctcagagggacacagcgctggagacaacaccccacactctcccaccaggacccgccccgcctgggtgacccccagaagcagctgtgcccgggggcccctgtccttggcggggcagggagagcttgtgacagccaagcctggcaccgagggggtcccagcagggagacaggcagggagacagcgcccccagacctcccctgtaggggaagccggcgggcccctcgcagggctgggactgagggtcttgcccgaggtgaccgctcctgcccgccctccccgcagcgccagcacagtgggcagcttcaaccggcagtgcctgtcctgtgacctggtggacaactgcacctacttcagcgcctccttcagccccggtgccgacttcttcctgctcaagtgcgaaggtgagttcccaccgccatgggggcgtgggtcgtttttagccgctttgaggagctccgggacccccaggacaggaagggccgccggccgaggacatcggctcacggagcaatgttcctggatcacctctgtctggagcattgttgatgttttacatcttataaagggtta

SEQ ID NO: 62477 - DNA, 1642 bp, Bovine  19866880541469
tcttgcggtagaaggttccataatctgctcatctgtgtgtcccactccaaaaaattctagaatgttctaaagattgtgtgtacttgcacaagtatagcaggagaaacgattcagagagaagcttcatgtgcagttatatggaaaggaactgaatatatttcaccgtatttaatggatccttcaacgaaacacaggatatatttttgttggagctggtcagttcattttacctaaatgtctatcaagagctaatgagttccttggtgtttcatgtttcttttttatctcctctcttgtagataaagaattcatctaccgagagcagaaaggaagtgtgatactgcggaatgttgaaacaaatacttctacggtgttaatagaaggcaaaaaaattgtaagtactccctttaatgaccaggataatttcagttttcccgccttcgagtcagtaaagcagaaaatgattttaggtttcaacttttagtatagccaagcagaagcaataaatttataatactacagactgagcagctaaagataatgtgagactgaaaccacactaatttaataagatgaaagcatggtttctctaagtgtacagaaagtttctctgcaggtgttggaaacaagtgttgcataccacttataattgaaagacagtcctaaggctttgcacatttacagaacaattgggggtaatgcagagaatacttcaggatggcttgctcgatctcattttttaaaaatcgcatcctcacatgcacagggaatattaatttaggcactgacagtacttactctataatgacattaagtgatgtttatgctttggaacaaggatggagtcgatatgaatgccagtacttcatcattgggaatacctgttttcccaaagataatggcattaagatctggagctcttgtacagttaatggtatttattgaagaattgactgaagttatgtaccagaaatcaatttaaagagcatcaactcttttttttttttttcacatatgttcacgctcatttttagaaggaatcaatcttcagctttagggagcctatccttttctcgtacaatatgctgaaaggaagtcacgggaagaaactaaggcaagtctgttaaaagagagacttgaaacagaccaagaatttgcagtcagaacaatcataacaggcatccggtgtgaatgagaaacacaaggaatcctggaattctgggatctggggattagagcccatggtggtggtgttgggagggggtggcaggggaagagctgcctagatttacagctaaggatcctgagcccagtaagggagtgagcttgagatccctgggtgaggactcaggctggtccctggagcctccatcccagacaagaaaggatgagaggaccactccatctctgtgctgccccacccgccacccacacaaatgctgccacaccttctccagaacacgaagcttgccttttgaacactcttcatttcttttcggtgtagtgacaccttgttctttaaaagtaagcattttagtggtgtttagaaagaaatggatcccgccctttacagagactgtttgcggatgtgagggaggcctggaatggctgtatgacggtataattcccaaaacgacaggtt

SEQ ID NO: 62478 - DNA, 2367 bp, Bovine  19866880546200
aactgggccccggccccttctccattgtgcctgtgtttcccacgtagctcagtcggtaaagaatttgcctgcaatgcaggagacctgggttcgattcctgggttgggaagatcccctggagaaggaaatggcaatccactccagtattctggcctggagaatcccatggacagagaagcctggtgggctacagtccaaggggtcacaaaagctggacatgacttagcaattaaatgaccacctccatctcttcccagccctgctccacgggtcaggtccctctgccaccccagtctcggagcccctacggagagactctgacactcccacaacatcaagagattttgtgtatcgtctagcaacttttaattttctgatcaattctatgcctttattctccttttgtgggctacactcccaatgcaaagatgcagtctactagggagatgccgaagacatatgctctgtccatggaatgcagttatgcagttatgaatttctgaatggcagagcagtccaggggggtatcaacatcacttccgtgcattgtcacacacacaataagctgtcacaacacagcctggtgctgccttaattgtcacagataatgatgatgatatacggcttccattaactccgccgtgtcaagcagtgttccccccccacacactcccactcagcaattcctatatatggaaaaggaaatcaaaatcacatcttcatgaaacagttctgtttaaagctgaaggaaacacatctaggtctccaaggaagtttgcagagctttcttgtgaatgagagcagtgacttcaattcctcacacagcaagctggaaatgtgctcgcagataaggtttgcaaagaagcaaatggttcttggaaatactgatgcaggaattatgtgactacttgaagtcttttgtgtgtggggttggggggggggtggaggtagaaggtggcattacagaaggatacagggagcaaaggaggaggagaatcagcatcccgtcctggtctggtacagatcttccctggagaaaaacagagcttaagctcctaccagcatctctgccttccctggatactaagaactgtcccccattgcccgactgtagaggaccaatcactggggtgactgtcctaaactccagactcagaaacaagaaccttgtccctggggccaacatccatctgctgtgtcttactccccagtagtgtgaccgcacatctacacgtcatctgctcactaatttcaccaagtgatcacacagaaaattatcttgtcatttttcagtcaagaagcataagaagaaaaaacaacaaaaagcaaaaaacccacaacttaagccaggttgagggagggtcttgtacactgcacttaggagatgtttgttagtgaccagtcagaaagagatggaactgcatatcagtatggaagtgatgctacttaaaagcaatcagatccccacaatttttgaaagtctttattgaatgtgttacaatattgcttctgttttatgtgttgtttttttggccatgagacatacgggatcttaactccccaactagggagtgaagctgcaccacccgccttggaaggcaaagtcttaagcacaaagttttaaccaccagggaagtccgcatccccagaattttagggccagagagaaccttggagtcaaacaagaactcagtttacaatagttttatacaactgaccctcttcgtgaacctgctcttcattcgtaccatggacaagctactgtgaccacatctaaatgatcacacatttcaactgggggggtatgtctaccctcagtgaactttgagaacttttcagatcttacctgagttataccaggcaagccaaacattagcaaaatctccacagtacacctcgatcagaaagtattctgaatacgtgcttagatgctaagcattgtaactagcgatataacaccaattttgcattctctttagtttaactgatgtcctaattctgcataacagtggatgctggcatcaaatgaaaaaaataatcattccaaatgacttagcattcaaagtatatccccaaacagtctcctgaggaagaatcatggctttgtcccagcgtcatcgccagaaagctgtgagcaagggctgggcagagaggacatttttcaagtggtagaaatagctcctttctgatagaattttagattttgtgttgagctttgcactttaaatattgactgcagcgactagggccagaaattttacacacacacacacacacacacacaggatttctgagtcctaaggacacaaacacacaccaataagcataaataggaagtatgtcgatgttttctaaataaccaaggat

SEQ ID NO: 62479 - DNA, 1080 bp, Bovine  19866880652041
ttgggatctcctgcattgcaggcggatcctttaccaaatgagctatcagggaagcccgagccttaaaagggaccagtctaatacaaaaaatcacatgcattttgtgcaccacaaagcagtaagttatcacagatgagtgggggcttcccagggggctcagtggtaaagaatcctcctgccaaggtaggagacctgggctcaatccccctgggtcgggaagacccccctggaggaggaaatggcaaccccactccagtattcttgcctggaaaatcccacatacagaggagcctggtgggctacagtccactggggtatcaaagagtcagacatgactgagcgaccgagcgagcatgcatgcacgggaggacattctggaggagacaagctgtatgggcagaaatgacctcagtggctgccagcagtgggggattttgtcatgcataagctatcctgtagctgcaggacagccctgcctgatggcaatgttaggcagagcatggcccgtggttccctacccgggacccccctccctcaacccctcccactggatcccattagtgattcccaccagcctaattcaaccagaagccggaggcaatagagcccctgtgacaggtacggtggtggggcgggtggtgccctggggaaagttacaggaagagaaatagaccaactcagtagttcggcaagacttccgaaggcctggcatttggcttcgaacctccatcaaggattccacagagcgaagcagagactacagagtctgcaaattaaatctgtacatgtccaccgaaatccgagttgtcatttttgcaaaggtgctaagtaggctttgaggaagagggttgttatataatagatgcaggataagaaggctgactccaaagggaatggatttcagcgtgattgctgagaattactgaattcagcagcaaaacacacagccctcttagaatatttcattttcaaaagcctctgaaaaagcatttgggcgaagctttcctaaagactagaaagaaatatgatgtcgagcatatattttaactcagttctgctaagagtgggtaagcatctcag

SEQ ID NO: 62480 - DNA, 3232 bp, Bovine  19866880764359
ggaagattccatagtacattttcacctactcgaatctgaaaggttaaggttaagatatagtgacttaagtgatagaactgtttgggttccatttttcaagactccagaattatgggaattccctggcggtctagtggttaggactcagtgctttcactgtggttgtccaggttcaatacctggtcagggaactaagatcccacaatctatgccatgtgggtccccacccccctcaaaaaaaagtccaaaatcagaactggataaaatgtattatgaaattggaactatttcatcgactcttggcctgaggctgtgttgcttgttcctctgtttgggacctgaactgggcccttctcgtgggacaccaggggtgccgtgcatgactctcaagcctcagtacctggctgactccacctggcctgcctcccgccagccaccagcaggagtgccggggggtgcttcccatgtggataattaaacccctggctccattccttctataggtcaagccaaacaaccccagttttatttaaaattgtacaaaatgatgtgggttttttggtttgtattcaaggagaacaaagtgtaacattagtttaaaaataaaagatgtaaagttagtttaaatatctgatggctggtaaatctaggaaagggaatggtttgaatatcgcgttaatgatccccacgaggcagtcgcgtcgtctctgctggcgtgctcagaccctgccgtcttgtctctccccgcagctgtggtcggcctgctgtacccctgcatcgacagtcaccttggagagccacacaagttcaagcgcgagtgggccagcgtgatgcgctgcgtggccgtcttcgttggcatcaaccacgctagtgctgtatcctaagacgttactgttaatgcgtgtctgtcacgtcctgggtcagttgagctgatctcttacaagcatgatttcaaaccacgttgctcactttcctctcagcagagctttcaaagtgatcctgaaaagtcctttcagttcatttcaggagacagttaaaatgaccctgggaacagagtggatatctttagtctgtccctttcttggtcactacctgttggatcctccgagttggtttggtaaattccccgtccatttctgcctcccatccttccacggtgcagacctggttcctgtggtgcagtgagacgttgcgggagcttcactcttcttggctgacccttccagaaggcagagcagaagcccgtctgcttctccgccctccccggtcatgaccagggaaggcccagcgctgatcagaggaggtggcctcaggaatagggttcccagtggaggtcacattcaaggtcaggttctggcgtccaccagtgggctgcctggcaaaacacggtgcagttttcaggaagacgggccatggtttaccaggcgtcaagacatttatagtttctttctgacagcgagattatatttttaaattctggagaaagctgtttttagagtttctgctgcttaaatctgctttaccctgattttaatgataagaatgtcaagaaaaggtattacaagagagcctggctctgacacatttgttttgtcccctgttggtaaagtagtgttgtgaaggaggccagctgtgtccccatcagctgtgaccgtgtcgtgttgaatgccattccaatgaggtgtctccttgcagacacagagtaaagactgtgcttgctcagttcaaactgctaataagaacaggaaataaaagtgggactgtggatgacttactagaatatagttgtttcgtggttgaaatgaatccaagcagggttttatgcatagtttttaatacattgactggtaaagtcaagttttcgacgcagggatcccagagatgccccaggtcatcctgatcaagtagccttgtatccagcacatgctctctgcagctcactgggcagcatctgaggctggagaattaggtggtgcacacgtgtaggctccggggctcgcttgtgtgtctttgaccgtgttagaaattgttgtacttttccttaactttgcgtcaccagaaactggattttgccaataacgttcagctctccttgacattagcagcgctgtctctgggcctctggtggacatttgaccgttcaagaagtggcctggggctgggcatcaccatcgccttcctcgccaccctgatcacgcagctgctggtgtacaacggagtctatcagtaagcacgtgcccccaagtgtcacctctgcccgggagctgtcactccagttttgctcagaatacccatgaagctgagatgccgtgttgtttgtaattacatggcatgagcttagacgtgaaatctttaaaagcacttcttattgttgattcacataaaaatgcaccatctgtaatttaaggacagccaagccacggtggagagctttgcattgtccttcagcctcttaagctgtgtccaggtccttgtgacccacgctgggctgcagcacactgggcttccttgtcctccaccatctcctggagctcactcaaactcatgtgcgtcgagttggtgatgccatccagccatctcatcctctgcagtccccttttcctcctgcccccaatccttcccagcatcagagtcttttccaatgagtcaactctttgcaataaggatatgctatataacacagggaattatagctactgtcataataatctacaataaagtataatctgcaaaaatactgaatcattatgctgtacacctgaaactaatataatattataaatcaactatgcttcaataaaacacttttaaaataaaaaattgtgaaagaacacaatgaataaagcactggaaataatatgcaaagaaaaaaaaatccaaaacaaaaacacagcaattgctgttttgccttttacttgcattttgcatcacaaaactgaaattaacttcatgggcggggcaattttttaatacattcaattaacacagacttttcattttcacagtatacttcctttctctttgacattcatctattaataaaaatgaaaccataccaatttgaactctaaaaatctaaacctcagataatgcagggtacttttaattatttcaaaataagatcgctgccctcctttagaaagaatgatcaaaattcttttctcttcttcactgtgtttgcggaaaatcatttttcctaggaatgccctgggtatgcacagtcttttaaaaa

SEQ ID NO: 62481 - DNA, 2873 bp, Bovine  19866880809349
tctaaacatgctgtccgaaacaattacatattgacaacaaaagagcaatttaaagcaaggatacatttcagcctgaaatgggagacaatctgactccaggaactcggggaggctggaggcagttttagaggagagggttgtgatgtcagggcctgaaggatcggaaggatttggacacagtcgcacggtcagcggcacctacgtttctggcgtgttgtggggatggggtaaaggatagagcgagcgaagacgggaccaccttctgtctgcgtgcagtggcggcgcatcactggtcctccagggaagactgcttcctgcaactggaaggcatcacgtgcatccttctcccacccccctcactgcgggcgagacgcatggatcacagcgtcctcccccaaagagcacaggcacactttaaactcagagctccaggaagccattagaattgatcagagctggcacagagtatgaaatttactttctgtccagaggcagggaaattgtggggagagtgattaattagatttggctgcataatgggaggccttggttcccccacgaaggaagcctgtaggactttctgcacaccgaaagaggtatttacacgcaccatttcaatatcctacagaactccataacctttccatgaaccccatgagtcaagcattttatttccattatatagacagagtaatagtgcccagagaagcaaagtaactcttccatgattacacaggtaaagaggctgacgggggatttattctcacatcgatttgattctaaagctcattcttttgatagtgcttgctaactgcttgtaattcaggggaagaagggagagaagcagggagacttcgccgggagggagcaggagaagcagcttaactaagatccagctccgcaggcctcggagctgtctgcagtgctgacatgctgcgcctgccagtaacggtaggatcctgccctttccgagagagagtttagtctctaagtcgtgtctgactcttccgtgaccccgtggactgtaatctaccaagctcctctgtccatgggatttcccaggcaagaatactggaatgggtagtcatttccttctccaggggatcttcctgacccaggaatcgaacttgcatctcctgcattggcaggcagatgctttaccacggggccacctgggaagtcttgcaggccttgctagaggcacgtagaatgccactctaaggacgctctttctcttatatttcagcctcatgttggcccttcctaaagatacacagacaatcctgttggtgcaacccctggcagctctgcagagtgaacgtgtccagcggcagcgtcctggaggaggaggtgttgggccgctgacactgctggggattctcagcgccaccctcgcaaactcgctgccttgaatctcctcacgcatcaggctcaactcacaaaaggcacaggctcccgaagatttaatgtgaggggcatggaacataaactcttgaaacccgccttcactctctgagaggatgccacacgcccaccatcacagtcaggtggtttctccactgagccctccctcactgcaggcctgccctgctccccgccaggccccctaactgactccaagccctactcaccccttccctgccctccgctctacacacacacacaaaactaacctaagcctgctgtttgcaccgagtctctcttaggcttggtgttcagcgtgttcttcctgtaaagacccacggcactcagctggggattaggtcttccacaccccaggctcaccccagacccccccaatcccgtctttccccatgcagagtcccaggagaacagccctgctccggcctggcctggcaccccactaattccaggaagacgctggctcactgaaaaggtcaagctcatttaatgattcacccgacctggaatatctcctctcagtctccatctattaaaccaaacaaaataaaacttactcgactataaggctttgctcaagccagacttcctttttgagattctttatggcatctcttcttttgtgttcattgtttaaaatacccatttgaggcatttaattttatattgttatataagcaaggagttccaaccagtccatcctaaaggaaatcagtactgaatattcactggaaggactgatgctgaagctgaaactccaatactttgaccacctgatgcaaaaaactgactcattggaaaagaccctgagctggaaaagattgaaggtggaaggagaaggggacgacagaggatgagatggttggatggcatcaccaactcaatggacatgagtctgagtaaacgccaggagttggtgatagacagggaggcctggtgtgctgcagtccacggggtcgcaaagagtcagacatgactgagcaactgaactgaactcaactgatatgtcctgagtcccttccttttcaagaagattttgaactccttaaggatagaaaccatgctttgttgctcaatacagcacttcactgttgacttatcttttctgcttccactgaaagcaaaacaagaaagccttagaaattaattgcagcaagtcaggttgagatgagattaaaaaaagaacttattgagcactgagaattgtagatcgttgaggctacagacattacttttaagagagaaattaaaatcacaagggcattttaatcacctgagtgtcatggaacaggtcttatctttgaaaaaattttaaagggaattttattatggtaggggttatatcattcctctccttgtaacagaaaggatttgagctggctagaaagtacagtctgataaaatttaattatgagactacaaatacatattggggacatattacaatacga

SEQ ID NO: 62482 - DNA, 1186 bp, Bovine  19866880895249
cagaataataaaatatgcactttactcatccagataagtgtgtggctgctgtgagggcaggaatctgcagagtcagtggggctcgtggcctgatgtcacagacggccttgagggcacgtttcccagtgtgggggccgcttcagtgagttagggggtttcctatggagtgcatgtaaacctcggctcgagggatgggggctcctggcactcccctgcatgtcctcctcctcttcctcagcccttgatattctgaaacgttcaacatgttcaaaagatcctttctggtaaacaaaacaaatcaatatggcatctgactgccaacaagcctatgggccgtggagtagcttagaatttacgtaagctctgcttctcagaactaacatctctgagtgagtcaggcaccctgcaaacgctttcagggtatttttttcctctaatgttgccccctaccgttttttaaaaggagcatttggaggtgaagcagttaagtcacagatgagaaaaaagcagccttcagagtttactttcccattattaaaaaggagctgagattccttgcaggctccaggagtcgaagcatcagtgtatataaccttccagggaacagcactcagcagactgagctgtacatcaaccatgattgatttagaatattggggccctgttatcacaccaacacaattccctgtaaatgccctaaagaaacatttcttttcaaccaatctgctcaagcagaagcttaccttgaattgcaaggcaatgagttcttttattaggaagatactaaaaaagatattctcaatttcctggtgatggagttttaaagaagattattcctagagcgggttgaggctcttcctgctgggaccccagtgccccgcccctcgctgggggccatgggattgttgccctgacccctctgccacctgtagggttgtctgtcgcaggacagcagaagcgtggtggatactgtccgttttgtcccgtgacaccctcgggtgagcccaatgaaacctcaaggtagattctcctggggcccggaatgcagctcagacccagacccatgggtgctctgagcagtggtgaccacgatggaataaacatgaggcttccggggagaccacagggagggggacggttgtgatgagtgctccagcgttcagccaggaagccagctgcacagaat

SEQ ID NO: 62483 - DNA, 660 bp, Bovine  19866881107712
ctttccgccctgctgcatgctgggagcgaaactgcggagattaagggcttcgctgttacaacagcacttccactctctaaatgtaaacagcctcagccccatccagcagaggcgatcacagctgtcgaatccatcaccagctgcaggccctggttggctgagcttctttagggggaaaaagactgtcctgcgatgaacaaaaccagaaggtgtgagcccgaggatgggattctccgttctgggaaggggagaccagcaccctgtgttcagagtctcagagtgagtctggaggactcagaagaaaccacagtgccctgacacccacgtctatgctctttgctggcccaggaaggtcctgacaaggttgcagatggtggcacctctgtgccaagggaggctggagttctagccgagatggcctgatgactcctgaggggcctggctctgtgttcccacagcctcacctgcagactgacccgctgacctgagaacagggtctgcgttattccactactttctggatgaggggagccccagtcagcagccttcccggggcagacggcccagcccatgctccttaccacacagcagggatgcagcaagagtggggtagagaccccagaaacctgtgcaccattctgctgaaaacaccattgctgt

SEQ ID NO: 62484 - DNA, 1568 bp, Bovine  19866881245549
cagagcagcccagagccaaggggacccttttgacccccccagaacttgttaaaggagttagaggacagagtgccccagcgtgagcagtgtgagtttctgtcaccacggaagtcacaagggaggtgatgtatatcggttgggattgaagcttggacaaatgactaacggtagttccgtcatttaaaaaaaagtaaacctgctgacagattcagctccgcaaagatgggaatttaatgcagtgtaatgggacacaattaatcccccctgtttactgccttgctcgcagcacgggtgagagccacggctccacgagggggtggggagcctatgaacgtatgcagaggctgtcccggcgtggcttcccgcctaccttggggtagtggtagggctttgcggtggggtagatggagccggtgtaggtgggcagctccatgaccggcacgcgtgagtcattgatggtggcgtaggcgagccgtgtaccgtccggagaccaccagtgggcaatgtgggtcttcaggatctcctctaaggaaacagacaaagcagagacgtgtgaaggcacgggggagggcacccgggagccccccggggacaaatgcctcctcacagcctctgaggaggcctccccgtgcccgggtgcaccgtcattctggacatacctgggctgaccaccgaaccccagcacagcaaacccagtcaatcaaggcccgaccgagcagaggcgaaccatccaaaaagcactctcctttttttgcacaatttgagcacgatgagcctatgaggtcctttctgagttgacttactattgctgtgtgtgggttattactttaaggggatcagaaaaccaaaatgagaggagatccattcgtctcaagcagggagcccccagcaggaccaagtgaggacataactgtttggagcttgaatcccaggaaatcaatgagcacgggactccaagggctcaggcccgcactgaggccccaggcacacggccgtgtgggaggcgctgctcagagcccggcgggcccttcaccctgacggaaggaggcgatcgcattccctgcggcagagacccagaatggccccctctccagggagaccgagatggaaacagcgacgggcccagcctccaccgggcactcccacggctcctcctcgtcacggagtctgggttaactagtgagctcactggggaggagtcccataggatctgacgtctgttccggaaagcatgatcccaccttgccttctgaacaagccgagagagggcacctcccaggggccactcatcagagcgctggggttggagaagcacctcggggctaaacagctctgaggctggggtcctccttggacaccgtgtgtgtgttttattaatgaattcccctggattcgtttttaaaataatggtcagcacagctctacaaccccccagcgtgagtcccattccaaggtcattatttggggtagaccacaaactggctctgagagcccgcagggacagaaaggcagtcgaacagctgaagtcacacagaggaagcagaatgagggactcagactccggggga

SEQ ID NO: 62485 - DNA, 1271 bp, Bovine  19866881330461
cccctatgttctgcctctagcacgtgtaggtctggccgcatggcctgtctctccgccagctcacaactcccttgaggaaagggtgccattcactcactcactcgaggtttcatccacttaatacttacttactgagcacgtatcacatgtacatgcacatcacatgtatgcacgtcacgtgacatcaatctttctaaacacaagagagaaaacgttctgaacagtcagtagagtgaaatctcctaaacctcagagcgcagtcgtgacggctcatgggccgggacgtcacgctgtcttacggcccttcagtccgcgacactggtccacctgggcactgtatcgcactctccaaggcccagggtccagcaccgtgcacccggatctcaaggaggacgaccgccgtgcccatgccactcccgtccctgcagcacctgagcccgtgcgtctcacgcctctcccatgtgaagtctgccgcgtgtgcagtaaactcggaagacccaaccttggccaatgcgcccgcaggccagtgagcggcataggtccctgacggctctcattccggggcggcgataacatccagtcaacacctctgctcctcggccccttctgtccctggagagtctactagccctgcctccgtgagcaggacgtgagagagccataaaacatgcggagtggggcttccaacctgcctgctgcactcctttctcaggaaggaggtgactggctacatggctcaccttctctctccctctccctgccctccccccatgatcagtggccaaggtccgtgaccacagcatcgggaacccacaaagacccacatcacggtctctgcaccttgttgcaatcagcaaagcagaaaggccaccagccgtgcagcgactaggaccctggtctttgggagcatatggctggcaggaattcactggggaatcaccagagacttctgggggtgccagcaaagcgcaggcagaatgtgtgcaccaccaggaaacaagaccacgatgcaacccgggtagagatgagaccccccaaccccattccaacagcgcccctggggtgctcaccgcacggcctccatctggtccttctcctccagggagcccagcctccgcctcacctcatgcagcagcctggtgccctggaagccgctgccgcggccatcacacttgaccaccacggccccatggctgctcaccattaccgtctcccaggtcactgcaaactttctcggccacactctggctcccccgggggtgccgtccctg

SEQ ID NO: 62486 - DNA, 450 bp, Bovine  19866881610672
tggtcgcacagcttcttcctgaataattatcccgcacagcactgtcaacccatcagcaaggctgcccaggcgaggagcaggaacagaaaggctcactcctcccctccctggaagtcccagcgcccgaaacagacagatggggagccacacgccttgcttggatcaccctgtgacagataataaaacacactttgttggaattttctacaacaagcctttattactttaataaatcacggggggcaatcatcaggaaaagagctgtgcttttccagccagacttctaagaggaacatttggcttcttttgttattatggggccaaatattgttgctaaattagtctgttttgaatactaaggaagctttctccctcctagaagtgagctcgtctctggctgaaaagctctcaaaattacacctttgtttttaatttgaattattatcactg

SEQ ID NO: 62487 - DNA, 1276 bp, Bovine  19866881620637
ctctggacactgaggtccaggaaagcccctgcacttggcgagccgggagcttcctgcactcactggggtcgcagagacgcggttccccccagttctctgggagtcctgacccccgcaggcccggccacggcctctgtagtccctgagcctggatccgtgttgcggatccgaacaagcagagccagatgtgcagagtctactaaacagggtgtcgtccgattccttccctgatactctgaggacaccctgtgccgtcggagctaagggtccggccgcgtgggcggccgggggtccccgcgtctcccgggcgcccggcccacacgggggcggtggccacgtggctgagtcctctgcccctttcagatctacccggacgagagccactacttcagcagcgccgccctccagcagcacctgcaccgctccatcctgggcttctttgtggagtgcttcaggatccaggacaagctccccgcagtcacagcgagagaggacgaggaggaggactgagccccacgacgcaccgcctggcccctcctgggacagggcacgctgccccgggcaccccgcggcctgtcccacagaggtggggcgcctccttcatcgcatgtgtgtctcgggtctgaaggcatttctgctccagaaacaagctccttgccaagtggaggtgtgtcgccactcatgaggggcttcctcggagcctggaaccaccacctcctcccctccacagcgtgaccggggcctccccatgaccctcccccaaggaacaaagcggagcctggatggcagagcagaagctggccctggaactggagctggcgagcggcagcgtgggacccggcctccccctgagtcccacgcccacccgggagcatcacccccctcgtgacggtcaccgcgccatggacctaccagagcacaattattttcacagtacctgtccccagattggcctgctcccgtctgtaattaggagattccgcattttaaggggctgtacaaagtgtcactgtagctgatgctaatggttaaccttctggaatttgtttgtatttttctatggtttttacctgacactgtctctggtcacggggttgttttgctgtgtgctttttttttttttttgctttgctttgttttgcttggtttcgttcagtcagtatgtaggctttgcacttgtttggattaaaaaaaaccagatcagaagtaacgctttctcctcaaggtcgtctctagacttgtggggacatttcaaaaatacgcaaacgacatccag

SEQ ID NO: 62488 - DNA, 2870 bp, Bovine  19866880234641
agtcttctccacaccacagttcaaaagcatcaattcttcagcgctaagctttcttcacagtccaactctcacatccatacatgaccactggaaaaaccatagccttgactagacggacctttcttgacaaagtaatgtctctgcttttgaatatgctgtctaggttggtcataactttctttccaaggagtaagcgtcttttaatttcatggctgcagtcaccatctgcagtgattttggagccccaaaaaataaagtctgacactgtttccactttttccccacctatttcccatgaagtgatgggaccagatgccatgatcttcgttttctgaatgttgagctttaagccaactttttcactctccactttcactttcatcaagaggctttttagttcctcttcactttctgccataagggtggtgtcatctgcatatctgaggttattgatatttctcccggcaatcttgattccagcttgtgtttcctccagtccagcatttctcatgatgtactctgcatataagttaaataagcagagtggcaatatgcagccatgaaaagcctacatgcaggtaaactttatgtggcagtgtcgtggggctgcagcgcccaggtatctgatcaaacactgcatatttctgtgcaggtgtctctggacaaggcagacattccacaggggggacgctgagtaaagcagactgccctccagaaagcgagtgtgccccatccactcgctcttgggttctggacttgcctctgcagccacatgagctgattctttaattaaatctctttccacacacacttcctgttggctctgtttctctggagaatcctgactaatatacctaagagcgggcctcctcttggctctgggacatgacctttgtttgactgaggtcgtgttgttgccatgaaagaacatctcagacacatcctccctctggctggcacctccctctggcactggggaaagtggcccttggcagacaccaagggaaccaccctttcggcttggcagatccttcccctccatggggtccccacctgggcggctgcaggaggcagatgtgttgactgagggtgctggtcactgtcgctgaactctggggggtgatgagtttggggccccctggagaggacactgtgggaggcagggagggatggctgtcgggaagggtcagcttggcccctgagcagctccccagccccctcaagcccctgcatggtgtgagcttatggtctagggagtcaggagctagagccaggaaatggcgatggtctggccggggatgcagccagattagggcagagcagaaagagcacatgggaagcacacgtggatagcagtcgcctccaactcaggaagatgtgaccggctgcaggaacacacggtgctgggtcctagaaaaaggcgaaggtcgatcgatatattggtaaattgggaggtgccctgcaaggtaggcagttatgtatcagagaagcctggctggcttctatgatctctgctcgtcaataggaacattgtgttggaagggagtcacaataaaaagcttctggagatatttaatctttatttgtgtttggaatgctgctgagtcataatcccagagctgagattcccacggcagaacatccccgtctcccttcatttcttcggagggagataccgtctgcattaagatacgaatcaaagcgctcagggcttgcctaagtggactctgctcatcaaagtacctaacttggtcattgctgtggaatttcatctggactgcaacaaagtccagaggggagaaggggggctgggaagagcgtggcggctggggagggagcacgccggatgaaggcaaatttcacacacggatattcagtgagggtgcatacatgtctgtataaatactcaggctaccccagtttccctgacctcctggttctgtagtttcttttagctcaatattgtcatatatcctttgggaacaaatgtgaggagggaaaagcatatatatgacatatatgtaagggcttcctggtggctcagtggtcaagaatgtgactgcaatgcaggagattcccgggtttgatacccgggttgggaaaatcccctggagaaggaaaatggcaacctgctccagtattcttgcctggaaaatgccatggacagatgaacctggagggttacagcccatggggtcgcaaagagtcggacacaacttaaccactaaacaaccaccacagacatacgtaaaatctcgttcttccttattttttaaaagccacaatacttgtggctgggcagaattttgacagtttgcttcccatctcaggctggcactggtagacgtctgtggggcagtgagagctctgactggaggagcccactccttcacccgccctcggccacacggagggaatgtccagacaaatgccatcctggtctggctgggctcctcggcatctccgtgtggatgacgtgccaatgccgtgcagagcagggccccagcagatggcgggcggccagtgggcgggcaaggccatgtgacgtctgggcagcctggcccctcaccttcccagaggtgacagctggaaaccaaccctgtactttccaaggttggggggtcagcccctccaggtcgggactgacagatttccctgggaaagtgccttggttctccttgggataaatgcttgttttctttgaaaatgcattttcatagtctggttaacatttattcaaagctaaggactgtaagaggcggagagaaaaaggaaaaggaagacgtgggctgtggggaggctgtgcactggtagagtctgaaccttttcactccggcttccaggaagccaatttcacagcaagatcagtt

SEQ ID NO: 62489 - DNA, 1733 bp, Bovine  19866880488123
gagaaacaaagagtccgtctcctagcagcttgtacatgaatgttccagcagcattatccaaaagaggcagaaagtgcagacagtccagatgtccatcctctgatgcagggctgaccaggtgctcacagtggaatgttacgtggccatacaagtgagcgagttactgatctgtactactacacggagaaatcttgaaaacatgatggtgagatgaaagaagccagacacagaaggctgcgtactgtatgattccacttgtgtgaaggggccagaaaaggcagatctgtagagagtgggtaagtggctgcctagggcgggatgggggacgggtggtgagagggagtggggaccgctgatggcacagggtctctttcttgggtgatgaaaatattccactcctgattgtggtgatggttggacaactccgtgaatatattgaaaaccatggaaaatgtacactttaaatgggtgaattctataatatgtgagttacatctcaataaagctgttaccagaaaaagtaaggaaacccaaataggtgaacacctcggccttcagtcatgtggccagatgtgtagaagctgaggttcaaacccaggccacaccgcactagcgtctgtggtcacagtctctgttctgtgccatgttcttttcatcaaaatctcagtttccttaggctagttgctttagcactgaaggtccagaggtaaagggtatgaacacagatttgcattttcagtccaatgttttggtaaggaggccagttagggggcttttggacgcacagactggttcctgagatggagagaggaggattccttaagggtagtcaccccaggattgagaagtcagttaactgtgtttgctcttcatcagcttccagttacctgtcctgagcagttaaccgtctcagctgttcatggggttcgggttacctgtcctaagatagtcggttaactgtcttctctgttcatcgggttccggttccctgtcctgagatttctcttttttcaccgcaccggggctgtttcccagattgcccagcacaatgagagggataccctgagtactgtctcctgaatgcctgtttccctgaatgcctgttttcctgaacttcttctcatcccagaaggagaatggacaaagcaacaaaggtaaatcatctagattaaccgtttttaaataacaacttcgccaactcaagttttaagtaatgaaatggagagaattccacagacttggcgaaagagggcttggaaagtctaaatacttatgaagtgctttcgcagtcctttttgtctgcattccttgaggcccgcttctcagggtggctggtactgttagctttgtctggtatgtcagatgactaagacggggagaatccactcaggtgccagaaaatgtcagggcagcagcaggtagacggcccagtgcagcacaagtggggagagagttatttccgtgtctttcacctttaccttgaactagtctagtctaactgggtcttatctcagcagcttgtggagtgtccattcttataaagtgtttccatttttcacattcaaagtaggaattccagtcttaaatttttagcataaactgatggtttttccatgatgagtcatttttaccagaccccttcatttttcagaaagatgagaaaaattttagttaacgtggtggccgcaagtggggttctttgtaggagctttgtctctgatactacatgatta

SEQ ID NO: 62490 - DNA, 794 bp, Bovine  19866880804288
tgtgaggagatatctcattgtggttttgatttgcatttctctaataatgagtgatgttgagcatcttttcatgtacacagtggagtattactcagctatgaaaaggaactcactggagtcagttctagtgaggcagatgaacctggagcctgttatacaggatgaagtaattcataaggagaaagacaaatactgtacattaatgcatatatattaacacatatatatggaatttggaaagacagtaccgacgatcctacatgcagggcagcaaggaagacacagatgtagaagacagacttttgaactcagtgggagaaggcaggggtgggagaatagcatttgcgagaatagcactgagacacatacattaccatatgtaaaataaatgaccagtgccagttcgatgcatgaaacagggcaccgaaagccagtgctctgggaccaccgggaggtggggggaggtcaagatggggggaacacatatatacctgcagctgattcatgttgatgtatggcaaaaaccatcacaatattgcaggtaattatcctccaattaaaataaataattaaaaatattaatatctgtggaataaacaagttaatggcttttagatttgagatgcctgctgagaaagaaactgctgagcacatgattgtcactttcatggcaaccagcaagtaaatgttcatggctgagctaacctggtctttcaatctactttgttaagagggaacaatatttatcttaaaatcaatcttctggattagcacagaaaggcctttcatctcca

SEQ ID NO: 62491 - DNA, 1924 bp, Bovine  19866881048733
aaaaaataacatctggccttgggggaagctgagtgaaatatagacgtgctcattccttgtcagggttgtcctggctaatcctccacagcgagagtcaggaccaagggggaggataagcccagaatatgctgacttgagctcatcacaaagagtcaagttttggccccaaatgacaggtcctttctttataattttccaactaaaccctttcaaggatcttctgaaaattctagttatcacaacaaatattttcacacactatcttctttcttttctatttaaaacaaaaaaagtttatttatgtgtctgcactgggtcttagttgtggcatgtgggatctagttctctgaccagggatcaaacctggggcccctgcattgggagtgcgagggaagtccccatacactatcttcctaaaataaaaatctgcacagaatggcaaaaagttcagaaagctaaaagatctctctgttctctaatttacagtagactataactgtagttctatagttatagtctactatcactttttaattgtagttatagtctactaaaactataacttagctatcgtctactctaacttccacagggaaattgcaaaagttgaaattccaccattaacagaatagtcgaaccaaatgaaatttcccacgcagtacaaaaacaaaagggttaatagtaagaaaagaaaacgaccccaaagagataacagggggaacaaaaccagatctttagggaagctttatgtggacaaaaagttattggaatgaaataattaagatgttaactcaaaatataaaacggtgctgaaggcccaggcacacagatggtattttgtcatagggctgagaagccccagtgagtccgggagctgagtcctctccggggttggcaaacagcgggcctgtgggccaaggtgtctgttgttgtaaggccagtaaactaagaatggttttcacattttaaaatatttgaaaaaatattaatgacccaaaaattatatgaaattcaaactttaggacacactgaaaaaagatttatgggaacacagccgcgttcatgcatttatttattgtccatggctactttgtgttacaatggtccatctgggtgaatgaaactgtgtggcctgcaaagctaaaatattcacaagtttcctccttgtagaaaaggtctgccgatgcctgttctaaaccagattttactgccatcaactccgtgtgacctgaggctggcctcctgccttatctggatgcacctttgaaaggaaggggcctggagaaggtgctggcccggccgccagaactgcagggagcaggagcacccactggcgccacctacagcccattaggaaaatggcaggcaggaggctggctgcagtgggacactctctcacaggtctgtccccatctttggtggagccgccctcttaggttgagggctcttaaatgaactctctcccccaactaatgccatcaatgaacaaaaaacctcgcctttacacaccttttaaacagacagcccacaactccaaatagcaatacatcttccagcattcatttcaggaataaatgtgccccacaaaatagaagaaaagcacttatttccacagagaacttattaccacatctggctttttagttctgaaggaaaaataatgaaaaagctctgcagctcatgagtcaccattctcacccacaccacttcacaaggcccgctcagactcctgaaccttcatgccctaaaaaacacaggtgagcagacctcacagctgaggaaacccacaacaaaggaatgcaaatgactgggccaaggggtttgtctgccggctctgaaccaattctccctgggccaaggttcccgcccatgagggagacaggccagactctcaccccttcagagcaaacaacccggctcaaga

SEQ ID NO: 62492 - DNA, 1176 bp, Bovine  19866881241143
ttggaaagtccccaatctcttctaagtattcactgaaaaatatcacccatcccttagattgtcactgggaacaaataagcacagaacagtggctaagaaccccccaaggtgatctcatgggagccaccgtgacctattgcatggtcagcacctgaggctgaacttctgcagggccccaagaacattctcccgggtgatgacatccttgtcttcctccttcagcctttcctccagcatccgcagcacctttgtgctctgggcgaggtagcggcgacctggtaatatgacaagagatgaacaagtaagagattcatcttgtgttaagtttctgctctgaagccactttctatgaaaactgtgcatataacacatgtagagtttgggattcctttggtggctcagtggtaaagaatctgcctgccaatgcaggagatgcgggtttgatccctgtgtcggaaagatcctctggagaaggaaatggcaacccactccagtattcttgcctgggaaatcccagggacaggggagcctggcgggctacagttagtggggttgcaaagagtcagacacaacttagtgactaaacacaacaagaatgcaggtggttttatgttctagaaaacttagtaaagcatatttaatctgcaagttggtttcattcaaccaactaatgaatagaaaaccactttttctgtcatctgaacatgattcatcactgtgttcttgtggggagcactgtcttttatttacccacgatcttgagcccaaaagtcaaatcacaaggcgatgatggatctgtgttttatgagccctttagtcttaacattagaggcagccaagtagtactttctggacataccaatggcctggagaagttaggaaccacacttgggaccctattataagccttgaattgtcattagcctatggtaaacttgtatcttgatatagattacattaatttcagacataaatttcaacaatattatatcaatggtctctggcacatacgctggctaatcataaaatgtttgctaaatggatggaagaacaaacaaatgagaaaatttttggagtatcatatagtcacaatctaaaactccctttatttcatgttaaaaagagctcaaacaaatgagaatttattgaagataatggcattttgtaaaatcattt

SEQ ID NO: 62493 - DNA, 979 bp, Bovine  19866882086528
gatccaagatctggagacagtcgcttacctggaagagttctttaaatgacgggtgcgccatggggttgggaacaaaaggcagggcatagaaaggcaggaactccgtggtctggctcagggccgcccctttggtctccaggaaggttttgaaataagaaatcctttcatccaggtcctctttgtcctgcaaggaagagaggatgtctgagatctccggcttgacgccagctcaccggttcacctgtcctccccccaaggctccctcagttccagccacgtcgctgccatcctcctcgcctggcccagcctgcgagctgtctgcagtcatccgaacatcaccccctgtttcaccccttcatgaaattgccagaatatcagagaactgcatgtataatatatatagtccaagtgctgccttttcactttatcattaccattttctgatatccttaaattcatcaatgtctttcttaatggcatgacaaaacctcatcttgtgggtctatcataatttatttaaccaatcccccattattagatatgtacatcgctttcatagtacagatagaaaaaaatatttgtctgcattcctctgatttccttaggaaaggtttttaagggtgaatagtttttttttttttttttttaatatggaacgctttcaaatttgcatgtcatccttgcacaggggccatgctaatcttcactgtgtcgttccgctgttttttttaagagtatatgtgctgccaaagcaagcacttaagggtgaacagttttttcaaacagccgtttccatatcattattcccttcttttattaagctaaccaggaattgaccttgccagcttcactacttcccgggtgtaaccccaggcaagtcgggttcccacccccaccccgatgggtctccacctccccctgggcctcagtgaagaaagtcttccctggcctcacctgttaggtccctcacagcctcata

SEQ ID NO: 62494 - DNA, 1316 bp, Bovine  19866880083650
actttatttttggggctccaaatcactgcagatggtgattgcagccatgaaattaaaagacacttactccttggaagaaaagttatgaccaacctagatagcatattcaaaagcagagacattactttgccaacaaaggtccgtctagtcaaggctatggtttttcctgtggtcatgtatggatgtgagagttggactgtgaagaaggctgagcgccaaagaattgatgcttttgaactgtggtgttggagaagactcttgaaagtcccttggactgcaaggagatccaaccagtccattctgaagatcagccctgggtgttctttggaaggaatgatgctaaagctgaaactccagtactttgcccacctcatgtgaagagttgactcattggaaaagactctgatgctgggagggattgggggcaggaggagaaggggacgacagaggatgagatggctggatggcatcaccaactcaatggacgtgagtgtgagtgaactccgggaggtggtgatggacagggaggcctggcgtgctgtgattcatggggtcgcagacagtcggacacgactgagcgattgaactgaactgaatgctttaaaaacacacaaacatacaaacaaactcacaaagaaagagatcagatttgtaattaccagaggaaggggcggggaggagagggaactggaggaaagtagtcaagaagcacaatctccagtgataaggtgaatactggggatgtcatggacaacattacaagtgccattagccctgctgtatgttatatactaaagttcctgagagagcaaatcctaagagttattacacacacacacactcacaaacatttctatttctttaattttgggtctatatgagatgatggatgttcactacacttaatgtgacagtcacttcatgatgtaagtcaaatcattatgctgtacactataaacatacaatgctgtatgtcgattatgtctcaataaaattggaagaaaaaaaagaacttaaaatatacatgttactccatattaccaccatccttcatttggagagggaatgttatatataaatcggacataatcattctctgggaattcgctctttgacatcctcttacccgttcctgtagaagctccaccacctgctggacacagtcatttacatcacaggagtctgttttcagcactaattcaggggcctctggcttttcatattcagaatcaatcccagtgaaacctataaaaggtaacagatgatagagagggtggaaattaaaataggttgtttcttcagcgcaagtctctgct

SEQ ID NO: 62495 - DNA, 3172 bp, Bovine  19866880180909
tttcctatttggacccagtctgttgtcccatgtccagttctaactgttgcttcctgacctgcatataggtttctcaagaggcaggtcaggtggtctggtattcccatctcttgaagaattttccacagtttattgtgatccacagtcaaaggtgcttttctctaattcataaataagcaaaaaaaggaacaaaaggaaaatgcatgaaacaaactgatattatgcctagtatcttcttaatactactgttttactccataaatttagttctaattgtttctcattaggcctacatttgttaaactctactgtttggtaggcagagcactaggttggaaatatgtacacgaatcacacacatatcctgtctttaatcatcttccagtccagtggaatagacaggcacagataatttcattttgttggggagcagtagcagatgaaccagaaacaaataactacgaattgaacaattttgaaattagattttcttgaatgttttgaagatgcaatgatttgtatacatgtagtgtaaactgtattttccatcaattaagtgttttcctaatttttgtgatggcactaaatgatggtgtgggggaggtgtaccagctgtaaaaccgggcttaaatctctgctcatgagcagagtgaatttttgagtttcaccttcttcatctgcattactagggtgataatgctttctatgcaggattgttgagaaagaaactgcgtgtaaagtgccagcacttgcttgcagatgtagaaatcttctttgctacatctcagttgagtgataatataataacacttttggatagtctaatgatgaggaataaattttctggtgacaaagtagtaatgattagaaataagtagggactcaaatgccaataattatgggttgcgctataatgtggggccatattattgctagggaacttgccaacttccaagtaaaaagttttcaaacctgtggtgattgatatatcactattttatcctccttatcattacttcctctgtgtattgtctcaggatattacaaactgagctagaatgtgctataggggtcatctcgtgttgcctcctctattttggaactgggaatgggaggccccagtctttctgttcattagtaataggcctaggagaactcacgtgtgttgagatcacagatcttttcactatcccacctgtcctcctaactgtgctttctgcaggtgacctcctggtcatttgtgtgcacacaaacacttttctgcagtctacctggtgccttacacatcaggcttctgggtgacactgatactattactctggttggttactctctttatatttcctttccccagaacttattttcttaatttttcaaatcaatgtcaaaccatttgacagatgttttccaaagtggccttttattgcttacttagagtgaaaatattaatgcttgtaacaaagctgtgctcatgttttcagtagactcattccccgactatcctgcccttaacagctggctttgtttcttccagtcctagactttaaaaagcacgttccttttcacttgttttgtgttaatatgtttcagaagtgttcattaaatggatcaatttttccacccctttcaacactagaaaacaaaacaagttgaatcatgtcaaaaacaagtagtctacagggatgaaataagtatcatggcctttctggatataatttaaaaatttgaggccatatcattttgtgaattctatagagactagttaaataccactagggaggaaaagtttgttatatagaaaaacaaatacttttttttttttttttatagctttgaatccctaagctttgaagaatttattatgaaagtgacccagtgatccatagactgggatttttatactacattgtcaggttatgaataaaataccctgttatataagacaaaagtattttaagatttattgcttttaaaatgcataagatgctttataccaatatatgatatggattccctcacaacatatattattgctattaacaatattaactattgttaattatgttaaaatatgctattaacatattttggcatgtaggatgtttgtaacctcagtattacaaaatacctcattgcccagatgtggctgctcattaagcatttcttgaggaacagagttgtctagaaagagcctcagaaatcacatgagaattttggatcaagatggagaagtgagaagatgtagggcccacaaacccatcaaaaatacatcaacatgaggatcaattcttattgaaaacctactggtggagggactcctgtacaaccaaggctgtaagaaggatacatccatgatcggcttggaaggagagaaagtcaatcaggttaggacctatgcccctgaggggactcagaagaaagggtgaatgcatgggcagacaccagccctgcggagtgactggtttaagctgcacatcggatgccctgatcctgaggtcttatccggagaagacaaacccttggaaggcctgctgagaccagcagaagggctgtgggagcttggactgcacttgtgaggagcacatgtgtgatggcttgcacaaaaagtaggacggagagaggtctgccctagtggctggtgggtttcccacgactgtctccccccagccccagcggagccaaggctctggccccgctccctctgcgtcacagcgtggcactggatctgagaaaaccataacgggaaaagatgaccatgggacgcagggcccacctggtcctgaactgaaagcctgctaaggccccccattgtttcatcacacctcacctctggggcaagagtcgagtgtgaagacagggtaaagcacaccttccctggtggttcagatgataaagaatctgcctgcaatgcaggagacacagctttgatccctggattgggcagatcccctggagaaggggagaaagaaatggcaacccactccagtattcttgtctgagagatcccttgtagagaggagcctggagggctgtagtccacggggtcacaaaagagtcacacatgactttgtgtattagggtttcccttgtggttcagttggtaaagaatctgcctgacctgggtcaggaagatcccctgagaaggaaaggcaacccattccagtattcttgc

SEQ ID NO: 62496 - DNA, 1252 bp, Bovine  19866880270623
ttggcttaaagctcaacattcagaaaactaagatcatggcatctggtcccatcacttaagggcaaatagatggggaaacagtggaaacagtgtcaaactttattttggggggcttcaaaatcactgcagttggtgactgcagccatgaaattaaaagacacttactccttggaaggaatgttatgaccaacctagatagcatattcaaaagcagagacattactttgccaacaaaggtctgtctagtcaaggctatggtttttccagtggtcatgtatggatgcgagagttggactgtgaagaaagccgagcaccaaagaattgatgcttttgaactgtggtgttggagaagactcttgagagtcccttggactgcaaagagatccaaccagtccatcctaaaggagatcagtcctgggtgttcattggaaggactgatgttgaagctaaactccaatactttcgccacctcatacaaagagttactcatggaaaagaccctgatgctgggagggattgggggcaggaggagaaggggtcgacagaggatgagatggctggatggcatcactgactcccatggacgtgagtctgagtggacgccgggagttggtgatggacagggaggcctggcgtgctgcgattcatggggtcgcaaagagtcggacacgactgagcgactgaactgaactgaactgaactgatactatgtaaggtccacaaggacaggggtgttttttcccctggcaaagtccatagtacaaaactactgcataaaaacccaaagaaatgagagaaaagtagcccaaaataaaactttacacagtatagtgtttcatttcttcacaagcttcaaactaaccctttcattgctaaattaaaccagagtgttttagtcccagtcactaattaaaaccaagtggcaaaaacagtacagtggttttacccattcattatgaacccacttaaaattcaatgaaatgtaaacagaaaatactgtggtagtgagaccacaggccctcagtgtgaccttttcaactcacctggctttcatcctgatattattagaactacttaatacaaggatgcattaactgaatatgacttacctaaatcttagtcagctgagagactgaaaacattttctacagtaccatgtttttgttttctggatctatagcacgagaggtggattaagaaatacctgtatgcaaacatgtatatttacctccctgaggggtaaacaattcaa

SEQ ID NO: 62497 - DNA, 2191 bp, Bovine  19866880403095
cctgatcctgcagcaggccatcgccaacccatgcttctcccagagactcctggacattcgtaggcaagctggggcagtctcctgtggggtcactgctcctttctcctgggtcctggtgtgcacaagattttgtttgtgccctccaagagtctgtttccccagttttgtgcaagttctggtggctctatggtggtgttaatggtgacctcctccaagagggtttaatgccatacccaggtctgctgcacccagagcccctgcccctgtggcaggccactgatgacccttaactctgcaggagaacactcaaacacagttctggctcagtctctgtggggtctctgggtcctggtgtgcaaggttcatttgagccctctgagcatctctggcaggtatggggtttgactctaaatgaaatttcgccccttcttccatcttgctggggcttatcctttgccattggatgtgaggtatcttattttggtgggatccaacattctcctgtcgatggttgttcaccagtgagttgtaattttggagttcttgcaagagaagatgagtgcactctgccatcttagtcagatggaagttatatcaccctaaaaaatcataaactttacagaagtaatgactagaaaaccatgtcttaaagttcttataattcttacttgagtgcagaacagacatacatatccactgaataaatgttgaataactaacaacaaatgaacagagggatgatggatcagatcagatcagatcagtcgctcagtcatgtccaactctttgcgatcccatgaatcgcagcacgccaggcctccctgtccatcactaactcctggagttcacccagactcacgtccaccgagtcagtaatgccatccagccatctcatcctctgtcatccccttctcctcctgcccccaatccctcccagcatcagagtcttttccagtgagtcaactcttcacatgaggtggccaaagtacttggagtttcagctttagcatcaggatacacttctctatttaatattttgatttctaagtaaatgacatggaacttaaggagcaagtgagagagagagagaatctgtgatgacagcacattggcccctggaattattaaaatgtttaatcagatagaagatttggggcccctaaataaaggccaggagcataggtaatcagcacagtcttagcagcaggagaaaaccaaatcaaaccaaaccccacttcattctcccatccccatgcccatacacacttgcacagttggaagcgagaggcaatttactggcacccagtacaagtcctttctggaagtgattattgtcacaaatccacttttagtcaaaggtgttaaaaaatgagatggagaccatccaattcttacttactttttgtgaggaactgttaaagagtgatacaagtggatagaaaagaaggtgggaagggaaagagacagaatagactacaggagaccaaataaaaagttcaaagtggaaagcaaaagtaacacttcatcattcccaatttcctcttgggctctgttgactaactggagtttcatcattacctgatgagaggccagctttgaagagctcagaggattcctttaaagtctttggatctcatctcaagttgaaggatgcacaagtgaagctcccaaccatcttgatgtgtttacaaggttctactaaacctgtcctaatgaaaatgtcagctgaccttgaatgtttaccagatctcagtaagcatatattggaaattcagaagaaatacactatagccaaaagagactacacaaaagacagaagccagagtcttatgaactgttccttctttgaagccctttctaaaaagaaggaagtcaagggcatctctgtctactcttaccaacatccacttaactatgtagagtcaaagtaaaaaatatgagtgttctgtggagaataagcccctctccactgtgaatgctattaagtgtagagtctttagttaagcagataaactaagcccactcattctcagattcttcatcattcttatctctgcagaaaagaccccctggaacttcctactgttctcccaggttaatttgcctcatctcatccttcaaatttcccagaggcatctttgtagcagaaactcccagtgagtttataaattatctttcccttaacctgaca

SEQ ID NO: 62498 - DNA, 1948 bp, Bovine  19866880416916
cagcatcaggccacacaccccccttcctgacaatgcatgctaacttacttcctgcggcagtacctggcccaacttctcttgtggcctggagtcaaactggcatcccagatcaaggttttgacaagtgtagggaagaggatctaagccttggaaagtacatacttgctttttatttctgtagcaaagcattcttgtactctgggaaagggaggaatgtgccttgcttttagatagcagagggttgagatgccaaagactaacatgtggaatggaaaaaatgattaaggcctagaagagggtcaattttaagtgtctgccagatagaaatgaatatttgatcatcctctcatactttccattttggttttgaatctgacagaaacttttctggttaaggagggatctactcaagttagcaaagaattgggtgttttgattatggaggagcctacctcaaagggctgaaaattattttactatttctaagtaattatccacatatcactatgtcatatcaaaagccaagagacattttacgttagtatggattttttttttttctattttggactgctgctgctgctgctaagtcgcttcagtcgtgtccaactctgtgcaattcataaataattaaatataaagatggagagacaggaaataactaactaactgaagaacctcactttccttccctatattaaccttgccaaactttaaccaacagtgttcccgacccacaatatccataaagatcttcttgaactgggtttattcatggttcaaagatgcttagtaaatgcattgcattggctatatgctgattaaaatcatcttcctaagttttaatcttttaaagattccaggccaaagaaaaaagaatctgatgtataaaggatagttagaatactcttaaaatcacacaaaaggaaaataactttaatggcctttaggaaggatggttaaattgcatttggaaaggatgactttcaccccgtggtaacctttatatgtcacatatatccatttgacatatattctctaattattttttacattagaagtttgggaaatgttttaaaaactaaaaaagtattgaatcatgcctagaatttcagaatgccaccatcattacaattctccacatgactttaaaatttcatttttgccattcacttttatttcccgggagaaggaaacattctaagccagaacacaattagtatagctctcaccatggcaatgttctttaaaaatatctttcatctaaacttacataaaagcagaaatagatcagttacctgaagaggcactctatgcagaaatgtgtcataccagttgctgtaaaataaaaaaaaaaaaaaaagaaagaaagatcagtaaatatctaactaatagagactctcccaggtaactgtgtataaataatatctccacagaaggcttttcttttcttgccaaaatccatttatgtctcaaaaatccaccccagctgtgaaatgcagacattcacacaggctataggaagtgttttgtattattggaggatggaagaactttatggagggcttcccaagtggtgctattggtaaagaatctgtctgccagtgaggagacacaggggacttgggttcgatccctgggtcgggaagacaccctggataaggaaacagcaacccactccagtattcttgcctggagaattccatggacagaggagcctggtgggctacagtccacaggtctcaaagagttggacatgactgagcacacagcacagaactttacagaggtctgtactaatgtcaacaaaattgagttagaattacatttcccagaatcccttgactgtgtgtttctggtgtagacatggccaaaagagaactgtgtgtgagatctgaagggctgagatgaagctgcagatgtgaagctctgaaggttgagcggggca

SEQ ID NO: 62499 - DNA, 1336 bp, Bovine  19866880425077
tatatcatgaaggcaaacaaaggtattcttgaggtttatgttgtagaaacaagtcacagggctcaaagttctctactttcaagcttgggtaaatggaagaaaatatccctagcttttgagaaaaatcttaaaatcttgaacatctcttgttaaagccaagagggacaattgacagttactctgtccaagtaaagaacaagaatttgcaaactccatccccctgtttttcctattagattcaatgtgttatttgaatttcattgtgtaagtaaccatgcatttccacatattcttatttaatttgcataaaattctgtgatataggtttaccactacttttcttttatggatgaagaaatgaagttcagagaattggaaatgaattacctaaggtcagcaagctttagaatcagactcagactgagtccctccaggccaccctgctgtatgccagagtcctggcaacaattctattaatattatatttcatcaaccatcgtgccatcctctgttgttgcccaaaggttgtaactgttttcagagcctcttgaactttggtaccctgagcatattctgtgcttagatgacaaaatgactgaggtttgttaatttatcactgcagagttttgaataaagtcatatggaaaagtcaacaaacagtattcttgctccataaaagtacgtgatgaatttatttcaagagtacactaagagaaactaggcttattgaaatgttagttggaggggggcatgtggtagacaatatcttagggaatagcttgatgtgagtattattttacaaaaagcaaaaggcaagtaaaatgcaaaaaagaaacaagatgggttcacggatttttccttgtgaaacagattgccttaaatggatacagctttaaaatttgactatatctggcaacattcggaacttaaaagtctcttatagaatgtgactctaaatggagaaccctttaaatatatggagagatagcacttagattaatagatcttcagaaaagctcattctttgatgatggggtttttaataggcatcagtctgttgtgcacagcactcactttttcccagagcaaaatggtttatcacacatgctggagtctactagaatatcagcctgccattctgggcactggcgaggtcctgaccatatgttcaaaaatgaaaaagatcaaagagctaataggtagtggtcaacatgtctctagtcagtacagaagaagaaacaaaacagggcagcagcccttcagttcagcaactgtggtaggaagcgccccaaatcactaccacagcacgaacggcaagtgacactgggaacagggg

SEQ ID NO: 62500 - DNA, 3387 bp, Bovine  19866880443228
acataaatgactccactgtctattccaattttactacataagccagatcaaaagagaaataagccaatccagagatgccagaaccaaaaatactcttcatcctaaaataccctttgtagagcaccctaaaaatatttttttctcagtgaaaatcgattctatatattagcaatgataaaataaaaatttgtattataaagcatccacctgcaacacgggagacctgggtttgatccctgggttgggaagatcctctggagaagggcatggcaactcactccagcattcctgcctggaaaatcccatggacagaaaagcctggcaggctacggtccatgaggtcacaaagaagtgacacaagcgactttgcacatttgaccccaataaaaattttccatttctttcttagatggactgattaattttttgttggtagtagagaatactgaagaaacaatacctggtagaattcacttcgttaagtctctccaataccaagcagcagatagaaaaaaattccacccatcaccaggggaggcagcacttctcaatcttggaacaaataacttcaccttcctgaatttgttttctcatcagtaaaacgaggaaaattacaactactttccagaatcttacaaattcaatgcaataatgctactgaagcgactaccaaaggcttttgcacatggtaagagtcctcgcaggagttcttgttgcagatttccacctctgtccatgccatctccttccactcacaattacattcttacacgtaatgctggtcaacacagacccaccaataaatcttcacatccccactcacacactctataaacctatggagatgtggttactattctttgctttaaaataccactgtattcaacatattcattctttccactcccaatctatatttgtgacatttggccacctgatgcagagagttaactcattggaaaaggccctgatgctgagaaagattgagggcaggaggagaaagggatgacagaggatgagatggttggatggcatcacaggctcaatgaacatgagtttgagcaaactccaggagatagtgaaggcacagggaagcctggaatactacagtccacagggtcacaaagagtcaaacacaactgagcgactgaacaacaacccacctttggaaaccctaacaaatggctttgtgatgacaatgaagttcaactgcactggctactcctggatcaccatgtagaaagtttgttagaaaaagtgcacattatagtaagtcaccttgtgatcagggtgctgcaggcaagcaaactccttgcatcaccataaacttcgagctgaatttcaagtattcactggtttccccatgtgccctaatgctcatttgagattcaacttcgtgagaaagtcaatcaaaagagaacaaacatcagaagagaagtacttatgtatgtgtgtgaatttctttcttgaattttttaaaaattctatctcatgttataaaagaaaagaatttatacagtcattctagcttataattataaataatggttctaagaaccaaatatccaaaaataaaggttgtaaggaacaaagctagtggaggtgatggaattctagctgagctatttcaaatcctataagaggatattaaagtactatactctatatgccagcaaatatggaaaacagcagtgaccacaagactggaaaaggtcagttttcattccaatcccaaagaagggcaatgccaaagaatgttaaaactaccacacaactgcactcatttcacatactagcaaggtaatgctcaaaattctccaagttaggcttcaacagtacctaaaccgagaaattctagatgttcaagctggatttagaaaaggcagaggaaccagagatcaaatcgccaacatcctttggatcatagaaaaagctagagaattccagaaaaacatctacttctccctcactgactatgcttcacagcctttgactgtgtggtggtggtttagaagctaagtcgtgtacaactcttgcgaccccatagactgtagcctgccaggctcctctgtccttgattctccaggcaagaatcctggagtgggttgccatttccttgcactgtgtgtatcacaacaaactgtggaaaattctgaaagagatgggaataccagaccaccttacctgcctcctgagaaacctgtatgcagttcaagaagcaacagatagaactggacatgaaacaatggactggttccaaatcaggaaaggagtacgtcaaggctctatattgtcaccctgcttatttaacttatatgcagagtacatcatgcgaaatgccaggctggatgaagcacaagctggaatcaagattgcagggagaaatatcaataacctcagatatgcagatgacaccacactcatggcagaaagtgaagaggaattaaagagcctgtagatgaaagtgaaagaggagagtgaaaaagccggcttaaaactcaacattcaaaaaatgaagatcatggtatctggtcccatcacttcatggcaaatagatggggaaaaaatggaaacagtgacagactttattttcttgggctccaaaatcactgtagatagtgactgcagccatgaaattaaaagacacttgctccctggaaggacaaacctagactgtgtattaaaaaccagagacattactttgccaacaacaaagctatggttcttccagtagccttggatgtgagacttggaccataaaaaaggctgaagttggtgcttttgagctgtgtgttggagaagactcttgagagtcgcttggactgcaaggagaccaaaccagtcaatcgtaaaggaaatcaatcttgaatattggaagaactgatgctgaagctgaagctccaatactctggccacctgatgtgaagagccaactaagtagaaacgaccttgatgatgggaaagattgaaggcaggaggagaaggggacgaaagaggatgagatggttggatggcatcactgactcaatagacgtgagtttgagcaagctctgggagatcatgaaggacagggagcctggcgtgctgcagtccatgggggtctcgaagagtaggacacaactgagcaattgaacaacaaaggaccaaaaattaaggttcatgaggcaggaatgtgtactgtgtaattcactgccacacacacagtggtttgcacggtgcctagtatgtacggcaccgagtatctgctaaattaatttacaggatcgatcagtacaagcagaaatacatactttcaaatgtgaagtgaaataatttccttaggaaagcatataattgaaatccttccccaaaagagggtggtacctaaaaagcaacgcgtcaagaaag

SEQ ID NO: 62501 - DNA, 2393 bp, Bovine  19866880462098
ctagaaatcaaataccacgtatttcaattcccaccagaggttcagttagaaatagaatccttctttgcttcctgccctacgccggcatgctgttacagggcatgcactgttttaacagctgcagagtcttagctcaggggtgacggaattgcgctggtgatgttgatccctatatggagctaaagctaagaggaaacttgatcatttgcagaatgatttaggaattgaaggtgagttatgctctctgtatgaggataatgagttaagaaagttgaaagaatgtgaagtcttagtaccagttttgcttagtaaacctagtataggactttctctttttagaccaagaatgaacagcagagacaaaaatgtgcaaatagtaaattttaaacaattaaaatatgaacattcaaatatacatctgagcatctggaacaatcaaatggcaagatgtcatttgcttattttctttttctgtagttttctatcctccttttctagctctgcttctattactgttttcacctcacatgtaagaactaagtgagaagacatctgctccttatatccatgtattcctgtagtccactaaaagttttgtcttgtatcaagagcaaacttgatcatgcgttatgaacaccaagaaggtccaatgtaacacagatggctagagccccactcccagaatttctgattcagtaggtctagggtagagctccagaatttacatttgtaaggtattcccagatgacacttttgctgctggtcgagggaccacaccagacaagcactgttgtcagttaaggccttgctgaaaggcttggcaaaagcaagccacctagagggaaaagggtaatgcaaatgaattgtttggggaaaacatggggaagggaaagactggctccctcagtctgagttgtgaaaggttcgtcattattcttgtctctgaagtctcctccgccaaccctgcttcattcttctgaatctggggctagaggttactcttcaaagcaagagggaagctgtgtttattgaatttgaattcattgattaagtgtattcatggctttgagaatattaataaagagtaagttttaacacctgggttttaaatgtttggtggcgttgtgagaaatgtaaatacagcattcattaaatatatataatgaacctaggacatgatggcaggaaagatggtgacctggcctcattttcatttgttcagaatattgcatggttaaagagggcattttttcattggcatgttacttgaattctgctgtgtgtcaaagtattcagttttttttttctcctgcctgcagatgatgccttttagttaatatttcttttcatatacttactacatgtaatctgtatttattttcttctttttgccagagtctccttcaatctcctcatattctttacttctaatttcacatattactacctttactttgctcatttttagtgctctagtgattttttctgttaccacttcaactttttttttcgcttccactcacacctttttcagtatcttttaaaatatagtgggatatgtgattatttctctttggctagaaccactttgttttataaaacattttggaatatctttccgtgatatacacaaaacccagaaatacatgcatacaataaaaagccaaggccatgaaaaatatagaagaaaaaagcaaactcagaaaatttgtaattaagaaatgtatactataaagaccttagtaataacatacctctaattaatacaattaactctgagcttcttggcagttgaagcaaaaaagagatgtgattagtttagaggaattgtattatcacttaaggagaagacatgttacttgtttgtaaggtcaggctcaaaggcccacgtcttgagtgggtctttgtacagaggattctggttaatatagtggatgacattttaatagcgttattgagtaactgtagtagcccatttcataaagcattttcagggcacccattaatgtaagccagggggataatgtcaaagtacaacaaagaaagtatcttgtcagaggttaagtaaatatcacagcatgattcaggggttaaaaattaggatgtctagagagaggcatacacttcatttttttcaaaacaatctctagaaatgaaattcctttcaaatgacttctgatagaagtcagctagcaaacaatttggaagtatgttctctggtaataaataattctttgttacttattaaggacagactcagtattttaaaaataaaccgactgaacaggagggttgacaactttttgtggaaaccagatcgaaacttaacactactttttgaatagatgactgcccaatttccacattgaagtgggccaacggaataaacaggt

SEQ ID NO: 62502 - DNA, 2207 bp, Bovine  19866880503649
taaatattttgctccttatagtctcatggaaattttcaatattaaaggtaaaaattactcatatttttatgctattatagtctactgccttgtcattattgatcttttcagatatttataacaacatctagcattatttaatgatcagttaattgggatcttgtgtttccagctatactttcttccttcagcaaatatggctttctaacttggggcatacacttttgttttatgggcctgaacaagcccatagacataatatttcaacttgtgcatggttggcacatatagtgttttttccacccccaaagcaattctgacttgcaacagtgttttagagctgcccactttatgtggggcatcatttctccacgttgtcattctcataatagctccctattctagccattaatgttcacttttttcattcaggaggtgtatttgtggccttaggcctgtcctcttcatgcctttaagatatgtgcttgatccctggtcgagagtaagagagagagctagaatagtggagaatgagactattgaaaggatggaaaagtagtccttttatatttacacaggttcctatagttttcatctcagattatggatttaatattcttaattcttaaagaagaagaacgaagcagttgtatttgtcttaacttagtacctatttctccaagagattggaactgaataagggaacagataaacctgcattattcaactaatggaagaaagatttaatcaaaaggaaagttggtaaaaggcaactttctatgggaaaagaggctagagggtagagaagacctattttctttttctcttccattagttggaggcaaaatcttgctgttcccttaaactttaaattaagtttaaatttaagttcttgcctttgtcgtggtgagacatttacctagagaaaaatctgttagtaccatagctagtgattcagtatgcacagaaattactatggagaacataggttcccttttaatgaatatacacgggcaataggtaaaagcaaagtatgtgaaatgatatacagtgttttattttacatttacctcagataagaggaaactaggaaggctcagaaaaattttgttcttagactgctcatttctttctccattaatttgtatttcctttgagcaaagtggataactttgcattatgaaacgtattgtgtttgtagaagcagtactctttgtaggcccatctggtgggggaacttgttcccttttgtaaaaaaccttgcctgtgtcttatgacatcattccttataaaggtagagatagattattgtgcacatataacataatgaatttatatgagatatagtgactatcccatgagtgagggaacaagacataatttggagttggagcctagagtgatttatgaaggtcattgtcttacaagttcagatgctttccatatggcgttggagaaacccccttatgtactgtatgtataaaacatatgtagcaaattagtttcacttacattttttccccctaaatatgttttggtttaaaaatgacagtgtcttttgtttatctgtaaaatgctatatcttttttttttttttttctaagagagggattattaataagaaatgagagtttttaaatgaggctgacagaatcaagtgtgagcccctttgacactgggccttgctgtggcttgggtgccaaagtttcccatctcattggatttatggcttaacttctgtatcacgcttaacttgagtgtgctcagcaatgtgaccttgtctgggaagaggaaaaatggatggttcattttccagctgtagtgtattatatttccatctaattgcattttcaaatagatgtgaagatgcaactacttccacttaaaaggaaattgcactacttagagaaacatggagaatggattgggagtaataatcagaatcgaaagtattttatgcctaaaagaataagcttttgtttgacctaagcagcaatcctattgatggatttggggtttttttgttttgttttgtctttgtctcattgttttagttgtgaagacttaaagggtgcatgccctcagacttttgtccagttttttctaaacctttaggaattgtctgattttataaaccttcacccactaaaatctatagtctacgtattcctttttaatactaaaaagcatgagtgcttttgcaaatt

SEQ ID NO: 62503 - DNA, 4038 bp, Bovine  19866880531067
taataaaagcatctttgtttttcttggtgaaattacctgcgccccattgccctgctcttagttcatgtgacttcagagtggacacaggacccagaccttgaaactcagcattctatccttggccgcagaagctgattcttagtgtcaaggtgaggcatttgctggaaacagtggaatgagaagttctcctgccaagatttcttaatttgcaagaggtaagataggggagggcttccctggtggctcagtcagtaagcgtctgcctgcaatacaggaaacctgggtttgatccctgcaacaggaagatcccctggagaaggaaatggtaacccactctagtattcttgcctgggaaatcccatggacagaggagactggtaggctacaggccatggggttgcaggagttggacatgactgagcgactaaacctacttacctacctaagatacaaaagcacctactcaagaaagaaggctcttcaaggggaaaactgagtcaagagacagagaaaggttactagttacagtttgagccaaatctgaagtctaatataagaggacctgttatgagaactgacaaactttcctttttgtctaagttatttcaaggtagaggattttgccatgcaggtcaaaagagccttataacaaaatacactgaatttggaataaacagttaaaattttccagcctagaaacaaatagagaacatttgttacttgagcaaataagtatactttccattaagtttaagcttagcacaaactagagttcaggtttaactagggccaaaatgtttgagaatttactacagaactatcatcctatgtgatagataccaaaattgcttatgattttctaatatggaaatataccttaagattaaaaagttctttttcagattgaaatgtattttattattcacatactttggatctggtaattttatatgaaatggaactgtaaggagaatctcttaaactcttttgatttataatgcctattatatattattaaatttataaatactttttgattttaaataactctcaggattattaagggcttccctagtggctcagatggtaaagaatctgcctgcaacacagaagacccaggttttgatccctgggttgggaagatcccctggagaagggaatggctacccactctagtattcttgcctggagaattccatggacaaaggagcctggcgggctacagtccatggggtcatatagagtcagacatgactgagcaactaaactttcactttcaggataattaggttgcaataaataaaaatttacccaagtttgcatagaaagtttgaagcacatgagagaagaaatttgatggcacctgaggataagactgcacatggtgactgcagccatgaaattaaaagacgcttactccttggaaagaaagttatgaccaacctagacagcatattgaaaagcagagacattactttgccaacaaaagtctgtctagtcaaggctatggtttttcctgtggtcatgtatggatgtgaaagttggactgtgaagaaagctgagcactgaaaaattgatgcttttgaactgtggtgttggagaagactcttgagagtcccttggactgcaaggagatccaaccagtccattctgaaggagatcagccctgggacttctttggaaggaatgatgctaaagctgaaactccagtcctttggccacctcatgcgaagagttgactcattagaaaagactctgatgctgggagggattgggggcaggaggagaaggggatgacagaggatgagatggctggatggcatcactgactcgatggacgtgaaatctgagtgaactccgggagttggtgatagacagggaggcctggcgtgctgcgattcatggggtcgcaaagagttggacacgactgagcgactgaactgaactgaactaagacacagaagcacaattcagcttgatcacactggcctaggcctgataactgagaaccctctgtttttcatgagactccccgcttcctgttcttgcctacctttgtgctactgcttaattctgctgtttttgtttttgtttttctgaaaaccacacttctttgctgacttgttgcagtcttctctttataactggatttggctttttttttttggagagccaacttccagtaatatctctttgttatcttgggactcagtttttcttagcaggatgaatcagtcagtttgatttttctaaattccaaattcctggtcaagagaatctgcttggttccctttgggggcagggtcatctggtacaaagaatctacctggattcaccatttcccatagtggaagcatccagtggggacaggtacttttcaggaggaaggcagggattaatttttctactgcagagagtaatatataaataatcttgattaccacaaaaataattacattctttctcactaggggaacataaagagatagccttacaaaatgatttgaatcattaattcataatttcagggtactattgcatggtttgtgttccacacagagcactttggtttctattaagagtaaattaaaatatacataagttagaagactctttagacatgttcaaaattattctgtccattatgttttagaaagttggaaatcaacagtattgcctctatagcattcattaatgtatggtatatttctgaacaaaagaaagattttagaaacaacccagacattaattcactctgataattgtttagagaagttggtttcactggaaaattgaggagggacaaaggaaatgaaaaaaaaaatcaatgactaacctacaagatcaattgaaaaattcaaaattgtttctgatgttacaactgacctaatttctcaaaacatcataaaataatttaaaacatattcatatagctatagataatatttatctaaagcaaagaaattgtaaccatacaaaatcaaatgcgtctgatttcgttttagggaatctttatgacctaatatgcaaagcaattttggaggaaactaaagtaaaaaatttaatctctcagagatctgatatttttttctgaaatgtgacatattgaaataatctctactaaaaggagtactgatgaggcaattgagcaaacgatattagttcaaaagatgaaagaagcaaatgacatattagcaatcaacaatataaatatataaaataaaaaatatacaatacttgctgtaactgtttagggtttctctactgcttgatatttcaagctcataaaggtgatttgatgatttttcactaatgaagcaatctggacatgaaattatgcttatgtttaactacagaaaaaaattaagaaagagattgattaaaggaactgccaggagaaatatcaataacctcagatatgcagatgacaccaccctatggcagaaagtgaagaagaactaaagagcctcttgatgaaagtgaaagaggagagtgcaaaaggcttaaagctcaacattcaaaaactaagatcatggcatccggtctcgtcacttcatggaaaatagatggagaaacagtggaaacagtggcagactttatttctggggcctccaaaatcatggcagatgatgactgcagccatgaaattaaaagacgcttactctttggaaggaaagttatgaccaacctacacagcatatcaaaaagcagagacattactttgtcaacaaaggtccgtctagtcaaggctatggtttttccagttgtcatatatagatgtgagagttggactataaagaaagatgagtgcagaagaattgatgcttttgaactgtggtgttggagaagactcttgagagtcccttggactgcaaggagatccaaccagttaatcctaaaggaaatcagtcctaagtgttctttggaaggactgattatttaaataatcactattagaaacaaaacaagaatggtttaaattgttacaatctaattccagaggaagaagacaaatttttcctaataaagccacatgtt

SEQ ID NO: 62504 - DNA, 2571 bp, Bovine  19866880673259
agttagacatgacttagcaacaacaaaaaaaaaagattagatgctccaactgaaagacacaaactggctcaatggatacaaaaacaaacccctatatatgctgtctacaagagacccacctcagatctagggacacacatagactgaaaataagatgggaaaatgtattccatgcaaatagaaatctgaacagcaataatcatgcaaaaagaaaacttgaatagcagtaatcatatcacataaaatagattttaagcagttataagagaccaagaaagacactctgtaatgatcaagggatcaatccaagaagaaaatataacacttataaacatatatgcacccaatagagaagcacctcaatatataaggcaaatactaatagccttaaggaataaattgacagtaacacaataatagtggggggttttcacatcccacttttatcaatgcagagatcatacagacagaaaatcaataaggaaatgcaacccttaaatgatacattaaaccagatggttgtaattgatattgttgtaattgatagagcatttcatccaaaagcagaatacacagtcttatgaagtgcacatggaacattttccagaactgatcacatgctgtgccacagagcaagccttggcaaattcaagaaaatctaaatcatatcaagcaccttttctaaccacaacactctgagattagaaatcaacaacaagaaaaaaactgtaaagatcacaaacacatggaggtgaaacaatacactactaaacaaccaatggctcactgaagaaatcaaagaggaaataaaaaaatccctagagacaaatgaaaatgaaagcacgatacagcaaaagtagttctaaaagggaagtttatagcaatacaaggaaacaagaaaagtctccaataaacaatctaaccttatgtctcagcatctaaagaaagaagagcaaacaaaacccaaagttagtagaagaaaagaaatcatgcagagcagagataaatggagacaaagaaaacaatataaaagatcaatgaaactaaaagctggctcttctaaaatggataaacttccagccagactcatcaagaaaaagagtgaaagggctcaaatcggtaaaacgagaaaaggaaaagacttgattggaccattccctctcgtaagtttaaggacaattacacagttccacctccccctagttcttgtacaaattgtggatgatgtcacagaacttcaatgtgttattacttttatttttttggacagtgaaagaagagggtctcagaaaataaggaatctctttccttgtaaaatatctttctcacatttcagaataatagtaatattatttatcaggaaaaaacgaacagccttggtcatagatttctttcagttgcccatgatacatgtttatagaggccagataagtgaagtttgctgtttctctttcctctcttgctgaatcagcatgggaaaggcaatgtaagaaagagtaccatactagtctcacagttggaacaccaagattttcatgcttattccttcttatctttctactacagatagatgaatatctctatacctcttacaacctagtacatgaaataaaaggtagaccaaaaacttttgttgtctaactgcatgaatatacattaatgtacaataataatcatgaagccttaataaaaatctctaaacattcagacatatgaactacatatttacaatcaatcaggcagcaaaataaatcaaattgacgtgagactgtaacactgtgaacaagggaacatcaacatatatgatttgaagttgaaagagacgatgtttcacacaataacacagatatttgctatgaggaacctaaaagcacaactaagaaaggtatgatctggatttcctaatttctgcaagaccaaaagtcttagaattaacaaatggaaaactaatcttcagtttgattctgcttgtacccatcctcccagtttcatgcacgttccccatccctgcactgcacaagcctcaagcatctgcctgtcatctgtcattcctcccactgcccatgctgtgccatccctgctcatgtgatgtttccctttagtggaagataaaagcacttcctggtagatgaaacacgttcctagaactaaaatgaatggttccaaagccaaaagctgcagcgcactgatgctttcattcacaaaggaagcaataattcagaagattcatagctgatgggcttttgccatctcagcataaaatacactggcgtttacctaaacaactgattccccatcccctcaggggcaacacatcaaaactcttattttgtgccttccttataaactgctagttttacactctgagtatttattagggcaagcatttactcactcaaaagaaatgcttaataacaggatatttggatataacataataatatatgctaatattatgcagcctgtcattttccaacaaatcagtttttgtccaccgaacttactttaggacatacgatcaagtacaggtttgaatgacacggtttaacaaataaagttttccatcatgta

SEQ ID NO: 62505 - DNA, 812 bp, Bovine  19866880722980
aatccaccttataactgagaccaaaatcaagaatataacaagtctcaaagcatagacaatcttaagacattatttaagaatgccttctcctcaggaattgtccttactctcttagagccttggtaagaacaaggcaaggcttctaatctttcatttatcaatctctctttgagttctttccaaacggttggtcctgttttagtaggagatattcaagataatgtaccttgaacaggagatgacgattctaaatctctctctgctccacaattaagttttatccacttgatggttacaagggtgagttccttgtgcacagaagaagggatgtatgcccagtatatgaagacccccaaaactccctgtgttctttcacaaactgccccaattgctattaaaataatgtcatgaaacatctacatcttccccagtatcacatgctggactgggcataaaaggactatttgcatactactaatttgtgggtagggcttccctggtggctcaactggtaaagaatccacctgcaatgtgggagacctgggttcaatccctgggttggaaagatcccctggaaaagggaatggctacccactccagtattctggcctggagaattccacagactatagcccatggggttgcaaagagttggacacaactgagcgactttcactttcccttttcactatttgtggacttagttccaatcctgcatattacttctatttcttcccaaggactggcctttgctggacttaccgttctctctctatttgatcctcgctatctaaactcataaagccatctct

SEQ ID NO: 62506 - DNA, 1573 bp, Bovine  19866880751054
taaaatatggcaagagatattagagaagcataattggattgatgagctatttgatgcatttaaagtcttatctgtgaaatcagaagtagagccctccttaaacttctcatacattagaaattgtgatggctatcaaacaagtattaattagaaaagactgagaaatcatctagtccaactcttttattttatagattaaggaaagagagatccaaagaagctaagatctgttttcatggtcacacagttaataaattagtatagataacttctagttagttaggaattatctaactcctatcatttatcattttagttctcttatcataccctgacttcattaattaaagtgacagtgacaatttgagcaaccccagaacctctaatactcatctttctatatgacacataggtgtagaacttgtgtttggaaaattcctggtgaattgcagtggacctcttaagaatttccccatttttattctctttccacaatccccaaaaactaggccacagaaacaccaattcactggaatttaatggttttcttttttcttatgtgctttgagagcagaatctcttaaagctcgtatctaaattcagacatgtgatgtgctttctgatgtcgcttttaacacaaaagccaaaagttgctgaagcatctcaaaattcctggcttcaatacagagttgtaatacagtgttataaaacgtctcactcccagcatggtgaatcacatgcactttcatccactgtgtgaaaattcattaattttaaaaacttccaccctttatgattagaggaaacagttgcttaagtggaaaagtaaaatgcaaatatgagtcaatacagaatgtgatttcaaaatggggagtggagtattggaattaattattttcttgtttattatcaagagtgatcactttttcaggataccaaaaaaacaacctcagaaataagctttagcaaatagctaaagtatgtctaattaattatatgcaactatcatataattaataacaccattactgagaaacaggctctacattatctagtccaaccttctgttattatgacatcagatattaggttttcttttttgtggagatttttatgctaaattgcttggtaaaaatttgtttttgtgtttcttataaagaaattcagtgcgttagaatattccatggataaacagggagcttaggcccccaacaacccactccagtattcttgcctagagaatcccagggacggaggagcctggtgggctgtggtctacggggttgcacagagttggacatgactgaagcgacgtagcagcagcagcaggcctccaagggtctcctctttatttctttaatattaatgaaagaaattggaggtcataaagactgctcttattatcaaaatgttctctatgatttttaacatctagagaagaaattcttatgtggcaacatcaaagcttaagctagtaagacttattttattggctagaagatgatacagttagttttcctctttacaaaaggaaggtttgactatttttatggcttaataggttctataaatg

SEQ ID NO: 62507 - DNA, 1658 bp, Bovine  19866880793518
aatggactggttggatctccttgcagtccaagggactccccagagtcttctccaacaccacagttcaaaagcatcaattcttcggggctcagccttcttcacagtccaactctcacatcccatacatgaccacaggaaaaaccatagccttgactagatggacctttgttggcaaagtaatgtctctgcttttgaatatactatctaggttggacataactttccttccaaggagtaagcgtcttttaatttcatggctgcagtcaccatctgcagtgattttgaagcccagttaccaaataaccaattgaggtatgcagtataatgcccatttgctccttgaatagaagcttccactctgagtaaaagcctctggtactaaaagtagtttagtgttaagtgttgcaaaatcgatggtgcaagttttgcttagattaaaaaatccatagtcattttgtctaaatcttataaacaacattgtttattctaattgaaatgagtgttatatttttgatgaattaaacaaacactggaatttaatctctagctattaacatcacttcaaaactattagactggtttttcacactgttaacactaaaaaataaaaatccatagtaaaagcaaatttgccgttaatcaaggatcattcttcttaaaagtaagaatttattagatatctagcaaattttaagtccaacaagtaagttttagtggatttttatcttgatgatttttaaaactatgcgttgtttttaaaatattttggcccgttgacgtttatattttcattttatcaccctttacacactttcctcttatgcaaatatatctactcttatcacctctttatgtatttcttttcatattacatgtttcgttatcacatttattcattttcatagtgataaggtttcaaaacattccccttcctttcataggcacagttctttctcctagaaatatctgaggagttgatttcttacattttaaaatactccagtttacacttaaaattgacattatgcatatgtctataaaatagtaaagtaaaaagaaaaatacaaaaatttgacttagattttttaacaagttgtttttcaagtagccatatcctttctaactaaagaaataaaggctgaactagaaaaagaagcccccttaaaaaaagatatatacatatatatgtatgtacacacacacacacacacacacacacacagattttctttataaagtagggtcgcttctaatgtattcttaaaaccctaaaatatgcagtgacccaggctttgtgctaggtgatttacatactttagttgtgattagtgtagtaactctggaaggtaggtttaggattatcaccaggaaaataaaataattttgcctaaggacacaaaagtaagaggtcaggatattaacccaggtctttctatgtccaaagtctgtatactctccctgaagccaactcctacatgttttttcccctaaagaaacttaaagtagatgactcttgttgttcagtcatccagtcgtgtctgactctttgtgaccccatggactgcagcacgccaggcctccctgtccctcaccatctcccagagtttgcctaagttcatgtccattgcattgatgatgccatccagccatctcatcct

SEQ ID NO: 62508 - DNA, 1208 bp, Bovine  19866880913049
cctgttatctcatgtcactttatatatccctcagcgcggcatatatctcaggatattgtgactggaggtttgtttctcttccctgttcgatcatgaaaccctttatagcaaacactgttccacttatccacgcatcccctgggcctagaatagcacttggcatgttgtcgatgccagacaagaatccatttgggaaatgactgtatccatgctgtacagttggctgccatttttattctcattccttgaggactgcttcatatggatcctgttgtttagtgggtgctgatatagaagagtcgtcctattgacgcagaaaaataatgaggcaatgtggggttcacccacagaaatttcataacaaagattccatttgcaagttaaaaactctgagttaaaacagacctaatccacttatggaatctcctttgcaaaaactatgaatgagtttaaacacagaggtcaaatttcaaaataaaatttcaatatcatggtcaaggtcttctcaaggcagtcagggttttgtgtatttgcacacacacacacacacacacacacacagtgtatgtgctgctcaaggtcatttttggtagttatataagctttaatttacatttgaaacattactttaccaaattgtttacattcacggatttccgacatcatttcagtttgacctgcggtaaattcctccatgtaagctcagaaggagacacacctctatcccagattttaacttgcaagcagaagtaagttattaaaggaattgggagagaagaaaaagagaaatggctgtgcttctaatagaagaaagaaggcaaacattgatttaatcaatggattcacttttaagtaagagaacagatgttttctgttaagcccctggtgaaaattcagtaggcgccagtgatactctggggccagtggcttctgataacgtttgaaatgaaggtctgggccgttcttgctgaatgagcttttgcacagcaggcctgtccccgtggtgagatttttctcctgagttctctcttctttatgcattcatgggctttcttccactgtccattcacttatgtgttttaccccttagagtaggcaatagcattacatttgtatatggttgtgctgtctgaaaatattaaccatcaagaatttaagtttctccccgtgagtatctccttgactcttgcattttcaggccccatagt

SEQ ID NO: 62509 - DNA, 972 bp, Bovine  19866881041157
cactgtgaaactttatgaacatcaggggaatatatatgccattttgggggaggaattaataattttttgttgctatgagctgaattaggtatttggagtagctgctttaggtggtactattaaagcttgaatattctgaacttattcagaccttagaatctgacagtttcagtacctttcccactacatccactctctgcccttcaacctaccagcaaggcctagatcagcatcatggaggccatatattgaactgaatgtgtccttcaatttacttttccatcctgcatagcacttctccattgacatgactgattagccaaggtaacgaagccactgtgttcatttaagttttattttttcaaaaaggcaagacccaaaggaggagtcagaatcttttccttatagaaatgcagcctgagaactaattttcacttttcattcttctttgtaaaatttccctatgaactatcccttcttaagtaaggcttaacgttttcaacttaaataattatagccatataaagacagacagacatttgtcaaccagtagcctggaaaccagtatatggtgacacacaacttgtataaagaagcgatagacgtaagttaattaccaagacaatggggaggggtcagaaagaaacattaaaaaaaaatccaaagacacaaagtaattttaaagttagtaacctttaacctgactcacattggttggaatccaatattgaccagagggactggaattcattctgatgatgtgatggtaaaaagttgtgagctcaatgagtctggtggtcttggcactattcccagagaaatcgagttcccagcacataactaaaggacctcaacttctggtccaactagccatctttactctgtcaaaaaaagactcagggtggaaatgggccatggggacacatttttttccttcctactgacaggtttcgtctctgaatgagtggaagg

SEQ ID NO: 62510 - DNA, 1187 bp, Bovine  19866881057445
tctacttctgctttatagactacaccaaagcctttgactgtgtggatcacaaaaaaaaaaaaaacaaaaaactatggaaaattcttaaagagatgggaataccagaccctctgacctgcctcctgagaaatctttatgcaggtcaggaagcaccagttagaactggacatggaacaacggactagttcaaaattgggaaaggaatacatcaaggctgtatggtgtcaccctgcttatttaacttaaattcagagtacatcatgcaaaatgccagactggatgaaccacaagctgaagtcaagattgccgagagaaatatcaataacctcagatatgcagatgacaccacccttatggcagaaagtgaagaagaactaaagagcctcttgatgaaagtgaaagaggggagtgaaaaagttggcttaaagctcaacattcagaaaactaagatcatggcatccagtcccatgacttcatggcaaataaatgaagaaataatggaaacagtgagagattttattttcctgggctgcaaaatcctgcagttggtgactgcagccatgaaattaaatgatgcatgctctttagaagaaaagctataacaaacctagatagcatattaaaaagcagagacatcactttgcccataaaggtccatatagtcaaagctatggtttttccagtacagatatggatgtgagagttggaccttaaagaaggggaagtgccgaagaattgacactttcaaattgtagtgttggagaagactcttgagagtctcttggacagcaaggagatcaaaccagtcaatcctaaaggaaatcaaccctaaatattcattggaaggactgatgctaaagctgaagctccaacacttaggccatctgatgcaaagagctgactcattagaaaaaacccccatgctgggaaagattgcagacaggaagagaagggggcaacagaagatgagatggttgtacggcatcactgacagaatggacatgagtttgagcaaactccaggagatggtgaaggacggggagacctggtgtgctgcagtccatggggtcgcaaagggtcagacacaacttagcaactgaacaacaattctatgatggatatatagcaaaacaataaatggagaagatccaaatgtgttgcaaatagtcacctcagactcctatcaa

SEQ ID NO: 62511 - DNA, 1242 bp, Bovine  19866881146950
tcctgggggagaaaaatgtgttaactttgaaatctgccatagcacagtctggttaatatgaaaaagcaggattttagctccaaatcctattaaagagatacctgtgagtgatgaatgcagtgtgggttattatagagatggatagataacagtggaaataagaaggaagacaccagagaactgagtgagactttggtgaagtaaccaaatgtctgttattgtagtgaaatcaaaagcacctttggcaggatgctagaaggacaagattacgtaaaaggacaataagcataaacccagcaccagttgttttgctattgaaatgcaagccatgggcaataagtaagacttggaatgaaaataaaaacttgcagcaataatgactaacatcaggagagagaaagtaatctggtaagaagctgccattaaggctttttaattatttcctccctcctgcctctgcctccagtggtaagaagtctttctagagaatctgtctctaggaggcagaaaagcaaatccaaccaagctcatagactgagcctgtgattcgagaagtgatccgtgagaactctgggaaagtcagagacccctgagcaagtcctacattagaagctcataaaaacaccatcacagtgagaacctaaaaaagctaatatgcaaccaaaaacatctctacatccaaagtagacaaagtaatgctaactctatccttggctttatgtgacaataaataggaaactgtcctgatcaatcctgtctaccataagcttgccttatgttggtgggctcacgtaatccttatagagcagttataactaatccaacttatagtgaaattacagaatacacagagaaactaagcaatttcctcaaggcaatgtagagccagaattcaaacccaagcagctcggcactccaaagcttttcctaccacctaacattagaagtcagtgttacttaataataagcacagaaattgagttcattttataatgtgataaaactggaaaaccctagggtagaaccctaaagaaatgccaagtttttttttttttttcctattataattaatctggacttaatttcatttttaaggtgggggtttttaatggatgattcaaaaataattaaattttggttttgaaaaatatttaatttagccaaagcagggatagatcttgatgataaacgaatgatgttgatgaaatgaatttccgtacttgaaaagaacctcagtgagat

SEQ ID NO: 62512 - DNA, 1340 bp, Bovine  19866881147037
gagtcccagaaagtgataatatgattaaatttgaacagtaatatatcaagtgtgcatcagatttttatccttatattttacaaacttgtttaccaggtatatgctataaaatatgcattgctatatgcctttggagaaaagaaatacattgagaagtatgatctgtctgaaatagtttagaaaaaatatgtgtacccatgacatttctgacaaggagatttttcacagctgtgtactaatacagctgttttcatgcagaggatttttaaatatagcccccaaaacagactgttagactttcagctgtttctatgaacaagtaatgtgtgaaacagacatattcatcccattctattataaaatctctccacagccttgatcctcattctgttgtacatacccacccctggggtaacaaacagggatcacatggggtcacgtggggtcagaaacgggatgaagacgagggatggagtgacgttaggcatggtctggcagacaacctctaggtgaccagaagttacacgcttactacacttactcatctcagagtgggccagacatcattcttagcaaagtgctcgcttattctctgagaattcatttatatcttaaacgtctactaaattgacagtgggcacactgttctttggaaggactgatgctaaagctgaaactccaatactttggccacctcacgtgaagagttgactcattggaaaagcctctgatgctgggagggattgggggcaggaggagaaggggacgacagaggatgagatgaatggatggcatcactgactcgatgggtttgggtgaactccgggagttggtgatggacaaggaggcctggagtgctgtgattcatggggtcgcaaagagtcggacacgactgagcaactgaattgaactgaactgaataattaacaatgttgaacctcttttcatgaccctgttaaccatctgtgtgtcttctttggagaagtgtctatttaggtcttcttcctatttttcagttgcagtctttgctttttgttgttgaactgtatgagctgttgacatacttttgaaattaagcccttgtcattcacatcatttgcaaatattttctcccagtctgtaggttttttcattttgtttatagtttcctttgctgtgcaaaagcttataagtttgattaggtcccatctgtttattttctattgccatgggagactgatttaagaaaacattggaatgacttatgtcagaaaatgttttgcctatgttctcttctaggaagggcttaaagacaaacttgagacatgacaccataaaatttctagaagagaacataagca

SEQ ID NO: 62513 - DNA, 3071 bp, Bovine  19866881201108
tagatctttttgcttttcttcatgttattttagaacattttcttatttggggtttgttttgttccattgcctggttttcttatttggggaaaactattttaagtatgttgaatcagcttttcctatctctgcatttatttttcttgaattcttttctttccttctttcttaatatatcagcattcttcctttttatctggtatttttcctaaagattttctttatgacattcattcagtcttaatttctgaaatgattttgcttgttacatctctttttatatctttcttttcttgaaacatgttattaaagttttctaatcctgacatatgtcctttcatagttacaaatttttcttaattttctttatcatgttttggaatattaggttactatttggaatattaggttactgtttttatgtgtttactgggcattgtgttttttgtttcttttctttcttttttttttcctgcaggtagtattgctatgtctgtattctttttttttttacatattaaatttgtataggattggaccacaaccctcttttgttgcccattgttaattcagataagcatttctttgtattagagagagttttggaacaaaataacttttctagctacatatctctagcactccctcttctctcgtgtttatgaagtgatttaaaaactggtctcatatatttgagatctactttctccctttgttcatttttacctaggctttttcttttgtcctgattgctcttgcaaattctgtttccaaaagttactcttcactgaggggcatataatacatgttgatacctaaaaggcaaactgatcaaagatttgagaatgtgattctcttattaattgaaatatataatactggtattcaagaaggaaggtaactgaattttggaatatggaaacaggtattgtgttctatgagatgttgtttatcttagttacatacaaatctgcacatatattcttgacaccaataatcaaatggcattttatgggttttagactagattgggtgtgttcagggtggtattgctgtagatgagttttatggatttcaggaggaacaacaacagtaacaactaaaaaaatgaagtttgagcttattctaactcagatttcttaataatttaaaaaccaagtggtcacagtgcacatatattacaaaatgatttcatgaacagtttcagtgaaattagatagtccctgtgcttcaacatatttagcactgccttgaattaattaaaggtactgtgattccaagtgactattaatttactgagtaaactgaacaagttaaattaaataaatggacaaattaagttattaacagaacaatgtgctgattgctagatcactctatttttgatggctgcttccttttcccttgatctataataacttcatttttgtattattcactcctgtattttattgtttccatctttcattaacaaagtcctgtttttaaaggttgaaatgatcttatcttcttggcaaatagcttgtattttttgttgtctttttcaggggccctgtgaaatctcgacgttcacattcagactccagctgtgttcatatttggccataattcacacagaagaaaggtgaagaagttaatattattaacacaggtaagaggtaaaatgatagtaggaaaattctaaataacacttttaattgaacctataccacttaccccacattatgtttaggaactctggtagagttccagaaatgttaccctttcctcaaatgttttatattcccggtgtctataaatccatctgtttggggctgaatttcatgccccctccccaaatgtatatgctgccaccctaacccccagtacctccataactcctttactgcctttggagataaggcatgattacataactgcctttggagataaggtttttcaaaaggtaattaagttaaaatgcagtctttaggatacaccctaatgcaaatatggcatgtattcttttaaaaagaggaaatttggacaaagatggaaggaaggcacagcgagaagagggctatctgcaagctaggggaaacggccccagaggaaaccagacctgctcacaccttgatcttgcacttccagactgcagaactgtaagtaaaggtttctgttgtttagaccgtccagtctgtagtgtttcactgctgcagcctgagcagatgaagacaccctctttataacagacagtctttgttggttttctgttatatcattgtttccaagaggcttttactctattggttgaagctgcaatatacatattcatccacttgtgttgtaggtgttatttttggccctttatcaaaggatttatcttggcttttttagaggaatcagtgttttaagtcctccttcagtgatgcaaaggtgtctccattttcttcagatgaattctccttttcttaggtgcattccacgttgttgccatggttgcacctctgtaagtataactgagggcctgatgtgctgcaagttaccctctgctcagtttaatattggacatgtacttaaagacatgaactgtgggatacaaataagagataatacatgtaatacatgtaaagtacctaacaagcctggtacatagtaagcatttgtatattttggttattattattttttgttattcctgtatcttctaagccagttacccgtaaaagcccttaaactgattgaaagtttaataccttgatttttttcatacctcaagctgattttgagcattggagcctatttccagagtatcagaatgtaagatctgttacagaataatcattttgaagatgaacaacacagtttgcatttcctgttactaagcctggttaggcttcaaacacagattttaaattgccacttaagaaccttttcccttagtttttgcaaatagttttcctattattttccaatctgtgccacagtttattttatagttgaagcttttctgtgtttatattcatagatttagataactgaccaggaacaaacacattttaccagacttgattagctactctgcccttcca

SEQ ID NO: 62514 - DNA, 1756 bp, Bovine  19866881209720
tttttatcaattaaaaaattatcaattcttactattaaaagaaacaagtaaaagcataagacccactttggggatgtaatactttatttcctttcacagacctgctctcttgtgtttacttaggctaacactaaataaattgctattctctaagcattcacattccctggaagaaagaagccataaattgcgtcatttaacagcaaaggcagggctgggaatacatactcaggacagaaaattcaaaatatatcatagttatcaagcgtagggactctgattttctggttttgtaattttttccccccaaattctttagctccatccactgggtttcatattaacaaatatttatgaaatgatcacatatgaattataattgccaattgccaaactaatctcagataaatttaatcaactactaagttacttcacaatagtgtcatcagactttttcatgtatttaagattctggtcaatacgtagcccatagttgaccagcgcctcagtggtcatgtctaaactaaactttatctcgacttcacttaagctgcatttccaacaaattccagtggagcaagggctgcacattttctttcttggacgctagagggagattggttgcagtcatccacttttaggtgtattttgcagcaaggctatgtccttctcatcaccatctagtctgctgctgagaatagtcacatatggcagcttcctaccctttggccctatcaaaaccacacatttttttgagtgctcttctaacatacgtgatggtggtggtttttagctcatatttatttaaaaaatgagattgcaaattgaggaagcttaaaacgggtacggctaacatcaaaccaaaggagtccatacagaacttgttaatctaatcataattacaaagaaaaatacattaaaaatgtaatagctgaacgtttggaacctcagaggatacaactaatttgtactaaagcaggttggatggcatcataaattcagtggacatcagtctgagcaaactccaagagatggtaaaggatagggaagcctggcgtgttgcacttcatggggtcacaaagagtcagacatgactgagtaactgaacaacacaatataataaaatcctctgtgttctcacctctcccactctccttggtcactcactcccagcataccagccttattactggtcctgagtcctacagacacattctccccaggaacttctccctggctgatccctctgcccacaatttcttcctgccaacaccctacagctcattcctgcagaggttcaagtctttgcccaaatgtcatcttcccagtcaaatctaccctgcctaggaaatctcatggacagaggagcctggtgggctacagttcatggggtcgcaaagactctgacgcgagcaactgagcacacgcatacaatgccacacagcctaccttatttctgctaacttattctatgttttatttttgccgtggcatttatacatttctattctacatagtttactgatttgttttgttgataataatcagtacataatgtctatgtcctttactaacatgtaagctctatgagagtgaggatgtcagtctgtttgcatatcactgtagcccaaacacctagattaatgcctggcagggaaaaggtactaaatgttaaaagacttaactagatcctctgcagtttaattcaataaaacattattgctttgtacttgaatttaataatatttttcacgat

SEQ ID NO: 62515 - DNA, 1351 bp, Bovine  19866881266302
caggctcctccatccatgggattttctgggcaacagtactggagtggggtgcccattgccttctcccactgtatcctgcaattttgctgaattcattgatgagctctagtggttttctgataacatctttaggtgtttctatgtagagttgatgtcatctgcaaacagtgacagttttattttgttcttttccaatttggatttcttttatttctttttcttctttgattagcatggctaggacttccaaaactattttggatacaagtggcaagaggggacatctttttcttgtcctgcttttcaccactgagaatggtgttagctgtgggtttgtcatatgtggcctttattatgttgaggtatattccctctatgtccactttcttgagcatctgtgtcataaaatgggtgttgaattttgttaaaagcttttacttcatctattgagatgatcatatgtttttaattcttcagcttgttaatgggctgtatcacatggatttgtggatattgaagaatccttgcattcctaagataaatccgtcttgatcatggtatatgatccttttaatatattgttagatttggtttgccagtattttgttgaggagttgtttttttaatagaagaggactttagaaaaataactgcaatactattatcaaaactttgagttccttaatatcattaagtatcctaagaattcgtgaatgcttacaattttggaaatcatcaaggaaaagtgattacaattgaaatgtgtaaagacaagtggttgttttttactcattggtgagtaacatatcgataaggtgcttagtcatactgtgaaatcattttgtaaaaagcacatctgcaaagtatttgcagtttccaggagcctgttattttcagggtctcatgaaaatacaaacagtttgtagagaagctccagcatctatggcatctattagcgggaggagtctatttggctggtgacatggtgaatttaaggatttacatctgggctgaggttatgggggagagtactgaactcatactcaccacacccaggttatgcacccaaattcccagacaacttttgtattattttcggcaaagactgttctcaatgagaaccatcctgctctattgctagaaacaaatttttgccaatgatcagggattggttgaggacttggcagtgagccagccagacagcaggacatgggtgtgtactcttaccccatctctgtacatccaaacacatttatctagcaatggaaagatccccccagacattaaaaggacaggacctatgaattttaaatgaacttctccctagggctctccaaacacatgctggcag

SEQ ID NO: 62516 - DNA, 1854 bp, Bovine  19866881270579
cctgttttaatctcatttgaatctggtttttcaaccagaaaagtgaaagtgaaagtcacttaatcatgtctgagtttttgcgaccccatggacgctagtctgtggaattctctagtgggtagtgggtagccattcccttctccagaggatcttcccatcctagggatcaaacccaagtctccctcactgcaggcggattctttaccagctgagccaccagggaagccctgaatctggttaaccatgtaaatctggttagccatatgcagttatcaaggaaactagaccctgcctctcttccttcccttacgtttagttgctaagttgtgtctgattcttttgcaaccccatgagctagccacggggtttttcaggcaagaatactggagtgggttgccatttccttgtccaggggatcttcccaacccagggattgaacccgtggccactgccatgtctcctgcattgtaggtgggttctttacccctaagccactggggaagccctttccttatatatcaagatttagttcagttacccatgtttatcttacccatagctgatagaactgaatcagcattgtttatcaaagtcattataagtgactttatttttggtatttacattttttttcagtctatttcaatatctcacagaagataaaaattaatttgtaaaagttttctaatttacaaattatttccccttttccatattgtaacataaggcaatttgtttaacattcccaattttccaagctataagattttattaaatattaaatgctatgtattttttgttctgattctgatgttttaattaatatgtccattttacttaatttaagcttagacatttaaaagtactgtcccacttaaactgtgtagaacacaggcagaatgataaataccagctggcaatgtaaatagtttcctgataaaggggatgtattactgatatcacacctcctcctcattctgtccatgaatgatgatgttcttgacaggacaaagcaaaagattcacagacatgctacccttgacacaccttaatttctcaaaccaacaatagtagctgtgtatttaataacttttgccatatgaataaaaaaaaaatttaactggtatgtttgtaagggtattgaaaagacatgtgtttccacaaaacaaatctgaaaaaaggaacggaggcaatttaggtgaaagagaatttgttaaagcagcttgagttaattaaatctcttgctggctttatttggtttcttgtcagtatgccttacttcttctttcaacttagtgttggctatcttgaagttgactggcttgaatgggaggaccacacccttaatttgattttccccctgagtcatttcattcaacaaagaaattttactgggctttttttttccttcaaagtcttttttaaatgccacattgtactgtgtctagaaaataacttgggggtgtggttactggtatgcagaacatggaacttacaggaagcaatgtgattagaagtccactgaatatttgagggaattaattcccacccaaaactcagtactagtttagaaacactggaacccataattttcatgagtggaatatagcttcagttatttaagagccttcacagagggcatgctcctcaatatatccactttagatggatatcctcccagagggcagaggcagggaccaaggataactgtggatgagggggttcctcatatagaacagaattcagattaaatcaataaactcgtccccaccccaaaacacagaacaggtggccagtagaatgtctgtccagtgacaaccatatggatcccatttctcctctttctggatgggg

SEQ ID NO: 62517 - DNA, 4589 bp, Bovine  19866881291335
aattgaacattgtgtttccggtatgcaaacagtgcagttttagtctcctcacagggcctcatgttattttatgtattgtatgtgaaacattatcaccgaagtcacttttctgtcctttgttttaaagtagagtttgaactgtaagagaaactgagggaattccctgggagtccgtggtttggactcggcgcttttactgctggggccaggttccatccctgatcagggaacagaggtcctacaagctttatggggcagccaaaaaaaaaaagccctaagtgaaattttagtagctctgtatatctagaaaatgtatatgctgctgctgctaagtcacttcagtcgtgtccgactctgtgcgaccctgtagacggcagcccaccaggctgccccgtccctgggattctccaggcaagaacactggagtgggttgccatttccttctccaatgcatgaaagtgaaaagtgaaagtgaagttgctcagtcgtgtccgactcttagcgaccccatggactgcagcctaccaggctcctccgttcataggattttccaggcaagaatactggagtggggtgccattgccttctccagaaaatgtatatagtatctgtttaaatcatggaagtgtgctaaattttatttcattatcttctgtaggacaaaaaagagcaattaaatttaaaaaataggcagatatgggactttgctggcagtccagtgtttaagatgccatacttccactccaggggctcaggttcgctctgatcgtcggtaggggaatatactgagatatactgactcctttgtccttaaatgccattcactgtatccctggatactgtgttcccatgccctgtttgttttctctgtaacattaatcactagctggtattcctctgatttctcctgtcttttctcatcatcattactttaattgctcaaaagtttaggattggagaacacaaagagagcagagtgacccatttctctgttaatcgacatgcagcaacaattaaaagaatgtttttgttacttaaaaggttataattattcatttcgattttgtttgcatttcatatgcaaatataatagctgtatcacaaatcttttgtgaaattataaaatgtattttaattctacagcatttctcattctcagttcagttgataagccaaacagatttaccattaaccttaagatgagcataatttataggtatatataacttgtgtgagagaaatgttcttattttgatcttgattcctgtttaaaaaaaaataattttctttctcttaccattagatggttatggaacaaggagattggctgattggaggagatcttcaagtcttggaccgaatttattggaatgatggtcttgatcagtatcgttttactcctactgagctaaagcaaaagtttaaagatatgaatgcaggtaagacatggatctgattatctcacatgggactgtttggagtctctgcttgatgggggaagttcttaaggattttttccaatacttactaaaaagtaagacagattgaggagtaaagataagtggagttagcaatggaatatgtaaggaaagctattatagtcagtctgaatccacctgtgtagttcgctcccattctgtgtaaaacaatagaaataatgacattctgcagaaaacaatagaacagcaataacacgttcactcttcattcaccaagtgctcgttgctcatctgttatatgtgcctgagtgccaagcgctgagtattcacaagtaaacaggagcttatggtgtattagagagagacagtcaaaaaacaacagaaaaagtcactgaagagtaggttaataatgatttcagatttctgaattaggatgaagtggagcagtggaagtggagagtctgtagaaacccttctttataatactgccttagaaagtatcccaggacagggattcttatattagacatctgtgattagcaggtcttttacacaaagctaggtaaataatgtgtttatgctggtacacccacaggtgccacagcgtttgctgtagattttgggaggcttttttaaggtctgaagaatttcaagcctcttataatcatactgcttatgaattctcactctggaaatggttaaaccctaagcatgggtactgctttttcaaataacttctgtgtagaaattgaggagatagctctattctagtttgctgataattgatacgacgtgaaatggatcaggaactggagatgtgatctgggcacaccccttcagggctccatgggcctcagcagcctgctcattcattcacatttcctgcttagacacctcagggtatttgatagtgtaggaccacatttctgcttctgaattttattcctcacctctgagtttgaagcacttatttggcctaagccacttgtgcaggaatttctctgtgacacccgctgcttgctgatacagcagcttgttttcttcctttttgctgacaggtttgggcaagtcgcaggggactgtatcacgcctgctgtaagtccggatggtgcccctttctcttttgtcagtatgtgacttaaaggtccgtgtgtaagtctggtttggcctttgaagtgtaaggaagcggggcttctgggagaggttttcctttctgaagagaatcaggcttaggacacaaagttatctttttccatccttccttttcctcttgctttggacgtgatcatgcacgggttcagtgtttggagctccggcagccattctgtaactatgagaatccatgagaatcttatactgttgagtttctgatcaaccctcgagtcctctgtatccacattttttactcaaaagacctaatgcatgtttcagttatagaagatgcttctagttgagtcttatcttgtttgtggccagaagcatctgataatttaacacgtatagacctctttttttctagtaagcaggaacatgtttaactgaggacttgctgagtattttttttccaatataatttatatcaggagctcatgttaataataatcttttggcactgttgaagggtcttatcatgaaattatcattcataatcggagactttatgttacatctgttttgcattcttccttgtggggccaaacgttttaaatcatttagagaatttgttgcataatgaatgattgcaacttttgtttaaagtagctgggagccagttatttgccttagatcaagcaaaaaagatggtggggtgttattttgtttacttttccattttagactaaagcaaataaacaacagattgaggaccttcctttatagttcttactcattcttttccggaagccagtaacaagtcatctacttgtgtgtacaaatcataattcaagggagagaaaagaggagattcttttttttcttttacttaggattcctttttaacctcttccccctccttccctcatcatagtagaagaactctgattaccttgtgtgggctgttgtcctgtgcacattgatagggtcagttttggtgtttctaacccattctgtagctggaaggattggaaaatcactaacacccatgtgattgcaggtgtcatggttccaggtggcaggttctttgaaccatggatgattgaccactatcttggaaagaatgaatttcacttaagccaattaagagccacattagtgtttattatacacagtggagtcctgctgggttacgaaaggaaatattggcataattcctttcaagctagtgtgtgctagcacagtgctgaatacatctgaaaaagccttgtagagtttattgaaccagaccatattttaaatgaattgatagaaacagtagatagatatcttaggcaaagttgggaatgatagatacatgaggaagctgaggcggaagcagatcgtctgcctctgaaggcactgccacaaggcagtgagcaggagatgctacaatctgaggttgggtgacggagcctctatcagccgggtcagggcacactcagatgaggctgtgagcattatctgtcaaagtgagtatttaaagacgggtggtcaaggttaagggagctgccaaggaatgacgaggcatttggggactagcaatttggggtagtattaccattcttgacatggtttcttaagtggggaaagagaaggctggcactgcagggaagggtagcaggcaggagatagttggggtgtgggcgtggctgtggtcaccatgctgggggcagatgttttctcctccatcctctgcttgcctgttggggtctgccttggggaggtaggcgtgcagtcctccccctgcccctggacacacacgtgcacacacacacgtgtgcacacacacacacatgcacaggagacatggactagaggggaaggtgaatgcagagcagacagtacagggtctatttggcaaaaagctttatattcaacattacttttcacgttaatttgaaagcactttgaagaaagaaaacaacttgctgccatgtttggggtgtgagagtccctgtttgtgaaaaattctagtctattcgtatttactcaagtggcctatctctgtcttgtgga

SEQ ID NO: 62518 - DNA, 1314 bp, Bovine  19866881299970
tagaaaagttgaaaatcctcagggtggcctattcaatatagggtatggggttgccttcacactcctggactttctgaactatgttgatataaaaataaagtacttggtagaagagaggctatcaagagagatgaaatgatatgcagtggccatcatttatgtcactgttcacatagaactgagatggttttgtaaatcactaaataatggagccgtacactgacagggaacgaagaccaagtgtgtggacctgggtttgtcctacgctctgttggccgagtcacttaacctttgaggattcacttccttcctgttttaatgagaatgatgctctcttccagttactttaacttctacatttctatagttctaggtgttagaccaagtaatttttgtttttacacagtgagtcaatgtgacggtataggctacagagctacctttgaaagcagctggctgttaagtcacagccaacaccttgtcttatgcttcccagatccatatacatatatacttgtagatttttttggaaggggagggcttgccaggtgtttttttttttttttttcctggcttcccgagatgattttaatttgttgagatttcctgctaatagatactgattatataggaagtatatacatttattatccacttactacttctaagtgctggtcatgaaatcgtggttgtctaatgtgaccatttctgttctaggtccagtggcattgcagagcaccgatggttgcgggagccaacttctacattgttggccgagaccctgctggcatgccccatccagaaacagggaaggatctttatgagccgactcatggcgccaaagtgctgaccatggccccgggcctgatcaccttggagatcgttccctttcgagttgccgcttataacaagaaaaagaagcggatggactactatgactctgagcagtaagttttacattctctacataaatctgtgaaacaccttgtgttctaagctgctcctagggttttaatgtactgccttatctttacaacagctgaccagtggcaggctttgttgtaccagtttcagagacgggcaaaccaaagaaactaatttctcaatactttagaagtagaaataaaaattgagtctagtttcatggttcatgatcttaggaattttcttgggaagtgttaaggcagtgatgacatttctgtctgtcttatagaagtagtccaagtactcagcgatgattttgctagtaagtgcaagggatccaagtaataagagagttgactaatatttgtgcagtcattgtggacaggcact

SEQ ID NO: 62519 - DNA, 1347 bp, Bovine  19866881474587
attaaccttacctgagttaggatttttatgttatcattctctttcgcagtaaaaaataatatagtaataataatgataatatcaatttcagcaagtacattgcagtttaattccatagatctcaggtgatttttttccctgtgtttcttaatcttgaagcctctgttgtccttcgatcacattacctttcccagtcgtttccatttttcttccttttccttcacagctttattttctactagaagtacttctgtgatttatctatagtggttatatgataaacattgactaactttatgatcattaccttccatttgctttccttccatagttgtttcaataaatcagtattgaatagatcaggacatgaaatgcattattattttcttggtacacatgctctgtctaaaagtgggaagaaaatctgtatctatgcacctagttggattattgttaagctaaaaagtttcttgaaagaaaattactttggtgatctgtacatctaggtgatagaagttccatcttccgccaaagagagatggtgagctactagtggatgatgaccatgttttattcatccctgtgtttccctcgagtacctaatgcagagccttacacagtgtagttaacttagaaactggctaactaagttagctaatttattctagtctggggcattatgatgatctgccaaactatctctgctaaataaataataaactagcatgactttactatacttcttttgaccagatgagttgcataccctcaacatagcatgttacagtcaagacagaatttctgaaaatttcacatggttcatagtactctggagtgaagtaaaactgtcatttacttagagttgatatcctagaagccagactaggaaaatggagaagtagttctataaaccagaaaactggatttgtttttagcaatctaaacattaaaattgaaaggtattgaccaacacctaaaggatgagagttggagtgaacttcctagtgtggatttgatttctcttgaagtgattactaattttaagtaatgaagaccctaggacagctaggagtaagtttgaatttaatttaaaaccagcacatgatggattgtactgccagctattgcaatggacatttatttaattttttctccagaaagctttttatttatttggacatcttccaatcataggagattatttagataggttctgtaggaatatacatagctattgttcaatcagtggagttcctggttttatttttcttaagaactgttgatgacagcatccagaaatgttagtgttaggtttctacaattcgaaattgcccagaatataaactt

SEQ ID NO: 62520 - DNA, 3172 bp, Bovine  19866880403533
taataattactctactgtggttttctataagggtagttcattttccttgaaaatttgttggggcaacactgattattctaattattagagatcacactactggcatttagtgggtagctcttgggataccatgtacctttaatgcttaagagcccaaaatgataaattgtattctttccctcacaactttttcaagatggaggaggaaatggcaatccactccagtactcttgcctggaaaatcccatggatggaggagcctggtaggctacagtccatgaggttgcaaagagttggacacaactgagtgatttcactttcctcacatctctcagaatgttccacatataattttgatctgagaaataaaactaccttataaataaatgcaaaataattttgcatagtttaaagataagtgactttcaggaattgtactattgtgaaaactggggaaagttgtgttttattttgttctttgcctgtaattagtaatcatttaaaaaaagcatgtcactctttgaagtgctgctcgtgacatacatacacctaattcactgggcatctgtagcttcccactgattctactaatttcaacatttatattgaaatatataatattttaaaatatattagtttattgcataattttcttttgaaaaaatgttatgtatgtagatagattgtattatctatgaatttcattttaagagagtaaaaatatcatatacaaaggtgtattgagtctgacagagttgaaaattacagccttaagaaataggaaaagcttgtagcattttagtgatgagaggaaatttagaattcagcctgcatagtggataaaacaatggactaagatttgaaggcctgagtcctaattacagctctgacattagtcagattacttttgaaaattatagtatttttatatgcaaaatttaaaagttgggatgacttgaagtggagggaatagactgtttctatattggtcttattccaagatacatagctagcaaatacatggaaatagaacattaattaacatatagaaaaatcctcaaataattggggctacaaaaatgaatttacgtacatttaaggcatttcaggctttgtctggttactcatttgctatgacgggtatggttagaggaggacagattcaataagggctactcaacagagatgcatgtcaaaatcatcattgaggcttataaatcaggtaccatggatctggggcctacagacacttctagagtttcatgtatgattctggtacccactccagatagaaaatgaaggcgttaattatctccaatattttcttcagttataaaattatttcctaccactgtatagagttatctcttaaaaatagtgttaaagcaatagactacaaatagataattcaccaagtagtatttaactcatatatctcattcaatttccagacctagtttgtgttccccagggattctctaatcatctcagaagatgtcttgatatttaaattcgctttagaaattatgtatgatgtaatgctttaagaaaaaggcctatatatgaaatcttaaaagatttaaggtgttttaccagtctgagtgaaaagtcaaaattcactaatacgaccaagaattcaaaagaaatattgaagcttatagagttccattattaggtcttgctctttaattttaccacttagtctatgaactggtcttcctgatatttgtagccttggattagttctgctcacaatgaaagtgaaagtgaagttgctcagtcatgtctgactctttgccaccccgtggactgtagcctaccaggctcctctgtctatgggattttccaggcaagaatactggagtgggttgccatttcctactccaggagatcttcctgacccagggatcgaacctcatttttaaaagagggaaggctagattatgtaacaactctgaaaattttattttttttccattggaataacaaaaaaggtggggctccagggtggggttcagagagaagagcaggttcataatccaggagttatagacagcttctaaggtgtcataaaggttcaccaaaattgactctgttcagctcaaccttaaagtttgcgtttaattttaatgaatgggttcatcaatggcacttgtcgtaaaaaggtgaacttcagctccccaaagatgatattgacattaattaaacaaaggcaagtggtaataaatctttaaaataataatctaaaatcctttgtaatcactaaagtggaatttgtcttgtatcggagtcataaacctgaaaagaatcaggatgtaaggatcatattgctctcgtgtaggaagcaagtccaacattcaaatccatgaacaaagacaacatacagttaatacctcctaaataaacaaaaactgatatgtgaaaaattaagtttaaataactcttataataaacatttatgcagatatatgtgaggtttattgcttctttgtttttagtcaaattatagctggacattggtatttaggggcactagagactagataaagttaacatttgtacttaactagcgatggattgctctggaaagcaggacaagacagatgtggtggaacatctagagtaacagattcaaaaatcatgttgatgtatttattatctcaatcatggaaaagtaatcaaccaatactataccatctcagaaaatagcaccactctaatggaacctgggaaaacaatcatatcctaattttgcatttcacatgtgcatttttaaatgctatcattttcccctcctttgatctttcctttgtatttgcaaaaggggctttcatctttggatgcctgtgcagggaggtgctttggagcccgtgtccttccatgtgtatgatgccaacagccagccagacttttgtaaatgacacaacagtaccaagacagctacatctgactgcttaacccctcagcttgcctgggcagttcaggagcccctgctgtgatgttttgtttgcacacatgcacagataaaggccaccactcctctcattaaataagaaggcatgtgggaaaattaataatttaattggcagggagaagatggatgtggatatcaaatgtaaatctgcatgcttccctgagcattcacctcagtgtctgaggaaatctggtgcca

SEQ ID NO: 62521 - DNA, 699 bp, Bovine  19866880423406
tcattctgatacagtaatggtttttccaaactaagtgggctcccttttgtagctacactttattatctggattcttattttcactcttaccccgggatttttagagagaggcattttttctcacatgcacatttgtaaatttcgaggagcagcaacagtcaagaggaaagatgcaaactcatgattcagatctgggacctcacacgggcactgccaccgctgtgcttctatgacttacatttcatgcaatgcttcagtttcttccactaatataataaaaaggagcctgaaacttttcttacataaaaatgcatcccccgccttttttttaagttgctagatttctggcatatatatatcctaataggaaggcattctggtcaaatggaagaggcttagggctttgaaagagggagcctaaattctaagcccctgcctggactggggaacacaggtatacctgtggcggattcatctcgatatttggcaaaactaatacaatattgtaaagtttaaaaataaaataaaattaaaaaaaaataaactgggctcccagctaattgagagaagccattcccacaatctgtggaggctcagttgtcctttgtattatgctacttggatgatttgagtttcacaacacttgctctaggaatagcacggataatgctttagaccaactaaagaaaggaagctagt

SEQ ID NO: 62522 - DNA, 1602 bp, Bovine  19866880442468
gttgatagtccctgctatctattatttacttttattcccccatgaagcctgatgtctggtaggaagtcttttatactaaaatttaattacctcttccaccctaagggaggtgtgcaaaaccctgataacagagtaaacacacgaaggttagagaaactcatcttcgcatggtgtttcccgtcacctgtcacttggaggggtgatgttctctgcgggtttccgcacgtgtccgtggtgagcaggacaagaagcacagtcagcttggaggtgccagctggagaagctaaaggatgtcttgattcaatccttcaaactgtggtttcctctcctggtttgacatttgtacactggccatctatcctaccactgatcacgcaatgaacaaaacaccagtcatcagcaactctatgttttcttttccagaaagaaatgagatttgtttccccaatgatatgtggaaattggtctcaatggggaacatctggctcgtgcatgtactgaacatgtattccatgtgcttcctctgccaggtgaagtgctgtgcgtgacatagatgtgaacatcacagttcccgtccccacctagcttgccatctacttggggtgccaaatcacgtcgtgtgtccacttctcctttttgcctctaacggcatcatctctgaggagatactcattatctgaacaagaccaacgattgctccatgaatctgtatttctcttctttctgataccctgttaccagatcaatcttcctaaaaacaacattaaacctcctttccaatcaaaaccttctaagtgtacttactggtgattgaaatttactctctaggcagtcattccaagccaaaactccccaaccctaggtcttactttgtgactctttccttatgcatccggtgttccagcctcactgcacaaccctccttcctaaccacacggtgcttctctttgtcccatatgttgttcacactgttccctttccctcaagtgctcttctgttgctcagcaacctattcttcttttgatggcttcgctaagcccacattctctacaaaatccttcccggttgaccagtcacagcgggaagaaatctcttaccttaagcgccactcccttatagttacactcccctaaggctttggtcatattctgggtttgactcatccgatcagaacacattcactcagtgtctaccatgtgtcatatactggtgatacaataattaaaaataaaacatgttcacaaaaactcataatcaggagtagaagacaagcaagcaattaacaagtcaatgtgacaagatgctttgtgtcaagtttctcagccttggcactatggacatttttgagtcagataattctttgttgtatgtgtgtggaggagtcctgtgtgtatgtgtatgtggcgggggagtcctgtgaattactggatgtttagcagcatctctggcctctgcccactagatttcagcagcatgccccaagttgtgaaaacctcaaatgtccccaaacattgctaaacatctgccggggccaaaactgtgcctcgttgaaaaccactgcattgtaggatttcacaaaatatgaggtgcataggaaggcag

SEQ ID NO: 62523 - DNA, 1254 bp, Bovine  19866880511707
ctagttgtgttgatcagtaagtgaaacaggggaagctttgtaatatctcatacaatacacagcctgagactatactgttctgtactgtgatgcgatttgttcaaattagagatgatgaaggtgctagaatttctgatcaattctactgatctctgtgtgggaagaaggcagagctgatatacagcttaggcttacctgggctactgtacccttagaaggcagccaacataaacacagaaatgggggtaaagtttgagtttgggttgcagaaactgtgatcagatggaggccagaagcttctgcttcctgctgaaaaggcagctcgagctctggggaaggtttttctccttctcacttgccttgttctcaatggccgacattaaggtaacatgagagcagctccagtcccacaaaagccttttataccatcaggaggcaattatggcctaagataccttccctggctgcatcatgtcttcctgaaaatgcagggcaaaggattaatgccaggtgaagggcgagtcagcatccaaatatttatctgtgaatttaggtcacaccacaatgctcagttgtgtcattccctctcaacataggaaaaagtgttctgtatcctggatacaagttcagtacaaaattgttctccaaggattacaagggaaatgctgaagctcagcaattttctttgccccttgcattgggctgctgtgccatcgggtgggcttgtgccagacagcagaatggagagtgaagtagtgctggctacaaaactcgtgtgagagagagaaatgagcctttaccacgagaccttaaagagcagggcctgaacttttcaccttttcggtggacatttgcaaggtcctcagcttgaaagtgtttctcttctgcaatccactgagcatgctaggaaggccacagctgggcctgcctcccctctggcaattgatgaagacacattcccaagcatccacttggagtcataatctttgttaacttgaatgcatttaaggacattaatttcttcttttctctcatgaggttttagcagaaaatcccactcctttttccttgccggcaatgtggtacatggtctccacacatccatatcccagacatacccccaatcccaatggtggagtccccaatacccttagtgcacctggttgtcatcacagatgagtgcagcttgctttctgggcttgccttgtaagatctgtggggagagtgcccatgtctcctctccccagctgatgc

SEQ ID NO: 62524 - DNA, 1173 bp, Bovine  19866880535524
tttaaagattttaaagatacatcttggattttaatactttatggcatgttagcagttgcacatgtttttgacaatgtttttaagcaatcaatttcatgatattttcttacatgcggggaaaaataatggtaatttcacttgttaaatgagaaaaataaggcaagaatgaaggtcaaactgatttagcacatcaaacagtctttgtcagccaagcttaatatatcctgagtttgtggaacaaatgaaattttgctgctatgttacactttgcttccaaacaaccattacaactggttttatatattgtgtgagcatcagaccatcaaacagtgcatctttactgacgtgttgctgcagcgatgatctacagcagcaatctgccatttatataagggcaaaatgtgcatctatatttagttgtgaaattggcctattatactcttgatgtttacagaggctaacataaattaatgatgacagctatgagcagtgcattagttaagcagcagagttcttaccttgaacttgaaggttccagttttaacttcccagtatgtactatactgctttcttcacacattaaaggaaggtttctgaaattattaccctttcttgaagagcattaaaagatttcgggttgggagttatgttgtacataatcctaccagataacagttttttatgcatttctcaattatattacctcgtaagaaatgtggtatttacaatcatggggggaaaatacttctgaaagatttttattctttgcagtggactgatttgattgactttgaactctctgtgatgccaatgtgtggtggactgttttattgaaagtaatgaaggaagggcaagcagtgcttatagaatctttactgtactttttccctgggaagctgcctcattcagctcatgtcagggcaggtgtaggtaccggagtaactatagatttcaccgttaactatgaccagagatctgacaagtatgcaggtgttcaaaggttcatgagttaaaatgctgcagcctttgatgaatttttgatggctgcatttttaatacaggtcgaccttcttcctttgaggctgcatgccagattaattgataaatagtagaagtctagtgctggattctcctaagcaaaacaagtaggaaaatccataaaaaaaaaaaaaa

SEQ ID NO: 62525 - DNA, 982 bp, Bovine  19866880566768
ttttaaaatgcctgccaaaaactgagcctggaacttgggggaaagaggggcacagcagggaagacaaggggccaccctcagaagtgaagctgttaagctgtgtatctggttgtgcacagggacagctgagagggagggagggggtggagaggaagcagaaaggggtgagtgggatgtagagagggagggagagacagagaatatgagagagagaaggaagaatggagagagcatgaattgccttgcaagttcaaaaggaattccatggaacagcaaatacctttggctttttcagaattcatcctagactatcatttgccttatggaagactgcctgaaggcctaggatagcagtagatcacggaatcctcacggaatttctggctgagctgtagctgtaaatgtttatctgtccatcagtgaatcactcaggctgtattagaagcaaatagaaaaattggcaatgtgtattaaaatatatctttcaatataaacacccgacatgtgactaaccgttgagtgaaaaaaagatctactttatcctatggacttctctcaggctttgtgttgcaattacctatgatcccctcccttctactacatgtactatttataacatcaaaagggtttcgagcttcttttcaaaaggaatttattacccaaaaggttgcatttgggaagggagccaactgaagactctggagaaaaaaagaaaaacaatttcatttatttaggaacaaatatgattctgataatgttgaacacgtctttcccatactacagatacatgtatgtgccagaaactttcaaaccccagcagtggtttacgaatggaagaaaataaatgtgttccgaagttccatcctgttaaaagcaagaagacattctttttgtcccagaaagagggaactgggaaagaaggggattgccagaagggttaagcacaagcagagtttcacacacaattggagatcaagatata

SEQ ID NO: 62526 - DNA, 1072 bp, Bovine  19866880616422
cttattggattataattgctatcccctgtattcagcattaaagaatatcattcagagttggttacaaaatactatcacattcctctttagactctcagtaaggaatttattgccctggtaatttgactatgtcttgcacagaatctgccactcggcttagctagcttggaagtctggtggcagcactcagagagcagatccatccctctcaggtggattcacattaaccacatccatgaggccaataaaccagaatgccagattattcatttacagtgagaagtacaatcacacagatggaatgcttgtcttagcaagaccctaacattcttttcctgcatggaaagcagacattcagaagcccctactgagcctggaatcagaataggggagtaagatgaatcacagtaatagttctgtggtacttactgactgttgcatgcatgctgagttggcctcagtcataaatctggctctttgtgaccccataaactgtagcccacttggcttctctgtccatgggattctccaggcaagaatactggagtggattgccatgcccttctccagggatctccctgactgagggatcgaacctatgtctcttatgtctcctgcgttggcaggtgggttctttaccactagtgccacctgggaagcccgcttactgatggtaggttagtcaatagttcattgaggctgcttttccatatacagtgcctagaaggggacatctggcatttgtctccatggctgtcattttctaagtactctctgtgggtaagtcatccctttctcagtgtcatgttctttttcttaagtcatcaagtaatattcacatcatgatgtgacagaattcattctgttgacttttttgttctatggtttactgttatggtagaaatttcatagatcagtttattttctgtatggaggatgccactggttaggtacaagtagtatgtagaactgaggtagtgggagatgaccagcaaaggccaactcactagctctttctggacttggaaccacgcctgtctgagagcctgccttgaggctgtcagcaggtaag

SEQ ID NO: 62527 - DNA, 664 bp, Bovine  19866880618053
tcccctaaagtcccagcagagtgcctcatagttgctgctcataaatatttgttgtttattttggaactgcttttaatcttcgttgccattcagtgctttgaaaatatatataacagacattaggcataaacttgaaatgctttttaatcagttggtgcagcatttttcaattactttgtaaaagagagtgccgagggatgtttcagaatcgtctgggctgccagtatggctttaaggataaacagactcttcaatgacatgagcttctttctctgcactatttgtgtgtttgcctcctaacatcgtccctatgctcctaggcttcaggtatgggagacacttttgcgtttatggaagttcctcagagctgtttggtcacttgctaatatatatgtggttttcataaaattgcctatggaggctagtttcttggtgtgaaggaggaatggagaataggataacaagagccaaagcactttatgtttttctaatttttttctttaaaacattttatctatggcttcattgggtctttgttgctgcgctcagactttctctagctgcggagggcaggggcaactctctagttgtgatgcatcatggacttctcattgtggtggctgctcttggtgtagagcacaggctctggggacgcaccgggctt

SEQ ID NO: 62528 - DNA, 2000 bp, Bovine  19866880628774
caatggcaacccactccagtactcttgcctggaaaatcccatggacggaggagcccgatagggtgcagtccatggggtcactaagagttggacctgactgagcaacttcactttcacttttcactttcatgcattggagaaggaaatggcaacccactccagtgttcttgcctggagaatcccagggacgggggattctatggggtctatggggtcgcacagagtcggacaccactgaagcaacttagcagcagcagtagcataatcctaaaacaaaatcttggttaaaaaatagtttagtaatgatatgggtcagactggtgtgtctttgctagtttacatgactactgtcaagattatttccattaggaaatagattagatggagagacgtctgttccttcttcttggaaacctagatattaaagatacatggactctcctgactgtgattttggaatagttacatgaaataaagtcaaccaaaggtagcaaccagctttatttaagtacaatagaaaggctgagactgtatgacctgtttttgttctggctatgttcaacgtttcaaattcttgttgaaggtatttccttatactgatatgtaaacacactcatccaagattgacttttcctccctcttcataaaactttggaaattattttgtaagaaaaactagtattaatttctaaagctaatggacactattttgaaggaagtaagcagatccttacctgtagcatgtgaattgactaccaaaatttttccacgaataacagcaggaattcagaacagagatttttttcgctgaacttcttgccaaaggctaacttgccaacttagttccacatttgtaattcagtgtaagttcatcccatatttgtgagtcaggctgatcctaactggaatgcactgaaattgttaggattgctatgtatcagatatctgtcaatcaaaataataaaaagaaatatcattagcaaatcatttggctaagcggttgaacctttaaaaattcgaaatataccttatactgccacaggagactgttcttaaatgaagagaaaagctgttacttaagtacaaggtaatgatgattatctgtaattcttaaggatcattttatcttcgggaaattatttgaaaaggcagatcttaatgatcgtcttgcctcaggactcatactcagaagtctaaacagagtgcctcagtttgcccaataaaatattatacaaccaagaataccagagagtttcctgatatttcaattcagaacgctaccgaaaccacatattctttctcccttaacactgtgaatacaatgagtaccttacatgatccatctgtaaacgaacgtgcacgtgagcgatgtgtgtgcctgcacacgcacagctgtgtacctgcactcacctttaggggtgggctggggatgctgggctgtcacttcatttgaatggcactggctctcgtgtcgtcagtttctcttgtgcctctgggcagagttaaagattgcgggtgtggatttacgcaggcccactttcgagctggactcttcactatgggatcccctttggctccttcctgtccatcacagggctgggcaattcagagatcaagttagatacccagctgtggcttcatgcaatagaaaacatatattttctacaaagcagtagaagtttaaaatgacgtgtttataaattagcaaactggctttccattttatttcgcactttgcttatgttaacacttcttgagatttcacattctttgccggaagcacagtactggtacagtgtaaagtagcaagctgcaggagcaatggcaaaaatatagatgcttgcacaattgttcttttaattcttagataaaatagaataaattcaagattgaatgggttttgtaaattactggtttcaggacttcgatccagtgaaaaatgcgtcctcctgtcagaactagagagggagctaagccatctcctctttcaccgatggcta

SEQ ID NO: 62529 - DNA, 1456 bp, Bovine  19866880661210
tatttttactctttttcttgatagcctcgacaagttcgagcttgccttgaattttccatggggataaggtgtgagtaagatttccacacctgcaggtgtacatttgttattatgtccctccagacattttcttttcttggaattcaaatattatttctagagtttctgagagcttaggtttgagtatttgtctaactcctcctaatgataagtatgtatgataaattttaaaagatatttagtctaaaatggactttaagagctatctttaaaaatatttaaaaactcttgtaaaatgctaaaaggtgaagaatataaataacaaattcaatgatcaggaacagtaaatatattttttgcctataagcctcaaaaaagtgtattaagtaaccaaaattcttattagggtaaacaaatgtaatagcagctagcatgcatagagtgtatctactattatcctaagtgctttctgctaagtattagctaggtttccatttttcagctgaggaacctgaggcgcaaagaactggagcaactgcataagatcatgcagctaacagttggacttgctactgaataaagagaatctaagtctaaaagacaggcttttaactacccctcacactgtctttgaacatagatttaaatactaagaaatcctctggatcttaggctagtgagttaaaaaaaattttttttttatcaaaataactatgtataaaggaaaggacatggcttatttcagtgagatagagggcaaggggtagcagggggacacctaagcttcaactctaacaaatgaggagttcgggagagtgtttcaggaaggacttagcgcatttcttgtgtgtctttggtcttctttgtggtctgtggtgattttccatctccaggtgcagagacaagcacagagcccctgcactctttacagagagagtaagtgctgagcaagtctgtttgaaacatatgtctttttgaaagtttaatggaggctttttccccattctccttgttgctctttaggaaacaggctgcatactttcagggacgtcggccttaccttgttctccgagaagaggcaagcgctccatgttcctaaggaaaaaacgatcactttgatcatgctgcctgtatgtcagactcgcttcatgaacaatacacttattttaaaagtttgttctcactaaagaaaaccaagtgtattgcagagtttggaggaaaggcacatgtacatcttttacaacaatgttcctaaaacctgtcagaggtgacccaacagtattatctttaaatatatggtcatcctcaaccaataaaacacctcgaagcatgttctttaggtccataaccaacctcaataataatttattttcagttacaagtaaagacagctttaactcaatgttctaataaacaaatggattgaccaactgggaactaattgtcacagtgggga

SEQ ID NO: 62530 - DNA, 673 bp, Bovine  19866880662575
ttatattattatatcgtccttgaataactgtggttaccaaaagttcaagttgatgcagtaatttagaaaaaaaggctctgcttcttgtgtgtctgatattctctgactgggtagttcagggttagtagaaggatgtttgatttcttggcttgcttgtggtgtgcttgcctaggagtaaggcacgggtggtggtggtgggcttttggtttattagaccgtcattatatatttcatttaaacgcaattgtaacatttcccccattttcttcagtttacagccaaaatgaatgtgaaatattttggggggaaaaatctagggtataaaaataatacttaatttatgaaataaaaaattagcatataaagttaatatttgactaaagctcacttaagtttatttttatttctttccaaggatgtctatgatttaactagtaagatacactaagacatgttagaatttctagctataaataacatttttctcataaactgacctagtgatattaaattgatacaaagctcaaaatcagtatttaacatttaatggaacgaacaaactaattctgcaatttaactcaacattttcagtaagatgacttgtaccctaatggcttgtaattaatttctctgaaaatcatatttatgatagtctgcagattcggggctttat

SEQ ID NO: 62531 - DNA, 771 bp, Bovine  19866880720224
gcacccagcactggaaatctagaaaaacatgtatctatgaaataatttcttttgacagagaaagaggaagtcccagtgacacctcttaaaaccataaaaacctgacacatcaactacttttactttaaaaacaaactatgcagtatgagtttggcttgaaattctctgctctcctcattcattatttaatcttcttttactttgttcagacaagcaatctgcctattgtgaagcttcacacagccaattacctcaaggtgtttagttcatttattatttaaagcataaatcttgtacaggttgtccattgacgaccctctgagtagctgtagtaaatgcctttcatccttgtggcctcagtcaatgctcatggacctacctgctgagcttggcaggccaggcaaggtgctggaacatgtaagataccagaggtaattgcacttccttttctgtttaagtgtgcatgtgaaagatgtgcacacagtagcaaatttggggttgaaacgtaagggaaatgaatcttcaagtgcaatcttcccttctatagagagcttattcgatgttttagctattgttataggctgaatattgaatttagaagtttgtttcaagtatgtctagtgacatcacacttaaaaatatttttgtggaaatatcaatctttcatatttgttggatttgtccttgaacccattttccttttctgactttctttcagtcttgtgtcataataccaacaatgaccaatatgaattactttcaaaaaggcta

SEQ ID NO: 62532 - DNA, 1149 bp, Bovine  19866880728896
ggagaaaggagtaagagtgaccgccatatttagatatcctttgagagaagctatgacttctgaactccacaagggaagagtttatagcagaagcaatatggagcaaatggctcctatgtggcagaaatgatgaagagaggaactttagagaaaaaggagagaaactctaaaatgtaaatatactgttaacaaaaagaactcagattaaccctaaaaccttatgaaatctgccttcaacaaggaacacaaaaggagaaaggcaaaactacaaattttttttttttaatcaatatgggtatccagctaccttgcagacttactatagtgtcgaccattgcatctcagtgtttggtgagttcctttctgtaaatatcggaaggaccttgttctaacactttcagttataacaaggtccttgagcgtcaagtagagttgagcattatggtatggctttcatatcattgcagaaatttatagaagtgtcatagtgatttttaaaagcctgtttttattttccttccatgctccttttacttccaggaatgaatccatttcagttcttgtgggtaaaagtccaaaagttactgcctttgtgattaatcttatttgagaatcctcttcaactaccctgtcgtgagttgtagaaaatttgtgtgcagtgaacttgtcaaaaataaaccacagattacttctgtggctctttttgtttctaaaaactgctgagtgctttagtgcaaacatcttacatttagagaaaacatgaaataaaaatgcactagccagaggccagaatggaaccttagtgctggtgtgcctctgctgagatagtgctggatgccagttggccagactcaggaacatttagattttgtttctgagaggaagcagtgcatagccataagccgcattaagttcattaggtgcaaatgctacatgacacagttaatatggtgacagaaataaactcttcagtgactcaattctagtggcaccaattttaaccaatttatcagacaattgagtatgttctgcacttgggatgggttttaaaaatatggtgtccattttcttgtttggcttacttgactttgcagagccagtttagtttatgaagatgcagatatgtattcactaagcatgtcagcactg

SEQ ID NO: 62533 - DNA, 2302 bp, Bovine  19866880753945
aaccttagatgtttactctatccttttacagaaagagttggctgatcctgcattagagcattctcccaactcaagaaatacactgtcgtactttttgttttgttcttttgttcttaatcattcaactgccctggacaccattgtttataagtccatcatttggaaactgtctggatttattgctctccatggattgcctcctgtcctccttaatacttgtactatccctttttctctctctgtttttaaacagctttatactttatcccctaaacactggtatagcacattaagaatgttcttatttagtaactgacatagatgcataactgtgtgctgcatacaaagaaagctgaatactaatagtaagtttaacactatttatgaagcatgataaaatatacatgcacatacacacggaactccacacggcacttctgctgggtctgctaaataggtatttatcaagcccattttacagataagaagactgaggtcaagcaccattatttaggattgcacagctcatcatcacagttagcagcaacattgggatttgacacaagtctttcatctccagagcctgtgtgtttaactttcctctggtactatgcttagagtgagattgatattaggagaataagaaaatcttattgttaaatatttcctctttcctttcaaaggggttcaaaggattgattttaaaagatgtgaaaaggaaagatgtattctttacttgatcagctttcattctgccacgacttaactgaattcagtaagtgaaaccacttcctgaatcccaccgcttactatatccttcccatcctcccaagtgaagatactcactgtggaacaaagtatagcctcttggttcttttcccctaggagaagaaaatatgacgagtatagagactgatgctccagattacctcaattcatattccagataacacttaactagctgcatgtccttgggcaagttgtaaaacctctttgaacttcaatttccttacttttaaagtgggacttatgataatattgtgtgtattaaatacacaattgtgtgttgtgtgtattaagttattgtgtgtattgtgtgtattaaatgcacctaaatgtattaaaggtatacatgcaaagcccttagaatccatcctggtatataatgagcccttaatgatactagttaaatattataagggtggttgtgataatgatgattaaactaagaatgcttatgaagaatcactatagcatcttactaattgtccccttcctgtttagtttctgaggcttcagcataaagagggcataagttaactgaggcgaggggaatttctttattctctcaaattacccctctgcattctgtatccaggtctcaatctcccagcatggaatgatttcgtttgccatctacccgggtaggctatgttgaatagaaaagaagtagtgaataaatattaagcacttctgacatcttcgctggaggaaatgcctttgcttcttggattaggtattccttattgacttcctgtgctcactgaaaggacttccctggtggctcagatggtaaagaatctgcctacaatgcaggagacaacccccagtggtttggggagaataaacacaaacatgtcaatgtttatgatattggccaacttacaaatcaggaaattatattttactaatcttaattggatttctgatgggttcttccttgcttgtcctaaagcagaggtcaacaacctctagcaaacaggctgagttcaattcccagaaattccctctggtctacttctaattcaccaaaagactactgaaataacagtttgaaaatacattacatttgcatggggtgcttcacagtttacaacttggcttccatgtgaattatgctgttaggcccttacagcaccccagagttatggaagctctgaattggagggagctgcctgtccagggagctgtgggtggggctccccttgggtatctggctgttttgtgccccaggaaccttacttatgctgttgtttctgcctcgattgcccttctcgctccccctgctttctgatctgtaaagcttctccgtgggttcaactcagacattatttcagttaggaaaacttccctgacagcctccaaatcctgccctcttagctcatcaccccttctttgtgctttaattatgccccgaagacacctagggctcaagtccctcaccatatttccatactgaatcaccattatgtcttcatacattttcccaaatagctcccaccccaggccttatcatacattt

SEQ ID NO: 62534 - DNA, 2081 bp, Bovine  19866880849162
taatcaagtaggaatgttactgacagtctacaacattgcttgttggaggtaccaaaacagaagctaaaacaaagttatttactttgggtgtggccactgcattcatttggctttgacatctccgaaccaatgtggaacatttttttacacattgtgtaaatttttttttttttggctttgtttttgtttgtactttgtcttaaaggtaagattgatggtacaagattataccacatttttcacagtactagttagaggcaagataatgtagtaatttgagcacagattctgaatgtctgtccccaaggctggtgaagtcattgctcccactgcatcattaataacacgagaatccagattggcaaacgtcctatcatcatgtagaagactctgtttccatttttgagcaactttcctgtaactctgcagtcctcctcttgtccctggtacagccttgcaattcagactccactgcaaaatattactgttaactgttggaaatcttgctcagatggattttttttttccctcctctgcttcctgcaccctaccaggaaaggtatgctccggcactagcttctccttctgttagatttttcctgccacttttacagtcttctttgtcttaactatagaaaaactgcttacatgtatagctttgttttactaaacaataaaaatgggatgagagcatgatctgtctcactgcagtgcctgtcgcctttcttatgctcagcaaccaacaggaatttcacatgaaatcacattatcatttatgttttttatgctcagtagccatcaagaaatttcacatgaaatcacattaccagttatgttttttaaaatatcaagacaatttctgtcttcatttgactgacatacacatattatttcccaaatgtgctatagtgtgttttcagcacttcagtggcttctagctcaattctcccccaccctcttcacatcttcattataaaattactggcaaattcgaatgtcgcacactttaacaacaactctgaaagacactgctggaaatacactgggaaataaggagagagaaacaggcgacacggaaatgtgtgaagattctggcaaaggtttggtaaattctccttgtccctgaacacgtggtcctgctctgtccccaattgtgacacgcagcctctagctagggcctttactttctccaattctatgaattaaatggggcacaatgttcaatttcactttagctgtgtggctgtatgtatataaaatttgaatcattgaatagttaaggtgaaagtcaaattatgccactttctcttctattcttcaatccaactccatcccaaagtggttggtcctttcaaaaggaagaactatttatcccagtacagtaaggggctctccctctctataccaatcttgtgagaagattaaaggccactctattaggcacattccattggattccttgaatatggtactgtagaatccagatggtagaaaactattaagtggataaaagcttagggaccaagggtttcaattataggtcatagccttctcaacctgacattctctatgcccacagatatatcaggcaacttctcagcactgttttctcctctccaagcaggcaaccttggaaaaattgattctattctggtctaggatccaaatttgagatcactgtgcttattaagttttaaaaccaagttcctgcttagattattggtgagatcaattgtcaccaattagaagacaaaacaaaacaaaagctgatcagatcttctgatacagctttcctctgtccctgggattctccaggcaagaacactggagtgggttgccaattccttctccagtgcatgaaagtgaaaagtgagagtgaagtcactcagtcgtgtccgaccctcagcgaccccatggactgcagcctaccaggctcctctgtccatgggattttccaggcaagagtactggagtggggtgccattgccttctccgatgtgcgaccataggtagtctcaaaatgaaactatcagactagaaactcagggcacagcagctagaatgtcaataaggaagagact

SEQ ID NO: 62535 - DNA, 888 bp, Bovine  19866880858787
ttataaactgagaaaagatggaggagaacaggctaaaaatggtacacatttttaaatgttcaggtatcagaatctggcaggtgcaactgagagacttcactagggcatgtgtatgcctgcagatgagtgtgcatgtgtgtgcatggtgatggcaagtgtgttgaaagtgatctagagtctagctttttcagaaagatttagtcacatgattctgaatactccctaactaggaacactgcattacaatttattaccttactgatgacccttcaaatgtaataaagaacccagtaaatcagaataattgataattcagggtcatttgaagttcagctccacattatgtaataatgtgaaaaaatacatcgaggtaaaatttacctttatacagaatgatgtatgtcggcacttcagaagctcccatttacaatcaacagcagaaatactacgtaactggagactggaattcagggctggtattctagcatgattaaaaataattcccacatttattaaagctgaatctaattgcttatactgtaaaatttagatcgggggatgatatgcattaaaagtaatttatgttccagaactttcactaattcagactgacataacttccagataattcatacttgtgaagttttttaatcaaatactcaaagtaacagcattaccattgtttattaatattgaatgagcaaaataacagtgcaccaaaagttttgttttagcccttgtaatttaaatgatgctataattgtccaagtaggttttcctattatgaatatagcaatagataccattatgtatcaagtctcttaagaaatgactctgtaaatcaattatttgcatagctcagaatgcttcttttctgctaaattaagt

SEQ ID NO: 62536 - DNA, 870 bp, Bovine  19866880860970
ggaaaagcgatgggctgctgagtgatgggtgccgtggcagagtccacagagctctccgcttgtcattctggactgcgagtcttgcttgatcccaaaggaacagcgcgacgagggctcagcaggtgagactccagggttatctccaggcacacttatataagcaccccgattctaatatcaaattcaattattcaccctgaaattgaaaatcctccttacccttgccatccgatgggacgaactgaattccattcccccatgatttaccttccctctggctgtttacctccagggcctccgcatcaatttatgagccgcccagtgggaaacctctcatcacaacaagcctccttggttgactgagcggcctgcaccctcttaccatgtgtatactgaatatacggggcacttaattgggacttgatatatcatttcatgaaagcagtcttcagccgtttcatttatgactccccaagtaagtgagactgtcttttgccatcagtcaggaattgtttcagctggtttcactttacagtctggcacaccgtggatgttcaacaaatgccgggggcaggcagggggcacctatatcttgccttggggatgactggagagcccagaacttggaatcaggttctttctataacattacacatttactcagcacctactgtataccaggtgctgtggttatgtgctaggaatgaaaagatcaatgaaaaataagtaagttctctgtgtaacagttgctcacagtaaggcctgggggtgggagctatttgggaaaatgtatgaagacataatggggattcagtatggaaatatggtgagggacttgagcccctaggtgtcttcggggcataattaaag

SEQ ID NO: 62537 - DNA, 904 bp, Bovine  19866880887643
tctcttaaaaatctaggtgttttatttctaacccttgaaaaacatgagatgatcatgttgttttcttgatcatgttatgctgggcctaggtttgtttcgaattgcttaaaattttctgatggaatgtttatgaggttttatagcacagggtaccctacagtggctagcaagtttcagcatcacataggtactcagtaatttctgaactgaatttgaactactgtggcttgtttttttttccttttaccagttcatataacctgttcaaattatacaattctcatcactgtcagtggctgagatatagtcttcacagatataggattacatgttccatttatttagcaatgtgctatgcacttttttggttgatttagtattctttacattccaaagcattgtcttttaattgaacagacaaatgaccgaagtgtctgcagattaaacattaacctgtatagcagtaccaagtatgcagtgtgtgggcactaccaaatggttttaaaaactgtcaacttccaaaacacagcagtctgagagaacttcataaacagtgtattacttttctgagaatgatgaccctcactgaggaagtgcctcttcagtttttctttaggcataaatgatactccataaacacaatgagattaacatagaggaacaaaataactgtgtttgtattgttcctgagttatcagattattatctcagtactcaaaatcccaaatgtggtgggatgaaaagtacaagataaaaagtacacatttaacatctattcagtcaccaataatgcttcaagtcagagctgggcttctacctggggcataatggggttcctgtttaacatatttatgttggttgtaaaattaggaactgtcattacagccccacatcacctgcataa

SEQ ID NO: 62538 - DNA, 3164 bp, Bovine  19866880899587
tttcttctactcttttcaagttaacctatttaccactcaagagaaatcgttatgtatgtattgtgcggtgctgtgctaagttgcttcagtcatgtccaactctttgtgactctatggactgtagcccaccaggcttctctgtccgtggggattctccagtcaatcccaccagagtgggttgccatgccctcctccaggggatcttcttggcccagggatcgaacccatgcttttctgtctcctgcactgtcaggcgggtttttaaccacaagtgccacatggtaagccctttgtatgtattacttattgttttattaagctttctgttatattgaaaactccttatcaaaactgatgaaggaaacgctagatgccatcctaagtgttttctctcgtttttctatcgttatacttatcaaatcacttgaatcatatggttttatcaaaaggcttttagaagattttaatatcttcattgtctgtcaagagttttaaccctaaatagatgctcaataaatgtttattaagaagaaaggagggaagcaagaggaggaagaagggatcatctctaccatgcccaccttcatcttttgttgccttaaattaagttttatagtaacttgtccatgcttttaaatggattttttaaattatttcccaaatccactggaatccacttttcttttctacatcttaagattgttgaactatgagtcggggatgtggagcaatgaagagagttgggcaagaacaataacacggatgcagtccagtgcctaggatgcaagtccagtctacaggaggagctcagtcctgaggagacaactactagaatctctgacggtcaccagagctgctactgacgcgagtggtacgacgtgccaggacgtgatactggtattcttcacggcagtgtaaccagtgcagtggtggtactgataagactgcttcctcatcttcctctgaccctcatgcaacttgaaatgcattcgcattcatgatggcaacctgaaaatttctcaacctcctgagtcttttttccttcaaaagagtttgtctcatagtcagggcaaagtgtattccagaaaatgcatagagagtcctagaatggaatacaagaaatgacgtacatcagccatttatacaatgtgctcatgaagggcaggggaagaggaagctgcatctggacccttcctccaatcaaaccgtgaagctctacttctattctttcattgtttatgcttctgggtgagatatacttgcaggaaacctcttcagctttaaaataataatttgtagaaggttttatgtttatttttattttattttactcatgtttatctttcatgagagaaagaaatacctaagagttataatccagccatcttggctataagaaagagctgccaactgaatggagtccactaagtaggcatggattcccagggaacgtcaaggttaaacaggggctccctgagtggagagtctattatctcctaattccatgtggaaccccgatgtcctggggctgcagagcaaaacagaacattcacagaaggagttattccatcactctgtgtaatgggtggcctgtgttttatagttaagtgcgtgctttttcaagtggatgcttttgaaataccactgaacgtagcttcataaaaagggagagataagtataataagtaagctagctgaataaataagaatactcaaggcctgggcacattataccacatgagacaagtcctgtgaaatgctggcagttactttttttgtaatgcatcaaagaagtcagcctggagaaacgctgcagggcagcatcccccgtttgcggggccctactccaaatctcaaggggagcaacagcaatgataggcttagaccacctggccatttgttagcagcaagggctgcctctggtagaagccaggcaccgagttagggagatgatggcaacattattctgtaataccttccgagtgttattacaaaatgacaatattgtttttagcccatttcccttaaccagattgacagaattacaggttgacattattgtgaaattttatgatgtatcatgttaactgtgccagtttgattagccttgattgacagcttgtacctgaacagcaagtgaaatacctcaaaaatataaaaccagcgtatctcgcgtgactttcacaataaacaaaaatctctagctaatttaatttttaactaactaggaatttcatcctaacctcattctactaaaatttcatttctttcaacatcatcttgaggctggaactggaggagaataaatctaggctgcagttataaaatcaccgcttgctttctgagactttaaatgcattaggaacagactgcttgcctaatgtggccctggtctgcattaccattggaagaaacagatgcacctcagggctggcatccctacacaaagcccaggctgagatatgaggcctttaaaaacacaatagagaaaggcaggcacaagcacctctctgcattatcaccataccttcacaatgcttctttcttagagcatcctcatctgttattgaaacagaagttgatctccttttaaatcttggaactagaagctagactgccgagtaaattaagcagaggggtggtactttccccctctggctccatggtgaattggacctgcaattcagtctggaatgagattggtagtttccatttgcctcggagattaaagccattcatactgcagaatctagacatactaagaggtacaattagacaccacttgtagattccacttgccatctgacttgtaaacacagtcagaaaaagtgggacttgatccaaacagtcctctccaatcaataacctgcttcacttccttctttgtatctctctggaaatctgtaacgattatgccaccagtttaaaagtactgcatcacaaaaggagtcttcagatgcttctgaattatattccttgttgctcagagtggaaatgaaattcccacaaaacgggtgcccgtgctctgtgacaaaccagatgctaagggctgagcaacagttacaaaagaaagcaaaccacctacagaaaattcaatgtgcaatttaaaaaaatattttttttttctttttagtgcagatggtacattaggaaggcttttgcta

SEQ ID NO: 62539 - DNA, 802 bp, Bovine  19866880957045
ttggagagtcacgggggtttgaccatggacaatctgatgaaagcagtttttctagggtatatattttcaaaaattacatgctagattcagtaccactttggctatctagaaaatgaaagcaccatagagaccttttttaacaaaaattactctgaatggacaggagtttgtagtttagctttgtttttatcccaaatcttatctaaggaaagcaaccatctttttccaataagatgcccaaacaccccaaatatgtctgtttcttcaattccaggttaaaaatgaatcttacatgtacaaaaaataaataaataaataaaagctttggccatggcaacatttatcctggaaagagaaacaatgcagaatgatagtcaagttaatgatttgcaaaatcctaacagaaaaagttctgagtaagtgaggcgctaagtttgggataaattttttccaagactaaataactacaggtccacgccctagtcaccctcatatttttcatgaaagtcactggaaagatcaaattattaatatctgtctcctcttacttaaaaacatactttaacatctcaccctaacaaagtcggtactttaggaaagctaacatcagggtgggaagcacttatgaatataaactcaagcaaagaacaactgaagtttggcaacacataaaaatgtcacatactttcacaacaaaactttgctcttccaaaaacaaaatatagctccaaagacacacacatatggttcacttacaaatgcagcacacacaatcattctgggaacagccagctactataca

SEQ ID NO: 62540 - DNA, 1675 bp, Bovine  19866881000740
agatgcatacttatagatagtatagaactaagccctcattttacaggtgagggaaatgatgtagaaagggcttacagttaagtattgctgctactgctaaggcgcttcagttgtgtccgactctgtgcgaccccatggactgcagcctaccaggcttctctgtccatgggattctccaggcaagaacactggagttgccatttccttctccagtgcatgaaagtgaaaagtgaaagtgaagtcgctcagtcgtgtccaactcttagcgaccccatggactgcagcctaccaggctcctccatccatgggattttccaggcaacagtactggagtggggtgccattgccttctcctacagttaagtattagaagatctaaaattagaatcccattgttttgcttttctgtctagggctctttcagatattatttctagcaataatatttgatttctatcatcatcatcatttgatttctatctcatcatccagatgagaatgctcttagctttggactatggctaataattcattttttttttgtgacctccagtcaacttaactatgtaaatactaatgatgaagatggattaaaataagataaaatactgtctctgctcataggataagttcagtctatagaggaacatggtgatgtcagtgagaaaagtgggaagattggaatttatataccagacttaattatttaaaaaattttatccagtttatcacagatcatccagttgtcacatgtttactccctctattagaaatctgatgatagcctagaactgaagtctatactgtactgaagtaggggacttgctactgtttactctggctctcaaaggttgctaggaatgcaatgggtgctttcggtaagctggttctgctgtacaatatatgtatattttattgctttcctctttaatgcaaacctgctactcattctgatcaaacattcatgaaacaacaacatcaaaagaaattcattttaatttgctaaggtcttctatgttgtgcccttgaagaagttcatatggataaacaagcttatataaatagcctccagcatcatgtgaagtgcagttcataatccaacaataaaacagtagacattatacttcgtgcttctccaagcagtctcttgaataaacctaaaggcatttggaaatttatatgaaaagtgcttacatgatgtaggcagcatctttttaatgtgatgagttgttcatgttaataattaaatttcaaagcttaaatttaaatttgtcccaaacaactatatagaaatttaattattttaatttactgcttcagaaaggttctttattctgccctgtgttcatcatatcttttcttaaaagtctataaaggttgatgagtttgttttgtgatgcccattgtgtacagattattgcaagttgtgcttgcagaaagcacactcaagtggcggtgtgtaatatgtcctgagtcaattacttcatggaaatgatatgttaagcaattggaaggtaacagatagtttttttccattattttagaaatatctctattgttataatacagatcaaatctacaatgaacattatgcattattcaagaaatgaccaggcattctcagcagtgtttcagctaaataactgatgattgtaacctttaaagaaatctcatt

SEQ ID NO: 62541 - DNA, 1851 bp, Bovine  19866881096546
cattgtgtttgttttaaaaatccctcctaacatgtgtgaatctgaggagaggagctgtgcaatgaaagttacatccttcccacatgagccctgtgctccgacaccatcagcaactctgtttttctttcacttgacaagtcagtttacgcatcctgggaaacctctctgcatcattttggtggcaaatggaaatgcggaccttgtttgggtgctgttttctgaacttgctttctcctaccccctcacaaaatgatcgaactagtaaaacctctttaaataccatctgaaaagcaggggatggtactatggtgaagttctgtttgcactcagaggttttcattcttttcgtcatcctcctaatttatactcttgccagagggaagaaattgtcttgtctatgagttgctccttggggagcaatacaagggcatcactctgtgactctgaagccgtagattcactgttcagttcaactacaggcagactgaaagcggactttctcaccgatctttccatgtgtgtgttgtacacgcacatgtagtgtgtatgcagacacaagtacctcattcgaccgagctctgtgttacctcagcccactgtgagaagcaagcggagagatggtatataattaaggctctgtcattatctagctaaaaatagagggaggagctatcccctttgcttccctgtgactgaaaaccagccaaaccaatttcactaaaattcagtaaaataaaaactgtgctcccaggatgagaagttgcatgccaaatttcagcctgaagcgaatttaaatggctgagttataaacctttcataaaggatgttttgtcgctcactcaagataaaaaggctccttttttgaaaaggaaattatctaggcacatagtctttagcggggattgttgccatttatttaaagaaaacacaattttaaatgactgggtttttgaggactgaaagcagcaactgtgtctgagcagtaattatgtttcataattttgtttagcaagtattacatattatatgaatagcatcatagtaaaaatgattagcattcatactatgcaaaattctgcatattaagagcttcacagtagtgtcctacatacaatacattgtaatggctccagattacattgtgtcaggcagaaccctctgtgcctgtgtgtctcccaccccagcccagcccagagccagagccgagaacaggcctccacttgatactgagcaccaggagaatgggcactcccaaaacagcctcagagacacttctaaaattgaggcaaggatttcattgatgatgttcatataccttcattattctgcaagcttagagaaagacctggttctgccatatgcattcatcgtgtgtgtgcggtgttagggtatgaaatgaaggcacagcccacgtgttccataaagagccctcagaatgacggagttgttgattgggatgtttctgccttaggaggtcttgtgtttgcagcccagcatctcaaaacagttttcccaacttggggatcaggccatgaagctagactaatgatgtctcacctgaggagacccagagacgtttgtaatgggactggggtcacacctgtgtacctgtaggaagcctaactcagggagatttggaccgagagaagcaaacttccaagggttacacacaggcttgtgcaacaaaggctatttttattgctgttactgttgtctaaaaacacgggtgtgtacttctatttccataatttgattttctgcagtaaataacattacttataaagtcaaaaattaaaatgaaatacatatcatgtatatacacagatttgccatatatatggatagatagat

SEQ ID NO: 62542 - DNA, 3259 bp, Bovine  19866881102976
catatcggatagtatctccccccagtgtactgatgggaccacatggagcttcacagaggttggtaagaagtccaaagtcacagaaggctggactggacactcaaaccaggggtctttcagatcccaaatcccataatttttctacctcattcaccaggctgcctcttttttgtagcctttttctcacttacgaaattttaaagcatgttggaggaatcatgtctttggcctttaatagatatacttacattagttcacaaaatataagatataagccttctaatatccataggaaaatgttgaagatagagatagaagattatgagtcaatacaaaataactggaagtactactggagcatatgttttgaagatgaaatgaaagtgtctcatccagtcaggcatttctactaatgttgttagaaattacacattttcagagaattaaaaatactacttttgtataaaaaatcctagtcatcatttaatcagtatataactttaaactttttaatggttccttcccccaattccttataaatttttaaagggataaatattttactatttactattattaatatatagcaaaatatatgatctttattttccagatttgttcagactgttttgttctgtagttggtttgtaatgagttactatattttagtcaaaagttggggtaagtgactttgcctttctgagtgctgacagaatccattgcttttaagtttttaatccaagactgttaacagttttgtaaagttttagtcaaaagttggggtaaatgactttgcctttctgagtgctgacaggatccattgcctttaagtttttaatccaagactgttaacagttttgtaaaaagaagcaagtctgtctgagagctgtcctcaatgatatctgtactcttccaggtagacgtaacaaaaatagtggcaaacactcattaacaaagaaaaaagaaactacactaaaactcttttcagccctgtcttctggttgtcactatcaaatatggcctccagttaagatcacatgtcacatctctgacacaggcggtttgacaagaagcaatctgaaggctttcagaaagaaatctgtctggggtagtttctatgtgatataaatattacaaggtcaaattcatttttttccagtgagacaaaatgttaaccttacactgggattcaaagctgacccatgacatcatttttggaatgaatatttcttttcattggaaggtgtgacctaatctccatatttcttctatgtatcttatttcctaatttgactttgagtcagaatcaccttttttcatacatgtgttgatgctttctgctgctggaaatagatctgtaggctgttaacaattattgtcgttcctaatacattctaaaaatgcattataaaggtggattgattctgtagttttataataacctgagtgtggcactggtatggtagatgggaagattattcagaatatatcctttttacattagacatttaaatctgttagtagttttggagttttatgaaaacgtcttttcctggtcttgatataaattattgacaaatatgagcttttgtcttgaatactatattttgtttacttataatatttacattaaagttgagaggttagatttgcttgtttattgtgcatgtatttatggacatatgttagccttgcctttattttcctataagtctcagataagcatattttcagatcaatcagcaaacatttattgagcatttactatgtgtcagacactaaagcaggagaaaagatgaataagatactggttttgttcttagctgttcataatatggataaatcacagggaaaaccgacattttcaaatggttttaaaaggagagtcacttgatatgtcttttgggcaagatacattgaagtcattatacttaaatgatcgtatgttattagtgactcccatattgcagagcaaaggtctataggataagaatacatttcactcattgaaaaatcttgtttttaagtcatgtggggccgtaagaaattcttaccatataatgtcatatgaataaagatgttccaaacaaaaagagactcacaaacttagagaactaacttatgattatgaggggaagggatatagggagtttgggatgcacgtgtacacactactatatttaaaatggataaccaacaaagccctactgtgtaacacgtggaactctgctcagtgttgtgtggcagcctggataggagggaagtttggaggagagtcgatatatgtatatgtatggctgagtccattcactgtagacctgaaactatcacaatattgttaattgtttacaccccaatagaaaataaaaggtttaaataaaaaaaatactattcacagttttgatcttagttaaaaattgcatacacatatattgattcacacacagaaatatagaaatatactaaactgaactaactgaatattggaattatgggtgatctttatctgtggtttgaaaccctttataatgaacatttatcacatttattaacaattttctatgttaatggagcctgtataccagcagtggtctgaatttccctcttttttggttcttctctgctccccggttcttcttgctggtttttcacatctttctgaggagctgggaggaatctgattttacctgtccacattttagctctccctcccagtggatttgtcactcttgttactgttgcttccagatcactcttctacgtcacagtcttcctcttagctgtagtgtactggttcatcagacagctagtttaaatatattttcagtctcccttaatcctttgtgattgattctgttaacattttatgtaaatgaaaagagatctggcttcttgaatccagaattccgagttcctcatcctttccctgggactctcttcctcttttttcccctctctaccgctgaagctgctcctctcgttacagagtctagcaaggcttaatcctttgcagctaaattccagggactcttttggacctgccagctccagggaaggggtggtgttaactgtgatgtgctttatgcccttccttcctgcggttaagtgtatcattttctccagttgacccggtgaaggaaggttagcaaaacgcttctaattcctaggtcagagcatagcctccaggctggaccaccaacgttgccaggggattgggtcactgccagacactggagatacgcacaagggctctattttt

SEQ ID NO: 62543 - DNA, 1322 bp, Bovine  19866881134737
attgagcacacataccatgagtttttagtacttcatccttatttaatatttaaataattaataattaaatatacacattaaatatgtgtatttaaggctataaatttccgaagtgaaattttagctgtatctcatacatcttgtacttttgctactgcttaattcaaaacatatttataattctttcttttaataatgaattatttaaacatctatatcttcatttccaaagttttttatactttaaaattagcttaattgcaaataacattgtctatatggttctgttcctttgaaatgtgctatgatgtggcttatatcccactaaacgatcaattttctcaaatgtttgagaagaatatatattttgcaggtcttttatgtggcattttttttgtttaatggagtgtgcttgattttttgttcagatgactgactatacagcctcaaaaatttattgctgctactgacgaataacatactgctattgatctttttataaacataaatatgtttgcttatatatttataatttgaattttgaaaactttagctcggctctcaacttcggaagaagtatcccagccggtactatgttgagatgatattgtgtagagattaacagccatattggtctgctgctgctgctgctgctaagtcgcttcagtcatgtccgactctgtgcaaccccatagacagcagtccaccaggctcctccgtccctgggattctccaggcaagaatactggagtgggttgccatttccttctccaatgcatgcatgctaagtcgcctcagtcatgtccgactctgtgcgatcctatggacagcagcccaccaggctcctccatccacaggattctccaggcaagagtactggagtgcactgccatttccttctccgaaagtcatgatgagattcttcttattcatttggtaagagccatattcaagaataggtcaagctgtatccacattctgaattaagaaaattaattatattatgagctcttctctgtttatcatgagaagttggagattggtcacatttactgagagttatggcacatttttccttatcactaagttgtaggacatgatgtaggaaaataagccagaggctttaatttgacttaccttgactgctttttgacctgttctatttttctttaccaatggacagcactttttgcaggcatgattttataggccttgcacaaatctcagtaagtcatatatataatacaaggtgagagactgcttttatccaacttggtgtatcgtttcctttgcctaacagatagttataatttcctaatgca

SEQ ID NO: 62544 - DNA, 1964 bp, Bovine  19866881200532
cttatgccatgtatttagaaatgcttttgtagaataaaaatatcacacaccaaagatagttcttgtaaagttataggcatttgaaaaatatctttcatatatatgcagttgaaaatactttttttgtaagtaatacattgcttgggattaatcagataaagatgaaagtcaagaattttgccaacagtgtttcttactaacattactcagttatgcctttcagctcagcatattgtatatgaaggatatcttgttaaaacaactgttgaagccaagtcgtgtcgtatcagccacactctgtaccctatgggaactcaaatgttcccaactctatgttaatataatcttgctgctctgctgagctaaagcaaaaatcagtttgtcagtgccatgtaaggcttcataaaagtagcacattatctgtatgtcttccagaaatgaaggaaagctgagatgaagattatgctgaatcaatttatgaaggtaaacattgttaacaaaaaccataaaataacctagaaaaggattccaacctccatttatcaactaacaacaagtttatactcctcctgatgtaattggtaacctgctatctatagaaaaacaaaattaccccactcaagacttagcagcagaagcagcaagggttctcagcggctattcggcacaaggttctccattttctgagacaggatcctttgcaatactctgtgcttgggaattctacaactctctacaaaggtctacaattctcctgtactttcttgggacatgaagtcttatttttgcttatcaacctctcttcattataaactgatgacaaaagacaaagatccgacttgtttttaggtttccagggagtgctgagggagaggtagcaatagaaacacaagaccagcattttttttttctcttaattaatgctatttcaggtctagtgagaactaattatggaaaacataaaaatccattttatattaccaaaaactgcatgtttctttcattggctgatgatcataaaggccaactctgattattatagaaacaaaaagacccatagagatgtgaaaggtttgaaaactaagcttaatctttaaataatttaatctaatttcaccaattaataaaacacaaagctaaatcttggaatgtcagaagttaagcacagtacagattcttatggactctgtaaagatagtttataaaagagttaccaaatgataatcttattgttaacattcaataaaacacggcctccctaaacaatattttacagaagttaatttacaggtgtaagtactctccttttgccagctcggtggccaatatttagcataaaggatgcagttttccaagtgtttctttgactaatagaagctatgatgaaatctgctccagcagcctgcagagactggcaggtggacctgagaccatggcaagctcagctaagggaatcaaacattcattgtacagcagtgttataagctaaggtaagaagagaggaaaaatagcaaatgcaggacagaccttgcaaaggaaggtcatgaagaattttaattatacaataatatctactaggttaaaaagaaaattaatctccaaacagaagaataaaaatatttttcaatgatgcaagcttagctacttaacatattgctaataaaacagtaagattccctttccagatactatgttctttaaacttgatgaaaatacagaagggcaatatgaagatcctggcagtcagataattttcagaaatcaaacagcatttttagcaataagtgcacaaaatcttgaaagtcagggtttctacaagacccagtgtacaaaaaaaaaatatcagaattcctacaaaaggggggttagtgatccttgcccttcaaaaattaacatatccttattatttaaaaagatgaaaaccttcactttatacaatggacaaggggggagcagtctattga

SEQ ID NO: 62545 - DNA, 1453 bp, Bovine  19866881201609
tgtcccctcatgttgagacttttaaattttttcctgagtgttctaaacttgagacaatccttgtcatgaatgcctacattcattaattgaagcctaacatgaggagtatggtgtatgtggctggggtgggggttaagggatgagagtgatgtatacagagaaagcatatgtggaaacagactaaactgaaaggaatgggacctaggaatggtggtttcttaaatgttaactacatttctggaaatagaaataagaacctcttatgattcaaccagattagggaaaaagagttgctgtgtaagactggagatgatgtgaagagaagaaagtgggaaaagtgctcacaaaataaaccctaactcgtttctagagtttcaaagaaaccctagtttgacaaaaacctaaagttgctaaattgccccacatcacacatcctagaaatgtgtggattcaattacagagcgagcgagactaccagcagcaaagatgcttttcttggaatttcaatgcaaagcaaatgtacagatgttggcataaaagccaaactgaagtgggatgaaagatagaggtccagagagaagattggagaagataaagaattaaatatgcaataaaagagaccattacatgcacagcatcaaacttggacagccaaagccttagctactagcatactcagatgctagtattggtgacatgtacaggctaaagaaaaaaaaagggtaagggtaacagaatcaaacaaatactacattaaaatcgcttatctctgtgggcaggctgtaaaaatcatatcattctcattgaaaaataattcattaaactgcaccccagcaggatgtaaagaacaacacacagcatacgaagatattgagcagcagggggcaataaactttataaaaactattaaagcatgcaacaaagcaagataatacaaggaggaaacaatggaaatgtcagtccaatttataaaatagccatgttaatacataagtgcaaacacttcacaaaaaaacatacatgcttatcacattaaaatgcacgcttgtgaaaccacccttgagatgtcaaaagctgacctgccgcagggctgtgaaataaaagccagcgggttgccacatggaaaggcctggtccagagagcttcacaccaggtaacctactgaaatgccataattgcttgtaggtatctgagactgctccagttacagacacagaggttaaatgaaaacagggccacacacggtccacaaccagcgatgtgcgaggacacttgtagctctaggctggtgggcttgagtgccctcaccttcaacccagtttcctccggtgttactggatggttgaggaactaatcctactcattcaactgttcctgagaactgcatagcttaggatcacctcagagcacacacagtgtccataagctgtgttttcaaactgttttactcccc

SEQ ID NO: 62546 - DNA, 1163 bp, Bovine  19866881217154
ttagcagtaaaatgcccattgaccagtgcaaataatgtagtggacagatgcaagggaccatgcagaagataagtgtatagaatttaggaactaattggatttgagaaggaggttatcttaaatacttcccaagtattgagcatatataacagaagtaaatgtctgaggtgagatgttgatcatctaaggagtacatacacagaggcatcattttaaggggtatcctattttggaatgtgagatgctgagctgatacctcaagagaggagaaagttaggaaaataatatagaaatggaggtgagtgcaatgggccattggcatagtctgctacttgacaccctaggaatggctgagatcagctaggaagaaagtgaaaacagaagagaaactggtctgggattacctgtgcttgtgcaattaaaagcgaagtgtgctttggttgtgcccatcaagacaacatgctgctgaagctcttactaccaccccagtgaaaatggcgaggaaaggtgtgtgctgctctaaacacacctgagaaacctttccgtgacaccttatgggaaacctttatgatttgagaaaaaaatctcaactagatttatttttaaatatccaatgttctgagtacttttccaataaaataaaatgctatttttcagtaagaataaaaatgtctgaaaactttaatgtaatatataattgatatagtttctcatcaaaacatttactgcatagagatacaactgtgcttaatatgtaccccattaaaaataattaaagggctgccacatttcaccacagaggtggattcatttccattctggactcaaagatcactttctataaagcattctcaagatgcctgttctgtttacaaaagctcttcagatgaaagatgtttttgcaaatgcaaaatatgaattattgtcatcatcatcgtttttattgtcctaggcatgtgaatggattttgcatctggtggctgttaggttttaccgcagcaggggtggctgggttaaaacctaaattcctaaagcaatactgtaatactttgaaccatagtgacatccaagagggataatgactttctgatgaagtgagcagctcctctgtggtaagaggagagacgccaaacctggaacccggtgcaaactcacagctaact

SEQ ID NO: 62547 - DNA, 778 bp, Bovine  19866881326792
aaattcctgaacaaggttctctaacccttgtgtaaaaccttccatttctctttaaaccctgtaccaaagtagctatgcaagcatcatttacatccccgggcagggcttgggcttctaagtcaggcgctgtgttttgctgaagtctgctcacagcctgtgcattaaattcataatgagattaaaatctactgttcttagaaaaagaagagttgaaaatgtgttgcaaaagcccttttgtctcatcatattaatgttgatgccctcttatcccagaaacttggctgaagctggagccaaaatctatattggtttaattttaagtggccttgtgaacaagtgagtacagacaccgaaggaactgaaaggtacttagagcactcaggctcctggatctggactctcaggtggggctgggcccacatgcttaacatttctgtgaaggaggggctgaatgttgagacccttgccacttccttcattgtaatcatagaggcagattggattcattaatgagcataataggattagatatcggaaaaaaatcccaaattttctaatctaatgtgaaaagaactcctcaaaaagtagacaaatgcatttgttctgcagtctttgaagaaagagtatgaagtgactgtttgataagataaatcaagtctgaatattcagcctgatgatctgctagaccaatggtagcaatcaccctttatttctattcagctttaaactctctctctcttttttttttaattgtatctgggtaagcatattccttatt

SEQ ID NO: 62548 - DNA, 1011 bp, Bovine  19866881326983
ctgcgaccccatgaactgcagtcctccagtgctcctcgtccatgggataccccgggcaagaatactggcgtgggttgccatttccttcttcaggagaccttcccagggattgaacccatgcctccagcattggcaggcagattcattaccactgagccaccagggaagcccctgtgctgggataggtttgtttgattcctgcgttctgtctacatcctctaaggacccggtttcctgcatccccaggcatggggagagcgccttggttttgtttgtggaagaaccgtccagtctttagttacatcacatgtttggtggctgccgtcctgggtgcctatttcagtaggactgtcagccatctcccaaccaggcctcctgtgtctccaccactgcggccttggctacggtgctgcctgtctgcagggcctgcttcataggccagacctgcgacctgtgaatcagagaaggccccgcactgggtttaatcctctgctgtcattcccttcaaattcttaacgatgattaatcaaagggctccacgttttcattttgcactgggttctttgtacaaatcgtgtggccagtcctatttgtatgagcctcttctcccttgctacccccagtactagagaaattgcctccttcaaggaccagctcaagtgtgcttcatgtgtgaagcgttctgattccttggtggacgtgagcgtctttgccccgtgtgtgtccctcagttacaacctgcatggcaccctccttgagctcactatgtacacctgtctcctgtccgccaaggtgggctcttggagagaaggcggcgccctcagcgaatcttctgttcttctccctccatatcctagcccgatggctttcagtgttccataaatgcttgttgaattgaagtgaattaaataatttgcccttttatctgaaagagtaaagaaatttacatttaatataaggcccctttgatagacatactgccttcatttctgttctcttctgatgttgaat

SEQ ID NO: 62549 - DNA, 1015 bp, Bovine  19866880404885
atttgttacctgatatttaagagctgaggatgaaaccttgtctgacctgcagctataccacataaaggatttttttgaatgtcaccgtatctgtatattgggattgaaatttaaagcttttttttgtctttgatgtaatacctatcaccatactatctcatttaaacttttctttaatgattttgaatagtttctagccctattgttcattacattatatgtgtatgttcatttgtgaatttgagaagtctctgcataataagctatcaactgacatactgtaaatgtttcctaaaattttccactcatctttcaaatttatttatattatggcataccaaatatatacaataatggagtcaactctaattccatttaaaataatttttcaaattatgtgtttgaaactgattgtttagaatgcctctaagttaaaactcttttccatctctacagaaatatatacataggttctttcctgaatttaacagcttcttgtttcgtttaacacctcaatatatatggaatttattttaatatatagatagtatataatgtatatgaatattaatctatagatatgtatgttcaaattactattcatttgttagatatatatatagacatatagatattatatattttcaaattattactccattttttaaaacattggttgactccttttatctcctaattacttgcagtttattatttaataaagtcaaacatatgcacatgagattctttgtagcttactttattatccctttcatctctaaatcctcatgttaatatcacattgttttgataatatatgatgtatcaaatacttccacatttaaatacatttacaaaattttattaactatctttatttccttattcttcaaatgaacttcaaaattttattagctatctttatttgttcatttttcaagacaaatttaaagtcactaccaagttctaaaagtaatccaatgggattattataagcattgaattataattaatt

SEQ ID NO: 62550 - DNA, 1193 bp, Bovine  19866880434068
gttcttcagagatttaaactgaattatgcttcttattactctgtgatcaaactgtaatatattttctaaagtgaataattgcccctctccataatgggctcaaaaacataatgcctttcagagggtttggtctttgacagactatttttggcagtccttagagtttcacatttcttaatttttgattaaatcctaatcaacctgatttccttcactatttcttcttccataactgtgtttctttctgccatctgtttttcatcctcatttagatcatcaaggcaaataatcaaattaaaaggacactgtcaatgtatttttctctcatatctaaaatctattttactgactcttatttagggtttgaagcatgattataaaatatattttccctttagtgatacagatataaatattacagcttagaaaaaaattttttgtaataatggaaaattactcaggctatattaatacttttatttaaaatactgttttaaatacttaaaaattcaaaaacatccatgaaaattataccagatcaaatttcagtcctatgcaccttgacagagtccctgtttctgtttagagcttggttttcattcctcaagtctgctctttaagaaattcttttttgtccttacttgttctcttttttctaccataatccaaatatgttttatgctcatgatagtaaaaataggtcatgctgtgatttcaaatcattttggcttcagctagtactagcttcaaccttttctatttactattggtatttaatagctatttgatcataaatacatacttaaaaagaatatgatgtaatatttaaagttcttcctttcagtcatttttcaggtacatcagtttttttttcttttgtgtagcagagttttattaaaatgcaaagggacagtgaaagctactgacacagacaacagaagggggatggagaatgcccccctcgctagtgttagcgagggggttatatactttttaaattagttattacaataaatcaaaagaatgtctcaaggttgtaaaagtcttactagacccactcccacaatttacattttaggatgacaggattagaacttaacagtagaaagaccctaccagacccactcccataatatacattctaagataccaggattagtcagaaggttttcaggaagcaaaaactgtcctca

SEQ ID NO: 62551 - DNA, 2482 bp, Bovine  19866880493162
tctgacactgtttccactgtttccccatctatttcccatgacgtatattttacatattgattattttttctatagctattttatattttattcagtttagtttttagctccagaaactctacttgtgtaacctattcattttgaacttatttttagacaactttgtgtgcactttgaatatgttttgcagttcagggacccataagatagaaaatacaccaataatatgaataggaaaattataattaaaagaattattaactagttccagggaattaactactgacagataaagagaactccaaagaatatataaataacctacacagggagcagccagtgccactgattcaggtataaatagacatggaataaggtataaatagacacggaatgtggtataaatagacatggaataagccactttcatcttcaagactgagagtcgtacaacattagattgagtgtatctttggaccgctggatggtaggaaagttcatggtgtactttgggcaagggacggaaagcaggaaatcccctgctgggatggcagtccagtggagaaacaagtgggaatctgcctgctgaggtgctgctaaaactcattggaaagccaccgtctggtgtcacacattctactggctgcctcatgctgcagcaaccagcatttttaaaaagttaaaagcacatcataaccagggagaggagcctctatcccttggaataactcatttagtaccttctattagtaaactttttcattgtgccagctggcaaaagagaagtgtttgtagactctaattccaatatcacaaagcagggcaaagaaaggttgaattgggactgagaaacaataaatagataaattccagtttgcatatagttataatacctgctttaatattctcgtctgctagcttcaacatcggtgtcatcagggtttgttcttttggctcatttttctcttgactctgtgtcacattttcctggttctttgcatatctactaatttttagtatgtactagacattgtgggtgggagagtacagaggctctgaatcctcctatcattctctggatggtgtttgtttttgatctaacaggctattacattactggccatttacattagacttgtgaaggcttgtttctgtgatatcaggagtgagtctcatgatttatgttcagacctagggtgaaccctttagatctggcacatagtctttagtccagtgacttgaaatttggggggtttccatgaacagcttgagttaaccaagccttctgtcacaccagtgtatgttcctcggttctttgttttggcacaacaaagatttggagcaacggacattaaagccctcggtgcatcacagctcttgggtcttgaacaaaccgtgtcatagctcttagacaaatcaatgttacagctctattttatttagaagatagcgggagaatccatccccgaagaagagaagagagtggaggaacgtgccagcttgtgtgcgtggtggggatggggggcggcggtgggtagagagagaaagcgagagagaaagaacctatgcatgcaggagagagagagttccaatgaatatttcaatgaatattcagggtttatttcctttagaattgattggtttgatctccttgcagtccagtggactctcaagagtcttctccaacaccacagtttgaaagcatcaattctttggcactcaaccttctttatggtccaactctcacatccatacatgactattggaaaaatcatagctttgactatatggaccttttttggcaaagagatgtctctgcttttcaacacactgtctaggttcctcatagcttttcttctaaggaaagcatcttttaatttcatggctgcagtcaaatccacagtgattttggagcccaagaagataaaatctgtcatggttttcatttttccccatctatttgccatgaagtgatgggactggatgccatgatcttagttttttgaatgttcagttttaagccagcttttgcactctcctctttcaccttcatgaagaggctctttagggcctctttgttttctgccattagagaagtatcatcagcatgactgaggttgctgatacttctcccgtaaccttgattccagctcatgattcatccagcccggcatgtttcatgatatactctgtgtagaagttaaacaaacagagtgacaatatacagctttgacatactcctttctcaattttgaaccagtccattgttccatgtccagttctaactattgcttcttgacctgcatacaggtttctcaggaggtaggtcaggtggtctggtattcccgtctctttaagaattttccacagtttgttgtgatccatacagtcaaaggctttcttgtgtgaatgaagcagaagtagatgtttttctggagttcccttgctttctccatgatccagtgagtgtttgcagtctgat

SEQ ID NO: 62552 - DNA, 738 bp, Bovine  19866880654567
tataaattttctataaaatatataaagaactatataaaaaggtaaagaccagatagaaagtagtctatagtatcaccaccattgctgagttgatccctggaatagttaaaatatataccacatagtatacaaatgtatagagattatacctcaatttcctggaatgaactgttgatcattgcaattaacatgtttagcaaaacaatgaccattgtaacattatagactccataaagaacataaccgatgttttcaataaatttgtgattatagttgatgaccactgatttcacttcagaaagtccaaatatagcccaaaacagtgtcttaaaactctcttccactctgggtaaaaaaaaggaaataaaggagatgataaagcatacaaatgaatgacaatgatactataataaaagcaagctgatataatgtctgaaaattattagatattcatgagaaaattcttcacttccctgagcctcagttttcttttttgtaaaatgggtacaataactatttccaggattgttgcaaggataagggaatattttgcatatgaagtacacaactcactatctggcacataataagtgctcaataaatgttaacataacttcaaaccacagacattaacatttaaataatccatagttttggtaaagaaaatattaaatgtattaataaaaacaatgtaatatgtaatttataatttatatatggaatggaataatggaattt

SEQ ID NO: 62553 - DNA, 1147 bp, Bovine  19866880676001
gcttctctgatagctcagttggtaaagaatccacctgcaatgcagaagacctgggtttgattcctatgttgggaagatcccctagagaacggaaaggctacccactctggtattctggcctggagaattctatagaccgtatactccagtggggtggtaaagagttggacatgaccgagcgactttcactttcattttacttctaacagaggaggaaatggcaacccactccagtgttcttgcctgaggaatcccatggacagaggagcctggtgggctacagtctatgggatcacaaagaatcggacacaactgaagcaagcaagcatgcattagctttaacaacatagatatcactgggaaatagaaatcatggctgtcttagtaaaatggtcttgaagtttctttacccctgaaaaaattttgcaccccgcaaaatatatatctggagatactgtgttttgttcagtttctcctatttatttctttgcaaagccattttccctttagaaaatgtgttaaagaggtttctaatctttctcttagcatgttaatatggtgctttaccacctctcttgcagattgctttctttgtcatttgcctcttcaagcatatgtattatttgaaaagtcctacccagatagggtattatacacgtcctaaaattcaaatagatttattaatgctttcttgacacctggatcctatccctcaacaaagtcgtctcctggtgtttcctcaggagtctcatcacagtctactgcatgtgcagatggtgctgtcagtcgtgctggactgtggctccctcaccagtggacttctgagatcaccactattattttcgcaacttgtttgtctctccctctaccaaggatacaactgtgggagtgttaaagcatgactctcatgacagcatgactgacagccacgaagtctaagacagtcctcagacaacctctaatagccaccaagaggctgaacacacctaaaacatctgtgatttgtgttggaagaaagaatattaagcaaattaagttaaaatggcactatacatatagaacagagaaggcaatggcaccccactccagtactcttgcctggaaaatcccatgggtggaggagcctggtgggctgagtccatggggt

SEQ ID NO: 62554 - DNA, 2403 bp, Bovine  19866880687939
acatgaaatatttttcttctcgtgtaattttagttttaatatcacatgactcctcacaatcttctttgtaaacagtagcattagttttactttcaccttttgtattagattcatcttctacaatgttaactcctggagaatcctttatattaaaaaaaaataagaagaagaaaaaatatatgaagtatgttatattacctaatatatcataaataagactctagaaaaaaatgagattttaggacatacacaaagaaagactatatagttaattggttaattcaaacttctacaaacaaatcttttgctctcttttttcctctccaattccaagaggattcatttagggcctactttccattacagtggttttatggccttgactgttacacatttccctgtgtgatacagtgctgagccattcctctttcaggaatcatgccatttgaaattccttctatggatactaagaaggttccctgagaggcctacatttctatgccagcaggacattctgccaccaatttgtaggaattgtgatgtggggctgaggggaaaatgtgtaggagatttgtcgcttttgtataagctaaagtatttacagatttgaaaggtaaagtattcatagacttaaaaggcaacaataataataacagaaacaaagaatggaatttttctttgcaaaatcaacaacagatgtcattttaaaaagccagcaacgttgtatctagaatggataaacaatgaggtcttactctgtagcacagggaactatattcaatatcctaggataaaccacaatggaaaggaatattaaaaaggatacatattttatatatgtatgatataaatatatataactgaaacactttgctgtatagcagaaattaacacaacattataaatcaactacacttcaataaaatacatttttaaaaattaaattaaaatcaaaagctaacaaccaactataaacttttgaataccagtggggagaaggaaggagagagggacaaggtagggggtaggagagtataaagtacagactactatgttcaaaaaaaaaaaaatgccgattacagctgtcattccaaatggtatcagttcttactggtacattgttgggttttttaatgttaaagcatacattaccagttttttattattaaaacattctttggtagaagttataagatttaaataaactgtaattaaaagaaaataataacaagatctgtcatctttgacatggatattgagagaaaagtgaagagctaatcacataatttaaaagatatttgcccaaaatacattttgctacaaagatctacttttaacttttgctctttcccctatactcctataacaattgacatattagctgttttcaaaaacagctatagtttacaactatagttttttagatgtaaataagattctaaaatttttagcacagagaattcttactaatacttctgtagctttcttagaatttattcttgcttcaactttggaatttggtattgatacagtggtaaatacatttataacatttaaatattataaaccaatatttaaattatagagattcaaattaccatctactcatagtattgcatacagtcttagctatcactctgacattgctcggaatacaattttttaatattaaattttaaaatttcctgagtgaccaggtacaagatcatatttgaagtacgaaagtttatagaacagtttttttttttagtaaaattaactttttatttgcctatcagatatttcatttttaaagttaagtggaaagttgttggctagtttttaacctaggtctgcaatttctttaattttttacaagaaatgtgttaagagtcaatcttcagtttatagtttcctacgtttaaaaagaatattatttaagcatgtctcagcatttctaaataaacactttaatttttccataaattatattgagtgctgtaattaatcttgtcaaacacctagtatatatcttaaaaactatataatcatgctttcttagctaaaataacattgctgaaattcttaccgtagaatgatgctcacagttatcttgtatagcttctccacaagtaaaaatacatagatttaagaacaagagtgaggcttggaaaagataaatcatatttttcttggttggagaaatgaaaattttcttcaaatatcagttagctctctgtggaaagagctccagtacattgagtcttcagtcgaaaatttctggaaggtgtacaacaaaaacagaagccagtacttactggtttccatgccctcgtttgaaacaacacccttcatataaggaataaggtagcctccagagatcccatcattctatgttatacaaacccttttatcactacatgt

SEQ ID NO: 62555 - DNA, 1718 bp, Bovine  19866880782377
cgtttacctcggcttttaaaagtatcctgctgcaacctgtgttcctctgtgttaaatgttgaaatttacctttggtatttagaatttcatggcgaccaaatatcagttggagaagtttgcgaggactctgtttgagaacgtattttaagaagtctttgttttcaccttcccgataggccagtaccgatgcaggcaccgccggggcgctgactccgcagcacgtgcgggctcactcgtcccccgcgtccctgcagctgggagccgtgtctccggggacgctgacccccacgggagtggtctccggcccggcagccgcgccggctgctcagcaccttcgacagtcttcctttgagatccctgacgatgtgcctctgccagccggctgggagatggcgaagacatcttctggtcagaggtacttcttaaagtaagtggaaaaagggtgggggaatattttctggcaccaagatacgatttatttttatattttccttaatatttatgtcaagctcagtgatctcttccataattatttttttttccaggatggtacgacctaaataccttctttgggtaatattttgaaagctttatggattcctggctcatagcctcttactaaacttttttttgtggcagttaggatgttctcattttgagtttgtgccaaacctgttaattagcctagctctaaactgaaaggatcccatgaagaatttgaaattgagagaattaggaggctggcatagttttatgaagtatgtagggcacaacttacctttttaaacattttactggtagaaaagaactataaaaataagtacgacttccctggaagtctgattttacggtattttaggtgtgagatgacggaccctttagctgcagtttgatgtgtattatcattttctccctcaaaaagcaaagagaaatatgcattttcatatttgatatgcagcagttcagtagcaaacttcttttgagccagcaggtcttcaaaatagaatccttcttctcagggtaaacaaaaacaaggctattgggttatttgtttttctcagccttattttttgtgtgtttaacaaatgtggcaaattttcattgaagctgaaaagatcaaagtagaattttgtttcctctcactttgaaattatagataagactttaatatttttatttggcttctttggcataagtacagaatgtttcttataagtaattatagactgaaattgatattttcaaaaagttgctaagttctgttcaatcatgttgagataataaaattaaaacaatccaagttttgattgacatctgtctttgacagtttactcccaaggcaaatgtaacatttattcattagatcagataatacaataataataatactgttttgttgtatatcttaatattttatattgcctttcagggcaggttgttaactttcagtgtaagatacagttttgtgacaagcttatttaggagaaaagcagaggggagaagtttgatcttgaaaagtttctgcagtttttttcccccctttcctgtaacttttttcttttttaaatcgttttctggtgtcccggtatccatttcagagggtcaggtttcaaccagaacaataaagagcctgagactggaaggtacacacaagtctggcaaactcatctgcatgagcaagatcatttgttctgaagcagacatccacagtaaatgat

SEQ ID NO: 62556 - DNA, 1599 bp, Bovine  19866880846833
cttatcaaatgtttagggataacaaaagagaattaacatacagagacaaactcccagctggctgtgactgtctttcccctcatttgtgaagcttcttaaggactgactcctccctaacaccaagcttcatccagttggcagagagtattctcccccactctacctcacaaagaccatccccaaacaatctagctcttaatagtcagtcttagcccagatggataaaggaataccactcacttaagatatgcctttcaaactcccatttgtttttctagtttctccttccttctttcctggatcatcgaccttaggtatgtctaatcctttaaacagagaccccacccacttaccccaacaggtatgacttcactcttggacccataggggcattttcttgagaacacaaccacccagcagctgtaaaaggggtttccaaataaaatcaagggtctcatttccttataaaaacacagttatcaaaagaaatataaaatccatcaaaggaagtatgtgtgatatcatgatttcttatgatatcacaaacataagattcagagaatcttagtatctattatgtcctttgaaaaaaaaaatagtatccataaccataaagcaaaaacctggaccttggttaagagtttgcagtttggaagctgcaaagcaagtgtgaaaatcacctttggctctgcttcctcttcttcatttagcaatcaacatctcctctagctgccatttggattaatggtggatctctttcagttgaccactttgcaggattatgttctgcatgacagaaaccagatattttgtttctaaatctctctggattgaagtaatcaacatctgctgataacagtttattgtcatgaaatgttattagggtctcagcactgtgacctgtggcgttattgcaggatgtgctgaaatgcacacacttgttctgtaacagagtgtttacctctaggaagaccttgcataatttttaacttcataaggcattcatctttgcctcttagagagtaaatcataaaaggaaaacattttcttgagcccattcttcgtttcctgcctctgtcataaaaaaatgctaaacataattggatccagttgggtaaaattaccatttgtgattgctctttgtttaggagtcatctgttgggttttagtacatggagaagtgctcatctgtatgccaaatttcagttaaacttgtgtatctaaaacttggtatgctgttgaagatccttaagcagttggaatggactgaatcacatttcttatagaatgtccatttggagcaggatatagaaatgatacatgctgttacaatgaaacaatgatacccaaacaacacaggtagttgcaacctaattgttctcagccccaaagaggagcaatggtgttgactagagttagttatttccaggcccaggcgagttgctgtttctgtagaggagtaatctgtaaagtatttacatatgttttgagggactaccattttttgaatacctactctgtagcagattcttttctaattgtcatacaaatgtaatttgctcttcaaggcaactacttggctatttttaatgtccattt

SEQ ID NO: 62557 - DNA, 770 bp, Bovine  19866880905147
taaattttaaatttctagtttttagttaatagaaaatgaaattttaacatgttcttcttgtgcaacagtgatttgttttgcatatcctcctggtgttctgccacaacactttagaggtcactgctctaaagtatagacccctcaaaagcagagatgtttaaatctttatggtacctgtgtcatgtatagtacatgtaagagaagttcaataaaagcttgccaactgaatgaatgaaacttagtgttttctgtgatgtttgaaggtaacttggaattttacagtggatatatactgtctactcatgtaaattttgactttgtcgtggtatttgtttaagattctagtgttacaagaagaaaacgaattgtcgaaaataagcacaaaattcttttagagcaaaaaagacaaaaccctggatctgtaggacagaagtacagtgagcagatgaatgtaagtaccacgttagtagacatctccattcaatagtgaaaaattcttggaaaacagaatgttcttaaaggtctgtgctctgcctgcaaactgttccacaacataaatgatatagccgaagccattgtgaagcactggaactctctatgctaggagcttattgtactatcagatcagttcagttcagtcgctcagtcatgtccgactctttgcgaccccatgaatcgcagcacgccaggcctccctgtccatcaccaactcccggagttcactcagactcatgtccatagagtcagtgatgccatccggccatctcatc

SEQ ID NO: 62558 - DNA, 699 bp, Bovine  19866880965261
aatcctattaataactcttgatagtttaaaatctgcctcattcagtttcacctgtcatttttactttcagtctctcactttctattagatatttgctggatttagacatttatcttaatggatccaaacctacactcattggtttgagaagcctgagatatttgtgttacacacagaattaaacacaataaagtgagctttttatatttctgacctaggagttaaagtcctataagaactggctcatcactccctctccttctgatcccccttctcaacccatcccctaggtacatatgagaattactcatatgagagaattactcatgagaattactgtgctgctactaaatagttttaaacaaaagcgaaaatttttaaattctttatttttcatgctttgctacataaattggctatgaatttgcattatatctattgtagcagttattcaatattaattaattcccccctcaaaatttcggtgaaattttctattgattcagacgaaactaagaaaatagtcctaggcaaattgatagtatcagggccttctgtgatcacttggatgttactgggctatataatatagaagaagggaattgttcatttacaaattaggtaaattaggtgtgaagcacctactatgtgcccaagacatatacctctaacctaggatgatcgggatatatggtaaat

SEQ ID NO: 62559 - DNA, 3374 bp, Bovine  19866881018190
tgaagtcatgtaatcttgtacacggcaactgacaggattttgttttccttaactgctttgtaccataaaatcccaggcagacataattggtggttctctatctgacttttaccttatgagggacgtttgacagtgtctgaagacatttttgactgctaccatgagagagcgacaggcatctagtgaataaggtcaagggtgcttgttggacagcctatattgggacagggaagcccccacaacaaagaactacccaggcccaaaagtctacagttctgagactgagaaatcctggacaaaaagaagaaactggggaggctgtcatgaaagtcttgcattgtcagtagttcatggtaaaaagaacaaaagcatttttaaactgcatctttctctcagcccatccattttttgacaatccaaacttgtttcttggaaggaacagtgaacagagtttcatttattcaatatttattaaacattggttgtgtgctaaatattatccaggaggacataaaaaaataaataactcattattgctgattgcaggaagttcaaactcaaatgaaaggagactgactaaaaattcaattatgtttatgtaatgtaagtgctgtactaaaggaagggaagtcagggaaccctgtctggggtaagcggaaaaggctttcagttatgaaaattttttttaaaaagcgttttgaatatttaggaattttgactccaagttgagacattgtatgctggttgagtctcagtctattggatttttaatgtgcttagtcattatgtgcttgctaatatgcttttaaaaccctaggtttcatttcaaattcattcatacaggcttatgcttttatcaagtatgaacaaactaaaagttgtactgtagtatctttgtgaatggagtcataagttaatagtctttctctgtggaaaatggccactccaataccaacccatgctcttcaattcttagaattttgataatgcattcactacagccattttaaatagaaagcaggaatcatagtttgtttattaattttttaaatttctttagcaatttttacatctgctgctgcttaagttgcttcagtcgtgtctgactctgtgcgaccccatagacggtagcccaccaggctcccccatccctcggattctccaggcaagaacactggagtgggttgccattttctcctccaattcatgaaagtgaaaagtgaaagtgaagttgctcagtcatgtccaactctgagcgaccccatggacttcagcccaccaggctcctccgtccatgggattctccaggcaagaatactggagtgggttgccatttccttctccgaatttttacatctagatactttttttactaagtagcaacacccagaaaatagatcagcatctcttgagagctatttgagagtaaatatgtgttgaatgaaacaatgaacaggtcacagaatacctattacatgacagatgctatgctaggtttgggggctatgaagataatcaagggaaagagacaaatgaaaggatgaatatgatcagtttgctgtgcaaccccttccctttatccactcaatcacaatcatgctgattctgtccaatacttttgaaactacccacatctctttaacttcactgccgctaccccagtgagagctaccaacatcctttagtgtcctgtaatagttttttaacagcattctctctggcttcagaatcaggaatgacctgcatggagactggaaatgatctcttttaagtacaactcaaatcacttcacttctctgcttaaaactcttcggtgattatgcaggccttttgtgagaaatgaactcttagaaaacctaaacagatcaatgctttacgagaaataaaaatgttattaaaataacatgagataaagaatttgtatttccttatgaatttatccaactcatttattcatttctgttgtcatatttttcaaagtactcaataatttctgatagaatccattttttttcctttaacttttcaactttttgtctttgagtattcttatttttcctggttaggttagctactgtctttttatgtgtattttattgtgtaccttcaaaacacgccatacatgttttgtgatcttattgttttcctcttctctttttttaatttttaattaaaatatgttgttgttgtcattcagttgccaagtcatgtccaactgtagcctgctatactatggggattctccagggaaaaatacaggtgtgggttgccaattcctcctccaaaggatcttcctgacccaggggtcaaacctgggtctcctgcattgcaggaagattcttttccatctgagccaccagggaagagttcttacagaatattagcaaaatttcctgtgctgtacaatatatcattgtagattatttatttgatatatagtagtttgtgccttttaatctcctatcccatctttcctttcccacttcctacctcccctaccctcccaccactggtagccactagtttttttctctgtatctctgaatctgtttctgtttgtcattcattgtttactttttagatcccacgggtaaatgataacatatgtaatccacgtgttctttatccattcattggctgatggacacttagattgcttttatatgaaggcaactgtaaatgattctgctactaacattgggttgcaagtatctttttgaattgttgttttcattttcctcaactatatacccaggagtagagttgctggatcatatggcagttctgtttttagctttggaggaacctagacactgttttggagaaggcaatggcaacccactccagtactcttgcctggaaaatcccatgggcggaggagcctggtaggctgcagtccatggggttgctaagagtcggacacgactgagcgacttcgctttcacttttcactttcatgcattagagaaggaaatggcaacccactccaatgttcttgcctggagaatcccagggatgggggagcctgatgggttgctgtctctggggtcgcacagagtcggacacgactgaagcgacttagcagcaggccagcgacactgttttacatggtgactccaccaatttacatccccacaggaatgaaaagggttccctttcatccacatcttcagcaacacttatttgtgtgtgcgtttttttaatgataatcgttatgtgactgtatcattctgtgatagtgcaaggtcatacctcattgtgattttgttttgcatgtctataatgattagagaggttgggaatcttttcacagacctgctggttatctatcttccttggagaaatgcctattcaagtcttctatttttaattag

SEQ ID NO: 62560 - DNA, 1349 bp, Bovine  19866881085432
ccccctcaccccacacctgcagtcacacttcaaaagccagcttctctccagcaagtggactcaatcaggaaacagatattgagtgtcaattaagtaccaggcagtgtgctacacactggggatgaaccagatagacacagttcctgtttgcaagacagatagtaaataaattactacaaataattgggaaaataattctaagtatgcaaaatgctgccaaagaaatacctggagtacgattttaagtcctctacattctctagtggccccggggtaggggggccaaattagtaacggtataatctgtagaaaagcaattctgaccttaaggaagatagtattttacattatgcagacaatttagctcctagttttttttatttcctccatggagaatgaaaagagccaaaatgcatgaacacttaaactatgtccttggtaccattctaagcccaatatatattaatttatataatttccacaataaccaatgaaggagtcctactattttccccgtttcacagataagacaactaaggcacagaaagattgtaactagctcaaagtcacatagcaggtaatggcagaattaagaatccaggcaatccaactgccagcccaaattctttattactgggctattacacctctgaatacagagaatttgcatcatcttttctcaacagtgcattcctgtcttctgcctctggaatgtgcccccagggccaggctggagagtgccccgccacatcacacttctccaccaactgcactgtttctcgtagttgctgacagcccacaagttcctctgtagaaaccagaggagacccttcctaggtctagttcacagggatcactcatctctgaattcgtgtacaatcactgtgcacagacacactcttacaggttatgttctctactaggtttacagcaagtgtgtttccccaaagtaaagagcacatgccttgtacagaactggtactcagaaatattaagagagggtccctgggttgtagggatctgtatgataggcagcaaagtcagtggcaaatggacattttagttcttgattttatgtttttttatgattttttttacaaaagtctatggatattaagaccatatctggaaaatattcaataaacatttaacataccaaagcattgtgccaagtattagaagtaaaactgactctctttcctgaactatatacctaaattgccagctgccttccaggtacaaccacaggttcaaatccaagactattatcctgatccctgcaactcagaaacacatattccaaaggctcttcctcaaggtttcagcacttcttgcaggctctccatcat

SEQ ID NO: 62561 - DNA, 1015 bp, Bovine  19866881112922
ggaaaaaaaattctaaattggcattcagtccaatgtgtattatatttgagtacatactgactgcagttatctgcagagtattaattatccagaagtataatgaagtggaaaaataggataaatgtaccagaatcagcaaggagggttatgtcttcataataaataactagttagtcaactgagcgtaattatgatatgtgcatgtacataaaaaagagttcagcacaatataaggattcattttgctcttgaacttgcttaagctccctctttagaaatatacaaatacaaatgttccttcacgggtgaattgtttttccactacaatccattgaacatggaagttctcatgggcaaagcactgggtcacctagcacagctggcaaaaaagtaatctgggaaaggatttttagctcagtggcaagcagacatcttgaggcctgtttctttcttctcccattagcttgtctgaggtttcctttccttgcaactctaagctgcacatggctccatcttattcagatgaagcactaataaatctagtattaggtagtgcttactctagttgtctaaaaatagtgttagtaagaaaatcagctcctccctgtgatggcgaaggtcatcagcctttatctgcaaaagagaaatgctcagagacagcctgtctgtattcctttttatctattttatgatgtaatttgtattgctattcttttctttttataagaaaaaaatcatacacactgcaataaaaaggtcaggaaacatatgaagagcagaatttttaaagatgattcctaacctcactacctagatgttgtgattataaacattttgtggtataaacttgtatgcacatttaaacacacacacagtttcttctttatctaaatatacatcatcattagttttagtgactgcatactttatggatacattaaaaattatgttgttaaacatctagtgataagtattttcaagatcccagcatatgcacttttaaaattttacttca

SEQ ID NO: 62562 - DNA, 1813 bp, Bovine  19866881117997
aactagctgatatttactggctgtgaaaaaggagggcttttatctatttttaaggaattgtactaggactgtttttacacttattaaagtaagttaatgcttgaatattacacaggtcattaaattatttcatatttatactttttccccctacagattttatacttgcaaacataaaaaggctcattttcttgtgcatcgtaagattatttattttatataatatagccatatgaatattttccagagaaagccctaatgaaagcaaacccaaaaaattcccattcttcagaatgaaaaatctaccccagaatacgaatggtcagtgaactgatgtccctgtttatgtgaaagaacatattaaatagtgttagaatctgtgtttctggaaataagtgttgatgggaccacagagattaaaaacacatttggtgtaaataaagtactggaactagagatgtggattaaaaggtgtatcttttgagtcttaaaggaggtaataaattacctaggttggcaaaaacacaatatcctttgaaaacacaatatcctttgtaatcgctaatagcaaatctgtgcgtagacattctgtgcatggaaatgtaacaggtaattaaaacctagatgttaattttcgtccgtggtttcaaggtattccaaaacttgcttttcagtcacaaaccaaaagttgttcagcacacctttctgatcaaagttaaatattttgcatcagtagttaaaggtgtgttaaatttttttaagtgttcagacatgcattaaccttttccttttaagagcaaatatttccgatagctgttaaaagtaatattttccttttaatgaagatgcacctaatgaccaactaaatatcataccctctcttgtagaggaagggaaagcgctgaaggctgtaggaactaactctgtaactccattaatggagtcttgggtagctagaataccatcatcagctcatttgaacttttactgaagcaagtctcttgatatccatgcattaaaaacaagtttttcctttgtttttttgttttgttttccttaccctcttttaaatattgcctcccggtcctaaaatgtcagtttgggttgtgaactatattattaactacttagggtggggaggaaaagctgtttcattgtgtttcaggtaaatagagttgttgctaactgcagcgtcttaaaagagataaatctcaccaagtttggcacataaaagcaacctgtgactcttctcttcacttttcctcaggggaggagggagggggtaccctgggcactgaggagcgtttagcgccctgactcctgcccgctgagccacccagtcctgtgactgcaaacccaccaacatccattttaaaaaaatactgggagagggagggaatactgccctaagtctgagtttctctgagatctaggaaaatcatgacttactgagttacatagttaagtgacagaactggaatctggacttgatcttttgacacctagaattttaaagaaatctagattgcaagcagttaatctttcagaaacacacctaagtcaccaatgctaatacatgggaatttcagagggaggaagatgacaatggttaatgcatttacttatgtactgtgacgtacatattgtgactcatcttgaggaaattaccaaggtagtgagtttccagctacagaagtaaaaccatccagttggattatcaggcctcgcctctgccacatccttaagagattaccttccaacctcacctttgacctttccctgactaggagcttaccatattacaagtcagtcc

SEQ ID NO: 62563 - DNA, 829 bp, Bovine  19866881296224
aatttataatttatatatgtaatgtaataatgtaatttatagtccttttgtgttttctgctcatctacacttctaatatccaataaatagataatggtatgtgtcttaaggtgtcttaaggaaaatatgacaatataaacatagtcaatgttactaaaatcactgacatgtcttaggaatttcaatgcattaggcataattattgaccaaaatgaagctcctctgcttaggtcagttggttcaatctctctgataaactgaactttacaggaatatgaataataggttatgctttgatcagtacttctcattttaacatttttttgttgttcttcagttgctcggtagtgtccgactctttgtgatcccatggactgcagcattccaggcttccctgtccttcaccatctcccagagtttgctcaaattcatgtccactgagtcagtgatgccatcagtctttcctagaatcaaggtcttttccagtgagtcggctcttcgcatcaggtggccaaagtatacctgaatacctaatatttgagtaatgtattccaaacatactttataaaaaacgtgtatccatggtgaacataagttaaaacccttgttgctgctggtaactcagattgattttggaagaagccattcttgtagggccccaggagtctgaactgagcaggatacagcagtgaggagcacagatgctagggtcagtggacaagggactagtcctggcttttctacatactagcagctatgagacactcagcatgtcatttaacttccctgagcttcagttcctttttgtgtgaaacagaaataataagat

SEQ ID NO: 62564 - DNA, 1948 bp, Bovine  19866881321621
tcctaccccacacaggactgcagggtgggggcctcagtgactgcgggcatgtaatcactgacttgctcagcaactttgctgtaatggcttcaaattgcaggcctgaggaaatgctccataaatagcagctcttttttcttgtaaagcctcttcgtagacccaacagaactgcactaccaaaaatggaggagtcaccatagaccttttaaaaaaaaaaaaaaaaaggtcaagagaacaaggaggaatatcctgctaaccaggttactcattttaggggaatgaatcacagtactgaaatctgacccactgtttgcattcaacttttaggtaacagaaattacaagggattaagtcagtttttgtaatcatgcaatttcatgaaaaggaaaaagaactgttgtttttataggcctttagaaaaagggatgtataccaagtttgaaattaaatgtttgacaatgtcttcttatgggagcagggctcctttcggtgtccattcataagccacctgcaagccaagacatgtgggtgtggtcacagaatacactctggggaagcaggaaccacatatataccaaggctctaaggtcaccgttagcactcacacctcctgcactccttatgttcatgtatatttatatatatgcatgtaacttcatcattcagataacttactgtaaattaacaaaaactcaatgaacagccactttaagttgaatatatttgcagtaacaatgaagatttttcttagctgaattcaggcaggggaaagaaagcagcaatgcatttaaatcaaacacagatagggaccaagaaattcaggttccatgtcgctccagttttccacgtgagttcatgcctaagttaatctacaacaaataaggcagtttttaaaaacaaaacatgagagtcaaattttacaggacaggtacaattagttgtcaattagaattcatggttttaaacataaatgatgacttgtaatcaaaaagcccgtattctaacttactaaatggttcagaaacaacctaatcggatagcacctcaattcagattacattattcaccaacaattagcctttacattttaacagtataaactgttttcctgtgacattatgctttaccctgagttttttaggcctcaggtgaaattcaactatcctgaacaatacttttaaaaaaattccatccaagtatggtaggctgaaaaacatggccataatattttgcagttcctcccaggaacaaagagtctacttttcaaacctttcaatctgagctgacagaatgcagtaacaagtgacattatggaacagcctcagaaggctttgcagcgtctgtctttatcccccagaaggctcccaccaacacggaaggagacctctgtgccccacctggcagccacctacaagccaggagaacaagcctcaagatgctaagactccagagctgtgagaaatgctaggtggtagttcaggcctcccaatccacgttgcttttgtcgttgctgttatggtagcccagtttggtaaatcaaccagtaagagcaaataacctccatgtggcttactacaaaacagctggaagtcttcatgacctaatgtgctgctatcggccatacgcatgtcttaattaccagcattcctgaaactcctaacttccttccaaaaccatgttaatgagttttgtgtaaaaagaattttgactgctctgtgtcccacaaaagttttgttaataaatttaaatctgattgttttaattgttactgggtgttttaacagtaacttataacggtgataggcagaatattagatttgttttacaatttattttaatagagttgattaataaatatgcactcaaatgtttattttggtgttcgtaatgtaaaatggtctctaaactacctgattttgcttgtctatcactctaaagtttaaagaat

SEQ ID NO: 62565 - DNA, 1354 bp, Bovine  19866881334567
caaactcttgcttaaatctctaatgacttggcacaatgatctcgtccttttccaggttactacctgggactgacctgcgttgcttagcagtcaactggacatatgctcggaccatttctatttcacacaccttgactactaactgagaaagggatcacgaggttcttaatgttttacacctcgggcaagcacggtgctaacgctttctgaagacatcaaaacagacgaacataactcagtgcctccaaaatgactgagaacaacacttagaaacaactctcaacacttttttggtgagaaattattatgtggtggcactatactaggtgcagggagatatgatatcaacagctttgaagtgaaaatgtactcctgatgtagaaatgttcatgacaggctcgaagggggaacttcaaggcagacttgaggctagaaaaaatccaggaagacaatccaggggaattaacatttgagctgcatcttgaaggaatctgtatttaatttaaacagttccctgatgaagggtagggatctgagggtgaagaaagctaccatttagtaaaatacagaaatgtcctaaatctcaacttaggtcacagaactaggaagtttccttcaattataactgccacaattaagaaactcactatttcactcaatcaaactgtgaaatttaagaggattattcagggatttgttgtttgggtgccactctttcaaaaaactctatttatttttggctgtgttgggtcttagctgccgcacacaggctttctctagctgcggcgaccaggagctcctcttccgggcggtgcacaagcttctggctgagctggcttcctccgctgcgggcacaggtgttaggctctgcagctgtggcttgctggccctagagcacacaggcttcagtagtggcagggcatgggcttggttgctccttagcgtatggaaccttcctggaccagggatggaacctgtgactcccacactggttggcagattcttatccactgtacccccatggaagtccaagggtgcctctttggaaaggcctagtaactttggggtcatcctataaggatactcttctctttttccttttagtctatgctgttgactatcatgaggttttgtttgcgggggcaggggggcagtgaggggaattatagagacacagtagtaagttaggaaataactcaccttttacagacaatgttcatgactagaaaatcacttcaaatatcctagattattgcagttccaaatgcacttaaagaatttgaattaaaagcacattttaattctgaacataattcccaattgtatcaatgagctttcctaaaattaaaatgta

SEQ ID NO: 62566 - DNA, 755 bp, Bovine  19866881336393
caaactcatggatcacctctaaatatgtacaagtgggcaacaaacattttcatcgcagataatgtgtgcatacatgagacacagacccttagacatgggaaacgtgtgggagttttccaaggttaggctattaggcttaaccatcgcagccaagtcttttggggataaggaggagatagaaagtaggccctggatcatgaaggtaaacaaaaagaggtcatcactttaataagatgtaaacagggtgagaaatttgaattaggaaaaacaagaaagagtagtagcctataattaattaataaattagaattacttatccttgggaaaaataaatttttatgtagtatttactactactagctgaaaaactactataacaaacactaacttcctgtaatattttgaaaacaaacaaaatattgtatgtcataatactgaaggtgactcaacgtcaacttcctgttcttgcctgaggaccctcttgcatcaggaatgactcaaaccacctgcaacgtctaatcaaaccagaaagtcctgattttgccacaagtcagatgatcagtctctccctctcacctgccccacaactcaggaatacagatgtcacccaggatactgaaagtttattaaacaaaacttagtggttcaaagtacagggctatcaagaagtaagagcagctggaaaaagtagatgcaatacatcttgcaaaagaatctaatttggaccaatttcagttttgaaattctggtctctg

SEQ ID NO: 62567 - DNA, 1364 bp, Bovine  19866881348488
caagcataattgtttttttctaggattataaccatattttgaaaaatgtctttgttttgatttatatatataaaacaggcatatattttacatgcattatatgattacagactaaatataatgacaaactatgtatatgtgtctataatattattctacatattaacagtagcagcaatatgaaaacatgataacattttttaaaacatcatgtaacactgaaattttacttcttccaattattctgaaggatagtccatttcctgaaggagagtgaagggtaaatgtcagacgactgaatcacaaaatactggaaaggttaaggcagaagcagagagttgccatagtacttttagtctcagacatgataattagtaaatttattctgagactgttcttgtaatgattcagaagtctattttcatggacaacgatgaggacaaaaaggcagggcagtcgcgtccaaaactcatttcttaaatgtcgtcatcaaggtttcctctaatgatttaggaaaaaatattaatgttctatgcatttactagagggcatacctatttgtctaccttttacacactgttcctatagtttatcagtagataatgacagaagcttacggctttcagagtggccattagaaaaagaagaaagtaaaccattcttagattctgtacataccaatatttctcttagtttttacttcaatgtctttgataacatgatacttagggagtatgatgactattatgaatctgaaaaactattttttagcactatgactaatatgatctctttagtaggtataattccccttatcattgaataagttggctgcttgctttgtcattttcaaagagtttgaaaaacttgaatcaatgtccccatgatccacctacactggatgtatatcagtcaaatggcattaatataaaaaaagcctatcatacagttggtcagtatctctagctatttactcagttgtacaaaagtctcatcaaaaattgatttcaaaatgaaaactttctgtgatttgagaataggtgttatcaaattcatactgggaaagtttttaaaagtgtccacagaaatatttacagtcgttgctgtaaatacaaagtaaagaagaaacttcgagcaatcattctaatgattcaattaatttgccttcattacctgagtcttttgtttgtggtgtatctctaacctcaggtagtcacatataaaagtaaatactcagaaaagtcaatgttttctatggtaacagatttctctggtagctgaattttgaagttgactgtcagtggtaagatgctgagctgtactcctacacaaccctgtgatcaacttgctcacttggaaagctg

SEQ ID NO: 62568 - DNA, 1040 bp, Bovine  19866881349189
caatgttcttgcctggagaatcccagggacggggggagggtcgcacagagtcggacacgactgaagtgacttagcagtagcagttgtaaatacagtagcctattatttattacctcttataattctcaaaatttggtacgggatcggcagcatcaggctcgcccgggtacttgtcaggaatataaattctcagaccctattccactcctactgaatcagaaactttgggtataggacccccagctctgttttaacaagccctataggattctgatgcaaactggttgaagaaccatagatttaagacaatattcaggtttccaggagtctttgttagtcaagatgattttggaagaattgacatttattagtaagaaagaccactctctccaggtattcgaattagttgtggcaaacaaagcttcatagataataaaatatatgtaagataaaccacttctcactggaagataataggaaaattgttacatctaaaattactggggctgaaaagttgtgtttcttaggaacattttgatgttatactcctcatttagctgagcacagctcaaagaatgtttctcattagttcttgttttcctgggggcagaggggagggggcgtggttagctgtacccaccccaccagatttctggttattatgagcaaaaggtttgacatcatcattcactcaattgctttcacttgcaaaaacataaaataccctgagagaagctaacctcattagcatttccttagaagctttatccagttaagacaataggatgattgtttgatctgtcaaggaatctttggttgggttaagaaacaaggttgatgtctccttggaaaaatgaggttgctgctaatatttacagggagctatgtagcatacagctccctcgattgttaagacaaaactgctaaggtctgtgtggcataagatatatgttggtgctatgctgtacttttgaatcaggtgaaagggtcccaggaaaaatcaatttatccagtagcaataaggacctctttttatcagt

SEQ ID NO: 62569 - DNA, 941 bp, Bovine  19866881541205
cttaaaaatttaaaaatattaagtctatgatcatttcactaatgaaaatgatggaaagatacaccttgtcaatgagccacttacagtgcttccctattttctgatttacagataaatcagggtcagtgtaataggagttcagggttcaatgaaacacagtgtcaagggggcagaatcaaatacatactgaaagcaatccggtttatttcagattgcaccttgagtcaggatagttttgaggagcagcaagggcaaaagccaaagtgaatggagttaataatgaatagatgaatcagaagctgtcattgcaggttagcattctgaaaagtcgactaaagcaagaaaagatgggataaaagcttgaggaagcatgatcagaagagggatatttaccattatttaaatagctttgtatgtacctgtcttcctcagcacctagccaaaaaaggaagcactaaatgaaaactgcttgtttacttgcttttaaaagtgcaactcccagaacccggagacaataagaatgggaattaatttgaaaagcagagactctctgacaagaatgaagatgattacatagcatcatcactaccaaccaagtcctttgagaatacaaaggttacactctaattatcataacattctctgaaggaataaacatggtttacatattctgaaaacagaactgtttaacactttcaattttctacaatgcaaccaataataatgtcaaaggtgggctagaccaattcttaggtagggacaagtcagtgataaaccagtgtgaaggctccaggtcctttgcttctcattttgtctgttgtctctctgacaacagactggacagaggatggaaaacaaaacaaattaaccaactatgttaggctttagcagctctgtaaaataaagggaagtgttaggttaactcttaagacggactattt

SEQ ID NO: 62570 - DNA, 986 bp, Bovine  19866881581528
tctaagactttagaaagtgtatactgttgaacaaaaatgtctatccttttattcattgtgcaaaagtttttttgattgaaaatagttgatgttatcaggataataatacacagaaaaataaatctagtagagcagaaaacctgtatataaaaatgcacattacttctatactaaattactggaaattttttattcctctaaattcccctggaccctaaaccccctctaattgtctgtcatcttcctttttgagacaaaaatttccagtgagtactctaaaattacactgtgttcactgcctcagcttccattcgtttcttaatctactgctgtctggcttctgtctctaccattccaatgtactgcttttgctagtgattaactaattgacctaactgcaaaaagagacacttcttgaccactatctttcttgactttaattccctcggttttcatattatcatatgttcctggatattttgtaacttctctggttgttcctcctcaggctctttcttgagctcctctttctttgcttggatatgctagattttttgagagttatgcaatcctctgcttgtctatccatattctctgtgtaatcttattcatattgtctgtgtgatcttatctgtatctgtatgtaagtgaagggttaatccatcctctgtggaccaattcaactctgggttaactctttatctctgtcccctggattattagcagaactaggagtgtgtttcaggcacacagatataaaaaatgacccttcatggataaactgtctgtactgacaggactgtcagtaagtcataggaaggacttataggaaggactggtaggaagctatagctttgggtttccccaagtgtggtaattcttaaaactgaacatatcgcttgcatggaagctattcatatagtcattacaagaaatattggctcctgtttagaacagaggatttctaacccaggtgtctgtgcatt

SEQ ID NO: 62571 - DNA, 778 bp, Bovine  19866881638593
tctccctgctgggtcgcatgctgacctggggagatttttaaacagtttaatagccggcttgcctctcttctttggttgatgttatagctgcaagtctgtgattaaagagcaacatttatgctccccttttcgtcttttgtatcttgtaataattgcttcgaggtgacatctgcctacatttttatgtatgtacatttaataatctttttgttttgacctgaaatgttctgtattttattttttaaagtttccagtgctgctttctttgagaaagtgtctctctcagaggtggattaacaaaggaaacacgtacaccccccccaccccaaacaccccactcaagtgagcctctggcgaaggtaaaccaggacaaaatgatctgaaaattatgccatatgggtagtggtttccatggaaaagaaaaactggaaagaagatagattagcatgattgtttttcaagatttttgagagattctcactggaagtaaaattaggtttattatgtgataagaatcgtgaaaatttttgactctgtggaatatttggctcacatcaaaccttcagaaataaaaaggtgtccccttatgattgatctcggtcagtaaaagtcagcaaaatcatgggttagttggtacgcatcaggaattacggagagggcccctcagcactggctgtggaagttggatgtggacttagaaatttagtatcttctaaaggatctgctttatgagcagtgtgtagtggagaagagttatagaaagatagttcacatccag

SEQ ID NO: 62572 - DNA, 1115 bp, Bovine  19866881703054
atgctgtaatgtgataatctaaaggagagaagaattgtattaaaaatggaaggcattcagtgcttaagcctcaagaaaaataagacacatgtccatatgaaaataaaaactacttcaagaaataatgagatataagaaatgactaataaaaataaaagccttccatcacaacccaaatccttatcacaaagataatatacttgacccttttggtagacgtacacatagagcaaaagaaactacattttccccatatttttatactttaagataatgttgttagatatctatctccaatatccatgtatttgtggtgagacggttgatcctgaaccacaggctacctaccctgagaaatctgactaaagctgagcagtgatctgtttgacctctatttgccctttgtatcatcactttcaaccagattttctagcccatattcattatctatatgactatcagacttctgagaggtgaaaatactgttaaagggcaaggaatgagaaaaggggaacctgaataagtaacctatgtacatttctcaactcatgagaggacactggttgatcagaaggacgtaatgcatggaccctcagaacaaagcatagcatgaacatagagggagcccaatacagcgaaaaaccatcttaataagcctgtctctctacttccctgttcaaatgcttttccacctatgcagatccattcctgcctgtccagctacctccacacctgatccccacttacctaataagctatctcccttcagagccccattgctatcccaccattcccaaattcttcctagctatccaaccgtttcttccacctgccagcctgtccatccatctgtcccctctgctcttccaaagaacttcttagcagccccgttaccatcctacccgatcaagtatcttccttgcccaccagcttcagttacttctagctttcctggcaggttccctcatctgccaaccccaattccttctggcccacctgaccatttaccccacccaccccgaggttcaccagtcattcctgattcagactcacagagcaagttgttttataaaactttcagatccgaacattctcttccagcacagcattcaacc

SEQ ID NO: 62573 - DNA, 908 bp, Bovine  19866880353516
ccattgcaatgaaaagaataaaatacttaggaatatatctacctaaagaaactaaagacctatatatagaaaactataaaacactggtgaaagaaatcaaagaagacactaatagatggagaaatataccatgttcatggattggaagaatcaatatagtgaaaatgagtatactacccaaagcaatttatagattcaatgcaatccctatcaagctaccaacggtattcttcacagagctagaacaaataatttcacaatttgtatggaaatacaaaaaacctcaaatagccaaagctatcttgagaaagaagaatggaactggaggaatcaacctgcctgacttcaggctctactacaaagccaatttcattttaattacactcactcaatagaattttagtccaaaaaaaaattgtgtacaatagaactagaaagcattttcatacacagttagaaagtctgtttttttctctgaatacgtaacagtttgaatatctacctggaagctttttgtgtcttttgaccacaaggtaacttttataataagcatacaaaattctagtattaattcagatttctgaaattggcttcaatctaagaaacgttaatgccacagacgacaaaggtctagcatacaatattctatacatactgctcaataagtgtaaataggagaagatggtgatgagtgtatgtgtggtaaacttttgatactagctataaatttagcgtgaatttctggaaataggaatcatttagtactagtaagttgtccccctcaaacatattaatctatcaaagtggaaattaattgccttggtttcaggggacaatttgtacccatgcagctttatatgggaaaagtacttatggaatttaaatagctgacgaatctacttgtgtac

SEQ ID NO: 62574 - DNA, 2072 bp, Bovine  19866881196466
ttattttgggagaaggaggcttacagagcacacagatgcggaggaattgcttatatttaccatgtgaaagctaagaatcatgtacgtgaattgacgttgagcgtgatggactaagaggtagaatagaaaattaagtaggctgtatctatcagatgcaggatttaatggactaactcagctggaaatgacgaaccgtttgcttggttgactgactaaagcatggattccacaaagggctatgttttatgaggtcaagatgccagagtttccctgtaatcatttagaggaaggaatccaacaggcttaatctagtgatgttactataaaattaccatatgcaatttgctttctctccttttgacaatgttaactgaaagttacagaaaacactcccaaccctggggcattaggaaatgaattatgaagggagaagcagaatcctttcaaacttggtgttagctgtcatggatagactgggtatgatggtagaatctgccactgaattaatctacatgattttaatgggaatgataaaatcccagagtgacagaagccagttgacagtacttaaccatcagagataagagcaactgccattcaaagtgttttaaagtctagggatctggggcatggctgattgattacccgggtcctaggaaaaaatataataaaatacaaatatggggaacaaaatctttcatcattgccataagatgttctcccacccaatttctctacgctacgtcatctataaaccagaaccccttgactgaagaagcgaccaggccctcttaaggagggtcttgcaacagttacgtgtacagactgtaaggcatcctctaaacaccagccagtagggtaaatagtcattttgtctgtgactctgctggagaaagagaaaaaccccagacactgactgtgagttgaccttaatccctgtggacctgaaatgccacgatgattcactgaagcttatggtgaccagtaaatagaggtttggcccaagtctatttcaaagtaagcctattgaatctatcctttggttatattcccagttcctgaaaactacatagtttggtaaagtagatgaagaaaataacagacttcagttcagttcagttcagtcactcagttgtgtccaactctttgcgactccatggcctgcagcacgccaggcctccccgtcccatccaaaatgacaaatttggaagaccctgaactaacctgtcccatggacacgctgaatctatacctatatacagggcaattcatcctgaagacctgagggttggttgaatatcttctgcacattcaattatagaccacataaagaaggaaagaccagtcacagacacattatctatgggaatcgcacccctgatggggcaacattcagtagggagggctatcagtgagggacctgtgtgcagacttgcagggcctggggcacagtataaaacccaaaatttgttttcataaaaatagataacatatttcataagcagattgtcttagcgtccacattggttcctcctccagcaccataatccatacaatttcagagcaccttactctcgatcatacatcccacacctcattacttataactgagaaaacctatttcagtgtgagagaagacagtaatccacatccaccaaatgtacttaactcatgtactggctgatccagccgaatagtggaatgaccaaagattcaatgtgagggccacctgggagataacacctctgaggttgtttgtgctgttttacagactttgctggacttgctctgaaatagtgacatggtgctaatgttatagagttcactggtctgggaactaagagaagttggagagacccttcatattatacttgacaagataagaataaatgtgataaattcagtaagagtcaagtctagattttctctcccccttttttcaaagatctgactcctagtgctaagagccaatacagagacaagaaggcctttaacttatatgcacatttctggcatgcaagactttccccagggcactgagtgccctgatttttatgcatcccctatgacat

SEQ ID NO: 62575 - DNA, 725 bp, Bovine  19866881309727
aaaaatgtgggtgtgggaggtgtgagaaattagggccgcggcttgagttggttctcccttgaaggactggaaaccacagtatgtccggatgacctgaaagtacaccaaagattttgagtaaaacctacaggccaggtgcagagaaacagtattctgcaaagatgaatccagtcatcacttactcatgtctgtccaaacaatcagccaggagaagaatgtccctgtcccccgaggccctgcttctttctcccaggatgtactactgcctgttaggaccactggggctgcctcagatacatcctgacagctgcagaagagtttggtagcagtcctaattccgctttcctttccatctgtttgcagatggtttaaatttgacccctcagggggaaaaaaaagtatcctaccaagaagcaattattatgcttgtagatttctcttttaaaaaaaatgacaagactgtgatttgcaagagccttgtaattgtggattatgttgggagtttgacactcattctgagcatggagtttctgacactgtttggggatagattgctaatatttcatgtagatttattcaaactgtcaatcagaacaacgtagaaaataatcaaaaatgtcagccagaatgttgaaggaagtccagtcctttcaaagctattagcattgcttttatttttctttttcaaaatatctttcaactgcaacaggatatacaacaccaga

SEQ ID NO: 62576 - DNA, 1324 bp, Bovine  19866881499827
cagcagtaaataattcatgctttgttttaatagttctcattttagcatgaatattcatagtgtatatgatggggaaaaatcagaattactcaagcttctgggagaagcagataagattattgttagaaagatgaaggaaagcattaatttcctgaatatttaaaataattatataggtttaaattttggtgtgatcatcaatgctatataggtatatctgtcattgtcattgactggtcgtttgtaccttaattgtcttcaactttaatattttaacataattagaatactaaatgttattttaaaagcattttatctagctccttaaaataactttctgaaatagtgttaggaagataccatttttgatgtttgaagtagcaaaatgtagcaaatttatttatatagttttgcatacactcacatacagctatagtataaaaacccttataaacagttatgagtttactagtcactaccacactatgaattattgaaaaaaaatataaacctggctatcatttgatcagaatttaataataggaacttttttattcacagtatgattgaatgaacaaatttataaatgattatatttactagctgccagatactttgtaaaacactaaggagaacatatatatgaataacggataccatctatcccccccaaattaatattaatggctagtcatttacttagctgagaagatcatccagtaaacttgaaagattcatggaaatatatgcactgtagatttattgcagtagttccaagtggcctattcaatattgtccacaaaatctattgttcttttctcatagtttcaaaaagcttacttttttctctcctttgacttaaaaagcacttcaaatttttgcctttctgtttgctctagcctcttcaaaatcacaggggaagctatctcatcaaaagatttaaatgacatggtgacatactggtctcataacactttatatgaaagaaactcaaatgctctcttttattttcattcaaaaactcttgctatctttattctactttgatccttataaaatttatttcaaagctcatcttgttgctattgtttcttttgttagtcttaaaaccattttttttaattaaaacattgacccaaatgtaagtttcttatcaatcattatttttggcttgtgtgagttatgaactatgctcaagatttaaaaaactctaactaaaattgtaatgaatgggtacatttaaactagacgagccttaaatgaaatagaacaaaatatggggatttttagcctcttaaagatataatgataaggggataatttt

SEQ ID NO: 62577 - DNA, 1534 bp, Bovine  19866881686599
gctacagtccatggggtcacaagagtcagacacatatatatttatctgcattcaaatgtttcctaggcttataaatctggagagacagtagtttttgaaatactgctagaaagtgaaataagagtttgagaatgtaagaatattttcttcctccatctccagtagctggtgattcctgagagagggataagtactgcacatacttgttttgtggtttgttttgattaaatactgaatcaactttaccattgcttaataagatacttaaaattcctacataaaagatatgcctcatatttcaagcccaataaatcacagtttcagttttcaattgagacatttatctggcaaacttaacaacactagcagaaacttaatggtagtctttttttactttttaactttttgtggccaggaaaaacaaaactggggttttctaaaggtaatcttcatagtattacagtgaaaatctgagtagaatttttttaatggagggcaataaattcttctgaagggaaagttctgtagtcaaacattcttttcttctctagcactgtcaatcaccaatgctcctctttgcggagagaaaaactagagctcaatgtttaataataataataggataagtaacacacatatttttatctttatttgataattctataaattatattacttataagtacagaaatagcttaagaaatattgttgacagatgactacttgggaggaaaattatggttatttaggaactaaaatattgtcattcttttaatagttaataaaataattaaaactctttcacttgctttcattttaaatatattattgaaactcttaatgctaatttcagagaaaggaaaatattgtgacatgcattttattgcctttaaaatattctgactagaattatgttagagctagtttaactatatcagttatattataccaacctgaatttctattgggcatttgtgtccagttatgagtgcttaacttttgaatatatactaaaatttcactttgattgtgcttgcatggatacctggtctaatatctacattacttgatgtgcaagttaatgttcactcaaaatggtttaatattcttttagaccaaggactcctgttttggagggcataggaaaggtgatagaatttctgcattttcaggatcatcttgaatgaacactttgttgcactctgaaatctgtatttttctcaacattgtcatttaaaatgttattatataccttttcggtatttttaaatgcaataatttcaagatgaggcagatctctttgcttgcattttgaagcagttagacaatttaaaactttccaactggctaatttttactgcaatctggttattctcaatcttggctggaaagcattgaaagcaaattaaaaccgaggcctcaccccataccaaatgaatcagagtatctgggggtggggccaaaggagaggtactaaacaaaggagggggtgaggattaatgcaccatgagctagagaaccacagcaatataac

SEQ ID NO: 62578 - DNA, 829 bp, Bovine  19866881852824
aaaagtaatttctatcctagtgaatactaagtctttaggaaaactgtcatttggtaaaatgtcaaggagttcatttaaaatgaacatggtctatgaggtagcaattttagagaagttgtcaaaattttcttcaaaggtgaattaatcagactttggtcttgcctaaagctcttttgtcctccttagccacacggactgcttctgcccataaaggagaatataaagatggcttcagcgtctggaactttccaacggatgaccactgcaacaaatcaaagttcagaattaacccttttcaaagtgtatgtgcaggagtacagaaacttagctattaaaaaatagtgattctgcctcactctgtttcaggccatgccctgcatatgcttccttttaatctgtggaaactaggaacccatgaaccgctgtggcattagataatttctctgattcagagagcttccctggtggctcagttggtaaagaatccacctgcaatgcaggagacctgggttcaatccctgggttgggaagatcccctagaaaagggaacggctacccactccagtattctggcctggaatacttgacttttaccgcaatacatgaaccgtgaacttccacatgttcaaactggttttagaaaaggcagaggaaccagacatcaaactgccaacatctgctggatcatcaaaaaagcaagagagttctagaaaaacatctacttcctctttattaactatgccaaagcctttgactgtggtggatcacaataaacagtggaacattctgaaagagatgggaataccagaccacttgacttccctcttga

SEQ ID NO: 62579 - DNA, 963 bp, Bovine  19866880392134
atgataggctttttcttttttatttgttctttataatgaaagtaaatttcaccaatggtcttcatttcctgaagagctacagcggttattttactatgttaagcactgtggtctgtgagttaaaaaaaaaaaaacaaaacacgacatgtggaaacgtcaacctctgttaacaatcgaagtactgttagcagcaaagagacaagcttcaacaagacaagctaggtatggcatttatcttcctttcggaggaaaataaacaatttggattgattaaagaaagagattgaaaatgtattgaaagacaaatggaagaccaaataaaaatgtgataaacacttgtcctttgtttggaaagataaactttataatttccatcggaaaaaatgcggctcagaatctagcccctgcaagccacggtaggtgttaaggattgctgaaaagcaaattccaggggaaatctgctgtgcttcactcctgaaaatgcttgaaaaagagtaaaagccctgaggcctggctagcaggtgtgtgaccaccttctcatcacaagagagacaagagaagaaagagtctctttcaaatttgtttgcaaaatgatatttctatcctaccaccttaaatatgcatggttgatgatgacttcaaagtggggtctctacagccaaagacgatactgattgattgagtcgttcgcaatttagcggctgataaattgccttcacgtgcattgtgatgtctgcagcccaatgtaagatttttcggcatgggtacaatattttaaaaagactaattcagggaaaactgcagcctaaaaaatgcctttttttttttttaactaaagttccaatgacagattgatgatgcatgtagggcaagcttccgattctagcaagagagcacaggctcccctgcagtcactctgagtcagtcactcgggcaagcattgtacacacatcattccaagca

SEQ ID NO: 62580 - DNA, 1369 bp, Bovine  19866880404050
atttccagtttttaaggaatctccacactgttctccatagtggctgaactagtttgcattcccaccaacagtgtaagagggttcccttttctccacatcctctccagcatttattgcttgtagacttttggatagcagccattctgactggcgtgaaatgctacctcactgtggttttgatttgcatttctctgataatgagtgatgttgagcatcttttcatgtgtttgttagccatctgtatgtcttctttggagaaatgtctgtttagttctttggcccactttttgattgggtccttttattttctggaattgactgatgcaggatcaatccctagtcaggggaactaagattccgcaagtcaagcagtgatgtgggaaaggggagggaagactgagtcattcaacgttgtattttcccaggggcagattttactctttttctttgttttttttctttgagggtgctggtggtgctggtgaggggaggctgttaataatgtgtgtgattatgatgcgattataatgtgttataatgtgtgcaattataatgtgtccaaggacccttaatccagatgcccgcagtgtgaggatgccacatcctacagatgagaggcttgtgagggactcggagacttattttgtaaattgttccatgtagaaatttgcctgtcctggcatcatgccctggatggaagccagagagagggtttcaaaaaagagattaaggtgttagttttagaggcaggaagaagacagtgggcaatgcatttgcctgattataccacatacctgatttccacccagcttgtgaatacctcagaagaggtaaaatgtcaatagctgttccagtaacatggacgaattttgagtgattcctctcctgtgtttttcaagttttatgtaatgttattgtttttaaaataaatatttttgcattttttcctgtaaaacttatgcaggcactgttagcataaaatactcagtataatgttatatatagaaacagatgagtatcctttgaggttaactagtaatactgatagtaaacagtattgccattcattgttagaagttattttaacaatgttgctgttcagttgctcagtcatgtttgactcttttgtgacctcagggactatagcctgccaggctcctcggtccatgggattttccaggcaagaatactggagctagtggccatttcctcctccagaggatcttcatgaaccagggatcgaactcaagtctcctgctttagcaggctaattctttaccactgagctgccagggacgccctattttaacaagacagacctttaaaatgtatccatatccatacatgtagcttatacaataaatctaaa

SEQ ID NO: 62581 - DNA, 1597 bp, Bovine  19866880405758
ttttttggttttgttctgttttgtttgttaatcttactcaattcctggtaagtttctcttaaacaccactttgttcattccttcctctaataagtaaataacttcttgtgaagaattgtgaaggaaattcaatcataataagagttcactgactgaaatcaattgcctttaatgtactaaaatgctattaaataacccctcttcttttaactacctaatatggaaagaattaagctaacttcaaaaccaattttattatgccagacatggtcttcctctaaaattaaaaccttagtgtggtgactctccacagcaataagaaagaacagagacctattttatgttttgaaataaacataattcatagatgcatgagttggtgtatactataacagactattgaggacaaacagttaaatctattattattcaaaactacatggcactctgctggctgttttgccatatattacatgctaaagcaatcctaaaaaaacagataaaaattgcacaacctataggatgttattatatcaaacttgaaaatcccatcttcataacaccagtatcttacctccaaagaaattattgtccttggaaaacaaaattaaataaaaaattcctagagtctattatacggtgtcatgaagtgtagaaatacaatatagggtaaaaattactaagcaattgattcttaaaactgttttttcattctgaagtccagcatttccctagcaggaagtaataggacatcattttcaaacatgtgacttcctttattacacacttgagatttcagactttaaatggaattatatgcttgcttctggtgaatcatgttcctgcatttaacgggctgctagcatttgaaatcagaaaggaattttcccttagaacactttcaaaaagacatggatagtttcccgccccctgctcttgggaacagggagtggagattaacattagtgaggaatagaataaaattaatgtgaaaggatggacgttttgatttgtcctttcatctccagctttgtatttcaccctaagacttggcatatggaatatcatttcatcttgaagctcctcagtggttgaatgacttttgactgagttataccctcctcagtacaggaaaattgattgcgtcctgggctcatagaaactggtagttatgccaggagacttgtaatgcttgctgggctgtgtaaaaactgtgaaatgtggcaacaggaaagacagtaaaaggaactggacatttctttatggcttgcaacttctatcctagtccaaattgaattgcgaagtatttttgaacattaaattccttgggggaaaaaaactatcatagtaaaaataagacttagggtctttaaaagattatccagaaaataattttgtgaaaaagaaaaattaataatctgacttgaaatcattatgatactaaagcgtgagcaaatacacaagaaaagttcctattgatcagaaactcccagaatcttctactgcttttctgttctcagaagtactagcagaaaaaacaactttgcccataaatttgtttgcaagtgtataaaaatctggcaagatacaattttca

SEQ ID NO: 62582 - DNA, 2766 bp, Bovine  19866880538306
cagtccctgcagggctgcatgaagcaggttattgcgcccacctccagagtttcggactgagttgggtcgcacagagtcagacacgactgaagcgacttgcagcagcagcagcagcaggccttgggtggggcagtctttgcatttctagcaagttcccaggtaatgctggtgaggctggtctgagacagcactttgagaatcacagctctatactgacacctttgtttacatggaatcgaggcaaatagtgtagagtaatagctgccaggaaaccacgcctaggattgccaacagctggtttgagagagataattaataggcctgcttgtatcagttagggtctcaactggaaacagatggcatgcttcagataggataagtcctgacagccaagaagtgaaaaccttgttaggccctagggttttgcaatgaagacctaagcatccatgtacaagattgaactcggcccaccttcacacacagtcatttagaacagctgacacaacgcagggttgtgaggttacctccatatgcacgctagccacaaggcccaaggaggtatcctagctgtacgctctgacacgtttatttcttttctctcagagtatctggaggcattgccctcttcagctctctgtcgtccttacccaaagcatgactcaggacttcaccctgagaaagtaaagtatctgggaaagctttactgatgtatacaaattttatctgagtagtcttatctcctttcctctgatcaatggcccatttttcttctacctgctgtaacaactattctcacttcaaacatatatgcagggggttattttatctctttaaatttctatatgtgaagttgtgggcttccctggtggctcagatggtaaagaatctgcctgcaatgtgggagacatgggtttgatccctgggtagggaagatccccctaagaagggaatggcaacccactccagattcttgcctggagaatcccatggatagagggctacagaccatggggtcgcaaagagtcagacacgactgagtgactaacatgggaggttacagccattcttccgtctcttctggtacctgtcgaaaggacactcagcagacacactggcaactttagattatagatgatctctgtgtagcccttgttattatagcattcttctttactttttgttttgatactaaatatttttaataataattttgttaaaaaaacttatgtaaccttcttagttaatatgcgcaaaatggatacaattagggatccattccacatctcaggaccagagtattcctggaccagcatatacctcctttcccatcaccggtctcctctgcccccaagtaaacaccatcttttaaaaaaaaaaaatgcatatgctatatcttatgtagacttccataagcagcatactgtttaattttgttggactctgagcaaattttgcagcttctattccttattccatattatatttctaaaaattgtttatattgttacatgtagaagttgtatattcattttccctgtgtaaatttataatgtgaagatgcttcaaattattcatttccctgttgctagacatttgtgtcttttctagtttttgtttttatgaacaaagtggcagtgagttttcttgtagatgtctcctacacgtttcagggtccctcttgagtgtactgaacctagtcatagcattgctggattatagaatacatacagattcattttcacagggcattatgcacttgttttccaaagtaactgcaccaatttacaaccctaccagtatggcataagagttctcattaagccacatctttaccacctctgatatgatcggtcaccttaatttttgccagtatagtttgtgtacagggtattacatgaggttttaacttctgtttgactaatcactagtgaaagtatctcttcttatgtatcatatcaggttcttagggctgctgtaacaaatttccatacactgggtgacttgaaacaacagaaatgtttttccctcccagttctgggagccagaagaccaacatcaaagcacaggcagagttgcgctccttctgaaagctctcaggaagaatccttctcgcatcttcctgtttctggtagtgtcaggcctcttccttggcttgtggctgaataactccaatcaaatctctttctttgccttcatgtggccttttagatccatgtgtctctcacctgaatgactctcataaagatgctcgtcgttggatttaggacctacctggataatttgttgtttagttgctaagtcgtgtctgactctttgcgaccccatggaactatagcctgccaggcccctccgtccatgggattttccaggcaagaatactgggagcgggttgccatttctttttttcgaagatcttcctgacttagggatcaaacctgtgtctcctgcgttatcaagaggattgtttaccactgagcggcctgaataatttaggatgatcttatcatgagattcttagttatttctgcaaaaacctttttttccaaaaatgtcagattcacaggttttaagaattaggacatggacatttaaggatcagggcatgtagttgaggcacaatttaactcacgacaaaaataattaccattcacactttgtaaaacacaggttcatgtttttttctcccgattatctattgaatctttattattttcctattaagcctttttcttattgatttgtaaaacttctttaaagatatccatt

SEQ ID NO: 62583 - DNA, 1467 bp, Bovine  19866880638117
aatttataatttagtgaaatacatcaagagctctggtaaagatacacattattgcctctttctttttaatttctaattcctgcatactttctaataataacagagcatttgacatgaaacaactttttaatttgtttatttttgtctatgttagatcttctggagaaggcagtggcaccccactccagtactcttgcctggagaatcccagggacggggggagcctggtgggctcccatctatggggtcacacagagtcggaatcgactgaagcgacttagcagcagcagcaggttggatcttcactgatgtgcgggccttactctgcctgtggcgagcgggggctcctccctagttgcagtgcactggcttctcactgtggtggcttctcgttgtgcaaaatgaactccagggcgtgagcgcttcagtagttgtgggcacatgggctcagtggttgcaactcccgggtctcgagcacagccttaatagtggcagcacgtgggctgagttgctccagggcacgtgggatcttcccggatcagggatcgaacccacgactcctgcactggcagctggattctttaccactgaaccacaggggaagcctgagacaagagctttttagtaaaggttacacataatattaacagtggggtaccagacagattgtaaatgctgttgttgtatgcgttaattgcaaaatatggaccttaatcctgaagaaatatgtgttaataatgtatattgaatatactgattaaaattgtctgattaatccaacagtaagtgctctggaggcattttattgagcttttaaagaattattatctactagaatctttttaatttctcaaatgctcctaatatattatttaccacttgctaatttttaaaatcatgagactaatgtcatttggatgctgaaaaatatatacctaaagtgataaaataataaatctttcttcttccaatagtctaccttacctttctaaccctactttgtagttagctgttatacacaaataaatccctgaagacattgtaatactacaaggcttggtttcagagtgtacattcatacagaatttcctttgcttagcacttagagttggaattatgagcataatatatacatattaaaacctagttcaggaaaggagagtaggtcagccctctatggtagaagataaatagaattcaagtgctcaaagctagagcattcaagaaaatagacacttatttgttatggggcaagaagaattagacctcagcaggacatgaacctagaatttccagatgtacaagctgaattcagaaaaagcacaggaaacagagatcaaattgccaacatccactggaccataaagaaagcaaggaaatttcagaaaatgtctacttctgcttcacagagtatgctaaagcctttggatgggggggggatcacaacaaactgggaaaattcttaaa

SEQ ID NO: 62584 - DNA, 1134 bp, Bovine  19866880673462
atgcaaagagccaactcattgggaaaaaacccccttgatgctgggaaagattgagggcaaaagaagaagggggtggcagaggatgaaatggttgcatagtatcactgactccaatgaacatgagtttgagcaaactctgggagatagtaaaggatagggaagcctggcatgctgcggtttatggggtcacaaagagtgagacctgacctagtgactgaacaacagcaaggagaattaagaacataaaatattcacagaacttggctttcactaaacaacaagcattttatagaatacaataatgcatgttatcagtttcatgtgtaaaattaagagattttagatagaacgagcccacaggaattaaacatcacacacagacttttgaagaccaagatgactctactcacagagcatatgcaacagggggtttgcagttgctgtgtatgagatgctgtgcggctgtgtttcagtgtcaataacactgggtgatgcatagtacaatatatctactgaatattgacatatctttgttctttgtcactttccatttttcattcctttcattccccccaaggaaataatctagaaccggggactctcaaagataattgtatatctcagcttggcatgaggaatacagagaaggaagtgaagcataagaatggacattagagcaagtaggatcctagtgtaaactataggaaagcgggatcatactctttttaaaattttttatgtatttttggctgtgctcggtcttcattgctgcgcatgggcttcctctagttgcggcaagcagcggcttctctctagttgcgatgtgcgggcttctcaccgtggtggcttctcccgttgcagagcatgttctctaggctgtgcacaggcttaagtagctgcggctgtgggcttagttgctccgcagtatctggaatcttcccagaccaggtactgaccctgtgtcccctgcattggcaggcgaattcttaaccactggaccaccagggaagttcgaatcatagtctttatagacatgtttcagggaaattctgaggttctgtttttaggagctcttgtggtatttctcaggtctgaccaaacttgggtcctcggaccaagaggcaactcttccga

SEQ ID NO: 62585 - DNA, 1509 bp, Bovine  19866880697606
tgagatggctggacatgagtttgagtaaactctgggagttggcaatggacagggaggcctggcgtgctgcagtccatggggtcacaacgaagtcggacacgactgagcgactgaactgactgactgactgactgagacagcatattaaaaagcagagacattattttgctgacaaaagtctgtctagtcaaggctctggtttttccagtagccatgtatggatgtgagagttggactatgaagaaagcttgatggacaggagtttgagcaagccccgggagttagtgatggatggggaagcctggcgtgctgcagtatatggtgtcgtaaagagtcagacacgactgagcaactgaactgattgactgaaataatcatctttattaatttaaactgtttctgttctgaagatggtacatactacaaaaatgattaaggcttgtgattgtaattatatattcctttatgactgatgtctcatagtggaatttaaatttccctttgccactttaaagtaaggtgattgaggggcttccctggtggtccagtggttaaaactccacactccgttggggaactaagatcccacatgccacagagaataaaagcaaaacaaaacaagatgatcgcacatcttgtgcaatacttccgggggcaggtagtgtaagctgaacccagttaggatatatcccacatttccggaacttggcacaaaagtttagatcacatctatctaaaaacctgacaattaccagaccatctcctggtacccgcttaatttattcctaaaaatttaccctacttgttattgctacattatatgtaggttaagactttggtcaaatattttggtcttttcctacattttacaattctcctttacattcagtctttggtgttccaaaagacccttactaaaataagtactcactcatcagcaacataaatattagacccaactaaaatctcccttttcccccaaatttttaccaacatgctcttctgagagatttacaaaagttgcaagcaaaaataacaaaactattgttcatccttatagagaatctagctttttttgttctgtacaaaataatttttaaacgaagattttcaagcacaagagtaaagtaaaacagtgaaaaaaaattctgaaaattattttttaaaaaagaaaaggctgcttaaagattttgtgtgtgcatgatcagttgtgtctgactctttgtaacactacggactgtagcctgccagactcctctgtccatggaattttccaggcaagaatactggagtgggttgcaatttcgtcctccaggggaccttcccaacccagggatcaaaatcccatctcctgtgtctcctgcattggcagacagattctttaccactgacatacttgggaagcgcttatgctcagataactctcaaatgtaacattcagtcatttaaatttgatatgcatctattatggtccagaaggtgtttgcttattcacagtgaaatatttga

SEQ ID NO: 62586 - DNA, 850 bp, Bovine  19866880748307
ttaatcatttccgagagtccctcaaaacccccctttgaaatgtattcattgcttgcaaattctcccagaatcttatatgaaagggaagacttcaatttaaattcaacaaacttcaatagagttagtctgcattttaaacatttgggaactgatgaagaagcctgtatgtaatctgccccactttgcaggttttgaagatttcaataatattccctgaatttttttcaggtcaatttaatttctaggtgagtgtttctcaactcagaggcgatttcacccagagggacgtccagtcggacatattttaggtgaccaccacttctggagagagggtgctcctaccatccaaaggggagagaccagggatgctgctaaacaccctacaacacacgggacagcctcaccacaaagcattttttgatccaaaaatgtcaataatgctaacactgaaaatcctaagatagttttacttgctttctttagactttttacagctacattatctacaacagctacacgtataacagtacaactccacgatattccgtggttttgcatcactgaccgaaacctatccgaggaagccagtttactacggttacacagtttactatctttttgggtagatcatggcagtgtgagggtcctcagattcgatccatccacaaacccttcgtccctttcctgttttctaaacaaagaatccagaatcatttatttgagtcatagaattgaacttattttccccaaacgaattcttacactgacgcaaaacaaggctgacttgccacttaactgctttctcaaactcttgctttcctctcaggtttgccatcaagtctggcccatt

SEQ ID NO: 62587 - DNA, 1797 bp, Bovine  19866880802956
aagtctcctagggaggcttacaaaaacaactcgtttaagagaaaattggttgacacgtgtctttgccttttgcactttgccttgctctttctttttttctgcttgtacttatggatgatgtcgggatacgaggtgaaacgcaacattttaggaccatgaggacaaaactcacattatgatggtgggacaggaaaataaatggaacttgagtagtttctggtttctctggactctgatatatcagggtggaaaacctcttatatttttaagcttactatcttgttccttactatctaccttgaataatgccagacacaatgtagaaacaataactatggaatgaatagagataaagaagaaaaatcaaatgtagcagtttctgagggtcgtggatatgagctcctcctagactctatctcttcattccttttaaaggcttaaagtgttcaagattctatggaataaacacttggatatgaatatctaactctcactgatcattcatctgatttgaaattcaaaaagcttggttaaaatgcaggcattttatgggtagggaaggaggtcattaatatcaatgctcaaattagtttatcaagtcatctatttatggtgctctcttatgcctggggacactacgaccaagaccctacatacatgttcccaaggaaaaggaagcaaattggagataatgagaaaaggggtttcaaaataaagtctgaaatatttatgaagtgctcctgtaccaatatctgtgttggccaaaaatagagacagtttctaatttcacacaggacagctctccaaggatcaccgggtataatctgttattgcctttacgtttgaagcattggctctactgacacagccaccaaagaagtgatatcatttttactaatggttcagttcggttcagttgctcagtcatgtcccattctttgcaaccccatggactgcagcacgccaggcctccctgtccatcaccaactcccggagtttactcaaactcatgtccattgagtcagtgatgccatctaactatttcatcctttgctgtccccttctcctcccaccttcaatctttcccagcatcagggtcttttccattgagtcagtgctttgcatcaggtggccgaagtattggggtttcagcttcagtatcagtccttccaatgaacattcaggactgatctcctttaggatggactggctggatctccttgcagcccaagggactctcaagagtcttctccaatctacagttcaaaagcatcaattctttggtgctcagccttcaactctcatatccatacatgactactgaaaaaaccatagctttgactagagggacctttgttgacaaagtaatgtctctgctttttaatatgctgtctaggttggtcatagactgagatccagataaaaacagttacagggattctcgggtggtccagcggtcagtacactggtctaccactgcaggggacccagggacaatccctggtcagggaactaagatgactcatgctgtgcagtgtgtccccctctcccccccaaaaatggctacaggatatacagtatagtgatttagagttgtagttgtggtaggaattgttgatgggaataaaaatactttttcttccaattgccaatctagggtaccatccatggaaataatgacagattgccatatagcacataatttatacctgcttaatatgcaaaatggagaaggaaatggcaacccactccagtgttcttgcctggagaatcccagggaatggggagcctggtggg

SEQ ID NO: 62588 - DNA, 914 bp, Bovine  19866880848067
ttgcaaagtagactggaaagaaaacatcatatactacttacctctgtggtaaatatttaaatcatcaaagcaatgaaaacattatgaatgaatgaaaccaaaaaagtaagctgtaacaatatgggaggataacaagagaattagaggcttagaggtttgataggttacatcatcatctgcaattcctaaaattcgtgactcaagaaataatatatacacttaaaaatttcaaaggaaaaatgagaaaaacagcttaaagagttacaagtggtttcagcaaaatgtgagtttgatgcttttggttgtacatattttagctctctttgatgtttaaactatatgtattagataacatgtcatttaataaaagggaaaatgcgtctttgcaaagttataggaacgcctgattctttgtaattcttatcacagtggctggcacgtggtcagtattgaacaagtagctgtgggacagagggatggattctgactataaatacacatggaagatgacttctgggtttcactttaaatcctatagaagtaggatgtgttctttgacaagagaaaggtaaaatgcttcacagaaagctttgtttgtgatataaatcataggtgaaaactatacatgcactgaaattatggccaagtaatagcaataaaataatgtataagaaaaaaatttttaaatgttagaaaatgtttattatgagtgcttaaaaaaaaaagtgctgggcctctatacctatagttttgagcggtatcacgtggccatatactgccacctagtggcaacatctgtaagtacagtctggttttgatagctgggagagacttttcacatttaagccaaaaaagctatccctctatgtccatccacccttctttctcaattcattaaccgaatcctgaacagg

SEQ ID NO: 62589 - DNA, 1411 bp, Bovine  19866880916513
ctagaattttttaaaagtaagcaaacagaaactggttaatttacagagaaaaggaaaatactggaaggatactgggtagtgcatagaatgagtcaaatttggaaactggtggtctaggcagggaccaaagaagaggaggaggaggtgagagctggccttaggaatcgcacctcctccacacacactggcactgaacgtactgtccttggaccccagcaactctgtcaggacccttgatggcacctggcaacgtgaatctaatgagtggatatgcagtgtgcactgtatcctctcacgtagtaagggggattaagtcttcgatgttagaggtgaattagcttgtccgcagtctctcgggacatgttaaggcccctgggccttgactgcttctccatctgcgacagttttgggagcagtctgactgtcttgcaaaatgcatggtgacccttcaggagccactgttggttctggaggttctgaagtgaagtgggccgtgtaacctgtgttctacccttggtccttcccgagtctgaccttgggcaagttcaagcgaagtgagagtggctctttacctgaggatgtttcatgtcgatgagctcggggagatgctactcagcaattcagaagaaagcgcttctttctgagagtgagagatttttctctcaggaccaatttgatcctgtgctgtaaaatcctttattcattatcaagtagcactgattaaatgtgcaaatgtgcagagtgctgtcctaggaactgtaggaccttaaaatcaaaaacaggaatttattacctaagaggtgtcatttagcaccctggatctgatgggacatcagctgtccagtcactccagaatgctttaggctcctgagcgcactgttttggttctggaaagcttttggagtttgctgctccgtgctgttgaaactccacagtccaaggataatattgagtgtacagagaaaatgtaaattaaatgtacactatgattttacttattttatttccatgaactctacataatgcaaaggatgtttactccatcagtttttgaaccactactttttttggagcaattcacactaggtatttccatggagcctcagtaagtataaaacaatctctgtaggctctgtccagtgttgctctttgtgagctgcaggtattataaaccccatagcaattctgacctaagtggttgcactatgtactatatccacagcaacaatatgctctaaatattctggtgtgatgctggcttttctgaaccattttcttatattattggttccataaaccttaatgttgaaattatcctggaaattccaacttttttgacattcaagttttatctgcaacacttattttcatccttagaaatggcataaaaattcttcatgaaatgatctgt

SEQ ID NO: 62590 - DNA, 2072 bp, Bovine  19866880969687
cttttacctttacctcttgctgtagaaggtcatgcatctcacagtatgtatctctctgttacaatttgcttccagctgagcagaaaggctgagccaagttcaatgtgtctaacacacctctcatgggcacgggaggctgcagatgctggcagagtcagagaagcactggaaccctctttattggcatgttgcagctaattgatgctccgtggattccttgctccatgtccgatacagccctttatgatccttccaatttcgttgagctgctgaagctcactgtctctgctggagctcagagacacacaggtcagtggtcaaggagaaagtcttaaagagctctgagtcaatttgcttcttttgtggccactgtggcaatgttacaatgaaaagaaagaaaggacagttgtattcatcaacaaattctaaacatggactaagtaaaatatgtcaaagccaaagagcacgtgatttcactatatgtggaaatctaaacaaaacaaaacaaatgaacaaagtaaccaaacggaaacagtgtcagagaacaaacaagtgttgccagagggggacagggggttggagagaaggtaaagaagtgggcggaggtagggatggggaaatggaggaaggccatcaaaagggacaaacttccagttataagacaaataagctctagggatgtaatgtacaacatgatgaatatactcgatctttaataaagataaatataaatcatttcaaatctttaaatgtattatttaacaacactgctgtatgttatgttattgtccagttgctaagtcgtgtccaactctgcgatcccatgaactgcagctcaccaggcttccctatccttcactgtctcctggaatttgctcaaactcatgtccattgaataactttcatatgttacatgtatgctgtaggttatatataaaagttaaaggagtaaaccctaagagttctcatcacgagggaattttgttttcctttttcctctcttttgtatctatatgagatgagggatgttcaccaaactcactgtggtcatcgttcaagatgtagataagtcatatcattatgctgtattccttaaacttatacagtgatgtatggctattaaatctcaataaaactgtaagaaaaaaaatgtttgtaataaaataaaaaataaattccaaacatacaaagtagtttcagagatacgaagagaactacctcagccctgggcctactctttactaagactgttaaccaggaccaaaggctaaaacctctgtgagacgtaactttctcttatataaaatggaaactgacaagaattccccagcaaggcaatatatagtaattacataaatggagggacatattaaagtattggaattttactgaagcatcagaatatccttgggctttttaaaaagtggtcacattagggaatttaaaacttttatttaaatacgacagctttgacataacctgaacagtttcaaaataatgttataagaagccacatgtgccacaaatataaagttcagggtaggttgtatatatatatagcatttctttccttcttggactatttcttttctctgttgcttttttactttcttgatcatttatttattcttttgatgacatacatggaccaagtttatttttctttgtttagcttaaaacatacaaaaccaatgtgccacacgtatgcatttttctatcagtcaggtgtatatttttaaaaaagtcttaattttttgattcccgcttttaccagaaaactcagtaacagaattatagccccaggggtagatattcacgttgatatatttgtagagctccgattagtgatctgaagtatataaactatgttttaaaaggttttcctatcctccactcaccccttcatgacctttgctcaaccagggtgcaccagctgactgccctgagggctgggcagtcacgctacataaagacagcattttttgaaaagggtaaagcaaggtgttgaactcagcctcagtgcaacctgcaaccttcctccaagactgcaggactcgagaggctcataaagt

SEQ ID NO: 62591 - DNA, 2208 bp, Bovine  19866880990022
tcctggtgagaatttagagagatgagcgttaaatgcaagtttgaggtcagtcactttttctgaaaggcaggccggttggtatcgagtccccagccttttcaatatttcttttaattaccttggaagtaaacacacttcccttttgagttgtgtttcttcaattaataagataacacagtagtgtttacaggacattagctgctcctctgcgatagcaagccaagtgcagaagctacatctgtaattggttttctgatacagcctttgcaaacacacgtaagagtggagttcatggaagggataaatggatttagttaccttcacaccctgccttcaaagagtggtttaattatgtctccttacagcagcttcccttccgccaacccattagagctttctgatttatgacacagtagttgcagcattcccagtaaagacaggagttgctcttgtcagatactatagctccacggtgatactgctctgagaaaataaatgaggttctaatagtcccggattattaccaaaggcagggtcaaggagtaacttttactttttttttaattaaccacacacaccaataaaattctaaattactaatttgtatgatttgtgcttatacatatatacgtatatttataaatgagtcaaagagacatctaaagaatgcttcctagtaatatcacttttctatagcatttaaaccacttgaaaactctacaatttgttatacttaggcatacatgttacttatgtaggtcaaaataatacctgaagggcccaagggacatttgtttttactaacactgcacacttttctcttaatcagtgtcaagatgtttcttccttgttcttacaaaggaaaatccattttcaatgcaatctgttactattttctgactagactgtgtactggaaccttctcataagtggattgctaccaataaataataatcacatgctacaggccctttgactttaatgatttcaactgttttgaaatgtgtctcacattttgtatcttataggtattactacaacttgaggtaaatagcagtaacagtgcatatgagagaccttgttgaatgaagcaaagtctgtttccaatgagctcatggtccagaaagtgaaaccaacaagagagcaggtcatggcatcacaatatcatcacagaggcatagttaccatagtacatccaaagcaagtatgagtgtttctatgaataacatttaaaccaatgctttcatgtacctctcaccttattgtgaactccctaagcttagtcactggtcacagataatactggtaaaagagttttaaatctccaaaaattcactatgaatggataaagaatatgtggtatctatatccaatgggatattactcagccattgaaaaggatgaaataatgacattgcagcaacatgcacggactgacacattgtcatactgagtgaagtgagtcagagaaggagaaatattgtatgacatcccttacatgtagaatctaaaaagaaatgatgcaaatgaacttacttacaaaacagagagagactcacagactcaaataatgaacttatgattgccagtggggaagggatagttagggagtttgggatggacatgtacacacacatccgttatttaaaatggataaccaacaaggacctactatctggcatagggaactcagctcagcgttagatggcagcctggatgggaggggagtttggagtggaatgctgtgctgtgctgtgcttagtcactaagtcatgtccgacttctctgtgatcccatggactgtagcccgccaggctcctctgtccatgggattttccaggcgaaaatactgaagtgggttgccgtttccttctccaggggatcttctccaacccagggatggaacccttgtctcctgcattggcaggcagattctttactgtctgagccaccagggaagccccttaatgcttttgaaaacagcttgaatgaagatcattggctgtatttttaaaacatgacaaaatttagaagattatgacttttacccatgatagcggacagaggtggcagtttttaaaaaaaaaaaatacatgtgtagctgacccttggaaaatcccatggacagaggagcatggtaggctgcagtccatggggttgctaagagtcggatatgactgagcgtcttcactttcacttttcacttta

SEQ ID NO: 62592 - DNA, 1549 bp, Bovine  19866881008931
cagggcataccgtgtaatactacagatatgcccaccatggtaatcttaaacattgttaaagatgaactgtgatgctctctcagattcctggtggtccaaacgaaaaggttaaacagaacaagttacagtttttactatttataaggaggaagctcaccaggacatcaaatgtcaaagtcacttttcatcacagttcaaatggaaacaaaccagagaagggatcagaaatggctcagagagggacagttagccagcacaggaccttaatgacacccttcttttactgttatttcagaaagaaatcctcaaaagttatttttctcagtctttaaaaacataactatattcccaagaattctaatagatttactttaaaaaatactcagaaacgtttaaagtttcctaacaaccacattctgtatatactgtcaactagactctgacattttggttacattaaagattcacccacaataaaaatatactggggataacagatttataaccatgtgctttctatttgttagtattagtgggctgaacaagtgcagaacagataaggaaaatatacatttgtcagggggagaattccttccacactacctgtcacaatctgaaatgggaatgtagctcatttctctctcagtttagtaagttcgtcttcttagaatctattctctgagttaattttaaggaactagggtctgattaagtattgaaggagctcaaaacagaaccatgactaaaataatgaaaaaatatatcctcagaggggaaaaaaaaaaacacctgaaaattgaaaataacaataataaagtactatgtattactgagaaaatgtagactcatgactgtttaataattaaatgatctaagtgaaggaagagtacccagaggacatgcccgggcaaagggcttttccttttacaattcaaacagaaagagccatcatgagatcctataaagcagctctggtttcatttggaccaagatgtagtgactgctaaaattatattgctcttcacaatgagatgcaaaataaaggaaggaaggcatgatttgtgggtctttgaaaacaaatttcaaatagatgttcattggaaggttttaaaaccttacaaaaagatttaaatacttttgagatatattagaaagctgatggtaaaattaatccagatttatgttgatatagttcatctcatcaagcagtcatagggattatttacattttgaatagaaaataataggatagacaaaacaatatatccctttttattgttctatataactctccttcataaaactcaatttgttgagatctcaatcaatccagcaattgcttttttgtcatgggctcccatcttggatcactggggatttcagactgtgagcaatgaacaggaaacaagatgagctgtgttacataagccactgagttttgtgtgtgtgtgtgtgtgtcccaaatgaattcaggtaaacttacataatttagatcacacaaattggtcttaatccatttttagaaggctaatcggcttgggtttattgg

SEQ ID NO: 62593 - DNA, 789 bp, Bovine  19866881047732
aatacgaaggactgaagagggaactcgtgactcgatcaaggtcatcctaacttacccaagggggcccaaggccttctggaaaaccacactcccacccccatctcgagtgagcaaggctggcaggcccctcactgggccggcgggtaaaaggaggcttatggagaactatgtggaaccaattccaaccccctggttggagtccttatggctggaaaggcattcagggtcagccgtggtttcctgaggctagggtgcagaatgacacacgtctggaaacgcaatgtagtgaggccactgctcagtgggagagaaactgacccctccagccgctcccaggatgaaccctaaacccagctccactcgagcttcacttacaccggctgcagtgtgtgaccaaactgcacacgaagaagaaaagcagaaacgctgggaggcctcgccccagtgcacacacgtggacggatcacttaggggaggctctggtgtgaggcttacctcccgtcggggaggggtggcagacgcccccgttctggcaggggctgctcgagcagtcctccgtcgccgtcagcaagcacccgggagacacatccaccgactcctcaatgtgtgcgtagctcctgggtctgttgtttaagggcagctcctgcccgttcaggtaaatggagtccatgcagccccggaaaccattgcccaccttgggggctccgtccgtgccgcgagccctgctggcggacgtggcccccaaaatacacatggctgtcgaggttgagggttttagtgtccccgggg

SEQ ID NO: 62594 - DNA, 1467 bp, Bovine  19866881064602
agagaggacaggagctctgtgcctttttcccacttgctctatgtatgtctttagtttggctgttcctgagttatttattatctatcatctggtaggtaagatgattctctgggttccatgagcccctctaacaaattaattgaagccaatgaggaggttgttggaacttcccatctgtagcccatcgatcagaagtgcaggtgacgacttggatttgccatggacatctggagtgaagggcagccttgtaggactgagccctcgacctggagcttcaacaccattggctggtacagatggtgtcacaattgagttgaatttgtaggacacccggttggtgtcaaggaactgctaggtgtggggcaaagacccacacgtcggaattgggtgtgaagtcttaggcttctttctgggctctcattatcaaactgtgttctcaagaagattctcatctttggctgaaaataagctgaaagttaaggctgatttttgtctgggaggcaatatagaatagtaattaaaggctttagcttcagagtcaaaatgtccaggtatgaattttggacctgacaaaattctatgacattaaggaactaaaaccctccaaactttagtcctctcctcagaaaatggtcatgctaattgtctttacctcatgggatggctctgaagataaaatgagatgatgcaggcaaagaatttggcacagtgcaggctgtagagtgagcataaatatatattagaaattatgtataaggaccttatctaccactctttaattttcttcggaaaatctgagttctttatgttccactttgttaagaaagagacgatctgagtctgacaaactgaattaatgactttgaacagaaaaactcaaattgatttgaactaaaagtttccaacagttggaatatatttcagaatatagactttataaagacaaatggagatgttttagctacaggattctgagtcagcccacatttttcctcccaaacacacattattgtcctctaatattttaaaaaattccacagcccaagttgtcagcttgaagagataaagacctctctcttagtcttttgtgtattttttttttactaaaatggttctaaagttaactctcatcattatgaaagtagaattattaatggactcttgaggatacacataaggaaaaataagtccatgtacatatttctcatctggcctcaaagggcggtcatttggtcacagcttggagtcagccatcagctccaccatggaaagaaatgacctatttcacttcggtatttctcactgaagattaaaatatatgaaagtttaaaggtgtctggatagatctaggcaaaaaaatctgagtaaatatagagatgaactctatgaaactttataaaacgatgataaatgcatttcaaaggcaggcattttatttacaacttaataaattaaaattctataaac

SEQ ID NO: 62595 - DNA, 935 bp, Bovine  19866881086901
acgatatttgtacagttacctaaaagtatattttgagaaaaactctgcagcacaaaaaccatgcttcctcttcagaaaatgtgttatctcatagtttacttttagagacccaggctgcagaactggtttaacatcattacgtggtcataagagacagtcttgctactactgtaaagatacagagcacaaagtcgagactatacccaagactactaagattctcccagcactgcggaactagaaagtggagagaccccatcactgagtatattcagaagcttggctatggcagctcttccggttgggtagacatatccaagagtaaaacacccccgcccagggcctggggttctttcaggggttctaaacactatatgcgtcttcctaagtgtctcctttactactgaagaatgatttgacttctggaagtaatttagttagtaaataagagatgatgatcaagataaagatggtctgtaatttggggttagacgccatgacccaacatagcaatttccccgtagtttataatttttgcttccaatcttgaactggatagggtacaagtgtaagaaaacaaatgactgtttttccttccaacattctaaatacttgattttgatttgggtacatgtttgaatctttagtgtgttagcaaagatattatctgaaatcatttttctctctatgcctactcatcagatgggcaccaaaaatcttcatatttttaatattgttttgtaagtttatcatatgtatacatataaatgcatacacatgaattacttatatttatttatcagtcatatcagttgtaatacaacatttgaagcttaaaaactttatatttgggcaaatattacattaagtaaaagtatactttcaagtgaacagtgttttagtttttgcaaaagaaagttggaaaaagtcaagtg

SEQ ID NO: 62596 - DNA, 1514 bp, Bovine  19866881086915
ctaataaaaccaaggaatatacgtttatatctatttgttgtcttctgagggtaatagctttaccacatccataactctatctacaatataaattgatataatataaatgttgagtatgaagttattctcctttcctctgcaatcatcccctttgtccatttccacattccctgtcttctggtatatgacacgatgcctggcacaaaatagcttcttaacgaagagctgttgagtttgttgttgcttttagtcactcagtcgtgtccaactctttgtgacccatggactttaacccaccaggctcctctatccatggagttctccaggcaagaatactggagtgggtagccattcccttctccaggagatcttcccaacccagggatcgaacctcctgcactgtaggcagattctttaccatttgagccaccagggaaagtcaaatactctcaagccagaaaactagtaatattttgtatgtttttacagaattatatataaatattagctgtaatcattttcttcatgccaccatgaacaaatgcaagtttaggtgttaaaaaatgtcactgaagagaggaaggattccagggaaagttttgcactttatgtgttgaaggaggttaatattgtataactctgtggggtccatttacatcaagcaagtaaatgacaggcatatatatacatggaatcagtgattttttttttttaatatgggcatgaatagacttgattttcttataatcaaatatgaacaatagtgacaaacttgagtaccactgactctgggaaaatccaagtcttcctaatagataaatgtatggtatatatagttcattagtttggttcattagaacacagcaaaggccccaatcagaagctgaattcctgtggtgatcaaattatctccactttataccacggccaactcttaactctgaacaacaaatctgagttggtggtctcaagatgatctgaatgaaaacagtgtgcagttttaaacttgtcgaatcaatcacagctgtaatgattgtcattctgggctataaagacttttctgcaatcatcgttaatccaaaagaacaaaacaaaaaacattttataacctttaaataaggtactatggtagcatttttctttgttaccactgatctgaaaataatctatcagagcagagtgacatctttgttaaagtctaatttctaacccattaaatttgctgttagggtaagtaaaattgagtcagttttcatatgcaaaatgaaaatggcagctacattattgactagaaaacaaagaataatttagatgaataaactgaaccccaagccaatgtatacagaaaatttcaatccaagaaaagagttacaatataatgagtctttttctcttttgccttcatgtaacactggaaaaggtcagttttcattccaatcctaaagaaaggcaatgccaaagaatgctcaaactaccgcacaattgcactaatctcacacgctagtaaagtaagc

SEQ ID NO: 62597 - DNA, 2215 bp, Bovine  19866881125370
tggaaatgcgacaggaattaaggcaaagcaagcaaactgctctcactgcagttgactatgaagagtcctttttgttcatttaaaactaaactgtaatggtttcacaggtgtcaataggatcaacaatttcattcaaagaccaaagttgggaaaatagcccagctatctagagagaaagtttaaggggtacagcctgaaccccgtgtcccagaagcttcaacctgctgagacagcagctggggcaggagagctcggggatgaagagggaaaagggatactgggttccagctagaaacaacctgaatatacctctgattttaattatctttgtaattaaaatactgtgtagacataagaattaaaatactaagatatcaaagtctaatgtaaagttttcaggatgttgtacgactttctatgcctagctaaattaaatgacagaaaaaaaaaaagaattggctgaggcatataatttttttagcctgatttaatctagtgatcccccaggcggtacagtggtaaagaatccacctgaaatgcgggagacatgggtttgacccctgggttgggcagatcccctagagaagggaacagctacccactccagtattcttgcctgggaaatctctggacagaggagcctgatgggctacagtccatgggattgcaaagagctggacaggacttagtgactaaacaacaacaatccagtgaagcctgcttcctactgaaaacgaggtaaatcaaacttaaaagtcatagttgacactaccacttataaattagaaattttaaccatattccctataaaatactgacatgtgacaatcacacaggcagttattttaaacattcaaatcatattcactaaaaatagttacgtgccatatgtcatataccaagaaggaaaaattaagaagctgtggctttggaccaaacatttatatttctctgtgtccttttgatgtacttttaaaaaccttacttttatattaataaggtacatacacagtgcttttattttaaacacagtgcttttattttatttttatgttggttattaccgtaaaaaaatgttgcaggcaaaatgatgcaatttaaaacaaactctccacttacagatcttactatcaattttaaattctgagatgtgcacaaaaagcagaaaaccagaaatgggctcccctcagtgtgacctagacaggacaatgagaactatcatgaacacttaccgatgatgtcaaaccagagaggtatgcctggaggctcaacagatatgactccaatcatgtgagcaactggatcactttccattacagtaaaggtaaaaaatgattcttcaaatgaaattggctccagggatggtttcggtttggaaatccattcaatgtggagtcgagtggttgacgacttttgggggcgaccattatcaacagccttaatctataaaatgtgggcagagaggggaaaaaaaaccgcatataaaaagctgcatcccataactgaagcatgcattggtttgggctgcagcccatggggtcgcttagggtcggacacgactgagcgacttcacttttacttttcactttcatgcattggggaaggaaatggccacccactccagtgttcttgcttggagaatcccagggacgggggagcctggtgggcagctgtctacggggtcgcacagagtcggacacgactgaactgacttagcagcagcagcaacactgaaccaatttcaaacacttaatatcccgtgctgtctattccatgtgtttaatgcctgataaaaagagcaaccttttcatgcctcgctgaacagaaataactggaataatgaagggaaaaacaaacccacacttcccactgttaggttaccacagggaggtcagtaaatggagagaaagttgtgagagaagagacttaaggctagattaatagtcaaagcacgggaagaaattcaaagactagatcttcactcactgaaagaatatcatattctccagctccagaaaacttcttggacaaaaccactcccgtttttggctcaataaaaaattttgccgtgctcattcccctcttcgatgctgtaggagatttcctgcgttgggacccttcgtctttggtctgtgggcgatcacacgatacaaaggcttctcgttttggcggtttcttttcccgttctggcttttcccgctctgggaggtctgat

SEQ ID NO: 62598 - DNA, 1352 bp, Bovine  19866881130892
acctggcattacaattttgattactgggacatttttgtcaactatattgagtactgactaagatacaagtagattaatgaatgaaaaccacgtgactgacggtgaaattcagaattactacgagaacaaaatgttatgtgaatccctgcaggcaggtcacacttcaagccttctaacaaaaggggcaggtgaaggcttttctagatgtatagcactaggcacttgtatgtaacaagcaccaagtttttaaactgaacctgggggaaagtctaaggtgaaatggtccctggaactgaaaaccatttcattcaaagtcgacaagaggcatctttagtgcctcatattcttcatcaaaaatactgatcacctctcagactatgcaaggctcacaaaagatacctaaagagttgagaaatgttttagatgctacataaacaatgaaaaaaaagtcatctatcttatagataggtaacaaccccatgagcatctgtttttaaaaaaaacaatcttactgtttccagttacttcctgcaagtacccatatgttccttgtttataaataacatttttaaaatatagaagcattttatattcaaagcatatagtactccaagcattatatcatgttcacttgttcaatatttttttttaaagaatgaaaagataaattatacaaagagtcaccatgagctctgaattcaaattctaaagcaacacagtccaaattactgaagttttgtcgcatctgccaatcactgtgaccctacagagagctgcaaacacagatcttgaaagaagtcagttacctttctcccctaaaacctgagtcacactgacagacagcaccatccaaactgtcaaaacacgttccgccgtttttacaaggttcatctttgcagtaggggctgagctggcacctgaaggacaagggaaaagtaagcataaaaacccagtgttttttctgtacctacaggagcaagtgaatgtggacactgcacgcacacacgacgacaccggaagtgcgactgctgcagtgagtggtggagtctgggcaaacctacgcacctctgaccagagtacagtcctctgcactggcagacgaagtctccgttgtccacaatgcaggtgccgccgtacaggcaggggttggaggaacacgggttgacgctcacctcgcagtaggtcccgacgtacaaggtattgcatttgcagtaataacctaaaccagcaaacgggaacccaaagtactatcactcagtaactcagaaagagaagtctcagggtattggtttttacgtttaagtgaaaatttggctctctaagacttgtaaatcctattcgatccccttata

SEQ ID NO: 62599 - DNA, 1095 bp, Bovine  19866881142885
atatgtgaaaactttctggttactgtgtacataaataattttttccctatactataagtagcttcaattatttataagattatagttactctctttctctctctctctctatatatatatgtttactctaaaaattatataaataataagtagctaatatattgataataaacataaatatggttgtatatagtatagctactatacataaatatctctatagttaataaaaattcagcacatcacaaaatattcaacatataatatccctaaaaatcaacatcttgggggaaaaagcaattgtttttcagatttttttttttggaaaattttttcttttgcttttaactagcttaatttttttttgtttctgaacaaaattttaccatatgggcactgccagtttccagcagtgattctatatgagtggataaaaataaccaacccttcagatacagaaatatactccatgttttttcatgtggaaatttgcttaataagaatttaatgaggatcaaccacatgccagattctgcatgatatataattacacaaagattaataagccaacattcctgtatttgagccaccctacctgtacctacagatcatgctgtcttagaataaacctctaattatttaaaaaattgaaatctgtacttgtttcttataatttgattataattcaaactgtgatcatgtattaaattccaccgttgtttgtgtaattatctctatttacgtacgcccaaataatttttagctaattgaaatcacattaataatttgagcaattctactgactatgtagcgactctgttagactatggaagtatccttatgcatagcgtttggcaatttgggggtgtaaattctcctaccgtgattgattttaagttacccacaatttaacagtcatcttgcacaattcctggatgtctaatgatcatctctaacaagctggtactagacagccaattaccagataaaacttaagttttagtcttttcaccttagtaaggagaaacaggaaagcatcttttgggatcattgcttttggtgaaagttctctggaggaacccaacaggaagtaat

SEQ ID NO: 62600 - DNA, 3138 bp, Bovine  19866881144324
catatgtaaatttaagttcatatatgtgtgtttgtatctgtgtgtatttccatgtattcctttctgatatggtttcatagcaaagcacctaaaaaatttctgaccgagattgaattggttaatatcaacctggtttcatataagtaacataattccaggcttaaaaatagtacattttagaacagtattgaattaataagaataaaaaaaaaaaaaaaaaacctaggctgtgcaaacaaaaaaaataaatcataacatttgagtacatggactttgaaatctaatagcctaggcttagcttccagggctattactgacagcctattgagcttgggcaggtaatgtaaatgatttaaagcatgagtttctctctcattaaataaaagcaagcaatgatatccatcttggatagtagccttgaaaattaaatgagacaatatatgtaaactacttgatacacaattaatcaataactaagagcttagtatctgctcagatgcggattataatacaattagacccagatctgcaactaactaagcaatggcaaagaggggcctcttgtgcatcatcacggatgggtgaggagacacaacgcgaagggtggcctgctgagtgcatctcacatttaaagcatgagtcctttgtgcctgcaattgtgtcaagagcctcagtgtattatctctaattatcatactatgatataagcatggtaacatgtttaatagatggggaaaaaaaacctcttaataagaaagagtaaccatttctagtacacactgctagttggaggtaaacagaacataggaaccctgctttctgaccccagaacctgtgttcacatttccaccggagctatcatcttttccaaagagcagctcctttcccagacatctctatgcctcccaatgaaatgaaagtcttagtgactcattttctcaagttgcatgttataaaataggcacggtggctcagacggtaaagaatctgcctgcaatgcgggagacccaggtttgatctatgcgtcaggaagaccccctggagaaaggaatggctacccattctagtattcttgcctggagaaatttcaaggacagaggagcctggccagctacagttcatggagttgcagagtcggatgcaactgagcaactaccacacatctttgacataaccaaatgaaagcagcatgttggtcatgttacctattgcagcttaataaacaatgccaacacacagaggcctaaacagctgtttcattgcctgtcaactctgtgcattggctgaggctctgctgggtgttgcttctgctgcctcactggcagtttctctgcacttgcagaaaaatggcagctgggaggaggtgtagctagcagtctagctccctaatgcctatctcactggctacacttttgttttaaacagagtttattttttagaacagatctatatttatagagaacttgagaagacagtagagcccagtttcctctataactaacatcttactttagtacagtacatttattacaattaatgagccaatcatgatgcaatttataaaactgaaatccacagttgttgttttccaccaaatttccttaatttctagctcttgtccttttttgttccaggatctcatcaggattctgtgttacatttagttgtcacatctccttagactcctcttggctgtgacgcttctgatttttgtttttgttttttctttttctgatgtcttattctcctggttctccctcatgttctttctctctgtctctctctctctcacataaacacaagcactcatgcctgcggacaggataattaaggtttcacatgtactggctcaaggatttaagatggaggaactgaaagttctcacactctggtctggacccccgagccttggaacatcacatgttccacatcctcttagtcaaagtcatctcagaattcaatggagggagcaaaagtcccatctcttgatgctcagagtgtatgtgtagggagcacaggccaacccgtcaagagccatctctaggccagcgaccacgtggatgccaggcaaacaccattgactgtttagttgatctttatgcagttcacgatgaaatcattatgataaagtgaaaacaaaatggcacactgatattgaattcaaattcttatttaagctatgtatctcaaaatcaattgttgtcatagggtatcacctcttaacacagatgcatttttttttcatggcattaaatcactcataaaaaatgtttaatgtgctatgtataaatgtgatactttactctttagtaaatataaaaatcaggtgaacacttacaataaaattaggttttacttttaccatagtattaggaaccgtagctctctttagaagtctaggttgtctccaggcataaaaatggaaatactgatactatgacaacacagcctgaattttctgctttgcagacaccagatttatttttaaatggtgtgaatcaaatctgtgctgagaggccaacttcaaaatataaaagaaaaattggcaatggaaggattttgctggtttggctgaagtgaagccttctatagtatttcattctagtggagtgtctgactgtgaaaatctttccaattgtaattctctttttgcttgccaaaaggggattatgaattaaagttaatgttgcaggaaatgtcacctgtcctttgaaggaaaataataaatcaaaatggatttgttcctcatatttaaaaggaaaaaagtactgacctacttgagggtcttctctcatgccttaacaaaacaggtaaataaataaagcagaatttcattgtgacttttcattttaatccttgctcatctctttccaataaatattcataaaaaagagaaaaacaaggaagagagagaaagagaaaggagatgaatattgtaacatgaccccagaagtagaattcttcaagtaagatattaaattaagaaaaatatatttaaattatgttttattcctttcacagatactacagcacaaactcaagaatgaagaataaataaaaacaaaatctggagacttattcctcaaaggtttgaagtatttgtgtattatgttttaagaaaataaagacaaacctaca

SEQ ID NO: 62601 - DNA, 1485 bp, Bovine  19866881201760
tcctaaacttaagcagcaggaatttcaagttcaccagtaagtagaagctgctgctgccgctaagtcgcttcagtcatgtccaactctgtgcgaccccagagacggcagcccatcaggctcccccatccctgggattctcccaggcaagaacactggagtggattgccatttccttctccaatgcatggaagtgaaaagtgaagctaccctttggcaaaggttctcagtgtgagggaataatcagaaaggacaaatgttagtgatccattgtgatttttaggtttcctgaagcatttcgtagccctctgctagattaagatgtgcaaatgtctgtctcgaagcactgctcagtcgtaagagataagactcacctcctttgcttttcatggcctggaatatctgactgctcatgctttaaattcttcacctgacaatgaatataccctgggataacattcatctctcaggcagcacacatcaaacatttttaatccctatctttgacatacaccatacacctcatgaataattaagtaatgactcacaattggcccgtttttcttccctttcttactttgcagacttcaaaggacttttgtacaggtagaaggtgaggctggtggtaaaaatcaacctaaattatcttctccctcagtatacgcttttgctaaggagaacttcattcttcagtcatgatgagagaaagccaaatcttcagcttcaaagctttcaagtcttgaacaaatccctactcgcttcaaaccatcattgtgaattccacctgcaactactcactcatctgagcggatctgtgtgcagttacttaaactgtccctaaccaaagcaggatcctcctactgagcaaagctgtgcaagtggagaccagattttccaaggtcagaacacgtggtttccacagcagcagggcggtgtaggagcgcataaggagatggagtcagggcagtgtatgataaaatctgcagttcatgctctccattaaatattttaatggcttggttttcatggcaaaaagctaactgaaagtaatccttagaacaaatcctcagcgaatcaattccctttgaaaaaaagaaaaagtcaagtgactcactgctctgtggtgatctagatgggagagaaattcagaagggagggaatatgtgtatacatatggctgattcacattgctgtgccacagaaactagcacaaccttgtgaagcaactataccccaataaataaattttaaaaaaatgtcatgagatactgaattgaatccaattacagtggaagctaaaacaaagcgtacttcagaaatgtgctgcagacattcatttagtattgatgatggcatatttgcccttcagtgagtcatagttcagggcttcccaggaggcactggtggtaaagaatccacctgccagtgcaggagacacaagagatgtgggtttgatccctgggttgggaagattctttagaggaggga

SEQ ID NO: 62602 - DNA, 1161 bp, Bovine  19866881908415
taattgtgtttgtaaatttagtctcaactaaatattcaaggaattttaaagatgctcacttgactagcatattctgaaataatgctggcatagccatggctttaattattgtctttaaaagagaaatataacccaacagactaacctaatctattcaaaagaaattgcaaggggtcagaataaaagactgagattcctttagcagaactgatgttttccaaaagggaaaaacagctaattcaaagattcaacgacgagaactcataaccatgagatctgaattatatttgtgactattgatgataccataataaatcatttaacatgcttccataaagcagtcatttctgcagtgtttctctcctcctcatctaccacttttccctgggccctcaacccccactcctctggaggaaaacataatgggatccatactcccatatacctctacaaaggcacagggaagcagctgatctcctaagtaaacagcattttatgaagtttcgtggtacttaattactttttatgaagtttcgtggtacttagttactttcaaccatcaaactagataaagaactaaaaaacaagtgataaaaatcatctaattcaaccctctaacttcacagatgagggagccgtgatcgagagatacaagacgtgtcattaggctgcagagcttgaatcaaagccctaagtggaaccccatctcctgagattccaacctaccttcaagagcagtacctagcagagaaatgaagggctgtcttagcccaaattccagtgggagtgaaatgaggcttcgtgtttgtgggagagatgactggtatcaggaatagtaagcatcagtggcacaatctcaaggttaaccactagagagctcaaaatactcctggcccgaccttacctcgctctccacgactctcacctaatcacacttgccaatcactgatgaagggtattactcatttcagaactggagagggcaacgggattttcagaaaatgtaggctctgttcttcaaatccatcactctgaagcacattagtcttcaagaaatataatcaatcattcttacagtgtccttgttaacggtcccaactctgcacttcaataaatgtgtgactgaggttatttattactgtcagtgcctcagtttcctca

SEQ ID NO: 62603 - DNA, 934 bp, Bovine  19866882168753
taaataacatatataagtgggtaatagcatgctttatttgatgccatttgcaataataaatatgtttgtattttcctgcttatactaacatcaccatttttacacttgccgatagtccttttgtaatgtatctagcacaaagatgcttttccaactttgctcatcagtcttctacagatcttcccacttgcccatgaagtttagccagccctcacaatccttctaaccgagtggatgaccagagtatcatttagaagtagttataatctcaactggaaggtcaatataaaaaaattttatagaaattatttctgtggagaaggaagtggcagcccactccagctttctcacttgggaaatcccgtggacaaaggagcctggtgggctacagacgatagggtcacaaactgaacaacaaagccagaagtgctcttcccttgttaattaaaatctaaaactttagctacattttagtagcatacacacatatcttactaactgaaactgaacagaacccttacaattagtcttgctgtatttttgcataaaataatgagttggcacttgagttgaaaaaaaatggccttatggtgttttgcttgggaaaaaaaaaactgcctttgttttgaatatgtttgtgtaagtttccatgcatatatcagatatgcactgaactaaagtgatgagaatcagtttgtatttactttgcaggaggtatcatgtaaacatgcatacgttgaatgtaatatggatcatgtccaagtgagtattttggtggatacagtttataaatatgtcaattatatacctttgtgtacttgtctgatttggaacttgtaaagtgaggactcctttttacacatttagtaaagaaaatgtctgaaagtaaagtatttccaaatacagtccaagaaggagatatagttaaaaaaaa

SEQ ID NO: 62604 - DNA, 1354 bp, Bovine  19866880368620
gctcacccggcaattctttatgtaggaacaggcccaaggctaaagttgaaccagaaatgaatcatttctcattctgcagtgactactgctctttctgaatcaaattggaggtcactggctaaacaaactgggaagaatgcatgttacaaaccaggagagttattttgtgggcacaaatctaaagctttagcttttttttttttttttaatctttacaagggaaaacattccccagctgaaagtaaatactaccgcaggactgacaactaagaacatggataaatcatgttatccatgtctggcctggcttaagaactgggaaccaggatataatatttgaacacaatccgtctgcaacgcaggggacccgatccctgggtcgggaagattccctgaagaagagaatggcaacccgctccagtattcttgcctggagaatcccataaacagaggagcctggagggctgctggaggagcctgctggactcacagcattgaaaagagtcagacatgactgagcaactaacacacacacacacacacaattctgattccagagaagctgtatgctctagtggtatactttcaattcttgatttctgcatataacaaaacctaaccagtatgtttaccagctataacgttcatatttcctccaaagatcgcttctggcctccctctcctctcttctttttatatttgttcttgagcagtagcagctcattcattcctgcaatttcaaccatcacctctacagaaattattaccaacctctctctaaaacccagttatctataaacgccaggcccacatctccattggccctttgtagggcactaatgatgtacccagagtgggaaagcaataccctctaatacacagacaccaagcaatttccacaggtccataactccttctgtggtttctgtttccttgaataacatcattacatctttattcacccagttcaaaaccttggaatcctcttctctctctcttgcctcctacacccagtttgatgcaaccttcattgattacaactgttacatctcctgcattgatccgtgaatgtcatttccaccatgcttttctcatgtaggagccacattttgaattaaatggtgtttcatggataaaactggaaatataaccactataatatatacctgcttgccaaccaacttcagctcatttctgactctggtttcagttcagttcagtcgctcagtcgtgtccgactctttgcgaccccatgagtcgcagcatgccaggcctccctgtccatcaccaactcccagaattcactcagactcacgtccattgagtcagtgatgccatccagccatctcatcct

SEQ ID NO: 62605 - DNA, 1679 bp, Bovine  19866880388716
atagccctaaaataggactgaaaatatataaaaacttaatgaagaatgataaatgaaaaatcacataccataaaaatgctggaagtagtgttggtgaatataaaactgatttaacagcaatggaatctatcaccaagcaaaagatacatagatgtgactgtataattttttaaatttgtataccactgaaataaaatttatttaatgtaacatcaatattttaaaagttaaaaacaaactctttatcagaaaacactgtaaaaatatttaaaaacaaattgcaacctgggaaaaatatttgtaacatacataataataactttactgtatagaagaaaatttacatatcaataagaaaaataagaacacattatgtattcatgcctgcttccataatatattaccacaaatttagtggcttaaaacaatccaaatttatttccttgcatatctggaagtcagaagtccaaaatcagtttcactgggtcaaagtcaagatgccctaagtaccggttctttcaagaggccctagaagataatccctttccctgcttcttccagcttctagaagccacctgcattccttacctcctggccccttccttcgtcttcaacgcctgcagtgcagtatcttcaggtctctctcttctctgacctctgcttccatcaccacatttggtttcacccttccccccttcagtcttcctcctgtaatgacctcacctgtataatataaaataatctccccatctcacagtccttaactgaaatacatatgcaaaacccctttggcatgtagggcaacatattcacatgtttcagaaattaggttatgaacatccttggcatgcattattcagtatactccacatcagttgaaaaacagatacagaagcggagacaatatacagaataaaaaacaaataaatgcccaatagacatgtgaaacacatagtcaacctcactactattccagaaactagaaaataaaatagtgaatactttttttgcctaaccaattgacatagatttttctaaaatgtaatacacaattctagcaagagtatagtttctgaaccattgtagaaaaaattaggtgatatgtgtctggagtcttcatttagtccaataatttcatttcttgaagtttttcctaaggaattacctaggtagatacttgaaatacataataaggctattatagtacttttaagaataataaattaaaattatattcaatattaaggcattggctaaagaaatggtgataaagctacatgattgaatattacactgccactaaaattaaacctccaaagatttttaatagtattggagatattctcacaatatactgctaatgacaaaaaaataaacagaatacaaaactgcataatctatgacatatatacaaagaggagtcttataatggcttatgttctttattatactttattttcttcatatttaatgggcttctctggtggctcagaggttaaagcttctccctggaatgcgggagaccctagttcaatccctgggtcggaaagattcccctggaaaaggaaatggcaaccgacttcagtactcttgcccagagaatcccattcagggaggagcctggtaggccccagtccatggggtcacaaagagtggacacgacgagcgacttcactttt

SEQ ID NO: 62606 - DNA, 658 bp, Bovine  19866880425044
atattgggagtgggtttctatgctgtcctccaggagatcttcccttccccagggatcaaacccaggtctcctgcactgcaggcagattctttaccatctgagccaccaggaaagtccagtacatgtataatggataataaatggaccaatgaatgaataagtggtgaatgaaggaatgagtgaatgacatggcttaatagcagtttgttgaaaaagagttttgaactttaagttgagcagcaaaaatatctaactgtggtcttaggtagaataacaaaagtatggtgcctggtttctgagtatctagaatcttggaatttcagagattagaaatgatggggaaacagactagacatgtgagatgacttgctcatggttccaccccaaatttgtggtcaaagtaggatttgcatttagagatcatgactctcagttaaatttgctttctacaagttctagtatattctgtgctggtcagaccacaactgtagcagactgtgcaattctgagctatacacttaaagatctatagctgcaaagtagcatctgtccaaggaaggatgatgcagatactaggggaaagtggaaaccatatcacgtgaagatgagatgaagacagtaaggatatttcacctagagaggaaaatacttgcaaagg

SEQ ID NO: 62607 - DNA, 1390 bp, Bovine  19866880469955
ggtcacctcttacatcaacaggtgaagtcattgagatggaatggctggcaatcttacccagttgcctttaattgtattataccctatgacttgtgcttccttggcttgttaacaatctacagcctgtgacataatgtatccttaacctattttggtgctcttaatttagaattattccttcttcccgcatgaaagagaagctgccaattttgagaatatccattaagttaagggcacaaggcagaacgttaacattcaacttaaagataaagcaatagactttataaattgcaaagcgcatttcttttttaatagaggaatgaggttgtctgctgagagatctggggcagtagaaagaagtttcctttcctaaggtacaagttttatttgcattccatgagtcatgttacatggaaatccttcactcaataagaaacatacacttctgctgtggttcgtgaccctccctgtctctcagttacgagcactacaaattccaaacatgctgtaaatcactgtcccccatctttcctccaagactttgtgctggagatggactgattcacatcttcatctccatgatgtacagaaacaatcaaaacaaatataagcctttattatccaacaggtactaaataaaaatccaaaggcttctgataaattggtagtctttactcagatgggtattttaaacccaccaaacaacttcagacataaaatggcgcatttgcaactttcctcctctccattgtgaggtgattgattttgtctggatgtctagagaaccagccagctttatatttgagttcgttagaaaaatcaagaaagaaggaaaagatctgcctatctgaatagcaaagtccccatttctttcccttttgacctaatcaatatgagaaggcactaaaaataatggtttcaaaatcttaactagaaatgccagctggccacaaaaggcttccttaaaagggcatgtgggaatccatagggagagtcatcattatactaatccattcagaatagttgatttctctacttctgagtccagatatctgtcctggattctgcagcagccaaggcagtgggagttttttttttttctgaagcaaacaaatctccctgtttcatactgatccaacctaattctagccacccagcctacacattatatatttcctattttgagaaaaacattcctggaacagggagtgggcagtggactcaattctattttccactaaattaagacaccttacagataaggaaagctacattttctgtgacagggaagaaggcagaatacttgctgcagtgaaaaaaattacaaaccaagaatcagaggataagaggaaaatggcagattgacttccggttaaaggacagctgtaag

SEQ ID NO: 62608 - DNA, 1498 bp, Bovine  19866880492211
taatagataatgaatagtcgagtattacacatttgagaggtcactttagaatggagcaaaagtaaaaaaccagaagatacttattctgccctttaagtattagcatacaactcaatatgttgttgagagcacagggatggttgcaagtcaaatgaaggttatgttataattggtactctgaattgttaaagagaagcaaaggtgaagctgaacactttttattattattttcattgaaatcttattaaaaacttttaatggaatgcaaactagataccatcttcaaggtcacaagttaaatcagatgtacagccattaataatatcactattaacatacagctttatgaaaataactttcccaacatagacatgggctaacatgttttctatcttctttgtattttctttgctattacagagaaagtcttgagcccaaacaaaagagagtatgaccatcataatcagtccactgaaatagagctgcaaatctctgcattatgttagattcaaaaaataaaaactggcaaataaatttagcattttaattcagtgattctcagtcatgcttaaatgtttaagcacctgaaaattatgacattcattgcagatttcaatgaaataatgatattttaatttagttgaaataattagaaggaaattcacctgcagaaatatgacagtttgtgtaagtatgcaagtgtctatacatagaaagtaatgatctataacacatatttgagaactaacacatataaggtttgtctcatttcttatgtgctcttggctcattcattttgtcaacttacagcagcacatgccactagacaaattgataaagcaatgaaacttaaaagaggggaggggagtgtggggagagaaatttacaaattagaaaaaagttttctctgcttttcttaaggaattgggtaaaagctgttattattttattttagtggtagaacatcttggttgagctcccaacagaattatttcctagaagcataatatgaaacctactatttagtgtgtgtgtgttcagacacatttccaaaagagaacatttttatatgaggcaaacaaaaatatcataattacccaagtttcttcacattatgaaaagtgaaggcctttaaaataattctcatcatgtaaaaccaattccccatgtaatattctgatcactttttaacataatttatgtattattctaattatttgactaatctcatctgtcctattgaatcatcatctaacaacttctcaatgccttttattcttagtaaagaaaaatgtgcaaactttaatatagatatgctatcatgaaaagccaatgcaaaatacaaggaccctgaagagaaaaacacaaagacaatatttataaatgcattatcttgtgcatgttataatcatcatttcagaggaaggaagcaattctaaaaataaattttaaaagctatttttacactaacattatttttttctgaatgcacacccat

SEQ ID NO: 62609 - DNA, 1237 bp, Bovine  19866880500901
agaaactgtcttccacaggtgttttaaactgggtagacactcttgcttgtcttcgtgttttacttccaaacagtaatatattgtatgtgttggttcatctaaacaacaaatcagcaagcagtccttggcagcccacatcagtctgccccagaaacattccctcacaaacacaaaatgtaatatcgaataagtgattgaacaaattgtaaaattatatgcaacatccaatccaaaaatcaataatgctgaagaactaaatgtttattatagtatacagaagaaaataaaggaaacaaatatctggtttttctagcttcccgttccccacccctgtgcaaagtaaaattaatcaagagtgggtccattcatcccttcaccactaagctatgaatgaaacataagaagccatgactattcacttgggatgggtgatcgtctaccatagctcttttgagttcattgcagtcttttcaaagtttctaacataatagtttaccctgttctctgagctcatcctaaaatgaactttctccaatcaaaattgtattatccagggtaataaaagtaatgctaggtcccaactactcataagtgcctataatcagcagatattaaaagatgtatatcaggaagatgtgtacaacagttgtggggaaaagcaagaaataaaatattatcttcacattagcagaaattagtgatgtattttcctttaaacatagatatctacataaacatgatactttaagacattcgaatataacatcaaatgatcagttatacaaaaataatatatgtggttgaagtatgcagtttaattttaactaaacatgtttttccttctctaaaaagatttgtcaatttggggaaaagaaaatacaacagagctatttgtactacagtgacattggatggtcagacttagggggttcagttcagtttagtcgctcagttgtgtccgactccttgtaaccccatcgactacagcacaccaggcttccccgtccatcaccaactcatggagcttactcaaactcatgtccatcaagtcagtgatgccatccaaccatctcaacctctgtcatacccttctcctcctgccttcaatctttcccagcatcagggtcttttcaaatgagtcagttcttcgcatcaggtggctgaagtattggagtttcagcttcagcatcagaacttctaatgaatattcaggacgaatttcctttaggatggactg

SEQ ID NO: 62610 - DNA, 1256 bp, Bovine  19866880574217
ttatagggttaagacgttatgtacttgtggagttgctgaagaagtaagaagactgctgcttctgaatctagtgttggtcctgatggtactatggctcagcaggggcattggtcaggaacataagctgggtgtgagataaggaagtcagcaaggaccgactggaatgcacatctgcctctcacaacctccaacctcaacaatgtgggtgacttgcagaagaagttgatgtcttattatggagctacatacccagtggcttagggctcagagaaactgatggagaaaatctagtgggaacttgagatgccacagccttcactgctgcccttcaataatgaagtgaggtagcaaccgtcagtgtggctggcagccactcgtggtgccttccatgaaccttcacaggagaatagctgctgctttacttccagttattctcttgtggcacagaacctgtgcaggagagcagtttctgggaattgtaattccatttttattacaataaattccatgtaattccagtttatataccttcaaaagaacatgaaaatgacctcagacttctcctctacaaaattaaattccagaagacaatggaacggtaacaactgaattaggagagaaataagctatgagctaaaaatttagttcctgtattagttattttgttcatgtttgaagacacctgtcatcttcagttcactcagattttcaaaatgttcttaggcttcccacgtcttcacctgccattgttcttcctctgtttccagtccttttctgatagctcagtgttgctatacatgatgatgctcctggggcaattctccaaatctcacacttctgcttgtgtcttgtcacttgtaagctgtggtacctgaagtcattaataatagaataagagactgaaagaatctttctatgttttctctccatgtcatattcagccacagtctgaaaccactcttctgatgttttatggttcattttgtccaagacaaggtttaccacaaaatcagtagctaaaaagaccatcttcaggtcatccatgcttggttcattaataaaatcttaggccctcttgattcattatctttttgatcccaattcctgccctgcttttctccatatgattcttaaactttgtttcccagtttgtcaccatatttaccacataaattatagatatctataatatgtgtttgttttgtttttacctgccttatcaattaatgtataagttaaatactatatttttagga

SEQ ID NO: 62611 - DNA, 2148 bp, Bovine  19866880760335
tgtttctaggccaggatgagtgagtcatattgcagcaactttgcaaggccaaattcttcaatttcatgaatcctcgaggaaaagtcagtacagactactgaaatatgacagagattatctcaaagtcacattagactctctactagtgtttatcttcagaggctacttccattttccaaaaccatgcagcaccacaccagctgttactgttcctcaattagaggagatgtttcacttacataattaatcatctggatatcaatcacaagaaccttttcattgaattaattgatatctttatatgagcatccatattatatgaagtgtgaaggattatataaggtaatggtattgtttttttttttaaataacctatgcgtgaatatgtaaatgagaaaggccctttgaaggcaacatcaggaaggcggggatgatgtgcaacccaccgggtcagagtcaggccttcttctagcctcaatctagacaaaaatcaactttactggtcctcttactttgggaatgtaaccaaattcaatctagcataaaaacctaattcgaagttactgagagtccaatatcaggtattacaggagagggggagagaggactggggcagtcctagttctcttttcccagtggtcccactgccactgctaaacctgccagtcatcctgattcatcagaggcactccttccacaaaaggctttacccacagtgatcttggaggtggcggcttctcagcacccatccttgagcagtcaacccattctgcagggcacatttggagatggctctgtgccccgcctccccaggggagtctcccctgccaggcttcctccccttctccagatcccaaccacctttttcctttacctcatggagcctccatcctctgttaaagcacttctctgccacatatccctggacttagaccttgaaaacaaagacctttttataagccaggctatgaaaacaaagcagagagtaatgacccaaactgtcaccacagtacatcaaattagtaataaatagattacataaataacacttggttaactggcaaaattagaaaatgtagataagccaaacacataaattaatctcacggacaaaagataaacaccaaggtttgacatatatcctttcagataatatcggtgaatgtatgttgaggtttttataagacaaaagaatttttaataaactgaatgttcactaataataagctacagagtttcacagtcatttaagcacaacttaccaacagatatatggtgtggctcttgtgtaagtttcaatcgtgttcagttgcaaatcagtgaggccttcaaaaagtttagatgaggatctctaagccatctgtttgcatgcttatctttcttttcccccacaacactaatttcccaccatgtcccacactatttccaagggacccttccagtcccagcacacatactattggtgagctattctcagtctccaagtctgtccaaagcatgtgacctcatctccagagtttctcctaattgtccctgtatcagcctgaatctaagtagatctagagatgctagaccagctttaccctccactcaccctcaccgtgaggatgttttgtttctcttttcacttcgtggaagcctggtaggctacgtccgtggggtcacaaagagttggatatgacttggcaatgaaacaagcctctctgtgattcctagtctagagaagggtttggccatttcaccatcatttagcttcaaggtactcatgccaaacctgtcattgctacaagaattcacattgcagttaaagtcagctcgggtattaacctctgtgctgtttcccacactgggctcttcactgccttaactgaggcaatcaacttggttcagaaccagcagatagtataaaagtatagcattaaataacacttcaaataacatttaaataacacattgatagtacttattatttttttgtattttaaaaaatatatatcctgattatactgaaaggtacttgcaaccaactttcaaacttgagcacaagactgaataattaaaaatagcataagaatattatatcacttaaaggaagtgcacaaattagttccacacatcaagtgtgcgaagttagctactataaaaaag

SEQ ID NO: 62612 - DNA, 2337 bp, Bovine  19866880840530
tattatatgactttcattatactgcctttctatcactttcattcttatttcatgtctgatacagcctctcagtccacctgtgtttcatttaatgtaaaataaggctaagttccaaaaaccctgacccaaacacatatctagtggtgtttgaacatccaccatttgaaacacatttctactacacagccaaggggcaaacattcttagtaagtgtgtgtgtgcctgtgtgtgtgtgtgtgtgtgtgtatgtgtggtgatatgcatgaatcagttcttatcttgactccaagctatttgtggctgatgaggatgctactctggcagaaagaagaaaccattttcaacttgagaagtctcctcttaaatcagtatatatctgattacagataacattttaaaatttagccagattttatttatactcacttgaagccctttaagtgtatcctgagattttaatatgtaattaagaaagcatttggaaatatcattcctcccctctagtaagtgttaaattcatccttaagaattattatactttctatttctgtcttgatttgcaaagggcacagtaatcaataataactgtaaaataatgtggaacaattagtttttcttgcatgctcataatttgtgttgacatcagttggcattagttaatgcatatactggagagggggaaattaagctgccaataatcaagcttcatgttcactgctattaatagcatttttgctttaaacaaataatttctgaaaatttgtattctagcatccaactagcaacagaatggatgcattttcttctagaactcaatgactttccaaacataatgattcaaaaaataagatgagtcaacatgtttctctgagttttaccagaataactgcttatgcctatttcacaacagagtctctgctatccttcatattcctagaagttcatggtaaattcacttgagttaagatacagtttaaatattcatgcaagcacaatatttgatcacaaaagctgaatttgtacatcaggttgaactttcctcaaagatacatggttctctacaatcactgatggtctgccatgttcaactgttcttctcattgttcctttcttgcctttattatgtcctgaataggtttgctattgttttcttacttccccttcatctaatttttttccctatgtgattctgagtcatccacagacagctttcctttctctagaggcaggagagtcctctcaaacttttccattcagattctattaatatacaggtgggagttcagaaggtaactttgataagagtatataggtatatagctgagtcatttagagggtcttacttcgaggctcagtgtctggtctgatgatattttacaactaaaactctagagatcagcagagttgattatatatactttattattttggctcagaacttgctgattattttgctactgagcaaaacccctcaatgatcaactataatttttaattatatttaggaggaatattaattaaagaggaacataattcaatttcttttagtaccatatttattggagatggagaaaatttttgaaaatataaataaaggaagtaaaaattgattccaatgaaggacaaaaatggatggaaatacatgcttccagcaagatagaggcttttctctacatgctcccatgtatcattttatgtatatggcatggtagtaaggccttaaggaagttttgaaatagtaacatcatggaattcagtgtgagaaatatatgctcaccattcttgctgtgaaaataaattctaaatgtgtattttttactgacaaatatagtcacacacttattctaattttattttcaagagtgtttatggcaatattaaaatcataaggttatgtggcagtccaacaaagccaacatttttcctgcagcaaaagaaatacagaaaacaattatttaaaatgaaaacaaagacaagaaacaacaataacaacacaaatcctcataatacagaggattgccccggtggctcagacagtaaagtgtctgtctacaatgtgggagacccggcttcgatccctgggtctggaagactctctggagaaggaaatggcaatccattccagtactattgcctggaaaatcccatggacagagaagcctggtagactacagtccattgggtcgcaaagagtcagacacgactgagctccataaataaataaatttatcactaacttactttagaggcagagatcaaaatacatattaatactgggataagctaatggcaaagtcagacattatcagagtattcaatttaatttggacttctaat

SEQ ID NO: 62613 - DNA, 1860 bp, Bovine  19866881054112
cgcaaagagtcggacatgactgagcgactggtctgatctgatctgatctgatcgtaagttattatctgaaaccttggcaatatttttactattttaactttattatgactatatatttcatacagtctatgttagggatttagggcatggcaacccactccagtgttcttggagaaccccccatgacagagaagcctggagagctacagtccatggggttgcaaagagtcagacatgactgagtgactaagcccatattagggatttaaattatccttacccattttacccatccatttaataagccgtctgtcttctatcttaggcaacctaaattatcatttctttgaattcaaaatgttatcacttattattatatatcttttatttttttcaaaataagtacatttatgtggcacactatgaattggaatgacaaagtataaagaaattagtaaaattacatacaaattaaaaattcttttctctgataatagaaaaaaggagaggctaattcagaattaggacactaaaatgctaggaattaaaagacagctaaagatgagtgtacatacattctaaatcaccagggaaatgaatgagcctctgaattactctctctgtttctactctgcctccctagagtcagttcacagaacagccagagtgatgctttaaacatgtaaacgagatcaaatcatttccttacttaaaacccagcaaagtcttttcatggagcttaggataaatttgatggtttgtaccatggtttatgaagctttacatgatctggcccttggctacctattcaatttcatttcctatcagtcttctctgccctttccatactccaaccacactggactgtttattgttctgaggacacaccaactaagtttgtgctatcagaatttttcacttactgttccctctgtctagagtgctcttaactcagatatttgcatgactcaaatatgaccttttcagaaacgctttcactgaccacagtatcaacatcagcatttccatttctgaatcctaacattatatcacatacttgatttttaaaaattgtctgttttctctacctcaatatatgctacatgtagaaagagatttagtctgttctgttcattgttatattcttcaggcctagaacaatatctagcaaataataagcacccaataaatatttgttgaataagtgagcaaataaatgaatacatatctgatttcaaatatgcttatatatgtatatatgtactattttagtggtttagacaaagtttttatttgaattatgtagttaattgatgaattcatattttttgcttcaattatcaagaaaagcatttcttcattcttatgtacaataaatatttattaatttttgttaaatgcttagtttgtagtggatgtgcaataaatacttgctgaataaatagagtacttaccatgtacaagatattagacattttagtatttaattgcctaaaagaaaaatggacccaaatctccctgttatgtggactgggttattttaaacataatgatgaatattgtatcccaaggatcaatgttcaataattagtatgaatggtaatagtccccacagcttgacagtccctggctacatgcaattcatacaattcatgttttcattatctctgtgccttttgggcattgcaatccatataatatcatttcaatctttttttttcccatcgaggtgctctaaatggtttagatttcctctctgtcagaatcttattctgaacaaaaactcaatcagccttgtttctttcaatgattatttaatttgtaccaactggtgctattgctatcctttatatcacctat

SEQ ID NO: 62614 - DNA, 2059 bp, Bovine  19866881133335
ttcaggcaaattggcaatcccttggtattttcttgggctgccctggtagctcagctggtaaagaattcacctgcaatgcagaagaccctggttcatttcctggatctcgattcctgaattgggaagatcccctggagaagggataggttacccactaagattataaacaattcctttcaggtttttctatcattgattttttttaataattctgagttccttatcagctaacaagttttgtgttctcgttctaacatagaaattcttcaaaaaaaaaaaaaaattagcaaatgactcatcattaaaaaaagaaaaacttgcagccaacaacaacacactgaactaagtcaattgaactatattgaaacagttagtcaaagattttcattttattttggcactagaacaaaaataggggacataatacccagatagtaggtaaacaacattattgtcatttttccatgggaaaagcatgattttgcttctataaaaacaaatgaaatattagggagaagatactttataagacaactttgacctcaaaccataacctacattttatacacaggatcagtctctgacactgaattcattgtttaataacataataacaacataaattgaaagactgtgaatgacatatacaaaccactgtataatagatgactaataagtacctattgaatagcacagggaactcttctcaatactctgcagtgacctatatgggaaaataatctgaaaaagagtggatatatgtatatgtatacctgattcacttggctatacagcagaaactaacacaacattgtaaatcaactatactcccaatattttttttaattaataacaacaacaactaaatcacaaagtacttcatatgtggcgggtgcatcctattctaaatcctttgcatataccaactcgtttaaacagtaaaacaacttataagcattattactattattgttttagtatatcatcacatatcactttatgagatagataccatcacattactatcatttctacttaatggatgaggaaatgaggcaaagaaagacccagcccttggccagggtcacccggctggttggtagtcgctctggcatgtaaatccagtcattctggttccagagtccatgcccataaccattccactgtccttcctctccagttggttaatttttccaaaatatcctattcatctaaagcaagccagactcttcatagtgaggataatggacgactaaagccaagtaagaaagttgtctacagatttccacagatggtagaaaacgcctttccctacaaattcatgaccctattgaaactccactgggcagcaaatctcagatccttgatgcacttgagaatattccagaactagaggaatagcacatatgccccagatgtctggcacagtcttacccagatcatcttcccagcagaacatgaagattcttccgaatatttacagagatcaatgaaatcattctattttaattttactgaagtatagttgatttacaatgctgtgttaatgactgctgtatagcaaagtgacttggttatacatacatgtatgcttcttcatttcttttccattatggtttatcacaagatattgaatatagctccttgtggtatacaaaggaccctggtgtttatttatcctatatataggagtttgcatttgctagtcccaaattcccaatccttccctccccaccctccttcccccttggcacctacaagtctgctctctatacctgtgagtttgtttctgattcgtacataggttcatttgtgtcgtatgctagattccaaatataagtgatatcacagggtatttatctttctgacttacttcactctatgacagtctctagatccattcatgttgctgcaaaatggcattatttcattctttttatggctgagtaatattccattgtgtgtatatatatatcatatgttccttacccattcgttgatggacatttagattgttcctatgtcttggctatggtaaataatgctgctatgaacattg

SEQ ID NO: 62615 - DNA, 1001 bp, Bovine  19866881190801
catatttgtatttttagatcagataaaaggaatagaaggttctttccttgaaaaacgtagtgtgattcaaagaaaatgttattgaaaagaaatacttaaagttttgtgaaatattgatatgtagccactaattttgtctctacaatcaattgctttttctttgtgtatctcaagcatgttcttatggaattacatagctgtacaagcgctaggatcaacagaatttttaaatggaggacaagggggtggggaaacaaggcactaaacaccagttctttcaaaataatcctaaatttggaggtagtacgtaaggacaaatcctgtctttactgcatcgtattcatttttgagaaaaaatcacctccatacagaactattttccatcagcacaaatacaggtatcaaaatgaagaggacttttgctgggttgttaaattccttggaaacatggactgtctttcatgacaacagtctccttcctcttctgttcccacacagcttgacaagcaggtcacagagaaaggttgttaattacattcctttgcctaaaagggatttggaaaaaaaaaaatgtaccttagctttactctcaagagggtcagatggctgaggcagtgatttgtttgtgtacagatgggctagtgcaaaggaatggaaaaaaatactcgggtgaagaattttcaaatgggaggatgcgttttaaagacagcttctattatacaccaactacatctggtggagtcacagggcaaggtgaatatactataaacaatgaagtctcctgagggaaaaactgctgcatattgagagagaactgtgcatgggacagccaagagtgtcccttgtatagtatatgtttttgaaagcaggtttcacatcagttttagtgtaactgggaaggatttcaactttttttttttttttaagacaaattacttggacttaactcctactaaaaaacccaagattcaatatatgatcagtagatacattaaattaga

SEQ ID NO: 62616 - DNA, 750 bp, Bovine  19866881200458
tcataacagagttctttccatgcgttggttagaaacaaagttttgggtagagcagaaagtggggcatctggttgaagaggctcctcggtagaatgaagaaatcacaaactctgttccccagagctttctccacactctcccattttgaatatcacagaatgtgtcagaaacacggtataataaagtaagaaactgaaaggtgctcgggattcccatgagtcgtttataacatggacctttacagagagcagctctgccatgttacaagtctcgatttgtctctttctcgttgatgtgtattccctgagagggtggaaacttttgtctcttgttcactgttatgcctcagtgactagagtagtgcctgacagctagcagctatctgttgaatgagtgtgtgttgggtgaggaggcttcctaagagagcactgaggatggagcttgcccctctgtcggacactatgaaagaatggacttagctctgtgtctggaaggacgtttgctgactgctgctgccactgggaaaagagaagaaccaggcctatggggctcgatggttttcatttttaaggaaggattttattctcagcggatgagtagcagactacagaaatagctagggctctgatacttagtccagaagcaaaattacttctgggatttgacaagagggttgggaaggtttgacaggagttacttgcaggaaaggaagaaaccaagagctcagtgaaatgttattaaaagtcctta

SEQ ID NO: 62617 - DNA, 833 bp, Bovine  19866881219903
tcctattatgacaggacatcattctaacttggaaatccaagcttttagaaacagtgctataaatagagttaatattagacaaactacccacaattggaaggaagggaacagatatcagtcagagttcaaatttccaacctttgcggctttggtcctttgccaaccatgcttcttctctatatgctgatggatacaggctgcacagagaacactactgaactgaaggaacttttcttcttccattacaaaggcttattacggtcaatagaatagacttcaacaattcagagagaatagtttattgttgccagaattctggttgaaagctacattgtattgtttaattcatcgggacaaaataagttaaaatatatgggcagactcactgtcatatgtctggaaaatcaaagcctgagacagtaggtacctgaagttcattgaaggagagttcttcaggaaaagctcttcagggcagggaataacaagcaggagagagaggaaagggctgagaaaggatgtggtcccatatacagaccagtcttgacttgatccatgtgatcacaccacagaattatgaccctctcttctgattcaagagggccagctatttgtagccccatttccatcaatcactagctgcataacctcttgggagatgcagctgccatcagcaattctctggaagaggacagagagagaggagggaggtggggcatgcagctgtgggtctttagctaccaatagcagctgaagaagaaatggaaagagatttaggcagggcacccacagtagctactatgctacttgtattcactcagaaatagaaaaaaaca

SEQ ID NO: 62618 - DNA, 1319 bp, Bovine  19866881254504
attgatggagagaacacttgagggggatggaggggttggaatgcatgataggttggccctggacaagaaatctctcccaaggtagaaggaagaaaaagaaaacattgcttttcagagcatcaatgggatcgaggtgaggtaaagagtcaggagttataaaaagcaaatggtaaataagatatggaagccagatgttgtcctgtattttaataagttcttaaatgcatagtctgcatggtatactggaaagagccctagttttgatgccaattctgcttatcaattgtgtaaatttctaagacaagtaatgaaatggcaacccactccagtattcttgcctggagaatcccatggagggaggagcctggtaggctacagtccacaggatagcaaagagttggacaccactgagctacttcactttcactttcatcatctgtataaaataagatttttataaatctgctttgaagggctgtattaaggaacatatttttgtcatgttaagtattaacacaatgctaggcatgttgtcggagaaggcaatggcaccccactccagtactcttgcctggaaaatcccatggatggaggagcctggtaggctgcagtctgtggggtcgctaagagtcagacacgattgagtgacttcactttcacttttcactttcatgcatcagagaaggaaatggcaacctgctccagtgttcttgcctagagaatcccagggatggtggagcctgatgggctgccgtctatggggccgcacagagttggacacggactaaagcaacttagcagcagcagcagagatctcttcaagaaaattagagatacaaagggagcatttcatgcaaagatgggctccataaaggacagaaatggtatggacctaacagaagcagaagatattaagaagacatggcaagactacacagaagaactgtacaaaaaagatcttcacaacccagacaattacgaaggtgtgatcactcacactcacctagagccagacatcctggaatgtgaagtcattatggaccttaggaagcatcactaggaacaaagctagtggaggtgatggaattccagttgagctatttcaaatcctaaaagatgatgctgtgaaagtgctgcactcaatatgtcaacaaatttggaaaactcagcagtggccacaggactggaaaaggtcagttttcattccaatcgcaaagaaaggcaatgccaaagaatgctcaaactaccacacaattgcactcatctcacatgctagtaaagtaatgctcaaaattctccaagtcaggcttcagcaataa

SEQ ID NO: 62619 - DNA, 1252 bp, Bovine  19866881309218
atactgctagataagaattgcaatggggagataacatgagcaatcaggttgtaagtaacatccataatcaatgatttgaaataaatctacataaaccttgactcaagacaaaactgtcagaaaaaaaaaaaaaatcccaaaacacataactgaatgtaccaaaaacttaaatgttcttagttatggatagataggaatgaattctattaccagtagcttgttaaataattccctttattttataatatcattgttgatttatattggccaaaggtacaaattttaccaaaataataataaaatttaatgtgccatatgttaactactttgattttttacaatggcctgtggaatttgataggattcattttcctaatgagggaactgacacacagaaagatgaaaaaatctcctaaagatcacagcagccattttcaatggctccacaatacgttttggagatggatcctgtccataggaataaagctttgaaatgcagagatcgctggagtgctgattgcatgacgagtgaatgctgtgagatgatggtaaaagtcatctcttaagagctttgtgatcagattcgtacatttgcaccctagatttctctgacccaactttgtttactgaatcctgaaattaccttttcagtgtgttttttcctggttccatgagttcaccttctctctatctcaactgatatggatttccccttcatatacctcttgcatatgattatcagacgtaacctgcttccaatttcagagtcaaagagaaagagaactaaacgtactgtttggaggtctgcgttctcccaggttactcctcctatggctgcatgagatgggattatgcctcaccatctctcaacaaagactttcagctgctatcagttttatttaaagaactcatgagtgctgcctaactatgtggcactgttttatatgcagaaaatcctagggtatatgaggagcgcatagccctgttgcattgtttatctccttctggccttgcagagttggttttcactgacgtgctgcctctttttaccactccatctcagttgactgaggtactgggagctcaagaaacttatccaaagtcacacatgagtggcttaccagaattcataccccagaactgtcatggttcctaaatcctttattatgagcattataccataccatcttccaggtctcagtattaacatcatgtaaatttattctccagcatgattcattaaaatgaaaat

SEQ ID NO: 62620 - DNA, 3128 bp, Bovine  19866881333401
aaattgctttccaggaagtagtccatctgagccctctttaagataagggactcttcctggttctgccagcaaacctcttcactaccataaagccaccagtgagaatatgggggacattctatatatcatatccattcaatgtttaaaaacaaatagaatccatactaattacaggaattttaggaagtactctctccttgtaagaaaactgaaaccaaagaaaatatttcactaactgaatcccgttcaagaagtattctttcttgagagtacatctctgactgcttctatctcaatctcaatttcaattgttgagattaaagccttaggaaaaatcaggacagcagaaagaatcatttcaaaaacataatgttcaattgtagatgaaaagactacagctagagcagtgactagtttgctaagaaagaggagaagatatgctgcaatcaggctgaggcagacagaatatagaaatcccccacagacttacatggtgcaactgtcttctgtagaactctacccacacatctgtgaacagtcattgttaaaatgcccaagagctatactaggtataccctcagctaaacatttcataaaagcatgactgtcaggttcctcctgggtaaacaggtcatagaaatttgaggagatataaataacatagttatattatgtttctatgatttgttttattcacttccagtgagaaatgttatatccactctcatggggcttcttccccctctttagggcagaaaattggtgaaaacaaccggtcttcttcttcctcaattcttggtaattctccttttcatgtggtttttgtcctttggtctattaatatggttttgtacactaattgcttttttgatggtaaaaaaaaagtcatacatttttacacgttgtggcactcagagttaatttttagattaagataatttggaattggatctagtctatgaactagggaaatattcaaagtgacctttagacagctgccttaattttaaaaattaaataagacactgaaagaagcaatgtttgatctaatcagatgttgatttattttaacttgatatcacctacaactaggtttgctttccttataaccagaactgacaccttaaaacaagatgatgcactagacaaatattctcagcataacaaaattgaagcctgactcgggtcatctataggaaatgagtaggaacccacataaatataagcatgaaaagtgaggcagcatctttccaaatacaatcaagtatatatagaatgttaactgttaagcaaacatttcatggtgagctagactcttttccggagtcacttcatattcccagagaacagaaagtaggtatttagaagggcccaggtataacatttggggatgcccagggtaacattttccaaactttgctccaaagagcaatagtccctctgagatagtataggtgtttcttaaaaattaatttcagtggtcacagaggtttaataaactctcactttaccataggacttcgcctttgctatggtactgtgtgttgggactcttctagagtgaatcatattgtacagatttctccagatgtatttgaccaagcaaccttttcactgaatatctgttagcatctcattgggtcccatgtgcctcaaggcacatagctgggaaaacgctgcatttgtgtaatgtgacaaagcccacagagcagtagttataaaaagaatgaaaagatggtcattctaaaataatcctattcccatgatattgccatctaaacccaagtaacagcatcaagtatttcactgtaccaattcttagactcctagcagtcatcagaagtggcaggttggagtcagaaaacaaacaattgtattctctaatgccattcaggagcatttctcaagatcccttcttggactgttcctcaaattttatgcaattgtacatttttggtgccagaactatcttgccatacatttaatttccagttttgtttcagagccttgtcatttcatcaatcagagctattccatctgctgaaatgctggcaaatccagctgctttgtgacttctaatcaatttcattaatatctccacgttctgtttcaattagtggcctattctttggactgtttgataacttgatactacctactgtctgtagattaaaaatcaaattacaaattgctttgcccctgacattaaaaatccttccttctttaccagatctttcctatttagcacatttagtcctcttgagttaaattatactctaccacgctgtgaagtagggttcaattgttatacaaggattggatccatactgggaagttcatcttgacattcacttaatccttgtgcccttactcagaattgaatcttgtttcatctaagtcttttcactgttgtgaattttttcagcatattaaacacctacttgaaatattatttacttggccataatcctcaagcatttttttaaattcatcagcataatacctatattgtctactagctgcaattcttgagtttgaaaactgtttaaaaggaccagtgggacagtcatccttgttactgattatattaccatgtaacctaagcagttaggaagtagttattgaatgctcttctttaagtatattgaacatctcttcacctttttactctttatgtcataaaaatcagtctgtgcttacctattttaattgcacaaaaatgtacagatttttacttttgtaacaaaatttagaaatagcatagaattttgactgtcctttcccatgcctcatggcacaaactgacagcgtggaggtttagtagcctaaagcaatacagcaacagtgctgtgggtcatatttttaactttaatgacaatctgtaattgcctgcagcctgccttatttctggccctgctgatttcttgaggacttgtgataacacagctccaagttggccctctaatcaggcttgtgacctcttttatatgttttttctatttttttcagggttatcaggtcttacagtaaagtagtcagagtctacagttctacctccttcttcagggcattccagggaattagaatttccttccagcctgtaaactttcataactgtctgcctcttc

SEQ ID NO: 62621 - DNA, 2511 bp, Bovine  19866881347241
ctaaggaaatgcccgctagaactttcacacttctcccccaccatcctatcctaccaattcctctgctaacatactaggcggaaagatgtctcttcctattgtacctaaacaaatcagtgtacagggaagtgatttatcattcatgaaaagcaatcagattgcttggggctgacagctgttcccaaaatgcagctgagaaacagacctttggcaatgtgtaaaatttggaacaaaatcatattactgtacttcagctggcaacaaataggctgacagtgagcttaataaacaaaataccatgtggcccagaatgtattagctaatctacatttatgaataaaaaaaatgatcactttccccattttttgtaagttactttcagtcaaacaaaacactgaggaaaagtaaaaaaaacaaaaacaaaaacttaggaaaagtaaaatattctctctagaatgttttttttttttttttttttaagatttaggcaaatttttggtaaaaaaaatttttccacacaattcattatgggaaatgggccaggaaaaaaaaattgatgaaacatatatagaggttaaagagggacagagtttttactagaaaaggaagaattccagtatattctggcctccgagccataattcatttcatttcccttgtcgagaatgctttcccatatctctctgcctgtctaagatctgtcttttcaaacaaaatatagatcctcatgcaacctccaaaatgttgcaattttgagatgattctcctgaccattctgacatggggatctcgccttcctgtgaactcctggaacattgctttcagcagcctgcctccctgttctccctcctctgtgtcccctctctctctaacctcttccttccctgcccactccccattcaattacactgaagcccttgccctatccaaagtaaggtgtgttttctttgtacctccatgtttcttcaaacactgagtccttggcaaagaaatgtgcttcattcaccccttcttcctggccaaccatactcagtctttcaggccagttcaaatgtcatttcttccttcatttaataaacatttaatgagtttctacgaggactgctgccctgaactaatggctaggggttaagatatgaagaaggcacaacttccattttaaagacatccacatactcttaatattaaaaacccaaatccttaacttcttctaatatcactgagtcctgtagcccctgacagtcactagactgtcactcctcccttatatccacagactccagccacatcagcttcctctcatattctcaaacttccatattccctcccaccacaggactttacacatcccatttcctcctgtcccacattcaccttggactagatgaactcttgctctgctttacttctcagcccccatattcatttcttaggaatatcttcttcaagctttttgaaaggtccaattctcttcttaagtactcttacagcaccatgtaaatcttcaaaaccatctggcagttaacacttaatggttgtgcatttgcaccttcaatgcctgcttcttccataaggctataagcctcgtttagcacaaactttgtgtcagtttaccagtagatcttcagaacctggaatatcgtctgtacatgttaacatgtacagacaatgatatttgtagagtaagtgacccccaaaaaaatgtatatgtgcaataaaaggtccattgggcaagataacaacaaagccctttatcatgggatagaaagtgtgatgaaggggaggcaagtatggtacaggatccttgaggaaggcctgatctaatagtatccaccgatcatttttatggaaataatttcttgtcttagacagctggaactcaaattaaggcgtaaataggaaatgaagcagtagacacagcaagtgaaggctttctttcaagaagtttagttgcagggaggctagagggaagatctggaatggaaagaatgatttattttatgagagttaaaaataagtatatgctgatggaatagaattagagacatgaagagattatataattagggaatctagattcctaaagatctagaggaaatataaagtcaaacagaggtaagatgaaccatccgtagcaagaagagagacctcttttttactaggtaggagagaaggatgttaaaatgtgtaggaattcgacattcattcaaaaaatatttattgagcaagtacatgcaaaggaagtacagtatgtctgtggagggtgtggaatgggattcaaggataaagagggtaagcctttttgagaaggtgacaactaagcaaagacacaaaaaataaaagtgggtttgccatgtcaacatctgggagaagagtaattcaggtaaagaaattgggtggttcaaaggtccagaggcaggagcatgcctagtatttagaaagaagatcagaaattgatgctgttgcatactaatggtttctaagttttctttgtaaagcaaagaaagttac

SEQ ID NO: 62622 - DNA, 1410 bp, Bovine  19866881409222
tatgcattaagtagatttaatatttcaaaatttctcttaagaattgattgctgaatttcactaatctctctcagacagaaatagggcttaagatcaggtagaaagtgactgtatctgctcagggttttctcaaattctaactcaccaacagtgctttcttttattgagtttgctttcttcttgtataaactctcaacgcccttagaatttatgtcacacaccattacttagtcatatgctatcttgtacaggacaggttcccattgtattattaaacagctcctcatggatcctgtgattatacggttgggcagcacagcaaattacatcataatatgaaactagtcactaatgaatctgttgttgttttactcaccaaatcatgtctgattctttgcgaccccaaggactgtagccctccaggtttcttgtccatggattctccaagcaagaataccagagtgggttgccatttcctttctccaggggatattcatgacccagggatcaaacccacatctgcttggtaggcagattctttaccaccgagatgcctgagaagcccactacagaactgatcacctataatttccaatcattcactccaaatccataaaaataattatttctgacaaaaggtaaaaggaaatgaaagaaaagtggtgactaatagggcctttggttttatctgtaatagtttcttgaaagaaaaagtatattcatgctgaggcagactgtcttcaaagatggctacaacaatcttcgccatgctgctcaacctgtatcacgggacttggttgctcctcccctaaagaagtgaagcctatttcctgtccccttgcaactgactgacctgctctgaccaacagaatgtgaagaaagtgacaaggacacagagttccagagcctagctttaagagatcctgcagcttttgcttccactgcttgggaacccggttctctactaaagagatcaaagggagagtccctggaggcttaaggatagaagacagagaaatcccagaattccattcatctcagttaaggagccagacatgagactgagagcatctcagattcctaggtgaatatgtctagtagagataacccattccatctgagccctgcctagccaatcccagaatcatgagtaaagaaaacacaggatggttgttttcagccactgaatttcaggctggtttcttccacagcaatagacaactgttacttgtgttattcaaaattaattttaaaaaataaataagccacctgcaaaccttttttcctgtttaacaactagcctctctccgtttcccatctcattccatgtctttaatgtttctattcatctaactgattatacagtctccaacaatgcaatgcaaaaatcagtgcaaatcaaggcaaaat

SEQ ID NO: 62623 - DNA, 1330 bp, Bovine  19866881747504
agataatctatttctaaaaatagtaatttattctcaatcttccatcgctggaaaaacccatactgctgaccaattactgtggtcctggtgaaaagcattattatttttatactttgggggccatgcaacatggcatgtgggatcttagctccctaaacagggatcaaacctgtgccccttgcattggaagcttggagtctcaaccactggaccaccagggaagtgaaaagtcaagagacttacgtttctcatactttaggcaaggatcttaaagtatatcaggtctcagattatagaagaaactcaaaaaaggcaaaactttacattataaaatgaatatataaagcatcaaaagactgcttagagacggtattaccaacaggaagcaaatgtttaaactaacaaaggtcaggaaaaatatttactatctttatagaaatatgagaaaacaaggcttaatgacggaggaaagggttcattttagaacatgttttttctttatcgtaagtttaaatttcacatgacattgcaaacataggccaaatattatgaattagaatatactcacagcatttagaaatactgtgttaggatctacataagtgattctgaaataacatttgctctttcaatagcattatttaggcaataagaaaatgtgcatgtgctagggaaaattcatgttcactgtagatgaaaaaagcctgaaagaatacatttgttgaaatttgcatttggtttggaaaacttctgtttaacaattgaacacagccatattttaacttttaagctcccacatggagagagtgtcaaggcactgcagcaatttacttttacagacattatgcggggttttgaaattcacaaaataagatatttcttcctgaattattttatgatcaatgtactgtctctacacaaggaaagttaaagctgtctgacaactcatagaaacattactggctcttaaagatgtaggaaattacatcaaagcatgaaaagcactgggtaatttttgcagtttcatctctaaacacaattgtaaagacatctgtcttttcagttctttctccgtctttcttctgaagcatggccttttaattcttgcccttgtaaatattttttgtctactgtagctttgcttcttaatatcctggttgatcttaccaggctaaaaagtatttacagggggatgttgcttttatctgtattcacagagaatgctaacaaattagaagaaagtgccagagaacaccacataccgtgcccagaacactacaatggcttctgcatgcacgggaaatgtgaacattctatcaatatgcaggag

SEQ ID NO: 62624 - DNA, 1109 bp, Bovine  19866880407034
tctgcctttactttggaaaacatgtttatcaactcagcctgaatcattgctgtctttatgttaaatcggcaatccagggctacgtagttattttccactgccactgcaggctttctctccttttcacatctgaatctcagcccactcctgctgaatagaatgcctggcctccttccagacttcccaaatctgattatggagtcctctgaggacaggtctgactggtctacactacctggagggtcaacttcagctggagacagccctgctgctctgttctaattggtgtgttatggagatgtgtctccctgaggcatcagcagacaagagttggagaacaaggtgtcctgaaatgatgcagggcccaacagagttagtcttgagttccattcatttttgaccactgacgatgcacaagacatttcgaatataaagcttcatgttgacttttataattctttaaaagcaatgtctgtccttgtacgttacagtggttaaagatgttggttaatgaatcagacagaattggattcagattctagctgtgtgtccttgggcagcttaattggtgtccttaaatcacagtttcttcatctcaaaattttggccagtcttagtatctaccctctagggtggtaggattttaaggattaaatggaatttggtagataaaaagtagaacatagaaccaggtggggacatattattaaaggtattatattcattgtttccataataattcaatgttcttttaacctgtcactaccatgatttatttctttttattatttagtgattccttagcttaactctccttaggctaattcttgatatcatatcttaacaatctaatcatccaaaaggaataaagataaaaatttgctaagatctgaggaaagatggcgatttttttattactttaatattactttgaaaacttaaatattaacttatttgaaattgattgaactcaaggcctacttacaacctagttgggggtgtttgctttcatttgtctgtcctttgctattatgtatgatttctaaaaatatgaataaacttaaaatcaggtatttgggcactaaatcatagaatatttactaatatgc

SEQ ID NO: 62625 - DNA, 1262 bp, Bovine  19866880410362
ctaccaggctcctccgtccctgggattctccaggcaagaacactggagtgggttgccatttccttctccaaggcatgaaagtgaaaagtgaaagtgaagtcgctcagtcgtgtccgactcctagcgaccccctggactgcagcccaccaggctcctctgtccttgggattttccaggcaagagtactggagtggggtgccattgccttctccaaaacttgcattacttcctgaatttatagtgtctcatttttttttttctgataaaaaaggagaaaatatataaattcttactatattaaaattttctgtcttttaaaaatgtgacaagggttcaactaattttgtatcaaatttcagtaagtttattcattcagtttcaagataccaaacagctgtgtactacattgtctgcagaaatactccctaatacacagttcactgaaggtgactctgaagagcaaaagcaattcttcccagattctctatacagttgtagtagaaagccttctaaggttaaaaatccagagattagcaacatattagctttcaggtgggcctctcctaaacactcacaattcacttattctcctgcaaatcattattccaaagatttgattcacttgtagccccacttgagtcttaaatagcatttcaaagcacttctatcattcatccattttcagaactgccatttagaagtgatgggaatttggcaccaaaatcaatgagaggatatgatatgagctctttccaattttttctctttgaacaccatctcaagtacagtctgtgaaatctgttttttaaagttatttttccatcttgatatcatttcaactaaattgagttctcgagcttgagatatgtattcacatagtttttcagagaaagaaattcattgttactattgttaatttatacctaaagttgttttaaaactttaattaaatgtttttactgctgatgtttctcatcagctttttactcttaaaaatatatgcctagattcaccactgtcatctcaaaatagttgcactagttacatctgtttattactgttatttagtcgctaaatcatgatcgactatttgtggctccatggactgtagcctaccaggctcctctgtccatgggatttcccaggcaagaatcctggatggccctttctttctccacgtgtttgttattaatacctactaatatatgtatacactgaatgtgttgattttctttcccctagtcagtctagattttatgtca

SEQ ID NO: 62626 - DNA, 780 bp, Bovine  19866880663570
atttatgcatctaatacctattatggagataaaccagtaaaaatgacttagaaaataaccctcctgatacaactgttctcaccttcctcttcattctctctttagaaatgaacttaagtttacttcaatgaaagagtcaatttatcagttaatcttgtaattatttttgctttgataattccttccattgctcttcattttcattagcatgtgtggttgtattttcacttatagtcttcctttttgaaagttaatgaggtctactaagacgcatattgtctcagcaatagccaaatggctggaatgcagcagcaggggaaaaattcattaaggaagagaaatttaaaaggacggctgcttctttaatgccgtagccattaagatggcagcttcctgccaccacagtagcacgtttcattgactttcctccttctcaatttcgtgtttcctggtgatgaattgagatgtaattcccacctgctatcgaaagcatatgtaagggttttcacattatttgtttctctaatagtaaagtactgctgcctaaacaagagaggcttctaaagtttgaaaccatttcatagatttccaagaataagactgatttttattcagatgttctagtggaaaatttaacaaaactcatattgaaatattttctcctaatgtgctcattatacattaaaaaaaaagatggttaaaatgcacatttcctgtttgaagttttttcatagagccctttaagccagaaatcaaggctccctattatttctacttcat

SEQ ID NO: 62627 - DNA, 1827 bp, Bovine  19866880673420
gctttgatggaaagcaggaatagaagtcaaatacatatttcataattcctttgattaaaaatgataaaggtaatattagtgtgttttcgtcttcatctctaatttataagttagaaataattctaccatggaaaagctaactgaaaaaggaaatgagattgattcaagatcatatcattgtttcatttattcttacaccttgattatgacagaatacctgatatccaggatttaataaaaatagatgcatggaatcacaatcatagagttttagggtatggaagagatctttgaaatcagttatttcaacaccctaatgtttcaggtggacaaaaaatagtctctagaaggaaaagtggcctaaccaaggttatacctcaaaagcatttaagataaacatttttcacttcatttttatttttctatttattgaatatttatttggaaggtcaagataaatgacaattattttacccattgtcataaatgactaataactcttataagatctttaaagattcacttcctaagattaaaagtctcatagttttcttcacgatcatattctgcttaacattaattagatattaaattgacctcaagtacccatcttggtccctgatctcattttgacaattctagatagactgtcaacttggaggttttcaaaacttgcagaattactatttcttcacttttcttaaatatttccttctagctatccaaattatatctctgtcaaccccagagcaaatcatatttatacataagatgaggcaataggcagacagtaaagatggaaaaaatagacaaataggtaatatgaactgtaaatttttcttttagtacaaaggtcagagctgatatgaaaagagattatgaggcatattagatagagtgcagtctcaatttacaaaaataaaaactatctcatgtacttaggatacaattaccctactcgccttggagtcatccagtgaaatgcctttaatctcttccttgattcccttccagccacacccttcacaactcttatgttctcagaatagccagtgtacacttatcttctgattctcaatgcatttgtttatttacaagtctgtgctgggattttttgttattgctattgtttctgtttttaatcctcatttgactatgagcaacttgagaacagagtctggaatatgcatacatatttagtaaagagaaatgaatacctacaagagaaaatgagcacatgagtaagtgaataaatgaatgttactacatgctattctgttacactgtttctagagtgtttgaatatgaacaaaccaaattacagtatttttagatctcagcagagtacagaatacttccaacaaaacacgtgataaaatttattttttgctttctatttttcagttatttacagttccaggccaaagtattcattttctttctgtcagaacttttaccaatttatttatgagtaccaatctttccatgaaagtgaaactttaacagttttatccattagtgggaaaaattgagcttaaaggtcaaagataaagaaaactagcttcattagcccaatcaagatataacacatccaatatattctgaatctacagttacccctaaagtgcaaagactatgtaaattacccattgtggtatgcttcaagcccaaagaattacacacctacacatgtaacccgaaaagaatattagtaccagaagaaacttaagaatttactgagaaccctgaaattcaaagaagctaaacaacttgctacattgacctaagtgacacataagtatgatacagaatgcagattctcaactc

SEQ ID NO: 62628 - DNA, 1809 bp, Bovine  19866880860977
ccatgcactcctccagaggatcttcccaacccagggactgaacccatgtctcctacattggcaggtgggtactttactattagcaccacctgggaagctctgtgctatacctatctcacttcaaattataaaaacacatggttggtcatagtatctcattacaaataattagaaaactcaaaatagggggttccagtgggaggagcaagggcttctcaggtggctcattggtaaagaattcacctgccaatgcagaagacataggagatgtgggtgcaatccctggttgggaagatcccctggaggagggcatggcaacccactccactacttttgcttgtccatggggtcacaatgagtcctacatgactgagtgactggctattcattcaatgggaggagcaaagagaatatctgggaaggaagcttggaaccagatggtgaggggacttacacaattttccatttatccaaaagtgctttatttcatttggtttagttttatgttaccccttacactttattcctttataaaggagtactaatcaagtataagatctacaaattatcctttattattggttgataaaatccctattcccaaaccaaatatccaccaccaccatgctttgggatcattaacctcatgggactatagcattcagcttttactcagctcttcaaataaggctgcatttgaaatctataaggaaaacagacaaagagaagaaggaaaggtgaagatgggaactagccctcagtggccttcaagcatgtttgtagtaggacgctttatttgcggggcaaagagaaacaaagctagagctggagaaaacaccgcttcttttcatgtaagagccaagcttcatggaccttacctgataagtttttgtaatccactaagtcaaacataacaacggccacagctgaccatgtgatgatgagagcgatgaccagaagccaggctgctggggagctgaatgtcgtcactaggtcctctgtgactgtcctcttcagcacttttccagaggccttgggcacagatccattcttgctgtctatcacagtcgtggttgtagatgcatttcctaatcaaacatttgagaaaggagaattacggtttaggatttcacatcaaatattgatgacaaaaaaaccctcacaaatcacagacttatataagtacatatagctcttttaccgcactttctacggcagagtacacctccttagtggtagggccaaactccctgtccattaccgcatttttacttcctcagcatttaccctgcactctgatacccataggccctcataatcggcattcctagtctcctaagttccataaatactgccacccaggccataaaccttggcatcgccttcaatcatttttacatctcccttaccaccgcctttattcactaccatcaagggcaatggcttttctggtcaagttgctttttaatacctttttcacttatttaggttcatacgtcaggtctaaatgcaagcaaaacatctcctctgggagagaaacaaaatcagggataaaatagttcaaatggatgaaattccttttggatatcctggtttaacagcgtaacctgaccctctatttgatgtcattcatttttatttgtgaaaggggcacagaaaatctaagagattaatgttggaaaaatcttattatatccaaaacctttttatatttgcttttaaaagtctacacatttatgactgaaaattcaaaactataaaaaatagcaaaatacataaatagataattatttagactctttattaagt

SEQ ID NO: 62629 - DNA, 2166 bp, Bovine  19866880911145
tataaagtagcagacagcagagagtagaagaaggacatcctaaaagctaaaaagaaattttcaatattagctttataacatgccactaaatactaattgattttctatttcataatctgcaaccaggtaaatgtcattcactggaagacgcaccattcctatgtcaattccacatgatggcccctccacaaaaaaagagtaacaaaaatccaaattaagtctaaagaagtaattcaaaacagtgattccacatcttaggcatgaaaatacatattgattgactggctttccaacagttgtcggaccacatgaagatattgctaatcatcccccaaattcaccaggttaaacgtaataaggaagcaaacatttagctaattaacaactatacacagaaaaagaaagggaaacaaaaacctaaatagctaataattaaagtccagatttcgttctgatgagcaagataaaaatctcagctcatcatccacttaacgtttagacatagtgagggctttgccaagtaccacaaaattcccttcattgaaaggcccacatcttctagcttttcttctatgatcctttatcttgttagtgtttcagtgtttgtgcttaaaaactgttttttaattattattattatttaagtaagacatcctgttactctactagagataagccaaacacgggagactgagaaacttggcaatctgtaaatcattacctgaaggccttcgatagccaagcgcagcatgcttggtgtcagtttagaagcttgcttgaagggtgaagttactccagtctatgatcaaaacaaatccattcacctgaagctcaggatcttcaatcatggcttctaaagaaagtaagatggcacgcaaaatatccaccagcgtgtacctatcagcaacagaaaagtactgcattaaatctgacatttgtagaatgtagaatgaccatttgtagaaactatggaatgtctttagcatactaaaaattgcctttaaaatacctcagaaagcttaaggaaaatattttgtttacaaatcttctaagatgaaatttactttattcactatactcaggggacatattagaacttaacatgcattctaccaaaacaaattccaatgcttttgaaaattctacagtttgtttcatattttataatcatttcctttctttgcaggccttcttataaccttacaaaatctcattttcagcaaatgtactattccctaaaaactaggcatggtacttttaaatagttcaggaatgcttttaaaagtactgacatttcatatcttcacatgtggaaaatttgagaatgagatttgaaggagtttcatcaataaacaacaccatgtgtaaacagttgtggttgaaagtgtcaaccaattttaattacttggactgagtttatatcataaagataaaagaaaagaaaaaaggaaaggtgggatgggtagaaagaaaggaaaatcagtaaaatcaatgaaaataaaagggaaaatgtatctgcctattattacacaagccacccacattcaggagttgagtctttatctttttctaccttgcagcttagcacagtccctgacacactgtaaaaatccaataaatgctcttcctttcttgtaaaacagagctcgagtgcaaagacactaattgtacacgacggcattgtctcaacaaaggcagtggaagtaagaagaaaagaagccaaatttgacaagtatgtttgaagtaaacttgtgaaaatttaatacttaattagatgtgggggctaagattgagggaaaagtaagagatgacacagattctagtttcagatccttgcctttgacagtaccagtaagctatctaaagtaaatggtacttcaggttttaccatttatcaaatggtaaaatctttcatcaaaatcaataatgcaaaaaaaaggatgctgttaaggatggctggaaatgtagaatttggaatagaatagcttgtatttgagaaacgggtagtatacccaggaagatatatcaagtaaacatctgagaaagtaaatttcaaactcaggagaaagctcaaaattgaacattccagaaccaaaagcatatcaatcccatgttcacagaagtgaaggaggtaatgcaatcagagccgagaggaaaacgaggtaa

SEQ ID NO: 62630 - DNA, 1710 bp, Bovine  19866880944555
ggttcccagacagacagtctttgcaacagccagcattctgtcaaccaaccacagacttctcgcagctggccaggaaagagaatgataattgcagcttgcagtatgtggaatatggggcgggggaagctagttaaatccacatgagtctaagggcttaggaagtagaatagagcaaagcgtgggtagaaagaagctaaaggagacaacaagggattattctgatttcatcacccatgatgtcagctgactttaatcactgagctttttcactgatgaaaatggtttggagaaatcttgaatttagttcttctttcctctttatcttatccagaattgttttctattttgttttagcctcaaagagggtcagtaacacaaccctcacccctgcaccctcgccaaggttgtgagagtttagggttaggggttggacaggctgcagagaaggaaggcagtaatgctgggcctgcatgaaggaggaacggcagagccagtactcaaagcgggagagaccatcagaatcaggctaccttccagctgagccttctcgttcacaggcactgttctgacatttattttattgatgccaaatggttgtgagtgaaaatatcattgtagctggacattctagatcttctataaaaggctcatgaatgtcaaactatacaactgcttcatggaaagataaaaatattgttttgctatggtaaatcccccaagtgaactgaaaatattcgacacttctgttttttactaaaaagtggaattattttatttacttacttttatttaaaatttttattttgagatcattgaagagttacatgaagttgtaagaaatgatgcagagagagcccatgtatctatcacctagtgttcaccaatggtaacatctttgagaaatgactgatactataatatcccaaccaggagattgacatcaatataatccacctgtctttaataattatttaagaaataagagattttgagtattatgtgatacagccacaaattgttacaagtaggtgaacaattgggaaagcactgctatataaatcaaaaacatgcttagatgactttatggattttgcaaccatatctgaaagtattaagacaacttatttatttcttatttcatacaacctgatttatgaaggattataatttgttatccctcatctgttgcagtagccgcagcatctaaacagtgcttaaaacatagtaggctcttgatattttttcaatgattcacatatattaatataacaggaagtgtttgctattatagaggtcatttttgtaacttccttcagaaatacatttaagaaggattgttgaacccagagaacattattgacattatttcctcagataaatgtctattttttatttcaaaagcattatgtgaagcaaactttggttatacttatttaaaaaattccttcctttagtctgtgcagcaatgacttttatgcatatgtgaattcaagatgtattgctttaccatctgaagaaaaaatgtctaatttggatgtgctggaataataagaaaataggacattgaattttataactgcatatgaatattgattgcattataaaatcaacgatcccaaagattgaatattaacagcctgccacatagcgagaaaagttaaaaggaaatttgaatcttagaagtgagtttctaagcaattgaattgctga

SEQ ID NO: 62631 - DNA, 929 bp, Bovine  19866880951798
ggactttgctgaagatgattaaaaagccgaaagagtaattcaatttacttcctgagttaatgtgtcataagttaaattgctactgtaaacataataaaggtcacagtggcatgacatttattcatttatttatttagactgtaccacgtgacatgcaggatcttagttccctgaccagggatcaaatctgtgctcccagcagtggaagtgtggaatcctaactctgccaggaattccctggcatgacttttattgttgatagaagaatgtagttaaaaaacaaaagtgtttatatcactgagagacaaaggatggcaaaagtatagctgttttccccagtgatgcatcatcaaataagttaaagattgttattcatttcattagcactggtaactaattacctaaaaaacaagtaagatatctcatggcaaacttaatggttaaaatgtgttccttccactttgatgacatttatatatttttttgttttgagcaataaaacctatttaactccatagaatgatcctattaaagtgaaatgaaaatcctcttgcatctgtcgcccaaatttggtgactgatctaaaatttcacccaggtgacattttactagggcacagtctggagaaatctggctagtctacatctcatttgcttgtatttaaacaaatgattcaccagacttgcctaattggatggcgtatttccactggagtgaatttcctaattgtaattcaagacaaatcttagggataagattcatcaagcctttccgctcaatcttatcatgtctaaagttcagaggtattttgagctctaaaagagcattacaaggaacttaaagcattctttggtgaaactgttacccatttttggagaagagtcacaagtaaaatagatatatatatacagaaataaaattaaactatg

SEQ ID NO: 62632 - DNA, 1749 bp, Bovine  19866881089170
atgttacaggtgtagagagttaaaaaagtgaccaatggtctcagaaaagcgtgagcatttgcccactgtcacagtagtaaatgtatccaaagttgtgtcagaattgtgaccttggctcttgaatgatatgtatttgtgaaacagaggcttagatgaagatatgagtgaatatttgtcaaatgttctctggatcagtatgaaaatgaattgacaagatccaaagatagatttggtgaggacagttaagaagtcatattagtgattcaggagataaagtgaaatatatggaccctaaatagaatgtatttacctcctagaacttattgcatgcattttgaatgcaatataaaatatatacagtttgtattatctttactttaatttttggagtacttttgaagttctattattatcacagttttagtaacttgattattggcttgttttattgtgcatgcttatgtaacattaacatttatacaattttaagatcatcgaaggttcattcttgaatgctatcaatccttactttacaaatatccaattaaatcttatgaaacatagatcccacagttccccacctacttcactgttggtgcaagatgatggggagaaaataatattgcttgtggagaatctccaaattcaggctgagggaaggaaaggacaggtaaagcagaacagctcagggggtaataagcctgggggtgattagtaagaaccagcacttgggcagtgatctattctatttccacataatcctaactccattcaaactatcctactctaaacagctttatttgaaattctacttctgatgaaagaaaaatatctcctaaaatttactttaattcaaatatttttcaaaggtctgagaagaatattaagtacatgttgtgattccagttgtcatgtcctagatttagttgagattcatctgtgagagttctaactgaacctaaaatgagagggtagtccaggaaaatgaaaatacaaagcgtgatactttctggaataaagcaagtctaggttaaattggagaaggaaatggcaacccactccagtgtttttgcctgtagaattccagggacggaggagcctggtgggcttccgtctatggggtcgcacagagtcacacgactgaagtgacttagcagcagcagcagcaggttaaattttcaataagaaacgaatgaccagcaccaaattgcttctgtcctgccaagaagggacctagaagaagtcagagaggtaaaaaggaagctcataaaatgccaagacaaatatcatctgctttaaaatatctccaaagaatgactcaagcttcagcaaagaaagaaaaatccttctacaattattctcctttttgtcatattctatcctcttcttataccaagagggctagcatcttcaaagtatcttacaggatgccctgagaatgaacctgatcttgtttataacatgtttccatggcaatatgctttctgtgttccaagtgacatgcaaatgactttgggagcatgcttcccatacaaactgaggattacctccaaatatatagatgagaaatgcttgctacacaaacaatctacagattgtgagttaattcttatttctctctctagaaaaagctgaacatcaaggaaaagaatctccatctatcaaaacaggtgattttgcctttttggtttgcattctatcccaattcactgtttttattacctttgaaaattaaagcaaagcacataa

SEQ ID NO: 62633 - DNA, 769 bp, Bovine  19866881142048
attctattataatacagctgtgttaacgtaatagtatttgctttcatgattcacaagatccttccaaaatattcagtgttttactgatgccagtattgatatcatttataatactggtaatgttgacttggggctccccagatggtgcagtggtaaagaatctgcctgccaatgcaagagatacaagagacatgggttcaatcccttggtcagaaagatcccctggagtaggaaatggcaacccactccaatattcttgcctggagaatcccatggacagaggagcctggtgggctacagtccatggggtcacaaagagtcagacagaactgaccatgagcatgaatgttgagtcactattgagatactttaaaatatcatatctaattgtacatattatatttcactgaaaattaattatgaatttcaacttgttataatttcttaaaatagaaatcatccaattctatagtagcttaatacttttaaaactgtaattcaatttttaaaatatataatacttagcatggttcaacaataaagcaaccagagattcactgcaaaaataagcttccctcctccccttcttttcctgttttaccagctcccatttcccaaatatccaataatgtctgataggtaatcattgttattttttaatgtgtccatctagcaatatatgtaaaagacatatacatataaacatgtgcttagtcactcagtcatgcccaactactctgcgaccccatggactgcatcccaccaggct

SEQ ID NO: 62634 - DNA, 855 bp, Bovine  19866881168009
caatttatactagatataaactggcacattgtgattaatttaaaatatttaattatttttctaactttgaacatttaaaacgattgtaaaatcagtaatttccacttaacattgtaacacagttcctagttcaagcctcaatatagaataacaaagtccagtatcttaaaaacaaagaaagcctaaaggagattgggggctggttactatatatatgataaaacaatatatatttcatgtgtgattaatcatcactgataaggagaaatgaaactacctgacaaatgaaaagagtctcctttgaaagttatttgtcacttgtcagactggtccctacctgagtttcaaaatgtttatgatggctttggaaggaacacttgtttctgttcattttctatagctggaaggaaatctaatatgtagagtcatatttaaattaatgattgaggtatgagatctaattaactagaggcaaagtaaataatgccaatattccattttcataaacaggttatttacctccttgcatttcattctgagcctagcaatcagttctaattaatcccaaccaaaatgtttggccttactctaaactcagagatcattcttggttgaatatttcagtgaattcacttaattaagattcaatgttaattcagtatgtctgtttactcgaatgggacttgactaactccatattatgtgtgctcatatttctaccctaaatatctaggctccaagtgattcagaatctgtgtatgggtcagctactagttttcgaatctttccttttaactctgtctccagactgtcttgacaatcaaagatttcttgacgctcaatatgtgaaatcta

SEQ ID NO: 62635 - DNA, 1123 bp, Bovine  19866881201268
tgaatgataacgtttgaagtgtgtgtgtatgcatgtgcttgctgtggatccctttcttcaaatgaaatcttacacagaagtccaaaaaattggttagaccatcagtctcacgacagtggagaagggcactgtccccacgccaccccacttgccctgaggcactcaacaagaaccttaaaatacagtttgaaaagccactggattgggtgacttctaaggggccagctagactctgtgaatctggagcagaactctgagttgaggttaccttgaatgactttatctttgactcaaaactcctagacatccaaatacaggagcatgaaaggcttcaaaatcccaccaagtatctactttagaaaaatataaaatctggagttgtatgaagcgtccccaccctggcccagcccacttcccaggtaccctcagcttacctcttcatggacttgggggacagttccttctctacctccttgacaggcatgctgtaggagtccacactgtactcgctgtcatcatcatactcgtggtccagcagtgttcttgcccaggttcccatgtcgtaaggggggagcattcctccaaactcagagggcagaatctcagggtgaattagttggtgcaggctgttcaggttgttaccatgcaaaaatatctacagacaagaagagggtggggaaaacccacagaggagaatgaatgccatgtggacaccaggggttggggtagggtaggaggaggaactgaggatagaaagagccagaacaagagttttccatgtctgttagcatatttaagcctctcttctactctgtgaaacaggcaggctggtatcataatcttaatatttcatataaaaatcctgagggtcagggactttaagtagcttctagaaggtcagatcgtttttaaagaattggaactgaaaatttagtgtcctgcttcatagctgggaacatgagcagaatctaatgtgcctacttcgatctgcacattatcctggtgttagttgtgcaaagctgatgatgtgcataatgaacgctattaaaacagacttttctcatgagggactcatcaactgctgagcccattcaagttactgaaccccaaagctgtcaccagt

SEQ ID NO: 62636 - DNA, 955 bp, Bovine  19866881330847
gcctatccttgaggtgatttttttcaatcttttggaaataatatgttttccagttcttcatgtgctgaaggcctagcctatgcttcttgccagcgaaactggaatcacaataatcaagggctaagttaccattctgtgttaagcaatatgctggcggtaactaattttttctgtgaagaacactttacatgctgctggcaatagggcagaattaggactgattctacctgatatacacatttccaagtgttgccctctctccaactcatattaagtatctctatggagttaaaaaggaaatgttgttcaagataaggtagcagcaaggctgactcaccacgagcaagtcaagaagcctgcatcaggaaaaacatattcatataaaaaaatcagttttttattcactccagaggcaaaacccaaactgtgaattcaatttggttaggacgccctgctgcttggaaaagtgaccctattttagggggtcatcatccatcactttaggtgcctttagacacagtcagaaattattatgaagaatgaaggaggagaaggggatgacagaggatgagatggctagatggcatcaccgactcaatggacatgagtttaagtaaactccaggagttggtgatggacagggaggccctggtgtgctgcagttcatggggttgcaaagagttggacacgactgagcaactgaattgaactgaactgaaagctctagataattttagttatttgacttaaagagaactaacatcctggcctaatgaatgacaaagataaaattagttattttatggatattttcattggtaaaagttacaaaaatttaactgcttcaaaattctaaatgcacgttgaacacactaagaataattactgaataacatcacttaagaattaatttgcaaatctttttaagaatttaaattttatttccataaatatt

SEQ ID NO: 62637 - DNA, 716 bp, Bovine  19866881352855
aagtggaccaaaggaaatatatttcactacaatgaacatatttttatttaaaacttttttcttttgtagaatatcatagaaacaatgagtttttaatcagcatgtattaatttataaaacatttgtaatacatattctgcttttaaaagcatatttttatattattatgtggggagagattctatgagcttatctctaccttatggattattttataaatttcacattttaaaattttgttttaagaattttttaattgtttttctataatctggaattatattctctaaaaatatttgattttcacctgtctaaatgagtattaatcttttcattagtactctttcccattcagataaattgaataatatttagccattttatactacctaaattatcaggttgtggcattatttatttaactgtgtctatgtgaaacattttgtttatatgtgctaaaaatgttggtttcatttgtccagttctagctatttttaccaaaatgaaaattcaaccaccttgttatttatgagtggggtttgcatttctaatttgataaggaataattgtccagtcacataatctcaggtttataggattgattattaaacaggttcttaatatggatgatgctttagaatctgctcctctgtggtttatgttgttatatagtgaactctgggagttggtgagggatagggaggcctggcgtgctg

SEQ ID NO: 62638 - DNA, 1037 bp, Bovine  19866881362721
aaggccctgcaaagattttgagagaagggaaatgcatcattaaaagcattataggctgaggagcagctggggggaaaaatagagatgaaaatgtacataatgtacataatgggtattagaaagtagattaatttaattgtatcttagcattcatgaaaaagtaaagtaggaaataaggttgcaaaagttaattgactcctaatagtaaaaggtcataaatgctacactagagtttgaatgttttttctgtgggtgatcagtcaagtgtttgaattgacaggaaaaaaaatgtattttaatagaaaagtctagcgggcctgtcataaaggatggattaaacagagacaaacattgtaatatttgcaacatgctgttggttaacttaagcagatcatcaacctgcttgtagtaaacactgatcatggaattcaaaggtagcaaggaacttgtgtatgaaaacacagattgatgaggcagtttttgctaaaagcaccatgagaatagttctcatacgtcatcttacatggagaatgctgttggacctgaagaagcatcaccctccttagtgaaatgctcataacctctgcacacgggacctttaccgagccacacagagagccgagtcaaagccctgtgccagctctgcagccctgactggaaaaaagacaggaagttaagagtttatcaccgttacactgttgccttttgctatcctaacatctcgttttatgtcatttttttccttgcttctttgaaataggcttttaaataggctgttaataaaagtgtgtaaatttaggtcttttcttgttcagttctatctgtgcttgatctttgatctcatctcttgtcttatggggctattataagagacagataagagactggattcttgaaatcttggtgtcaagtttaatctgcagtggagtcctaggtatccaaaatccttatctcctgttctgtttaaatgttctcagggctatgggagtgagcagcaggaatgagtcatgtgaaatcaagctttatgccacttaaaa

SEQ ID NO: 62639 - DNA, 1359 bp, Bovine  19866881410125
aaacttctgtcggagtcaggtcagataagccctgaagatgtatggtgaaggaaggaaaaggattcaggcagaaggcaggaaaagggctggttgacaccctggtactgtcagaaaggcagctgtcctgctggtttcagagcagggcagagacagtccttatgcacatgtccccatgataaagcttcacagaagatacgaggatggagctgtttatgccctgctgctgctaagtcacttcagtcatgtccaactctctgtgaccctttgtatgtagccctccaggctcctctgtccatgggattctccaggcaacaatactggagtggattgccatgccttcctccaggggatcttcctgaccaagggatcgaacccatgtcttttgtgtcttctgcattggcaggcaggttatttaccacgagctccatatgtatacttagatctgggatgggggtggcaggaggcaaagagaagcaagggggagcttttttaaaagaatctaggaggaggaaactcaactgaattttagacaagctctaaataccatgtatacattttgaccttgaagtactattattagttggtcataccctattcatttaaaccttagaaatagaattcacaattattagtctatagatcctgtaaggtatttttacaggacatagcttttcattttaatgtcccatatacattaatgttacatatgttgatttaaagaaataattctatatatcaattaataagtcccctcccattgtagatttctagggagatattttgattactagcaacttatactttatatgaaagcatgagatagacaactaaaacatagtttctttagtaaatccagaataatcaccttctcatataggtgagaactacaagtgattttcaacttaattaggtttataaatcaatgtgaatattagatcacttataaaaataaaggaaaataggtctaatgtagatttatgtctctaagggctatctgcctccctaaggatatctttaacagactctgacacatatttaaacataccatttccacagctcccactccatggtagctcaataaactaagttcctgcctaactgacatatgaaatattagattctttcttgaataaattttttcgactttgatctacacaataactggtttgcataaatcttcaatgtactccttagatgaaataaaaactttttaaagagaaattgtggtcaaagatggcatttcatgagactttcaactttgctacctgataaaaagcagagtaaaatctctataaataaccaaagtaacaaacagaaagagaacttcatttcacctcaacagccaaatccttcaatgag

SEQ ID NO: 62640 - DNA, 1685 bp, Bovine  19866881587167
ctttgaaaattattctatatgttataaaaaatagtctaggaaccttgtgccagcaaataaaagcaatactattgctttaacatacttggcaatagttttcttattaatttcaaattttcccattttatgttcatcatagatccccaggtggctcaggggtaaaaaatccgcctgccaatgcaggagacacaagctcgatcccttggttggaaagatctcctggagaaggtgggagatggcaacgccctgcagttttcttgcctgggaagtcccataaacagaggagcctggcaggctccagggttgcagaagggtcggacaggacttagtcacctagcaaacaatgacagtagatgcacaaatgctttaaatactattgacagaatgcattgggataggtgtttgtaattaatcacagtttatactttctcaagatgtaaatgaattttaactcagtggtcatttacaagagtgacactccctctgtcatgagatctatcacttcattgtttgcggcgcaggaggcctttcaaagtctgtagtctcctggatgtactgggtacccccttgaaaatgcaatgggggcccaagggaaaaaaaaaataactatcagcattagagtaaaaaatatcctcaatatttgtttcaagatttaggaggtagactttagttatctagagatggtttagaactaggaaatctcctttgattaaaaaactaggtaaatcaagcttcagtattgtgatttgctttttccttcacattacctgaattctgctcatagcctccttcttgatttgagattctgagtaattcattatttctagtaaagtaaagaaaacatcagtaacttagatcattaggaggaatgcatactatatgtcatcctcagtggaattagactaaaccgaaagcaatcatattgacttgagtgagaaaaaactcagaacaataaaatattggcagcttacaaacatgagattcaggtattatggaaataagccagtcaaaatcactcacggaacaaaaataaagccaattcactgtgtttgaatgtcagagggattttcaggtaatagcttgtaaaatgaagggcacctttagagatccaatgtaaatttcaacaacgtaaattcttcctttagagagtaacaatcctcacaaattccaaagaaatatattcctaataaaatgataagcctctttcctgtaaatgagttctgctatttctgtcatgtttaattttatctgttattatgtctttgttgtcttacttcaaaagtctgtttcaagtcctcttgtgtaattaggtgggatataaattgtaaatatattgtatgagaaagaatattttgagtatttactatgtgttagatgtttcatttcttaatcctcacaacagctgacaaaaactctcctcattttagaaaggccatgaagcttggatacttcatgacattttcaaattcacacagattataggcagtggagctgaaactcccatatttatttgattccaatcatgtaggctttataataaacagcttgctttcattataaaattatattactatatccataaattattatatagatataattttatattcattcatatagaaaaaatagtgtgtaatttcagtagcattttctgacattattgaacataaaagaggccttttctg

SEQ ID NO: 62641 - DNA, 1117 bp, Bovine  19866881596912
tgagaattgtcctgacttactagaatgatatttaaggtactctttgtatcagtaagagtgtcatcttaataatctgtcaacacagatccagctggacagtttcaagactttcttctactacataatcctctctagtaagccagaagataaacagtttgggaaaagcacttgaatgtttgtaactgtagcctaaaaggaagtgaaccaatggatatctaaggaaggcactttcaaaggatgatttaactgaactggaaaagaaatcctagaaaaccaatttataacatacagtcaaatgtcaaaaacaattgctttcaagaatctaaaatatttcactggtatattatgtggtctatttccacttaaaaatgcccacttatagttggaacacatagggatttttttaactccacaagttttacttttcttccacttgttttcagtggtggcctttttgcacatttaatgtgtgctgaacacttggggctataagcagggcaaatatatgtatgacttccatgcgctttttgtacaaaatttacttcaaactttcatgaagtttagctaattatgttccattagaacaaacctaggtcctattaactgattgttaacagatatgacacaataacaggattctcaatattttggagaataaaaatgaaagagattcaagtttgagcagttggtatgaaaatatgttacaactgaaattatatgcctcaaagtaatagcaatgaagcagaactgaaattgttcttatctactaatgagacatcatcaacaggatgacatttagtcgcaagcatattcactgccgcggacaagcctggatatgctgcctttatttacagagtgacaagtctgggaaattcagcacaatgttagttttctacatgtttttctcttgaagtatcttccatttgacagactctttagtattgtatttggggggactcatctggggtctagtgttgcttataaaaaactgctgcccagggagtgagcattcagttggtgattgtgttaaatatagctgaggttcatatacatccatccagaccttcacacacacacacacacacatgactcttaaaccatttatggaacctttttc

SEQ ID NO: 62642 - DNA, 1040 bp, Bovine  19866881888363
aattcctataaacccccagtaccactatttagccttgtgtaacacaaatcatctttctatactttgataaatagtattgtgttgcgtgacccctgaggtccaggtattgtatttgtcttatgttcagtgtgcccagttcttaatccagtgcaagtatataatgttctctcaatatcttattctttaaactcaattgaatcattagccagaaaccaatctcttctgacttttgagcaaggtttccattatgacacgagattatcaacaaatagtagtaactgaagaattaatgtttgagtttttacagaaactgcagttctctgcattcacattgccattccattgccgttccattccattgccatcttgattgaacagtgcaattacatagagtgttaattgtctgctaataggaggaataatgataaaattgcatagtacattcatgtaataacactcaaattactgttttagattcctttcccatttataatcaagttcagcgatgctgatccaatttttaacaaatacactagcaaatagtgttggtataagtattttattgaaatcaggaatctaaagtatatagtggaattcagcaatgcagcaagatacaaaatcaacacacaaaaagtatttgcatttctgtacattatcaatgaacaatctgaaaataacaaaaacaattccctttataatagtatcaaaaagaataaaaccctttgaaattaatcaaagaggtgaaagacatacaatgaaaaacaaaacactcctgaatgaatttaaagaagataggtaagtagaatgacattccatattcatgaatgggaagacaatattattaacatgttaatactatcccaagagatctacaaagttcatgagattcctaccaaaattccagtgatttttttttttttgcagaaatagaaaaactcatcctaaaattcatatggaatttcaaaggaccctaaatagccaaaacaatagctctaagactcacacttcctgatttaaagacttacaataaagctacagta

SEQ ID NO: 62643 - DNA, 1825 bp, Bovine  19866880571393
ctcgaggtcacacaattaatcaggacagcagaggcagaactcataaaaagatgccttatatttgagggcattctactaaagttagaagaagaaagtgttcccctatagctttcaaggttttctaaatagtaaagaaaaaaaaattaaaagcacaaaattttgcgtaaatttgtctacgtttttgtcctatgttttgactcaaattctaacactggtatattgttttgcaaatagggccaaacctgctggcttgttcctaaggaaccttgcagtattatatatcatttgtttaaaaggcataaaacatccctaagttagaaaaattcatttaggaaagaaaatattatctttgctaagccatgttctgaaagaggaggatttacttttctaccttgttcttcacagattctcagcacactgaaccctgaataataaaaggtaaactaagcagtgcgctacacgggccaactatgtacaatccaactggaatgcaaaaagccctgctcaatcagcagtcatgtagtgtcatgaggcaacacatgtgtttttataagcactcattaaaagttagttacaattcgagatcctgtccaaccagtatggtatgccccaagttagtgatcttaagagagacaaaactactaaccaacaattgtttaacatgtattaaacaaaaaagaacaatgatattaatttccttctaatagcatatttttggaatttatggaattaactcttccaagcataataattggcagtggccccaaaccaaatgattttatcttttaaaatacatcagcattgtacatcatttacttggggacaggatacaagggcaattgccatactgaagctagttaacttcttcaaagacagttgccttgttctggtcacattagaatgtcctaagaataatctgtacctgatgacgattgattgaggagtcaagtcacatcaggaaaaaattaggtttgtgccatgattcgtttagtccagctattcacatgtgacttacttaacttcagttgagagcattttctcattcttaaaaagaaaggtattttttatgacaagaatagaacaagctaaggtattaaaattaaagtatgttctgaaatgaaagatacaagtcacctacaacaaaacactactctattttatttctatagttttttttttttaatctaaagttatcctatagttcttatttaattctcacatcagccttgtgtggaaggaagaaagtggtattgctatttattgctattctaatttatagagcattgatataacttacctatggtcaaagagcgactccacagccacacagggaggaatccgaagtgtctactcctgtgctaccctgactccaaatttaggactctttcaaacagtcaaattataaaatgtatcacagcttagaagtaagtacaggatgtatcatgaccacatctctgctgtctacaggaacaatttgaaaaaaagtacgagctagtgtctactcagtaccgtgctaggcaacacaaagattcagaagatttccaatacacagttctttcctcctagtgcttcaaacctagttgggagacaaaagtaaagggcatgatgtaaatctgaatagtgagcaatatactgtcaagagttaaaagggtgtttaaaataagagattaattgccagcttcttcaaaggtggcttttggaaggatttagactgagggatggggcttcccaggtggcactagtggtaaagaacctgcttgcagatgcaggagacatctgagatgtgggttcaatccctgatcaggaagatcccctggaggagggg

SEQ ID NO: 62644 - DNA, 1067 bp, Bovine  19866880664380
agatttttatttaaatatactaggaaacagttgaccttgaaatcatcatatgagggtcaaagaaccaccccacggttcgataatgaggagtttaaattagagcaaaagcatcacatatataaaagtaaccctaatatcgttttatatggatgataaatgacaacttatcccacatgactattctaagtttattaaaaattagatccagcattatgtcctacaagtattcacgtttacaggaaacatgatatcatattgccacaatgtcttgtgataaagcctaatgatggtatatagaatattcacatttgcaagtatataccatgatgtcaaatatattactcaatgtgatgacttcagggtcatgagtaatgtcaaaacaaataagtcagccacctggtaagacagggcggagcatttaataatatataaatctttataggacaacaaacatttaaaataatccctaatttagcttggtatttcacatccctgttgaaaatggccttcaaaacaggtgtgcttaatataaagttaaagcagaattctaatgccaatgaatcaccactgaacattattctacctacatagttctatcacctacaagaatatttctttgttaataacatataactctgccaaaacaaaaacaaaatgtgttacaactcagtttcataagggcaatttgaatcatattatcttcagaatataactaatatacttggaatacaactattccagttaggagtgaacctgataaaatatctaagaaaatgtccaccataaagttcttaaaatgcaattcaacctcatgaggaagtagatcaagcggaagagatttaggatgaggttgaaataatcagctccaaacctaaaggaaagttcaaatttactcttgatagttttagaagtcaggaatcctatagggactaaatcaatcactcagaaaatcaaatcacaccaatttttacatttcaaagaaggattattatgaagtcttgttgtatatttaagtagttaatatgatccaccaggatgcttgtctacacccactaatactatttctg

SEQ ID NO: 62645 - DNA, 1613 bp, Bovine  19866880813984
ctgagagatctgaatgacagcatatgcctaaattagactttaaagaaccactaaaagttgcttgagtatgatgtttgtatttcccactttggtgtggcttgttttcaaaatggatcatatatatttgatatcagagattataatttttaatatattttgcatcaacatcttgattttcatatctcaaatgtgcagtgcctgtccaacaaactcttctggaacagaatgatggctgaataagaccaactgtaatatttagtaaactaacagtatgcattgtgacacatcattctcacaaatcttaattgttaatattaaaatgtaaatgaatggcatttattcaaataattcattctaaaatcaaccacattcatctcatacaaaataactagttcagtgataaaattattgagagtagaatattttttgctactaaaagtcactcagttgtgtccaactctttgcaaccccgtgaactgcagcaagccaggcctccctgtccatcaccaactcccggagtccacccaaacccatgtccattgagttggtgatgccatccaaccatctcatcctctgtcgtccccttctcctgccctcaatctttcctagcatcagggtcttttccaatgagtcagctcttcgcatgaggtggccaaagtactggagtttcagctttaacatcagtccttccaaagaacacccaggactgatctcctttaggatggactggttgggtcttcttgcagtccaagggactctcaagagtcttctccaacaccacagaagaaaagcattgattcttcggcgctcagctttctttatagtccaactctcacatccatacatgaccactggaaaaaccatagcctcgactagatggacctttgttgacaaagtaatgtctctgctttttaatatgctaaactacctggggcagaaactgtcttaccctttcatggattctcccatagcacctgggacagtttagcatgagtgaatgaatgacagtacttcaatgttcagagctgtgccataacatgtccacagatccatttataaggcatgataaaaacaaattatctgaagaaaaaatctgccctatgtattctgcccaattccaatggaaggacatcaaagtgactggagcataatgaaacagagcacagcatttcaaaatgactgactcagggaaaactctgacagcatttaatgtagtcccagctgaataaagatttcagctctccttgaatgatttcagctctccttgagtgatttcataggtaggcggcagccagtccagcctctgcttttgattagcagggcttaagatgaaatcatatctctcagcgtgtgcctttaaagtgatagctgagtaatggatggtaatttcccatctattatgataaggctcccttccaatgggtttttgtgcattctgctaagtgactctggttttcatttccccaacacatttttcttcccttaaatgcccttctaatatgccttattttgacactgaatggcttagtacaatttgcaaagatttgtttgtctctgctatagattgattctttctgatctctcctcgatttggtaaggatgcatttgacctc

SEQ ID NO: 62646 - DNA, 1349 bp, Bovine  19866880876569
actctgtaatatatatggctccctaaaaaaccgtaacacatattttccttgttgctgcagtttggtaaatgttactacagataacatgctggatgttagggcggcagtgcctcagtcacttggtgccctccaggaagactgaagtgagcttaatttgccttactttgacacacccctaggctactgagctgaatgtgattaaccccctcggtatagtagtattaatggtaatttcctttgcattagtcagttggggtgtgctgggatcatggcctgcttgcacagaaccaaccttaaatcttattttgttttttttttccctttctttttcatagttgagtatcttctgtgccatcacttctgacttcattctgatctttgctacctcttgctcttaatattcaaacatctaccttgtttatacatctctggtgttaggcaggctctgctataattctaacttaatttttacttttccgggtttcttctggcagtttgaaaaaacataagtctttaatttctagttcagttcattacaacaaactcttgaaccctaaaagaatcaattatcctttgtacatggtagtaatatgagacagtctgcattaccaagaaactattacaaaagagatcaaagtaagatttttttttcagtacacgttattacatcaggaattgccacaagtcatttcagttatttcttgtgtcagaagaaaggaaggagattatagtatgtcattttatttaagaacgatctttaacactactagtcttactgttttgctgagaaaggactcaggtgttcatcttttttccattgtcattgagcaggaaaaagttaccaggagaagcaagttcttaaattattatttcattcaatttttggaacttccttctgctataaaagtaaagtaactgagtcccccgccaaaaggaaaaccttaattttcacaatgggccatctgttttaacattgagctgacctttcattttgtgaattgattgccaaaggggcaagatttccttctccctgggagactgttaatattctgtgctttataatgcactgaacgattttagtaactagcaatgcttttcctgcctcattcagattcatacatttttatttgattggttctatgctgccaccatacagaacacctaagtaattgtcacaaaatatgctggcttgctttcttaacatgttgatttgtaaactttttgccttttgtgggaacttctgaggtaaggagaattgagttaatcttaataaacttattgcttccttgatacctcagttggtaaagattccaccctgcaatgcaggagacccccagtttgattcctgg

SEQ ID NO: 62647 - DNA, 1927 bp, Bovine  19866880881527
ttcacaggtgccagactgaggaaactggctattactttgtatgctctggggagtccataatgttttctgagcaaggagatcagagatgtgctttaggaagagagctgagtctagtaacaagtgaggagagattgaggaagatggagcaggggcccatttgggaggctgttgctgtagtctgagtaattgacatgagatgttgcacaaaggtgatggggaagagagagagggcacagactgaggatactgggccaaatcaatatcgatcagtgtttgttgatgggaaatgaggaatgggaaaggtcccgaaagattcaactgcaactttctcataaacagaaaccaaaaggtaagaggaggaggcacctgtgaggagaagatggtagaatcactgctggaatttttggctggaggccagcctgaacagaggatggacagatgggactggatgacagacaaaagaaatgttgggccagtgaagacattggcagcgtgtgcatggagatggtgttcataaagaggaggcgaagaaggagggaaaggagctggggaacaggaagagcactgggaaagaaagcagagaattaggaagccaagtgagggaggttcaaggaggaggctgtggtcagtaactcagagtgctctgccaaaactgaagaggatgacgcacgggaaaagctggctgacatagagaacaggcttgtggttgccaaggtgggaggaggggagggcagggaaggattgggagtttgggagttgcatatgtaaaccagtatagacaggatggataaacaacaaggtcctattgtacagcacaggatatccagtgataaaccacagtgtaagaatacatgcagtgtattatatatacatgtatatatatgtatacctgaatcactttgctgtggaacagaaattattgcatgcatgctaagtcacttcagtcgtgtccgactctgtgcgaccctatggactgcagcccaccaggctcctctgtccctgggattctctaggcaagaacactggagtgggtcgccatttccttctccagcgtgtggaagtgcaaagtgaaagtgaagtcgctcagtcgtgtctgactcttcacaaccccatggactggagccctaccaggctcctctgtccatgggattttccaggcaagagtactggagtggggtgccattgccttctctcaacccatccaccacccgtgcccaaatctcctgggacttttgtgaacgccacttctgaggacttcctccagatctacagattcagattctctggaagatgatgcccaggaaatggcattttaacaaacaccccagatgtttctgattcatcccaaggtttggaaacagcattgggtgctcagtaaaaatgcaaagatcaagatgattctgcatatttacttactttgtggggatacaattttctgtaagaatcttgaaaacgttttaatgaataatatatttatcccagcaactctaaagaccaggcagtcccactttcaaaatgagggaatcaagtcttaaaatatatgtgacatgtccaccctttacaatcaggaatcaactacttgcacctagaggagagggataaacagttacccattcaccgattagtgcattttatactgtaaatctaatccacttgattaacttatgtttgtatgcaattcctagttaattctttcttgtgggggaatggtatttttctaaatttataacttcagtatgctccttagttacaaatagactccctgactcaactactaattgcacgttcaggacactcttttattcttctgtacaacccccaggaatggtaaattttttagataaattacttccttttcttcctccttaccactgattaaaggcaatccactagccaattctctcacctgctatcctaccatttcaat

SEQ ID NO: 62648 - DNA, 841 bp, Bovine  19866880898887
ctgaaaaaggtttcttataaataatttggaaatactttcggaatcctttcttggcaatggaaatagaacattgcagatccttttatcatcaagtgattgatttatatgtgggaagtcctcggtgcttctggaattacttaatgatgctatgccactgtctataaatctgagaggatattgtacagaacatgaaaatcccaaaggaaggaagccacgtgagatcatgctctctttgcacagtcatctaatacaaggttttgctggagaactgggtgacataatctgtttcacatgaaatggccccttggggatagattagagccaaaacaggaatccacaaaagaagtccattatgtttggacaagcatctaaccaacctttcttgtgtttttctgggcatatgatctcctctttttttgtgactcacttgtcaagtacattttgcccacacacaggacatataatagtctgaaagtcaattacgttcgtcccagctgtaaactgactgcagagatgactaagaacaccatggaattgaacctagaatagtaattttgctgtttttgttcaatgctgtattaggagaaaaaaagattttgagggctattggattggtaaaacttggtatgaattggtgataatatagtgataatttatcatgtgtggagacagggtggatgcaagaattatttgtattgttattttactggagttggttttgttattgactgtacaaaggaaattagtcccgtgtcatacatattcacattttttccatagtttgcctttttctttggattttgtttagtgcctttatccacacatacatttgaaatttgtg

SEQ ID NO: 62649 - DNA, 1850 bp, Bovine  19866880986185
tttcaggcaagagtactggagtggattacccccaaaaaagcatatgcaaccattccagggaatactgtacttggggaagtaaaaccccataagtgatgcagggagctcaaattttaacacattctatttttactagaaaagaaattcaggtcctaatatattatcagggctaaatttaacatttggcaggctggttgtatatggccattcttcctgcttctgatgctacacttacatttactgcacatgcgacctaaatctaaatgaaaactaatgttcagcatcaaaatgtacatccttcgggaaggtaacgtgtgcaatctttccaaggctaagaacagtttctgctgattagcagatcttgcatgtcatccaaattcctttgcccactcatgtgggttagacactagggtaaccaagttcctttggcagggattgaggagatagagcagaacacacctgccagcactagagagaaatggaacgagctttgctggggcatctgtgacatggctctgtagcgaggaattctgggaagactgagactaagactggaaactgggtttttactgagttaacctcacaacacaaactctataaaaccaaaatttgttctgtctttatgtgaagtgtatgcacaagtctggaagtgtttccccgggggtgagaggccggagactgagcaaatgattactgaattagcataactgtataagaataaaatttatcataccagagaagaaattttcttcttcattctgtagatatggagttagtgatattacatatagttctctattatgaggtgataataaggagtcagctctaagccctaggtatgagtgttattatatattaagaaaatctcctttttcttgttggtttatagggtttggagttaaatgagaaaaatatagcatctaaataacatttagtatagcatttaaatatagcatttaaatatcaatatttcttagtgattttatcataaagtcataatttgtttttaattctaggttataggaaagcacactatattaggaagcataaaaacactatttgtttactgtttctagatgtctagtacagattaagtcctattaatataaacattagtggggcatctaaatatttttcatcatcctagaattctaatgtcttgaaaattattaggaattaaaaaggcaaggtaaaattgaaaatagagtaatttcaatatgcagggtttaaagatttttaataatatttatcaaataggatttttccttcattttaaagttctaacagattgacatgagtatgaaagtccaatgactattccaatgactgtggaatagttctttgggaggacaggtcatcacaatgaaacccttccgtttagtactgacaccttctggatgcccagaacttgccccaatttatgaagacaccaatctacacaacggtgcagtatggaatttgtttctcttctgataaaactgaagcaataatagcatcacacagttatactctaaggtattttaaagtacacaaaagtacagctatttatgctatgtagttacgtgaataatattcccaagagacattaaatctttaataaccaacttctgtcaaacacttaagcacagaactatattaagacagcatgtggcattcaatatctgacatttcatcccataagaaggcaaagcacaacaataacatgtctctgaaaagcaaatgccattaagtgcaaatttctagaacacaaggtcaatctagaaacacattttaaaattcaacagattcactttttaaattagtatgctcagtatataattttcaaacacaatccgaagtgattttccaat

SEQ ID NO: 62650 - DNA, 1035 bp, Bovine  19866881019293
ttttaacaaataaaaattgaaagctattaccctagggaattctatcagaatgtcctccatgtatatttaaaggtcctcctactcacattgacttcaccgccccaaatcttcattaataaaagtgacattgaggtctgttaaaaagctgtgaatgaaatgtaacttgtagtgtttcagatttataagcttgccaaaccaagttactgaatggcattattttcttcttgatagctgatgtggggaaattaatattttacttttagaagtgaagatggcaaagctaaagagtgaaaaattatcagtacaccaagcaggatactaaacagaaacaaaatatctaggtcatctgctaatgccattttgggggaaattttattacaggaattatttcaattgattttaattttcaaagcacatttaagaataatctaaaatcagaagtcaaacaaatttgttgcaattggtaaactgataatgtcttctatttttgttcctggaggcatttgcttttatttcaggtttgttgggattggaatgcagacttgcctataccagattaatgacgttttcttcaacccccactcttcttcatcctgacctacgtcaagcatatactaatgctcttaatcctattcttttactgtgggtatcttctaaaaataaatcttagttatgccaagacagacataatgaaaataatttctttgcaatatgtattttaagggtaaaaacccctaactctattgccaattctagtaccacctccttacacactgtaagaagctatacagggaaaactgaaaagaaagtcataactaaaatagcatttgcatctaatgattttctaaaggccactaatttaacaatataacaaactacatatttttgcttttatgctttaaagagagtcaacttagcaatactgcacaaagaaaaaaagagcatagagaaaacataaccataatcagatttggcccagattctccttgactttttgtgtaactttatgccattttaacagtttcaattccttca

SEQ ID NO: 62651 - DNA, 722 bp, Bovine  19866881600053
tcccctccactcaaccattcctccctggagtcagatttagtgcaacaggcaggttcctaccttggtctgaacactcttatcaaacttgtcatttttgaagctaaaagtattctggtgcctctgaggcctggaacgagtcacgttccctttctgtgagctcatcgcagaaacgacaatcgcctcgttctgggacaaggaaggtgcaggcaagagtaagttgcgaggaactatcccacggagctcacgcttctactactgacccggaaggaacttaaccagcctttctgtccccgcccccggcctacccacgtgattcctcgagggggtcaaaggacaccctcaggcctctcagcgccctcaaggcccttttaaaaccgcccagtctcgatccttcccccttcgctcagcctctctctctcaatcccggcgtaaaaatcccgctttcttcgaagcgagaattcccccattggtccgaatgtagcagtccatcaaagtcgaggggcggggaggccttgcttctattggctctccttttccgcaatccccgcctcctgccgactctgctcagcctctccggagcgctacacctccgggttgcttgtgattggtggaagtcgggctaaactagactccgtccctccccctgcccgctcgcaggctggagccggggtcagctttggcatcttcctacagtcagtgaccaactcctagcttagtgagct

SEQ ID NO: 62652 - DNA, 869 bp, Bovine  19866881672459
accacaggaaaaaccatagccttgactagacggacctttgttgtcaaagtaatgtctctgcttttcaatactgaatatcataatgaaagaacttaccctcttctgggctaaaccataactgaacccaattgtggcaaaatatttgaattataaagaaaaagaaaagaaggttctaaaacgctgaggcagggggaaaagtcatttatcagtaaaacagttaaaaaccaatttttgttggcctgcaaaatatcaagaacaagagtttggagagaaagtggttgttattcaagaatattatattgggccacattctcccttatgtgtgaaggcaacaaaattctcaaatgtacaaaggtttggaaaatattctccccatgaatcctttgaaaaaattacttgaaaatctatatgattcaatgagtgatgaggcaaagtgaagggtcattgtataggaaagtatgatacaacaggatgtcagggaaggctaaattcatttaaaacagaaatatgaaaaaaagttgtaaaggagtttaaaaaatgacagaatgtgtacaatgttaaaagtaatacctttttgaaaaactatcagactatgagttttaaacctggtctaacagctttaataaacaataatataaacacttgaaaaatcaaaatggcaacataaatcaaggtatttccctctgggaagaggttcctgggacctgaatatataatactgtctttgaaactgagtgttaggtccttgagttttggtattatattttccctgtatcatttgaatgtctttaatattttatcataaaatcttaaaataatgtacaggctgcaagaaagaacttcccaagtactaaaaattgttttacttt

SEQ ID NO: 62653 - DNA, 2083 bp, Bovine  19866880348804
ttgcacagtgactatctttgagtaataatttgcttttttttttagcaatgttagcaatgtttctttaaattttgaaaatatattacttttaacttcagattaaaagctgtttgggccaagtgattctagagttgttacttgttatctttctgtcctttggcactaccagtcttatttatcctttgtcctcagtatggactcagcacttttgcaatattcctgcagaagcatgtacatccacacatacatatacatacctatatgtgtggttgtacacggctgtcctggagtattacaaaaacgttgcttgatatacacatatactgctatttgatacacacacacacacacacacacacacacatacatatgagaacatactttgtcttatgaatctatatctatatatttacattatttttaactatttcacataattctaccatgtggtttcaaagttactttgctctttttactattgtctctctccttttgtaagcctttgggaccatcccaaggaagaagtggaggagataatttgatttttattgtgtgaaaaatactgaaaaataaaataagacagcttaaaaacaaccttctttctttcaatagtttaaacttggtacattttataactaaagaccaatcttatctgcaaataaaggaccaacttccctggtaatgactccttgaattctgattatgcatttggtgcgtggccaaaatgtcttcagaatgtatcctatcagcatcattgaatgtccccaggattgtcaaagttcattttaagcatcaatacagatcctcaaaccccatatatggaatatgtgtggcctcaaatttttgatgatgaagaactgataggtaaaattcgcaggatactgaggtttttaatagatcatttatgaaattatcatggcttctctattctacaagcaattttcagtgaaaaccaacttctacgatcatttgctacaatgtgatgactgccattattgtattgaactatttcctgttgggcgtacaatcacagatgcaggctatttaagtgttctttatttcccctgtttatcctcaccactaacattctatggtacatcatttttaatcccaggatactttgatatcagaaccccagaagactgattgatatggacagatagaaccagaaacaattaggaatatacactcagatattttacaacctctgtcgtgtcgtttgcttagatgaacttttgtgaagtaaatattctgtttgcctttatagacattaaacagttaagaatgagaccaactaagaaatctggccatggtcacataacttacaagtcagggagctaccacgtcatacttccatgctcattctacccttcttcacagttcagtcaacctctcacctctaaccacttaagtgcactccaaatcttgatcctcgtttaatgtttctagagcttattaatgtttctagatccttattaatgtttctagccagaggactattctctggctcaaagtcatcatgcatcccatactgccctcagagcttcctaaaacatgtcccctaaactagctttgcaaactcaccagccattctcttagaatatatgccatattttccaatcaatttaaatgattgctccaggacatagttcagtgtgtcttgccacatattcttctaatgcactggatacagacagtattgctctcctactctccaaaattctgaggtcatgctattaatgccttcatacttggtccttcagtcgtgcctgactctttatgatcctttggattgtagcccaccaagttcctctgtccatgggatttcccaggcaaggatactggagtggattggcatgcccttctccagggattgaatccagttctcctgtgtctcctgcactgcagatggactctttaactgctgagccatcagggaagtcccatactattaacagtaatcacgtttgtaaattattttgtgacaggatcaggctgggcactctgctgctgctgctgctaagtcgtttcagtcgtgtccgactctgtgtgaccccatagacggcagcccaccaggcttctc

SEQ ID NO: 62654 - DNA, 1311 bp, Bovine  19866880385367
tctcttttgtttggggggcagttaaaatacttagtttgctttcagctaaccgggctgattctctcaactctgcatgacggcagaagtattcgctgcagtttctgctgtggaagaaaaccgacaccaaaattctggacacctgaacatcacttcatactaactcaagtgcactgtgcatcagcttagaaagggaggcgtttgagagcgtgcgacagatatcatacttaatgccagggcccgcaaactttccatttatagctgtcacttctcctgtctgaggcctgtcattcctctcaaatttcagtgacatactgtaacgccaactcaaaattctccactcctgtttctggcaccgtctatccgacaaatgtctctagattctggcaacatcaggagttcagaactgcgcctgagagctgaccccacggcagctaaccagccttgaaggcctcctaaatcaagaaaaggactttcatcacgcggcatgaatcttccactgacattttttcacggctaaatatctaaatcccatttcttgataaaaatttacatttccaaagccagttactctccagttttcacatttttcctatcaccacgtggctccttagcctttctcagtctagcagactcacccaggcctccagggccaggccctccacctgaatcaccacgtcttaaaatgtacagctcacagaattccaattaagatctctcagagaagcttccataacatcaccgcctccgaggtggtgtataaatcccaagtcttgcctgatctgtctcaaactgactgcttcacattcaaggatttaacaggcacagtgagaatccattctcaattcaagtctgaaggacagtttaatctaaaacatactaggtacttcatctcagtacaaaaatcccatgcgaaaaagtacatgtcactaaagacggccacgtactttaagactggacaaatttagctctgagcacctcttccatagctttgaagaacccaagctgtctccagagcttctctgaacccctaaatcttttttcatttttttaagaaaatttaaccttgtttttctgtctgctctgcttctattcatgtgccccggcttcacttcttactttctttttttaaaaattaattaattatttttcaccatgctctgcagcttgcaggatattagatccctgaccagggatccaacccaggccccagcagtgaaagcaccaagtcccaatcccaggaccaccagggaatttccccagtggcattttctgcttcagccctactcaggtctcaatcagtgtgtgctttca

SEQ ID NO: 62655 - DNA, 1380 bp, Bovine  19866880519518
atgcctttagctatggccgtgctacagttaattatgaaacgagcaccctaacccacggtttcatctaacagaaattcccatattcttgacgatccagctgcatcaggcttagctctgaatgaaagagatcagattagctcatatctgtccatcctactttgataattagcgatctaattccgagtacaattatggaagtttgtgtcttaaaaaaacaatcattaagaagctctaagtgaaagatggaattcaatgttcttaaaatcactcccctttttccacccctacagactacagtgagctgatctcaaagctcctaggtattaaacagatctttgtagttgtcacagagataacacagggctgctctaatgagaatggctacagggtgaaccctgttcatttgtctattaacatttttacctgtttttaattgaaaggacggtacacctacaattttccttttaaatcatgcgagtctcatgctgacaagcattgatcttctccaaaacagtagacatgaataattttaaaaaatattctgtcttattattttagagggacagccagaactctctgccggggaacaggttattcagttagctcattttctgtgccctggggtttctctgtctccttctcgtcctgttctctttgagaaggtggatcttattagcatcatcattgcatgttgaagagaggcaagcttgagagcggttatgcttcttcaaagaagctcaggagataaataagcttaagtaaaacaaagatctgtgagagtatctgatgtttctacgtattcttactatttctcatctacatccatttggaaatcgttagttgaaaatttagctgtatcttctgcaggctctattttctgttagaaaaccagagcatggcaatagataataggattatttagaatcttgacaaagtattaagcttcttccactggtttcctgattttaaatttctcagttaaaaaaatgcattctgaatatttataagagaaccttaatgtttttattagttataatgctcaaaatcttatttctcaaactgtgatcctctactagcccaggaaaaatcccatatgagaccagaaaacatgctcagaggccttctatagtttcacattgagtgtttaattaaacattcagtgtaagtgtattctgggtcatctgcattactttctggaaccgactcccagctcttttcttttgctactgtaattacttttgtgtttaacttcactccaggcagagaccacaagtaaacctttgcagtgtatttcaggaaagaggattttgccacaatttgagaaaggagtagaggaattgagccgtgatacatgtctccctggcagaggctgggtaagtt

SEQ ID NO: 62656 - DNA, 2209 bp, Bovine  19866880665269
ggatgatgtggacaatgacaaactgaagttagcaggcaaataattttactgtctattaaggagggaagaaagagtcccaagaccaaaagtttcaagaatttctacttttgagcaatgacaataattgaaactgggctgcctaaatcatcctgggtgactctaaaaacaatgctgaaaaataaaaagcatgattagagataaattaacaccgtatcagtcctttcttataaatctgataagcaaaattttaaaatgtacatattattcaaggatatctattattgtgataattctacaaagcaataggaggaaatgactgtcagcacattaagagaaggaaatggcagcccactccagtactcttgcctgggaaatcccatggacagaggagcctggcgggctacagtctatgccgtcaaaaaagagttggatacgacaatgacggaacaacaagactggtaccatgtccaaggagcaatggggacaggatagagagtagcccacaagaccctcactctaaagtactaacatatttagcaaagctttgattcatggggttcatttttttcccagcgtattttttaaaactaaatattggctgcagttgctggattttctctgcttaatggacatcaacataccaattttcattaataacaaactgtaactaatccttaaacagcacaggtttgaactgtgccagtccactcgtgtgtgtttgcttttatttttttttttccagtaaatacagtactacatggtctgcaattggttgaacctgcagagtggaactgctggcacagaaagctgaccacaggacgtaagcaccacgggttctggtattgaagttggctactgggaccagtcccccttggacactgaggcaacaccatacagattttcaactgcctaagattttcaacactcttagcccctgcattgatcaagggtcaacagtacatgctagagaaaaatttgcattgttggtaatagccaagagttcataagagttgaggtgcattgtcatgtcattctgagacactgtgtagttctttatgatgggtttgaagagtctgtgccattcttttttctgttttaaatacgctaacagaaagttgccagagtggtgataatgtgataatgctggtgagccaaggcacacagttattttagaaagcaaagtatacacaataaaaatgttgtaagtgatggaaaaataacaaacgttacttgtttgatttctctttgaatgtctaaatagttctgtgcaaactaatgtgttcttagctaaaaagattgtttcatatactaagctgttcttttacttttgaataattttcatatttagttcattctattcaggttatttacttaagcaatacgtattgaattccctaccatgtgccatgcatacaatacaggtagtaaatttctgcttcactctaagttgttttaagcagttgttgaataagtgatttatggataaaaatgaataaattataaatttaccaaaattcattcaatgaataagcatcaaaactggaatttgagcccactgttctgtatctgaagcctttatgtctatgctgtcttcatttaacagctgtgtgaattgtaccctcatgtcaggttctggctactctcttcagaacatatcattattatttgtttctcccatttacagtcagactgccctgtgccttagaagattagtttaaatgagtcagcatatttactgacccaagtgacatcattcctcatggttagaaacatacattagagtcaagtaaaagtttatatcaacaaacacatggagtggttggaggtgacagatggggtgtcttgagaaaggagtatgtgactaaatctcatcacagcattttaaaaattacctttgagatgtagggtgaaccaagagtctaaaactttaactgatatgtgaagattgcctcagtagtattctggcttcttctacaaaccacattagtgaatcactggagagatgttttcatgtcaagaaatgtactgagggaatgtgagggcaaactgcctaccttcatttatgccaaagatacccgaatgttcaaaatgcaaatagacacggtcctttctctgcatgcctaacactatgcaaatataaacttaggaaaaggcccaatgtaatatgcagcagaaaagtaaataagcaagcacagtctcttgacatatt

SEQ ID NO: 62657 - DNA, 1482 bp, Bovine  19866880781341
gagtaggtatcccttaggtccgttctcttgtgaaagcatcacaagaaccctttgatccatactgcccttgaccacacttttccagcaagggaggcaaaggaggctcagttgtgttccttaggggaggttcggggtgtgatgaagagaaaggtagagagacaatatggcggattatttcttttgaaaagcaatactattttactgcattaagagattacctttgggacaaaacatcaaggtttattgagattctgccatcatttctttccctactaaaaggtcactgcagtatcttcatcttcaacggagctcttgagcaaatctcatttcagcaccatggacagcaacacttctactaggacatgtgcccatggtcacatttgccatttcttaagaaacttgcatacactattcctttgtgaatcagcaaggtttacagccattattatattcaacaggaaggggctgaagataatatatgctattaatgagttcagtattttttagtcatggcattaagcatttgccaattaatacttcctgagagcatcctgaaaattcaagctaattacataaggtgactaataaataatctaacactgatcagttatcaccagatacgtaatcaaaattttctactcatactgagcttctgatcaataactatacacatttctaagagaaaacaagaaactcgtgtgagtaaatacgcttaggaaggccccccaaactttcaaaacaacaagaattactcctggaaaacacataaaacgcttttagttcttcccacataaacaatcacaaacactttctcttgtctctttggccaaccagcttaatttgtcactatcagagacttcatgtgtcaggtccataagccagaccacacatgcctgtcttagcctgttctgatttcagctgtggtcaccagtatgcagtcccatcacagtcttcctcacaagcttcactcaaattacattaaaaaaaaaaaaaaaaaaagtggcagaatctgaaccaactccgtagctttaagagatagttaaagcactgactttatctcagaagaccagagtcctcttgatcttccaaggattctcagaaggcactgatccatcagcaattcacaagagagacccaagtcaagcagcaggtcaggcgcttagaaccacaaaaacaatggtcgaagtaacaaaaccagagtcaaaaagcgactttaaaactctagaagacacctccacccaacacacacagagataacagcgcgaggaagggggaaaaaatccacgggttcctaccttacagtcctcaggacacgatttcaccgagtactcctccgattgtaagtatttatgcagcacgctttcaaactcttcgtacttctcctgagcggtggtggtcgtagtcttggtaagcctcgacgcactgtctgcaggtggtcatctccccgccctccttgagcaccacatccagactacagttcaa

SEQ ID NO: 62658 - DNA, 927 bp, Bovine  19866880809704
attaaaataccttcagtcctttaataaagctaatcataatacagtaattacatgaatcatgctttgatttgaagaaatccaaacccactgatagtttgacaatagaatgaatatactttgaaatgaagacatgagtttgcttaagttcttttttcctaattcaaacaagattttgacactgtgatccagcttgatttcatctcagaatcacacagaaaagaccacagctaaattctgcctgatggtaagagtgtaacacaaagataagtgcttctgggagttacagaagatttgccttccccactttcctatgattatggaattaaaactaggttttcaccaaatggattaaatccagtcaacaaatatttggtgaacaattatgtaccaactgtgctgcaaggataaataataaagacctggagctaattttacataacacattatttctaagtcaataattatgcataagacagacgaaaaacatacatagcttaagagtcagttcagaatgcctaggaaaatgattcaatttatggaaaaagaaaaatccagagataatcttttaaattcttgaaagtgaaagtaattgtccctcagttgtgtcccattctttgcaaccccgtggactgtagccctccaggctcctctgtccatgggatttcccaggcaagaatcctggagtgggttgccatttccttctccaggggatcttcccaacccagggatggaacccaggtcccctacattgcaggtagattctttattgtctaagccaccaggaaagccctttaaattcttaattttatactagtaattctcatcactttggcatgacccaagtccagatgaaggatagttaattccattgtcttctttatataccaagatgctgctgctgctgctgctaagtcgcttcagtcgtgt

SEQ ID NO: 62659 - DNA, 3207 bp, Bovine  19866880822384
tgaataaacattcaactcttcctctcgcatcatttagattgataataaactctaggtatttggaaaaaagccttgatggctgctctagaatcatattttatccaacagaagaaaatcaccgacattaaccaactatcttacatgctaaaaccagttcttgaatcacatttcaaggacaatggtttggataatcatcttgctacaggttctatataatttgtcagttaaacaatttaaatgccttgagtaatacttgttcccatttgctttgactagtcctgtgtcccttgtacacattaaaacaaaaataagaaggcatactaccagcataatattaagatatttgttagaaaagcatttagaactataacagtgtgactgctgccacagaaatctagggattctagataactgcacataattctttcattaaaatactcttcagtgcctccataggtaacttcttctcctagctacccagtgtatgtgcaaagcgtagcactaagacacctcccggatatctcagaagagtaaactaagtggtacaccaggatgacgtcaatctgtgttaaaatatttgcaggaaaggttacgagtaaatgagcaattattgggagggggcagggtgcgattacaacagggtcataaggtaatgctggggtattgttcttctctttatgtacaagaattccaagggaatccagtaaaaggtaataagacgaagacagatggatctggcagaaccttggcagctgtcaatagaaaatagagatcagaaccttccgttccttacaaggtttttctagaaactgacagcagaaaattaaaatcctgtcaggggccaactaaagatgtgccctgtattgctgacataatattcagttggatgtgaacagatttttaatttcatatcctaattaacgctgatagagagcaatttcaaaaatgtctcacaaggatgagccgggtccactcagtcagctctcaaaaaccggccaggaagccctgcgcagacttcgccctcccggtggcctgcctgcttcccttcctcatcacaccctgccccgtgctggctggctgactgtggttcctctgccttctgaacacatcactggctcaggtctgtaactatttgtgtcagcgatttgaggagccatctcgtgtgcccacgttgctagttgggaatatattttagagatttttaaaagttgaaatttgcatgaaatctatcttatgcaaatatcccaatatgaaaaatttctcactagaaaatatctttagctccattatcaataagttggttgctaaatgtctcttctcacaggtaaagaaaagatatgtgtatctaagctccacagaggtcactaatcttatgctatcatcttttttgtttcagtttgtaacactcttccatttttccatttgggcgaagaacagactcattggaaaagaccctgctgctgggaaagactgaaggcggaggagaaggttggatgaggatgagatggttggatggcatcaccgactcaatggactatgtttgagtaggctctgggagttggtgatggacagggaagcctggcgtgctgcagtccatggggtcacaaagagtcagacatgtctgagtgactgaacagaactgaactgaaatttattattcacttagcatattataaatgagtatgctgtgtagatatacctagaaaaatgttttattatcccaaatagaaatgacaaaattagtcttcccaaaataggtctttggtatattttcactttttcttttacagcctacagctaatttattggtaaatatatctgtatatactacagatcattaaaataaaaacaacttttacaaacaacatcaaaatcatactctttgtaaaatatacccttagaaatatttcttgcatatagattttctaatcacaatctgtgaagatcctataaatcttaaaaccagtaaaatatacaatattctgtattttttctgtaacccttttcttattttcttttttctacagttatctaaactttactcaagtgcataacatatatagacatacaattcctagaataaaatatatatacaaaatatgggttccttgaggaaagaaactaatttttgtacatcaatcatggtacctaacacaatctttagcagagagcatcatttcataaattgttagagtgtagacggatgaatgaataaaaggaaggttgctgactgtgccaaacagagtaagaagggaaaagccatttttataccatccctattgctagaaattttattagttcaaatgcttggtttgaaaattgagtataaccatttgcctgacagaacaaaaagaaaaaacccaaagttgggttcaagcgaattcaatgaccaataaactcagctgcactagatattgaaaacttcatcacgcctttcatgcagaaatggaaagatctcttccatggagtcagaggaaaaactgcctgaaaaatctcgtttggtgtcactgtatcagcacacagctattcagaactactcactcagccccttctgagagtcagcatcatgctctttataggatgtcacccacaaatcagagcagcgggcctcgccctctcaaagactacgaaaagatacaggagctgttcctgctatatgaaataagcaagtgaacagctcagaaaaccagaggagactggattcaatttgtaaataatgttagtcggaattcaaagggaaatgacaatttaattctaaatagaacatttctaaaatgaacacaagttggtcaacatttctctcagaatcaaagttggtttccaggacataataatgagaactaacagacagcctgctcaaaagcaggtaacaaaagtcaaattagtattttacggtctaagacctttaaaaattgctttgcattattcaggataaaaaccatcgagaaatatttgatatggcatttgcattatctgaatattcattttcaaaacactacatatgcacttttctgtcctttctctgcacatatttttataatgatgtccccaaggcaggtgatacattcccccagacaagtgctaaactctctgaactacaagtttccttagaaaaattatcttagaaatatgggggctaaattttgtgtatgcttttaatttgctaaactaactagaaataaaattatctccaaataacaaatttag

SEQ ID NO: 62660 - DNA, 1795 bp, Bovine  19866880899361
tgacctgaactgaactgatccccagttattaaaaacattaaaaacatgaagtttcacaaaccaaatgtatttcaatacatcagttttgtgctgattgatatgcaggtatggactctttactatttcattctaaaaatccaactgcacgtagaacctattgattttgatttctttatcaagagcaaacaatcaatatccaaattacttaagctggcacgcatatgttaatgtttcttgataacttttttgagatatttttgtatcacccatgtccctcacccatttgaggtgtacaattcaacgattttagtaactttagcaagtagagcaactatcatcaaaaattaattttaggggcttccctggtggtccagtggctaagactccatgatcccaatgcagggggactgggctcaatccctggtcatggaactagatgccacatgctacaactaagagtttgtatgccacaattcatagagccctcatgccatgaagaagacctgctgctgctgctgctgctaagttgcttcagttgtgtccgactctgtgcgaccccagagacggcagcctgccaggctcccccgtccctgggattctccaggcaagaacactggagtggattgccatttccttctccaatgcatgaaagtgaaaagtgaaagggaagtcgctcagtcgtgtctgactctgtgcgaccccatggactgcagcctaccaggctcctccgtccatgggattttctgggcaagagtactggagtggggtgccattgccttctctgcaaagaagacctagtgcacccaaataaatgaacacatttttttaaaaatcagtattagaatgctttcattcttctaacagggcttccctgggggctcagatgataaagaatctgcttgtaatgtgggagacctgggttcagtccctgggttgggaagatcccctggagaagggaaaggccacccactccagtattctggcctggagaattccatggactatatagtccatggggctgcaaagagtcagacatgactaagcgattttcatcttcactttcacgttcttctaataatgtcccccatacccatttacagtaaatcccaatctccacctggagccccaggcgaccaccagctctggtccttgttcttgaatttagagacaggacttaatgggtttacatcacaagttctctttttcaatagaagagtaattgctagttatttctcacaggaagtttcatatgtttagtgattctaaatgattttagaacccaaatgacaataactcatcaaggacaaaacatcttaacaccacttaaagtaaaactgagggcctagttcattcagatggctctgttaaattgttaatatgagagttgaaggtaaatgttctttagtgacataaatcttgactctcagttctcactgaaagtagactttataccatggttctgcataataaacaggaagcagagcttagttaacaaaaaaacttgcttactggtaataagtcaccatatccccggcagaatatctatcagaaccagccatttttgttgaaacaaacaacctaattttgccatttttctagtggcttccattctggagctcaggagttgagagttgttattgagcttgctcacaaagccctgacacctgccctcttacatatactggctttaattgtcatgtacctgatgaggatctgaagcatctctctatccctccaaagtggaagaagctaagatgttacacattgcacctccaattactgaagcatggcacat

SEQ ID NO: 62661 - DNA, 1286 bp, Bovine  19866881175356
tgagtgcagtgatatcagcgcagcctggttgtgggagtgcatatgtgcacaaatgtctcttcaaatatacaaacatggatattgtccctcctccctgccccctccctgcttccctccctctttctctgctataccctcaatgatcctgctgggtgaatccatctgaaatgtatggtgatatccctcatcctcagttgcttcatgtggtactgtgaaaacaaaaccaattttagcatcaaaggatattttcaagtatttttcttcactaggcaagctgtaagaatcttcagctgttttgttgccatggtgagtggagttgaagcagtatttctagtcagaggaaaatctagaaaacgaatgctaatatgaaataaactaacagccatcattctttaaagcaaggaagtttaaatgtgagagtcatcacctcctgtcagacattcagagaagtatgtacttgtgcctgaagtttagggaataaaggttgcccattttctcttatttgcaaattcagttttgaatatagctaaacttttaaattgtattgacattttattttgagaatgaatttaaaatttgattgcagttagaaaataattttttatggcggtggagtaactaggtttcagtcagtcctccagaaattattacctcctgattgacccagagaaatttatatgtttgtaggaactcattttcttcatctacaaaaaggaaaaatgaaaataaaaaagaagaaaactaattctttttgttcttacagaattattttagtagtagtaaataacgtactgtgtcctgaaagcttgtaaacttagaccccagacaaacatttaattttagtattgtcacatgataatgttgtcgttgtcgtttggttgctaagttgtgtcagactcttttgcgaccccgtgggctgtagcccaccaaggcttctctgtccatgggattctccaggcaagaatattggagtgggttgccctgccctcctccaggggaatcttcctgaccctgggattgaaccaagtctcctgcattggcagatgacttctttaccgtctaagccatcagggaagccccatgtttatcatagaaccctgaaatgtcatttctagatattttttcaaaggaatcccttctgtaaatccaatttcatttatgtaggtttatttgatttccttttggtctctgatgtgtgtactaacttgcttcagtcatgtccaactctttgcaaccctatggaccgtagcccaccaggcttctctgtccatgggaactccaggcaa

SEQ ID NO: 62662 - DNA, 562 bp, Bovine  19866881321900
ggacctcagttccaccccaggaaagttttggagtgggacttgctgtctgggattattctacaaggtttttagtctccaaaacccctcagccttttagctgctgacaactagctgcctaagagaattgccagtctcccaccactgtggcaagttaaccactgttttaatgcataccactgtgcctggcaattagtaagttctgaacaaatatttgtgaaatgttattaactatattggagaagggaatggcaacacactccagtattcttgctggaaaatcccacagacagaggagcctggcaggctacagtccatggggttgcaaaagggtcagacacaacctagcaactaaacaacagaaacgacattagctgcgtgcctaggtgcctgaaatgaatccagtttttcttctcaaagtctgtttctacatgtcacttcgtcttcatcttattattatcctcccagacactggagcaagagatttctcagtcaaatgtatttcttacttgcctttattcactcatacataattcattaattctacaaatattgctgctaggag

SEQ ID NO: 62663 - DNA, 3272 bp, Bovine  19866880388100
tccttttttccctaatctagtttgagtcggttttggtcacctacaatgagagggttctgacagagacttaagggtttgttttcttcatactatgcaataccagcttacaaaattattaaggaaaatggagaactagcgtgtatcatgtacttaccatgtgccaggccattgggtaaggtgctttcacgtgtgatttctcatttatgcatgtgtgcgtgcatttggtcatgtccagctctttgcaatcccatggactgtggccccaggctcctccatccatggagttttccagacaagaatactggagcgtgttgccatttcctactccaggggatctttccaaaccaggaatcgaacctgggtctctcgcacctgctgcattagtgggctgattctttaccactgtgccacctaagaagcctggttagttcttataaacccattgagcttggcaatatttttacctcattttaccaagagcacagatacgtttgatgccagtcttgctggcccagatccagtgtttgaaggttgaatggagcagcttgcaggaatttggggggcattgagggaacagacttctcaggtccattttctctcccacttcactcccctggaaagtctgatggaagaatcagggcacgcttaatcccttttctgagaacgagagcacacatcgatgaggaatccctgctgtcccctctggccatcctgggtgctggggaggtggccgtcctggagttcccacccagctgcctggtggagaggggatgagcagctgaggcactgggcaatagcccaggttaatccaggatgcagtttgcaaccccgttgcaggaccaatcaaggatttccttcagaagtatcacttcccagcagctggctggcttgattttgccaactgcttgtgacccctggctgcacaggaagcttcagcaggtagaacttggccagcctgaggagcagacacaccccggagcttcttaggacaggacagaaaggtttgcacaaatgaggtttgcatgatacaggatgagaaaggtgccagggaaaataatcccccatgtccattagccctcttgatatatcagccctttgagttttggcctgaagactaagagctaccatagcaacagctacaggtacttattggagctactgtatcacctcccatttcctattaaaatagccaccattggttatcaagcaatcactaagtgccaggcactttacttatattattctcaatcatttcaacaaccctgcaaagtggacattaaatattacctactattttatgaacaaggtaactgagatggctagaggtcaagatatgacgaactctaggaaggaaggggaatttgcacctggtctgtctctatttccacctcactgtcacaggggtaagggattaagtgagaagagaggggcaatacgtttccaggagctgctcaggatgggtcaagccaccagaaatagaaatgcgacttgaggcttgaatcccttttcaggctttgggtcacttagaagcagagatttttgttattttgtgtttatcccgtataccctccacacccaactcatacttagctctgagcagggacacaaagagtgtttgttaaatgaatgagaaagtgaggcccggtgtctgctttctgtaaaacaggaagtggctgaggggccactgacttgatgaggtcttctctctgtgtatgtcacttttaggagctctaaaaagttctcaggttcatcctgagaactctcaggtgcagccacactacaatttagtgcaatggacagaagtttacaaaagttcacaggtcatttgataggcagtgatttcacaaatgatatcctggaagtgaaagtgttagtcactcagtcgtgtctgactctttgcaaccccatggacgtagcctgccaggctcctctgtccatggaattgtccaggcaaaaaccctggagtggcttgtcattcccttctccaggggatcttcctaactcaaggatcgtctcctacattgcaggcagattttttactgtctgagccaccagggaacatactctggtggtgtaaaagagttaatgcatctttcaaaaatatgtcccactggactgctggagagtagcttgaagtaaggaatgaatttgattgaaaaaatttctttctttttctttttttttttttgctgaaccttaacaggctctgattggagaaggaaacggcaacccactccagtgttcttgcctggagaatccgagggacggaggaagcctggtgggctgccgtctatggtgtagcacagagttggacacaactgaagcgacttagcaacagcagcagcagcaacaggctctgatcaagtgctgagtgctaaaaaaagttaagcagagacctctagaaggcaagtttttcaaaaacggaaggtggaatacaaaattaaaagtcttttttaaaaaataaaatgaatcaactatacttcaataaaataatttttttaagatatggaagaaaagggaaggaggaaaaattggagaaaaagttaataaaccggagctttgactgtttccttcctagcagggaaaccctgagcccaattcccctttgcctgctctttgaggcaaggctgagttagcaagctataaattccacgcgcctaagtgtgaggaatgtggagatgaatgtggggaagtcttcattccagaggaaagggcatgagagtgggccagctggagatggaagacaggacataccccaagtgcgagccaacggagatttgaaattagaatctgggctcaacctgcatctaggttttaagaactctgtaagtggatagggctgtcaagcagttggagggcattttgtagagacctgaggtgacacagcattgattcacccagaaaaatgatcagcatatttatcattatttgagtcagtgtatcttcttggcaaggagcagcgtttgggtggggagctctgacctggggggttccggtaatgaagagagagccctgcagaggtgaggagggaaggtcagctggttcagagaagctcctctggcttggccatcaaaggcagcttgatggagacaggctgtctaaacaacttgccaaacttccggtggatggtaggcaacaccctcccgtagaactcatgccctgggatccgagcctggcacttactctggaactagttctagaagatcatttttattagaaagtgtggtttggagtgtaaaaacctcagaggcctctatctttaaaaaaatcaa

SEQ ID NO: 62664 - DNA, 3169 bp, Bovine  19866880412709
aaatgttaagagacttatccgactcaagacaggatcaaaactaaatcttaaaaatttaagaagttctctcacatttctttcccaccccatcacattttcaaaggatcttttctttttttttttttttaaggaaaatgaatgtgttcttttccttgtttagatggaggagaaaactattggggttggaaataaatctcatgtaaggaatatttatccatgagttagtcagtgatgaatttggtgtaccagggaatcactccagtctggccaggggaagataaatattttcatttgacaggaaaaaaaaaaaaaggatgatgatggtggcagataaaggcccaagagcctccagaagatcttgtcattgccttccgagacataatatctgcaaagattaatggaaatgttttgcacagtgatacttaatctctgagtttggggagttaaatttaaatattcaagcaaaatttctcatcaaagatgggatcctgggtcacagatcctggttcacagagaatgtgcagatgggagaaattcggatagcacggcaaggtattcagacaaccacgcctcatcttacctaatcactgattctggaaagactttctctcagggaggatgggccaggttaacaccctgaataatattctcaccttacaggacaatgcaacaaccatggattggatggctccaaactggggctttgcgtttcgagggaacaatattctcttctactggaagagggatattgtcaggtatcgttacaaattttctcaatcattttcatacaaaagaagcataactctgcttgggaaccatgtgtctatctgaaagccggggagactcaaagctcccaccaagttagcaagcagacagccctcttcctgcctcctgcaaagtgccagcaagcctacatgagagatgctgtgcgccccctgcttttacaggggaagcacactgttcacaaagccgtgcgggctggcccaagaccatcctcagtgcccgtctcgtcctcactcagcatcagcgggacagtgactgcatcagccgcttctcttctctgcattctccagaccatagcccaggctttcccgtcagcctttttcagtggagagaggggtacctacctcccgaatagttttcctccttttaggttttcctctttctgtttctgttcgcttgtgcctgagtcattctgctttttgtttgtttgttgtttggtttggggattttttaataatttttttttcttttactgaaatatagttgctgtactgaataatttttctaaagcagacacaaccaagttgcttttctgcctgaaatccatctagatcctgaagccaaattagcctctataccccaacactgaattaagtcttggagacagagttttggatgaagtagaaaagattagatttattgctttgccaggcaaaggaggccacagctgtctaaagccctcagaattgtgtgtcctgacctggagcgggtagtgaggagtctcatagtaatgcctcagggagggcgtggtcagcttgtggactttcttctgattggttggtggtgaggtaagtgggagtcagcatcatcaaccttctggttccaaccagtctggggtctacgtgcttatgaacagcatacttttaacttctcccacctggtgagggtttcaatacctgcaaaacagctccaagatattgttaggtatatcccttgagggggaaccaggaaggttccccaaaaatgccttattgtttcttgactgttcctcccttgtctccacatgcatgctcaatcgcccaattgtgttcaactgtgacgccatggactgtgtagcctgccagactcctctgtccatgggatgttcaagacacgaatactggagtggggttgccatttccttctccaggggatcatcctgacccagggattgaacccacatctcctgcaatggcaggtgctttctttcccactgagccacctgggaagccctatctccacgtggcttccgtagttactgcacgtgggatcagtagctgcagctcactgacttagttgctacacagcatatgggatcttccagaaccagggattcaacgggtgtcccttgcattacaaggcaaattcttaaccaaatggatcaccagggaagcccctcaagtaatcctgataagcttctctggttcgtttagtctgcctcttgtggtcttctctgatatggagaatgctgatctcttccagttgttgggttttaattctatgtgtgcttagccactcagttgtgaccaactctctgcaaccccctggactgtagcccgccaggctcctctgtccatgggattctccaggcaagaatactggagtgggtaggcatccccttctccaggggatcttcccgacccagggatggaacctgaacccgggtctcctgctttgtaggtggattcttgaccctctgagccaccaggaaagccctattgttatttgtgtcccttgaggtggaaccagggtcctgccccaaggctgtactactgtttcgtaatgttcctcccttgactctgcatcccttcccagattagctctttggaaggtcactgaggctgaacagaaaggctccccaagcccaggaacccttccaggccctgcttgtttttagtctctcaaggtccaactcaggagtccctctctgtgagccttcctggagcttccctgtcaccgctactgatttttacatcgaattctgtcttgaaatgtcacagtttgtatgtattttgtttgtgtacatgtgggcttatttgccctcacgagatccttgagggtagtgaataagttttcatctctatctttccagcatttagcctggtgtccattacacagaggcaatacgtgtttgttaaattagcctggtggaactgcttggcactgagttgtaaaaacattaacgggtttaaactgaaaacagatttgccccaccaggagtgacgctgtcatgttttaatctattgtttaaacaaactcaacctttcaaggtcaattcaagcacataggaagaaattaaaaatcataatcctgctatgtgggagtaaccataaatttcactttggcacttgttcttccaatattgtatatgtatctttctaacaaatatttataaattacaaatttt

SEQ ID NO: 62665 - DNA, 1913 bp, Bovine  19866880541680
agtgcttaattgaattcttaattctttaaaacatctcagtgcacatggattaagttttttccctgagattctataatgtcctccaataaaaatgtatatttaaagctttcgagacagatttcttatatttttgttcatttcctttgtgacctttcatataaaaggcatacagatagaattgcccagttagatttaaggctgtgcttttcctctgcaaatacccagtgtctaatagagtaatgatactctattatgttagagtatcattatatgaccaatctgtagtttctccaaggaattttaataccagaaacacaaaagattctctggtaacttgatgacacctacagtggagcagaccattaagaccagtatatagtaaggcccctattttaaaaccttgtttaaatattttttgccaatgagagaatctttccctttcccgcacccacccccgccccacctttaattgccatgtagcttaggtcttccccaattaaaaggaatacattgttttaggaagaggtgtaagagaaaaccgtgacttttaagtcagatgaattctgactactatttattttgtgacctttgggagattgccgcatgtggggggcctctgcgcagctgtgacatagagatacacctgtttatagaattgtgatataattgagtgagacagcacatgtaaagggcttcagacagtgcccagcagtggtaaacgctctgatatttgcagtcttctctctgtgctcttctcctccacccgcgttcctcatgctgcgttatctgttccgactgggcttactcagaagttaaaactgttgaactaaacgtgaaacctttttgtacctgccaactgtacgttgctctgcattcactgcattaataagtaaagaggagtcaggaccctggttgacctgtatataaaacacacccagtgggtgtatgtggcctttttcttcacaacaaattgctcccccaggattgggtagaatgaaaaatactccactcgcagccttccttttaagtccacatggatcccatagaagattgcatttaaatctcccttcagcctacaaatttgagaattgagctttgaattgtgttagtatgacgtggggaggcgctatcattttaatcattttgtgttcggtggcttgctttactgttcgttgtttgtttgaccatttgtactgctcagatcactgtcctaaaagaacttcatcttaacagaaaatcattttcaggaaaaattttaatagctatttaatactgctgctttatatttcaaaataagttaccattttattattgtaaatttttattgttttaggtgcaaagatggtttgaaaggatttacattctctgcacttagggtaagttgcatcttttatattatttttatggttagagaatttatgttagcttttttttttttaaatgtaatgtcattgtacataattatttatttatgactctacttttaagttgaaggtaattttaaaagttacaaaagtggctttgtggtcatttcactaacagagtaatttattaattttcctcctaaaaataaatcagtcagtcaatcactatttggggggcctattgtgtgccttatactatagggtgttaaagaagattacaagaactctctgttcaaagagcttggaaagacaaagctacacgtgaacaattactggaaaactaagtccttaattgtgtggcaccagattatgggcttcgttagggcaggactcatgtgttatcaaacacattttggattataagcttcactagagtcactggcctcttctttttacctggtagttcatctcttatcacagtaattgacacatagtggatactgtaaagatgttggttagcactgaattttatagttcatcaagcatttt

SEQ ID NO: 62666 - DNA, 1621 bp, Bovine  19866880749384
tgaaatcacttgatctttttagacatccaaatgacataacaggttttaattcatacacaggaaacattcattacatataggagacaaccgaccttagcagtggttttatggttataaagaatgttacttctgtttatagatgagggttggtttaagttatccggaagtttaaacaataagcagatggtttgtttccaaattgatagcagtcatctggctctaaagaagagcgtacttttgtaaatacatattctttcgtgttctatccaatatgacatgataaaacaatgtactaagttatgttctgctttacctctctgaacataataaaatttaagaaaagtatggatttctccaccacattatcttcttaaactgagagtcaaaacaaactaaaaaaatggtaacaccaaacaaatgctgagatgtagagggagatttcaattgtttcgaaacaaagtaagagagttgagtcactcagggttttctcaacattaaatggtgataatatcaaatataataactgagagtgtttaacttcaaataaaagtgaggaataaagaattacatctaaatttgacctttcgttttattagcatataaaatattttaaagtaggcaagactagtatatgtaataatcattagatgattatacaacatcccttcctcttcagttccttcctctattctaaaaagatgctgattttgtttaggtaatctatcttctttcacaaggctattggcttaactaaatcaggaatgtcaatctcattcctcttgccagtgatttttttagatacatgcatatgataccagagataaggcaatttcatgaaaataaagaggtcagttcatcaagagaacataataaatttaaatatttatgaatctaaaaacaaatattcaaaacatatgagtcaaaaattgatgtaactatatggacaaataagaaaaacccacactagagtcagagacttcaatgccctctacaataactgatggaaaagtatacagaaaatcagtaaaaatatgagcctggaagaatactattaatcaacgtagcctcactgatggtagtagataccacactaaacaaaagcagaataaacattcttttcatatccatacaaaacattccccagggtagactacagtctggaaaaaagagagaagtcacaagttaccattattaggaatgagattaatatcaccactagttcttcagaagttaaaagggtaaccagagaatacaggaacaattttatgccaattaatttgacaacttaaatgaaatagacaaattgcttaaatagcacaaactatcaaacctcacaaaagaaattgaaatagtagttacagatcgtcccacaaaggaaattcccagtctatatggcttcactggtaaatgcttacaaacatttaaggaagcaataattccagttctacacaaacttccaggaatttgaaaagaagggaatgcttcttaactcactataagaggacagtgttaccccaagagcaaaaccagagaaagatattaccagaaaattacagaccagtatcccccatgaacattcctaacaaaatttcagcagactgaatccaacaatatataaaaa

SEQ ID NO: 62667 - DNA, 1440 bp, Bovine  19866880897595
tttttggcagcgggactcaaatggggtcatgaagccatcgaaatgcacagctcttatttccacatcgcagcctgggccatccccgcggtgaaaaccattgtcatcttgattatgagactggtggacgcagatgagctgactggcctgtgctacgtggggaaccagaacctggatgcactcacgggctttgtggtggccccgctgttcacctacctggtgattgggactttgttcattgctgcggggttggtggccttgttcaaaattcggtcgaatcttcaaaaggatgggacgaagacagacaagttggaaaggctgatggtgaagatcggggtcttctcggtcctgtacacagtgcctgcaacctgcgtgattgcctgttatttctatgaaatctccaactgggcgcttttccggtattccgcagatgactccaacatggcagtggaaatgttgaaaatctttatgtctttgctggtgggcatcacttcaggcatgtggatttggtctgccaaaactctgcacacgtggcagaagtgttccaacagattggtgaattctgggaaggtaaagagagagaaaagagggaatggctgggtgaagcctgggagaggtaatgagactgtggtataaggctagccagcctccatgctttccagggggaatgccagcattggggtgcaagtgctactaaaaagcttatgcagtgaatctcagtttgaacaaactagcaacacttcagtaaccccccccaataatccaccaccgctctccccccgctgcccatctccccccagcatcataaaactagtgattttgctgcagactttggaatgatccaaaatggaaaagccagtaagaggctttcaaagctgtgaaaaatcaaaacattgatcacttgagcaggtcgcagcttggagcgtggaggtcctcccgagattccaggaagtccaggggatgctccttttccctgcagggtgggatttgagctgtgagtaggcaacttacagggagaaagattaacttttttttaaccctttacaagttttaaatactaactgggtctttcagacagcagagcgatctataaacactggaagcactgggttcagagaagtgttacaagagttttatagtttggctgatctaacataaacattttctgtggtacactgtctgctgtttagaactttgtggattgctctcccaagaggtggtgtcagaatctttcagtgcctttgtcataaaacagaattgtttgaacaaacaaaagtactgtacaaacacacatgaggtatctcgtgaatttttcttctctctctccctcttaaatttcaacagctccctactagaccgctgctgttttttccattttacattaatgactcaaaataggtatttttataggaatgtttgcactgcagcaggtctaatgagggg

SEQ ID NO: 62668 - DNA, 1938 bp, Bovine  19866881045857
aaaaggatatagagagcaaggttaaggcctagggagtgtttataataaacaaggtatatataaagaaggcccatttctgtctcttgatgaggtgggaagaaatgagttttgattacaggacagaaagtggagataactggagtcattagtcatgatttcaaggtggcaaaacattaaaagagacttcaaggaggtctggggttggctatattgtttgcttttacaaagttgtgtttcttaatagccatcagtctagatggtatagatactgaactgccaggggcaaaagacgtgtctgacttcatttttttccccccacttttccaattccatgaatcaaaacaacatgttatattttggcaggtgcttagaaaatttagaatccatgccagaatggcattgtaaaacactgagcttcagaatttgtatttgattcttgctctaatagtttatccttgtcactatattgaatttaaatggctcaccatttgtatgctgtcacattatttcatattcttggtgaaccaacagtttatttggaaaattctgatacaaagagggccatgggccaaggtgaggttttaataatatcagatcacagtgtttaagcttggtggccttgtctataccaactctgtatatgcctttctatactgagataattatcgttcagaatgcccttattttcttcataatagtaactctgcttttgatttaagtacaaaaataaatgtgccataattttctccttaaacaaaacaaacaatatctggacaatatctggctaactatggaacacttaggttttatttttcaaaaattggaagggttcttaagataacatcagtctgttttgatcctaataggaagagctgtaggccaggaaagcaattatttccacatgggtaaggccagttccaactacctccccctgaacttgctccccctaaactacctccccctaaacttgcctactttgattatatagctgtatgtggttgagagtattagcaaatgtaggctctcttttgaaaatcaagtctttagatatacagaaaatgtttctttgtacttcatataccaaatgaattttgtgtgtagtgttggggtgagtttagcagcaagtaacttaaacattttgaatttccaaaaaatttaattttttataaaaatgtctgtccaattataatttttaccattttgtttgtacatctatttttctttctttgtttgactcttggctttatcctcaatagatgagtttgcaatgtaaagacagtaaggatgtggcagaacttgagatttgtgttaaatggtgtggttggtctttctggtgatcagcccagatcctaaagctatgaatcacttcattagcataacagatacttataccactcaggaaattccaaggatgtttaaagctgtgtaccaggaacagggagcaaagcacagatatattctttattaaagctcaaatccatagatttcctttttctgaaagtttcatatatatggaatcatacaatatatgaggcttcctaggtatcactacggagaaggcaatggcaccccactccagtgctcttgtctggaaaatccctggacagaggagcacggtaggctgcagtccatggggtcgctaagagtcggacacaactgagcgacttcactttcacttttcactttcactcattggagaaggaaatggcaacccactcctgtgttcttgcctggagaatcccagggatgggggagcctggtgggctgccatctatggggtcgcacagagttggacacgactgaagcaacttagcagcagcagcattctggctaattttattcttgtgagtaagcaatcatcatttatctacagactaagagtctgtgtcttccatgtacattcataaaagtatggcacatagagttaaatcttgaaca

SEQ ID NO: 62669 - DNA, 1291 bp, Bovine  19866881064895
ttgacgcataacgtattttattttttccctttgataataggtttcccattcagcctttgcttgaggaccatcagattttcagggatggattattgaaattaagtaggataagtctgtgtgatcagtcctttaatttccacggacaagtttatgctgtctttcttatactcttaaatttttttaaaattaatttgtttgtttcttttcggttgcactgtgttttcattgttttgtgcagcctttctctggttgcggtgtgcggaggctactcttggttgccaagcgtgggcttctcattgcagtggcttctcttgctggggagcacgggctttaggtgcgtgggcttcagtagtggcggcacacaggctcagtagtcgtggggcacaggcttaactgttctacagcatgtggaatcttcctaaaccagggatcaaacccagggccccttgcattggcacgtggattcttatccactgcaccaccaaggtaatccataagcctctcatattttgaactagagatttaaacaaaacaaaacaaaactgtgattatcctgttcctatcctatcattgtgtactggctatgttaaagagggagataacttgaatgtgagagtgtatttgttcctacagaagatcccggatgttgaataagatggggtaaatgcataggaatttaggttgtaccccttgagaaggagaggttattgttatctgaggaaaaggatgttcccagatatttgggcagccagaggcgtggaactacagccgacacttctggttgcccccagtatctgtgcttttcattttgctcagtaatgaaaccccaaatgttagctgggcatttgtccaaccaataaaaaaggttatatttcccagtctctcttgaaactaagtgtggccatgagacaaactttgcgcaatgtttgtaaggagaagtggtttgcatagatctactgtgaagtttacttaagaggaagttatgtcctctgttcctctttggctggtcttcctctctagcatgtggatgtcatggctcaaggtgaagtggccaacttacaagttaggatggaaatcacaggtaacagtttgcagaacaatctgtcagaaggagtttgggatccctgatggatatagagccaccatcttagactaagactgtctatgttggtctgtggatatagagccaccatcttagactaagactgtctatgttggtctgagagagagaccaacgtttatcttttctaccactgtaactctggactttcaatctgagtacttttattat

SEQ ID NO: 62670 - DNA, 928 bp, Bovine  19866881259817
tttgtttctttgtaagttgttgtatagtgtatcttactttaaggaagtcttgtctctgtttatctgaaattgtgcaaaagttaacaagtggtcttacttgctttgaaaacattttttatttagcaacaaatttttcttaagatctcattaaaggtcaagatacctgagtaacctactcagattactgagtagaatctggtagaaagtaatctaccagggttttttaaaactaagatacactataaaacaacttataaagaaataaagctaaaagatttgcttttctatgttttatataagtaatttacaaaggttgaagataggtgtatttcaaaattattacatctatccccaaatgaaacatattaatattgtagcatttaaggaagaggaatttataattatgcctttagttcccaaagaaagtcaatgatatgttgttggaggtggccagtaggcagcttgaagtgtgagtctagactcaggaaaagcatggtagttatataaataaaatttgaggtttcctcccgtaggtgattattgaagctattggagattagagtctcaaagctcagaataggaagcctgaggttagaggttgagaaatagcaacatttaaggaattagttttgaaccaatttttaaattaattgatcagttattagttcttccttttaaaagtaaatatcagtaatatattagaaaggatagaagaaaaagaatgtggaggattaacagtttttttccaagttagcaaatcatgataatttaaatttttaaatctctgaagctctattcaataatgaaatctttactaaagttatacgctttatactcaattgtataatcatcttttttaaaggaagcatttaatgaggtacaagcatacaacatggttatatacacacacatatgtatgatggataca

SEQ ID NO: 62671 - DNA, 3791 bp, Bovine  19866880356956
atagcccagtggtatgccagcagtaattctcaggcttcagaatttaagagtatctgaggagctcatcaaaaatccagattcctgagctctactcagagaaattgatttggtaggtctaggtggagcccaagaaaactgcagttttaatagctccttaggcccatcctttgtgaaacactgatctcagattctgcataatccctcatccccctggaagctccttctcttctcactaagtgaactcagatttctagacctggggctccagattttgcctgcctgccagactctgtagtcttcaatgttctgtaggcacctctgctttgtgtgttcagaagtaaattcatcatctcatcccttgccagtgttccttttcctgtttccctgtgatactgattttgctctctgttgtgaccccgctcaaatatcaacctcaccttctacagtcaacccccagttcttatttttctgttttgtgtctcatactctgggcttccccagtggcttagcagtaaagatgggggttccatcccttggttgggaagattcccctggagaagtaaatggcaacccactccagtattcttgtctgggaaatcccgtggacagaggagcctggcgggctacagtccatggggttataagagttggacatgactcagccactaaaccacccacaaccatctcatactcttttccctttctgtttcccttgctccttcactacttcaggcttttattaccttttacccagaatattataataacttcctaacttgtcttactacctcttatgctgtcagagtaaatccttctaatctgcagctctgtaatgtagctccctactctgcagatgaaagatgaacccacttagcttcgcaccatggacctggcatcttgggtgccttctatatagatagccttcttttcctaggaattagacataatatatggaaagctttcagtccatagctgggcttcagtaactggtatttatcattggtgcttcattcaccatattataatccagctatgtaagatcacttgagattttccctgcaattttgtgtcaattgtactcttttttttttttttttttaattagaccactcagtcaggatttcttctttaaaaaatttatttagtttttttggctgcactgggtctttgttactgcatgtgggctttctctggttgccgggagcagagagctactcttcgctgcagtgtgagggcttctcgttgtggtggcttctctcactgcagagcgcaggctctaggcatgcaggcttccgtagttgtggcgcacaggcctggttgccccgcaggatgtggaatcttcttggaccagggattgaacctgtgtcccctgcattgacaggcgaattcttaaccactggaccaccagggaagcccacttgtactctttcttcatcagactttcactgagcttcttcacatctcaaatgccatcttttctgaggaactttccctggtctcccaaccaaatggaatgtgttaatattttgagcctcagaagacactggactttgttgttgatgtgttactgatctcaggcatacttatcttttctcttggttagactctgggctctgtggggatgggcacaggagtctagatctgcttccctctccagctctcctagagtgtcctgctcttgttcactaaatatctcttgaatgaaacttgtgattgtcaccaatccaagttcgatgcatgatactggatgcttggggctggtgcactgggacgacccagagggatggtacggggagggaggagtgtggggggttcgggatggggaacacgtgtatacctgtggtggattcatgttgatgtatggcaaaaccaatacaatattgtaaagtaattaaccttcaattaaaataaatttatattaaaaaaaaacaaaaaaaaagaaacgtgattgtgctgatgacatgatcatcagcatgtctgctgataaaagcttaaaatatgatctcatctgctggttcatcctatttaaaaaagataattcttggggaaaacaaacacaaaaaccctccggatataaaagactgaagctgaagtgactgtggagtggatactttgagcatggtttgcccactttagctttaaagacagctcttagcttagtacagtgatgaccctgtcctgtgaacctggtcactttcttgaaacaggctgtagcaaaccatagcatccttctgaatatcaccaactgccctgtcaacccccaccatgccctttgctaaatcaacaagcagtgttaatactctaagcaagaaaataggtttgcaacatacaaagaaagctacctttgttagagttggttacagtggatttctcctatgtgtacttagcaagctgggtaaaatatgaagttgttacaagtatcttaaccaaacttgaatatgccatgtttttctttttttttttttaggagggtggggttcaacttttttacaattataaccagagctaaattaagaaattaccctagtctactgactttatttctcagagttgttagatctaaaagacaatataactcatgaaaatatatggaaaagtacaaaagctgatgtaaaatggtaatcaggatgtcaaagaattagggtagctgaagaataaaactggctgggctgcagactggcagacagtggctgtgctggtttaacaaggtgccatctaggaaggccattaaatgtacatggtgacaaatcacagccaccatctgccatgtttttttgcttttttttttttagttgcctgaaattataactccattttaagaaattgttttaaatataaagagcaactgcatttgtcatattctgtgtttagagactagattcaagatgtgcttttaaaataaaagttagcctgccaggctcctctgttcatcggatttcccaggcaagaatactggagtgggttgccatttcccttctccaggcgatcttctgaacccaggggtcgaacccaagtcttctgcatcaggcaggcattggcagctggattcctcactgctgagccacgagagaagccctcagttttggctagtaaccatataccttacattcgttacttattgttaaatattctgtgactcttttagttgtgggatccagcaaaaaatgaaaaattacaagaattttttctgcaagaggtacgaatgggagaactttggttatccagaggtaagaatgtaaacatacttttgtaagcagttatttatgataactgatgtttgagaaatatttatggattggtatttttatgtcaaaaaacttccccctagctagatgtgtttcagttagagaaactatcccagcattttcacttcattgctgtccagctccactctgttagagtttgtatttaagttcatgttgcagtcttgggaagtaggcagaaagaagcaaagccaaatacaagaacaccttatttactgtcagataaaattctaagtaagtgagttttccaaatgattaaatgttgtatgaatcaaaatgtaaaaaaaaaaaaaaaattaacttctttataaaaattttcctgcctaagcatattcttaataaaatacttacttactttgatgataaaattattgagtgatcattcagtataatgatacctgtgggggtaccctgcacttgacttgagaaacttcacaatgttgtcagggaaaatgatggtagataatattttataaacattgtagatagtaatatctttattgtggtgtttaacactagaaagaaaaa

SEQ ID NO: 62672 - DNA, 783 bp, Bovine  19866880414051
tctgatggtttgggggttttggttttgaagtctgctgttttaggtgcagagtgatttgcaagcaaaagtcagttctgtcacagaactacttaataagttacaggagactgaaacgcaatcacacctgtaacacagcagcagacacccagggtgaaacctgatgaccaggaagagaaaacgtgctcggcaactggaaatcccagcacagcagaggcccaggtacctcacggctcccgtccctacttcccgatctctcatcccgtggatgagctgatactcactggccacggcaaacagctcatttcagtttaccacttagctccgagaccatgacatggccttcctctaggtgcagactccgcaggttccagctcaaacgtcgctactacggtgagaccaccccctgtggctggcttctcctccttttgtgaattttttcatactatgttttaaattgagagatgatccacaccccataaaatgcacctttttaaacaagcaaacaatgtagtagtttttggtaaacgcacaaatttgtgcaaacaccagcaccatctaattctacattttcatcacccaaagggagagctggttttcaccggtcagtcctcagagggacccaggtcccaaatcactcagatccccaagcctgaaaggcccacagaagctggagcctcggtgtcaggtccatccagccaagtgcagaccgtcagaggcctggagctcctcttctttccagcttactactgctcacccctcagccatcacagagagccatgcttg

SEQ ID NO: 62673 - DNA, 1819 bp, Bovine  19866880455138
atctccaaattgtgaaacaactgccaattagagggatgtgtaaataatttcatactttaagaacagaggggaaggcatcaatataaattatccttggatactaatatttcttttaatcctatctaattgtatcgtcttaatgagaaaatataattattgatattctatttaaaaatggcacccagacttcatttttcctttttaaataacattttcaaaacaaatatattctatgattctatccagagagtaatactcaaattaaatcaaacacacacacacaaaattgatcttcataaaaaatatttttacagagaagataattttatatttaactttgtattatctttttaaaaaatatttgcttagagctacatttaaaatatctatggggagatacttgccctatagcaaaataactcaaaattttcatctatcatcatgaaaaggtaataactaacgcatgtaattaaactttaagataactaatttccttacagatctatttattaccttttcctcagaataatctgagggaggagaaagcatcattccaatgcatggtgtgtgcctgctaagttgcttcagttgcgttcaactctttgcgaccccatggactatagcccaccaggctcctctgtccacaggattctccaggcaaaaatgttgaaatgggttgccatgccttcctccagaggatcttcctaacccagggaatcaaacctgcatctcctgcattggcaggcaggttctttaccagtgagccaccaggaaagctctactttgagcaatttccagtttggtttcccaaccatttctacaccagcaaaggaaataccaggtgatgctctgcggggaccgctctgggttattcaggtgaacaagacttttgctttagaatttagacagtaggcccaagttgtttcatttcctttgctcctatgaactaggtccctctgagaccagaactcacaacaagaaccccctctgagttctgggcctgtgtttgcctccaaggcccacaaagccactttaattaagatccctcggtggcctggggacccctgtggaaaagcccggaatgccattattgccccctgagcggctgaaagctctgactgtcgccactgccgctggaggcttaggtggcctcgccccacggggagccgtttcctctaatcccgctgcacctccgtggagagcccaccgtgtgaagagtagcacatctacttcaaacagaaatcgggcctcgtctgtttgagctgaggggaaggctgggggtggtgaggagctgcagattcaaagtgaagtcagctgggatgacaggcagtagctccagcccccagagactgaagcggcgacaggaggcctaggggcttccatctctctctgcaccctggggggctctccctccgggggctgggactctttgaagtcagggaggatggttttgacaacagatgggataattcacttctgttcagtttggtccatgcagaccaaataaatccaaacagagtgggggaagttttgcctcatgacaaagaaatgctgccattttgttacacccaatgcttccccgctcccaggccacatagaggaatttggttgaccctctgtagcctttaatagatggtgtttgcacagaagaaagcatctgattctaccatagcacttaactgttgtggtgagaaggatgttcaccgagggacaggacggccagatttgaactccagctgcaccacactccatggcatggtaatgctcagcggacactttggtgttgccaacttggacctctcaacctcctttctctcat

SEQ ID NO: 62674 - DNA, 2099 bp, Bovine  19866880456103
tgctgaaaaagagctaaacgataaccttttcttccaggaataaggatgcctctggttgtgcacgagtcagtgagagtaggagctgtctcatagccttgcagacaagacctgcattgtccaaggttgctgtttccgctgccattccctggttcccctctgccctcaaaagatttgtaaagtggtcagggccatgatgttgcccagttttgctaccaactttcttttctcttgatcttttgtttcaatgtctgctttctttcgtctatgtgctcactgaagcctaattgtgggggtcaagctataattagtttatatatgaagtttaattcactgtggctcttctggcattagactcaaatgggctttgatgtctggctggagctttgatccctgtccctcgaatggtggtcatcaccccaactcaaaagactgccttttatttttttccctcctattaggagacagcttttcccaattacatcatttgtgtttgtttggccataaaagctggaaggcatcattttgttgcattgctctatagctaaacgtgcaattgatgctccttactttgctgggctgcaaaaaaatgttcactgctggataaggcatttgtacaatgatgctcagactttgtggggggtgctgttgggagtcgttctgcccaagggcaaagcgtcagactgtgtcatctgagggacctttcctggctttgcccaggaaatgtctttaagtgtaagccacatgactgtgatatattcagtcaagattctttttcatgctggcaactttatcttactctctagatcctccgggtggcagatccaccccgtctttaatgtcacacattctgagtgtcgattagcagcctttctgagaagacagaagcctccagggaaagcaaaagaactaaagagagctgagcaatactagaaaagagataacaaagtagcattggtggaggaagaagcaccagtacttgctttaaaaagaaaaggaaagaaaaatcaaaacagtagggcaaagtgagatcctgtagctgacaggaaggagcagcaaacagtgggtgattaccttcaactgcttcccaaatacctgcaaccaaaacaaagactcaaagaggaaagaaagcctaagaaagaaagactaaattggagaggagaaataggctgttgggttaaaaagagaataggggcaacccaaccaggcacacttaatctgacaacattagttttcctggaaaaacaattacagcgttgagctccttggttctaacttcacttgacagcctgagtttgttttaattggtgcatgaatgaacagcattatttattaatgtgtaatggatactttggaaagcataacctcttttcctatttgtgaccattttattggtggagccgtttgaatagattagttttaatatttaaacttgctgggaacactttttcatggacatgtacaagctgttatggcaaatggtttgctttgggctaatgagtcagctcgaagctgcatttggtgaggagggggctggggaggtttagagggtttggagacacagtgacttgtctgtctactttaacaagatttattagtagtgtgtaaaaacatgtttcggcttttttcccccctctcgactatataaatatagttgtcaatgtgtgacataacacaggccccaataatagactccacccagccagaaggaatctaattcagaactagaaagcaagaaacttgcctataaatgaaaggcacaagacaatgacagaggacaaaggggtgtggcatttggcaaagaggaccagtcattattctttagtgctttactaaaataggaaggaaaatttggttcctttattatcaagtactgtgtttggcacacagtaggcataaagcttagatgagctgaagagaattaattttgtatgctgatgagcacccaagcataattccatttttacatttttagatttaatatacaatctagttaatggtgaatcatggttgtagttatagttccaattatgactgtgagggcagcaatggggaggtcaatggagagtggctagagaattcttatttttgctttttggtaa

SEQ ID NO: 62675 - DNA, 1457 bp, Bovine  19866880489925
ctttgaatgaatcagttctacagtcctagttcctcgtcctttcctctgtgtcccacccatttccttcaccaccagtttcctgagagaagcaccttcgttccttgcctgaagtgctcactacaactgaagtgcttgtagtcactgtttgcagtcccattgctctcctaaaactatttccctctgtggtcacctggagccatgtaattaccttctctctgactactctatctcatgcctggtccttctcaattcttcttaataccgttgcctacctgcttcatctggaaaagctccctctgactttgaaaatgcaatagtgcctcattctgttccagcctttctgatcttcctctgactgccttgaagattctttctcctcttctcaccgctaaatgtgaatggcctcagacttgtcattgctccattcccatttcccctggcattccctcctttgatgatctcctctcctgctgttgcttcaattatcatattttggatagatgacttcttggctctagactcacatttccatctggcagctgagcatttccacctactattttctaagtaacaattctatctcaaactaatagtctttccccagatttttctattgctattaaggatatcactattttcccattcatctagagttaatttttgtcatctcacaattcttagtccttaagatctaagagatggccaaatactatagattctcaatgagagattctcacattctcttcccttcttcttattcctactactaccatcagagctcaaattcttggtggacactaaatcttctgcctcttttccgttctcactgtcgctatttcagtaatctcccagtgtcttctttcatgtccccccacttcccatccctacaaagtctttttgccagataaatcttccaaagatagagctctggtcatgtcacttcctaaaacttccagttcctaactgctcaaatactgaagtccattcattatctatatcttgttatacaaccaccaaaccaaattgctctctgttccatgactatccaccatgcttatcctcttcgaagtgcctactcacggcttctctgtctgaaatgtcctccccaacatcaaacttagttccttggttttccacactaatcagaagcaatctgttttctccaggctttgagtctccagaaccactagctaaatatctttaataatttgttcctcaagttacttataatattctgtacaataacatgtaataaaacatgcgtacccacctgagaatctaggaacaaagataagaatacatccaagtagctatggtcaaagaggtcccatgataaccaaaacatctcagttcttttctccattgggtgatcacagagtcagaaacccatgaatgtatgtacagagggacagaagggagtcacacgaacttttattgacaacagtagtaaaatatta

SEQ ID NO: 62676 - DNA, 2172 bp, Bovine  19866880525489
tttattgtaaaaatgttacgaatttcagacaagagtcttcatatgaaagtcagtatacaactttggacacccactgaatccactcagtcttccatgagtatcagggaggacctcgggcagggcccctggggtccacgggaccagctccaacctagtgcagtcctaaccagcctttggtgaggagtatacggaccagagggctccttttttaaagctcttattaaatcttttcacccagaggattcacaaaaaagcaaccattagatatctaaaagcttccatcaggagctgttaggaggaaatggaatttaacaagcctccttcagactaaacatggatacttgcaagcttggtctttaatcgtcagttccactactgggagagatgacatctggctgtcaccctagctctttatgctagtgaattacatcatcttgggcaaaaccattcacttctccaggcctcagttacctcatctgcacctagaagatctcagaggtctgagcattaagggtctatggttctaatctgagaattaagactgggcaggtgtagataagcaacaaacacctcccacccatcattcattctaggggtgctgatgggtctctactcagcccatctctgaacacatatcctgtgccccttataagtttctgtagctcaaaggcccatcaccagacactcattaaatgccacattataatgaaaacgacacctggaaccataatcacaccttggtggtgtttagtcggtaaatcatgtccaacttttgtgaccccccaaggactgtagcctgccaggctcctctgtccttgggatttcccaggcaagaatcctggagtgggttgtccatttccttctccatcttccaaacccatggatggaacccagttctcctgcatgcaggcagattctttacctactgagccaccagggactcacccctaagcctcagcaatatacattatctcttaattcccacactattcccatactacttgtaacatagataagcaaactaaattaaagcaatttacttaagatagttcaattcagttgctcagtcgtgtccaactctttgtgaccccaaggactaaagcatgccaggcttccctgtccatcaccaagtcctagagtttactcaaactcatgtccattgtgttggtaatgccatccaaccatctcatcctctgtcatccccttcacctcccgccttcaatctttcctagcatcagggtcttttccagtaagtcggttctttgcatcagctagccaaagtattggagtttcagcttcagcatcagtccttccagtgcatattcagggttcatttcctttagggttgactggtttgatattgcagtccaaggggttctcaacagtcttctccagcagcacagttcaaaagcatcaattttttggtgctcagccttctttatggacaaatcctcacatccctacatgactactggtaaaaacataggtttaactgcacagacctttgttggcaaagtgatatctctgctttttaatattctgtcttggtttttcatagatttcctgccaaagagcaactcttttaatttcatggctgcagtcaccatgtgcagagatattggagcccaagaaaataaaacctatcactacttccacttttttcccaatctatttgccatgaaatgatgagaccagatgcgatgatcttagtttttgaatgttgagtttcaagccagctttttcactctcttctttctctttatcaagcagctctttagttctcttcactttctaccattagaatggtatcaccttcatatctgaggttgttgatatttctctcggcagtcttgattccaccttgtgatttatccagcccagaattttgcatgatgtactcagcacagaagttaaataagcagagtgacagtatacagccttgacatactactttcccattctggaaccaggccattgttccatgtctggttctaactgttgattgacctgcatacaggtttctcaggagacagggtttgagttccagttcattttcattaatatttgagtgaaattttttgagcctcaaatttcccatatgttaaaccaagataagaattactagtgaaaaaaatcgctaggaaagtattagaattatataaagccataaaa

SEQ ID NO: 62677 - DNA, 752 bp, Bovine  19866880535415
agaaagcttttgcctagagtctcaggtcaaagtcacctgctgtataaagagtattagggaagaggctaaaggaaagtaagaagtttcaaggggaaattgcaattttaaaatagcttaagtgtaaatccaatgctactgattttctccgcttactgtggagcagccctagagtggaaaaggatcaacgcatatagcaattaacaaggtcgtttttgcatttgtcttgtaagtttattccaataaccccgtgacataactggagtggatattattaaccctgttttatcaacaaggaaatcaaggctcagtagttaaatcaagatgatacatcaatcaaatcaagataagaactcagttctattcactttgttcactctaagcgctttggaagaaatggctcttttatacaaattatctgcagccaagcaattttttaaaaagctcttaagaaaagctgccaatgtgtgcactgtcaacagaagcatgcctaataatcttattagtggaacaagattcttcattaaatttgttacacggttagatggggggttggtagcaggtggtagatactgaaaggagctcctgatagctaaaagctgttggcaagagcatttagaatatacaatgatggatgacatagtattcaatttagggaaggtggttgagtctaatagggtgacccaagggtcaacctcaggacttagtgctatttaacaggtcataggatttttgcagcaggcataacaacagct

SEQ ID NO: 62678 - DNA, 616 bp, Bovine  19866880597809
atttcatttcattcctcataacaggccggctagagatggtaatataaggataaaaatctccctttcttcctgtttacacataaagaaaaactgaggcacagagagattagggaagttccataaaaaaagaaagaagaaaagcaatttggcttaagctgtagggttgggacaaaaaccccacgggactaatcttttaaatccagcctcctaactttggtgagctgtctctcttttaagccagcactactttctctgctttttgaacactgaaatgttcattagaagaaatctcactctttctcgatctcccttccttctctcattaccttgactatttctcaaacatttctcatttgttcatttatttgtttttttgcttcaatttgcatcctttccccctttcttcatgtctttcattagccattaccacagctgggagcatttatttgttttttagaaagactttggcattcttccttcctttgcgttttctttgtatcatttttaaaacatgtcccaccattctcttatcctttccaaagccagaagatctttcatcagcttgaccattcctcttacatatttatttcttcttgtttgaagaaaatttgatctc

SEQ ID NO: 62679 - DNA, 1666 bp, Bovine  19866880614008
acatccagtgtagatacagcatcctcactgtcatttgaagtgcttctagttctttcctttgcagagttatgtgccgtgtgtctttcctcaacacacttggaggtacagctgcagcctccatctcagaggaaacacaaactccttcagagtgttgtgaagcaaagtgaatatgttgaggacccagacatctgggtccacattggggcttcattgctttcctgcttggtgtgctttggtaagtcaagctctataaactccagtttctgcattgtaaaatgtgcgcaacaatatagatttcacaggctcattgtattaaatgagagaacatacatccaatatacttagacagctacaaagaaagtccttgaagattatttttcccctagtgaatgcatctagaaaatcctaaaagtgttagtctctgagtcatgtccgactctttgtgaccccatggattgttcttctgtccatggaattctccaggcaagaatactggagtggattgccattcccttctccaggggatctttccaacctaggaactgaacccaagtctcctgcattgcaagcagagtctttaccatctgagccacagaggattgctgcatgctatgccaccctcaactggggcatatccaaggagatacctctgcatggaaaagcctgaaaatcattcattcatgcctcagctccttctttcagcatatattatgtatcaagcatttggaatataaaaacaaataagacacagtctactcctgagacagtcttcatgggcctctcacaatattaaaccaaacagcaaagatttcttttatggtctcaaatttctgccctgccacctgaaatcagctccttgctttcatttcaagtccattgatcagcacactgcactgacaagcagactatttaaaaaaaaaaagactttatttctttattaattttaattcatattgtttatcactgcttatcatcttcaaagagaatgattgcttatggaaatttaaatctgtacattccaggaaaaaagatagaaacatactcttctctaatacttagtgataccacctgtggtatttatagttggtattgcattgattaatatggcctggtccctagtatgacccaatgttaacttgagtgaagcacagttctttctcagagggtagtagtacagcatttactattctactgtcctgtaaactaagatttgaattaaaaaaaaactaagagtagtatcatttgtagccttggggtgaaataggcacttcccagcatgattgttgcaggagagtggaactggactgaaaagcataggctttggcatcagacacatagagtgaacgctcccacctgggccactcgtgctagtgaacaactcaacgctgtcggtgactttgggcaggtctttcgatctcttctggcttctgtttcctcctgtgtaaactgagcatcccaacagtacagagccctctgacctttggtgaggattaagtgggatattgcatgtaaaaggcctggcccatgggagcagccgttgcgaagtggttgtcctcattgagtcaggtgtggggacccaggaggatggaatttggggatgaatggctttgcctttggagattaacattcccattatcatcacatatatcaaccggccagtctttga

SEQ ID NO: 62680 - DNA, 1234 bp, Bovine  19866880672823
tcccttgaatagttgacatgtccttggtgggaagtctcctcactgttgtttttcctggtgcacatacatgcatgtctcttttgctgtctttgcccagggcctcctctgttggtgtgctgtagcaccggtctttaatctcccagtcctatgaagccctggtgttaccctggagtattggttcctgtttgaaccaagcctggtagctaccttctgcagacctaattctttcatctgcaaattgtcataggaaacaaccgttaaacctgagatctaggtcagctcttatcagctgcccagggttctgggtatagatttgggctggtggaggtaggtgcccactgtgcatgtggaagccagattttggcaaagctcggggagtaatgaaaagtaacattcgtttcacagttctagacttgaacagtctattatgggttgggtttacagttaacatagtataattttttgattattacacataaaatttatttgtatttttcctcgtctcttcataggcactggtttgctctgtctttttgaggaaaattaaggtgattccctgcccctgtcccccatcaaaatttatccctggaagcctgatgaaccagttaggagaatctggagtttctctgtaagtttttttttttaatgtatttttattggaataaagttgaattacaattttgtgttaattattgctgtacagcaaaatgactcagttatgcatatattttatacattcttcttcatattattttccattatgatttatcataggatattgaatatggctctttgtgttatacagtaagactgtgtttatccattctgtagatatcagtttccatctgctaatcccaaactctaaatccaaccctctccaaatcccctccccgttggcaaccaccggtttattctctgtgtccctgttaggttcttttgtgtcatgttttagattctacatataaattataacacacggtatttgtctttctctttctgacttactccacttaatataataatctctagttgcatccatgttgctgcaagtggcattgtgtgcacgcatccatactaagtctcttcagtttgtctgactctttgcaatcctacggaccgtagcccaccagactcctctgtccatggaattctccaggcaagggtagtggagtgggttgttgtgccctcctccaggggatcttcctgacccagggattgaacctgcgtctcttat

SEQ ID NO: 62681 - DNA, 763 bp, Bovine  19866880698992
cctatattcctgatacttgaaaaagacagatctatcagtggttcccaaatgccagttcacaaatcgtgcgaatcaggttattaaaaattccttggggaacttgtcagaaatacagacccttgggctgtgtcctgaagcttctgagctgggcgcgtggatctgtatttttgctgcattgctcaggtgattctgcgaagcaacaggttttggcctctttggaaccaatgacctctcaatgttcttcatggtcctaggatcttaggattcagtgtcttcatcttcaaaattaagataatagtacttgtccctttcttactgcacaaaagagtggggagaattaatgaggcaattttcataagtattcttggaagaaaagtacaatttaagtgtaatgtattgaggccagaattgaactagatcgtctcagcaatgcaaattgttagttcagaacaaagaggagactcaggtccatagagagcattggcaggctgagttttgctaccaggattccagttcccaaaagtgttgatccacctttggcctgaactcaaggcccgtggaacccagtaccttactgtgagatttacaaatcagggacttggtggtgacagaggcaggcaggctggacagggaggtttcatttccttgagctgcattaacagagaaccatacattgggtgacttaagagaaatatacaccctcacagttctggggggctgtaggagaaatcatagtgttggcagggtgaactcctcattaagg

SEQ ID NO: 62682 - DNA, 2451 bp, Bovine  19866880709468
ttttactttcatgcactggagaaggaaatggcaacccactccagtgttcttgcctggagaatcccggggacggggaaacctggtgggctgccgtctatggggtcacacggagtcggacacgactgaagcgacttagcagcagcagcagcagcagagggtgataaacccagaataacttctcagtcccagtcctcttccctaaattcaagacacaaaatctaagaccctcctggacatctcacaggctcctcatattcaacatgcccaaaactagctcatcatctccctaaaatgccaagttcatattgctccctttattcccttttttcgtcagaggcatcactctccacctgttcacccaatctaaaaacctagaaatcatcctcaactctccctctatttttcctcaatcccccaaatccattagtacctatgacaaaagctctcaggttgactcttttccattcatcccacttgctctgccttacttcatgttctttatgtctcacatagacatttcatggatctcagaagtggcctttttctctctccccaatctcatgctcctcccctcctcctccaccacactatcaccagaacagttttcataaaggacaagtgaaaacctcttggcagtcaaagctcttcatgatgcatccttgcttacctttccaaccttgtctgctattatatctcctagaacttctttttacccacttaacaacattctttgccagcccatctgtatatgttctttcatccctccaatgcctttgcgtatgttctttctttggtttcttttccttgcaagctatctcctatttatatatccttcaggtgacagctctaaactctccaagcgactctagatggcctccttctacacttctactctgccctcctataacccatttttatcaccatcctgcgctgaaacctttacgaatgggctctgctctaatcaagaaaaagcattgccttgtttttttctgtgtttctaacaccttacaaaggaacatagtaggggttctgctttttggacaaattaattaaccacatcaaaaggacagctcacaaaaaaactataagggaagagaagatgacattaaagatccttacacatgttccttagttttggagattatggaaagatttctccttagactgcaaatctttaaaggttttaccaacttcaatttgagcttttaaaaaagcaagagagcttttaaactactcaatcctgtgataaacagacaatgtgattcttccccactccatactcattataatgcacatgcacttaccctttctcactgctaatctgaaagggttttcatgggaggagagaaggacaatctttaaggaatcatatgtaataagattctaaattgaaagtttcaaccaaggcaccaagatacactagtatgatattccagagcaaaatctgagatcaacatccaaattttcaatgaaatactctaaacactggttatatgactgttaaatcaaacctctgctgcactgaaggtatccttgggccttttaaagatcaagagagcttcagggaggagatttctttggagcagaggtcacttcccctcaggtcaacagagtgaggcctcaaacaatcacccagagctaaacagtatctctccagaaaaagttaagaagagacagaggagcatccctgctgaccacaagagagtatcaaggttggggtcagcctgcctccagagagtctctcgccaaaactccaggccatgcccaagaaagagtaagcttggggttgtctggacaccaagtgataaaaagagattatatttgatgatgaaacgcaaccacaagaatgagcagaaacatattgggatggctaaaagctcacccagaagtgaaggaagaacttcccccagggaggaaattctaaaaggaggggatcacaaaaatagatttgctttctgactccagtgcattcatgacactttgggcagctgactggttacgcacaattctgtcccaattggaagtcctcccagagccaacagctgtcctccagctgggaaggaacgatggaactcttcccaaaaattaaggtaaccgtgctcttcaggcagatggagactggaacccggctactgaagagcataaatataaacatatcggagaaagaagtgagaactaaaatgaaacatccataaaaagaaaatccattttgctccatcatcaatgccaatgaaagaaagttgtcgcctaagaaaagtaagatgaggggagggaggaaggagagaaacacacatgactcttacccaggccctgattctgctgttcccactggatggcatctggcacctggaaggtgaccccctccaaagagaccacgttttcctgctctaagccaggttcctgagacgtgatgccagggagcgtaacccaggcagctcgggtcacccaagg

SEQ ID NO: 62683 - DNA, 3023 bp, Bovine  19866880714454
ctcaacagctgctgtgagtacatggcagtgataataagatcctttcttccactccagcacacacacaaactataaatcagggaaacttacattctaatcagtaaatccacatacaatgaatgtcgttagtcttttactagtaaagcaagaaattgtatgtgtacattaaaagagtttggcaatacccaaaacaccaatcaaggtaacaagaaacgaagctcaggaagacaattttggggttgccagacttagtaaattaaaatagagaatctctattttatatttggaacatacttatgctaaaatgatttgtttatccaaaattcaaatttaactgtattttatctgatcatctttgctgtattaggtcatcacctggttctgattgataaaaaaaccctctgtatcagagaggatctggtcacatgaagaactggataaccaaccccaagagccagaagtggacaatatccatgtaaataccacccagaagtgagtctttgcaatagaatctgagcattgtggtgtccttggtaagattatcagtaaattgagtagaaatgctccacagtacagcacctaattttctttaccaagtaccaagtactttatctgacagcttgatccctcatgtatgttgtccataaggcactgctgaaatgagtgtatgtgagctggagtgtgtgtgtctgtaaccaaggtaacatcatcaagggaagtaccacttaagggttcgcattaagggctcttgaaaaccagctgcaagacttcctcagattctgcacctctgtttgatgaggatgttttttgtttgtttatttttgttttgttttcatttgaaattacaccagcgacaaccatgtgaggcaacagaacaaaatgaaatgaaagaggcacattaaaaaaaaaattcttcttagaagtctgtgtttccctggaatctcctcaaaacatttccctcaactttctgcaagttcttatttttcagtgattttcccttcctttatttttgacccctttaaaactccttccttggattttgttgttcttataagtctcccaaggcagccaacaaagagatccagccacagaagaaggacaggagctgctagagtcacagtcatttgcatattggatattttccttctcactgtaaaagcctgtcttttcttcctggtcttcctaagtgtttattaacacgagttttgcagcatcttgcagtgttcttctccccaggtcctccctgactcaaattctctgtcaagggctttctgtttgcttttaatttcttaagttgaaattcctaggaatagacttccatatgctaagtataatcaactcactctgggtattcaatatttgatggttgtggtgatgatgtagtaaataaggataatgacattagaataacgttaatatgacgttagaataacgttagaatgacgttataataacattagaatgacgtcagaacaagctgttgaaattctgatacatgttttcattgcattcaaaaccttcaaacacttgacaggatctatttcagtactaatgagcttagatttctaccttgtactaaattatgtgtttaatatgaagtttattgggaggacaagtcagtagaataaatccaataaaatgattttctttaagcaaagttttggagtggcaatttttttttaagtatagttgatttacaatgttgtgttagttctggtatacagcaaagtgattctgttttacacatatatatattcatattcttttccatcattgtttactgaaagatattcaatgtgttatacagtaagactttgttgtctatctactttatatatagtagttagtatctgctaatctcaaattcctaatttatccctctcccaccccctttcccctttggtaaccataagtttgttttctatgtctaggagtctgtttctataacagcaaatttttgtacactgtagttgcttttaactgtcaacacaaagtccgtaatatttacctacctttattgtttgactcttattatgcaaacacacagatgaatcctcttgtttctctgctttgccctaagagacctattataattgttgaagcagagtatcatatgctttatagtcccttctttttaaaatctgttattttctatattcccttattaagtgttagatttctttaggccttgaactttctgattctgttctaacaaatggaattttgactgttgccttgaaaaagcaagataagagatgaaagagctactgatgtaggtacaaaagcaaaatgttcaccagtacagctctttaaaaagaaactttttagataaagtcatgggtgaaaacatttataagaaataaatcttccttttttcagccataaataatgtccttgtgagactgtcagtaaaaaaaataaaaaataagagatttgaacatcaaagatctaatgtcttctgtggaatataccctttaatcctaagtgagttggtccttatgaataactctattcaaaaatgacatctataactctagaaaagataagaattgccttttataaggtcgaagagtttaactccatcttttcttttttttacgtacctaacgatagctaaatcaatgactttaatagattcattatattaaataatgagcatgagatatttattattgacataggtgtgcatgtatgtgtgctgtgtacttagtcgctcaatcgtgtcctactctttgccaccccatggactgtagcccaccaggctgctctgtccatggagattctgcaggcaagaatactggactgggttgccatgccctcctccaggggatcttcccaacccagaattgaacccaagtctgccacactgcaggcagattctttactgtctgagccactagggaagccgtataggtgtacacacctactgcctatgttgcaaagaaaaatgtactcctttatgcctctagcaaggacagaatttttaaagacggctttaccgggaaggcaaaactcaggcccaa

SEQ ID NO: 62684 - DNA, 1088 bp, Bovine  19866880717350
atgctcttgatggactcgatgaatgacactaggccctttgccaaacactttgtcctacattagacagtgaggtcactgtagaaaggggggcaagatttcaggagtgccatggcaaggatgctcaatctcatcacagggagagctcgaattttaaagtcaacatttacagccagtcttttacattaagtacgccttcccaaggactggggaagggagattcaaaatgtctcttcagctgctgcctgcagaaagggttccaaatggtctgttggaaatgactcaactaatgtttagaacactaatcatctctaaagtaccctgtaaaaaacaattcacaccacatcactcaccaaaaatatgctactgaaaaccctttgaagcaataactctctctgcattatgcatttattgggaattaacgaccaactggaatctatggactttgaccagaaccagagctattaatgcacaggaaaaatctgacactctcttgatctttccaaagctagcatccttcgatgtgtgcagaatataaaatcctggatgctgcattatacgtgagttctctggttatttatgaacagactggagaactctcttgtgaccacagctccagatttcaagcaattgaaaacctaagtaacaggatctgtcaggaggatatttacagtctaaaccgtgttgtccacatagagaagacaaagtgagactctgaccaactgaaacataaaactgccctacggtctacagagaggaaagatgccttctatgtcttcatagtaagtccactggattacagttcattttaatcaatagtgaattcatttttgaatcttacctaatataatcacaatttcacctttccttccacttttcctgagctgtatcgtattcactctttcattcgtctgcctacactgaaaaggctgaataattcatctccagagtctcctaaacaggatagtaaaagcagcatgaatgagtcagcttttgcagttacttcctcataactctttgtcactaatagggaatagcttgttcttggctttgtacccccactgcacaaatttgctgttgaactcgtggaa

SEQ ID NO: 62685 - DNA, 1352 bp, Bovine  19866880751860
tctaaggaggcattttcctaagtctataaattctaggagctcctttttttagctccccaaaatgactattttagtcaaatcttgggtccccagctgatctgggggcaaactgcttaggcaataagtatttaagttacctttttgaaaagcaatgatgagaaagttggaaggatttataaaatgggtcaaagccttaactataaatgctcttggagagagcagaatcaagatggtctttaaagccaaggcattattctctgccagatgggaaaaggcacagtattatggtcatgaagggctcttgtggatctacatggttctgttaacttcatctaaagccagactccttggtttgccaaaagtagctactatagaccaaaacgctaaagagcacttggggatactataaatttgcttgacatgcgtcatttccaaacatttcctagtccttgtgggggtggggggtgggtgggcattcttggttctccaacaagtgagaatgggaggacatattcttggagagctgcatctattacggcacgtcgatttccataatcaaaaggcagcctttactattttatattattagacaataaatcgctcttaatgctttgcagatctttatctctggatacatttggaacatagttgcatacctactcatgacgtgaaggaattcatgatatgaggcctcttatttagctttcagaagtctcaaatcagatctgaaacttaagaaggaaaccaatcaatcggtgattataatgtgaaagtgagtgttagttgctcagtcgtgtctgacactttgccacaccccatggactgcagcttgccaggctcatctatttatggaattctccaggcaataatataggagtgggtagccattcccttctccaggggatcttcctgacccaggaatcaaacctgggtctcctgcattgcaagcatattttttgcagtgattatttaatatttagttcagttcagttgctcagtcgtgtccaactctttgcgaccccatgaatcacagcacgccaggcctccctgccatcaccaactcccggagttcacccagactcacgtccatcgagtcagtgatgccatccagccatctcatcctctgtcgtccccttctcctcctgcccccaatccctcccagcatcagagtcttttccaatgagtcaactctttgcatgaggtggccaaagtactggagtttcagctttagcatcattccttccaaagaaatcccagggctgatctccttcagaatggactggttggatgtaattgctgaatcaacgcagagtttacgtatcctaggagcccaattccattagcagtgcttt

SEQ ID NO: 62686 - DNA, 2196 bp, Bovine  19866880784147
ttgtttgggaatgagcctaatgatttgtcattgatggacaacagaagcagatttcagagaaccaagaaaaaagacaatgacaagctgtgtttggcaaactacccttgttactcagccagcaggtaaaagtgttacagggcaagtgttccagctcttggatttgaagtcacatagccaaaataaagttatcaactcttacagcttaaggagactctaaagatctagtccctggctatcaggtcaggatctacctgcagatatcaaacccttcgctagaagaccaacaagccagttgcagcttccaagtatctttccatagttactgacatttccactgagatgagaaatactgcagttaccacttccatccaagcatgtatacacatacattcactcatttatctcagtcagtcaacaaccactttttgggacctccctggtggtccaatggttgggagttcaccttccaatgcagggggtatgggttcgacccctggtcagggagttaagatcccacataccttgtggccaaaaaaccaaaacacagaacagagacaatattgtaacaaattcaatagagactttaaaaatggttcacatcaaaaaataaatagaaatggttcacataaaaaaataaataaaaacaaaatcgagcatttaaaaaaaaactttaaaacaaaaaccaccacttattgagctgctaaaatgtgctgtatactatggaaggtcttaggaatacaaagatgactaaggcaggattcctcaccttcaggtagctcacaatcctgtaaggcagacagacattaacaaatacaataaaaccccatcagcaaaaagccatgcaagtataggaagtaaccaacctatgagaactctcccaaataagatgacatctgcctcagctgctgcagaatgagttaagcatatcacagatctatgagggagaagggagaaaaggaattccagacagagaggcctggatatgcaaactcttagacacatggcaggacacgacatgatcaggttaagaagcactcagtgcggcggggaggagaagcccacctggcagaaggaaacacaacagacggtaagctcacaggaggtctgaggctcacatgtgcagagccttaaaggccagaacaaagagacttggacattctcataggcaaatgaaggagtcaacacaaggttttaatttcagagggactaggctgtcttattcaaattgactgtttctcagaagttggcctaacaccttctctcacaatatatatatttgttcagtggggttgctgctgctcccaacagacataatcagtcttgtgttttagaaggatttcactgaagacagcatagaagtggactggaagtggaagagactgcaaaggaggaaactggtaaacacgctccttcaatagtctgggcaagagaggatgctagcctaacaaaggtgggatggcaaaaaaggatatgttcgatagccacttaggagaaaattaatggggctttgctatcaactggatgtggaaactgagggaaacaaagaggaatcagagataacatctcgatttctaacttagacaatgaatgtttccaaatggcttggtacctcttatcagctcaaacagcagtgagtagtcaataggatcaagatcacaggtggatgggttagacttggacttttgagtcaaaaaggaaggtggacccagtacactggaagtgtggacacagaaaaatcataggggcttctacatagtgacctcagttcattcaaagcccctttcagttcagttcagttcagttgctcagtcatgtccgactctttgtgaccccacgaatcgcagcatgccaggcctccctgtccatcaccaactcccagagttcactcagactcacgtccatcgagtcagtgatgccatccagccatctcatcctctgttgtccccttctcctccttcccccaatccctcccagcatctgagtcttttccaatgagtcaactcttcgcatgaggtggccaaagtactggagtttcagctttagtatcattccttccaaagaaatcccagggctgatctccttcagaatggactgcggtccaagggactctcaagagtcttctccaacaccacagttcaaaagcatcaattcttcggcactcagccttcttcacagtccaactctcacatccataca

SEQ ID NO: 62687 - DNA, 1095 bp, Bovine  19866880795802
ggaaactaatttcaatcaaaactaaatttaaataataatcaccttatgtttttaatagttatactaaaaaataaagcacaatattttatgaaggaacttttgataaggctttaaaagattgaggagtagtactaatgaataaaatttccacatctcaaaaacatagatgccaaaatacaatgaaattaagctttcttgcttaattagattattctgctctcttatcctggtatatattataaatatcaagtcctctgtgtgacttttagttacagaagatcaaagtttttgtccctatttaatctgctttccattataattatatttattcactcaaatattgaaaacctactatgtgctagattatacgttaattgtttaaagaaaaaccctgtgaatttctatgattattagcagtctgggtggcagggccagtctagacccagaaatgatactcatttgtaaacaaaagtttattataaaataaatgtgtcatgtccccatttccacttccactcccaataaacagttcgttgtaagaaggggaaatctctctaggtaatatctgtgctcattcttcctcactaccccaaggcctatccttatcttactcaaagccacatttacctacatgacacctctcgtccctgttccctcttttctagagttaaggaacaagacagtcatcccagcccccaaaggccaacccaactgtctcaattatgagaagatgtgacatttgggatagaggagtctgtccttaaggaaaacctataccaaagtacctttaatgggtttataaaatttccctctgaaaccaaatctgcagaatgaaaggcagcaattaccaatgaacttgagacccagacactctagataacacagatctgtgcttccccaaatgattgctgctaacaacacacactacagagacaccagctgattagcagcctcagttgtttggtgttatgtttgcactgcctagacctcagaaattcagccttatacctaagtggacaatacataaaaccaagggtatagtgacttgtgccagaacctatcgcctcctttaatctctgtattttctctgctctt
